United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 13

SEQ ID NO: 539595 - RNA, 22 nt, Human
ccugggcucacagccaaggcuc

SEQ ID NO: 539596 - RNA, 22 nt, Human
ucaucaguguccuuaucacuua

SEQ ID NO: 539597 - RNA, 22 nt, Human
gaggcugaaguguacaugggug

SEQ ID NO: 539598 - RNA, 22 nt, Human
uuacaugguuguuggaaaugcu

SEQ ID NO: 539599 - RNA, 22 nt, Human
ucauccagccucaucaggagcu

SEQ ID NO: 539600 - RNA, 22 nt, Human
ggcaaaguuuucaucucauaac

SEQ ID NO: 539601 - RNA, 22 nt, Human
acuagacaucgagcuacagagu

SEQ ID NO: 539602 - RNA, 22 nt, Human
cuuacaaauacacuuaggagag

SEQ ID NO: 539603 - RNA, 22 nt, Human
ccagccuggacugggucuugug

SEQ ID NO: 539604 - RNA, 22 nt, Human
cccaguggagauaggagugugg

SEQ ID NO: 539605 - RNA, 22 nt, Human
cagagcucagagcagggcacuc

SEQ ID NO: 539606 - RNA, 22 nt, Human
aaauggauggaauugacauuua

SEQ ID NO: 539607 - RNA, 22 nt, Human
uacugugacagaguacuuaaac

SEQ ID NO: 539608 - RNA, 22 nt, Human
acugggaguucuccaugucccu

SEQ ID NO: 539609 - RNA, 22 nt, Human
aguuuauagcccagauucaugg

SEQ ID NO: 539610 - RNA, 22 nt, Human
ugucccagguccuagaugacca

SEQ ID NO: 539611 - RNA, 22 nt, Human
gccugccucaaaaucccaguuc

SEQ ID NO: 539612 - RNA, 22 nt, Human
ggcugggcaaacaagacucuuc

SEQ ID NO: 539613 - RNA, 22 nt, Human
cccuggagcuagucugagcaga

SEQ ID NO: 539614 - RNA, 22 nt, Human
aucaacaugacaggagaagaga

SEQ ID NO: 539615 - RNA, 22 nt, Human
uggguggcacuucuggggucca

SEQ ID NO: 539616 - RNA, 22 nt, Human
uauguacaccggggaagguggg

SEQ ID NO: 539617 - RNA, 22 nt, Human
acaguaaugauucugagucucu

SEQ ID NO: 539618 - RNA, 20 nt, Human
aguaggggaaugcaagagca

SEQ ID NO: 539619 - RNA, 22 nt, Human
uccagugguacauggagacacu

SEQ ID NO: 539620 - RNA, 22 nt, Human
cccagaaggucgaggcugcagu

SEQ ID NO: 539621 - RNA, 22 nt, Human
cccaggaggucgaagcugcagu

SEQ ID NO: 539622 - RNA, 22 nt, Human
ccaguuuuuccagugcuuucug

SEQ ID NO: 539623 - RNA, 22 nt, Human
gcugcuggggccuucccucggg

SEQ ID NO: 539624 - RNA, 22 nt, Human
ugugugugacucauacuagaac

SEQ ID NO: 539625 - RNA, 22 nt, Human
aaaaguauuggccaccauuucu

SEQ ID NO: 539626 - RNA, 22 nt, Human
ggcugagacuagagugaggcau

SEQ ID NO: 539627 - RNA, 22 nt, Human
uugaaaggugacauuguuagag

SEQ ID NO: 539628 - RNA, 22 nt, Human
agugaggcuaauaggcaauggu

SEQ ID NO: 539629 - RNA, 22 nt, Human
guauucuugaguggcaacuagg

SEQ ID NO: 539630 - RNA, 22 nt, Human
uaaauguguaaaccuccauuac

SEQ ID NO: 539631 - RNA, 22 nt, Human
aagggcucugugugccucccca

SEQ ID NO: 539632 - RNA, 22 nt, Human
ggugucccaggccagcugugug

SEQ ID NO: 539633 - RNA, 22 nt, Human
ugcagcuuaucucuuuggcagu

SEQ ID NO: 539634 - RNA, 22 nt, Human
uuucagagaugcagaauucagg

SEQ ID NO: 539635 - RNA, 22 nt, Human
aucuuuucuguuugcuaugucu

SEQ ID NO: 539636 - RNA, 22 nt, Human
acauuucagugagcuauugaag

SEQ ID NO: 539637 - RNA, 22 nt, Human
gcaggcugaugacuggaguugg

SEQ ID NO: 539638 - RNA, 22 nt, Human
uuucucaaguucagauauuuga

SEQ ID NO: 539639 - RNA, 22 nt, Human
gagguccucuguguccgcgggc

SEQ ID NO: 539640 - RNA, 22 nt, Human
agagccagccuucucagcuuac

SEQ ID NO: 539641 - RNA, 22 nt, Human
uacaguaacauguuguacaagc

SEQ ID NO: 539642 - RNA, 22 nt, Human
aggcucaggucucaggucuggc

SEQ ID NO: 539643 - RNA, 18 nt, Human
cauuaugugguuauagaa

SEQ ID NO: 539644 - RNA, 22 nt, Human
acuuaaaaccagacagcgucau

SEQ ID NO: 539645 - RNA, 22 nt, Human
ucauuuguuacagccacauacc

SEQ ID NO: 539646 - RNA, 22 nt, Human
cuggccucagagggucauggug

SEQ ID NO: 539647 - RNA, 22 nt, Human
uuugaacaugcugcaugauaau

SEQ ID NO: 539648 - RNA, 22 nt, Human
acaaugaauacuaagcaccagg

SEQ ID NO: 539649 - RNA, 22 nt, Human
ccagcuuuaucaagucugagcu

SEQ ID NO: 539650 - RNA, 20 nt, Human
uccaagcccuccuuccauuc

SEQ ID NO: 539651 - RNA, 18 nt, Human
caggucagccuggccuca

SEQ ID NO: 539652 - RNA, 20 nt, Human
agagacccuguagcuugcag

SEQ ID NO: 539653 - RNA, 22 nt, Human
acaggcauugggauggagguug

SEQ ID NO: 539654 - RNA, 21 nt, Human
aggaaaggaaguccccagggu

SEQ ID NO: 539655 - RNA, 22 nt, Human
gugggcuucccuuaagccagag

SEQ ID NO: 539656 - RNA, 22 nt, Human
uuggaaaugcauuuguuauuau

SEQ ID NO: 539657 - RNA, 22 nt, Human
ucugccuggacccuggugagcu

SEQ ID NO: 539658 - RNA, 22 nt, Human
uuucaagcaugucaaguuaguc

SEQ ID NO: 539659 - RNA, 22 nt, Human
auacuuccugcuucccugaucu

SEQ ID NO: 539660 - RNA, 22 nt, Human
ccuggcugagggaccucgggua

SEQ ID NO: 539661 - RNA, 22 nt, Human
cagcuguugucaccucacaucc

SEQ ID NO: 539662 - RNA, 22 nt, Human
gccuggcuugccagcccuggcg

SEQ ID NO: 539663 - RNA, 22 nt, Human
aggcacuggucuaccccuuagu

SEQ ID NO: 539664 - RNA, 22 nt, Human
ucucccacugcaagcccaggcu

SEQ ID NO: 539665 - RNA, 17 nt, Human
aucuggcugcuucuaga

SEQ ID NO: 539666 - RNA, 22 nt, Human
gugccugguuuggggaauguuc

SEQ ID NO: 539667 - RNA, 22 nt, Human
auuugucaauaagaugaacaua

SEQ ID NO: 539668 - RNA, 19 nt, Human
cugucaggggcuggauguu

SEQ ID NO: 539669 - RNA, 22 nt, Human
gcagcuuuagaaacaagggcug

SEQ ID NO: 539670 - RNA, 22 nt, Human
aggcagaggagaaugaucuucc

SEQ ID NO: 539671 - RNA, 23 nt, Human
cagggccaggcagcagcugucac

SEQ ID NO: 539672 - RNA, 19 nt, Human
aaagugauuuuuucuggca

SEQ ID NO: 539673 - RNA, 18 nt, Human
ccuggcuuccaucuuggu

SEQ ID NO: 539674 - RNA, 22 nt, Human
uuuucacacaaggugauaaguu

SEQ ID NO: 539675 - RNA, 22 nt, Human
aaagccaguucuuagagaaagc

SEQ ID NO: 539676 - RNA, 22 nt, Human
guguggggcucagugggaaugu

SEQ ID NO: 539677 - RNA, 22 nt, Human
acugucaccaucagagcgggaa

SEQ ID NO: 539678 - RNA, 22 nt, Human
ucucaggccccugaguuucucu

SEQ ID NO: 539679 - RNA, 22 nt, Human
uuacuuugaugaucaaugagcg

SEQ ID NO: 539680 - RNA, 22 nt, Human
gcagggugauagugaggcucag

SEQ ID NO: 539681 - RNA, 22 nt, Human
auuguuaauaacuauuacauug

SEQ ID NO: 539682 - RNA, 22 nt, Human
gccaagcuuauaugaugcuuga

SEQ ID NO: 539683 - RNA, 22 nt, Human
cagggccucgaagccucugggc

SEQ ID NO: 539684 - RNA, 20 nt, Human
gcagcugaaaguaugacacc

SEQ ID NO: 539685 - RNA, 22 nt, Human
gauuucuugaccccugucucag

SEQ ID NO: 539686 - RNA, 18 nt, Human
gaaaugugauucuagggc

SEQ ID NO: 539687 - RNA, 22 nt, Human
cuucugggcauucagcugcaca

SEQ ID NO: 539688 - RNA, 22 nt, Human
uuucuauugaucuaauaaacau

SEQ ID NO: 539689 - RNA, 22 nt, Human
cuagggacagaaagaggguaga

SEQ ID NO: 539690 - RNA, 22 nt, Human
gacauuuaaauugcaggcagcc

SEQ ID NO: 539691 - RNA, 22 nt, Human
aggaccugagaguuggaaaucc

SEQ ID NO: 539692 - RNA, 21 nt, Human
uccacaaguuagaaggaaauu

SEQ ID NO: 539693 - RNA, 22 nt, Human
ugagccccaggaaauugaggag

SEQ ID NO: 539694 - RNA, 23 nt, Human
acauuucauauaaaagggaucag

SEQ ID NO: 539695 - RNA, 17 nt, Human
cucugggcagccugggg

SEQ ID NO: 539696 - RNA, 22 nt, Human
guaguucugcagugucaccuga

SEQ ID NO: 539697 - RNA, 22 nt, Human
ccagucagccaagcugcagcgg

SEQ ID NO: 539698 - RNA, 22 nt, Human
ucugagaagcuagaggacaaag

SEQ ID NO: 539699 - RNA, 22 nt, Human
uucaugaauaccccuucuguaa

SEQ ID NO: 539700 - RNA, 22 nt, Human
cugggcagcugugcaaacaaua

SEQ ID NO: 539701 - RNA, 22 nt, Human
aauuugauucccugcaccuguu

SEQ ID NO: 539702 - RNA, 22 nt, Human
ggagugugauuguucucuguua

SEQ ID NO: 539703 - RNA, 22 nt, Human
ugccuguguccccuucuuggca

SEQ ID NO: 539704 - RNA, 22 nt, Human
ucccaaggccaggcaucuagaa

SEQ ID NO: 539705 - RNA, 22 nt, Human
aggucauuguuaagucaccaua

SEQ ID NO: 539706 - RNA, 18 nt, Human
agagcagcggcaucacac

SEQ ID NO: 539707 - RNA, 18 nt, Human
cugggucuccaggcugcc

SEQ ID NO: 539708 - RNA, 22 nt, Human
ugcucagacaagcugaacagua

SEQ ID NO: 539709 - RNA, 23 nt, Human
ugagcaucacaggagaaccaggc

SEQ ID NO: 539710 - RNA, 22 nt, Human
ucagcagauggguuguguuggc

SEQ ID NO: 539711 - RNA, 22 nt, Human
uuggcagugucacuagggagcc

SEQ ID NO: 539712 - RNA, 19 nt, Human
ccaggccugcgggcguugg

SEQ ID NO: 539713 - RNA, 22 nt, Human
uggagcaggugggaugucguga

SEQ ID NO: 539714 - RNA, 22 nt, Human
caagggaguuacugagggcggg

SEQ ID NO: 539715 - RNA, 22 nt, Human
ggcaggguaaaccgagguaagu

SEQ ID NO: 539716 - RNA, 22 nt, Human
guguguccaggcgggagucaag

SEQ ID NO: 539717 - RNA, 22 nt, Human
cugugcccaccuggcucugagg

SEQ ID NO: 539718 - RNA, 22 nt, Human
uggagcagcacaagaaagggga

SEQ ID NO: 539719 - RNA, 22 nt, Human
ucagaacauugacauucuuauu

SEQ ID NO: 539720 - RNA, 23 nt, Human
uggcagugaucaaaagcuuacau

SEQ ID NO: 539721 - RNA, 19 nt, Human
uggagaggaaaugcugcuc

SEQ ID NO: 539722 - RNA, 22 nt, Human
guauucauauuaaacauaucaa

SEQ ID NO: 539723 - RNA, 22 nt, Human
aaagccagugguaugagagaaa

SEQ ID NO: 539724 - RNA, 22 nt, Human
aauaucuuggcccaacuccaga

SEQ ID NO: 539725 - RNA, 22 nt, Human
ugauuuccacgugcacccaggu

SEQ ID NO: 539726 - RNA, 22 nt, Human
uggugcucccuggaguugugca

SEQ ID NO: 539727 - RNA, 22 nt, Human
aggcacaguuucauccccgggc

SEQ ID NO: 539728 - RNA, 22 nt, Human
ucccugggccuccugcuaugca

SEQ ID NO: 539729 - RNA, 22 nt, Human
agcucacaguguccuuccucaa

SEQ ID NO: 539730 - RNA, 22 nt, Human
gucagagcugugcaaggcugag

SEQ ID NO: 539731 - RNA, 22 nt, Human
gcagaaagcuuagaggguuugc

SEQ ID NO: 539732 - RNA, 22 nt, Human
agaagccauucccuguaggcuc

SEQ ID NO: 539733 - RNA, 22 nt, Human
uggccugucuuguugugcuaga

SEQ ID NO: 539734 - RNA, 18 nt, Human
cacaggcucccagugagg

SEQ ID NO: 539735 - RNA, 22 nt, Human
ggagagagaugccgccuugcuc

SEQ ID NO: 539736 - RNA, 22 nt, Human
ucauaaaguuacccaaauuuua

SEQ ID NO: 539737 - RNA, 22 nt, Human
ugcacacaccgugcuucacuga

SEQ ID NO: 539738 - RNA, 21 nt, Human
ucuggcaggcacgggcccagc

SEQ ID NO: 539739 - RNA, 20 nt, Human
acacacuuugaucuugagcc

SEQ ID NO: 539740 - RNA, 22 nt, Human
cacugucccuguuuccuggaaa

SEQ ID NO: 539741 - RNA, 22 nt, Human
caguuucuauggcugggcucug

SEQ ID NO: 539742 - RNA, 22 nt, Human
acaauucuggguauuuauauag

SEQ ID NO: 539743 - RNA, 22 nt, Human
cauuacaugguccaggauauau

SEQ ID NO: 539744 - RNA, 22 nt, Human
ccuuuuucccuggagggacagc

SEQ ID NO: 539745 - RNA, 22 nt, Human
ucauguuuuaguaaagugaagg

SEQ ID NO: 539746 - RNA, 22 nt, Human
uggaagaagcuacaagcgguga

SEQ ID NO: 539747 - RNA, 22 nt, Human
aggcaguuguugcugagcagcu

SEQ ID NO: 539748 - RNA, 22 nt, Human
cuucuggggauggagcccagaa

SEQ ID NO: 539749 - RNA, 22 nt, Human
gucagaucuuuggggaugcugu

SEQ ID NO: 539750 - RNA, 22 nt, Human
ccaugggcgcacaggccuggag

SEQ ID NO: 539751 - RNA, 22 nt, Human
uucuggagcuaaaguccacucu

SEQ ID NO: 539752 - RNA, 23 nt, Human
ugggccuggaaagccuuagagag

SEQ ID NO: 539753 - RNA, 22 nt, Human
cugcccaggaaggagaggaugg

SEQ ID NO: 539754 - RNA, 22 nt, Human
gaggaggcacuugagcagaugu

SEQ ID NO: 539755 - RNA, 22 nt, Human
cuuacauugucuuaguuuucaa

SEQ ID NO: 539756 - RNA, 22 nt, Human
ugaggcucagaaauguaaguuu

SEQ ID NO: 539757 - RNA, 22 nt, Human
uauguguuugacacccugcaag

SEQ ID NO: 539758 - RNA, 22 nt, Human
guguaaaucagcuuguguaaua

SEQ ID NO: 539759 - RNA, 22 nt, Human
cucccaggggaacuaucaagua

SEQ ID NO: 539760 - RNA, 22 nt, Human
uagacacauccguggaagcuuc

SEQ ID NO: 539761 - RNA, 22 nt, Human
uggagagcgugcuuagcacucu

SEQ ID NO: 539762 - RNA, 22 nt, Human
agcauacaguaggugcucaguu

SEQ ID NO: 539763 - RNA, 22 nt, Human
ccuucagaccuagacaggaauc

SEQ ID NO: 539764 - RNA, 22 nt, Human
aggcugagcggggucccagagc

SEQ ID NO: 539765 - RNA, 22 nt, Human
aggcuggcgacaucuggcgggc

SEQ ID NO: 539766 - RNA, 22 nt, Human
cugggcuccacuacuugcuaac

SEQ ID NO: 539767 - RNA, 22 nt, Human
ggaggaugagcuacgaggagcu

SEQ ID NO: 539768 - RNA, 22 nt, Human
uggagcagcuaagccucugaga

SEQ ID NO: 539769 - RNA, 22 nt, Human
gaacacagugguuguuuggagg

SEQ ID NO: 539770 - RNA, 22 nt, Human
gcagccagccccucugaccucu

SEQ ID NO: 539771 - RNA, 22 nt, Human
caggcuggaguuaccuuuaggg

SEQ ID NO: 539772 - RNA, 16 nt, Human
ccacagggcaaggggc

SEQ ID NO: 539773 - RNA, 22 nt, Human
acagaguagcucaagaagauug

SEQ ID NO: 539774 - RNA, 22 nt, Human
gaaucauuuagcucugcaugga

SEQ ID NO: 539775 - RNA, 22 nt, Human
cugccucuggccucaggcccag

SEQ ID NO: 539776 - RNA, 22 nt, Human
uggcucaggauaauuuucccaa

SEQ ID NO: 539777 - RNA, 22 nt, Human
uguuacauuucucuuucuugga

SEQ ID NO: 539778 - RNA, 22 nt, Human
aggaagcucggagagggcaaau

SEQ ID NO: 539779 - RNA, 22 nt, Human
acauuaaaauugggugggguaa

SEQ ID NO: 539780 - RNA, 22 nt, Human
gugggcuuugcuggauccuucc

SEQ ID NO: 539781 - RNA, 22 nt, Human
cagcacaauuuucaggagucca

SEQ ID NO: 539782 - RNA, 22 nt, Human
accugccuaguugguucugccc

SEQ ID NO: 539783 - RNA, 22 nt, Human
uagauuucgcugcaucucaauc

SEQ ID NO: 539784 - RNA, 22 nt, Human
ucaggcagaccaccgugggcag

SEQ ID NO: 539785 - RNA, 22 nt, Human
gaggaggucgcugcugagcccc

SEQ ID NO: 539786 - RNA, 22 nt, Human
gcaggggcugcugggaacucgg

SEQ ID NO: 539787 - RNA, 22 nt, Human
uuguacagggaaguaauacaag

SEQ ID NO: 539788 - RNA, 22 nt, Human
ugcagcauuauucacaguagcc

SEQ ID NO: 539789 - RNA, 23 nt, Human
uucaaagcuuaagcucuuuccac

SEQ ID NO: 539790 - RNA, 22 nt, Human
ggagcaggagucucuugaauuu

SEQ ID NO: 539791 - RNA, 22 nt, Human
cccaucaggaacccaggagccc

SEQ ID NO: 539792 - RNA, 22 nt, Human
caugggcugcugacaggggcuc

SEQ ID NO: 539793 - RNA, 22 nt, Human
gugagacaagauuuguaggcag

SEQ ID NO: 539794 - RNA, 22 nt, Human
aaggcugcuuuuaacaugcaua

SEQ ID NO: 539795 - RNA, 21 nt, Human
ggcacugagccagauggacuc

SEQ ID NO: 539796 - RNA, 22 nt, Human
cacagagacagaagcacuuaug

SEQ ID NO: 539797 - RNA, 22 nt, Human
guccucugcuucaugcccugau

SEQ ID NO: 539798 - RNA, 21 nt, Human
uccaggccucaggaagggaug

SEQ ID NO: 539799 - RNA, 22 nt, Human
uccuggagccacggagcuuuca

SEQ ID NO: 539800 - RNA, 22 nt, Human
gggcuacagacaugcucuaagc

SEQ ID NO: 539801 - RNA, 22 nt, Human
aggacuccauguguccuggaga

SEQ ID NO: 539802 - RNA, 22 nt, Human
gcaugggcaagaggacuggggg

SEQ ID NO: 539803 - RNA, 22 nt, Human
aggcaagggggcgccaccuucc

SEQ ID NO: 539804 - RNA, 23 nt, Human
cugguucauagucaagagauuga

SEQ ID NO: 539805 - RNA, 22 nt, Human
acauucuacaguuaaccauuag

SEQ ID NO: 539806 - RNA, 22 nt, Human
cugccugcuuuucugggagccg

SEQ ID NO: 539807 - RNA, 22 nt, Human
uacaguauggaaaauguauagu

SEQ ID NO: 539808 - RNA, 22 nt, Human
uggcugggugcuauccaguacu

SEQ ID NO: 539809 - RNA, 22 nt, Human
gacagaggcaagaccagaagcc

SEQ ID NO: 539810 - RNA, 23 nt, Human
gcaggaguuccuggacuccagga

SEQ ID NO: 539811 - RNA, 22 nt, Human
cagcuagagggaugcuguguga

SEQ ID NO: 539812 - RNA, 22 nt, Human
agucuucagcauagcauauggc

SEQ ID NO: 539813 - RNA, 22 nt, Human
gcagggucugaggccacagagg

SEQ ID NO: 539814 - RNA, 22 nt, Human
uucugcaucugaauuuaaguac

SEQ ID NO: 539815 - RNA, 22 nt, Human
uuucagagaacugaguccuugc

SEQ ID NO: 539816 - RNA, 22 nt, Human
gcaaagcauucuguggagucua

SEQ ID NO: 539817 - RNA, 21 nt, Human
cagugguuuauaaacaacaga

SEQ ID NO: 539818 - RNA, 22 nt, Human
uuugucuuguguccuuaggacc

SEQ ID NO: 539819 - RNA, 22 nt, Human
cauucacauucuucuuacuguu

SEQ ID NO: 539820 - RNA, 22 nt, Human
aaaugucuguuagucauaucau

SEQ ID NO: 539821 - RNA, 18 nt, Human
ucauuuugucugccuuug

SEQ ID NO: 539822 - RNA, 22 nt, Human
ggcagggcuugucucugugaug

SEQ ID NO: 539823 - RNA, 22 nt, Human
gaggccuggcucugcccuccug

SEQ ID NO: 539824 - RNA, 22 nt, Human
aaauguuuugcucccauguggu

SEQ ID NO: 539825 - RNA, 22 nt, Human
agcagauggugucaugggaugg

SEQ ID NO: 539826 - RNA, 23 nt, Human
uugcauguagcccaugaguaacu

SEQ ID NO: 539827 - RNA, 22 nt, Human
gcauuuaaauuugaacuucaga

SEQ ID NO: 539828 - RNA, 23 nt, Human
ucccagccucuucucuugcauac

SEQ ID NO: 539829 - RNA, 22 nt, Human
ggugcagaucuuucucuucagg

SEQ ID NO: 539830 - RNA, 22 nt, Human
aguuuuauuccaaugugcagca

SEQ ID NO: 539831 - RNA, 22 nt, Human
uuccaggauggcaauaaugaau

SEQ ID NO: 539832 - RNA, 22 nt, Human
gugcagugaaaaaagaaugucc

SEQ ID NO: 539833 - RNA, 22 nt, Human
ccacuggcauccagcugccauc

SEQ ID NO: 539834 - RNA, 22 nt, Human
uguuuauugagugccuacuaua

SEQ ID NO: 539835 - RNA, 22 nt, Human
cacauuuaucuguucuuucuag

SEQ ID NO: 539836 - RNA, 22 nt, Human
agagggcccauguugggcugcu

SEQ ID NO: 539837 - RNA, 22 nt, Human
agcuggccuucggugucacugg

SEQ ID NO: 539838 - RNA, 22 nt, Human
gguggcucucugucagugacag

SEQ ID NO: 539839 - RNA, 22 nt, Human
gcugucugcugugcacugagca

SEQ ID NO: 539840 - RNA, 22 nt, Human
ugaagggguucagcaugggggu

SEQ ID NO: 539841 - RNA, 22 nt, Human
aagaggaacugggggcugaguc

SEQ ID NO: 539842 - RNA, 17 nt, Human
uuucagauucacuuucu

SEQ ID NO: 539843 - RNA, 22 nt, Human
auucuguauggaaaagcacuau

SEQ ID NO: 539844 - RNA, 22 nt, Human
cuucugcaggccuuauuuuagu

SEQ ID NO: 539845 - RNA, 22 nt, Human
auguaugaagcuuuguuuggga

SEQ ID NO: 539846 - RNA, 22 nt, Human
uuacacaugcucacuuauuugu

SEQ ID NO: 539847 - RNA, 22 nt, Human
ucaggcugguggucagauggcu

SEQ ID NO: 539848 - RNA, 22 nt, Human
cuucacagucacccugcugugu

SEQ ID NO: 539849 - RNA, 22 nt, Human
cccuggauuuacaucauucuga

SEQ ID NO: 539850 - RNA, 22 nt, Human
uagcagaguaauacuuuggagc

SEQ ID NO: 539851 - RNA, 22 nt, Human
ggagucagaauggcaggguggu

SEQ ID NO: 539852 - RNA, 22 nt, Human
caguuaauguccuauacaauag

SEQ ID NO: 539853 - RNA, 22 nt, Human
gcagguguggauuugcauccag

SEQ ID NO: 539854 - RNA, 22 nt, Human
guucauguuuguguauugcuca

SEQ ID NO: 539855 - RNA, 22 nt, Human
ccuguucacccuccaugcacag

SEQ ID NO: 539856 - RNA, 22 nt, Human
cuguucacagaauccuccccug

SEQ ID NO: 539857 - RNA, 20 nt, Human
aggaaggagaaucugagcaa

SEQ ID NO: 539858 - RNA, 22 nt, Human
gucaggaucaaauugaaguuau

SEQ ID NO: 539859 - RNA, 22 nt, Human
auauuaggcaaggagauuauuu

SEQ ID NO: 539860 - RNA, 19 nt, Human
cuguccugguuuggucccu

SEQ ID NO: 539861 - RNA, 22 nt, Human
cuuucuuauaccugucagggcc

SEQ ID NO: 539862 - RNA, 22 nt, Human
uaugggucuggaaaauggcuug

SEQ ID NO: 539863 - RNA, 22 nt, Human
gccuguguggaugggccccugg

SEQ ID NO: 539864 - RNA, 22 nt, Human
ggggcuguuuuuggaauggcug

SEQ ID NO: 539865 - RNA, 22 nt, Human
caaagcagaccuuuacccuuua

SEQ ID NO: 539866 - RNA, 22 nt, Human
caaggaaguuuuaggagaggaa

SEQ ID NO: 539867 - RNA, 22 nt, Human
ugcuucuguauugaaauuguua

SEQ ID NO: 539868 - RNA, 22 nt, Human
agauauuuugugugauguuuca

SEQ ID NO: 539869 - RNA, 22 nt, Human
ugggcugaguguggaacuaguu

SEQ ID NO: 539870 - RNA, 22 nt, Human
uagauaaauuagaaaguuuacu

SEQ ID NO: 539871 - RNA, 22 nt, Human
uguaauauuguagugacaguac

SEQ ID NO: 539872 - RNA, 22 nt, Human
ggaagggcaauaaaaucucagg

SEQ ID NO: 539873 - RNA, 22 nt, Human
ugaggaaguuguuucucuucua

SEQ ID NO: 539874 - RNA, 22 nt, Human
ggaaggucgagcugcaucuggc

SEQ ID NO: 539875 - RNA, 22 nt, Human
guggcagcggcccaggccgucu

SEQ ID NO: 539876 - RNA, 22 nt, Human
auaucuuuguuuuugccaagau

SEQ ID NO: 539877 - RNA, 22 nt, Human
aagcagaaaaacugagcuccaa

SEQ ID NO: 539878 - RNA, 22 nt, Human
cgugcccugcgcaagugcugcu

SEQ ID NO: 539879 - RNA, 22 nt, Human
caggaggcaguuucagaaguca

SEQ ID NO: 539880 - RNA, 22 nt, Human
ugccuuguccuucgucagggcu

SEQ ID NO: 539881 - RNA, 22 nt, Human
gcucaaggcaggcagacaugag

SEQ ID NO: 539882 - RNA, 22 nt, Human
agccuucauaaucuugggcuuu

SEQ ID NO: 539883 - RNA, 22 nt, Human
aaagcuuuucaguauguucaug

SEQ ID NO: 539884 - RNA, 22 nt, Human
uaugcacacauguaugcaugug

SEQ ID NO: 539885 - RNA, 22 nt, Human
agcugguucagaaauuagaugg

SEQ ID NO: 539886 - RNA, 22 nt, Human
cuuuggcaugguccucacuaua

SEQ ID NO: 539887 - RNA, 22 nt, Human
aaaaugaggucaauauccuuuu

SEQ ID NO: 539888 - RNA, 22 nt, Human
aaagauuuaugaaguucaauua

SEQ ID NO: 539889 - RNA, 22 nt, Human
caggccucuccuuagucuggca

SEQ ID NO: 539890 - RNA, 22 nt, Human
guccucuggaagaugaguucuu

SEQ ID NO: 539891 - RNA, 22 nt, Human
agcugcugguuuaagggauggg

SEQ ID NO: 539892 - RNA, 22 nt, Human
uggcucagucuggguugacuga

SEQ ID NO: 539893 - RNA, 22 nt, Human
agugcugacucugggcacagug

SEQ ID NO: 539894 - RNA, 22 nt, Human
agcagcucuguuuaccuggagg

SEQ ID NO: 539895 - RNA, 22 nt, Human
agaacagaggccuuauguuuca

SEQ ID NO: 539896 - RNA, 22 nt, Human
caaggccacguucugcaugcgg

SEQ ID NO: 539897 - RNA, 22 nt, Human
agaggaugguugaggaagaccu

SEQ ID NO: 539898 - RNA, 20 nt, Human
ugcugggcaugcaguggaaa

SEQ ID NO: 539899 - RNA, 22 nt, Human
accucugccacuuucuaacucu

SEQ ID NO: 539900 - RNA, 19 nt, Human
uguuuacauguuucuucag

SEQ ID NO: 539901 - RNA, 22 nt, Human
cuggcacuuggcacccaugaaa

SEQ ID NO: 539902 - RNA, 22 nt, Human
ggugaggcguccccaccauggg

SEQ ID NO: 539903 - RNA, 22 nt, Human
gugucucuuagccugcuaaugc

SEQ ID NO: 539904 - RNA, 22 nt, Human
ccaggccuagccccugagggua

SEQ ID NO: 539905 - RNA, 22 nt, Human
cagaauaugacucgggcacuac

SEQ ID NO: 539906 - RNA, 22 nt, Human
augaagcugaccuugucuugcu

SEQ ID NO: 539907 - RNA, 22 nt, Human
gaggccuggucuaugagauguu

SEQ ID NO: 539908 - RNA, 22 nt, Human
aauaagaacaacuaagguuuau

SEQ ID NO: 539909 - RNA, 22 nt, Human
agguagaggccuccaggcagca

SEQ ID NO: 539910 - RNA, 22 nt, Human
gaauuugucccuugauauaaaa

SEQ ID NO: 539911 - RNA, 22 nt, Human
ugaggaagaacaagaauuuaga

SEQ ID NO: 539912 - RNA, 22 nt, Human
gagacagaguuucacucuuguu

SEQ ID NO: 539913 - RNA, 22 nt, Human
caagauuuauauuuucacacaa

SEQ ID NO: 539914 - RNA, 22 nt, Human
uccugucagugaggcagaugaa

SEQ ID NO: 539915 - RNA, 22 nt, Human
cagcuggcuggucagugcacaa

SEQ ID NO: 539916 - RNA, 22 nt, Human
ucugggagagggaaagaagacu

SEQ ID NO: 539917 - RNA, 22 nt, Human
ccugguggagaggggcggagcg

SEQ ID NO: 539918 - RNA, 22 nt, Human
aacacuuuguugccuaugaacg

SEQ ID NO: 539919 - RNA, 22 nt, Human
agaauuuuugauuaucuacucg

SEQ ID NO: 539920 - RNA, 22 nt, Human
acacucuguaaugucacacucc

SEQ ID NO: 539921 - RNA, 22 nt, Human
ugggaagaggcgggaggcuguu

SEQ ID NO: 539922 - RNA, 19 nt, Human
ggauaagguuggagugauc

SEQ ID NO: 539923 - RNA, 22 nt, Human
guccucuguuagaaaugugcuu

SEQ ID NO: 539924 - RNA, 22 nt, Human
cccaggaggcagaaguugcagu

SEQ ID NO: 539925 - RNA, 21 nt, Human
agaauucuuaaguauucuaau

SEQ ID NO: 539926 - RNA, 22 nt, Human
ugcagugggccggaggccaggg

SEQ ID NO: 539927 - RNA, 21 nt, Human
ugugucacuaacuagaggcua

SEQ ID NO: 539928 - RNA, 22 nt, Human
gacccagaaggagugcccuaga

SEQ ID NO: 539929 - RNA, 22 nt, Human
ucacaaauagcuauauuaagga

SEQ ID NO: 539930 - RNA, 18 nt, Human
cucucugggugaggacaa

SEQ ID NO: 539931 - RNA, 23 nt, Human
agacagaggcugaggcuggccgc

SEQ ID NO: 539932 - RNA, 22 nt, Human
ugggaaggaacugccuuuagcu

SEQ ID NO: 539933 - RNA, 22 nt, Human
agggccuggacuaauuggaucc

SEQ ID NO: 539934 - RNA, 22 nt, Human
auaugaaguuacagguaagaaa

SEQ ID NO: 539935 - RNA, 22 nt, Human
uggccugcuuucauuugaugcu

SEQ ID NO: 539936 - RNA, 22 nt, Human
ccaggcagagugcuccagaaag

SEQ ID NO: 539937 - RNA, 22 nt, Human
gcugccuggaauaacggcuggc

SEQ ID NO: 539938 - RNA, 22 nt, Human
uaaaggcacggaguuguuaugg

SEQ ID NO: 539939 - RNA, 22 nt, Human
ucagacagugugaucagucucu

SEQ ID NO: 539940 - RNA, 22 nt, Human
uugaaagaagaagcugcgaugu

SEQ ID NO: 539941 - RNA, 22 nt, Human
cuucacaaagcucucuuuaugu

SEQ ID NO: 539942 - RNA, 22 nt, Human
uggagcugguucuggggaagcu

SEQ ID NO: 539943 - RNA, 22 nt, Human
uaagacaaauacuauuucaaga

SEQ ID NO: 539944 - RNA, 22 nt, Human
aauucaugaguagaaucuauau

SEQ ID NO: 539945 - RNA, 22 nt, Human
ggcucaggcuggagugcagugg

SEQ ID NO: 539946 - RNA, 22 nt, Human
cuacaaagaaaguauacuggac

SEQ ID NO: 539947 - RNA, 22 nt, Human
uuauuuaggagaaggaacccug

SEQ ID NO: 539948 - RNA, 21 nt, Human
gccauuguuuucuaccuggag

SEQ ID NO: 539949 - RNA, 22 nt, Human
auaaauuuucuugcuguacuua

SEQ ID NO: 539950 - RNA, 22 nt, Human
ggccacugcugcucugguggag

SEQ ID NO: 539951 - RNA, 22 nt, Human
uggcagccaucagagcaggggu

SEQ ID NO: 539952 - RNA, 22 nt, Human
caagugucuauaucagugcuug

SEQ ID NO: 539953 - RNA, 22 nt, Human
acuuuacaaacuccucacuguu

SEQ ID NO: 539954 - RNA, 19 nt, Human
cuggugcuugagugaguca

SEQ ID NO: 539955 - RNA, 22 nt, Human
caggugggauuuugcugcuuga

SEQ ID NO: 539956 - RNA, 18 nt, Human
agggagagaccgcggguc

SEQ ID NO: 539957 - RNA, 22 nt, Human
agccucugauggcucccaagga

SEQ ID NO: 539958 - RNA, 22 nt, Human
cugggagcugaggcugacgcug

SEQ ID NO: 539959 - RNA, 22 nt, Human
agagcucaagacgcucacagua

SEQ ID NO: 539960 - RNA, 19 nt, Human
aggcagaggcuuggcuagc

SEQ ID NO: 539961 - RNA, 22 nt, Human
ugggcugcggauaggccucgga

SEQ ID NO: 539962 - RNA, 22 nt, Human
ucuggggaugagguccagugau

SEQ ID NO: 539963 - RNA, 22 nt, Human
ugauuucauaguauauacauga

SEQ ID NO: 539964 - RNA, 22 nt, Human
uugcccagaguccacagcguac

SEQ ID NO: 539965 - RNA, 22 nt, Human
gugcauuugugcaugcacaugu

SEQ ID NO: 539966 - RNA, 23 nt, Human
ucacauauguagaaguggaauuc

SEQ ID NO: 539967 - RNA, 22 nt, Human
aaagccagaguguguuagagac

SEQ ID NO: 539968 - RNA, 22 nt, Human
uuguacaaauaggaaccucuga

SEQ ID NO: 539969 - RNA, 19 nt, Human
agcagagcagggccguggg

SEQ ID NO: 539970 - RNA, 21 nt, Human
augcacaaaaagacucuuucu

SEQ ID NO: 539971 - RNA, 19 nt, Human
cuggaaaguuggcagugag

SEQ ID NO: 539972 - RNA, 20 nt, Human
uauuugaaauggccaagugu

SEQ ID NO: 539973 - RNA, 20 nt, Human
uugcagcagugaggugaagg

SEQ ID NO: 539974 - RNA, 22 nt, Human
ucauacauaaauaagaguuuag

SEQ ID NO: 539975 - RNA, 22 nt, Human
caaagccucugauuucacuugu

SEQ ID NO: 539976 - RNA, 22 nt, Human
caggcccugggcaggaucagcc

SEQ ID NO: 539977 - RNA, 22 nt, Human
guucaaggaagggaggaaagcc

SEQ ID NO: 539978 - RNA, 22 nt, Human
uaguuugucaaccacugucaca

SEQ ID NO: 539979 - RNA, 22 nt, Human
auaugagagaggaaagauuuua

SEQ ID NO: 539980 - RNA, 22 nt, Human
ggugugguuugaagggagaugg

SEQ ID NO: 539981 - RNA, 18 nt, Human
cugagggcagccccuggg

SEQ ID NO: 539982 - RNA, 22 nt, Human
aaaacauucugugaacucucaa

SEQ ID NO: 539983 - RNA, 22 nt, Human
guguuuaacaucugguuuauac

SEQ ID NO: 539984 - RNA, 22 nt, Human
gagcacagaacuaaaugcuggu

SEQ ID NO: 539985 - RNA, 22 nt, Human
auauuuggaaagaaaaucauug

SEQ ID NO: 539986 - RNA, 22 nt, Human
augggccuguuccuaugcuggu

SEQ ID NO: 539987 - RNA, 21 nt, Human
auucacagguauccucucccu

SEQ ID NO: 539988 - RNA, 22 nt, Human
uuuagaguugaguauucauugg

SEQ ID NO: 539989 - RNA, 22 nt, Human
gccugagaaggauaggaagcga

SEQ ID NO: 539990 - RNA, 22 nt, Human
cuguccugcaguugggggcagg

SEQ ID NO: 539991 - RNA, 21 nt, Human
ucaggcagugcaaauacaugg

SEQ ID NO: 539992 - RNA, 22 nt, Human
guugaaagagcauggacuugaa

SEQ ID NO: 539993 - RNA, 22 nt, Human
ggccucagaaauagaguaaaau

SEQ ID NO: 539994 - RNA, 22 nt, Human
aguguuaaugguguauauuagg

SEQ ID NO: 539995 - RNA, 22 nt, Human
uucacaguggcccucucugagu

SEQ ID NO: 539996 - RNA, 22 nt, Human
aggugaguugguaggaaguuug

SEQ ID NO: 539997 - RNA, 22 nt, Human
cugcacugagcaucuaaccuua

SEQ ID NO: 539998 - RNA, 19 nt, Human
agggccaggauucuggaac

SEQ ID NO: 539999 - RNA, 22 nt, Human
gcugaguugaaagcagaggaua

SEQ ID NO: 540000 - RNA, 22 nt, Human
gggcacagcugcuacccagugc

SEQ ID NO: 540001 - RNA, 22 nt, Human
gccaggcacugcucuaagcccu

SEQ ID NO: 540002 - RNA, 21 nt, Human
aucuuuagccauccaaucaga

SEQ ID NO: 540003 - RNA, 22 nt, Human
cauggcagaaaccugagcugcu

SEQ ID NO: 540004 - RNA, 22 nt, Human
ggcccugcgauuagguggcagg

SEQ ID NO: 540005 - RNA, 22 nt, Human
uccuucagcuuauuucuuagga

SEQ ID NO: 540006 - RNA, 22 nt, Human
aaagagaacuuuuacccaagaa

SEQ ID NO: 540007 - RNA, 22 nt, Human
caggacagguguucuagaucag

SEQ ID NO: 540008 - RNA, 22 nt, Human
cccuggagggacagcugcucua

SEQ ID NO: 540009 - RNA, 18 nt, Human
ggcugagguugacuagaa

SEQ ID NO: 540010 - RNA, 22 nt, Human
gcccaggaguugaagggcugac

SEQ ID NO: 540011 - RNA, 22 nt, Human
gugcagugagcagugcagcacc

SEQ ID NO: 540012 - RNA, 22 nt, Human
ucagagagccucaggcacugcc

SEQ ID NO: 540013 - RNA, 22 nt, Human
auguuaacugaagccauucucg

SEQ ID NO: 540014 - RNA, 22 nt, Human
aaggcugacucaacagggggcc

SEQ ID NO: 540015 - RNA, 22 nt, Human
cagggccacacggaagggaaca

SEQ ID NO: 540016 - RNA, 22 nt, Human
caggcacacauccgugagagau

SEQ ID NO: 540017 - RNA, 22 nt, Human
auggccuggggagcaugggaag

SEQ ID NO: 540018 - RNA, 22 nt, Human
agggccugucuguagaacugaa

SEQ ID NO: 540019 - RNA, 22 nt, Human
aguucuggcgcccaugagcaga

SEQ ID NO: 540020 - RNA, 22 nt, Human
gccugggaaagaguagggaaau

SEQ ID NO: 540021 - RNA, 22 nt, Human
ccaaaggccaggcacugagguu

SEQ ID NO: 540022 - RNA, 22 nt, Human
ugucaaaaauaagagagauugu

SEQ ID NO: 540023 - RNA, 22 nt, Human
agaggaugauuuuaaggacacu

SEQ ID NO: 540024 - RNA, 22 nt, Human
ggagaguuguuuuugccuagau

SEQ ID NO: 540025 - RNA, 22 nt, Human
ugguaccagggguuauuucugc

SEQ ID NO: 540026 - RNA, 22 nt, Human
guggacugcgcuugagggggcc

SEQ ID NO: 540027 - RNA, 22 nt, Human
ucugucacucccugaugaugaa

SEQ ID NO: 540028 - RNA, 22 nt, Human
ggcccagcugugcuuccagccc

SEQ ID NO: 540029 - RNA, 22 nt, Human
ucagagucauugcaaguagaag

SEQ ID NO: 540030 - RNA, 22 nt, Human
uccaggcaagggaggagcaugg

SEQ ID NO: 540031 - RNA, 22 nt, Human
ucuucccucuucugccaaauac

SEQ ID NO: 540032 - RNA, 22 nt, Human
uaaaucuccuguuuuucaucua

SEQ ID NO: 540033 - RNA, 22 nt, Human
ugugcuucuugcagcuccugua

SEQ ID NO: 540034 - RNA, 17 nt, Human
acagagguuauacagac

SEQ ID NO: 540035 - RNA, 22 nt, Human
caaguccaagaucaagaagcca

SEQ ID NO: 540036 - RNA, 21 nt, Human
cugcucugacagugaggccag

SEQ ID NO: 540037 - RNA, 22 nt, Human
acauuuaccuaguuaagucaau

SEQ ID NO: 540038 - RNA, 22 nt, Human
cuguccuccagacgacaguccc

SEQ ID NO: 540039 - RNA, 22 nt, Human
gaaaacauccagagauagaccu

SEQ ID NO: 540040 - RNA, 22 nt, Human
ugaaagcacucacuucugcucu

SEQ ID NO: 540041 - RNA, 21 nt, Human
ccagucuguaaaauggggaca

SEQ ID NO: 540042 - RNA, 22 nt, Human
gucuuuauuugagauugucauu

SEQ ID NO: 540043 - RNA, 22 nt, Human
uuauuuaaaagugguaagauuc

SEQ ID NO: 540044 - RNA, 22 nt, Human
uggcucuguuuuaugaguacca

SEQ ID NO: 540045 - RNA, 22 nt, Human
ucacagccuggucacucugccc

SEQ ID NO: 540046 - RNA, 22 nt, Human
agcagcagauccaaaaaaugug

SEQ ID NO: 540047 - RNA, 19 nt, Human
gaaggagagcugaguuagg

SEQ ID NO: 540048 - RNA, 22 nt, Human
acagugaaaauaauaucuucaa

SEQ ID NO: 540049 - RNA, 22 nt, Human
uugcagagugguugugaggauu

SEQ ID NO: 540050 - RNA, 19 nt, Human
cuuauuagagugagagcuu

SEQ ID NO: 540051 - RNA, 22 nt, Human
uuuacaaguuuacagaaugaug

SEQ ID NO: 540052 - RNA, 22 nt, Human
cagacuuuugacauuaauacag

SEQ ID NO: 540053 - RNA, 22 nt, Human
ccagcugcgggcaucgagaguu

SEQ ID NO: 540054 - RNA, 22 nt, Human
cccuggccagcucaugucugag

SEQ ID NO: 540055 - RNA, 22 nt, Human
augucuuucgcaucaguagcua

SEQ ID NO: 540056 - RNA, 22 nt, Human
acagaccaaguuuccagcaggu

SEQ ID NO: 540057 - RNA, 22 nt, Human
gccagggaacccaagggccuca

SEQ ID NO: 540058 - RNA, 22 nt, Human
acagcaggcaugaagaaauguu

SEQ ID NO: 540059 - RNA, 22 nt, Human
uggcugggccgggccuugugcc

SEQ ID NO: 540060 - RNA, 22 nt, Human
ccagccagccuugaucugagua

SEQ ID NO: 540061 - RNA, 22 nt, Human
gcuucuauuauuuggagcugag

SEQ ID NO: 540062 - RNA, 23 nt, Human
ugaagugaaauuucacaagggac

SEQ ID NO: 540063 - RNA, 22 nt, Human
caguacuuauuucuauuuaggg

SEQ ID NO: 540064 - RNA, 22 nt, Human
uggcugagaaguucugguggga

SEQ ID NO: 540065 - RNA, 22 nt, Human
cagccugcucucagauguugag

SEQ ID NO: 540066 - RNA, 22 nt, Human
cagcaucucacuucccagaagg

SEQ ID NO: 540067 - RNA, 22 nt, Human
acugugcuuucucuggaggcau

SEQ ID NO: 540068 - RNA, 22 nt, Human
ccuggcucuguccucgcgcaaa

SEQ ID NO: 540069 - RNA, 22 nt, Human
accaggcaaaaccacaggagca

SEQ ID NO: 540070 - RNA, 22 nt, Human
gcaaagaaaguuuuaaugaggu

SEQ ID NO: 540071 - RNA, 22 nt, Human
gggagccagcagggcauggagc

SEQ ID NO: 540072 - RNA, 22 nt, Human
acagcaaaggacgaacacucug

SEQ ID NO: 540073 - RNA, 22 nt, Human
auaaagcuaagacuuacaugaa

SEQ ID NO: 540074 - RNA, 22 nt, Human
uuuucugaaguuuaagacauuu

SEQ ID NO: 540075 - RNA, 22 nt, Human
ugaaagguuauuuaggucugcu

SEQ ID NO: 540076 - RNA, 22 nt, Human
gaaaucauuauaugguauugcu

SEQ ID NO: 540077 - RNA, 22 nt, Human
auuaauauacacuguuagcaug

SEQ ID NO: 540078 - RNA, 22 nt, Human
cagcuccugcagcugcugccgu

SEQ ID NO: 540079 - RNA, 22 nt, Human
uuuauauguuuguacaauuaag

SEQ ID NO: 540080 - RNA, 22 nt, Human
cagcagaggugguucacauugu

SEQ ID NO: 540081 - RNA, 23 nt, Human
aggaacugaggccuagggaggua

SEQ ID NO: 540082 - RNA, 20 nt, Human
cccugcagccaugggagugg

SEQ ID NO: 540083 - RNA, 20 nt, Human
cuucuucagccuaugcuuca

SEQ ID NO: 540084 - RNA, 22 nt, Human
agaucucaccucuguguauuau

SEQ ID NO: 540085 - RNA, 23 nt, Human
uuuaacuuuccaauaauucauug

SEQ ID NO: 540086 - RNA, 22 nt, Human
caggcccugccuugagggaccu

SEQ ID NO: 540087 - RNA, 22 nt, Human
cuggcugcaggaugaggcugcc

SEQ ID NO: 540088 - RNA, 22 nt, Human
gauuaguaagaguuuaccuauu

SEQ ID NO: 540089 - RNA, 22 nt, Human
agagcuggguggacuuguaguu

SEQ ID NO: 540090 - RNA, 22 nt, Human
agugcuggagggaggcagguuc

SEQ ID NO: 540091 - RNA, 22 nt, Human
aaaugcuagggagaaacucucc

SEQ ID NO: 540092 - RNA, 22 nt, Human
gcugagccacccuugcuucccu

SEQ ID NO: 540093 - RNA, 22 nt, Human
uguuugugguuauaauaaguau

SEQ ID NO: 540094 - RNA, 23 nt, Human
ucacuaaaguguuuagugcagau

SEQ ID NO: 540095 - RNA, 22 nt, Human
uuucuagggcucuugucuucug

SEQ ID NO: 540096 - RNA, 22 nt, Human
ugaggcagcccacuuuccuuag

SEQ ID NO: 540097 - RNA, 21 nt, Human
ugaggcucuguugugccugca

SEQ ID NO: 540098 - RNA, 22 nt, Human
ugccaggcucagccccuaucuu

SEQ ID NO: 540099 - RNA, 20 nt, Human
agaaaucagaccacacacua

SEQ ID NO: 540100 - RNA, 22 nt, Human
agccugagagccaagcugugca

SEQ ID NO: 540101 - RNA, 22 nt, Human
acacugaauguuuaagaacuug

SEQ ID NO: 540102 - RNA, 22 nt, Human
gggcagagagcuggaacuccuu

SEQ ID NO: 540103 - RNA, 19 nt, Human
aaggcagaaguuggauaug

SEQ ID NO: 540104 - RNA, 22 nt, Human
uuuuucaucugauugauaacuc

SEQ ID NO: 540105 - RNA, 19 nt, Human
uucuaccuuacuguaggcu

SEQ ID NO: 540106 - RNA, 22 nt, Human
cuguacaggucaaugauaagau

SEQ ID NO: 540107 - RNA, 22 nt, Human
augucacagcucccauuccucc

SEQ ID NO: 540108 - RNA, 22 nt, Human
auaaacaguaaaugugagcagu

SEQ ID NO: 540109 - RNA, 22 nt, Human
gaaacauuguguucuacagauu

SEQ ID NO: 540110 - RNA, 22 nt, Human
augaggcagaaaaaagucggag

SEQ ID NO: 540111 - RNA, 22 nt, Human
agcagcugccacuggaauagga

SEQ ID NO: 540112 - RNA, 22 nt, Human
ucagaauuuaaaauguguagau

SEQ ID NO: 540113 - RNA, 22 nt, Human
uauugacaauuugugaaacuau

SEQ ID NO: 540114 - RNA, 22 nt, Human
cugagaggaugcugcaguggag

SEQ ID NO: 540115 - RNA, 22 nt, Human
guuuucauuacugcugugauuu

SEQ ID NO: 540116 - RNA, 22 nt, Human
acaggccacaguggagucucug

SEQ ID NO: 540117 - RNA, 22 nt, Human
uuugaaagaauuuauguacuuu

SEQ ID NO: 540118 - RNA, 22 nt, Human
caggagacuauggcccaaggcc

SEQ ID NO: 540119 - RNA, 22 nt, Human
aaugauggucauggcaacuuuu

SEQ ID NO: 540120 - RNA, 22 nt, Human
uggguaaacugggucuggagag

SEQ ID NO: 540121 - RNA, 22 nt, Human
gcuguggcugaccaccaggggg

SEQ ID NO: 540122 - RNA, 22 nt, Human
aaaucagagaauauauuuagaa

SEQ ID NO: 540123 - RNA, 19 nt, Human
uggcugggcgugccuccgu

SEQ ID NO: 540124 - RNA, 20 nt, Human
ucucaggguucagcaaagua

SEQ ID NO: 540125 - RNA, 22 nt, Human
uugagaguuaccagcagaggaa

SEQ ID NO: 540126 - RNA, 22 nt, Human
aggcugggaaauguauuccagc

SEQ ID NO: 540127 - RNA, 22 nt, Human
aaaagcaaggcagucugucuga

SEQ ID NO: 540128 - RNA, 22 nt, Human
aggggcuccuggccuggagagc

SEQ ID NO: 540129 - RNA, 22 nt, Human
augggcuggggaagcucacucc

SEQ ID NO: 540130 - RNA, 22 nt, Human
ucagggcaaaagggaaaccauu

SEQ ID NO: 540131 - RNA, 22 nt, Human
aauaggacuuugguccuagcuc

SEQ ID NO: 540132 - RNA, 22 nt, Human
ugaauucauccauuuaugcaag

SEQ ID NO: 540133 - RNA, 22 nt, Human
ccugggcaacauagugagaccc

SEQ ID NO: 540134 - RNA, 22 nt, Human
gcucagugcagccuuucuguau

SEQ ID NO: 540135 - RNA, 22 nt, Human
ggggauggaauguaguagugau

SEQ ID NO: 540136 - RNA, 18 nt, Human
uucucauaccucacuuag

SEQ ID NO: 540137 - RNA, 19 nt, Human
auagucuuuccaauuauac

SEQ ID NO: 540138 - RNA, 22 nt, Human
uucagaguaggauacuagcuua

SEQ ID NO: 540139 - RNA, 22 nt, Human
gcagggcagugugucugugggg

SEQ ID NO: 540140 - RNA, 22 nt, Human
uuuugcuuaaucuagauuuugc

SEQ ID NO: 540141 - RNA, 22 nt, Human
ucagauuuggacacaggaacuu

SEQ ID NO: 540142 - RNA, 22 nt, Human
gaguucugugagccauccuagc

SEQ ID NO: 540143 - RNA, 22 nt, Human
aaaggcagugugauacuguggu

SEQ ID NO: 540144 - RNA, 22 nt, Human
cgaaaucaaacuugggcuucug

SEQ ID NO: 540145 - RNA, 22 nt, Human
uuuguagacuaccaguaauugu

SEQ ID NO: 540146 - RNA, 22 nt, Human
ugcagggcacacgcacgggugu

SEQ ID NO: 540147 - RNA, 23 nt, Human
uguaaauuuuguagucacauuuu

SEQ ID NO: 540148 - RNA, 23 nt, Human
aacaauagguuuuggcagaauag

SEQ ID NO: 540149 - RNA, 22 nt, Human
uugggcuuggucgguuugaggc

SEQ ID NO: 540150 - RNA, 22 nt, Human
guuucacagcaaaguucccugu

SEQ ID NO: 540151 - RNA, 22 nt, Human
caguugcuacaguucaagugug

SEQ ID NO: 540152 - RNA, 22 nt, Human
agggugucagccacggaauggg

SEQ ID NO: 540153 - RNA, 22 nt, Human
cuaguggaaacuaacuggaauu

SEQ ID NO: 540154 - RNA, 22 nt, Human
agauaauuugaguaaauuaauu

SEQ ID NO: 540155 - RNA, 22 nt, Human
ucaaagcaauuucaccagugcc

SEQ ID NO: 540156 - RNA, 22 nt, Human
uggcugagaccuucccaaauuc

SEQ ID NO: 540157 - RNA, 22 nt, Human
uccuggagaauccugccaccug

SEQ ID NO: 540158 - RNA, 22 nt, Human
agcagcagaggucagaaaggua

SEQ ID NO: 540159 - RNA, 22 nt, Human
caguuucagaaucaaaacauca

SEQ ID NO: 540160 - RNA, 22 nt, Human
cugugccaggcccagcugacuu

SEQ ID NO: 540161 - RNA, 21 nt, Human
uucagcuauucagaaggggag

SEQ ID NO: 540162 - RNA, 22 nt, Human
uuucacauagaaagugauuuac

SEQ ID NO: 540163 - RNA, 22 nt, Human
gcagcucucuggccugcccugg

SEQ ID NO: 540164 - RNA, 22 nt, Human
gucagcuaggcagcugugaugg

SEQ ID NO: 540165 - RNA, 22 nt, Human
ucuguucaagacugaggugaca

SEQ ID NO: 540166 - RNA, 22 nt, Human
uacacaucccagacucccagga

SEQ ID NO: 540167 - RNA, 22 nt, Human
agugacugacaccuguaauccc

SEQ ID NO: 540168 - RNA, 20 nt, Human
aauguucaguaauuguuuua

SEQ ID NO: 540169 - RNA, 22 nt, Human
aggcgcagaaggccaggggccu

SEQ ID NO: 540170 - RNA, 22 nt, Human
aggcagcuggaggcagagacua

SEQ ID NO: 540171 - RNA, 22 nt, Human
ccaggcucaccuggagccccug

SEQ ID NO: 540172 - RNA, 16 nt, Human
aggcucagaggcugga

SEQ ID NO: 540173 - RNA, 22 nt, Human
acagccagggucucaggaggcg

SEQ ID NO: 540174 - RNA, 22 nt, Human
auuucucagcacuuccuaucuc

SEQ ID NO: 540175 - RNA, 22 nt, Human
cucacagcacuugugucauugg

SEQ ID NO: 540176 - RNA, 22 nt, Human
gugugcaugcauagacaccaca

SEQ ID NO: 540177 - RNA, 22 nt, Human
uggacagguugaguaggaggag

SEQ ID NO: 540178 - RNA, 22 nt, Human
agcaggugacccaagcaggcug

SEQ ID NO: 540179 - RNA, 21 nt, Human
ucuguucaaggaacuacggau

SEQ ID NO: 540180 - RNA, 17 nt, Human
uuucuggaaugggcaaa

SEQ ID NO: 540181 - RNA, 22 nt, Human
cagagggcucuuggcugccugc

SEQ ID NO: 540182 - RNA, 22 nt, Human
gaagacauuaagucuaugucac

SEQ ID NO: 540183 - RNA, 22 nt, Human
uuguacagaaacugcauuugga

SEQ ID NO: 540184 - RNA, 22 nt, Human
uagggugcaugacaagaucccu

SEQ ID NO: 540185 - RNA, 22 nt, Human
uguuccuggaaagccagguggg

SEQ ID NO: 540186 - RNA, 23 nt, Human
ugcucugugaauaguuggugacu

SEQ ID NO: 540187 - RNA, 22 nt, Human
gggugggagucuggcccucaaa

SEQ ID NO: 540188 - RNA, 22 nt, Human
agaggagguccuuuucugaugu

SEQ ID NO: 540189 - RNA, 22 nt, Human
uccagaccauggauggcugcaa

SEQ ID NO: 540190 - RNA, 22 nt, Human
uuaguaauguguuaauaugaau

SEQ ID NO: 540191 - RNA, 22 nt, Human
gagaggugaauguggaugccac

SEQ ID NO: 540192 - RNA, 22 nt, Human
uggaccaacauucacuggcaua

SEQ ID NO: 540193 - RNA, 22 nt, Human
cucuccuggggagcacacacac

SEQ ID NO: 540194 - RNA, 22 nt, Human
cuuccagagauagggccucaag

SEQ ID NO: 540195 - RNA, 17 nt, Human
ucauuuguugugacuag

SEQ ID NO: 540196 - RNA, 22 nt, Human
ggccccacgggggaguccuagu

SEQ ID NO: 540197 - RNA, 19 nt, Human
ccuggcugugaagccugca

SEQ ID NO: 540198 - RNA, 22 nt, Human
agaguguuuuucugucaaggac

SEQ ID NO: 540199 - RNA, 22 nt, Human
uugaaacuuuaguaaacuaagg

SEQ ID NO: 540200 - RNA, 22 nt, Human
gagugugggcacgggggccuug

SEQ ID NO: 540201 - RNA, 22 nt, Human
cuaugagaagaaaacaagauua

SEQ ID NO: 540202 - RNA, 22 nt, Human
ucuggauggucagcucuuccug

SEQ ID NO: 540203 - RNA, 22 nt, Human
uuucccaaguguaaacauggca

SEQ ID NO: 540204 - RNA, 22 nt, Human
acuguggccugcuguaugggcu

SEQ ID NO: 540205 - RNA, 18 nt, Human
auccuugaugagaggucu

SEQ ID NO: 540206 - RNA, 22 nt, Human
cugaagcagggagugaugaagu

SEQ ID NO: 540207 - RNA, 22 nt, Human
ggcucuggugugaagcagccuc

SEQ ID NO: 540208 - RNA, 22 nt, Human
uacugcuuguuagcuguauuug

SEQ ID NO: 540209 - RNA, 22 nt, Human
agcaugaaagcauaggacaguc

SEQ ID NO: 540210 - RNA, 23 nt, Human
ccugaagggucaggguccucagc

SEQ ID NO: 540211 - RNA, 22 nt, Human
caagaaacuuuauucugccaua

SEQ ID NO: 540212 - RNA, 22 nt, Human
agucucugcugguugugccuau

SEQ ID NO: 540213 - RNA, 22 nt, Human
gcuguggaguacagagcugguu

SEQ ID NO: 540214 - RNA, 22 nt, Human
cggggagaacacuguguccuuc

SEQ ID NO: 540215 - RNA, 22 nt, Human
gggaggagcugagugugugugc

SEQ ID NO: 540216 - RNA, 22 nt, Human
ggguaauuggggccuugcagug

SEQ ID NO: 540217 - RNA, 20 nt, Human
ugaaggccauuuguuccaga

SEQ ID NO: 540218 - RNA, 22 nt, Human
aucaggaucugcaucauaagaa

SEQ ID NO: 540219 - RNA, 22 nt, Human
uucaacauagcugaggcauaua

SEQ ID NO: 540220 - RNA, 22 nt, Human
agagaugggaaggcagacuuca

SEQ ID NO: 540221 - RNA, 22 nt, Human
aacagaacuguuguucuggagg

SEQ ID NO: 540222 - RNA, 22 nt, Human
cagccaagaaccacagacccag

SEQ ID NO: 540223 - RNA, 22 nt, Human
ugucauuuuagugcaucacuca

SEQ ID NO: 540224 - RNA, 22 nt, Human
aaagugacaaccauuuauuaag

SEQ ID NO: 540225 - RNA, 22 nt, Human
gauauuuuuaguauuucugccu

SEQ ID NO: 540226 - RNA, 22 nt, Human
uucugugcccauuuuaaaaugg

SEQ ID NO: 540227 - RNA, 22 nt, Human
cugaggcaggagaauugcugga

SEQ ID NO: 540228 - RNA, 20 nt, Human
cugccaugauugauagagug

SEQ ID NO: 540229 - RNA, 22 nt, Human
ugggaacaguagcugcugagcu

SEQ ID NO: 540230 - RNA, 22 nt, Human
ugcaauaaguuguguuaucacu

SEQ ID NO: 540231 - RNA, 22 nt, Human
cugguacaaaaugcugauauca

SEQ ID NO: 540232 - RNA, 22 nt, Human
uguuugcacauucguuucaaua

SEQ ID NO: 540233 - RNA, 22 nt, Human
uagaaacagcauauauuagccc

SEQ ID NO: 540234 - RNA, 22 nt, Human
gcucccagucugauggaggaga

SEQ ID NO: 540235 - RNA, 22 nt, Human
gcagauggaaagugcuugaggg

SEQ ID NO: 540236 - RNA, 22 nt, Human
ugaggcaggagaaucaccggaa

SEQ ID NO: 540237 - RNA, 22 nt, Human
gcagcuggacccacacggcuua

SEQ ID NO: 540238 - RNA, 22 nt, Human
uggaggccagagguacugggac

SEQ ID NO: 540239 - RNA, 22 nt, Human
cugugugugucugcagcauacu

SEQ ID NO: 540240 - RNA, 19 nt, Human
uuugaaaggauuguuauuu

SEQ ID NO: 540241 - RNA, 22 nt, Human
ugcuucugaacucagcaugugg

SEQ ID NO: 540242 - RNA, 22 nt, Human
gaggucaucuguuuugguuacu

SEQ ID NO: 540243 - RNA, 22 nt, Human
gggaauuauagcugucacaggc

SEQ ID NO: 540244 - RNA, 22 nt, Human
uggaaugacagagagucugaau

SEQ ID NO: 540245 - RNA, 19 nt, Human
aaaaggagagaucagaguu

SEQ ID NO: 540246 - RNA, 22 nt, Human
agccuggagcuugaguuaugag

SEQ ID NO: 540247 - RNA, 22 nt, Human
uccuuuccaugcuucuagaggc

SEQ ID NO: 540248 - RNA, 18 nt, Human
caggaaccucuccuuuuu

SEQ ID NO: 540249 - RNA, 22 nt, Human
uuucagagcucuaggcucucag

SEQ ID NO: 540250 - RNA, 22 nt, Human
agaugcugcuccacaggccagg

SEQ ID NO: 540251 - RNA, 22 nt, Human
cagggcugaggacacaaguaaa

SEQ ID NO: 540252 - RNA, 22 nt, Human
ucagggcaaugucccucagaag

SEQ ID NO: 540253 - RNA, 22 nt, Human
cugagcaggacagugggagacc

SEQ ID NO: 540254 - RNA, 22 nt, Human
agggcuccgggcaggcgaugga

SEQ ID NO: 540255 - RNA, 22 nt, Human
gagcuuuaggagaaggagguca

SEQ ID NO: 540256 - RNA, 22 nt, Human
gguggggucacgacagagggaa

SEQ ID NO: 540257 - RNA, 22 nt, Human
ggaagaaagguggacaacaggu

SEQ ID NO: 540258 - RNA, 22 nt, Human
cuauaucauaaaucugaagagg

SEQ ID NO: 540259 - RNA, 22 nt, Human
guuccacaaaauguacccaguu

SEQ ID NO: 540260 - RNA, 22 nt, Human
agcccaaggcuucccugcuggc

SEQ ID NO: 540261 - RNA, 22 nt, Human
guccucuggugaaagcauuccc

SEQ ID NO: 540262 - RNA, 22 nt, Human
auaacccucuggauaggacagg

SEQ ID NO: 540263 - RNA, 22 nt, Human
augaaauaucuugaagaaauuc

SEQ ID NO: 540264 - RNA, 22 nt, Human
cagccucucuguaucucaggau

SEQ ID NO: 540265 - RNA, 22 nt, Human
ggcucaggacugcagcguagag

SEQ ID NO: 540266 - RNA, 22 nt, Human
acagaguccuagcugcaaagaa

SEQ ID NO: 540267 - RNA, 22 nt, Human
uugguucaaaacauggaagggu

SEQ ID NO: 540268 - RNA, 22 nt, Human
accuucaaguaugugggcugaa

SEQ ID NO: 540269 - RNA, 22 nt, Human
aaggccaugcacauccuaggca

SEQ ID NO: 540270 - RNA, 22 nt, Human
gagguagcaugcuggaagggac

SEQ ID NO: 540271 - RNA, 22 nt, Human
gugcaugaagacucagaaaguc

SEQ ID NO: 540272 - RNA, 22 nt, Human
uccagaccaugugagaggcgca

SEQ ID NO: 540273 - RNA, 22 nt, Human
auuaauuuuaccuuuguaaaca

SEQ ID NO: 540274 - RNA, 22 nt, Human
gggcagguggcaaagccagagg

SEQ ID NO: 540275 - RNA, 20 nt, Human
auugugaauacugcauaugu

SEQ ID NO: 540276 - RNA, 22 nt, Human
ucccauggucuauauagaggca

SEQ ID NO: 540277 - RNA, 22 nt, Human
aauauagauuuacucaagagaa

SEQ ID NO: 540278 - RNA, 19 nt, Human
uggcucugucgaaggcaca

SEQ ID NO: 540279 - RNA, 22 nt, Human
caggccuggcccccggcacacc

SEQ ID NO: 540280 - RNA, 22 nt, Human
gauaugaaguggcauugugaag

SEQ ID NO: 540281 - RNA, 22 nt, Human
aagagagagcauucuucuguua

SEQ ID NO: 540282 - RNA, 22 nt, Human
auuuccuaacagaggcaacagu

SEQ ID NO: 540283 - RNA, 22 nt, Human
agcacagaguugcagagagcgu

SEQ ID NO: 540284 - RNA, 22 nt, Human
ugcagucuuccagcugcacaaa

SEQ ID NO: 540285 - RNA, 22 nt, Human
aauguacaaaagucagccaacu

SEQ ID NO: 540286 - RNA, 18 nt, Human
gaaguuaguggugugcua

SEQ ID NO: 540287 - RNA, 23 nt, Human
acaacuuuacagauacauuuugu

SEQ ID NO: 540288 - RNA, 22 nt, Human
cggggcaggagucccuguagag

SEQ ID NO: 540289 - RNA, 22 nt, Human
acuguacuuacgcauauacagg

SEQ ID NO: 540290 - RNA, 22 nt, Human
ucagugcagaauagugaugcau

SEQ ID NO: 540291 - RNA, 22 nt, Human
ugccaggcugucaauucaccca

SEQ ID NO: 540292 - RNA, 21 nt, Human
ucugcccuccaggagcucaua

SEQ ID NO: 540293 - RNA, 22 nt, Human
uccagggaucuuuagagucuuu

SEQ ID NO: 540294 - RNA, 22 nt, Human
cagggguguuuuuggccaggag

SEQ ID NO: 540295 - RNA, 22 nt, Human
uuccagaaaguucuggaacugg

SEQ ID NO: 540296 - RNA, 22 nt, Human
uagauaauuuggcaucauauug

SEQ ID NO: 540297 - RNA, 22 nt, Human
gagagcuguaauagucaugucu

SEQ ID NO: 540298 - RNA, 22 nt, Human
cuggaacaguguuggagcuuga

SEQ ID NO: 540299 - RNA, 22 nt, Human
gagccugaauuugaccugcuua

SEQ ID NO: 540300 - RNA, 20 nt, Human
uugauaggcagcuugucagg

SEQ ID NO: 540301 - RNA, 22 nt, Human
gcuccccauugaucugcaggcu

SEQ ID NO: 540302 - RNA, 22 nt, Human
gcugcugggucccucugugcca

SEQ ID NO: 540303 - RNA, 22 nt, Human
agccaggauggucucgaucggc

SEQ ID NO: 540304 - RNA, 22 nt, Human
aauuauguggaagaggauuaaa

SEQ ID NO: 540305 - RNA, 22 nt, Human
uuuguuuagaugguaaaucagu

SEQ ID NO: 540306 - RNA, 22 nt, Human
cagaauggcuuuuauggcucag

SEQ ID NO: 540307 - RNA, 22 nt, Human
agauucuacucuagauccaugg

SEQ ID NO: 540308 - RNA, 22 nt, Human
gucacaggaagcagcaggcacu

SEQ ID NO: 540309 - RNA, 22 nt, Human
uccaugccaggcagucgaugca

SEQ ID NO: 540310 - RNA, 22 nt, Human
aucaggaugaagcuguagcgaa

SEQ ID NO: 540311 - RNA, 21 nt, Human
acuuuacaauuuacauaguga

SEQ ID NO: 540312 - RNA, 22 nt, Human
ggagugaggcauuuguagcuga

SEQ ID NO: 540313 - RNA, 22 nt, Human
uacaggcaugaaugaaaucugu

SEQ ID NO: 540314 - RNA, 22 nt, Human
auuucaugguacaucgugacuu

SEQ ID NO: 540315 - RNA, 22 nt, Human
ugucuagggagcugcucaggcu

SEQ ID NO: 540316 - RNA, 22 nt, Human
gagcaguggucugaucuucuaa

SEQ ID NO: 540317 - RNA, 22 nt, Human
auugaaagauauacuguucuca

SEQ ID NO: 540318 - RNA, 22 nt, Human
uucaaaacaaucuguuugcauu

SEQ ID NO: 540319 - RNA, 22 nt, Human
aaaguucaugguguuauagaaa

SEQ ID NO: 540320 - RNA, 22 nt, Human
agcugagcuaguaguuccagug

SEQ ID NO: 540321 - RNA, 22 nt, Human
ccagcuuuagguugccugccag

SEQ ID NO: 540322 - RNA, 22 nt, Human
cagaggcagccgggggagaacg

SEQ ID NO: 540323 - RNA, 22 nt, Human
acucugccccgaguucugggaa

SEQ ID NO: 540324 - RNA, 22 nt, Human
acauuucuuccuaauuaucccu

SEQ ID NO: 540325 - RNA, 22 nt, Human
guuuuguugcugcagagcucaa

SEQ ID NO: 540326 - RNA, 21 nt, Human
gcugugcacauaguagaagug

SEQ ID NO: 540327 - RNA, 22 nt, Human
gcaggccuccccugcuggagcu

SEQ ID NO: 540328 - RNA, 22 nt, Human
uuugacagcuuguuacaaaguu

SEQ ID NO: 540329 - RNA, 22 nt, Human
caauguuuuuccuuccuuaaua

SEQ ID NO: 540330 - RNA, 22 nt, Human
cuccagucauagucugucuugu

SEQ ID NO: 540331 - RNA, 22 nt, Human
uucuuguauguaugcaaaauca

SEQ ID NO: 540332 - RNA, 22 nt, Human
agaggucauaucucagaagaga

SEQ ID NO: 540333 - RNA, 22 nt, Human
aggcccaguccucugccgucug

SEQ ID NO: 540334 - RNA, 22 nt, Human
gugauucaaauguaacuaauua

SEQ ID NO: 540335 - RNA, 22 nt, Human
aguggauggucacugauccagu

SEQ ID NO: 540336 - RNA, 22 nt, Human
gcagagaggauauuauugucca

SEQ ID NO: 540337 - RNA, 22 nt, Human
uaggaacaguuucaggauguuu

SEQ ID NO: 540338 - RNA, 22 nt, Human
ccaaaguaaggcaauuccuaaa

SEQ ID NO: 540339 - RNA, 22 nt, Human
ucaguuuuaagguuugagaauu

SEQ ID NO: 540340 - RNA, 22 nt, Human
uauaacuaauacuggccaugag

SEQ ID NO: 540341 - RNA, 22 nt, Human
caauuuuacucuuccucuucca

SEQ ID NO: 540342 - RNA, 22 nt, Human
cauaacacauucaucagcagag

SEQ ID NO: 540343 - RNA, 22 nt, Human
ugggaggaucucuugaggccag

SEQ ID NO: 540344 - RNA, 22 nt, Human
cauuucauuccuuugaaagugg

SEQ ID NO: 540345 - RNA, 22 nt, Human
aaacauugcuaaauaaugcugc

SEQ ID NO: 540346 - RNA, 22 nt, Human
cauugcaccacauugcaucccu

SEQ ID NO: 540347 - RNA, 22 nt, Human
accuucagacaucaacuaucuc

SEQ ID NO: 540348 - RNA, 22 nt, Human
gggacuggaguagaggccggug

SEQ ID NO: 540349 - RNA, 22 nt, Human
agggggucguccggaagaccug

SEQ ID NO: 540350 - RNA, 22 nt, Human
ucacaguaucacacaaggauua

SEQ ID NO: 540351 - RNA, 22 nt, Human
gcuguccucugaucucuggagg

SEQ ID NO: 540352 - RNA, 22 nt, Human
aagagaaggauucugagccugg

SEQ ID NO: 540353 - RNA, 22 nt, Human
gccaggcuguggggaacuugaa

SEQ ID NO: 540354 - RNA, 22 nt, Human
guuuguaaccagaacagagagu

SEQ ID NO: 540355 - RNA, 22 nt, Human
uuuacagucucuauagucaaaa

SEQ ID NO: 540356 - RNA, 22 nt, Human
ccuguucagagcuaagcaucau

SEQ ID NO: 540357 - RNA, 22 nt, Human
uguccaaugcccuuuccacaug

SEQ ID NO: 540358 - RNA, 22 nt, Human
aagggcucucugcauugaaauu

SEQ ID NO: 540359 - RNA, 22 nt, Human
uguaaggagugugaguuugagu

SEQ ID NO: 540360 - RNA, 22 nt, Human
cugugggaugggaccucagcug

SEQ ID NO: 540361 - RNA, 22 nt, Human
ucagaauuuucuggaauggagc

SEQ ID NO: 540362 - RNA, 22 nt, Human
guacccaggcacgccuugcuga

SEQ ID NO: 540363 - RNA, 23 nt, Human
uagcagcauuuuuagccucuguc

SEQ ID NO: 540364 - RNA, 22 nt, Human
ugaggcaggaggauugcaggau

SEQ ID NO: 540365 - RNA, 22 nt, Human
cacaugacucuggcuacccaga

SEQ ID NO: 540366 - RNA, 21 nt, Human
ccugggcugugguuuggagac

SEQ ID NO: 540367 - RNA, 22 nt, Human
cagcuguucagcaacucgcaga

SEQ ID NO: 540368 - RNA, 22 nt, Human
ucaaaaguuucacauagagaua

SEQ ID NO: 540369 - RNA, 22 nt, Human
ugaaguaggcagcaugcugaga

SEQ ID NO: 540370 - RNA, 22 nt, Human
acugcccuguaacugccaggua

SEQ ID NO: 540371 - RNA, 22 nt, Human
ucuugaaagcauuuucuucauc

SEQ ID NO: 540372 - RNA, 22 nt, Human
uucuuucucacucuuuaggaag

SEQ ID NO: 540373 - RNA, 21 nt, Human
aggaagaucuggaggucggcg

SEQ ID NO: 540374 - RNA, 22 nt, Human
aauguuucguaaauugucuaug

SEQ ID NO: 540375 - RNA, 22 nt, Human
aagacauugcaugauaaugcug

SEQ ID NO: 540376 - RNA, 22 nt, Human
caggauccuggcugcauggacg

SEQ ID NO: 540377 - RNA, 22 nt, Human
uggcagaaguacacaagcaugc

SEQ ID NO: 540378 - RNA, 22 nt, Human
ggcaggcuugguggcaccgguu

SEQ ID NO: 540379 - RNA, 22 nt, Human
cgggcagcggcguggccauggu

SEQ ID NO: 540380 - RNA, 22 nt, Human
gagcuggcaggaggcuccccga

SEQ ID NO: 540381 - RNA, 22 nt, Human
uagaagacaggaaauacaaacc

SEQ ID NO: 540382 - RNA, 22 nt, Human
gcaaagaaugcagauuugccuc

SEQ ID NO: 540383 - RNA, 22 nt, Human
ugaccugcguaggugguuucug

SEQ ID NO: 540384 - RNA, 22 nt, Human
uucuaaacacuacgggauuugg

SEQ ID NO: 540385 - RNA, 22 nt, Human
gaaaacacuuugaucugaaagu

SEQ ID NO: 540386 - RNA, 22 nt, Human
uaagaacaucuguccccagauu

SEQ ID NO: 540387 - RNA, 22 nt, Human
aacuucauguaauuuaaaacag

SEQ ID NO: 540388 - RNA, 22 nt, Human
agcaguggcuggauggugugcu

SEQ ID NO: 540389 - RNA, 22 nt, Human
acgagguuggagaguuguuugg

SEQ ID NO: 540390 - RNA, 22 nt, Human
uuaaggaauuacgaaaauauuu

SEQ ID NO: 540391 - RNA, 22 nt, Human
ccucaugguacuuacuguagcu

SEQ ID NO: 540392 - RNA, 22 nt, Human
aucuagaaguggcaugaauuac

SEQ ID NO: 540393 - RNA, 22 nt, Human
aaggaaagauucucucucuaga

SEQ ID NO: 540394 - RNA, 22 nt, Human
aagaaauuaaugugccauuacu

SEQ ID NO: 540395 - RNA, 22 nt, Human
agcagagccugggcuaggggug

SEQ ID NO: 540396 - RNA, 22 nt, Human
caggguuucaccauguuagcag

SEQ ID NO: 540397 - RNA, 23 nt, Human
uugugggcagauuccauggggag

SEQ ID NO: 540398 - RNA, 22 nt, Human
aagcaaguucucaucauuuaua

SEQ ID NO: 540399 - RNA, 22 nt, Human
gcagaggaggacccaggaauua

SEQ ID NO: 540400 - RNA, 22 nt, Human
cauguuuucuaggcuuucacaa

SEQ ID NO: 540401 - RNA, 22 nt, Human
gcuggcaguguauuguuagcug

SEQ ID NO: 540402 - RNA, 22 nt, Human
gaguggagcaaaagagguagau

SEQ ID NO: 540403 - RNA, 22 nt, Human
acagguggcuuccauuuucuaa

SEQ ID NO: 540404 - RNA, 22 nt, Human
auucuggacaaugagaaacugg

SEQ ID NO: 540405 - RNA, 22 nt, Human
uggccacccagcugacgccuuc

SEQ ID NO: 540406 - RNA, 18 nt, Human
gagcugggagaaggaagg

SEQ ID NO: 540407 - RNA, 22 nt, Human
uuugcuaaauaagugauuaagu

SEQ ID NO: 540408 - RNA, 22 nt, Human
uccuggauggccugcaggcggu

SEQ ID NO: 540409 - RNA, 22 nt, Human
gcugucacucuccggccuuccc

SEQ ID NO: 540410 - RNA, 22 nt, Human
gcucugcucuaacauuccugac

SEQ ID NO: 540411 - RNA, 22 nt, Human
guccuuugaaggcaaaaggaga

SEQ ID NO: 540412 - RNA, 20 nt, Human
cagaaggucuaagcuuuaga

SEQ ID NO: 540413 - RNA, 22 nt, Human
uagaggcauaagagggaagcag

SEQ ID NO: 540414 - RNA, 22 nt, Human
ucccagggcacucacccucccu

SEQ ID NO: 540415 - RNA, 22 nt, Human
gcucugagagugggugauucug

SEQ ID NO: 540416 - RNA, 22 nt, Human
ggucauugucagagccuguacu

SEQ ID NO: 540417 - RNA, 22 nt, Human
agcuucuugggcuuuacacaaa

SEQ ID NO: 540418 - RNA, 22 nt, Human
gcccauggucagggaggcaggg

SEQ ID NO: 540419 - RNA, 22 nt, Human
cagggcagagggaaacuccuuu

SEQ ID NO: 540420 - RNA, 20 nt, Human
agccucugcccuucccacug

SEQ ID NO: 540421 - RNA, 22 nt, Human
aaaucuaggcucauccuggucc

SEQ ID NO: 540422 - RNA, 22 nt, Human
cauugacaguucuuuaaguugc

SEQ ID NO: 540423 - RNA, 22 nt, Human
gaggaagaaucaggguggugag

SEQ ID NO: 540424 - RNA, 22 nt, Human
aucuggcuuacgaagcacuggu

SEQ ID NO: 540425 - RNA, 22 nt, Human
gcacagggagacagccguggcc

SEQ ID NO: 540426 - RNA, 22 nt, Human
ugugccuuaugaauucuuucug

SEQ ID NO: 540427 - RNA, 22 nt, Human
auccaguucucagugcuuacag

SEQ ID NO: 540428 - RNA, 22 nt, Human
ugcaaaugggcaucuccaagug

SEQ ID NO: 540429 - RNA, 22 nt, Human
uuccaagugucagaucagauuu

SEQ ID NO: 540430 - RNA, 22 nt, Human
gccuggaguuguggugaagcca

SEQ ID NO: 540431 - RNA, 22 nt, Human
ccaaaguccauaguuuacauaa

SEQ ID NO: 540432 - RNA, 22 nt, Human
ugaagcuggaagcaugcagacu

SEQ ID NO: 540433 - RNA, 22 nt, Human
ggcagcucugcuccacaugagu

SEQ ID NO: 540434 - RNA, 22 nt, Human
agggucccgaaggagacagcaa

SEQ ID NO: 540435 - RNA, 22 nt, Human
guccucugacucagccuuggga

SEQ ID NO: 540436 - RNA, 22 nt, Human
aaggcagcucagcucauggcag

SEQ ID NO: 540437 - RNA, 22 nt, Human
agggcugcugcuccgggcccag

SEQ ID NO: 540438 - RNA, 21 nt, Human
aguguuaauggaaauuauauu

SEQ ID NO: 540439 - RNA, 22 nt, Human
ucaagagaagugcuccacagua

SEQ ID NO: 540440 - RNA, 22 nt, Human
gcagcugcuguggcaucaagcu

SEQ ID NO: 540441 - RNA, 22 nt, Human
gagcaagacuacaggcagauga

SEQ ID NO: 540442 - RNA, 22 nt, Human
ggcagugguuagaaacaugagc

SEQ ID NO: 540443 - RNA, 22 nt, Human
caaagucuucaguugauucuga

SEQ ID NO: 540444 - RNA, 22 nt, Human
cuggcagcccaaccuagagucu

SEQ ID NO: 540445 - RNA, 20 nt, Human
agccaggccucaaguuaagu

SEQ ID NO: 540446 - RNA, 22 nt, Human
auauuaggugcucaauacaugc

SEQ ID NO: 540447 - RNA, 22 nt, Human
aaauuucuaagcagccacuucc

SEQ ID NO: 540448 - RNA, 22 nt, Human
acagccuguguaccagcuggga

SEQ ID NO: 540449 - RNA, 22 nt, Human
ugaggcuuagagaagaugggau

SEQ ID NO: 540450 - RNA, 22 nt, Human
gggagcucucccugaggccugg

SEQ ID NO: 540451 - RNA, 22 nt, Human
uguggcagaaccagaauucaaa

SEQ ID NO: 540452 - RNA, 22 nt, Human
ggcuccucucuggccgcucccg

SEQ ID NO: 540453 - RNA, 22 nt, Human
caauagcagcuucugaaugcaa

SEQ ID NO: 540454 - RNA, 22 nt, Human
caaagccauagaguagauaaga

SEQ ID NO: 540455 - RNA, 22 nt, Human
cugugccuccaaguggucucug

SEQ ID NO: 540456 - RNA, 22 nt, Human
ucaauucaauugaacaguuacu

SEQ ID NO: 540457 - RNA, 22 nt, Human
gaucauuuugaugcccuuuuag

SEQ ID NO: 540458 - RNA, 22 nt, Human
cuuuggcaaugaaacacaagaa

SEQ ID NO: 540459 - RNA, 22 nt, Human
ugugcagcucuagagccaagcc

SEQ ID NO: 540460 - RNA, 22 nt, Human
accaucaagaccuuaucuaguu

SEQ ID NO: 540461 - RNA, 22 nt, Human
aauuucacauaaggcucauugg

SEQ ID NO: 540462 - RNA, 22 nt, Human
aguuucuugaagacugauguuu

SEQ ID NO: 540463 - RNA, 22 nt, Human
cugugcuucgcaacuccaaggu

SEQ ID NO: 540464 - RNA, 22 nt, Human
ggucaggguuccagguaucuuc

SEQ ID NO: 540465 - RNA, 23 nt, Human
ucggugggcguggaggccgaggc

SEQ ID NO: 540466 - RNA, 22 nt, Human
agagccugggaauuugcauguu

SEQ ID NO: 540467 - RNA, 22 nt, Human
uccuggccucacaguccugggu

SEQ ID NO: 540468 - RNA, 22 nt, Human
ucugucucaaguucuugcacuc

SEQ ID NO: 540469 - RNA, 22 nt, Human
acugccuguagcucuucaucuc

SEQ ID NO: 540470 - RNA, 22 nt, Human
uuauucugcacuuuuaaaauau

SEQ ID NO: 540471 - RNA, 22 nt, Human
aaguauauuuuuugaagcauau

SEQ ID NO: 540472 - RNA, 23 nt, Human
aagagcagggaauauuuauuugc

SEQ ID NO: 540473 - RNA, 22 nt, Human
cucagagucugcauuucuguca

SEQ ID NO: 540474 - RNA, 22 nt, Human
cagaguggcacucugcuggaug

SEQ ID NO: 540475 - RNA, 22 nt, Human
uugcacaguuugaagaugacuc

SEQ ID NO: 540476 - RNA, 22 nt, Human
aaaaguauuuauggcuauguaa

SEQ ID NO: 540477 - RNA, 22 nt, Human
guggcaggggcgggcuguuccg

SEQ ID NO: 540478 - RNA, 22 nt, Human
cagggcccaagacacaaugagg

SEQ ID NO: 540479 - RNA, 22 nt, Human
gcagggaagaucuuggagcugc

SEQ ID NO: 540480 - RNA, 22 nt, Human
ucaagagaaggggaaauagacu

SEQ ID NO: 540481 - RNA, 22 nt, Human
cuaguucuagaucccugaggaa

SEQ ID NO: 540482 - RNA, 22 nt, Human
cugggcagccucacacaauguu

SEQ ID NO: 540483 - RNA, 22 nt, Human
aggacagcagccauuggcaguc

SEQ ID NO: 540484 - RNA, 22 nt, Human
agagugaaguaauuguuaggau

SEQ ID NO: 540485 - RNA, 22 nt, Human
aaggguggauuucugagcucua

SEQ ID NO: 540486 - RNA, 22 nt, Human
gguuucaacucagcuaguaagg

SEQ ID NO: 540487 - RNA, 22 nt, Human
aaaucucaauuugaauuguagc

SEQ ID NO: 540488 - RNA, 22 nt, Human
gagcuuccauggacgccaucug

SEQ ID NO: 540489 - RNA, 23 nt, Human
uggcucagggucucuuaugaagu

SEQ ID NO: 540490 - RNA, 22 nt, Human
ucaugcuuuggguuagaaaccu

SEQ ID NO: 540491 - RNA, 22 nt, Human
aaaggaagauugagcuuuucca

SEQ ID NO: 540492 - RNA, 22 nt, Human
aaaucacuaaguuauagugugg

SEQ ID NO: 540493 - RNA, 22 nt, Human
acugugugcuggacaugauguu

SEQ ID NO: 540494 - RNA, 22 nt, Human
augaggcacaucacagccaaug

SEQ ID NO: 540495 - RNA, 22 nt, Human
gaggcugcuuugaugacaggag

SEQ ID NO: 540496 - RNA, 22 nt, Human
uuuuggcucugucuguaucuuu

SEQ ID NO: 540497 - RNA, 23 nt, Human
aacugagauaauguauguaaagc

SEQ ID NO: 540498 - RNA, 22 nt, Human
gggcagcauaacaaucacugaa

SEQ ID NO: 540499 - RNA, 22 nt, Human
uuuaagguggacaucuaaguca

SEQ ID NO: 540500 - RNA, 22 nt, Human
gggcuuggcacaugggcucagc

SEQ ID NO: 540501 - RNA, 22 nt, Human
aggaccugcuaaugugccaagu

SEQ ID NO: 540502 - RNA, 22 nt, Human
gcaggcucguuggaaguccccu

SEQ ID NO: 540503 - RNA, 22 nt, Human
cagcccuggccccagguggucu

SEQ ID NO: 540504 - RNA, 22 nt, Human
ugcagguggccaucuucguucu

SEQ ID NO: 540505 - RNA, 22 nt, Human
aagagcugcacauauuuauauc

SEQ ID NO: 540506 - RNA, 18 nt, Human
cagaaaguuauuuacucu

SEQ ID NO: 540507 - RNA, 22 nt, Human
aaacacagguacugcagaagug

SEQ ID NO: 540508 - RNA, 22 nt, Human
ucagagagguuggugauaagaa

SEQ ID NO: 540509 - RNA, 22 nt, Human
acagagcuguacaugugccaug

SEQ ID NO: 540510 - RNA, 22 nt, Human
agcaggugccagguguacccgc

SEQ ID NO: 540511 - RNA, 22 nt, Human
gccagcuggaaaucugcuugaa

SEQ ID NO: 540512 - RNA, 21 nt, Human
acucaggagacuaacuauguc

SEQ ID NO: 540513 - RNA, 22 nt, Human
ucgggcuccugcacuuggagac

SEQ ID NO: 540514 - RNA, 22 nt, Human
auuucauggcagacuuuaaccc

SEQ ID NO: 540515 - RNA, 22 nt, Human
uggcuccuucauucuccugcca

SEQ ID NO: 540516 - RNA, 21 nt, Human
ugagagccuccaaccggcuac

SEQ ID NO: 540517 - RNA, 22 nt, Human
cuugaucuacauagugaaaccc

SEQ ID NO: 540518 - RNA, 22 nt, Human
caggaaaauggaaucaccugua

SEQ ID NO: 540519 - RNA, 20 nt, Human
ccagcugagccaaggggaga

SEQ ID NO: 540520 - RNA, 17 nt, Human
uuauuuuuugggcugag

SEQ ID NO: 540521 - RNA, 22 nt, Human
ggaagccagaaagugagaauau

SEQ ID NO: 540522 - RNA, 22 nt, Human
gggagagagagcucauguugaa

SEQ ID NO: 540523 - RNA, 22 nt, Human
ucuguuuaggcaaaauagcuac

SEQ ID NO: 540524 - RNA, 22 nt, Human
gaggaaccugggcuuccauccu

SEQ ID NO: 540525 - RNA, 22 nt, Human
gggagggaagguaccuguguga

SEQ ID NO: 540526 - RNA, 19 nt, Human
agccuggcuuugcucugcu

SEQ ID NO: 540527 - RNA, 22 nt, Human
aagaaggcggaccagaagggag

SEQ ID NO: 540528 - RNA, 22 nt, Human
agguuuccagcauggggaaggc

SEQ ID NO: 540529 - RNA, 22 nt, Human
cauuuguaguuaaaaaugucuc

SEQ ID NO: 540530 - RNA, 22 nt, Human
uuggccuucucauuugcuuauu

SEQ ID NO: 540531 - RNA, 22 nt, Human
cacagaacaccaaagaaccuuc

SEQ ID NO: 540532 - RNA, 22 nt, Human
ggcaucaggaucugucuugcuu

SEQ ID NO: 540533 - RNA, 22 nt, Human
uccuggaguauuucuguggugu

SEQ ID NO: 540534 - RNA, 19 nt, Human
gggcacagccuccccccag

SEQ ID NO: 540535 - RNA, 22 nt, Human
cccuggcaaaacacucucuuga

SEQ ID NO: 540536 - RNA, 22 nt, Human
caggcugaucagggcugggaug

SEQ ID NO: 540537 - RNA, 22 nt, Human
aauagcuuuggucaccaucugg

SEQ ID NO: 540538 - RNA, 22 nt, Human
aggacagcccuugagagcacau

SEQ ID NO: 540539 - RNA, 22 nt, Human
cucuguagaaacagggcagaag

SEQ ID NO: 540540 - RNA, 22 nt, Human
cagagcauugagggucugccaa

SEQ ID NO: 540541 - RNA, 22 nt, Human
uggcagagccuugccaaacucc

SEQ ID NO: 540542 - RNA, 18 nt, Human
ucauagaagugaaucaga

SEQ ID NO: 540543 - RNA, 19 nt, Human
aggcagcacccaguccuug

SEQ ID NO: 540544 - RNA, 22 nt, Human
ccuggcagguggcgcccucggc

SEQ ID NO: 540545 - RNA, 22 nt, Human
ucccaagagcucugggauaagg

SEQ ID NO: 540546 - RNA, 22 nt, Human
ugccuuuucuguagcucuggaa

SEQ ID NO: 540547 - RNA, 22 nt, Human
ucuacuuuucccuauacaguuu

SEQ ID NO: 540548 - RNA, 19 nt, Human
cagaguacaccagauagga

SEQ ID NO: 540549 - RNA, 22 nt, Human
ucccagccauuccuuuaggugu

SEQ ID NO: 540550 - RNA, 19 nt, Human
ccuggcccugcugcgcggg

SEQ ID NO: 540551 - RNA, 22 nt, Human
gauuauuuugugcaauaaucgg

SEQ ID NO: 540552 - RNA, 22 nt, Human
guggcagucuuuggcaaugaca

SEQ ID NO: 540553 - RNA, 22 nt, Human
gcucagacucuggccugaugau

SEQ ID NO: 540554 - RNA, 22 nt, Human
aagggcagcuuaaauugguagc

SEQ ID NO: 540555 - RNA, 22 nt, Human
cagaaagaccugauuggcaguu

SEQ ID NO: 540556 - RNA, 22 nt, Human
cugaggcuggcguuugaggaag

SEQ ID NO: 540557 - RNA, 17 nt, Human
aggaagggcaaguuucu

SEQ ID NO: 540558 - RNA, 22 nt, Human
gagauaaugaugcuaacccagu

SEQ ID NO: 540559 - RNA, 22 nt, Human
ggaaggggucaccuccugauga

SEQ ID NO: 540560 - RNA, 22 nt, Human
aaguccagcagugcuuguugau

SEQ ID NO: 540561 - RNA, 22 nt, Human
agucucugugagcucccaaugg

SEQ ID NO: 540562 - RNA, 22 nt, Human
ccccaggacacauggaccaagu

SEQ ID NO: 540563 - RNA, 22 nt, Human
aguugcagacgcagagauguug

SEQ ID NO: 540564 - RNA, 22 nt, Human
uucagaaagugaaucuuguuau

SEQ ID NO: 540565 - RNA, 17 nt, Human
uucugagccacuuccuu

SEQ ID NO: 540566 - RNA, 22 nt, Human
uuuuuaucuuguaugugucucu

SEQ ID NO: 540567 - RNA, 22 nt, Human
agggcucugggguggcagagau

SEQ ID NO: 540568 - RNA, 22 nt, Human
uuugcauuacuugacuuuaguu

SEQ ID NO: 540569 - RNA, 22 nt, Human
agcuuuggagacugacuccauc

SEQ ID NO: 540570 - RNA, 22 nt, Human
uauauuaaaugaccaguuuuaa

SEQ ID NO: 540571 - RNA, 19 nt, Human
gaauguuuguauucagcgc

SEQ ID NO: 540572 - RNA, 22 nt, Human
aaacuuaguagaguucauauua

SEQ ID NO: 540573 - RNA, 22 nt, Human
aaagcccauguggaaguacagg

SEQ ID NO: 540574 - RNA, 22 nt, Human
ucaauucugcauacauuucacu

SEQ ID NO: 540575 - RNA, 22 nt, Human
uucuaugccauguucagcuacu

SEQ ID NO: 540576 - RNA, 22 nt, Human
ucuaagaaaucagaugaugagg

SEQ ID NO: 540577 - RNA, 22 nt, Human
agcugcagcguucauuuuucca

SEQ ID NO: 540578 - RNA, 22 nt, Human
uagaauaugugguguauacuuu

SEQ ID NO: 540579 - RNA, 22 nt, Human
gugcccuggcucacagugucuc

SEQ ID NO: 540580 - RNA, 22 nt, Human
ugcaggccggcccuaggccuca

SEQ ID NO: 540581 - RNA, 22 nt, Human
ccugcuucagggaugauggcac

SEQ ID NO: 540582 - RNA, 22 nt, Human
auuuagcaaaaaaugaugaagc

SEQ ID NO: 540583 - RNA, 22 nt, Human
aguaaaauuaauggaucagaag

SEQ ID NO: 540584 - RNA, 22 nt, Human
ugagugugcuaggugucucggu

SEQ ID NO: 540585 - RNA, 22 nt, Human
auuccaaaaggauguuagaaug

SEQ ID NO: 540586 - RNA, 22 nt, Human
cugcucugacccuuucaccuuc

SEQ ID NO: 540587 - RNA, 22 nt, Human
gauuucaaagguucugcaugcc

SEQ ID NO: 540588 - RNA, 22 nt, Human
uagcagagguaaguguggcaau

SEQ ID NO: 540589 - RNA, 22 nt, Human
cccagguguuuguggcagaggu

SEQ ID NO: 540590 - RNA, 22 nt, Human
accaugaugggaagcucagggc

SEQ ID NO: 540591 - RNA, 22 nt, Human
cugagaggcggagcuugcagug

SEQ ID NO: 540592 - RNA, 22 nt, Human
uggagaauucuauguugagggg

SEQ ID NO: 540593 - RNA, 22 nt, Human
gaggaagaaagcauaggugggg

SEQ ID NO: 540594 - RNA, 22 nt, Human
ccagggcaacgcugucucagag

SEQ ID NO: 540595 - RNA, 20 nt, Human
aggagaugauccagagucag

SEQ ID NO: 540596 - RNA, 20 nt, Human
agagagaccuaggccuaguc

SEQ ID NO: 540597 - RNA, 23 nt, Human
aaggggauacuuccacuuucuuu

SEQ ID NO: 540598 - RNA, 22 nt, Human
uacaguagaauuuuuaguaacu

SEQ ID NO: 540599 - RNA, 22 nt, Human
uuguucaugguuguaaguuuga

SEQ ID NO: 540600 - RNA, 22 nt, Human
aaauuagucgguuuaggaauuu

SEQ ID NO: 540601 - RNA, 18 nt, Human
uccuccuuuggccuuuuc

SEQ ID NO: 540602 - RNA, 22 nt, Human
cccaagcagggugcagaggcau

SEQ ID NO: 540603 - RNA, 22 nt, Human
caggguagacaguaggugucug

SEQ ID NO: 540604 - RNA, 23 nt, Human
agugcuggagaagcuucuggcuu

SEQ ID NO: 540605 - RNA, 22 nt, Human
cagccaugagucuaagcaguuu

SEQ ID NO: 540606 - RNA, 22 nt, Human
acugucuuccaggucuggaggu

SEQ ID NO: 540607 - RNA, 22 nt, Human
aggggccuggacauggacgcgc

SEQ ID NO: 540608 - RNA, 22 nt, Human
acagagucaugguagucaaagg

SEQ ID NO: 540609 - RNA, 22 nt, Human
uugguucagaugggaucugcga

SEQ ID NO: 540610 - RNA, 22 nt, Human
gagcugcacgcagcauccaaga

SEQ ID NO: 540611 - RNA, 22 nt, Human
ugcauuaugcuacccagaagcu

SEQ ID NO: 540612 - RNA, 22 nt, Human
gugccagggaguggaggagcuu

SEQ ID NO: 540613 - RNA, 22 nt, Human
uuucauucauguguuaaaggug

SEQ ID NO: 540614 - RNA, 22 nt, Human
gacagggcgagacucagucuca

SEQ ID NO: 540615 - RNA, 22 nt, Human
gccuccuggccuuugcuccuca

SEQ ID NO: 540616 - RNA, 22 nt, Human
uaccuguggcuuguuggaugga

SEQ ID NO: 540617 - RNA, 20 nt, Human
cuagccuggccuugcucugg

SEQ ID NO: 540618 - RNA, 18 nt, Human
guucaagccaacaucaag

SEQ ID NO: 540619 - RNA, 18 nt, Human
acauuuaggagagucaau

SEQ ID NO: 540620 - RNA, 22 nt, Human
uuuuguuuguguccacugcagu

SEQ ID NO: 540621 - RNA, 20 nt, Human
uucuugagccaaaaggcaua

SEQ ID NO: 540622 - RNA, 22 nt, Human
aacacauaggcagagcaugaca

SEQ ID NO: 540623 - RNA, 22 nt, Human
gacagaguuguugauguaugcu

SEQ ID NO: 540624 - RNA, 22 nt, Human
guugacagcuggugagcugcua

SEQ ID NO: 540625 - RNA, 18 nt, Human
gacaaaugcaauuuaaag

SEQ ID NO: 540626 - RNA, 22 nt, Human
agcuggcuuuugugaagguuuu

SEQ ID NO: 540627 - RNA, 22 nt, Human
ccaggccugauugggaaucuug

SEQ ID NO: 540628 - RNA, 22 nt, Human
ugcagggcaguuuguuucggca

SEQ ID NO: 540629 - RNA, 22 nt, Human
ugggccugaguuugggaacugg

SEQ ID NO: 540630 - RNA, 22 nt, Human
cuucucuucccagggacacagg

SEQ ID NO: 540631 - RNA, 22 nt, Human
cugcagcuuauuugcuguguga

SEQ ID NO: 540632 - RNA, 22 nt, Human
uuguccuuaccucaaucuggaa

SEQ ID NO: 540633 - RNA, 22 nt, Human
ccagccaguccagcauuggugu

SEQ ID NO: 540634 - RNA, 22 nt, Human
uuucugaauaacucuaugauau

SEQ ID NO: 540635 - RNA, 20 nt, Human
cagaggcauuuucagacucu

SEQ ID NO: 540636 - RNA, 22 nt, Human
gcucugagcacugugcggcugg

SEQ ID NO: 540637 - RNA, 22 nt, Human
cccaccccuggacaggugagug

SEQ ID NO: 540638 - RNA, 22 nt, Human
cagcaguguacaaggugucaga

SEQ ID NO: 540639 - RNA, 22 nt, Human
ucuucuuaugugccauuaucuc

SEQ ID NO: 540640 - RNA, 22 nt, Human
uuuucuuccuggauuuuggcau

SEQ ID NO: 540641 - RNA, 20 nt, Human
agaaaaaguguggaaauuuc

SEQ ID NO: 540642 - RNA, 22 nt, Human
uaaaaucaugacagauugacau

SEQ ID NO: 540643 - RNA, 22 nt, Human
gaaugaguagaguauaaacaaa

SEQ ID NO: 540644 - RNA, 19 nt, Human
ugcuaaguccuuuagaggc

SEQ ID NO: 540645 - RNA, 22 nt, Human
uccuuucaccaaaaaguguugu

SEQ ID NO: 540646 - RNA, 22 nt, Human
uugaagcagcucaggaggcuua

SEQ ID NO: 540647 - RNA, 22 nt, Human
cagagcagagugauuguucugg

SEQ ID NO: 540648 - RNA, 22 nt, Human
aguguuguaauaaauaucaucu

SEQ ID NO: 540649 - RNA, 22 nt, Human
augggcaguaacaguggcaguc

SEQ ID NO: 540650 - RNA, 22 nt, Human
aauaacaggguugauuugcaau

SEQ ID NO: 540651 - RNA, 22 nt, Human
ccugucugaggaggugcucuuu

SEQ ID NO: 540652 - RNA, 22 nt, Human
aaguguuuagguuugcagucga

SEQ ID NO: 540653 - RNA, 22 nt, Human
agaccaaagaaaacacaucugg

SEQ ID NO: 540654 - RNA, 22 nt, Human
guccucugcccaggucaagguu

SEQ ID NO: 540655 - RNA, 22 nt, Human
aagcaguaugguauuuaaguca

SEQ ID NO: 540656 - RNA, 22 nt, Human
uuucuuuuacaguguggcuauu

SEQ ID NO: 540657 - RNA, 22 nt, Human
agcugggcagacugcagugguu

SEQ ID NO: 540658 - RNA, 17 nt, Human
uguagcuucuccuucuc

SEQ ID NO: 540659 - RNA, 22 nt, Human
cuggggugagcagaaacagggg

SEQ ID NO: 540660 - RNA, 22 nt, Human
gaggcugcggggaggagccugc

SEQ ID NO: 540661 - RNA, 22 nt, Human
uuuaucuuuggaucuucagaaa

SEQ ID NO: 540662 - RNA, 22 nt, Human
cucaaguaauuagcaacaaaua

SEQ ID NO: 540663 - RNA, 22 nt, Human
gaggaaaauaacaacuaagggc

SEQ ID NO: 540664 - RNA, 22 nt, Human
cugcaggguuuuaacaauggac

SEQ ID NO: 540665 - RNA, 22 nt, Human
cuggaggcugaguugggucucc

SEQ ID NO: 540666 - RNA, 22 nt, Human
uguacaaugccgagacuaacuc

SEQ ID NO: 540667 - RNA, 18 nt, Human
cccagugcucacugccuc

SEQ ID NO: 540668 - RNA, 22 nt, Human
uuccaaagucauguugcugaua

SEQ ID NO: 540669 - RNA, 22 nt, Human
uuagaaaucaccucugaagauc

SEQ ID NO: 540670 - RNA, 22 nt, Human
cuggagugaggucugggagccu

SEQ ID NO: 540671 - RNA, 16 nt, Human
uaacauuuuuaaaagg

SEQ ID NO: 540672 - RNA, 22 nt, Human
accagccugucugagucguggg

SEQ ID NO: 540673 - RNA, 22 nt, Human
ugucccucauugacgcugugcc

SEQ ID NO: 540674 - RNA, 22 nt, Human
ccugccuguacuagagacccag

SEQ ID NO: 540675 - RNA, 22 nt, Human
ccuuuccuuuuuagugugggag

SEQ ID NO: 540676 - RNA, 22 nt, Human
aauguuuaauguuagugguaau

SEQ ID NO: 540677 - RNA, 22 nt, Human
cuugaaagcacuuaguaaauua

SEQ ID NO: 540678 - RNA, 22 nt, Human
agaucugaguggcugcauguaa

SEQ ID NO: 540679 - RNA, 18 nt, Human
aggcuucuuggcucaguc

SEQ ID NO: 540680 - RNA, 20 nt, Human
uucauucauuccacaacuuc

SEQ ID NO: 540681 - RNA, 22 nt, Human
gcuuuuuugcuauugaaguggu

SEQ ID NO: 540682 - RNA, 22 nt, Human
uggaaagaaaguaaaggcguau

SEQ ID NO: 540683 - RNA, 22 nt, Human
ugcuggcuuuuugugucaaaga

SEQ ID NO: 540684 - RNA, 22 nt, Human
uggcugagagcaauugacucug

SEQ ID NO: 540685 - RNA, 22 nt, Human
ccugggugacccgugagcgucc

SEQ ID NO: 540686 - RNA, 22 nt, Human
acagggcaugugcaagagacau

SEQ ID NO: 540687 - RNA, 22 nt, Human
uacuuuuuagcacagugugugc

SEQ ID NO: 540688 - RNA, 22 nt, Human
aggguagggcccggagacagac

SEQ ID NO: 540689 - RNA, 22 nt, Human
ucaacaguucuguccaauuaau

SEQ ID NO: 540690 - RNA, 22 nt, Human
cagagcaugaauaaaaguuaca

SEQ ID NO: 540691 - RNA, 22 nt, Human
aggcacugugcagucccaagca

SEQ ID NO: 540692 - RNA, 22 nt, Human
ucuugauuugaauugcaguugu

SEQ ID NO: 540693 - RNA, 22 nt, Human
gcuggcagugugaaugacaagc

SEQ ID NO: 540694 - RNA, 22 nt, Human
auaguuugaaggcuguucuacu

SEQ ID NO: 540695 - RNA, 22 nt, Human
ggggcugagucagugggaagag

SEQ ID NO: 540696 - RNA, 22 nt, Human
ggcagucagugugguucauaaa

SEQ ID NO: 540697 - RNA, 22 nt, Human
cauaugaaauaugaguugaaca

SEQ ID NO: 540698 - RNA, 22 nt, Human
aagaauguuaguuucugauaca

SEQ ID NO: 540699 - RNA, 22 nt, Human
acauguauugacauuauauucu

SEQ ID NO: 540700 - RNA, 22 nt, Human
aagaaugucguugguauuuuaa

SEQ ID NO: 540701 - RNA, 22 nt, Human
aaacugauaaaauaaguacauu

SEQ ID NO: 540702 - RNA, 22 nt, Human
aagcauuuuaguaaugaacuug

SEQ ID NO: 540703 - RNA, 22 nt, Human
gcugucuggguugagggcccug

SEQ ID NO: 540704 - RNA, 22 nt, Human
ugccaggcuaaguggaggacuu

SEQ ID NO: 540705 - RNA, 22 nt, Human
gagaugaauguaaacaaaggca

SEQ ID NO: 540706 - RNA, 22 nt, Human
cagagccccccuucugaucaca

SEQ ID NO: 540707 - RNA, 22 nt, Human
caaagugcugagauuacaggua

SEQ ID NO: 540708 - RNA, 22 nt, Human
aggagucacucagggcuucauc

SEQ ID NO: 540709 - RNA, 22 nt, Human
gaacccaggcuuuugaggcugu

SEQ ID NO: 540710 - RNA, 22 nt, Human
ggaggugguggcagugacaauu

SEQ ID NO: 540711 - RNA, 22 nt, Human
ugggcagagucauacaggagac

SEQ ID NO: 540712 - RNA, 22 nt, Human
auaacaugaccugugcuucaca

SEQ ID NO: 540713 - RNA, 22 nt, Human
gaucuuuaaggcuuacccugga

SEQ ID NO: 540714 - RNA, 23 nt, Human
ugcuggguaucagaaucacugag

SEQ ID NO: 540715 - RNA, 22 nt, Human
caguauucaucuaaggagcuug

SEQ ID NO: 540716 - RNA, 23 nt, Human
uggacccugcacaccagcucuac

SEQ ID NO: 540717 - RNA, 22 nt, Human
gaagagcuauguccagggagca

SEQ ID NO: 540718 - RNA, 22 nt, Human
cugcccuggcagccuaccaugg

SEQ ID NO: 540719 - RNA, 22 nt, Human
cuggagcucuguguguuccuga

SEQ ID NO: 540720 - RNA, 22 nt, Human
ucuccugcuucaacugauggac

SEQ ID NO: 540721 - RNA, 22 nt, Human
guggcauuaggccaggugcaua

SEQ ID NO: 540722 - RNA, 22 nt, Human
gauuucaaaaguagauccauca

SEQ ID NO: 540723 - RNA, 22 nt, Human
cacagacuugagaagcaccuua

SEQ ID NO: 540724 - RNA, 22 nt, Human
gacaaagcagacaagauaauuc

SEQ ID NO: 540725 - RNA, 22 nt, Human
uucuaagaaauggaaaacgauu

SEQ ID NO: 540726 - RNA, 22 nt, Human
ucucaguggcuuccucacuuuu

SEQ ID NO: 540727 - RNA, 22 nt, Human
uguucaaaugaucuucuuaaau

SEQ ID NO: 540728 - RNA, 18 nt, Human
ugaggcagucagugaugg

SEQ ID NO: 540729 - RNA, 22 nt, Human
aagugguaggaagagagcacug

SEQ ID NO: 540730 - RNA, 22 nt, Human
acuccagggcugaacgaggccc

SEQ ID NO: 540731 - RNA, 22 nt, Human
ugguagggacacuaugcagaaa

SEQ ID NO: 540732 - RNA, 22 nt, Human
aagcagagcaagcguauuuauu

SEQ ID NO: 540733 - RNA, 22 nt, Human
ucaguaaaugagcaaaaauuuc

SEQ ID NO: 540734 - RNA, 22 nt, Human
agggucagguuaagggagucau

SEQ ID NO: 540735 - RNA, 22 nt, Human
acaaaugugauuguuucugaaa

SEQ ID NO: 540736 - RNA, 22 nt, Human
acaaggcuaugaaguauuaguu

SEQ ID NO: 540737 - RNA, 22 nt, Human
ugccaggccacguagcuucaag

SEQ ID NO: 540738 - RNA, 22 nt, Human
auuuacagugugccuacuauau

SEQ ID NO: 540739 - RNA, 22 nt, Human
gccugcagccucaagggcugag

SEQ ID NO: 540740 - RNA, 22 nt, Human
aauaugcauguauacaugugua

SEQ ID NO: 540741 - RNA, 20 nt, Human
caaugcacacagcugcuucu

SEQ ID NO: 540742 - RNA, 22 nt, Human
cccuuccucccaggcuucugug

SEQ ID NO: 540743 - RNA, 22 nt, Human
gggacuguaaauucauauggcc

SEQ ID NO: 540744 - RNA, 22 nt, Human
gagccuggauugucaccgacuu

SEQ ID NO: 540745 - RNA, 22 nt, Human
aaacacaagaggcaggguacag

SEQ ID NO: 540746 - RNA, 19 nt, Human
aggacccuuauccuggcuu

SEQ ID NO: 540747 - RNA, 22 nt, Human
ggucagcagugcagggcagagc

SEQ ID NO: 540748 - RNA, 22 nt, Human
uucccacagagauuacauugaa

SEQ ID NO: 540749 - RNA, 22 nt, Human
ugaguguauaucaggagagagc

SEQ ID NO: 540750 - RNA, 22 nt, Human
ugaagcagagaauuugacaguc

SEQ ID NO: 540751 - RNA, 22 nt, Human
auuacagauagacuuugaagcu

SEQ ID NO: 540752 - RNA, 22 nt, Human
aacauuucagcaaauaagaaca

SEQ ID NO: 540753 - RNA, 22 nt, Human
uggagcugacucacaccagcua

SEQ ID NO: 540754 - RNA, 22 nt, Human
cugaccuguaacuguaagagac

SEQ ID NO: 540755 - RNA, 22 nt, Human
aaaagagaauccuguacagaga

SEQ ID NO: 540756 - RNA, 22 nt, Human
aucuggcucucucauuuacaaa

SEQ ID NO: 540757 - RNA, 23 nt, Human
gcagauggccccagagugcugcc

SEQ ID NO: 540758 - RNA, 22 nt, Human
ucuuuauuuaagucuguuguaa

SEQ ID NO: 540759 - RNA, 22 nt, Human
gugccaggugcuaagcugugcu

SEQ ID NO: 540760 - RNA, 22 nt, Human
gcccaggccggagagcagugcu

SEQ ID NO: 540761 - RNA, 22 nt, Human
agcacagaaaguauugacugaa

SEQ ID NO: 540762 - RNA, 22 nt, Human
ugcccagguuugagugcccaag

SEQ ID NO: 540763 - RNA, 22 nt, Human
uaaggccaccguuauagaacca

SEQ ID NO: 540764 - RNA, 22 nt, Human
acaugcauucucuaaaagcaaa

SEQ ID NO: 540765 - RNA, 18 nt, Human
gagcagaggaggguuuuu

SEQ ID NO: 540766 - RNA, 22 nt, Human
uugucuuaaauggauggacaau

SEQ ID NO: 540767 - RNA, 22 nt, Human
agaaaugacaagacugaucagg

SEQ ID NO: 540768 - RNA, 22 nt, Human
uuugucaaucccuugaaaaccu

SEQ ID NO: 540769 - RNA, 22 nt, Human
cccaggaaagagacugcugggu

SEQ ID NO: 540770 - RNA, 22 nt, Human
cuacauuuuucaccgagccucu

SEQ ID NO: 540771 - RNA, 22 nt, Human
ucagcuuuccuugcuuuagauu

SEQ ID NO: 540772 - RNA, 22 nt, Human
cugcacuguguaacagauaacu

SEQ ID NO: 540773 - RNA, 17 nt, Human
uuuucucucuuggauuc

SEQ ID NO: 540774 - RNA, 19 nt, Human
gcucugagaggggcauggg

SEQ ID NO: 540775 - RNA, 19 nt, Human
uugaaagauuagcuuucua

SEQ ID NO: 540776 - RNA, 22 nt, Human
gaaaggucuuccggucuuccag

SEQ ID NO: 540777 - RNA, 22 nt, Human
uuaaauuauuucuagugaggug

SEQ ID NO: 540778 - RNA, 22 nt, Human
gucagagcccccagcggcgcgg

SEQ ID NO: 540779 - RNA, 22 nt, Human
agcagagguuuguuggaaaccu

SEQ ID NO: 540780 - RNA, 22 nt, Human
aagaugguguggucaaggacca

SEQ ID NO: 540781 - RNA, 22 nt, Human
cugggcacauuuugacuagugu

SEQ ID NO: 540782 - RNA, 22 nt, Human
gagauggggucagcugggacau

SEQ ID NO: 540783 - RNA, 22 nt, Human
ccaggugugauuuggcaguguc

SEQ ID NO: 540784 - RNA, 22 nt, Human
aacaguuugccugaaauguauu

SEQ ID NO: 540785 - RNA, 22 nt, Human
uagaaacaugagagaaacucuu

SEQ ID NO: 540786 - RNA, 22 nt, Human
uuuaaaaguuaucaucugucca

SEQ ID NO: 540787 - RNA, 22 nt, Human
cuguuuuaucucaagaguucaa

SEQ ID NO: 540788 - RNA, 22 nt, Human
acuaaagaagccaaaguuuucu

SEQ ID NO: 540789 - RNA, 22 nt, Human
ugcagcagucagucaggccugg

SEQ ID NO: 540790 - RNA, 22 nt, Human
gcagaggagcaaguugcuacag

SEQ ID NO: 540791 - RNA, 22 nt, Human
cacucugcagcugaagggcugg

SEQ ID NO: 540792 - RNA, 22 nt, Human
augcccaaugucacaauuuuug

SEQ ID NO: 540793 - RNA, 22 nt, Human
aaaauagauaaugccaggguca

SEQ ID NO: 540794 - RNA, 22 nt, Human
acagagcauuugggacagagag

SEQ ID NO: 540795 - RNA, 22 nt, Human
acugaaauauuuagaagugaag

SEQ ID NO: 540796 - RNA, 22 nt, Human
cuuagggaaucuuagagcugga

SEQ ID NO: 540797 - RNA, 22 nt, Human
agcucccugagaugccacagca

SEQ ID NO: 540798 - RNA, 22 nt, Human
cauuucaccuuagagaauuauu

SEQ ID NO: 540799 - RNA, 22 nt, Human
gauauuuucgcagggagaauuc

SEQ ID NO: 540800 - RNA, 22 nt, Human
ccugucugcagauaucucaggu

SEQ ID NO: 540801 - RNA, 19 nt, Human
gucuuacaggcaacaugag

SEQ ID NO: 540802 - RNA, 22 nt, Human
cauaacuagagugaaauguuga

SEQ ID NO: 540803 - RNA, 21 nt, Human
gaaaagcaagggaguagaaca

SEQ ID NO: 540804 - RNA, 22 nt, Human
aacauuuauauggguucaugaa

SEQ ID NO: 540805 - RNA, 22 nt, Human
cacaugcaggagccaauguaca

SEQ ID NO: 540806 - RNA, 22 nt, Human
uauuaauucuugccaauucucc

SEQ ID NO: 540807 - RNA, 22 nt, Human
guaucuuuccacaucuucagua

SEQ ID NO: 540808 - RNA, 22 nt, Human
ccuguucaagguauuaauuauc

SEQ ID NO: 540809 - RNA, 22 nt, Human
ucuuuagcuagaaauacucuaa

SEQ ID NO: 540810 - RNA, 22 nt, Human
ugagguagaagccuggguugag

SEQ ID NO: 540811 - RNA, 22 nt, Human
caggaggcuuugggauccaagu

SEQ ID NO: 540812 - RNA, 22 nt, Human
ccaagcagaaccauucaggcac

SEQ ID NO: 540813 - RNA, 22 nt, Human
accaaaaccugcuacuaaagga

SEQ ID NO: 540814 - RNA, 22 nt, Human
uagugaaauuuaugcacagcua

SEQ ID NO: 540815 - RNA, 20 nt, Human
gcccacucuaauccacuguc

SEQ ID NO: 540816 - RNA, 22 nt, Human
gauuucuguaacacuucagaua

SEQ ID NO: 540817 - RNA, 22 nt, Human
caaagcaccacaaaccagguga

SEQ ID NO: 540818 - RNA, 22 nt, Human
ggcuggagugggcuccagaguu

SEQ ID NO: 540819 - RNA, 22 nt, Human
cagcccuggcuagggcgagggc

SEQ ID NO: 540820 - RNA, 23 nt, Human
ccugucugugcuggguggacaca

SEQ ID NO: 540821 - RNA, 22 nt, Human
guuacucuuccccggggucugg

SEQ ID NO: 540822 - RNA, 15 nt, Human
aggcacugugggacc

SEQ ID NO: 540823 - RNA, 22 nt, Human
cugcagcuccugagcucagaga

SEQ ID NO: 540824 - RNA, 22 nt, Human
uaaagguagugugacauauugu

SEQ ID NO: 540825 - RNA, 22 nt, Human
ugagaaagccuuuagucccagg

SEQ ID NO: 540826 - RNA, 22 nt, Human
acuugguguauuagcucucacu

SEQ ID NO: 540827 - RNA, 22 nt, Human
ugugaagaauuaaugugaauca

SEQ ID NO: 540828 - RNA, 22 nt, Human
ugggccuccugcccuggccuag

SEQ ID NO: 540829 - RNA, 22 nt, Human
cuucagcugacgucaaaacacc

SEQ ID NO: 540830 - RNA, 22 nt, Human
agugccuaaccccuuguaugaa

SEQ ID NO: 540831 - RNA, 22 nt, Human
ugcaggugauucugaugcaguu

SEQ ID NO: 540832 - RNA, 22 nt, Human
ugaaaauucaucucauagcaga

SEQ ID NO: 540833 - RNA, 22 nt, Human
gggucuccauguuaacaucacu

SEQ ID NO: 540834 - RNA, 22 nt, Human
cagcuuuauuaaugauugucuu

SEQ ID NO: 540835 - RNA, 22 nt, Human
agggccagaugaagccacaagc

SEQ ID NO: 540836 - RNA, 16 nt, Human
uacauucugaucacug

SEQ ID NO: 540837 - RNA, 22 nt, Human
auaggcaaauuaauaagucaua

SEQ ID NO: 540838 - RNA, 22 nt, Human
agguccaggauuuguggggucu

SEQ ID NO: 540839 - RNA, 22 nt, Human
uccccauggguggggacacaua

SEQ ID NO: 540840 - RNA, 22 nt, Human
cagcuggaucccugcagaacuu

SEQ ID NO: 540841 - RNA, 22 nt, Human
acucagagcagagcagccugag

SEQ ID NO: 540842 - RNA, 22 nt, Human
caggcacugugcaagggucucg

SEQ ID NO: 540843 - RNA, 22 nt, Human
cuugaaucuggcuuugccacuu

SEQ ID NO: 540844 - RNA, 22 nt, Human
ucaaggaaugacuauaugagga

SEQ ID NO: 540845 - RNA, 17 nt, Human
aggaaacauuuucuuuc

SEQ ID NO: 540846 - RNA, 22 nt, Human
ccugucucccuggcauggcuca

SEQ ID NO: 540847 - RNA, 22 nt, Human
uuucacauucucugguuaucga

SEQ ID NO: 540848 - RNA, 22 nt, Human
guucuggaguggugccaggccu

SEQ ID NO: 540849 - RNA, 22 nt, Human
gcuccugcagagauguuccaug

SEQ ID NO: 540850 - RNA, 22 nt, Human
cucuugcagauaccuugaagga

SEQ ID NO: 540851 - RNA, 22 nt, Human
acuuugugcccaacagaaagaa

SEQ ID NO: 540852 - RNA, 22 nt, Human
uauuucuuuucgugacuuauug

SEQ ID NO: 540853 - RNA, 22 nt, Human
ggcuggcucagggcuugagaga

SEQ ID NO: 540854 - RNA, 22 nt, Human
aguucaggcauaaggcaugaac

SEQ ID NO: 540855 - RNA, 15 nt, Human
uucaggauaugacuc

SEQ ID NO: 540856 - RNA, 22 nt, Human
uauagcaucuaggaugauugca

SEQ ID NO: 540857 - RNA, 23 nt, Human
ugguugcagugccaaguaucacg

SEQ ID NO: 540858 - RNA, 22 nt, Human
ucagauggauuuauacuauuuc

SEQ ID NO: 540859 - RNA, 22 nt, Human
aagaugcaugcugaagcuggcu

SEQ ID NO: 540860 - RNA, 22 nt, Human
caagagcuagaaauugguuaga

SEQ ID NO: 540861 - RNA, 18 nt, Human
ggagccagucugucucug

SEQ ID NO: 540862 - RNA, 22 nt, Human
cauuuagagaagauuacaagga

SEQ ID NO: 540863 - RNA, 21 nt, Human
uccucugcucucauaccacaa

SEQ ID NO: 540864 - RNA, 22 nt, Human
cugagaguauuggcaggcuugg

SEQ ID NO: 540865 - RNA, 23 nt, Human
uccugcugaaagcuccagcuggc

SEQ ID NO: 540866 - RNA, 22 nt, Human
guucauuuaggaaaggaagagu

SEQ ID NO: 540867 - RNA, 22 nt, Human
uuuccaaauaaggucacacuca

SEQ ID NO: 540868 - RNA, 22 nt, Human
cagcagcaacaacggaagccuu

SEQ ID NO: 540869 - RNA, 22 nt, Human
uccucccacauaggacaauggg

SEQ ID NO: 540870 - RNA, 22 nt, Human
uuacuuuguucucaagauaugu

SEQ ID NO: 540871 - RNA, 20 nt, Human
aggaaaaauggaaacuggag

SEQ ID NO: 540872 - RNA, 22 nt, Human
acagggccaggugagaggugcu

SEQ ID NO: 540873 - RNA, 22 nt, Human
agugcaaagggaucagauuggg

SEQ ID NO: 540874 - RNA, 22 nt, Human
uuucagagucuggcugcagccu

SEQ ID NO: 540875 - RNA, 22 nt, Human
agaugguucagaauuauaaaga

SEQ ID NO: 540876 - RNA, 22 nt, Human
ccacccugagccgcaagagcag

SEQ ID NO: 540877 - RNA, 22 nt, Human
agucugcacucagguggagguc

SEQ ID NO: 540878 - RNA, 22 nt, Human
agccacagagcaggagaccuuu

SEQ ID NO: 540879 - RNA, 22 nt, Human
cugggcacagacccccugggcc

SEQ ID NO: 540880 - RNA, 22 nt, Human
aaauuucuaagucaagaagaac

SEQ ID NO: 540881 - RNA, 22 nt, Human
uaggaagaugaguaucaacuug

SEQ ID NO: 540882 - RNA, 22 nt, Human
ugccagcccaccuuggggccuc

SEQ ID NO: 540883 - RNA, 23 nt, Human
guggagccacaucacaggcuccu

SEQ ID NO: 540884 - RNA, 22 nt, Human
ucuggcucagggcucugaggga

SEQ ID NO: 540885 - RNA, 22 nt, Human
ugguucaggcaggguguugcug

SEQ ID NO: 540886 - RNA, 17 nt, Human
uuguuucuucucugugg

SEQ ID NO: 540887 - RNA, 22 nt, Human
ccuggcagcccagagcgccgcu

SEQ ID NO: 540888 - RNA, 22 nt, Human
agggccuggcuucacuuucuca

SEQ ID NO: 540889 - RNA, 22 nt, Human
auaugcacauacauacauaggu

SEQ ID NO: 540890 - RNA, 22 nt, Human
gugcauuugacgaauacucacu

SEQ ID NO: 540891 - RNA, 22 nt, Human
gagcagugguugaacagaggca

SEQ ID NO: 540892 - RNA, 22 nt, Human
ugguuccuucugcauuuucagc

SEQ ID NO: 540893 - RNA, 19 nt, Human
ugucucagugucccuuccu

SEQ ID NO: 540894 - RNA, 21 nt, Human
agcaggugcuguuggaggaaa

SEQ ID NO: 540895 - RNA, 22 nt, Human
uggccugguuguugcugccguu

SEQ ID NO: 540896 - RNA, 22 nt, Human
cggagaggugggggcagcaucu

SEQ ID NO: 540897 - RNA, 22 nt, Human
ggucagggcucuuccaguggcu

SEQ ID NO: 540898 - RNA, 22 nt, Human
cugccucacauuggcuguguga

SEQ ID NO: 540899 - RNA, 22 nt, Human
uugcauugauguuccuucuugc

SEQ ID NO: 540900 - RNA, 22 nt, Human
uuuguacauauauaaaaucugu

SEQ ID NO: 540901 - RNA, 22 nt, Human
ugaaaucugucccacuuuagcu

SEQ ID NO: 540902 - RNA, 22 nt, Human
gcucaguguuucugguagaaaa

SEQ ID NO: 540903 - RNA, 22 nt, Human
ugggcagaggacagggaagauc

SEQ ID NO: 540904 - RNA, 22 nt, Human
uccucagugcuagccaacugcc

SEQ ID NO: 540905 - RNA, 22 nt, Human
gccugcagaggugcugcuagcu

SEQ ID NO: 540906 - RNA, 22 nt, Human
cugggccugguguggcaccugc

SEQ ID NO: 540907 - RNA, 22 nt, Human
cugucaaauucauaacacuuau

SEQ ID NO: 540908 - RNA, 22 nt, Human
aucacauucuuucaaagcaguc

SEQ ID NO: 540909 - RNA, 22 nt, Human
ugcuuuggccacuagaauucag

SEQ ID NO: 540910 - RNA, 22 nt, Human
uaugaacuuuugaugugacaug

SEQ ID NO: 540911 - RNA, 22 nt, Human
gggcugacaaucucuuuacuua

SEQ ID NO: 540912 - RNA, 22 nt, Human
gaagaacaagcagugcuuuccu

SEQ ID NO: 540913 - RNA, 22 nt, Human
cugguucaauggggcugagccc

SEQ ID NO: 540914 - RNA, 22 nt, Human
ggcagacacaaaaacauaaggu

SEQ ID NO: 540915 - RNA, 22 nt, Human
aaugacuuugaaauauuugagu

SEQ ID NO: 540916 - RNA, 22 nt, Human
gcagcuuuuuggaugucaguua

SEQ ID NO: 540917 - RNA, 22 nt, Human
caucugcugacuugacaaguac

SEQ ID NO: 540918 - RNA, 22 nt, Human
uggccugggccggcagauauac

SEQ ID NO: 540919 - RNA, 23 nt, Human
ugguggggucuuggagacagcac

SEQ ID NO: 540920 - RNA, 22 nt, Human
cugcaggcugagcgccugccgg

SEQ ID NO: 540921 - RNA, 22 nt, Human
cacugcuuuaaggcugaguaac

SEQ ID NO: 540922 - RNA, 21 nt, Human
guacacacagguggaugggcu

SEQ ID NO: 540923 - RNA, 22 nt, Human
aagccaggggcugcuuaggaga

SEQ ID NO: 540924 - RNA, 22 nt, Human
uuuagggaagaagcccauggcc

SEQ ID NO: 540925 - RNA, 22 nt, Human
ugagaaaauccagaggcuaguu

SEQ ID NO: 540926 - RNA, 22 nt, Human
aacuuucuccagugccaacuau

SEQ ID NO: 540927 - RNA, 22 nt, Human
aguggcagacacaaugugggca

SEQ ID NO: 540928 - RNA, 22 nt, Human
gugcuuucugcaugguuccuac

SEQ ID NO: 540929 - RNA, 22 nt, Human
ucuggggauaagacccagguau

SEQ ID NO: 540930 - RNA, 22 nt, Human
cuaacuuuagcuuagauuauca

SEQ ID NO: 540931 - RNA, 22 nt, Human
aaagguaguacuucuagaaggg

SEQ ID NO: 540932 - RNA, 22 nt, Human
cugggagcaccauacuuguuuc

SEQ ID NO: 540933 - RNA, 22 nt, Human
ucaaacauguuagcagucugug

SEQ ID NO: 540934 - RNA, 22 nt, Human
ucaggccuuugaacuuggagug

SEQ ID NO: 540935 - RNA, 22 nt, Human
aaucuucacagaaaaaugucug

SEQ ID NO: 540936 - RNA, 22 nt, Human
acuaaagaugucuaaauauauu

SEQ ID NO: 540937 - RNA, 22 nt, Human
gcugcuggagagcgagacuguu

SEQ ID NO: 540938 - RNA, 22 nt, Human
cgcaggcuccggggugcccugg

SEQ ID NO: 540939 - RNA, 17 nt, Human
ugguucuuuucauuccc

SEQ ID NO: 540940 - RNA, 22 nt, Human
gaaaggucaguuccacuuccau

SEQ ID NO: 540941 - RNA, 17 nt, Human
gcaguuaaauuaagaug

SEQ ID NO: 540942 - RNA, 22 nt, Human
gaggugugguccucagccccca

SEQ ID NO: 540943 - RNA, 22 nt, Human
uggcagagagacucuccuugau

SEQ ID NO: 540944 - RNA, 22 nt, Human
uggcccugccgcacuauccuca

SEQ ID NO: 540945 - RNA, 22 nt, Human
cauaaguuggguaauauaauga

SEQ ID NO: 540946 - RNA, 22 nt, Human
cucuuaaagcuuccaguuucaa

SEQ ID NO: 540947 - RNA, 22 nt, Human
gaaauauucuugucuuguuuuc

SEQ ID NO: 540948 - RNA, 22 nt, Human
ugaaacauuaggaaaucauuau

SEQ ID NO: 540949 - RNA, 22 nt, Human
acauccagaucucagcauggcu

SEQ ID NO: 540950 - RNA, 22 nt, Human
aagaacauuuaugauggcauuu

SEQ ID NO: 540951 - RNA, 22 nt, Human
gggcugaggaacauauuuuguu

SEQ ID NO: 540952 - RNA, 22 nt, Human
auuugucaaaacacagagaaca

SEQ ID NO: 540953 - RNA, 22 nt, Human
uugagggucuggaucugcugcu

SEQ ID NO: 540954 - RNA, 22 nt, Human
cucacaggagaaagucaugguc

SEQ ID NO: 540955 - RNA, 22 nt, Human
caauuucucgaacucuaaucca

SEQ ID NO: 540956 - RNA, 22 nt, Human
agggccaccucucuggguuccc

SEQ ID NO: 540957 - RNA, 22 nt, Human
aguggcugauguaggcaguggg

SEQ ID NO: 540958 - RNA, 19 nt, Human
augagcaauaguuuuaauc

SEQ ID NO: 540959 - RNA, 22 nt, Human
ugaaacaaaccaguaauuuugu

SEQ ID NO: 540960 - RNA, 22 nt, Human
cagggccaaguuggugccuuuu

SEQ ID NO: 540961 - RNA, 22 nt, Human
auggccaggcaccucuggcuga

SEQ ID NO: 540962 - RNA, 22 nt, Human
gaggagcaugggaaggcucugg

SEQ ID NO: 540963 - RNA, 18 nt, Human
uuugcaaaggaaguaugg

SEQ ID NO: 540964 - RNA, 22 nt, Human
acaacaaagacacuugaaauga

SEQ ID NO: 540965 - RNA, 22 nt, Human
ucacagugaugacgugggagca

SEQ ID NO: 540966 - RNA, 22 nt, Human
uuaugcaaaggggccucuuccu

SEQ ID NO: 540967 - RNA, 22 nt, Human
aagaacauguuaaaagauucac

SEQ ID NO: 540968 - RNA, 22 nt, Human
cuuaacauccugcauuuuucuu

SEQ ID NO: 540969 - RNA, 22 nt, Human
guguaucaaagcacagacuuca

SEQ ID NO: 540970 - RNA, 22 nt, Human
guuauuauuucucuccuugcua

SEQ ID NO: 540971 - RNA, 22 nt, Human
ugggaggaaugucacugagcca

SEQ ID NO: 540972 - RNA, 22 nt, Human
cagaggcuguguaggcagacug

SEQ ID NO: 540973 - RNA, 22 nt, Human
agcuuugggcagaagaggauuc

SEQ ID NO: 540974 - RNA, 22 nt, Human
aaucagcagaagagaggucuua

SEQ ID NO: 540975 - RNA, 23 nt, Human
uggggagaguuacccuggaagcg

SEQ ID NO: 540976 - RNA, 22 nt, Human
uucuggagggcaugcugcugcc

SEQ ID NO: 540977 - RNA, 20 nt, Human
gagauggacagaugaagggg

SEQ ID NO: 540978 - RNA, 22 nt, Human
cauguuuuguguacagaauauu

SEQ ID NO: 540979 - RNA, 22 nt, Human
uugaaacuuagaaauugagcug

SEQ ID NO: 540980 - RNA, 22 nt, Human
aguauacuccccauccuagaaa

SEQ ID NO: 540981 - RNA, 22 nt, Human
agaaugcauuuuguguagcuau

SEQ ID NO: 540982 - RNA, 22 nt, Human
agcuggcuucacaggcagugug

SEQ ID NO: 540983 - RNA, 22 nt, Human
ugcagcuucuuguccugugauu

SEQ ID NO: 540984 - RNA, 22 nt, Human
guuuauuauacaacaaaagcua

SEQ ID NO: 540985 - RNA, 22 nt, Human
auuaagggccaauccuccagcc

SEQ ID NO: 540986 - RNA, 22 nt, Human
aucacagagauugcuuuuaaaa

SEQ ID NO: 540987 - RNA, 22 nt, Human
cugcugaucgaaucagucaccc

SEQ ID NO: 540988 - RNA, 22 nt, Human
ucaccacugaacagaccuuugg

SEQ ID NO: 540989 - RNA, 22 nt, Human
agggcugccccaguccagccgg

SEQ ID NO: 540990 - RNA, 22 nt, Human
ggugggauggaggaucuuagac

SEQ ID NO: 540991 - RNA, 22 nt, Human
cagaaacuguuuguuaauauuu

SEQ ID NO: 540992 - RNA, 22 nt, Human
uguggccugggagcugaggucu

SEQ ID NO: 540993 - RNA, 22 nt, Human
aaauaagaaauucuucuuugca

SEQ ID NO: 540994 - RNA, 22 nt, Human
aaaagcaaguugccuagguuga

SEQ ID NO: 540995 - RNA, 22 nt, Human
augcugugauuguagaaauauu

SEQ ID NO: 540996 - RNA, 22 nt, Human
aauaauuagugggacagagaac

SEQ ID NO: 540997 - RNA, 18 nt, Human
gccugcaggcacgggggu

SEQ ID NO: 540998 - RNA, 22 nt, Human
guaacaaaggauaacuugguuu

SEQ ID NO: 540999 - RNA, 22 nt, Human
augcugcacaagccacauguag

SEQ ID NO: 541000 - RNA, 21 nt, Human
acuggcugguggcuaagaauc

SEQ ID NO: 541001 - RNA, 22 nt, Human
aagcugcagaugugccugugga

SEQ ID NO: 541002 - RNA, 22 nt, Human
ccuuuucuugccacugacucgg

SEQ ID NO: 541003 - RNA, 22 nt, Human
aggggcuccucucugagaguag

SEQ ID NO: 541004 - RNA, 22 nt, Human
gagcaggcuugcagagaagggg

SEQ ID NO: 541005 - RNA, 22 nt, Human
aucaggauccaccuugagccug

SEQ ID NO: 541006 - RNA, 22 nt, Human
caaagcaggaagaauauugaaa

SEQ ID NO: 541007 - RNA, 22 nt, Human
caguggaauauauaggggauuu

SEQ ID NO: 541008 - RNA, 22 nt, Human
ugucuucuguauucaagucuau

SEQ ID NO: 541009 - RNA, 22 nt, Human
ggcagguguuuuuauauuaaag

SEQ ID NO: 541010 - RNA, 22 nt, Human
gcucugucauuuugcagacacu

SEQ ID NO: 541011 - RNA, 20 nt, Human
cugcuguguuauuguagaac

SEQ ID NO: 541012 - RNA, 22 nt, Human
aucuggcucuuccuggaguucc

SEQ ID NO: 541013 - RNA, 20 nt, Human
uccagcugggaacagcugau

SEQ ID NO: 541014 - RNA, 23 nt, Human
uccucccugacuucuacagcaca

SEQ ID NO: 541015 - RNA, 23 nt, Human
aggcccaacucugugagggcugc

SEQ ID NO: 541016 - RNA, 19 nt, Human
acauauguggauauacaug

SEQ ID NO: 541017 - RNA, 22 nt, Human
ugguggacaccgcagccaugaa

SEQ ID NO: 541018 - RNA, 20 nt, Human
cagccuccacucacucagcu

SEQ ID NO: 541019 - RNA, 22 nt, Human
gugcagggcuggcaccggaggc

SEQ ID NO: 541020 - RNA, 22 nt, Human
uuuuacaagcugagucguuaaa

SEQ ID NO: 541021 - RNA, 22 nt, Human
agucugucuaauauuauucagg

SEQ ID NO: 541022 - RNA, 22 nt, Human
cuuaaaagagaugacggcaggg

SEQ ID NO: 541023 - RNA, 22 nt, Human
uccucuucugcccaucagaggc

SEQ ID NO: 541024 - RNA, 22 nt, Human
gaugcaggugugccacagagcu

SEQ ID NO: 541025 - RNA, 19 nt, Human
ccagucccauacaggagau

SEQ ID NO: 541026 - RNA, 22 nt, Human
uuccaacuuuaaaauucauucu

SEQ ID NO: 541027 - RNA, 22 nt, Human
ggaggaagugcaguucuacuac

SEQ ID NO: 541028 - RNA, 22 nt, Human
aaaugucaggugguggauggcu

SEQ ID NO: 541029 - RNA, 22 nt, Human
caggcucagccacaggggaagg

SEQ ID NO: 541030 - RNA, 22 nt, Human
ugccaggcuccggaacgacagu

SEQ ID NO: 541031 - RNA, 22 nt, Human
augccuuuuuaucauggaugau

SEQ ID NO: 541032 - RNA, 22 nt, Human
aggcccaguuauccuacuuguu

SEQ ID NO: 541033 - RNA, 22 nt, Human
ucugucuccucugaggugccag

SEQ ID NO: 541034 - RNA, 22 nt, Human
aaacugucauuggaugcauuug

SEQ ID NO: 541035 - RNA, 23 nt, Human
agcagggccagaauacuugcugu

SEQ ID NO: 541036 - RNA, 22 nt, Human
gcagaagcugggagaagggauu

SEQ ID NO: 541037 - RNA, 20 nt, Human
gcuuccuucccagcccccac

SEQ ID NO: 541038 - RNA, 22 nt, Human
acagaggccccgugggagagcc

SEQ ID NO: 541039 - RNA, 22 nt, Human
agaaucugaaggcaccucuggu

SEQ ID NO: 541040 - RNA, 22 nt, Human
gaggcugcccaacuggagugga

SEQ ID NO: 541041 - RNA, 22 nt, Human
ugcucucucaggccuggcccac

SEQ ID NO: 541042 - RNA, 22 nt, Human
gauucuuacuucuaagcaagcu

SEQ ID NO: 541043 - RNA, 17 nt, Human
agcugagcuggccaggg

SEQ ID NO: 541044 - RNA, 22 nt, Human
cuggagccccaggcugugcaga

SEQ ID NO: 541045 - RNA, 22 nt, Human
ugggccuguuucccuucagggc

SEQ ID NO: 541046 - RNA, 22 nt, Human
ucagccuggugauuccucuguc

SEQ ID NO: 541047 - RNA, 19 nt, Human
gguaaaagugagcuucagg

SEQ ID NO: 541048 - RNA, 22 nt, Human
uguuccuaaauaugaauggaga

SEQ ID NO: 541049 - RNA, 22 nt, Human
ucuuggagaauggcagagaagc

SEQ ID NO: 541050 - RNA, 22 nt, Human
uaggcuggaacuuaggcagagg

SEQ ID NO: 541051 - RNA, 20 nt, Human
uccuggccuucucgggcagu

SEQ ID NO: 541052 - RNA, 22 nt, Human
uuuuucagccaugaauuacacu

SEQ ID NO: 541053 - RNA, 22 nt, Human
acagagucgccuuguagcuggc

SEQ ID NO: 541054 - RNA, 22 nt, Human
gagcacaggcuuugguggacac

SEQ ID NO: 541055 - RNA, 22 nt, Human
aaguaccuagaaauauuuuuga

SEQ ID NO: 541056 - RNA, 22 nt, Human
uucagcuagcaucucacuuggu

SEQ ID NO: 541057 - RNA, 22 nt, Human
ugcagggauuagaggccgggga

SEQ ID NO: 541058 - RNA, 19 nt, Human
acuuucuccaggaccuguu

SEQ ID NO: 541059 - RNA, 22 nt, Human
agggccugggucuguacuccuc

SEQ ID NO: 541060 - RNA, 22 nt, Human
gcccuggugugcccagcauggg

SEQ ID NO: 541061 - RNA, 22 nt, Human
aacuggaauagcacaggaaaag

SEQ ID NO: 541062 - RNA, 22 nt, Human
cucucaggcuugggucguggca

SEQ ID NO: 541063 - RNA, 22 nt, Human
cacagguguaugaauaugucca

SEQ ID NO: 541064 - RNA, 19 nt, Human
gaauuauuuuuaugggaug

SEQ ID NO: 541065 - RNA, 22 nt, Human
ucagucauuguccuuaaaacac

SEQ ID NO: 541066 - RNA, 22 nt, Human
ccuggcagguuacaaccaguua

SEQ ID NO: 541067 - RNA, 22 nt, Human
gcagagugguuucagaguugag

SEQ ID NO: 541068 - RNA, 22 nt, Human
ccugucuggccuuccacggggg

SEQ ID NO: 541069 - RNA, 22 nt, Human
ugcugcaguguuugcugaaguu

SEQ ID NO: 541070 - RNA, 22 nt, Human
gcugcagcuguaggacacaauu

SEQ ID NO: 541071 - RNA, 22 nt, Human
aggaaaggauuggcuucucugu

SEQ ID NO: 541072 - RNA, 22 nt, Human
agcccucauggaacagcuccua

SEQ ID NO: 541073 - RNA, 22 nt, Human
cccuuuaaguccuggaacaaag

SEQ ID NO: 541074 - RNA, 22 nt, Human
gccaccagguuagauccagccu

SEQ ID NO: 541075 - RNA, 22 nt, Human
aauuucacuguggagcacauuu

SEQ ID NO: 541076 - RNA, 22 nt, Human
ugaggcaguauuuuagugacuu

SEQ ID NO: 541077 - RNA, 22 nt, Human
aaacuacacuuugggaccagca

SEQ ID NO: 541078 - RNA, 22 nt, Human
caaggaaaacagaugaucaaca

SEQ ID NO: 541079 - RNA, 22 nt, Human
ugggagcucagaaagggagguc

SEQ ID NO: 541080 - RNA, 22 nt, Human
uauuucuugagacucgucuucc

SEQ ID NO: 541081 - RNA, 22 nt, Human
cagcuugaaauauuaggagaug

SEQ ID NO: 541082 - RNA, 22 nt, Human
ccagagguccugcucacuggug

SEQ ID NO: 541083 - RNA, 22 nt, Human
gggcugugagaguggggcugcu

SEQ ID NO: 541084 - RNA, 22 nt, Human
uaggaaaagucuagauugauga

SEQ ID NO: 541085 - RNA, 22 nt, Human
ugcagcugcuggcccaggugcu

SEQ ID NO: 541086 - RNA, 22 nt, Human
ucagaaaagguagcugugacaa

SEQ ID NO: 541087 - RNA, 22 nt, Human
uaugaagacaaugauagcauga

SEQ ID NO: 541088 - RNA, 22 nt, Human
aagagcuguaugccauaugauu

SEQ ID NO: 541089 - RNA, 22 nt, Human
acccugcccucuccagcucagg

SEQ ID NO: 541090 - RNA, 22 nt, Human
uuuaucugaccucacuucuuaa

SEQ ID NO: 541091 - RNA, 22 nt, Human
cugaggccggagcacugaagag

SEQ ID NO: 541092 - RNA, 22 nt, Human
auucagagcacuggguagaauu

SEQ ID NO: 541093 - RNA, 22 nt, Human
ugaaggccucugguacaugcca

SEQ ID NO: 541094 - RNA, 22 nt, Human
uacaucaagauaaaaacuguca

SEQ ID NO: 541095 - RNA, 22 nt, Human
gcagagaccccgcagugaggcc

SEQ ID NO: 541096 - RNA, 22 nt, Human
uuuaaagaaauuccucaucuuu

SEQ ID NO: 541097 - RNA, 22 nt, Human
aagaauuuaaacuaaccauaug

SEQ ID NO: 541098 - RNA, 22 nt, Human
cacauuuagguuccuauagcca

SEQ ID NO: 541099 - RNA, 22 nt, Human
caggguccggcugccuggcugu

SEQ ID NO: 541100 - RNA, 22 nt, Human
aauguacagcugcugcugaagg

SEQ ID NO: 541101 - RNA, 22 nt, Human
aguuucuaccgguacauucagg

SEQ ID NO: 541102 - RNA, 22 nt, Human
gccugagcuacuagggagucug

SEQ ID NO: 541103 - RNA, 22 nt, Human
ugcaggcuuuagccccauggcu

SEQ ID NO: 541104 - RNA, 22 nt, Human
ggagcugcuuugaucugaagaa

SEQ ID NO: 541105 - RNA, 22 nt, Human
uagcauuuauggucaugugucc

SEQ ID NO: 541106 - RNA, 22 nt, Human
uaguggagguggucugugaacu

SEQ ID NO: 541107 - RNA, 22 nt, Human
aggccugacuugaauuuagggc

SEQ ID NO: 541108 - RNA, 21 nt, Human
ccuccaggagcagagcccuga

SEQ ID NO: 541109 - RNA, 22 nt, Human
uuaaaaucuaaagcaguugucu

SEQ ID NO: 541110 - RNA, 22 nt, Human
ucccagaaucuuuggaagagca

SEQ ID NO: 541111 - RNA, 22 nt, Human
cuucaaagggucacuauuuauc

SEQ ID NO: 541112 - RNA, 22 nt, Human
agcagcuuaucuuggagaggca

SEQ ID NO: 541113 - RNA, 22 nt, Human
ucuggcaggcaaucggcucugg

SEQ ID NO: 541114 - RNA, 22 nt, Human
cuuccaguaguaucauucucau

SEQ ID NO: 541115 - RNA, 22 nt, Human
uccucugcucagcauuccucac

SEQ ID NO: 541116 - RNA, 22 nt, Human
caguagcacucugucagugaag

SEQ ID NO: 541117 - RNA, 22 nt, Human
gcaguguuaggaauaaaaauga

SEQ ID NO: 541118 - RNA, 22 nt, Human
auauucuugugauuauaaagua

SEQ ID NO: 541119 - RNA, 22 nt, Human
uaaagucagggagauugaggcu

SEQ ID NO: 541120 - RNA, 17 nt, Human
aggcagcucagaacauc

SEQ ID NO: 541121 - RNA, 22 nt, Human
cagagcagguaucuuuggugaa

SEQ ID NO: 541122 - RNA, 22 nt, Human
ucucuguaguugggcagcugcu

SEQ ID NO: 541123 - RNA, 22 nt, Human
uggccuguggcuuaaggucugu

SEQ ID NO: 541124 - RNA, 22 nt, Human
uaaaauguagcuucuaggcugg

SEQ ID NO: 541125 - RNA, 22 nt, Human
ggaggccaccugaccugcuguu

SEQ ID NO: 541126 - RNA, 22 nt, Human
cccacccugggcuacacaucca

SEQ ID NO: 541127 - RNA, 22 nt, Human
agcucccaauugacuugaacua

SEQ ID NO: 541128 - RNA, 22 nt, Human
gguggccugcccugaucccugg

SEQ ID NO: 541129 - RNA, 22 nt, Human
aaugagaaccuugaaaggaacu

SEQ ID NO: 541130 - RNA, 22 nt, Human
aagccagccagugccagucuua

SEQ ID NO: 541131 - RNA, 22 nt, Human
uuacaguacagaaaauaacaga

SEQ ID NO: 541132 - RNA, 22 nt, Human
aggccuuccucggagacaggga

SEQ ID NO: 541133 - RNA, 22 nt, Human
uugaaacuaugaagacaaccau

SEQ ID NO: 541134 - RNA, 22 nt, Human
gaggaggaaacccuguuccucu

SEQ ID NO: 541135 - RNA, 22 nt, Human
uccucugcuggaagggcaagag

SEQ ID NO: 541136 - RNA, 15 nt, Human
ugggcagaucacuug

SEQ ID NO: 541137 - RNA, 22 nt, Human
cuagagaggcagauguccugug

SEQ ID NO: 541138 - RNA, 22 nt, Human
uacacaguauaugggaucacag

SEQ ID NO: 541139 - RNA, 22 nt, Human
cacagcuggggaagcugaggcc

SEQ ID NO: 541140 - RNA, 22 nt, Human
cauuaacacuuuggauuuagac

SEQ ID NO: 541141 - RNA, 22 nt, Human
gcugggagaggcagcuuucgga

SEQ ID NO: 541142 - RNA, 22 nt, Human
aauauaugacuccacugcauga

SEQ ID NO: 541143 - RNA, 22 nt, Human
cugagguguugaugaccuaugc

SEQ ID NO: 541144 - RNA, 22 nt, Human
gaggaaggcuaaggggcuuaga

SEQ ID NO: 541145 - RNA, 22 nt, Human
uaaaugugagugaugcggugaa

SEQ ID NO: 541146 - RNA, 22 nt, Human
ucuuuagagcucagaaauacag

SEQ ID NO: 541147 - RNA, 22 nt, Human
acacugaauauacaaugaauau

SEQ ID NO: 541148 - RNA, 20 nt, Human
gcugccagugccugaugcuu

SEQ ID NO: 541149 - RNA, 22 nt, Human
caguugaugggacucauguggg

SEQ ID NO: 541150 - RNA, 22 nt, Human
agggcuccgggccaccggccug

SEQ ID NO: 541151 - RNA, 22 nt, Human
gcagagcccuggggguauggug

SEQ ID NO: 541152 - RNA, 22 nt, Human
ugauuuccaguugcugggugcu

SEQ ID NO: 541153 - RNA, 22 nt, Human
auuugcaauuacucaugucauu

SEQ ID NO: 541154 - RNA, 18 nt, Human
ucugucuguacaaguauc

SEQ ID NO: 541155 - RNA, 18 nt, Human
uagaggggaagaccuuua

SEQ ID NO: 541156 - RNA, 22 nt, Human
cuacauuuguucuauagcuuuu

SEQ ID NO: 541157 - RNA, 22 nt, Human
aaggcacugacugugcagggga

SEQ ID NO: 541158 - RNA, 22 nt, Human
ugggccuggagcccuggagagu

SEQ ID NO: 541159 - RNA, 22 nt, Human
ccugagggaggguauaggcugu

SEQ ID NO: 541160 - RNA, 17 nt, Human
agguggguggaucaccu

SEQ ID NO: 541161 - RNA, 22 nt, Human
aacagcaauagcacuauucauu

SEQ ID NO: 541162 - RNA, 22 nt, Human
uuaauacaacuguugucacugg

SEQ ID NO: 541163 - RNA, 18 nt, Human
ggcagcaagaagggaggg

SEQ ID NO: 541164 - RNA, 22 nt, Human
guucaugcuacccuuuccuaau

SEQ ID NO: 541165 - RNA, 23 nt, Human
ucuggcugcuccuuucaaugcuc

SEQ ID NO: 541166 - RNA, 22 nt, Human
caagcugguaucagcuagagcg

SEQ ID NO: 541167 - RNA, 22 nt, Human
acagcuguauccccagagcuca

SEQ ID NO: 541168 - RNA, 22 nt, Human
agcccugcaggaugagggaggu

SEQ ID NO: 541169 - RNA, 22 nt, Human
aaacagauaaugcuauaaaugg

SEQ ID NO: 541170 - RNA, 22 nt, Human
auuauucaaucauauuaaaagu

SEQ ID NO: 541171 - RNA, 22 nt, Human
caggaaccuacaucuguuuggg

SEQ ID NO: 541172 - RNA, 22 nt, Human
cuggugucugcucccucacagc

SEQ ID NO: 541173 - RNA, 22 nt, Human
ugcuuucaaaggcuuucuagau

SEQ ID NO: 541174 - RNA, 22 nt, Human
aaaaugacauuccagugauauu

SEQ ID NO: 541175 - RNA, 22 nt, Human
agggaauguagcaagaugccaa

SEQ ID NO: 541176 - RNA, 22 nt, Human
cagauggccagaggcagcugca

SEQ ID NO: 541177 - RNA, 22 nt, Human
uuuaugaacuacagauauaacu

SEQ ID NO: 541178 - RNA, 22 nt, Human
uggaacacuuuguugaaaugca

SEQ ID NO: 541179 - RNA, 22 nt, Human
uuuauguaaguggaaugaugcc

SEQ ID NO: 541180 - RNA, 22 nt, Human
ucacagaagaugcuggauguug

SEQ ID NO: 541181 - RNA, 22 nt, Human
acacaucaugccaaguuucacc

SEQ ID NO: 541182 - RNA, 22 nt, Human
augugcaacuucagcagaaagg

SEQ ID NO: 541183 - RNA, 19 nt, Human
uuggaaggagccagagugg

SEQ ID NO: 541184 - RNA, 22 nt, Human
caaaaguucucacccagacaug

SEQ ID NO: 541185 - RNA, 22 nt, Human
aaucuuucccuauuaaaugugg

SEQ ID NO: 541186 - RNA, 22 nt, Human
ugcagaggugugcauucuuaag

SEQ ID NO: 541187 - RNA, 22 nt, Human
ucugggcccuaaaccagcucua

SEQ ID NO: 541188 - RNA, 22 nt, Human
ggcuuucuaugaacucaaaggc

SEQ ID NO: 541189 - RNA, 22 nt, Human
guauuccuaagucaugacaaau

SEQ ID NO: 541190 - RNA, 23 nt, Human
aauuaccaugcaacuugugaaac

SEQ ID NO: 541191 - RNA, 22 nt, Human
agacuucuugagcuggcacuuc

SEQ ID NO: 541192 - RNA, 22 nt, Human
uuguuuaaaagaaaucauagaa

SEQ ID NO: 541193 - RNA, 20 nt, Human
uauaacaguguugggugugu

SEQ ID NO: 541194 - RNA, 22 nt, Human
aggagaguucacacuggucaga

SEQ ID NO: 541195 - RNA, 22 nt, Human
aaggccuggauuuagguuguga

SEQ ID NO: 541196 - RNA, 22 nt, Human
ugggaaggacgugucaguggca

SEQ ID NO: 541197 - RNA, 22 nt, Human
ggagagguuauccguguuaugu

SEQ ID NO: 541198 - RNA, 22 nt, Human
gcagcuggcucagagagguggg

SEQ ID NO: 541199 - RNA, 22 nt, Human
cuguuuauacgacagguggagg

SEQ ID NO: 541200 - RNA, 22 nt, Human
uccucagacuucccuuugugua

SEQ ID NO: 541201 - RNA, 22 nt, Human
acauuucauuugcaguauggau

SEQ ID NO: 541202 - RNA, 19 nt, Human
cucugccucuggcuguggc

SEQ ID NO: 541203 - RNA, 22 nt, Human
gcugaagggagugcugagucug

SEQ ID NO: 541204 - RNA, 22 nt, Human
ccugccuggcuuccagaagaga

SEQ ID NO: 541205 - RNA, 22 nt, Human
agucucagaaaauaugcuuuuu

SEQ ID NO: 541206 - RNA, 22 nt, Human
augcacaugaggcaagcaaaau

SEQ ID NO: 541207 - RNA, 22 nt, Human
gcaauuauaucaccagagaucu

SEQ ID NO: 541208 - RNA, 22 nt, Human
uuuauguaauuucauaggugug

SEQ ID NO: 541209 - RNA, 22 nt, Human
cugugaauuaaguauuguuauc

SEQ ID NO: 541210 - RNA, 22 nt, Human
ugccucugcugcuguggcauca

SEQ ID NO: 541211 - RNA, 22 nt, Human
ucuucauuuuauagcaucugug

SEQ ID NO: 541212 - RNA, 19 nt, Human
cuaaggcaagaaacuggac

SEQ ID NO: 541213 - RNA, 22 nt, Human
ggugaggcccagugaucugugu

SEQ ID NO: 541214 - RNA, 18 nt, Human
gcaggugccacugcuguu

SEQ ID NO: 541215 - RNA, 22 nt, Human
cagaggcagaggucaucucugg

SEQ ID NO: 541216 - RNA, 22 nt, Human
ccuuuauucaauuaguccuaau

SEQ ID NO: 541217 - RNA, 22 nt, Human
aaagaagguagggcuggugacu

SEQ ID NO: 541218 - RNA, 22 nt, Human
aauucauccaugaacaauucca

SEQ ID NO: 541219 - RNA, 22 nt, Human
gagagaagaauguuccgaggcc

SEQ ID NO: 541220 - RNA, 22 nt, Human
uccugcagcauccgucgucugu

SEQ ID NO: 541221 - RNA, 19 nt, Human
ugagaggcuuaaggcagcu

SEQ ID NO: 541222 - RNA, 22 nt, Human
aaugcuuugacuauaucuauaa

SEQ ID NO: 541223 - RNA, 22 nt, Human
gagcuuuagcugagaccugcuu

SEQ ID NO: 541224 - RNA, 22 nt, Human
caggaaggcgcggcugugccug

SEQ ID NO: 541225 - RNA, 18 nt, Human
uuaagagcugaaagggga

SEQ ID NO: 541226 - RNA, 22 nt, Human
ugaggccuggacucugcaugga

SEQ ID NO: 541227 - RNA, 22 nt, Human
agcuggcauucuccuuguuauu

SEQ ID NO: 541228 - RNA, 22 nt, Human
auaucacaaacaagucuguacu

SEQ ID NO: 541229 - RNA, 22 nt, Human
uugcagcuuagugauguuaucu

SEQ ID NO: 541230 - RNA, 21 nt, Human
ugggaccuauuucaacuggau

SEQ ID NO: 541231 - RNA, 22 nt, Human
ccagcugcaggggagcagugga

SEQ ID NO: 541232 - RNA, 22 nt, Human
uccaguggagugugggggugaa

SEQ ID NO: 541233 - RNA, 22 nt, Human
cuccugggaauuuaguugugag

SEQ ID NO: 541234 - RNA, 22 nt, Human
aggcugagcugguagugaguac

SEQ ID NO: 541235 - RNA, 22 nt, Human
accuucaaugaaaauaauaguc

SEQ ID NO: 541236 - RNA, 22 nt, Human
aucagaaaauacccaguguuua

SEQ ID NO: 541237 - RNA, 20 nt, Human
ggccuuggguuucgccuguu

SEQ ID NO: 541238 - RNA, 22 nt, Human
aggagcccugcgggaggcagag

SEQ ID NO: 541239 - RNA, 23 nt, Human
aggagacagggaagugccuggcu

SEQ ID NO: 541240 - RNA, 22 nt, Human
uacaagguuguacuuucucucu

SEQ ID NO: 541241 - RNA, 20 nt, Human
ugggccugagccugugggcu

SEQ ID NO: 541242 - RNA, 22 nt, Human
gcuggaccaggugugcacaggc

SEQ ID NO: 541243 - RNA, 22 nt, Human
agcugggccugagcuggaagcu

SEQ ID NO: 541244 - RNA, 23 nt, Human
uucacagauuaaauauuucuucu

SEQ ID NO: 541245 - RNA, 22 nt, Human
uuguggaaauacagacuccaag

SEQ ID NO: 541246 - RNA, 22 nt, Human
cagagccaggguugcaccccug

SEQ ID NO: 541247 - RNA, 22 nt, Human
uaagacaugguugaucuagugu

SEQ ID NO: 541248 - RNA, 22 nt, Human
aaggcugaguaaaacagagaac

SEQ ID NO: 541249 - RNA, 22 nt, Human
agucugggagaaggugagauua

SEQ ID NO: 541250 - RNA, 19 nt, Human
ggcucucccuugagagagc

SEQ ID NO: 541251 - RNA, 22 nt, Human
acccugggcuuggccugcucag

SEQ ID NO: 541252 - RNA, 22 nt, Human
agcaauauuuaaagguuugcaa

SEQ ID NO: 541253 - RNA, 22 nt, Human
uuagaauuauuguuuccuucua

SEQ ID NO: 541254 - RNA, 22 nt, Human
guagggacuuguuuuacuagua

SEQ ID NO: 541255 - RNA, 22 nt, Human
ccuuucaaaacagaacacuagc

SEQ ID NO: 541256 - RNA, 22 nt, Human
cugaggcucaagggcagguggg

SEQ ID NO: 541257 - RNA, 20 nt, Human
agugucugggccucaggccc

SEQ ID NO: 541258 - RNA, 22 nt, Human
ugcugccacauuuaaagagggg

SEQ ID NO: 541259 - RNA, 22 nt, Human
auaugggggggcgugcagagga

SEQ ID NO: 541260 - RNA, 22 nt, Human
aagauuuccuggauguaauucc

SEQ ID NO: 541261 - RNA, 22 nt, Human
gccuaacuuggcuuuguucacc

SEQ ID NO: 541262 - RNA, 22 nt, Human
agcucagcgggcuucugguaag

SEQ ID NO: 541263 - RNA, 22 nt, Human
ucagcaggcacggacaggcugc

SEQ ID NO: 541264 - RNA, 22 nt, Human
cagucccaccaggaucgcucuu

SEQ ID NO: 541265 - RNA, 22 nt, Human
gcaggaagcauagaagaaugcc

SEQ ID NO: 541266 - RNA, 22 nt, Human
ggccucucuccagucagugcag

SEQ ID NO: 541267 - RNA, 22 nt, Human
ucaaaaauguuuuauauuggua

SEQ ID NO: 541268 - RNA, 22 nt, Human
auggauaagucaaagaguaucc

SEQ ID NO: 541269 - RNA, 22 nt, Human
aaaaaccuuucauugcaaaugu

SEQ ID NO: 541270 - RNA, 19 nt, Human
cauauuuuugggcuggcau

SEQ ID NO: 541271 - RNA, 22 nt, Human
agugguaacuaaguccugcuua

SEQ ID NO: 541272 - RNA, 22 nt, Human
uggccugccccgagauccuggc

SEQ ID NO: 541273 - RNA, 22 nt, Human
uaacaaaguaccauagacugga

SEQ ID NO: 541274 - RNA, 22 nt, Human
gugggguguccagcagcgagcu

SEQ ID NO: 541275 - RNA, 22 nt, Human
aucugcuugcccucuuaggacc

SEQ ID NO: 541276 - RNA, 22 nt, Human
uugggccucacucuagaaggca

SEQ ID NO: 541277 - RNA, 19 nt, Human
cuuuucaagccaucaguuu

SEQ ID NO: 541278 - RNA, 22 nt, Human
gagggagagugauggaccauug

SEQ ID NO: 541279 - RNA, 22 nt, Human
agagaauuacagaagaauguca

SEQ ID NO: 541280 - RNA, 22 nt, Human
ucugccuggaugauggcagggc

SEQ ID NO: 541281 - RNA, 20 nt, Human
ggcaggcuuuauauggaggg

SEQ ID NO: 541282 - RNA, 22 nt, Human
gcaguccaaaguggcucucacc

SEQ ID NO: 541283 - RNA, 20 nt, Human
ggaaaaaugcaugcucaaga

SEQ ID NO: 541284 - RNA, 22 nt, Human
ugcaaaugaguugcagaucagg

SEQ ID NO: 541285 - RNA, 22 nt, Human
cccaggucugccagccuguggg

SEQ ID NO: 541286 - RNA, 22 nt, Human
auucacagagugguuaguggua

SEQ ID NO: 541287 - RNA, 22 nt, Human
guacuagaugagacagcguggg

SEQ ID NO: 541288 - RNA, 22 nt, Human
ugaggcagccugcauuaaagag

SEQ ID NO: 541289 - RNA, 22 nt, Human
uucaaaggcaggauagcagcug

SEQ ID NO: 541290 - RNA, 22 nt, Human
uuaugcuaguugaaauaacaca

SEQ ID NO: 541291 - RNA, 22 nt, Human
aggcucagugcaaaucauucug

SEQ ID NO: 541292 - RNA, 22 nt, Human
aauguuucuggauauugugggu

SEQ ID NO: 541293 - RNA, 22 nt, Human
auuuguuccacacauauuuacu

SEQ ID NO: 541294 - RNA, 22 nt, Human
ggccugcuauuggugggcagac

SEQ ID NO: 541295 - RNA, 22 nt, Human
ccaccuccaccuauugccagcc

SEQ ID NO: 541296 - RNA, 22 nt, Human
aaauucagcagugaaaugcccc

SEQ ID NO: 541297 - RNA, 22 nt, Human
cagagcugggcauggugaaagg

SEQ ID NO: 541298 - RNA, 19 nt, Human
auucuucagcagugagacc

SEQ ID NO: 541299 - RNA, 22 nt, Human
agugggaggcggcugacgggcg

SEQ ID NO: 541300 - RNA, 22 nt, Human
gcagggaccuugcccacccucc

SEQ ID NO: 541301 - RNA, 22 nt, Human
aucaggauagugguuaccuggg

SEQ ID NO: 541302 - RNA, 22 nt, Human
aggugggcaaugaggccugagu

SEQ ID NO: 541303 - RNA, 22 nt, Human
ugaggcucagagaagugcuguu

SEQ ID NO: 541304 - RNA, 22 nt, Human
uucccaagucuccaauguggga

SEQ ID NO: 541305 - RNA, 22 nt, Human
ucagaggagaugguuaccaggg

SEQ ID NO: 541306 - RNA, 22 nt, Human
ucauuucaaguucugacagcua

SEQ ID NO: 541307 - RNA, 19 nt, Human
auggaaaauuguacucaau

SEQ ID NO: 541308 - RNA, 22 nt, Human
gaguuaauacugaguuuauuaa

SEQ ID NO: 541309 - RNA, 22 nt, Human
gaagaagcaggaguguguagca

SEQ ID NO: 541310 - RNA, 22 nt, Human
cauuugcagagggugacacucu

SEQ ID NO: 541311 - RNA, 22 nt, Human
cuuggcagagggcugggcucag

SEQ ID NO: 541312 - RNA, 22 nt, Human
guauuuuuaguagagucggggu

SEQ ID NO: 541313 - RNA, 22 nt, Human
aagacauugucauuuuauaauu

SEQ ID NO: 541314 - RNA, 22 nt, Human
gcaagcaagcagguagagcuga

SEQ ID NO: 541315 - RNA, 22 nt, Human
ugguuuauuucucugaaagguu

SEQ ID NO: 541316 - RNA, 22 nt, Human
aguuucaauucuuuucacaaag

SEQ ID NO: 541317 - RNA, 19 nt, Human
ucauuguugguuugucggg

SEQ ID NO: 541318 - RNA, 18 nt, Human
gagucuuuguuacugcug

SEQ ID NO: 541319 - RNA, 22 nt, Human
acacagaugcauuacacaucua

SEQ ID NO: 541320 - RNA, 22 nt, Human
aggggcugacuggaaagugcca

SEQ ID NO: 541321 - RNA, 22 nt, Human
ccagaugggcuuuagcaaauga

SEQ ID NO: 541322 - RNA, 22 nt, Human
aaauuuguauuccuuuuccgua

SEQ ID NO: 541323 - RNA, 22 nt, Human
cagggcucccaaauaucucuuc

SEQ ID NO: 541324 - RNA, 20 nt, Human
aauguuucugaacagguagu

SEQ ID NO: 541325 - RNA, 22 nt, Human
auugcaaagcguagacucuaaa

SEQ ID NO: 541326 - RNA, 22 nt, Human
aaggccuuucuuaucaguagau

SEQ ID NO: 541327 - RNA, 22 nt, Human
gaagaggaugacaggagccggu

SEQ ID NO: 541328 - RNA, 22 nt, Human
gccaccuggacagcugugcccu

SEQ ID NO: 541329 - RNA, 22 nt, Human
caaagguaguauauauauuguu

SEQ ID NO: 541330 - RNA, 22 nt, Human
ugggcucagaagauaguuucca

SEQ ID NO: 541331 - RNA, 22 nt, Human
gauuucuuuaugaaguacagaa

SEQ ID NO: 541332 - RNA, 22 nt, Human
ucugccuggauuuuggaaagcu

SEQ ID NO: 541333 - RNA, 18 nt, Human
gcuuuauuucuuggggaa

SEQ ID NO: 541334 - RNA, 22 nt, Human
aggccuggccccaguugcuagg

SEQ ID NO: 541335 - RNA, 22 nt, Human
aaaagacauaugugggcauucu

SEQ ID NO: 541336 - RNA, 22 nt, Human
gcuggugcauuagcugcaguuc

SEQ ID NO: 541337 - RNA, 22 nt, Human
uguuuuuaaauaaugauagaaa

SEQ ID NO: 541338 - RNA, 22 nt, Human
aaucaguuguccaaaguucaca

SEQ ID NO: 541339 - RNA, 22 nt, Human
augaaaugucuggaucuuuuuc

SEQ ID NO: 541340 - RNA, 22 nt, Human
uggcagcaaaaccagaaucaga

SEQ ID NO: 541341 - RNA, 19 nt, Human
ccacacagugugcaauuua

SEQ ID NO: 541342 - RNA, 22 nt, Human
agugggagccagcagcuugggg

SEQ ID NO: 541343 - RNA, 22 nt, Human
gcugggcugcgucggggaagcc

SEQ ID NO: 541344 - RNA, 22 nt, Human
acagauuuuugguaaauaauuu

SEQ ID NO: 541345 - RNA, 20 nt, Human
cugcccugcccuggguccug

SEQ ID NO: 541346 - RNA, 19 nt, Human
agcagcuggagguggagug

SEQ ID NO: 541347 - RNA, 22 nt, Human
aagcacaguucuuagaguuaca

SEQ ID NO: 541348 - RNA, 22 nt, Human
uaggcugggaagaaagauucuc

SEQ ID NO: 541349 - RNA, 22 nt, Human
aaacaucaauugcaucucccaa

SEQ ID NO: 541350 - RNA, 22 nt, Human
gguggggccugcuccagcggcc

SEQ ID NO: 541351 - RNA, 22 nt, Human
ggcaggugcucaaaaauauuug

SEQ ID NO: 541352 - RNA, 22 nt, Human
ugaagagauagaaguacaugcu

SEQ ID NO: 541353 - RNA, 22 nt, Human
gcuguggccgucagggaaaugg

SEQ ID NO: 541354 - RNA, 22 nt, Human
gcagcucuccucugugaggaac

SEQ ID NO: 541355 - RNA, 22 nt, Human
gcugugcagucuuuggugugcc

SEQ ID NO: 541356 - RNA, 16 nt, Human
ggugggguaguuagaa

SEQ ID NO: 541357 - RNA, 22 nt, Human
gggccuuccgacucccaaggcc

SEQ ID NO: 541358 - RNA, 22 nt, Human
ccauuaaguauuauuaaugauu

SEQ ID NO: 541359 - RNA, 22 nt, Human
cuguagcaaguuauucaauaaa

SEQ ID NO: 541360 - RNA, 21 nt, Human
aagacagaaaagccuauuuuc

SEQ ID NO: 541361 - RNA, 22 nt, Human
cccaggagguagagguugcagu

SEQ ID NO: 541362 - RNA, 22 nt, Human
ucugagugcacuaggaggggca

SEQ ID NO: 541363 - RNA, 19 nt, Human
uggcagggagaguuugaag

SEQ ID NO: 541364 - RNA, 22 nt, Human
aagaaaucagaaaagcauucgu

SEQ ID NO: 541365 - RNA, 22 nt, Human
ucugagccguauggcuuggcua

SEQ ID NO: 541366 - RNA, 22 nt, Human
gaaggcaacaccaggaugcacu

SEQ ID NO: 541367 - RNA, 21 nt, Human
uuaagaccugcaucaucauua

SEQ ID NO: 541368 - RNA, 22 nt, Human
cagguggcuuagucccauuuua

SEQ ID NO: 541369 - RNA, 22 nt, Human
gggcugaggcuaccacuggucu

SEQ ID NO: 541370 - RNA, 22 nt, Human
acaaaaguguaggaauuccuua

SEQ ID NO: 541371 - RNA, 17 nt, Human
aggcaggcagagcggga

SEQ ID NO: 541372 - RNA, 18 nt, Human
ugggccugcauccuaguc

SEQ ID NO: 541373 - RNA, 22 nt, Human
guuucgucaggcuuauucuauc

SEQ ID NO: 541374 - RNA, 22 nt, Human
cccagcucaagcagagagcuaa

SEQ ID NO: 541375 - RNA, 21 nt, Human
ugcugccaucaugcagagaug

SEQ ID NO: 541376 - RNA, 22 nt, Human
gucuucuguaagaugagguccc

SEQ ID NO: 541377 - RNA, 22 nt, Human
aagccgggccugagaaaugaca

SEQ ID NO: 541378 - RNA, 22 nt, Human
aagugcaagcaggacuuaguuu

SEQ ID NO: 541379 - RNA, 22 nt, Human
ucacaaaagcuuuugaauuugg

SEQ ID NO: 541380 - RNA, 22 nt, Human
uccucuggauauaagccucacc

SEQ ID NO: 541381 - RNA, 22 nt, Human
agcugcugccucacuggucugu

SEQ ID NO: 541382 - RNA, 22 nt, Human
uccugggagcacaugguccugc

SEQ ID NO: 541383 - RNA, 22 nt, Human
gggcucagucggcaagccccuu

SEQ ID NO: 541384 - RNA, 22 nt, Human
gucacacaauaguaaguggucc

SEQ ID NO: 541385 - RNA, 21 nt, Human
acagucuccccagaucucucc

SEQ ID NO: 541386 - RNA, 22 nt, Human
auuuucuauucugcugguuuag

SEQ ID NO: 541387 - RNA, 22 nt, Human
uuaguguauuuucaaauguaga

SEQ ID NO: 541388 - RNA, 22 nt, Human
uuugcauuuccagaguagcaga

SEQ ID NO: 541389 - RNA, 22 nt, Human
uuucugcugugcuuucuugcgu

SEQ ID NO: 541390 - RNA, 22 nt, Human
uuuauguuugacaaugaucugg

SEQ ID NO: 541391 - RNA, 22 nt, Human
aaaauauguauaacucuucugc

SEQ ID NO: 541392 - RNA, 22 nt, Human
aggagcagcccacuccuguccu

SEQ ID NO: 541393 - RNA, 22 nt, Human
ugcugucaguuggcaggaugag

SEQ ID NO: 541394 - RNA, 22 nt, Human
ucaggcagaugcagggauggau

SEQ ID NO: 541395 - RNA, 22 nt, Human
gaugcugcucgggugccuggga

SEQ ID NO: 541396 - RNA, 22 nt, Human
ucccacauaugcaauccugaau

SEQ ID NO: 541397 - RNA, 22 nt, Human
agugaaaacacuaguucuugcc

SEQ ID NO: 541398 - RNA, 22 nt, Human
uccagagcagguggucagaagg

SEQ ID NO: 541399 - RNA, 22 nt, Human
ccaggggcuggugcugagcugg

SEQ ID NO: 541400 - RNA, 22 nt, Human
ucaccccuacauuucccuugcu

SEQ ID NO: 541401 - RNA, 22 nt, Human
uggggaagggcacccuggagac

SEQ ID NO: 541402 - RNA, 22 nt, Human
uucucuuuucaccaguugcuaa

SEQ ID NO: 541403 - RNA, 22 nt, Human
guacacauuaugcuucucuaaa

SEQ ID NO: 541404 - RNA, 22 nt, Human
aaauguauccuacuuccugagu

SEQ ID NO: 541405 - RNA, 22 nt, Human
gcacagaaguaaaauacaaguc

SEQ ID NO: 541406 - RNA, 22 nt, Human
uuagauaaaaguguucaauaaa

SEQ ID NO: 541407 - RNA, 19 nt, Human
ccuggcugcugugggaugc

SEQ ID NO: 541408 - RNA, 22 nt, Human
aaauaucauuuauaacuuuuaa

SEQ ID NO: 541409 - RNA, 22 nt, Human
ccugagagugagggccuccuua

SEQ ID NO: 541410 - RNA, 22 nt, Human
acacuucuauucccugcacaaa

SEQ ID NO: 541411 - RNA, 23 nt, Human
auagaagauuauugcaacagucc

SEQ ID NO: 541412 - RNA, 22 nt, Human
ccaagauaaucugugaaaaauc

SEQ ID NO: 541413 - RNA, 22 nt, Human
gauuucuuggcccacucucaga

SEQ ID NO: 541414 - RNA, 22 nt, Human
agcugaguuaauucaucacuua

SEQ ID NO: 541415 - RNA, 22 nt, Human
uccccacugggccuccucuuuc

SEQ ID NO: 541416 - RNA, 22 nt, Human
gaugcacugcaguauauacugu

SEQ ID NO: 541417 - RNA, 22 nt, Human
uuugaacugauaaucuucuguu

SEQ ID NO: 541418 - RNA, 22 nt, Human
aaaugcagacagcuucacacac

SEQ ID NO: 541419 - RNA, 22 nt, Human
aaguuugacagaaguuucuaau

SEQ ID NO: 541420 - RNA, 22 nt, Human
uacuuaaaaauuaucaaagugg

SEQ ID NO: 541421 - RNA, 22 nt, Human
gagggcugcugccagauaugcc

SEQ ID NO: 541422 - RNA, 22 nt, Human
uuccaaguuaggcgagcuggug

SEQ ID NO: 541423 - RNA, 22 nt, Human
ugguuccaguuuucaauagagc

SEQ ID NO: 541424 - RNA, 22 nt, Human
gccacucaugggaggugugcaa

SEQ ID NO: 541425 - RNA, 22 nt, Human
caaauguuugguggcauuuugu

SEQ ID NO: 541426 - RNA, 22 nt, Human
caggaaugaggucguaaguguc

SEQ ID NO: 541427 - RNA, 22 nt, Human
ucaguguuuuccagggucuacu

SEQ ID NO: 541428 - RNA, 22 nt, Human
uucauuugggaugagucagaag

SEQ ID NO: 541429 - RNA, 22 nt, Human
agcaguggagcgagauguuuaa

SEQ ID NO: 541430 - RNA, 22 nt, Human
aaauacagauuccagggucuua

SEQ ID NO: 541431 - RNA, 22 nt, Human
acauauuuccaugcagcauguc

SEQ ID NO: 541432 - RNA, 22 nt, Human
agguggaacguucaggugcuag

SEQ ID NO: 541433 - RNA, 22 nt, Human
aaggagaaggcaucauucaagu

SEQ ID NO: 541434 - RNA, 18 nt, Human
ucaggcucucuggcuaga

SEQ ID NO: 541435 - RNA, 23 nt, Human
agggcccaagccuggacagcagg

SEQ ID NO: 541436 - RNA, 22 nt, Human
ugcacacagccagugaguggca

SEQ ID NO: 541437 - RNA, 22 nt, Human
cccagguggguuggccucuguc

SEQ ID NO: 541438 - RNA, 22 nt, Human
uggagcagaggcugagguuggg

SEQ ID NO: 541439 - RNA, 22 nt, Human
aaaauggucucagcuggcacca

SEQ ID NO: 541440 - RNA, 22 nt, Human
gcagggaggaagagaugcuucc

SEQ ID NO: 541441 - RNA, 22 nt, Human
aagauucucagagugaaagaau

SEQ ID NO: 541442 - RNA, 23 nt, Human
cccagcagauuguaaagugucca

SEQ ID NO: 541443 - RNA, 22 nt, Human
aaauccuaaaaguuugacuuaa

SEQ ID NO: 541444 - RNA, 22 nt, Human
aaugguuuaacauaugcuugag

SEQ ID NO: 541445 - RNA, 22 nt, Human
agacaucagcuugugugcaggg

SEQ ID NO: 541446 - RNA, 22 nt, Human
agaggccuccgaaaggugggcu

SEQ ID NO: 541447 - RNA, 22 nt, Human
cugcuuuguguggucccuccag

SEQ ID NO: 541448 - RNA, 22 nt, Human
gcaacagcauucucauugacau

SEQ ID NO: 541449 - RNA, 22 nt, Human
accagcucagaagccagaaaga

SEQ ID NO: 541450 - RNA, 22 nt, Human
acuuccugcagcuucucagccc

SEQ ID NO: 541451 - RNA, 22 nt, Human
agguccugucuuaucucuguaa

SEQ ID NO: 541452 - RNA, 22 nt, Human
uuauuuauuguguaccuacugu

SEQ ID NO: 541453 - RNA, 22 nt, Human
uccaggcccgagaugggcugga

SEQ ID NO: 541454 - RNA, 22 nt, Human
cagcaagauuuuuaaagcaagg

SEQ ID NO: 541455 - RNA, 22 nt, Human
gcucccagaaccaaggcugggg

SEQ ID NO: 541456 - RNA, 20 nt, Human
gugcauuucaccuguacugu

SEQ ID NO: 541457 - RNA, 22 nt, Human
uuacauuuugggguaaggauaa

SEQ ID NO: 541458 - RNA, 22 nt, Human
ugucccuuuguguucugaaacu

SEQ ID NO: 541459 - RNA, 18 nt, Human
caugggugacagguggau

SEQ ID NO: 541460 - RNA, 20 nt, Human
ucagccagcuaacaugggga

SEQ ID NO: 541461 - RNA, 20 nt, Human
gccugcagagaaggucagag

SEQ ID NO: 541462 - RNA, 22 nt, Human
caucacaaauguaauaaugucu

SEQ ID NO: 541463 - RNA, 22 nt, Human
uuucuguagugugguauguagg

SEQ ID NO: 541464 - RNA, 22 nt, Human
uuccauaauaaccugagagaaa

SEQ ID NO: 541465 - RNA, 22 nt, Human
ugcccugcccuugcuauuucua

SEQ ID NO: 541466 - RNA, 17 nt, Human
auuuacauugucaccga

SEQ ID NO: 541467 - RNA, 22 nt, Human
agagcugggaccgucuggaagu

SEQ ID NO: 541468 - RNA, 22 nt, Human
ugggcagaggcucugaagucca

SEQ ID NO: 541469 - RNA, 22 nt, Human
guuuccuacacuguaguauuau

SEQ ID NO: 541470 - RNA, 22 nt, Human
uacaguuaaaaaguucaauggu

SEQ ID NO: 541471 - RNA, 22 nt, Human
ggauggcauguugggcucuguu

SEQ ID NO: 541472 - RNA, 22 nt, Human
gggccccaaaaugccaggcucu

SEQ ID NO: 541473 - RNA, 22 nt, Human
agaacuguccuuggaggagagu

SEQ ID NO: 541474 - RNA, 22 nt, Human
cccagcauccucagggagcggg

SEQ ID NO: 541475 - RNA, 22 nt, Human
ugggagcccaagggagcugccg

SEQ ID NO: 541476 - RNA, 22 nt, Human
ccuccaggaacuugagagacac

SEQ ID NO: 541477 - RNA, 22 nt, Human
cugugcuugacagugggaagca

SEQ ID NO: 541478 - RNA, 21 nt, Human
cacaggugggucagugaggcc

SEQ ID NO: 541479 - RNA, 22 nt, Human
cuucacagaauaaacucauuau

SEQ ID NO: 541480 - RNA, 22 nt, Human
cagaaauguuuaugcuuuugaa

SEQ ID NO: 541481 - RNA, 22 nt, Human
ggaggaccugcuggcccugcaa

SEQ ID NO: 541482 - RNA, 22 nt, Human
aagauucccagagaaguuccac

SEQ ID NO: 541483 - RNA, 22 nt, Human
gcagcuuuguggagaggcccau

SEQ ID NO: 541484 - RNA, 22 nt, Human
uuucagugcuucuguuuaccgg

SEQ ID NO: 541485 - RNA, 22 nt, Human
agaagccauauuuagggaggag

SEQ ID NO: 541486 - RNA, 22 nt, Human
agaaaucacaggaggcagaagg

SEQ ID NO: 541487 - RNA, 22 nt, Human
aggcagcaauugaaaucauugu

SEQ ID NO: 541488 - RNA, 22 nt, Human
caggauggucagaugcauuguc

SEQ ID NO: 541489 - RNA, 22 nt, Human
ucaaacauaucugauuuuccau

SEQ ID NO: 541490 - RNA, 22 nt, Human
aggcuucuugauaaaaugcaga

SEQ ID NO: 541491 - RNA, 22 nt, Human
guaaaauucuagcaucugaaag

SEQ ID NO: 541492 - RNA, 22 nt, Human
uuuagcaucgaaguaaauuuag

SEQ ID NO: 541493 - RNA, 22 nt, Human
ggggcagcucccgagggcagga

SEQ ID NO: 541494 - RNA, 22 nt, Human
caggcaggugcagauuccucuu

SEQ ID NO: 541495 - RNA, 22 nt, Human
ucaggcugagaaaaucuggacc

SEQ ID NO: 541496 - RNA, 22 nt, Human
gaaaucaguucugaaauuuaca

SEQ ID NO: 541497 - RNA, 22 nt, Human
gggcccuggccgaaucccucug

SEQ ID NO: 541498 - RNA, 22 nt, Human
gugugcagaagacacaagacau

SEQ ID NO: 541499 - RNA, 22 nt, Human
ucuuugauacagauguaagcug

SEQ ID NO: 541500 - RNA, 22 nt, Human
ucacaucucccuggaggacaca

SEQ ID NO: 541501 - RNA, 22 nt, Human
ucuggaguguguguauucagcu

SEQ ID NO: 541502 - RNA, 17 nt, Human
gcaucacagauaacacg

SEQ ID NO: 541503 - RNA, 22 nt, Human
uaggcagagguaugguaaggac

SEQ ID NO: 541504 - RNA, 23 nt, Human
cccugcagucagggugagauggu

SEQ ID NO: 541505 - RNA, 22 nt, Human
ccagcuccugggucuuagucag

SEQ ID NO: 541506 - RNA, 22 nt, Human
ugaacaaauggaaauaaccagu

SEQ ID NO: 541507 - RNA, 21 nt, Human
gccugggaaaucugggaagcc

SEQ ID NO: 541508 - RNA, 22 nt, Human
gccugugaccccuccaucugcu

SEQ ID NO: 541509 - RNA, 22 nt, Human
aguauacauauauuagccuucg

SEQ ID NO: 541510 - RNA, 22 nt, Human
uguaaacauaccagagccaagu

SEQ ID NO: 541511 - RNA, 22 nt, Human
ucagcagaggggaaggcaucug

SEQ ID NO: 541512 - RNA, 18 nt, Human
ggagcugggccugguucc

SEQ ID NO: 541513 - RNA, 21 nt, Human
ucuuuccugcccaguugcccu

SEQ ID NO: 541514 - RNA, 20 nt, Human
gagcacaguaaugacugcua

SEQ ID NO: 541515 - RNA, 22 nt, Human
gcagguggagcaguagucuggu

SEQ ID NO: 541516 - RNA, 18 nt, Human
gcagcuuuugauucaccc

SEQ ID NO: 541517 - RNA, 22 nt, Human
auguagcaucuauccugauaaa

SEQ ID NO: 541518 - RNA, 22 nt, Human
auggaagacuaacagaaacaug

SEQ ID NO: 541519 - RNA, 20 nt, Human
ugauuucucuucuauuccuu

SEQ ID NO: 541520 - RNA, 20 nt, Human
uacauauuauaucagcugca

SEQ ID NO: 541521 - RNA, 22 nt, Human
gggugacauuucccaaugagcc

SEQ ID NO: 541522 - RNA, 22 nt, Human
aaauguacgggaguagaauuag

SEQ ID NO: 541523 - RNA, 22 nt, Human
gcaggugggagccgcugccuga

SEQ ID NO: 541524 - RNA, 22 nt, Human
augaagauuuauaauugccuuu

SEQ ID NO: 541525 - RNA, 22 nt, Human
cugcggcuggggacagcuguug

SEQ ID NO: 541526 - RNA, 19 nt, Human
aggucauugauagugcagg

SEQ ID NO: 541527 - RNA, 22 nt, Human
ucaguggauauuucuguggcug

SEQ ID NO: 541528 - RNA, 22 nt, Human
uggcccugcuguaucaucugcu

SEQ ID NO: 541529 - RNA, 22 nt, Human
uggggacacagagccaaacuau

SEQ ID NO: 541530 - RNA, 17 nt, Human
ucugggcuucagugguc

SEQ ID NO: 541531 - RNA, 22 nt, Human
ucucagagauuuauggaaaacu

SEQ ID NO: 541532 - RNA, 20 nt, Human
auugucagccuucagaggag

SEQ ID NO: 541533 - RNA, 22 nt, Human
acagugucaugucguguucccc

SEQ ID NO: 541534 - RNA, 22 nt, Human
aagaauaacacuuagguuuugc

SEQ ID NO: 541535 - RNA, 21 nt, Human
uccugcaggaggccugagagg

SEQ ID NO: 541536 - RNA, 22 nt, Human
gcauagcuguuaauuugguuuc

SEQ ID NO: 541537 - RNA, 22 nt, Human
cugguucauuagguauuagugg

SEQ ID NO: 541538 - RNA, 22 nt, Human
ggcagcucugaugaugcucugg

SEQ ID NO: 541539 - RNA, 22 nt, Human
ccagagccggcucccucagcuu

SEQ ID NO: 541540 - RNA, 22 nt, Human
acugucugcuggccccugguua

SEQ ID NO: 541541 - RNA, 23 nt, Human
ccagcuccgugagccucgggcuc

SEQ ID NO: 541542 - RNA, 22 nt, Human
ccaggaaugaaauguagauaaa

SEQ ID NO: 541543 - RNA, 22 nt, Human
aucagcaagacuaggggaauac

SEQ ID NO: 541544 - RNA, 22 nt, Human
aggagugaguguccucagcaga

SEQ ID NO: 541545 - RNA, 22 nt, Human
aauggcagaggcaaagauggua

SEQ ID NO: 541546 - RNA, 22 nt, Human
ugggaccugcuccuggaaugag

SEQ ID NO: 541547 - RNA, 22 nt, Human
aauugugcuaugauuaugaaag

SEQ ID NO: 541548 - RNA, 22 nt, Human
guccagugacaaguagcuggcc

SEQ ID NO: 541549 - RNA, 22 nt, Human
agugaagaggaaguggggcaca

SEQ ID NO: 541550 - RNA, 22 nt, Human
aacuauacucuguaaaugugcu

SEQ ID NO: 541551 - RNA, 22 nt, Human
gucugggcucccagggucggcg

SEQ ID NO: 541552 - RNA, 22 nt, Human
agauacaucuugaacuucuaga

SEQ ID NO: 541553 - RNA, 23 nt, Human
caguggagacucaugcuuccuua

SEQ ID NO: 541554 - RNA, 22 nt, Human
cuuuauuccuacaagauuuucu

SEQ ID NO: 541555 - RNA, 22 nt, Human
guaacagaggguuugcagauau

SEQ ID NO: 541556 - RNA, 17 nt, Human
ggccuguguggcugcag

SEQ ID NO: 541557 - RNA, 22 nt, Human
ugcugaguggcggccucacuuu

SEQ ID NO: 541558 - RNA, 19 nt, Human
ugccagcauuaggcugaag

SEQ ID NO: 541559 - RNA, 22 nt, Human
cugugcccuguggcuggcaccu

SEQ ID NO: 541560 - RNA, 22 nt, Human
auaauacaugguugaucuuuuc

SEQ ID NO: 541561 - RNA, 22 nt, Human
gaggcagcaucuauggugggaa

SEQ ID NO: 541562 - RNA, 21 nt, Human
gccagcugcagggcuuccuug

SEQ ID NO: 541563 - RNA, 22 nt, Human
caguggcagagaacagagaccu

SEQ ID NO: 541564 - RNA, 21 nt, Human
gcugagagguugggaaguuca

SEQ ID NO: 541565 - RNA, 22 nt, Human
ucaucaaagucaaagaaugacu

SEQ ID NO: 541566 - RNA, 19 nt, Human
caugaugagcauccugcag

SEQ ID NO: 541567 - RNA, 22 nt, Human
cuggaauugcauaauauguccu

SEQ ID NO: 541568 - RNA, 22 nt, Human
ccugccagugaagcugacgggc

SEQ ID NO: 541569 - RNA, 22 nt, Human
aaagaaggaccuggaggaggau

SEQ ID NO: 541570 - RNA, 22 nt, Human
auuucacucauucauguuacuu

SEQ ID NO: 541571 - RNA, 22 nt, Human
gcugggcucauuugugugucug

SEQ ID NO: 541572 - RNA, 20 nt, Human
gcagcugcccccagucccug

SEQ ID NO: 541573 - RNA, 21 nt, Human
ucaggggcuguguuuuccauc

SEQ ID NO: 541574 - RNA, 22 nt, Human
aggcugagagcaacgugucaga

SEQ ID NO: 541575 - RNA, 22 nt, Human
cauugcccaguaggaucaccag

SEQ ID NO: 541576 - RNA, 22 nt, Human
uucagagaugacaccugguguu

SEQ ID NO: 541577 - RNA, 22 nt, Human
uacuuuuagccuauuugauucu

SEQ ID NO: 541578 - RNA, 22 nt, Human
auuugcauaauagugauuugua

SEQ ID NO: 541579 - RNA, 22 nt, Human
acuaggaaguggcaaaacugga

SEQ ID NO: 541580 - RNA, 22 nt, Human
ugcauuguaggauguuuagcag

SEQ ID NO: 541581 - RNA, 22 nt, Human
gcugggaggaauuuggggaaua

SEQ ID NO: 541582 - RNA, 22 nt, Human
cuguacaucccgagagccagua

SEQ ID NO: 541583 - RNA, 22 nt, Human
aguggcagagccaaguagagcc

SEQ ID NO: 541584 - RNA, 22 nt, Human
uggggacccggacuccuggguc

SEQ ID NO: 541585 - RNA, 22 nt, Human
ccuggggaaucuugcaggggaa

SEQ ID NO: 541586 - RNA, 22 nt, Human
ggcugcagagcugggugggccu

SEQ ID NO: 541587 - RNA, 22 nt, Human
aagugagauuauauguacggga

SEQ ID NO: 541588 - RNA, 22 nt, Human
acuguucugccaagaucaacgu

SEQ ID NO: 541589 - RNA, 22 nt, Human
agggaggauaguagucaguuua

SEQ ID NO: 541590 - RNA, 18 nt, Human
caaauucagugcuggaag

SEQ ID NO: 541591 - RNA, 22 nt, Human
ggguggcaggauuggcaggagu

SEQ ID NO: 541592 - RNA, 22 nt, Human
uguucccauuuucugcauaauc

SEQ ID NO: 541593 - RNA, 22 nt, Human
aaguggagccagggaaacugaa

SEQ ID NO: 541594 - RNA, 22 nt, Human
cuuccugaacaaugccaucaau

SEQ ID NO: 541595 - RNA, 22 nt, Human
uuucuguauuuaaaagaucugg

SEQ ID NO: 541596 - RNA, 22 nt, Human
cugggccagggaggugucugua

SEQ ID NO: 541597 - RNA, 22 nt, Human
agauuuugucucaauacuucug

SEQ ID NO: 541598 - RNA, 22 nt, Human
aaugguuuguaccuguccuugg

SEQ ID NO: 541599 - RNA, 22 nt, Human
aguauuuucgccaucacaagaa

SEQ ID NO: 541600 - RNA, 22 nt, Human
agguggcugagcugugccccug

SEQ ID NO: 541601 - RNA, 22 nt, Human
ccagcccugaacccugcugcau

SEQ ID NO: 541602 - RNA, 22 nt, Human
gccccagccaaggugacacgaa

SEQ ID NO: 541603 - RNA, 21 nt, Human
acagcagggcuggcaugacag

SEQ ID NO: 541604 - RNA, 22 nt, Human
gacucguucauaguuccaauuu

SEQ ID NO: 541605 - RNA, 22 nt, Human
gcccagaguucaaggcugcagu

SEQ ID NO: 541606 - RNA, 22 nt, Human
uuugugaagggaacagaagugu

SEQ ID NO: 541607 - RNA, 22 nt, Human
ucucagagauguuagggaagag

SEQ ID NO: 541608 - RNA, 22 nt, Human
cuggcaggcggagguugcagug

SEQ ID NO: 541609 - RNA, 20 nt, Human
ugagaaaguagagacucagg

SEQ ID NO: 541610 - RNA, 22 nt, Human
gcagugaaaaagugcacccugu

SEQ ID NO: 541611 - RNA, 22 nt, Human
ugcuaaguucugcaaaagauaa

SEQ ID NO: 541612 - RNA, 22 nt, Human
uauaauuuuaagugguaaauua

SEQ ID NO: 541613 - RNA, 22 nt, Human
gagcucuggcagggcaggucug

SEQ ID NO: 541614 - RNA, 22 nt, Human
cauucacaaagcugauugaugg

SEQ ID NO: 541615 - RNA, 22 nt, Human
gcccagcuggcuuccagcacau

SEQ ID NO: 541616 - RNA, 22 nt, Human
uacuuuagaaggaaauaaguuc

SEQ ID NO: 541617 - RNA, 22 nt, Human
acauuuugcccuuauuugcuga

SEQ ID NO: 541618 - RNA, 22 nt, Human
cugagagaaucaugcugcaggu

SEQ ID NO: 541619 - RNA, 22 nt, Human
ccuggagcacucucccuggcug

SEQ ID NO: 541620 - RNA, 22 nt, Human
ggagaggaaaugccagcacuuc

SEQ ID NO: 541621 - RNA, 22 nt, Human
cagucccaggguugguucagcu

SEQ ID NO: 541622 - RNA, 22 nt, Human
ggugggcacccgagacuggauc

SEQ ID NO: 541623 - RNA, 23 nt, Human
acugagccagggccugggucagc

SEQ ID NO: 541624 - RNA, 22 nt, Human
cauacauauguggaugucauau

SEQ ID NO: 541625 - RNA, 22 nt, Human
cugcggcucugcgggcagcugg

SEQ ID NO: 541626 - RNA, 22 nt, Human
agggaguguuacauaauggguu

SEQ ID NO: 541627 - RNA, 22 nt, Human
uaaaucccuacaucuguguuuu

SEQ ID NO: 541628 - RNA, 22 nt, Human
ggcuccagauguccccuggcaa

SEQ ID NO: 541629 - RNA, 22 nt, Human
ugcuucugcucagcuuccuacu

SEQ ID NO: 541630 - RNA, 21 nt, Human
gaguggaacgcucuucacacc

SEQ ID NO: 541631 - RNA, 19 nt, Human
aggucccugucaccucuca

SEQ ID NO: 541632 - RNA, 22 nt, Human
uaaagacaauaggaaaguuguu

SEQ ID NO: 541633 - RNA, 22 nt, Human
aaugcuguauaucuuagcuaau

SEQ ID NO: 541634 - RNA, 22 nt, Human
gguguccucaugauuuucuaga

SEQ ID NO: 541635 - RNA, 22 nt, Human
uuaaagcaaguagaagccugag

SEQ ID NO: 541636 - RNA, 22 nt, Human
acauauaugcugggacugugac

SEQ ID NO: 541637 - RNA, 22 nt, Human
cugcccugcucuccgggaucuu

SEQ ID NO: 541638 - RNA, 22 nt, Human
aagcugccuagaguugaauguc

SEQ ID NO: 541639 - RNA, 22 nt, Human
cugggccagcaacugcaaugga

SEQ ID NO: 541640 - RNA, 22 nt, Human
aucacaggugguaggaaaagaa

SEQ ID NO: 541641 - RNA, 22 nt, Human
ccaggagcagggcuggcugcac

SEQ ID NO: 541642 - RNA, 22 nt, Human
gaggcucagggaaacagcgcag

SEQ ID NO: 541643 - RNA, 22 nt, Human
ccauuuguucgcccagcuccaa

SEQ ID NO: 541644 - RNA, 22 nt, Human
cuuagggagaaugccucugcag

SEQ ID NO: 541645 - RNA, 22 nt, Human
cucugcccagugcccacaggag

SEQ ID NO: 541646 - RNA, 22 nt, Human
acuuuacagaugguuuccugac

SEQ ID NO: 541647 - RNA, 22 nt, Human
ccugagagagaagcgaccuggu

SEQ ID NO: 541648 - RNA, 22 nt, Human
ggcugccugccgcccacuuggc

SEQ ID NO: 541649 - RNA, 22 nt, Human
ggcuuuggggugugcagagaug

SEQ ID NO: 541650 - RNA, 22 nt, Human
agaccgagaaguucuccaggcc

SEQ ID NO: 541651 - RNA, 22 nt, Human
uaagcuauuccugaagaagguu

SEQ ID NO: 541652 - RNA, 22 nt, Human
aggcucugguuggcaaguaaag

SEQ ID NO: 541653 - RNA, 22 nt, Human
agugaggucauacuggagaggg

SEQ ID NO: 541654 - RNA, 22 nt, Human
cacagcuugggcucugacaaua

SEQ ID NO: 541655 - RNA, 22 nt, Human
caaacauuugacuucucucagg

SEQ ID NO: 541656 - RNA, 22 nt, Human
ggccacagaacagcuacaggac

SEQ ID NO: 541657 - RNA, 22 nt, Human
cgugucaucugagccuugggcg

SEQ ID NO: 541658 - RNA, 22 nt, Human
uuucacauaaauauuaugccua

SEQ ID NO: 541659 - RNA, 22 nt, Human
auuuugaaaccaaguuauuucc

SEQ ID NO: 541660 - RNA, 22 nt, Human
ggcucugguugaccaugauggc

SEQ ID NO: 541661 - RNA, 22 nt, Human
ccccuuccgucucuugaguguc

SEQ ID NO: 541662 - RNA, 22 nt, Human
ucaaaccaccuuguuacugggg

SEQ ID NO: 541663 - RNA, 22 nt, Human
uucaaagugugaccugacaagc

SEQ ID NO: 541664 - RNA, 22 nt, Human
aaucuauaugcuuuucacauac

SEQ ID NO: 541665 - RNA, 22 nt, Human
gggcuggcaucaguugccgaga

SEQ ID NO: 541666 - RNA, 22 nt, Human
cugaggcucugggugucacugu

SEQ ID NO: 541667 - RNA, 19 nt, Human
cagaacagaggucauggcc

SEQ ID NO: 541668 - RNA, 22 nt, Human
ugccaggcccagcagggcggcc

SEQ ID NO: 541669 - RNA, 22 nt, Human
caugagaaguggccuucaaaaa

SEQ ID NO: 541670 - RNA, 22 nt, Human
aagcacagacacaaaaggcuuu

SEQ ID NO: 541671 - RNA, 22 nt, Human
cagcuucugagcaagccagggg

SEQ ID NO: 541672 - RNA, 22 nt, Human
acauuauaguugcuacagagua

SEQ ID NO: 541673 - RNA, 22 nt, Human
acaguaaaaagccuuagaauuu

SEQ ID NO: 541674 - RNA, 22 nt, Human
uaauuucuggagggagaaagag

SEQ ID NO: 541675 - RNA, 22 nt, Human
cagacagguagggacagaacau

SEQ ID NO: 541676 - RNA, 22 nt, Human
ugugccugucccgcauucuggu

SEQ ID NO: 541677 - RNA, 22 nt, Human
ugugccugaguuggcugaguac

SEQ ID NO: 541678 - RNA, 22 nt, Human
gagauuggccuggcuugccaac

SEQ ID NO: 541679 - RNA, 16 nt, Human
gagggcagaggcggaa

SEQ ID NO: 541680 - RNA, 22 nt, Human
uguauuaugauuguuguucaug

SEQ ID NO: 541681 - RNA, 22 nt, Human
acccuguaugcuauaucccuaa

SEQ ID NO: 541682 - RNA, 22 nt, Human
ggcagggguccugguguugacu

SEQ ID NO: 541683 - RNA, 22 nt, Human
acucucagaggguggcagcaau

SEQ ID NO: 541684 - RNA, 22 nt, Human
aacucagucauaaagcgaaugc

SEQ ID NO: 541685 - RNA, 22 nt, Human
cucagagcaaugaacaugcaaa

SEQ ID NO: 541686 - RNA, 22 nt, Human
uucacaauuucccuucaucagg

SEQ ID NO: 541687 - RNA, 22 nt, Human
gcacagcaauuucuauaagcuc

SEQ ID NO: 541688 - RNA, 22 nt, Human
uugaaagugccaaguccuagug

SEQ ID NO: 541689 - RNA, 22 nt, Human
agggcaguucagccacaggcuc

SEQ ID NO: 541690 - RNA, 22 nt, Human
uccauuuacuauucucauaucg

SEQ ID NO: 541691 - RNA, 21 nt, Human
ggccugagcaccuguccaccu

SEQ ID NO: 541692 - RNA, 22 nt, Human
ugaggccucauuuagggagagg

SEQ ID NO: 541693 - RNA, 22 nt, Human
cugccagguuggcgcucgcucu

SEQ ID NO: 541694 - RNA, 22 nt, Human
ugcauacacuucaaaugagcau

SEQ ID NO: 541695 - RNA, 22 nt, Human
aaguccaguuucauuugagguc

SEQ ID NO: 541696 - RNA, 22 nt, Human
ccagucccgcaugguccagaau

SEQ ID NO: 541697 - RNA, 22 nt, Human
ggcucaggagaggggcuaaaag

SEQ ID NO: 541698 - RNA, 22 nt, Human
ucugccugcugccugggggcuc

SEQ ID NO: 541699 - RNA, 22 nt, Human
uucuguuucuggggucucugac

SEQ ID NO: 541700 - RNA, 22 nt, Human
cuggugggagcagcaggcagcu

SEQ ID NO: 541701 - RNA, 22 nt, Human
cagucccacaagaucuccacaa

SEQ ID NO: 541702 - RNA, 22 nt, Human
acuaaggaauaugacaaacuca

SEQ ID NO: 541703 - RNA, 22 nt, Human
ggugccagccuagugcaguggu

SEQ ID NO: 541704 - RNA, 22 nt, Human
ugggccugccccaggcuucagc

SEQ ID NO: 541705 - RNA, 22 nt, Human
uaagaaacuaaugcaauaagag

SEQ ID NO: 541706 - RNA, 22 nt, Human
caggcaccccaggugagcacug

SEQ ID NO: 541707 - RNA, 22 nt, Human
aagugccugaccuagccuggag

SEQ ID NO: 541708 - RNA, 22 nt, Human
aaaugcagaucccugaaucuca

SEQ ID NO: 541709 - RNA, 22 nt, Human
ugggcucugcaucagugcccau

SEQ ID NO: 541710 - RNA, 18 nt, Human
aagaggaggagcagguug

SEQ ID NO: 541711 - RNA, 22 nt, Human
cagcagcugaggcgcuggcgug

SEQ ID NO: 541712 - RNA, 20 nt, Human
auuucaguguuugcaauuuc

SEQ ID NO: 541713 - RNA, 22 nt, Human
uggcagaggaggcucagauuga

SEQ ID NO: 541714 - RNA, 22 nt, Human
aaaagcaauugcaguucuugcc

SEQ ID NO: 541715 - RNA, 22 nt, Human
ccuccaggcugaauaucuagaa

SEQ ID NO: 541716 - RNA, 22 nt, Human
cagaauaaacagaaacguagcu

SEQ ID NO: 541717 - RNA, 22 nt, Human
gaacauuuggcaugagaauuug

SEQ ID NO: 541718 - RNA, 22 nt, Human
uggcaggaaaaagggccagagg

SEQ ID NO: 541719 - RNA, 22 nt, Human
uaugcuacuagaaauaaaaugg

SEQ ID NO: 541720 - RNA, 22 nt, Human
ucuccuucgaggcccagcuccc

SEQ ID NO: 541721 - RNA, 22 nt, Human
cuguccuggagggcauaggacg

SEQ ID NO: 541722 - RNA, 22 nt, Human
ucugucacucuagagauggcag

SEQ ID NO: 541723 - RNA, 22 nt, Human
ggcuucaccaggugcaugcaug

SEQ ID NO: 541724 - RNA, 22 nt, Human
auuccugacuguuagaguuugc

SEQ ID NO: 541725 - RNA, 22 nt, Human
ucugcuggaaaaccagggaauu

SEQ ID NO: 541726 - RNA, 22 nt, Human
aaucaaguauuuuccaguggca

SEQ ID NO: 541727 - RNA, 22 nt, Human
aaacuagccacacagaauacac

SEQ ID NO: 541728 - RNA, 22 nt, Human
gagagggccagggugagaacua

SEQ ID NO: 541729 - RNA, 22 nt, Human
gauuuccuaauguggaucucug

SEQ ID NO: 541730 - RNA, 22 nt, Human
uggcagggucuugcuguguugc

SEQ ID NO: 541731 - RNA, 22 nt, Human
uaguaaauuaaaauauugacuu

SEQ ID NO: 541732 - RNA, 22 nt, Human
uggcucaggguccccaaauggu

SEQ ID NO: 541733 - RNA, 22 nt, Human
aggcuuccgaguagcugggacu

SEQ ID NO: 541734 - RNA, 22 nt, Human
gcucucugccuuucucaaugac

SEQ ID NO: 541735 - RNA, 22 nt, Human
uaauaccuugaucucucuuguc

SEQ ID NO: 541736 - RNA, 22 nt, Human
gucccugcaucaccacgggacu

SEQ ID NO: 541737 - RNA, 22 nt, Human
agagccaggcggcugggcaccu

SEQ ID NO: 541738 - RNA, 22 nt, Human
uacacacaugcauuugccuuau

SEQ ID NO: 541739 - RNA, 22 nt, Human
uauaauuuggggaaaguggugu

SEQ ID NO: 541740 - RNA, 20 nt, Human
caggaaccaaagaggacucc

SEQ ID NO: 541741 - RNA, 22 nt, Human
gggcugagagcuggaaucugag

SEQ ID NO: 541742 - RNA, 19 nt, Human
cuuuucaucaacagccaau

SEQ ID NO: 541743 - RNA, 22 nt, Human
auucucaguucacuaguuucuu

SEQ ID NO: 541744 - RNA, 22 nt, Human
cuacccaggcuggagugcagua

SEQ ID NO: 541745 - RNA, 22 nt, Human
aagauauucaaagauuuauuag

SEQ ID NO: 541746 - RNA, 22 nt, Human
gcaggugggggagaaguuguga

SEQ ID NO: 541747 - RNA, 21 nt, Human
cccugcaggccagggcugagc

SEQ ID NO: 541748 - RNA, 22 nt, Human
uuuacacuuauuaugaagcuuu

SEQ ID NO: 541749 - RNA, 22 nt, Human
aguucaauagaaaaauauauua

SEQ ID NO: 541750 - RNA, 22 nt, Human
gagaaucuacaggaaaccgaag

SEQ ID NO: 541751 - RNA, 22 nt, Human
acauguaaaaggaacaugcaug

SEQ ID NO: 541752 - RNA, 22 nt, Human
ugcagaagauggucugagcacc

SEQ ID NO: 541753 - RNA, 22 nt, Human
ugccacagaggugaagcccacu

SEQ ID NO: 541754 - RNA, 22 nt, Human
uucuucaaugugcccuguuuuc

SEQ ID NO: 541755 - RNA, 22 nt, Human
augccaguaagucucagcuagg

SEQ ID NO: 541756 - RNA, 20 nt, Human
ucugagagucugagugauga

SEQ ID NO: 541757 - RNA, 22 nt, Human
agauuucccucuuguauuugca

SEQ ID NO: 541758 - RNA, 22 nt, Human
gagauauguuagaaagcuauug

SEQ ID NO: 541759 - RNA, 22 nt, Human
gcagcaguggucuguagaagga

SEQ ID NO: 541760 - RNA, 22 nt, Human
aaguaucuuucuagcaacuaaa

SEQ ID NO: 541761 - RNA, 20 nt, Human
auuuuguuuauguuccucuc

SEQ ID NO: 541762 - RNA, 18 nt, Human
ucucagaggccauccuag

SEQ ID NO: 541763 - RNA, 22 nt, Human
cagaggccuuucuacagugaua

SEQ ID NO: 541764 - RNA, 22 nt, Human
gguaacaguauguagaguaaga

SEQ ID NO: 541765 - RNA, 22 nt, Human
gccuggcuccuaagagcacaac

SEQ ID NO: 541766 - RNA, 22 nt, Human
gcccucagaugggaaaggaggg

SEQ ID NO: 541767 - RNA, 22 nt, Human
agcaaguugaaugauaauacuc

SEQ ID NO: 541768 - RNA, 22 nt, Human
cagggagaaaucuccaggaggu

SEQ ID NO: 541769 - RNA, 22 nt, Human
acacagauaaugcucauauagg

SEQ ID NO: 541770 - RNA, 22 nt, Human
uuucuguaaguggcaaauaaug

SEQ ID NO: 541771 - RNA, 22 nt, Human
ucucuucauagugacacccauc

SEQ ID NO: 541772 - RNA, 22 nt, Human
uuccagaauugggagccuugag

SEQ ID NO: 541773 - RNA, 22 nt, Human
cuggcugcaggaaggagugggc

SEQ ID NO: 541774 - RNA, 21 nt, Human
gccugcugccuguggccgguc

SEQ ID NO: 541775 - RNA, 22 nt, Human
ccugggcaacauagggagaccc

SEQ ID NO: 541776 - RNA, 22 nt, Human
ccagccugaaaugccucauccu

SEQ ID NO: 541777 - RNA, 22 nt, Human
uuuagcagcaaauaaguagugc

SEQ ID NO: 541778 - RNA, 21 nt, Human
cacucaggguaugugccaggc

SEQ ID NO: 541779 - RNA, 22 nt, Human
cucuggagcaccgggcuaucca

SEQ ID NO: 541780 - RNA, 22 nt, Human
agaagccaugguaugcaacuac

SEQ ID NO: 541781 - RNA, 21 nt, Human
gcugcaucaaucuacccaggg

SEQ ID NO: 541782 - RNA, 22 nt, Human
uuuccucuuuguaccuugacua

SEQ ID NO: 541783 - RNA, 22 nt, Human
gcugcaggggggucuggacuug

SEQ ID NO: 541784 - RNA, 22 nt, Human
auuugagaugguaaauaacuuu

SEQ ID NO: 541785 - RNA, 22 nt, Human
gcucaagagagaugcaguucuu

SEQ ID NO: 541786 - RNA, 22 nt, Human
agcugccugggcuuguacaccu

SEQ ID NO: 541787 - RNA, 22 nt, Human
agagcuauauacagauuauuga

SEQ ID NO: 541788 - RNA, 22 nt, Human
ucaaaaauggucuuugagcugc

SEQ ID NO: 541789 - RNA, 22 nt, Human
uugauguugcucuuaacaguau

SEQ ID NO: 541790 - RNA, 22 nt, Human
uacaggaaggagcacaucggga

SEQ ID NO: 541791 - RNA, 20 nt, Human
uucacagaggacucagguca

SEQ ID NO: 541792 - RNA, 22 nt, Human
aaaucaaaagacauguguuuua

SEQ ID NO: 541793 - RNA, 22 nt, Human
ccugccugcaccuucucugggg

SEQ ID NO: 541794 - RNA, 22 nt, Human
ggcagggcccugauuccugggg

SEQ ID NO: 541795 - RNA, 22 nt, Human
guuuugugaggcacccacaggu

SEQ ID NO: 541796 - RNA, 22 nt, Human
ggaggugggagacauaggcggc

SEQ ID NO: 541797 - RNA, 22 nt, Human
uauuccagugugaucuuuguag

SEQ ID NO: 541798 - RNA, 23 nt, Human
uguaaaaugggguaguguuacca

SEQ ID NO: 541799 - RNA, 22 nt, Human
uucuaaacggcuucacaggaau

SEQ ID NO: 541800 - RNA, 22 nt, Human
ccagcuuuuagugggcuuauua

SEQ ID NO: 541801 - RNA, 22 nt, Human
ugaugggaggugcugcaggacc

SEQ ID NO: 541802 - RNA, 22 nt, Human
aagggcuccauccuuauaaaug

SEQ ID NO: 541803 - RNA, 22 nt, Human
acuggcaguuugagaaugcauu

SEQ ID NO: 541804 - RNA, 20 nt, Human
gcccuggagccuuguccugg

SEQ ID NO: 541805 - RNA, 22 nt, Human
aggagcugcaaauauuaguaau

SEQ ID NO: 541806 - RNA, 19 nt, Human
agcaccugugagagccugg

SEQ ID NO: 541807 - RNA, 20 nt, Human
ugcacagcugugaauaggau

SEQ ID NO: 541808 - RNA, 22 nt, Human
uuaacagagugccuggcaugua

SEQ ID NO: 541809 - RNA, 22 nt, Human
ugccuuuuauggcuagccucag

SEQ ID NO: 541810 - RNA, 23 nt, Human
cacugcagcguggucuggcagga

SEQ ID NO: 541811 - RNA, 22 nt, Human
caaugaaaauuuaaguugcagc

SEQ ID NO: 541812 - RNA, 22 nt, Human
uugugugguagcuucauugaac

SEQ ID NO: 541813 - RNA, 22 nt, Human
acccaggagcaggcugggcagu

SEQ ID NO: 541814 - RNA, 22 nt, Human
gugugccaccagucaaggugaa

SEQ ID NO: 541815 - RNA, 22 nt, Human
agggcagccugagugcuggccc

SEQ ID NO: 541816 - RNA, 22 nt, Human
uucagaaaggauaauuggaagg

SEQ ID NO: 541817 - RNA, 22 nt, Human
aaggaagagucuagaacaggca

SEQ ID NO: 541818 - RNA, 22 nt, Human
ccaccagcuuugccacccugcu

SEQ ID NO: 541819 - RNA, 22 nt, Human
ugcuucuggaaacaguggcugu

SEQ ID NO: 541820 - RNA, 22 nt, Human
agugaggauaccaauguguaga

SEQ ID NO: 541821 - RNA, 22 nt, Human
cugccugcugacauucuuuaua

SEQ ID NO: 541822 - RNA, 22 nt, Human
gagaaaggcauuccuaugcaaa

SEQ ID NO: 541823 - RNA, 22 nt, Human
guccagagauggacgagcagau

SEQ ID NO: 541824 - RNA, 22 nt, Human
ugcagucuggauguccucagau

SEQ ID NO: 541825 - RNA, 22 nt, Human
aacuggaagagugaauauaacu

SEQ ID NO: 541826 - RNA, 22 nt, Human
ccucgaccuccccaggcucagg

SEQ ID NO: 541827 - RNA, 22 nt, Human
uucuuuauugagacuucauugu

SEQ ID NO: 541828 - RNA, 22 nt, Human
ggagcagggaauuacagcgcag

SEQ ID NO: 541829 - RNA, 16 nt, Human
ucagggcagaauggca

SEQ ID NO: 541830 - RNA, 22 nt, Human
cucagggucugguccuuagauu

SEQ ID NO: 541831 - RNA, 22 nt, Human
uuccucuccucacaugagucac

SEQ ID NO: 541832 - RNA, 22 nt, Human
auguuucaucaguaagguuuug

SEQ ID NO: 541833 - RNA, 22 nt, Human
uccaggcagagcaacaaaauau

SEQ ID NO: 541834 - RNA, 22 nt, Human
acccagcuaacccuacccugga

SEQ ID NO: 541835 - RNA, 22 nt, Human
ucugaggcauaaccuguucugc

SEQ ID NO: 541836 - RNA, 22 nt, Human
cagcuguucggggcuggcaugu

SEQ ID NO: 541837 - RNA, 21 nt, Human
ucugggcccaugcugccucac

SEQ ID NO: 541838 - RNA, 17 nt, Human
agggacagcaguuuagg

SEQ ID NO: 541839 - RNA, 22 nt, Human
acaugauuugcaugauuuguaa

SEQ ID NO: 541840 - RNA, 22 nt, Human
aggcagguguugggagacacca

SEQ ID NO: 541841 - RNA, 22 nt, Human
ugcacacagcugggccuggcug

SEQ ID NO: 541842 - RNA, 20 nt, Human
guauuaggagguaaauguaa

SEQ ID NO: 541843 - RNA, 22 nt, Human
uuugugcacauugcuuuucuau

SEQ ID NO: 541844 - RNA, 22 nt, Human
agcuuuguggcuuugcaagacu

SEQ ID NO: 541845 - RNA, 19 nt, Human
cgcaggcuucgggucgcuc

SEQ ID NO: 541846 - RNA, 22 nt, Human
cuuauuauaaaauccuguuuga

SEQ ID NO: 541847 - RNA, 22 nt, Human
auucugaucauucaagauguca

SEQ ID NO: 541848 - RNA, 21 nt, Human
agaugaggauacugaggccua

SEQ ID NO: 541849 - RNA, 22 nt, Human
uugcaacaucugaacauuuauc

SEQ ID NO: 541850 - RNA, 22 nt, Human
agagggcaugcuugguggccug

SEQ ID NO: 541851 - RNA, 22 nt, Human
guacacagaugcuugagaaucu

SEQ ID NO: 541852 - RNA, 22 nt, Human
cauuugcauaugaagaaguaag

SEQ ID NO: 541853 - RNA, 22 nt, Human
uccaggcauaagccuugagugu

SEQ ID NO: 541854 - RNA, 22 nt, Human
gcugucugccgcaggcugccac

SEQ ID NO: 541855 - RNA, 22 nt, Human
auucuuuuguccuagcuugaua

SEQ ID NO: 541856 - RNA, 21 nt, Human
cuuggaguugguugaggaugc

SEQ ID NO: 541857 - RNA, 22 nt, Human
uuucuucugagaucagggagaa

SEQ ID NO: 541858 - RNA, 22 nt, Human
augaaauuuuaauuauaccucu

SEQ ID NO: 541859 - RNA, 22 nt, Human
uuucaaacauaucuucauuacu

SEQ ID NO: 541860 - RNA, 22 nt, Human
aggaagccugcaggugacugcu

SEQ ID NO: 541861 - RNA, 22 nt, Human
aguaaugaggauguuugcaaaa

SEQ ID NO: 541862 - RNA, 22 nt, Human
ucaaaagucugcauucuucaca

SEQ ID NO: 541863 - RNA, 22 nt, Human
agucccuguacuuuccacugcc

SEQ ID NO: 541864 - RNA, 22 nt, Human
ugaaggccacuuccugugagcu

SEQ ID NO: 541865 - RNA, 22 nt, Human
auggcccaggccuccuguggcu

SEQ ID NO: 541866 - RNA, 22 nt, Human
cagugcuccugauguacccuug

SEQ ID NO: 541867 - RNA, 22 nt, Human
caggaaccauuuucucuuuaua

SEQ ID NO: 541868 - RNA, 22 nt, Human
uuuuaucugcuucauuaguuga

SEQ ID NO: 541869 - RNA, 22 nt, Human
uauuacaguucgaguuucuagg

SEQ ID NO: 541870 - RNA, 18 nt, Human
uggccuggagacaacucu

SEQ ID NO: 541871 - RNA, 22 nt, Human
ccugcagguuucccccggacgg

SEQ ID NO: 541872 - RNA, 22 nt, Human
ugcaggcuauccuuugcugcaa

SEQ ID NO: 541873 - RNA, 22 nt, Human
aagcagccaccucaucuccacu

SEQ ID NO: 541874 - RNA, 22 nt, Human
uucuuaagucaguaagaugcaa

SEQ ID NO: 541875 - RNA, 22 nt, Human
ucauugaauuucacagcuuuau

SEQ ID NO: 541876 - RNA, 22 nt, Human
gcauuucagaaagguuaccaac

SEQ ID NO: 541877 - RNA, 22 nt, Human
cagcacuggggggauucggagc

SEQ ID NO: 541878 - RNA, 22 nt, Human
gcccagcagcugguggagaagg

SEQ ID NO: 541879 - RNA, 22 nt, Human
ccuuggaggacugcugcuucuu

SEQ ID NO: 541880 - RNA, 22 nt, Human
aaugaaacuaguagaaucuuug

SEQ ID NO: 541881 - RNA, 22 nt, Human
uguauuuucugaagauaaucaa

SEQ ID NO: 541882 - RNA, 22 nt, Human
uaaagucacagagcaggugcaa

SEQ ID NO: 541883 - RNA, 22 nt, Human
agaauucucuuccauugaaaca

SEQ ID NO: 541884 - RNA, 22 nt, Human
gccuggcuggucacugccuggc

SEQ ID NO: 541885 - RNA, 22 nt, Human
caagauauugauuuccagcuga

SEQ ID NO: 541886 - RNA, 22 nt, Human
gaauuuuaauaaagguuuauca

SEQ ID NO: 541887 - RNA, 22 nt, Human
aaaggccaugguuggaguguuu

SEQ ID NO: 541888 - RNA, 22 nt, Human
acauuugauugaugaaucaaau

SEQ ID NO: 541889 - RNA, 22 nt, Human
aggccagcaagaaagagagucu

SEQ ID NO: 541890 - RNA, 22 nt, Human
gguccagaguccuugcuagaga

SEQ ID NO: 541891 - RNA, 22 nt, Human
aagggagcuuaggagaucaggc

SEQ ID NO: 541892 - RNA, 22 nt, Human
cccagggcccuggacagcuaca

SEQ ID NO: 541893 - RNA, 19 nt, Human
acugggaaaaaggcacugg

SEQ ID NO: 541894 - RNA, 22 nt, Human
ccacacagggggaugaguuauu

SEQ ID NO: 541895 - RNA, 22 nt, Human
cugggccugccaccaucuuagg

SEQ ID NO: 541896 - RNA, 22 nt, Human
caguggucugugcuucuguaca

SEQ ID NO: 541897 - RNA, 22 nt, Human
agugauucuuuaaagugguauu

SEQ ID NO: 541898 - RNA, 22 nt, Human
uuaguuaguggggcugucaguc

SEQ ID NO: 541899 - RNA, 22 nt, Human
uccugggaaguggcuggcugag

SEQ ID NO: 541900 - RNA, 22 nt, Human
agaacagaagggaggaaggccu

SEQ ID NO: 541901 - RNA, 22 nt, Human
caggagcccagaguccucagcu

SEQ ID NO: 541902 - RNA, 22 nt, Human
augggcagaguggggacaggaa

SEQ ID NO: 541903 - RNA, 22 nt, Human
gccuucugaucgcuggacugac

SEQ ID NO: 541904 - RNA, 22 nt, Human
gucccauuucaagaaauucaug

SEQ ID NO: 541905 - RNA, 22 nt, Human
ccucccugucuaccuguugugg

SEQ ID NO: 541906 - RNA, 22 nt, Human
ugugcuucugcagagacuauuu

SEQ ID NO: 541907 - RNA, 22 nt, Human
aucuuugaagaggacuugaagu

SEQ ID NO: 541908 - RNA, 22 nt, Human
guguggcugugggagauguuca

SEQ ID NO: 541909 - RNA, 22 nt, Human
aaggaagaagggaaguuacuua

SEQ ID NO: 541910 - RNA, 22 nt, Human
gcugcccugucugcagcaggac

SEQ ID NO: 541911 - RNA, 22 nt, Human
uccugggacuuucaaggcuagg

SEQ ID NO: 541912 - RNA, 22 nt, Human
aggaccuggaucacagagaucu

SEQ ID NO: 541913 - RNA, 21 nt, Human
aggcugcuggcucaggguccu

SEQ ID NO: 541914 - RNA, 22 nt, Human
auucuguauuucuaauaagauc

SEQ ID NO: 541915 - RNA, 22 nt, Human
gaggcagcugaaggagugacag

SEQ ID NO: 541916 - RNA, 22 nt, Human
ugucagagcaaggccaggccag

SEQ ID NO: 541917 - RNA, 22 nt, Human
aggcugggcuccgcccaacucc

SEQ ID NO: 541918 - RNA, 22 nt, Human
gcuggcuccucuguccucacgg

SEQ ID NO: 541919 - RNA, 23 nt, Human
agacaaaagccucagucuuaggc

SEQ ID NO: 541920 - RNA, 22 nt, Human
ucucagagaagugaugagcaau

SEQ ID NO: 541921 - RNA, 22 nt, Human
aaagcucacaguaauacaaggc

SEQ ID NO: 541922 - RNA, 22 nt, Human
cucaggccauucuuccagcugc

SEQ ID NO: 541923 - RNA, 20 nt, Human
ccagauggucccugugaaaa

SEQ ID NO: 541924 - RNA, 22 nt, Human
aucagagaccggucaagucaug

SEQ ID NO: 541925 - RNA, 22 nt, Human
guggcucuccauugacauggaa

SEQ ID NO: 541926 - RNA, 22 nt, Human
acaguuugcccugacauucucc

SEQ ID NO: 541927 - RNA, 22 nt, Human
acgugcaggaucugguuggcga

SEQ ID NO: 541928 - RNA, 22 nt, Human
caucauuuuauuaaccaagaaa

SEQ ID NO: 541929 - RNA, 17 nt, Human
ccugggaggaguuauga

SEQ ID NO: 541930 - RNA, 22 nt, Human
ucugucacaauuugcuuacucu

SEQ ID NO: 541931 - RNA, 22 nt, Human
gcagggcucugcuguaguccua

SEQ ID NO: 541932 - RNA, 23 nt, Human
cauauucaaaacuggaccacucu

SEQ ID NO: 541933 - RNA, 21 nt, Human
uuugugugucacgugcacagg

SEQ ID NO: 541934 - RNA, 22 nt, Human
cggggcugcgcucuuccugccg

SEQ ID NO: 541935 - RNA, 22 nt, Human
gaauucugguccuguccaaggu

SEQ ID NO: 541936 - RNA, 22 nt, Human
aagaagaugguuaacuuucagu

SEQ ID NO: 541937 - RNA, 22 nt, Human
cuggcugggguccauccucuaa

SEQ ID NO: 541938 - RNA, 20 nt, Human
cccugagaccagagagcagc

SEQ ID NO: 541939 - RNA, 22 nt, Human
acaguguacuccuuuaccggag

SEQ ID NO: 541940 - RNA, 22 nt, Human
agugaguggguuacagauggga

SEQ ID NO: 541941 - RNA, 19 nt, Human
ugcagccacgugagagacu

SEQ ID NO: 541942 - RNA, 22 nt, Human
cagagguagaaggcaugcagug

SEQ ID NO: 541943 - RNA, 22 nt, Human
uccaauuuuacgucuguauaaa

SEQ ID NO: 541944 - RNA, 22 nt, Human
agcagagaggagguggcccugu

SEQ ID NO: 541945 - RNA, 22 nt, Human
acagauggagguuauuaugaac

SEQ ID NO: 541946 - RNA, 22 nt, Human
ucugagagcaucacugggguac

SEQ ID NO: 541947 - RNA, 22 nt, Human
gagcagcugguaggugaaccca

SEQ ID NO: 541948 - RNA, 22 nt, Human
aagcagagagcagaauuaaguu

SEQ ID NO: 541949 - RNA, 22 nt, Human
ucugaggcuucagacuguacug

SEQ ID NO: 541950 - RNA, 22 nt, Human
agcagugggugacagagcugag

SEQ ID NO: 541951 - RNA, 22 nt, Human
aggccagguuccucaaucuuga

SEQ ID NO: 541952 - RNA, 19 nt, Human
gcagagucaagagcugcug

SEQ ID NO: 541953 - RNA, 22 nt, Human
cagcucccagagugaccagcag

SEQ ID NO: 541954 - RNA, 22 nt, Human
ggcagccauacucagaccuggg

SEQ ID NO: 541955 - RNA, 22 nt, Human
ggcuggccuguguggccgccac

SEQ ID NO: 541956 - RNA, 22 nt, Human
aaaucaguuggaacacaagcag

SEQ ID NO: 541957 - RNA, 21 nt, Human
uagagaaaagaagcuguuccu

SEQ ID NO: 541958 - RNA, 22 nt, Human
ugggugggagcacccugucugg

SEQ ID NO: 541959 - RNA, 22 nt, Human
agugggcagugcgcucggaugc

SEQ ID NO: 541960 - RNA, 22 nt, Human
ccugcagggaaucgaggcagaa

SEQ ID NO: 541961 - RNA, 22 nt, Human
aaggcagagggcuggaucagag

SEQ ID NO: 541962 - RNA, 22 nt, Human
cagagcugcuucccaguuugug

SEQ ID NO: 541963 - RNA, 22 nt, Human
uagagcuggccgggacagcugg

SEQ ID NO: 541964 - RNA, 22 nt, Human
aaaugucuuucaauagagaaau

SEQ ID NO: 541965 - RNA, 22 nt, Human
gcugucacauuuggagcacugg

SEQ ID NO: 541966 - RNA, 22 nt, Human
uuucauguuuauggaaaaugag

SEQ ID NO: 541967 - RNA, 22 nt, Human
ggugguggagccagcugggagu

SEQ ID NO: 541968 - RNA, 22 nt, Human
ggccucagaggaggugugaguc

SEQ ID NO: 541969 - RNA, 22 nt, Human
caaggagauaaaauguugagcu

SEQ ID NO: 541970 - RNA, 22 nt, Human
ugguugugcacggagcugcagg

SEQ ID NO: 541971 - RNA, 17 nt, Human
cagaaggaagcauggca

SEQ ID NO: 541972 - RNA, 22 nt, Human
cagcccugggaguuggggccga

SEQ ID NO: 541973 - RNA, 22 nt, Human
gggaagguauuuagcugcugaa

SEQ ID NO: 541974 - RNA, 22 nt, Human
gcucagagauggggaaugaaaa

SEQ ID NO: 541975 - RNA, 22 nt, Human
cauuugaagaagaaacguacua

SEQ ID NO: 541976 - RNA, 22 nt, Human
ugucaguggaccuggagaggcc

SEQ ID NO: 541977 - RNA, 22 nt, Human
gugcuaggauuacaggcauggg

SEQ ID NO: 541978 - RNA, 22 nt, Human
uuucaagaacaacauucauuca

SEQ ID NO: 541979 - RNA, 22 nt, Human
guacagcuaagaauuucaucuu

SEQ ID NO: 541980 - RNA, 22 nt, Human
acugucuccucaucaugccugg

SEQ ID NO: 541981 - RNA, 22 nt, Human
ucagggcucaccagccucugcc

SEQ ID NO: 541982 - RNA, 22 nt, Human
cacuguccaugcuugcuaaccc

SEQ ID NO: 541983 - RNA, 22 nt, Human
caggcccacugcuugucuaguc

SEQ ID NO: 541984 - RNA, 22 nt, Human
uaauagcauuaucaucaaaacu

SEQ ID NO: 541985 - RNA, 22 nt, Human
aaaagcucuuucugcuguagau

SEQ ID NO: 541986 - RNA, 22 nt, Human
uucuucaaggguaaaggcaacg

SEQ ID NO: 541987 - RNA, 23 nt, Human
auuuuaaccuugacuaacaugca

SEQ ID NO: 541988 - RNA, 22 nt, Human
cuggcuggagcuguuguaggcu

SEQ ID NO: 541989 - RNA, 22 nt, Human
acaggcuuacaggcugcaagua

SEQ ID NO: 541990 - RNA, 21 nt, Human
ucuuuucucugcaggauuccu

SEQ ID NO: 541991 - RNA, 22 nt, Human
uucuucaggauacgucauccag

SEQ ID NO: 541992 - RNA, 22 nt, Human
guuauauugccaaguauauugu

SEQ ID NO: 541993 - RNA, 22 nt, Human
uuaugcuaagugcaacaagcca

SEQ ID NO: 541994 - RNA, 22 nt, Human
uccaaaaaacguuugaauaguu

SEQ ID NO: 541995 - RNA, 22 nt, Human
agcagggcaguuaaaggguccu

SEQ ID NO: 541996 - RNA, 22 nt, Human
ugugaguacugcuauuuauaua

SEQ ID NO: 541997 - RNA, 22 nt, Human
cuuauucauaagucagacacac

SEQ ID NO: 541998 - RNA, 22 nt, Human
ggggcucugcucugagccgugu

SEQ ID NO: 541999 - RNA, 22 nt, Human
gugcccuggagggguugaaggg

SEQ ID NO: 542000 - RNA, 22 nt, Human
cccuccccacaaagcuucacac

SEQ ID NO: 542001 - RNA, 22 nt, Human
ugaagauuuuguagcuuucagc

SEQ ID NO: 542002 - RNA, 22 nt, Human
agaaaucaaugaagucugcuaa

SEQ ID NO: 542003 - RNA, 22 nt, Human
gggcugaccaaugccuugcuuu

SEQ ID NO: 542004 - RNA, 22 nt, Human
aaauagcacagcagcugaggcu

SEQ ID NO: 542005 - RNA, 22 nt, Human
acaaaguaagggcuaaugagca

SEQ ID NO: 542006 - RNA, 17 nt, Human
ugagcaguagaagaugc

SEQ ID NO: 542007 - RNA, 20 nt, Human
cagggcucugggccuggccu

SEQ ID NO: 542008 - RNA, 22 nt, Human
guggccucugugcuccugccua

SEQ ID NO: 542009 - RNA, 22 nt, Human
ugggcagggucucuguuaucag

SEQ ID NO: 542010 - RNA, 22 nt, Human
acaggcucuggggcaggauggc

SEQ ID NO: 542011 - RNA, 22 nt, Human
gcucccagguucuugggccuug

SEQ ID NO: 542012 - RNA, 23 nt, Human
uggugccucagaagcagugggcu

SEQ ID NO: 542013 - RNA, 22 nt, Human
ucgauguggugacaagguacgu

SEQ ID NO: 542014 - RNA, 22 nt, Human
ugcucugggcucaauggcagcu

SEQ ID NO: 542015 - RNA, 22 nt, Human
aggagcugagggagcgcccuug

SEQ ID NO: 542016 - RNA, 22 nt, Human
ccuggcugcauuuugcuggaug

SEQ ID NO: 542017 - RNA, 23 nt, Human
uuuauuuauuuaggcugagggau

SEQ ID NO: 542018 - RNA, 22 nt, Human
agggagacacaugaggaaguca

SEQ ID NO: 542019 - RNA, 22 nt, Human
aggcagccugguuugaauggaa

SEQ ID NO: 542020 - RNA, 22 nt, Human
ugaguagggguagaaaguuuag

SEQ ID NO: 542021 - RNA, 22 nt, Human
augccuuauuccaacaaucuag

SEQ ID NO: 542022 - RNA, 22 nt, Human
caaauacuaaacauaagauuuu

SEQ ID NO: 542023 - RNA, 22 nt, Human
uguguguauaugcauuuaucua

SEQ ID NO: 542024 - RNA, 22 nt, Human
ucauugcagaaauaaaggugaa

SEQ ID NO: 542025 - RNA, 21 nt, Human
uagcuucuugaggcuuggccg

SEQ ID NO: 542026 - RNA, 22 nt, Human
cacauugaaccauauauuagug

SEQ ID NO: 542027 - RNA, 22 nt, Human
gucucagauucagacaucuaca

SEQ ID NO: 542028 - RNA, 21 nt, Human
acagaugggaugagcacacug

SEQ ID NO: 542029 - RNA, 22 nt, Human
aaucauaauuguauacauucau

SEQ ID NO: 542030 - RNA, 22 nt, Human
acucugugugaguagagccugu

SEQ ID NO: 542031 - RNA, 22 nt, Human
gcagagcagugcuugcccagcg

SEQ ID NO: 542032 - RNA, 18 nt, Human
uggacaggguggagaaaa

SEQ ID NO: 542033 - RNA, 22 nt, Human
gccauccucugagcacuaggca

SEQ ID NO: 542034 - RNA, 21 nt, Human
uugcaacaaccuauauauuuu

SEQ ID NO: 542035 - RNA, 22 nt, Human
uuaagaauggaaugaggaauuu

SEQ ID NO: 542036 - RNA, 22 nt, Human
ggugcaggcgguggggcaagua

SEQ ID NO: 542037 - RNA, 22 nt, Human
ucacaacuugaagcugauuuaa

SEQ ID NO: 542038 - RNA, 22 nt, Human
agugggguccaucccuucccuc

SEQ ID NO: 542039 - RNA, 22 nt, Human
gucccaggcagagucaggaggg

SEQ ID NO: 542040 - RNA, 21 nt, Human
gcagagccggggcgagaaggc

SEQ ID NO: 542041 - RNA, 22 nt, Human
aggcuccuugcucacaggcuca

SEQ ID NO: 542042 - RNA, 22 nt, Human
aucuaagaguuaacaucaagaa

SEQ ID NO: 542043 - RNA, 22 nt, Human
gagaggccaccugacgagcagu

SEQ ID NO: 542044 - RNA, 22 nt, Human
caggugggagcggagacugauu

SEQ ID NO: 542045 - RNA, 22 nt, Human
uuucacagaaaggauaacauua

SEQ ID NO: 542046 - RNA, 22 nt, Human
uuucaaagggaaguuaugaagu

SEQ ID NO: 542047 - RNA, 22 nt, Human
gauucuuuggccuuuauugaca

SEQ ID NO: 542048 - RNA, 22 nt, Human
aaacaagucacuuuaucuugaa

SEQ ID NO: 542049 - RNA, 22 nt, Human
gcaggcugcugagauccuuagg

SEQ ID NO: 542050 - RNA, 22 nt, Human
ucacagacacagggagaagcau

SEQ ID NO: 542051 - RNA, 21 nt, Human
accaggcuugugggagggagc

SEQ ID NO: 542052 - RNA, 22 nt, Human
auguucugccuccauuuugagu

SEQ ID NO: 542053 - RNA, 21 nt, Human
ugggugcaagcugcggaugcu

SEQ ID NO: 542054 - RNA, 22 nt, Human
agccagggauggcagugcccag

SEQ ID NO: 542055 - RNA, 22 nt, Human
agggagaaaauuggaugcacaa

SEQ ID NO: 542056 - RNA, 19 nt, Human
aaccuuuagaucauucucc

SEQ ID NO: 542057 - RNA, 21 nt, Human
uugggccuuuucugguagcuu

SEQ ID NO: 542058 - RNA, 22 nt, Human
cauuaggguaauugaacacuua

SEQ ID NO: 542059 - RNA, 22 nt, Human
uuggcauuggagaugcaagaac

SEQ ID NO: 542060 - RNA, 22 nt, Human
uccagaguacggaagagucauc

SEQ ID NO: 542061 - RNA, 22 nt, Human
uugguucaacuuuucuaaguag

SEQ ID NO: 542062 - RNA, 22 nt, Human
ccugccugcguccucugagggc

SEQ ID NO: 542063 - RNA, 22 nt, Human
guacuuccguggacuaauuguu

SEQ ID NO: 542064 - RNA, 22 nt, Human
ugacuucaaaggcucuacuccu

SEQ ID NO: 542065 - RNA, 22 nt, Human
ugcugccagccaggccauggag

SEQ ID NO: 542066 - RNA, 20 nt, Human
augugagggguugaaguggg

SEQ ID NO: 542067 - RNA, 22 nt, Human
ggcagcugauuagcaucaagga

SEQ ID NO: 542068 - RNA, 22 nt, Human
aucagaagaaauggaugugacu

SEQ ID NO: 542069 - RNA, 20 nt, Human
cucuuaaauguaaaguaggc

SEQ ID NO: 542070 - RNA, 22 nt, Human
caucacagggggcuagaagucu

SEQ ID NO: 542071 - RNA, 22 nt, Human
gcaggcugagaguccaagaagg

SEQ ID NO: 542072 - RNA, 22 nt, Human
gcagauggagauaaauggaacu

SEQ ID NO: 542073 - RNA, 22 nt, Human
ggccucucaugcccagagccaa

SEQ ID NO: 542074 - RNA, 22 nt, Human
aguggggccggugaggccgagg

SEQ ID NO: 542075 - RNA, 22 nt, Human
uuugcauugccucugacuuaug

SEQ ID NO: 542076 - RNA, 22 nt, Human
aaggaggcccucuccuucugga

SEQ ID NO: 542077 - RNA, 22 nt, Human
ucugggcuuuguaaugggaggu

SEQ ID NO: 542078 - RNA, 22 nt, Human
gggcaaaggcagaaagcggugu

SEQ ID NO: 542079 - RNA, 22 nt, Human
uggaccugagccuggcccugcc

SEQ ID NO: 542080 - RNA, 22 nt, Human
gcacagcagccgaaaugcccuu

SEQ ID NO: 542081 - RNA, 22 nt, Human
uggcagcuuccugcucauagga

SEQ ID NO: 542082 - RNA, 22 nt, Human
cucagagaaaugucacaacaau

SEQ ID NO: 542083 - RNA, 22 nt, Human
ucagcucuguuuugaguggaac

SEQ ID NO: 542084 - RNA, 22 nt, Human
aaugucauugagcuccaauccu

SEQ ID NO: 542085 - RNA, 22 nt, Human
uggcagcuccuggggccagcac

SEQ ID NO: 542086 - RNA, 22 nt, Human
aggcacagcacaccuggccccc

SEQ ID NO: 542087 - RNA, 22 nt, Human
agucacuguucugucaugucaa

SEQ ID NO: 542088 - RNA, 22 nt, Human
agcagaggaggauuuaguuagg

SEQ ID NO: 542089 - RNA, 22 nt, Human
cugccaugcaguuagucccuca

SEQ ID NO: 542090 - RNA, 22 nt, Human
cgggcuccgggucuuugcaguc

SEQ ID NO: 542091 - RNA, 22 nt, Human
acaguuucuccauuuacaccuu

SEQ ID NO: 542092 - RNA, 22 nt, Human
aaugcacaugucuuggccucac

SEQ ID NO: 542093 - RNA, 22 nt, Human
uaacaguagccuuauguggucu

SEQ ID NO: 542094 - RNA, 22 nt, Human
cacagcugcacagaggaggugc

SEQ ID NO: 542095 - RNA, 22 nt, Human
acugucaaauuuauggaaagag

SEQ ID NO: 542096 - RNA, 22 nt, Human
auguaguguagagauuagucuc

SEQ ID NO: 542097 - RNA, 22 nt, Human
uuugcaaagaaauuauugcugu

SEQ ID NO: 542098 - RNA, 22 nt, Human
agcagcaggcuuaaggaaaagu

SEQ ID NO: 542099 - RNA, 23 nt, Human
uguaucuguacuauuccugccuc

SEQ ID NO: 542100 - RNA, 22 nt, Human
acuaaaacaguggcuaguagac

SEQ ID NO: 542101 - RNA, 22 nt, Human
agcagccaguucucugugguag

SEQ ID NO: 542102 - RNA, 22 nt, Human
ggccagcccagugguccucucu

SEQ ID NO: 542103 - RNA, 22 nt, Human
aauuucuugggagcucagagaa

SEQ ID NO: 542104 - RNA, 22 nt, Human
caacagcugaucuuugaugaag

SEQ ID NO: 542105 - RNA, 18 nt, Human
agauuuugagaaauacaa

SEQ ID NO: 542106 - RNA, 22 nt, Human
uacauuaacuuacguccacaug

SEQ ID NO: 542107 - RNA, 22 nt, Human
aguccaaggagagacagcauuu

SEQ ID NO: 542108 - RNA, 22 nt, Human
ggcaggguggcagaggcucaga

SEQ ID NO: 542109 - RNA, 22 nt, Human
cugggcucuguguuucaguuuc

SEQ ID NO: 542110 - RNA, 22 nt, Human
uguccacaucacucacuuguca

SEQ ID NO: 542111 - RNA, 22 nt, Human
caguagcagggauuauuuuagg

SEQ ID NO: 542112 - RNA, 22 nt, Human
uauacagaaagaauucaagucu

SEQ ID NO: 542113 - RNA, 22 nt, Human
ugggaggaucgcuugagcccag

SEQ ID NO: 542114 - RNA, 22 nt, Human
ugggccugggcuccuguccucu

SEQ ID NO: 542115 - RNA, 22 nt, Human
ugaggcaguugagcuuccugag

SEQ ID NO: 542116 - RNA, 22 nt, Human
agcaggugggcaugaaagcuga

SEQ ID NO: 542117 - RNA, 22 nt, Human
accaugccaguggcagccagac

SEQ ID NO: 542118 - RNA, 22 nt, Human
aauaugaauuauuguuacaagu

SEQ ID NO: 542119 - RNA, 22 nt, Human
auacauguucguguacauguuc

SEQ ID NO: 542120 - RNA, 22 nt, Human
agaagcuugaaggagcagugac

SEQ ID NO: 542121 - RNA, 22 nt, Human
cagauacagguuuuuguuagau

SEQ ID NO: 542122 - RNA, 22 nt, Human
augcaacaaaugcuacgaaucg

SEQ ID NO: 542123 - RNA, 22 nt, Human
aucagaaucauuucaucccuau

SEQ ID NO: 542124 - RNA, 22 nt, Human
cugggccucaaucucagaguuu

SEQ ID NO: 542125 - RNA, 17 nt, Human
uaaauacacaaggguau

SEQ ID NO: 542126 - RNA, 22 nt, Human
agagacuguacguggcaaguau

SEQ ID NO: 542127 - RNA, 23 nt, Human
caaauucuaggcaggcucuuuug

SEQ ID NO: 542128 - RNA, 22 nt, Human
acauuucuggaguuucucaaca

SEQ ID NO: 542129 - RNA, 22 nt, Human
gacccuggaguuaguccugugu

SEQ ID NO: 542130 - RNA, 22 nt, Human
gagagugaugaaugguuaaaca

SEQ ID NO: 542131 - RNA, 22 nt, Human
caggaaccuugucuguguuguu

SEQ ID NO: 542132 - RNA, 22 nt, Human
uccagggaugccagccauguug

SEQ ID NO: 542133 - RNA, 22 nt, Human
gaaaucugaacucuguauccuu

SEQ ID NO: 542134 - RNA, 22 nt, Human
ugagcccagagcccuuguaggg

SEQ ID NO: 542135 - RNA, 22 nt, Human
agaacagaugugggcagaccug

SEQ ID NO: 542136 - RNA, 22 nt, Human
uggcagaauuucuagcagauuc

SEQ ID NO: 542137 - RNA, 22 nt, Human
ucauuuuuugcauaccuguguc

SEQ ID NO: 542138 - RNA, 22 nt, Human
ucaccuguauuaauacagaacu

SEQ ID NO: 542139 - RNA, 22 nt, Human
ggcacagggaggcccuggugug

SEQ ID NO: 542140 - RNA, 23 nt, Human
uuucacaaugagcauuacagaau

SEQ ID NO: 542141 - RNA, 22 nt, Human
uagcuuuaauaagcugcugaau

SEQ ID NO: 542142 - RNA, 22 nt, Human
ccucuuccacugggccccaucc

SEQ ID NO: 542143 - RNA, 22 nt, Human
gugucccaauguucaggacggc

SEQ ID NO: 542144 - RNA, 23 nt, Human
agcagcugugguuuaccuuagua

SEQ ID NO: 542145 - RNA, 22 nt, Human
uccaggcaguuuuccagguugu

SEQ ID NO: 542146 - RNA, 22 nt, Human
cagcuacuccucccaugacuuc

SEQ ID NO: 542147 - RNA, 22 nt, Human
cuucugugcuucacaguugcca

SEQ ID NO: 542148 - RNA, 22 nt, Human
gggcccacuggcugucugaccc

SEQ ID NO: 542149 - RNA, 22 nt, Human
uccauggggcccaggaugagag

SEQ ID NO: 542150 - RNA, 22 nt, Human
agaguguaauaagggcaagggc

SEQ ID NO: 542151 - RNA, 22 nt, Human
ucuccugucuucucagcacccc

SEQ ID NO: 542152 - RNA, 22 nt, Human
gcagcuuugaagacuuauuugc

SEQ ID NO: 542153 - RNA, 22 nt, Human
caagggcucuuuugaggaaugu

SEQ ID NO: 542154 - RNA, 22 nt, Human
gacacagcacuguacaaggaau

SEQ ID NO: 542155 - RNA, 22 nt, Human
agcucccagcagagcuggccac

SEQ ID NO: 542156 - RNA, 22 nt, Human
ggcugcagauagccagccacca

SEQ ID NO: 542157 - RNA, 22 nt, Human
gccuucagcccugacuggccag

SEQ ID NO: 542158 - RNA, 22 nt, Human
ccuggcagcuccuccccggcgg

SEQ ID NO: 542159 - RNA, 22 nt, Human
uggcucugcugaaccuagugca

SEQ ID NO: 542160 - RNA, 22 nt, Human
gcccugcucauuucacguguuu

SEQ ID NO: 542161 - RNA, 22 nt, Human
gucaggaugcuauuguuauuaa

SEQ ID NO: 542162 - RNA, 22 nt, Human
ugcuuuauucgacaucugguag

SEQ ID NO: 542163 - RNA, 22 nt, Human
agaugcugucacacacacuguu

SEQ ID NO: 542164 - RNA, 22 nt, Human
aagcauuucuguuuaucuaucg

SEQ ID NO: 542165 - RNA, 17 nt, Human
uggagcugcguguguuc

SEQ ID NO: 542166 - RNA, 22 nt, Human
agggacacacuccaguguuauu

SEQ ID NO: 542167 - RNA, 22 nt, Human
agcaggcugcuggcguugaagu

SEQ ID NO: 542168 - RNA, 22 nt, Human
cuggacaggaagaauugggagc

SEQ ID NO: 542169 - RNA, 22 nt, Human
gaggaaaaugggacaggcugua

SEQ ID NO: 542170 - RNA, 22 nt, Human
ucuuucuugugggugcccuuuu

SEQ ID NO: 542171 - RNA, 22 nt, Human
gcccuggagagggauauggcau

SEQ ID NO: 542172 - RNA, 22 nt, Human
aggcagaugguaacugugauau

SEQ ID NO: 542173 - RNA, 22 nt, Human
agagcuggaaucagaccucagg

SEQ ID NO: 542174 - RNA, 22 nt, Human
uccuugaacagagggccugggu

SEQ ID NO: 542175 - RNA, 22 nt, Human
aguuuuaagaugcgcuucuguu

SEQ ID NO: 542176 - RNA, 22 nt, Human
cugagccaaggggacagugaca

SEQ ID NO: 542177 - RNA, 22 nt, Human
agccuucaguaaauccacugug

SEQ ID NO: 542178 - RNA, 22 nt, Human
cucuggagaacuccuugugucu

SEQ ID NO: 542179 - RNA, 22 nt, Human
ggagggugcauuuuacccugug

SEQ ID NO: 542180 - RNA, 22 nt, Human
uuucagaugcaauuaauuuuca

SEQ ID NO: 542181 - RNA, 22 nt, Human
gacuauuuuuaucuaacugggu

SEQ ID NO: 542182 - RNA, 20 nt, Human
guaaaauauggucuuugggu

SEQ ID NO: 542183 - RNA, 22 nt, Human
ugguaccagcuguguguucacu

SEQ ID NO: 542184 - RNA, 22 nt, Human
gggcuggcugauuuuccucucu

SEQ ID NO: 542185 - RNA, 22 nt, Human
gcugagcugggacaguccuggg

SEQ ID NO: 542186 - RNA, 22 nt, Human
uuucagaugugugucucugaag

SEQ ID NO: 542187 - RNA, 23 nt, Human
ccucagcauggcaggagcccagc

SEQ ID NO: 542188 - RNA, 22 nt, Human
cauaacauugagcagcauuccu

SEQ ID NO: 542189 - RNA, 19 nt, Human
ucaggaaguugaugaggug

SEQ ID NO: 542190 - RNA, 22 nt, Human
uucugggggccaggacaguggu

SEQ ID NO: 542191 - RNA, 22 nt, Human
uccaggaggccucauuuccugu

SEQ ID NO: 542192 - RNA, 22 nt, Human
ggccagagaauaugccuuacgu

SEQ ID NO: 542193 - RNA, 22 nt, Human
auuuccucaugaucauaaugca

SEQ ID NO: 542194 - RNA, 22 nt, Human
cagaacuggccuuucaucaguc

SEQ ID NO: 542195 - RNA, 18 nt, Human
cggcagagugcuucuagc

SEQ ID NO: 542196 - RNA, 22 nt, Human
ugagagaggggacugccugcuu

SEQ ID NO: 542197 - RNA, 17 nt, Human
aggugcagaggcagagc

SEQ ID NO: 542198 - RNA, 22 nt, Human
ugcagaggagucagccugggca

SEQ ID NO: 542199 - RNA, 22 nt, Human
agaugaagacucaggagcaggu

SEQ ID NO: 542200 - RNA, 22 nt, Human
uaugcacacauuagcacagggu

SEQ ID NO: 542201 - RNA, 22 nt, Human
gcagccacacuguuacagaaug

SEQ ID NO: 542202 - RNA, 22 nt, Human
guauuuguaguagcauagaauu

SEQ ID NO: 542203 - RNA, 22 nt, Human
cagggagcuggcuggcugugcc

SEQ ID NO: 542204 - RNA, 22 nt, Human
cucagggggaaucaggucacag

SEQ ID NO: 542205 - RNA, 22 nt, Human
aagcacagagagguaaaguaac

SEQ ID NO: 542206 - RNA, 22 nt, Human
uggaagaauagaagaugguuga

SEQ ID NO: 542207 - RNA, 22 nt, Human
uacaugaacaaaauagcagaaa

SEQ ID NO: 542208 - RNA, 22 nt, Human
uucacauuagugguucuauaua

SEQ ID NO: 542209 - RNA, 22 nt, Human
cagcacaggucaguuuuuuaag

SEQ ID NO: 542210 - RNA, 22 nt, Human
auuuccauacacccauuucuga

SEQ ID NO: 542211 - RNA, 22 nt, Human
aauuaugagguagauaucacau

SEQ ID NO: 542212 - RNA, 22 nt, Human
gcaggagcuuugcuuacugcug

SEQ ID NO: 542213 - RNA, 22 nt, Human
uccagccuuucuacucacugag

SEQ ID NO: 542214 - RNA, 22 nt, Human
ggaggagacggagugauuagug

SEQ ID NO: 542215 - RNA, 22 nt, Human
aaagccaguuucuggaaguacc

SEQ ID NO: 542216 - RNA, 22 nt, Human
acugggcauuuugaacguucuu

SEQ ID NO: 542217 - RNA, 22 nt, Human
gggagggaaagcuugaucuguc

SEQ ID NO: 542218 - RNA, 22 nt, Human
guccucuggagguuuuuaggug

SEQ ID NO: 542219 - RNA, 22 nt, Human
acaggcucgugcgcgcacgugu

SEQ ID NO: 542220 - RNA, 18 nt, Human
gaugaagcugcuggggau

SEQ ID NO: 542221 - RNA, 22 nt, Human
gaggccuggaauuccagccugg

SEQ ID NO: 542222 - RNA, 22 nt, Human
gguagcagggcugugagucaga

SEQ ID NO: 542223 - RNA, 22 nt, Human
aggcaccuugagagcaggagcu

SEQ ID NO: 542224 - RNA, 22 nt, Human
ucuuuucuccagaccugggauc

SEQ ID NO: 542225 - RNA, 22 nt, Human
ugaaaucuccucuuuauauauc

SEQ ID NO: 542226 - RNA, 22 nt, Human
uuguuacacauaauaacauuuu

SEQ ID NO: 542227 - RNA, 20 nt, Human
ccagagcagccacugaaguu

SEQ ID NO: 542228 - RNA, 22 nt, Human
uggaaagaaaaacaggccauga

SEQ ID NO: 542229 - RNA, 18 nt, Human
acugccuggcgaagauag

SEQ ID NO: 542230 - RNA, 22 nt, Human
gagaggggcgcgcagcucgcga

SEQ ID NO: 542231 - RNA, 22 nt, Human
agcagguggucuguugcugcug

SEQ ID NO: 542232 - RNA, 22 nt, Human
accucaggauguggacacagaa

SEQ ID NO: 542233 - RNA, 22 nt, Human
ugccaggcccucccacagauua

SEQ ID NO: 542234 - RNA, 22 nt, Human
uuacaauaccacaucaccucau

SEQ ID NO: 542235 - RNA, 22 nt, Human
ucucccagaggaucccagugga

SEQ ID NO: 542236 - RNA, 22 nt, Human
aucaacaugaauuucucugaag

SEQ ID NO: 542237 - RNA, 22 nt, Human
ggcaccuggagguuuacuggau

SEQ ID NO: 542238 - RNA, 22 nt, Human
acucugaggcaggucagggcag

SEQ ID NO: 542239 - RNA, 17 nt, Human
cugagcauccgugcucu

SEQ ID NO: 542240 - RNA, 22 nt, Human
ccugggagcuguggaaaggcug

SEQ ID NO: 542241 - RNA, 21 nt, Human
uaccaauugccuucuaguugu

SEQ ID NO: 542242 - RNA, 22 nt, Human
gaagccucaacaucucugcguc

SEQ ID NO: 542243 - RNA, 22 nt, Human
ugcagugugaccuguagcgagc

SEQ ID NO: 542244 - RNA, 22 nt, Human
acagccugcagccccaggucgc

SEQ ID NO: 542245 - RNA, 22 nt, Human
uaacagaaacagauaaguguaa

SEQ ID NO: 542246 - RNA, 22 nt, Human
cugggagcggcugucacugguu

SEQ ID NO: 542247 - RNA, 22 nt, Human
agggcgacaauggagagcguuu

SEQ ID NO: 542248 - RNA, 17 nt, Human
ucugccgacugccagcu

SEQ ID NO: 542249 - RNA, 22 nt, Human
agcugcuaugacaacaccagcc

SEQ ID NO: 542250 - RNA, 22 nt, Human
ucuuucaaugagcauucuuucc

SEQ ID NO: 542251 - RNA, 22 nt, Human
agcuggcuaugcccugugaacc

SEQ ID NO: 542252 - RNA, 22 nt, Human
uacacauaggucugaauaaaaa

SEQ ID NO: 542253 - RNA, 22 nt, Human
caggcaggagaggaggauuucu

SEQ ID NO: 542254 - RNA, 22 nt, Human
uucucuuacauuuucucagccu

SEQ ID NO: 542255 - RNA, 22 nt, Human
auuuguuucagggccuugguau

SEQ ID NO: 542256 - RNA, 22 nt, Human
ucaaauaaugccauucaucauc

SEQ ID NO: 542257 - RNA, 22 nt, Human
accaaggagacaaagguguauu

SEQ ID NO: 542258 - RNA, 22 nt, Human
aauguuaauguguuugcuuaug

SEQ ID NO: 542259 - RNA, 22 nt, Human
aauuaacaaauguagcugugau

SEQ ID NO: 542260 - RNA, 22 nt, Human
ugcucugcacaucccucacaaa

SEQ ID NO: 542261 - RNA, 22 nt, Human
aucaaaucauugcauuaauguu

SEQ ID NO: 542262 - RNA, 22 nt, Human
agagugggacacgggcgcuguc

SEQ ID NO: 542263 - RNA, 22 nt, Human
gcccugcugcuggcagaggcgc

SEQ ID NO: 542264 - RNA, 19 nt, Human
uuuacaaguucuuuguaug

SEQ ID NO: 542265 - RNA, 22 nt, Human
gccaggcagccacccucugcga

SEQ ID NO: 542266 - RNA, 22 nt, Human
ucaaaguuggaaaagcuggccc

SEQ ID NO: 542267 - RNA, 22 nt, Human
ggccaugguuggggaagacaug

SEQ ID NO: 542268 - RNA, 22 nt, Human
uguuugcucugacuaucuugcg

SEQ ID NO: 542269 - RNA, 21 nt, Human
ggcagccucuguggaagggga

SEQ ID NO: 542270 - RNA, 22 nt, Human
ugaagccuuguguggccucucu

SEQ ID NO: 542271 - RNA, 22 nt, Human
agauacaucauuuauaccuuca

SEQ ID NO: 542272 - RNA, 22 nt, Human
aaguccagggaucaaaguaggc

SEQ ID NO: 542273 - RNA, 22 nt, Human
uuucacagcagugugcugcuuu

SEQ ID NO: 542274 - RNA, 22 nt, Human
ugaguccaucgcagggaagugg

SEQ ID NO: 542275 - RNA, 22 nt, Human
auguuuguguuacacucugcag

SEQ ID NO: 542276 - RNA, 22 nt, Human
uggcagagucaucacaucugga

SEQ ID NO: 542277 - RNA, 22 nt, Human
agguuacagugauuauagguuu

SEQ ID NO: 542278 - RNA, 22 nt, Human
uccugagauucugcauuucuaa

SEQ ID NO: 542279 - RNA, 20 nt, Human
cuaucuccuggcgugccuuc

SEQ ID NO: 542280 - RNA, 22 nt, Human
gccugagagucugcauuucuaa

SEQ ID NO: 542281 - RNA, 17 nt, Human
ugaaggccaugaccacg

SEQ ID NO: 542282 - RNA, 22 nt, Human
caguucugacuuucauaauguc

SEQ ID NO: 542283 - RNA, 22 nt, Human
ucaaaggcauugccaauaagua

SEQ ID NO: 542284 - RNA, 22 nt, Human
ucagagucuaugcaacagaauu

SEQ ID NO: 542285 - RNA, 21 nt, Human
ucagggcagcugcucuucaga

SEQ ID NO: 542286 - RNA, 22 nt, Human
guucacagggauccuuguugaa

SEQ ID NO: 542287 - RNA, 22 nt, Human
gucaggagauagggcaagcuuc

SEQ ID NO: 542288 - RNA, 22 nt, Human
ugagggugggccugcaggaaga

SEQ ID NO: 542289 - RNA, 22 nt, Human
auagaccuucuacacaggacaa

SEQ ID NO: 542290 - RNA, 22 nt, Human
gccaccagcagaaaaggggcca

SEQ ID NO: 542291 - RNA, 22 nt, Human
aguguggcugcguagggcucuc

SEQ ID NO: 542292 - RNA, 22 nt, Human
uugcaucaguccucaauaaaau

SEQ ID NO: 542293 - RNA, 21 nt, Human
aguugcauaggccagccaucc

SEQ ID NO: 542294 - RNA, 22 nt, Human
guuagggagggugcauaugugu

SEQ ID NO: 542295 - RNA, 22 nt, Human
gagcugguuuuaggcuaugucu

SEQ ID NO: 542296 - RNA, 22 nt, Human
ugacagaacagguugggagcaa

SEQ ID NO: 542297 - RNA, 22 nt, Human
gagagcuggauucuggauaggu

SEQ ID NO: 542298 - RNA, 22 nt, Human
uggggccugagguggagcugca

SEQ ID NO: 542299 - RNA, 22 nt, Human
acuuuucucccuccugccuuca

SEQ ID NO: 542300 - RNA, 22 nt, Human
gcagcugaagcugcaguuccag

SEQ ID NO: 542301 - RNA, 22 nt, Human
agccagggagguggagguugca

SEQ ID NO: 542302 - RNA, 21 nt, Human
ucucccaaggagguccugagg

SEQ ID NO: 542303 - RNA, 22 nt, Human
caaagucauaaaacuuguaagu

SEQ ID NO: 542304 - RNA, 19 nt, Human
ugcccugcccgcagccuug

SEQ ID NO: 542305 - RNA, 22 nt, Human
aggcuggcgucaggggcuguac

SEQ ID NO: 542306 - RNA, 22 nt, Human
cagugauguuucugcaucagag

SEQ ID NO: 542307 - RNA, 22 nt, Human
gcuggggagcaagaguagugag

SEQ ID NO: 542308 - RNA, 22 nt, Human
cuucagagcaucacuucagcug

SEQ ID NO: 542309 - RNA, 22 nt, Human
gggagguguucugccaacgcgg

SEQ ID NO: 542310 - RNA, 22 nt, Human
acaaagugaaaagcaucgaauu

SEQ ID NO: 542311 - RNA, 22 nt, Human
ccaguguuuacaguugaacaaa

SEQ ID NO: 542312 - RNA, 22 nt, Human
ugggccucuguuuccucaucug

SEQ ID NO: 542313 - RNA, 22 nt, Human
caaagucauggggaugcagguc

SEQ ID NO: 542314 - RNA, 22 nt, Human
aguggagugaguggcagaagga

SEQ ID NO: 542315 - RNA, 20 nt, Human
ugcuguaagauuagagagcu

SEQ ID NO: 542316 - RNA, 18 nt, Human
cagauccaggcagcuauu

SEQ ID NO: 542317 - RNA, 22 nt, Human
ucuggagauaagacagacagau

SEQ ID NO: 542318 - RNA, 22 nt, Human
uauuuaauuagugauuguagag

SEQ ID NO: 542319 - RNA, 20 nt, Human
ugugggcccuuggcuggcaa

SEQ ID NO: 542320 - RNA, 22 nt, Human
gccaggcaggugucggagcccu

SEQ ID NO: 542321 - RNA, 22 nt, Human
agccucugguccucccucagcu

SEQ ID NO: 542322 - RNA, 20 nt, Human
caucagaaauccugacccac

SEQ ID NO: 542323 - RNA, 22 nt, Human
acccugccucugcuuccuguag

SEQ ID NO: 542324 - RNA, 22 nt, Human
gcagugaacauaacacagaagg

SEQ ID NO: 542325 - RNA, 22 nt, Human
ccacuguaguuaugaugaaguu

SEQ ID NO: 542326 - RNA, 22 nt, Human
gaaggaaguuuauuuuagaaga

SEQ ID NO: 542327 - RNA, 22 nt, Human
uauacagaacauuaagaacugu

SEQ ID NO: 542328 - RNA, 22 nt, Human
aagauguaucaguuaagucuuc

SEQ ID NO: 542329 - RNA, 22 nt, Human
ucuuagaaaugaaguucuuucu

SEQ ID NO: 542330 - RNA, 22 nt, Human
cuccuggaguccuuuccuauuc

SEQ ID NO: 542331 - RNA, 22 nt, Human
ucagaggccugaaagaauuugg

SEQ ID NO: 542332 - RNA, 22 nt, Human
uaggaaaauaucucuuauuggg

SEQ ID NO: 542333 - RNA, 22 nt, Human
caccaggugcuggaggacauca

SEQ ID NO: 542334 - RNA, 22 nt, Human
gugcccagugcaggcccgcagg

SEQ ID NO: 542335 - RNA, 22 nt, Human
ggugggugagcccugggagcug

SEQ ID NO: 542336 - RNA, 22 nt, Human
cugcuuugggcagcuuuguggc

SEQ ID NO: 542337 - RNA, 22 nt, Human
acacugaaugcuguuuagaaau

SEQ ID NO: 542338 - RNA, 22 nt, Human
ccucuugccaaucagcuacaga

SEQ ID NO: 542339 - RNA, 18 nt, Human
uguaaacacuuucauucu

SEQ ID NO: 542340 - RNA, 22 nt, Human
gcagugaaacaauaggaucaaa

SEQ ID NO: 542341 - RNA, 22 nt, Human
agcucuccacacauaggacuag

SEQ ID NO: 542342 - RNA, 22 nt, Human
gugauucauucgauuaguauuu

SEQ ID NO: 542343 - RNA, 22 nt, Human
agaauauaaagauaauucuguu

SEQ ID NO: 542344 - RNA, 22 nt, Human
gugcccugaggucuucacuuug

SEQ ID NO: 542345 - RNA, 22 nt, Human
caggcagcccugcaccaagugu

SEQ ID NO: 542346 - RNA, 23 nt, Human
ggcagagagcauggcuggggccc

SEQ ID NO: 542347 - RNA, 22 nt, Human
aggcuggcaaggcagaugugug

SEQ ID NO: 542348 - RNA, 22 nt, Human
agcugcagagguuugugcaaca

SEQ ID NO: 542349 - RNA, 21 nt, Human
gaaguacaccaggaaggccac

SEQ ID NO: 542350 - RNA, 22 nt, Human
uuucuuguaagauguuuauuaa

SEQ ID NO: 542351 - RNA, 22 nt, Human
gaaguuaguguggaugcaggga

SEQ ID NO: 542352 - RNA, 22 nt, Human
guccucaguaagagggccucug

SEQ ID NO: 542353 - RNA, 22 nt, Human
agggcccaggacagcaucaggg

SEQ ID NO: 542354 - RNA, 22 nt, Human
uuguaacagcugcuuaauagag

SEQ ID NO: 542355 - RNA, 22 nt, Human
ggcagcucugugucugggaagc

SEQ ID NO: 542356 - RNA, 22 nt, Human
uggcccugcuggccaaaggcua

SEQ ID NO: 542357 - RNA, 23 nt, Human
gaaagucaauaugguagcuuuga

SEQ ID NO: 542358 - RNA, 22 nt, Human
ggugcagagcagugucagagca

SEQ ID NO: 542359 - RNA, 22 nt, Human
aucugccugagucuagguuuuc

SEQ ID NO: 542360 - RNA, 22 nt, Human
agcugagcugcagaugacugua

SEQ ID NO: 542361 - RNA, 22 nt, Human
ugauuuguuuagugccaaguuu

SEQ ID NO: 542362 - RNA, 17 nt, Human
caggccuugagccuuua

SEQ ID NO: 542363 - RNA, 22 nt, Human
gcagagcugggucuguauccaa

SEQ ID NO: 542364 - RNA, 22 nt, Human
ucucagagaucuuucugcaugu

SEQ ID NO: 542365 - RNA, 22 nt, Human
ggacucagcagccaggaguggc

SEQ ID NO: 542366 - RNA, 22 nt, Human
uuuacaaguacaccuaacagcu

SEQ ID NO: 542367 - RNA, 22 nt, Human
gcuggccuccugcuagauggaa

SEQ ID NO: 542368 - RNA, 20 nt, Human
gugcccugugggcuauuuuc

SEQ ID NO: 542369 - RNA, 23 nt, Human
ucugucacuuucugcuguggagu

SEQ ID NO: 542370 - RNA, 22 nt, Human
uaguauuuaaucacuuuugucu

SEQ ID NO: 542371 - RNA, 22 nt, Human
cucaggauggaagccuacagga

SEQ ID NO: 542372 - RNA, 22 nt, Human
ggcuccuguccuccuggagcuc

SEQ ID NO: 542373 - RNA, 22 nt, Human
aaacuguaagagaauaaacuac

SEQ ID NO: 542374 - RNA, 22 nt, Human
agcuccugcuugacagaagagg

SEQ ID NO: 542375 - RNA, 22 nt, Human
ccagagcagauguggccuuggu

SEQ ID NO: 542376 - RNA, 22 nt, Human
ucucccagugucuggcagucag

SEQ ID NO: 542377 - RNA, 19 nt, Human
gguuauuugaggguuaaga

SEQ ID NO: 542378 - RNA, 22 nt, Human
gaggggcugggguugacuccaa

SEQ ID NO: 542379 - RNA, 22 nt, Human
uaacuagauauagacuuucuac

SEQ ID NO: 542380 - RNA, 22 nt, Human
caggaaugacugcagauggggc

SEQ ID NO: 542381 - RNA, 22 nt, Human
gccagcagcccagaaggacuuu

SEQ ID NO: 542382 - RNA, 22 nt, Human
aguguccccuccaagggccugg

SEQ ID NO: 542383 - RNA, 22 nt, Human
gaaaguacagauuccuggccag

SEQ ID NO: 542384 - RNA, 22 nt, Human
gcaguuacuagcaauuugugaa

SEQ ID NO: 542385 - RNA, 22 nt, Human
caagcagagaggucaacuaaua

SEQ ID NO: 542386 - RNA, 22 nt, Human
cuggcagcauuaacagagagca

SEQ ID NO: 542387 - RNA, 22 nt, Human
uggcugagccacuuguucagau

SEQ ID NO: 542388 - RNA, 22 nt, Human
agggcaguguggugggacugac

SEQ ID NO: 542389 - RNA, 22 nt, Human
acucacaggacucugcauauag

SEQ ID NO: 542390 - RNA, 22 nt, Human
uaugaaaauuuagcugaagcau

SEQ ID NO: 542391 - RNA, 19 nt, Human
gggcuuggggcugaagccu

SEQ ID NO: 542392 - RNA, 22 nt, Human
caauguaucaaccagaaaguuc

SEQ ID NO: 542393 - RNA, 22 nt, Human
agcagggccugagugaccuaac

SEQ ID NO: 542394 - RNA, 22 nt, Human
uugcaaggagccacucugccug

SEQ ID NO: 542395 - RNA, 22 nt, Human
ucaugaaucguggaaugauuua

SEQ ID NO: 542396 - RNA, 17 nt, Human
agcaaaaguaucaaagc

SEQ ID NO: 542397 - RNA, 17 nt, Human
gagccacccugugcgag

SEQ ID NO: 542398 - RNA, 22 nt, Human
uuuguagacgucagaaguuacu

SEQ ID NO: 542399 - RNA, 23 nt, Human
auauaaacaccagauagauugua

SEQ ID NO: 542400 - RNA, 22 nt, Human
ucaaaguagggguaagccaggc

SEQ ID NO: 542401 - RNA, 22 nt, Human
agcaguggaccucagugcuauu

SEQ ID NO: 542402 - RNA, 22 nt, Human
ucuagaaauuuugccuuguauu

SEQ ID NO: 542403 - RNA, 22 nt, Human
cacucugcgcugggcgccagcg

SEQ ID NO: 542404 - RNA, 22 nt, Human
cagucauuuuauuugaaaauua

SEQ ID NO: 542405 - RNA, 22 nt, Human
augucuuucaaauucugccuag

SEQ ID NO: 542406 - RNA, 22 nt, Human
gcuuuucuagcuagaacauccg

SEQ ID NO: 542407 - RNA, 22 nt, Human
aagcaauauacugauaugauua

SEQ ID NO: 542408 - RNA, 22 nt, Human
aggucauuuuugccuucuauuu

SEQ ID NO: 542409 - RNA, 22 nt, Human
gaggcugauucggggaacagca

SEQ ID NO: 542410 - RNA, 22 nt, Human
aucugucuauguggcuauguau

SEQ ID NO: 542411 - RNA, 22 nt, Human
aggccaggaauccuugucccag

SEQ ID NO: 542412 - RNA, 22 nt, Human
uuccacauagaucacagguguu

SEQ ID NO: 542413 - RNA, 22 nt, Human
uaagucauuaggcugaguucaa

SEQ ID NO: 542414 - RNA, 22 nt, Human
guaucacuuuugagagugagaa

SEQ ID NO: 542415 - RNA, 22 nt, Human
gcuuccugagaaacaaucugau

SEQ ID NO: 542416 - RNA, 22 nt, Human
gacagacagggguucuccugga

SEQ ID NO: 542417 - RNA, 22 nt, Human
uacagagaacucauagaaagaa

SEQ ID NO: 542418 - RNA, 22 nt, Human
caagggccuccaccuugcucgu

SEQ ID NO: 542419 - RNA, 22 nt, Human
guaaacaagucuaccauuagaa

SEQ ID NO: 542420 - RNA, 21 nt, Human
ugcaggcugugcgcuccugcc

SEQ ID NO: 542421 - RNA, 20 nt, Human
aacaaacuacaaaauuaugu

SEQ ID NO: 542422 - RNA, 22 nt, Human
cugauuucucaguucuaggaag

SEQ ID NO: 542423 - RNA, 22 nt, Human
cugggcugugguguggcccaaa

SEQ ID NO: 542424 - RNA, 22 nt, Human
cugucagguuggucucagagcu

SEQ ID NO: 542425 - RNA, 22 nt, Human
uggucaggcugcucugcggcgu

SEQ ID NO: 542426 - RNA, 20 nt, Human
ugacucugcaaccgucucuc

SEQ ID NO: 542427 - RNA, 20 nt, Human
ugguaucaauuacuagauug

SEQ ID NO: 542428 - RNA, 22 nt, Human
gcugaggaaaggcuggaaggga

SEQ ID NO: 542429 - RNA, 22 nt, Human
cccugaccccacggcuggagaa

SEQ ID NO: 542430 - RNA, 22 nt, Human
uuaugggagcaauuggggaggu

SEQ ID NO: 542431 - RNA, 22 nt, Human
cuggagugaagcuuauuuuuca

SEQ ID NO: 542432 - RNA, 22 nt, Human
gcagagccugugucugagcaaa

SEQ ID NO: 542433 - RNA, 22 nt, Human
aguguauuugccuauaaaaaug

SEQ ID NO: 542434 - RNA, 22 nt, Human
agaguggagagaaacaacucug

SEQ ID NO: 542435 - RNA, 22 nt, Human
uuccagcccgcgacuuguucag

SEQ ID NO: 542436 - RNA, 22 nt, Human
gugcccugguccccagcauaua

SEQ ID NO: 542437 - RNA, 22 nt, Human
cugugcaguccagcccuggaca

SEQ ID NO: 542438 - RNA, 22 nt, Human
agcagcaggcuagggaacugcu

SEQ ID NO: 542439 - RNA, 22 nt, Human
agcuggccauugugaguggccu

SEQ ID NO: 542440 - RNA, 22 nt, Human
auacaucuaugccuuucugaca

SEQ ID NO: 542441 - RNA, 22 nt, Human
caccagggcucugagcucugaa

SEQ ID NO: 542442 - RNA, 22 nt, Human
cugggagcuagcucugagcuga

SEQ ID NO: 542443 - RNA, 22 nt, Human
gucuuuuugucuggcagagguc

SEQ ID NO: 542444 - RNA, 22 nt, Human
cauuaucucuucuauaugcuag

SEQ ID NO: 542445 - RNA, 21 nt, Human
ccagagccugcugagcccccu

SEQ ID NO: 542446 - RNA, 22 nt, Human
guuuuuucaugaguaguuaucu

SEQ ID NO: 542447 - RNA, 22 nt, Human
ggcuucuccagguacugagcau

SEQ ID NO: 542448 - RNA, 22 nt, Human
guuucaaagcacagcucacauu

SEQ ID NO: 542449 - RNA, 22 nt, Human
aguccuaggcccugcuccagau

SEQ ID NO: 542450 - RNA, 22 nt, Human
cagugccaugucugagccccua

SEQ ID NO: 542451 - RNA, 22 nt, Human
uacagaauaaagcgugaagcuu

SEQ ID NO: 542452 - RNA, 22 nt, Human
uauuuguguggguaucuauaua

SEQ ID NO: 542453 - RNA, 22 nt, Human
aaaguucagauuagacucaaga

SEQ ID NO: 542454 - RNA, 19 nt, Human
ucacaggcaucuccccaga

SEQ ID NO: 542455 - RNA, 22 nt, Human
ggaguaggaguagaacucauca

SEQ ID NO: 542456 - RNA, 22 nt, Human
cugaggcuuggaggggucuggu

SEQ ID NO: 542457 - RNA, 22 nt, Human
agguccugggaguucuagugug

SEQ ID NO: 542458 - RNA, 22 nt, Human
uccaaguuucuucugcacaaca

SEQ ID NO: 542459 - RNA, 22 nt, Human
ggcuccagggaguggagagaag

SEQ ID NO: 542460 - RNA, 22 nt, Human
gauacauuuuaucuccuaacag

SEQ ID NO: 542461 - RNA, 22 nt, Human
uaaugguauuuguugaaaaacu

SEQ ID NO: 542462 - RNA, 19 nt, Human
ugcucauggggacuucucc

SEQ ID NO: 542463 - RNA, 22 nt, Human
uauuuguccuuauuaagaucug

SEQ ID NO: 542464 - RNA, 22 nt, Human
ucucaugugauucccgugcaug

SEQ ID NO: 542465 - RNA, 22 nt, Human
cuuugcauacaauuuuuagaaa

SEQ ID NO: 542466 - RNA, 22 nt, Human
ccauaaucuggcuuugagagag

SEQ ID NO: 542467 - RNA, 22 nt, Human
uggugagagcagaccuucuuuu

SEQ ID NO: 542468 - RNA, 22 nt, Human
uucaugugaucacagauuguaa

SEQ ID NO: 542469 - RNA, 21 nt, Human
ggcagccugacccccagagag

SEQ ID NO: 542470 - RNA, 22 nt, Human
aagagcauggaauggagaucca

SEQ ID NO: 542471 - RNA, 22 nt, Human
aaggagcuuguucgccuuccuc

SEQ ID NO: 542472 - RNA, 22 nt, Human
ugggcugaacuucaucugauga

SEQ ID NO: 542473 - RNA, 22 nt, Human
ucagagcuuuggagaccaggaa

SEQ ID NO: 542474 - RNA, 22 nt, Human
guccaggcugaccccuagagga

SEQ ID NO: 542475 - RNA, 22 nt, Human
aggaccuguguuuuccuugaau

SEQ ID NO: 542476 - RNA, 22 nt, Human
ggagagaauuccauggacaugu

SEQ ID NO: 542477 - RNA, 22 nt, Human
uacuuguuaucaucuuuuccuu

SEQ ID NO: 542478 - RNA, 22 nt, Human
ugucccagacauaaguggacau

SEQ ID NO: 542479 - RNA, 22 nt, Human
uucaaacaaaacuguucccaua

SEQ ID NO: 542480 - RNA, 22 nt, Human
ugcauuccuccaccuccugcac

SEQ ID NO: 542481 - RNA, 22 nt, Human
aggcuccauaccaucuccggag

SEQ ID NO: 542482 - RNA, 22 nt, Human
uuuggaaaaagccugaacauag

SEQ ID NO: 542483 - RNA, 22 nt, Human
uuucuguaaggacuuaaugcaa

SEQ ID NO: 542484 - RNA, 22 nt, Human
ucccacacagcccgcucaccgg

SEQ ID NO: 542485 - RNA, 22 nt, Human
aucuggcucacuuagucuagga

SEQ ID NO: 542486 - RNA, 22 nt, Human
gcucuugauguucauugacuug

SEQ ID NO: 542487 - RNA, 22 nt, Human
auaaaacuuauuagaauugugu

SEQ ID NO: 542488 - RNA, 22 nt, Human
ggcugccuucccugagccccgg

SEQ ID NO: 542489 - RNA, 22 nt, Human
cugccacuuucacccagugcuc

SEQ ID NO: 542490 - RNA, 22 nt, Human
uggcaacaugucgaagugcugu

SEQ ID NO: 542491 - RNA, 20 nt, Human
gagagcuggggaugaggcug

SEQ ID NO: 542492 - RNA, 22 nt, Human
cagcucugugcaggccugggga

SEQ ID NO: 542493 - RNA, 22 nt, Human
aauuucaccuaucacuuaagcc

SEQ ID NO: 542494 - RNA, 22 nt, Human
ccuggcaccuucacagacuacu

SEQ ID NO: 542495 - RNA, 22 nt, Human
uguuaccaggcaguauugcuua

SEQ ID NO: 542496 - RNA, 17 nt, Human
ugauucaacuagaaacu

SEQ ID NO: 542497 - RNA, 22 nt, Human
aacaaauggggccuuguaugaa

SEQ ID NO: 542498 - RNA, 22 nt, Human
ccugugcuucagcuggaggagg

SEQ ID NO: 542499 - RNA, 22 nt, Human
uguuaaucaaucaacaguauua

SEQ ID NO: 542500 - RNA, 23 nt, Human
uuccuuaacuguuaagauugucu

SEQ ID NO: 542501 - RNA, 22 nt, Human
guuauuuuaucucugagagguu

SEQ ID NO: 542502 - RNA, 22 nt, Human
uggccccccagagcuggaggac

SEQ ID NO: 542503 - RNA, 22 nt, Human
gcugggcucagaccuagugaac

SEQ ID NO: 542504 - RNA, 22 nt, Human
uauguauaaaugcaugugugga

SEQ ID NO: 542505 - RNA, 22 nt, Human
ucauaacaggcugagaggauuu

SEQ ID NO: 542506 - RNA, 22 nt, Human
aaauaaacugaagcacagagag

SEQ ID NO: 542507 - RNA, 22 nt, Human
ucugccuguaauauuuggagaa

SEQ ID NO: 542508 - RNA, 22 nt, Human
cugccuugaggagguuguggga

SEQ ID NO: 542509 - RNA, 20 nt, Human
aauguauauuuuaugccagg

SEQ ID NO: 542510 - RNA, 22 nt, Human
acuacauuucucaguaccugaa

SEQ ID NO: 542511 - RNA, 22 nt, Human
cuggcugccacuucagggucuu

SEQ ID NO: 542512 - RNA, 22 nt, Human
caggggccaaggguccagaccu

SEQ ID NO: 542513 - RNA, 22 nt, Human
ggucccaguugcccaggucagg

SEQ ID NO: 542514 - RNA, 22 nt, Human
ucaccuuaacaaucugaccauc

SEQ ID NO: 542515 - RNA, 22 nt, Human
cugccugcuucugagccagagg

SEQ ID NO: 542516 - RNA, 22 nt, Human
aaauugcaaaaguacuuuuagg

SEQ ID NO: 542517 - RNA, 22 nt, Human
aggagcugaaacuucucauaug

SEQ ID NO: 542518 - RNA, 22 nt, Human
ucaggcucaaagggccggauga

SEQ ID NO: 542519 - RNA, 22 nt, Human
ugcugccaggucuugcugucca

SEQ ID NO: 542520 - RNA, 22 nt, Human
cuggggccacaacggcgcacgc

SEQ ID NO: 542521 - RNA, 22 nt, Human
uuaagcuaauuaguuccagcau

SEQ ID NO: 542522 - RNA, 22 nt, Human
cagucaccaccagguggcagua

SEQ ID NO: 542523 - RNA, 22 nt, Human
ugcccugcugugccuggagcca

SEQ ID NO: 542524 - RNA, 22 nt, Human
gaggccagaagucugagaucag

SEQ ID NO: 542525 - RNA, 22 nt, Human
gugcauccacuagggcucuccc

SEQ ID NO: 542526 - RNA, 22 nt, Human
ugccugggaaccaauccuggcu

SEQ ID NO: 542527 - RNA, 22 nt, Human
agagacagaggcaauauagcuu

SEQ ID NO: 542528 - RNA, 22 nt, Human
ccagagaguaaacauuuuccgg

SEQ ID NO: 542529 - RNA, 19 nt, Human
uucauucuuucuacuuacc

SEQ ID NO: 542530 - RNA, 23 nt, Human
uaaagacagccuucaggauucug

SEQ ID NO: 542531 - RNA, 22 nt, Human
agucauauguggcauuuucuaa

SEQ ID NO: 542532 - RNA, 22 nt, Human
aaaugugaguuauagcaauaga

SEQ ID NO: 542533 - RNA, 22 nt, Human
cagaagacugcagggaagggac

SEQ ID NO: 542534 - RNA, 22 nt, Human
ucacauuugcaauugcauuguu

SEQ ID NO: 542535 - RNA, 22 nt, Human
ucaguuuucucaucugugaaau

SEQ ID NO: 542536 - RNA, 21 nt, Human
aucuggaagaacugguaagug

SEQ ID NO: 542537 - RNA, 22 nt, Human
ugccugaggagucagggcaggu

SEQ ID NO: 542538 - RNA, 23 nt, Human
ucacaggggccagcgcucugugg

SEQ ID NO: 542539 - RNA, 22 nt, Human
ugcaaacaauuuccuauaaagu

SEQ ID NO: 542540 - RNA, 22 nt, Human
ugauuuuuagcuauucugaaga

SEQ ID NO: 542541 - RNA, 22 nt, Human
guauucuugguuaucaaaauac

SEQ ID NO: 542542 - RNA, 22 nt, Human
aggaagcugggaaacugacauu

SEQ ID NO: 542543 - RNA, 22 nt, Human
gggcagcugccaagugcaucgc

SEQ ID NO: 542544 - RNA, 22 nt, Human
uaugaaauuucuaguucugcuu

SEQ ID NO: 542545 - RNA, 22 nt, Human
auuuacagguagaauuuuaagu

SEQ ID NO: 542546 - RNA, 22 nt, Human
aguggugcugcgcgcggagcuc

SEQ ID NO: 542547 - RNA, 22 nt, Human
cacugaaucucaaggggagggu

SEQ ID NO: 542548 - RNA, 22 nt, Human
gugaagcacgcugccgcacugg

SEQ ID NO: 542549 - RNA, 22 nt, Human
ucaacagaagugauagcuauua

SEQ ID NO: 542550 - RNA, 22 nt, Human
aacuuucagaauccuaugcauu

SEQ ID NO: 542551 - RNA, 20 nt, Human
auuccucagccccagccuca

SEQ ID NO: 542552 - RNA, 22 nt, Human
caguuuuacccaagcuuauuuu

SEQ ID NO: 542553 - RNA, 22 nt, Human
caugcaguguguaucuacuuaa

SEQ ID NO: 542554 - RNA, 22 nt, Human
aaggagagguuguccguguugu

SEQ ID NO: 542555 - RNA, 22 nt, Human
aagggcugccagggggugccag

SEQ ID NO: 542556 - RNA, 22 nt, Human
accaggcacuccugaggucuga

SEQ ID NO: 542557 - RNA, 22 nt, Human
ugggcucaaacuggagguuguu

SEQ ID NO: 542558 - RNA, 22 nt, Human
ugacaagaggcagaaucagcug

SEQ ID NO: 542559 - RNA, 22 nt, Human
ugagagcugccacgugaccaug

SEQ ID NO: 542560 - RNA, 22 nt, Human
uagcugccagaccauucuuacu

SEQ ID NO: 542561 - RNA, 22 nt, Human
auuuccaagaaagcuuuaggau

SEQ ID NO: 542562 - RNA, 22 nt, Human
cagcucccgccaucgggaggca

SEQ ID NO: 542563 - RNA, 22 nt, Human
aauuucagagguagagauucua

SEQ ID NO: 542564 - RNA, 22 nt, Human
uucuaaagccuguccuaucaga

SEQ ID NO: 542565 - RNA, 22 nt, Human
ugcuggguuaccuaagccuaaa

SEQ ID NO: 542566 - RNA, 22 nt, Human
ucacaggcuccagggccuggau

SEQ ID NO: 542567 - RNA, 23 nt, Human
uugggcuggcucucgaugccucu

SEQ ID NO: 542568 - RNA, 22 nt, Human
acacacaaaucuauuagugaau

SEQ ID NO: 542569 - RNA, 20 nt, Human
ccuggagccuggaaggaguc

SEQ ID NO: 542570 - RNA, 22 nt, Human
ccaggccaaauucagucagcag

SEQ ID NO: 542571 - RNA, 22 nt, Human
ugucuccauuuucaaguagcag

SEQ ID NO: 542572 - RNA, 20 nt, Human
auagaaguauuauguaaugu

SEQ ID NO: 542573 - RNA, 22 nt, Human
gaagaacugacaaacuagauca

SEQ ID NO: 542574 - RNA, 22 nt, Human
uuucaagagggaacugaacaca

SEQ ID NO: 542575 - RNA, 22 nt, Human
cuuauuauggcauguaaguggg

SEQ ID NO: 542576 - RNA, 16 nt, Human
uguuagcugugcauua

SEQ ID NO: 542577 - RNA, 22 nt, Human
acaugggaucaaugaggcaggc

SEQ ID NO: 542578 - RNA, 20 nt, Human
gaaauguaucucuugauucu

SEQ ID NO: 542579 - RNA, 22 nt, Human
auuuuugcccugcaguacauaa

SEQ ID NO: 542580 - RNA, 22 nt, Human
agggcugacacaccuuauccuc

SEQ ID NO: 542581 - RNA, 18 nt, Human
aguaguggguuuagcuuc

SEQ ID NO: 542582 - RNA, 22 nt, Human
ccaggcugagcaugauuggagc

SEQ ID NO: 542583 - RNA, 19 nt, Human
ucaaagcaagcauguucug

SEQ ID NO: 542584 - RNA, 21 nt, Human
cuugaaagguagagucuacag

SEQ ID NO: 542585 - RNA, 22 nt, Human
uaugcauagguaucuauacuca

SEQ ID NO: 542586 - RNA, 22 nt, Human
augcugugucaccuuaggauuu

SEQ ID NO: 542587 - RNA, 22 nt, Human
auucacacauacucauguguga

SEQ ID NO: 542588 - RNA, 22 nt, Human
aggugagaaaacgaggguugca

SEQ ID NO: 542589 - RNA, 22 nt, Human
gccuccuggauuuuagugccau

SEQ ID NO: 542590 - RNA, 22 nt, Human
caguuuuaugaaugcuuauuag

SEQ ID NO: 542591 - RNA, 22 nt, Human
aaaguuuccugcuaagugcuau

SEQ ID NO: 542592 - RNA, 22 nt, Human
gacuucaaaggucaaacaucgc

SEQ ID NO: 542593 - RNA, 22 nt, Human
uagaaacauauguuugagacau

SEQ ID NO: 542594 - RNA, 22 nt, Human
uuuuauugucucccaguucugg

SEQ ID NO: 542595 - RNA, 22 nt, Human
cagggccuccuaaggcaucuaa

SEQ ID NO: 542596 - RNA, 22 nt, Human
ugucccagcagcuggguucucu

SEQ ID NO: 542597 - RNA, 22 nt, Human
uuucugaaaucucuuuugagga

SEQ ID NO: 542598 - RNA, 22 nt, Human
acauuuuacaccaagacuucuu

SEQ ID NO: 542599 - RNA, 22 nt, Human
ucuccuggauggaccuucucuu

SEQ ID NO: 542600 - RNA, 19 nt, Human
ggaggccuggguauuugcc

SEQ ID NO: 542601 - RNA, 21 nt, Human
auuuccaaggguaccuaagau

SEQ ID NO: 542602 - RNA, 22 nt, Human
uagcucuucauuucaucugauu

SEQ ID NO: 542603 - RNA, 22 nt, Human
gggcugaaaggccgccucagau

SEQ ID NO: 542604 - RNA, 22 nt, Human
cucagaguucuccugggaggug

SEQ ID NO: 542605 - RNA, 22 nt, Human
gcuggcagacugggggcagaac

SEQ ID NO: 542606 - RNA, 22 nt, Human
aaaugaccagaauacaggcuuc

SEQ ID NO: 542607 - RNA, 22 nt, Human
ucagucuucuagcaaauccagg

SEQ ID NO: 542608 - RNA, 22 nt, Human
gcacacacuguuuuccucacau

SEQ ID NO: 542609 - RNA, 22 nt, Human
uaaagccacgcuggaaaucagg

SEQ ID NO: 542610 - RNA, 22 nt, Human
uaaagacacccagggagggacu

SEQ ID NO: 542611 - RNA, 22 nt, Human
uuugcauugcagugguuuacag

SEQ ID NO: 542612 - RNA, 22 nt, Human
aaggccauuauucugauauauu

SEQ ID NO: 542613 - RNA, 22 nt, Human
ucucccuggagcccugaagcau

SEQ ID NO: 542614 - RNA, 22 nt, Human
agcugcccuuaauaggcauuca

SEQ ID NO: 542615 - RNA, 22 nt, Human
auuucugauaaacguaagcugc

SEQ ID NO: 542616 - RNA, 22 nt, Human
ucucccaggucauacacagaga

SEQ ID NO: 542617 - RNA, 22 nt, Human
aucaaaguggaaguuuacuagg

SEQ ID NO: 542618 - RNA, 22 nt, Human
cucuggagcgcugcuucccgcg

SEQ ID NO: 542619 - RNA, 22 nt, Human
gagcucauucauucauugccug

SEQ ID NO: 542620 - RNA, 22 nt, Human
cucugggccaccgcugguguau

SEQ ID NO: 542621 - RNA, 22 nt, Human
uuugggcucuugcugaccuggg

SEQ ID NO: 542622 - RNA, 22 nt, Human
cuccucacuuuccagacugggc

SEQ ID NO: 542623 - RNA, 22 nt, Human
uuuaauaucucacacuuccaug

SEQ ID NO: 542624 - RNA, 22 nt, Human
agcucugggcugacaugcuccc

SEQ ID NO: 542625 - RNA, 22 nt, Human
cagaagaaaguggggagacaag

SEQ ID NO: 542626 - RNA, 22 nt, Human
cuucagugauauaggcuucucc

SEQ ID NO: 542627 - RNA, 17 nt, Human
aguguuuccuuaucauu

SEQ ID NO: 542628 - RNA, 22 nt, Human
ucaguaaaauuacagaucuaca

SEQ ID NO: 542629 - RNA, 22 nt, Human
uucacaguaaguaggauaguug

SEQ ID NO: 542630 - RNA, 22 nt, Human
acauuuaaguuaaaaccucagu

SEQ ID NO: 542631 - RNA, 16 nt, Human
auucugcugccugcuc

SEQ ID NO: 542632 - RNA, 22 nt, Human
aucacauugccagugauuaccc

SEQ ID NO: 542633 - RNA, 22 nt, Human
gcccugagacugagcauggguu

SEQ ID NO: 542634 - RNA, 22 nt, Human
uggcucagcugucacagccugg

SEQ ID NO: 542635 - RNA, 22 nt, Human
agacauaagcgagcaucacagg

SEQ ID NO: 542636 - RNA, 22 nt, Human
aaacuguaaauacuaguaagug

SEQ ID NO: 542637 - RNA, 22 nt, Human
uuucacaacugcuuauuugaga

SEQ ID NO: 542638 - RNA, 21 nt, Human
aucaccagcagaagcugcaga

SEQ ID NO: 542639 - RNA, 22 nt, Human
uugcuuuugggaaaacaugccu

SEQ ID NO: 542640 - RNA, 22 nt, Human
ugggcucagggaagcuuggccu

SEQ ID NO: 542641 - RNA, 22 nt, Human
cuuuucuuacucccgcaaggca

SEQ ID NO: 542642 - RNA, 22 nt, Human
ugagugccugaacauagaguag

SEQ ID NO: 542643 - RNA, 22 nt, Human
ugagggcugcuuccagagcuag

SEQ ID NO: 542644 - RNA, 22 nt, Human
uucuuucugaauacaguugagu

SEQ ID NO: 542645 - RNA, 22 nt, Human
uacauaguauucacauuguuuu

SEQ ID NO: 542646 - RNA, 22 nt, Human
uguaggcugaagaugaagugga

SEQ ID NO: 542647 - RNA, 22 nt, Human
acacuuaacuucugagaauaaa

SEQ ID NO: 542648 - RNA, 22 nt, Human
agcuucuuguagaacucaaaag

SEQ ID NO: 542649 - RNA, 23 nt, Human
agacccagagacuggcucugcuc

SEQ ID NO: 542650 - RNA, 21 nt, Human
ggagauggguaucgccugggc

SEQ ID NO: 542651 - RNA, 22 nt, Human
auucuucacauggauaggaucu

SEQ ID NO: 542652 - RNA, 22 nt, Human
agggaagaaucacugggauguu

SEQ ID NO: 542653 - RNA, 22 nt, Human
agccuggacagcuacggagaac

SEQ ID NO: 542654 - RNA, 22 nt, Human
cugggccauggaagucucugcc

SEQ ID NO: 542655 - RNA, 22 nt, Human
ccagccacugggccacugccag

SEQ ID NO: 542656 - RNA, 22 nt, Human
ccucaggauccgcaggugcagu

SEQ ID NO: 542657 - RNA, 22 nt, Human
gucaugccuggcuucuuagaca

SEQ ID NO: 542658 - RNA, 22 nt, Human
ggccuggcauggggacuaaggg

SEQ ID NO: 542659 - RNA, 22 nt, Human
aagaauuuuccagcaugucagu

SEQ ID NO: 542660 - RNA, 23 nt, Human
cccagcgcugagcccugcaggca

SEQ ID NO: 542661 - RNA, 22 nt, Human
acaguguaauucauggcugaaa

SEQ ID NO: 542662 - RNA, 22 nt, Human
uuucacaggaugcuguuuuaua

SEQ ID NO: 542663 - RNA, 19 nt, Human
ucuaaacuagucccauaac

SEQ ID NO: 542664 - RNA, 22 nt, Human
guuuuucucugaaauaguugac

SEQ ID NO: 542665 - RNA, 22 nt, Human
ucuaauuuuaggcauuuguuca

SEQ ID NO: 542666 - RNA, 22 nt, Human
cagcugccuucugcgggaaguc

SEQ ID NO: 542667 - RNA, 22 nt, Human
uuauuaggaacucaggauuuuu

SEQ ID NO: 542668 - RNA, 22 nt, Human
acucagaggaaacccuccuagg

SEQ ID NO: 542669 - RNA, 22 nt, Human
uguacauagaucuugaaaauua

SEQ ID NO: 542670 - RNA, 22 nt, Human
gcccauggcuucccuaggcaca

SEQ ID NO: 542671 - RNA, 22 nt, Human
agagggcuggacgcagguugga

SEQ ID NO: 542672 - RNA, 22 nt, Human
gagggcagugaauuuugaagcu

SEQ ID NO: 542673 - RNA, 22 nt, Human
acugcagccuagggaccacagu

SEQ ID NO: 542674 - RNA, 22 nt, Human
uaggacaggugaggggcugugg

SEQ ID NO: 542675 - RNA, 22 nt, Human
aggaggcugggcacaguggccu

SEQ ID NO: 542676 - RNA, 22 nt, Human
uggcauguauuaguuggcaguu

SEQ ID NO: 542677 - RNA, 19 nt, Human
ugccugucaguagaucuca

SEQ ID NO: 542678 - RNA, 22 nt, Human
ucuggccuacuggaguccauga

SEQ ID NO: 542679 - RNA, 22 nt, Human
gcuggccugcugggcaccaccg

SEQ ID NO: 542680 - RNA, 22 nt, Human
accaggaaaaacacuguguugg

SEQ ID NO: 542681 - RNA, 22 nt, Human
gccacaugcaauugcagcacgu

SEQ ID NO: 542682 - RNA, 22 nt, Human
gaaucagccugaguuugcagcu

SEQ ID NO: 542683 - RNA, 22 nt, Human
cagcuggcgccuggggaccaga

SEQ ID NO: 542684 - RNA, 22 nt, Human
agaugaaagauuuuuauagaga

SEQ ID NO: 542685 - RNA, 22 nt, Human
aaagcucuuauagcagagugug

SEQ ID NO: 542686 - RNA, 22 nt, Human
gacuuauucacgcagcuauacu

SEQ ID NO: 542687 - RNA, 22 nt, Human
guuacaaacucaggugccaaaa

SEQ ID NO: 542688 - RNA, 19 nt, Human
aaucagaaauaucgaggcc

SEQ ID NO: 542689 - RNA, 22 nt, Human
gcccuggacagugacggugacc

SEQ ID NO: 542690 - RNA, 22 nt, Human
cucaccaggaacagcugcggag

SEQ ID NO: 542691 - RNA, 22 nt, Human
aaaaguauaggguuuggaguca

SEQ ID NO: 542692 - RNA, 22 nt, Human
cacuaaaacuacauuggaaaca

SEQ ID NO: 542693 - RNA, 22 nt, Human
aacaaaucuuaaaguaauucaa

SEQ ID NO: 542694 - RNA, 22 nt, Human
auagacaaacacgaagaugaca

SEQ ID NO: 542695 - RNA, 22 nt, Human
uacagagacuuuauggcacaaa

SEQ ID NO: 542696 - RNA, 22 nt, Human
agggcagcaaugcagcugcugc

SEQ ID NO: 542697 - RNA, 22 nt, Human
auacuuacuuuucuucagacua

SEQ ID NO: 542698 - RNA, 22 nt, Human
cagacauauguuuuaacagauu

SEQ ID NO: 542699 - RNA, 22 nt, Human
ccugggaggcagagguugcagu

SEQ ID NO: 542700 - RNA, 22 nt, Human
uuuggaaaguguacaaauuuga

SEQ ID NO: 542701 - RNA, 22 nt, Human
acagaucacuugacuaaaauga

SEQ ID NO: 542702 - RNA, 22 nt, Human
ugauacuuuggagacuugagua

SEQ ID NO: 542703 - RNA, 22 nt, Human
cccaggucgucagcaguguggu

SEQ ID NO: 542704 - RNA, 22 nt, Human
aagaggcauaaaauuuauaugg

SEQ ID NO: 542705 - RNA, 21 nt, Human
acagagcauaaugguguggca

SEQ ID NO: 542706 - RNA, 22 nt, Human
augauggugagguugagcacag

SEQ ID NO: 542707 - RNA, 22 nt, Human
uucaaagaauuuugagaccuga

SEQ ID NO: 542708 - RNA, 22 nt, Human
gucucccacuuucuggccucuu

SEQ ID NO: 542709 - RNA, 23 nt, Human
ucagggacaugaugugucauauc

SEQ ID NO: 542710 - RNA, 22 nt, Human
ugcacacacaugaaguagcaug

SEQ ID NO: 542711 - RNA, 22 nt, Human
uccugggcuucacagacucugu

SEQ ID NO: 542712 - RNA, 22 nt, Human
ucaauucaacacaugcacauug

SEQ ID NO: 542713 - RNA, 22 nt, Human
uccugccuugccugggacauca

SEQ ID NO: 542714 - RNA, 22 nt, Human
accaggggaugguuggcacugu

SEQ ID NO: 542715 - RNA, 22 nt, Human
ugcaggugagugcaggggcuca

SEQ ID NO: 542716 - RNA, 22 nt, Human
cugcugggcagaggcugcauga

SEQ ID NO: 542717 - RNA, 22 nt, Human
ucaggcucagguuaggggccaa

SEQ ID NO: 542718 - RNA, 22 nt, Human
ccaggccuccugugaguggacc

SEQ ID NO: 542719 - RNA, 22 nt, Human
ugaggccugcccuggggaaguu

SEQ ID NO: 542720 - RNA, 21 nt, Human
aucaacauugaaagagcugga

SEQ ID NO: 542721 - RNA, 20 nt, Human
aagaaacuugaaaguacaag

SEQ ID NO: 542722 - RNA, 22 nt, Human
ucccugaaucucgaacuagccu

SEQ ID NO: 542723 - RNA, 22 nt, Human
guuuuccacuggauuguuugga

SEQ ID NO: 542724 - RNA, 23 nt, Human
ugauuuccagugagucaguggga

SEQ ID NO: 542725 - RNA, 22 nt, Human
ugagagggcccagagcacacca

SEQ ID NO: 542726 - RNA, 22 nt, Human
cagggcuggauuucauuucuag

SEQ ID NO: 542727 - RNA, 22 nt, Human
ggguccagacacuccagaggaa

SEQ ID NO: 542728 - RNA, 22 nt, Human
gaagaagggagugcguguaaua

SEQ ID NO: 542729 - RNA, 22 nt, Human
ucuuuaagccaagauauauuua

SEQ ID NO: 542730 - RNA, 22 nt, Human
agaagccagaauauucauggau

SEQ ID NO: 542731 - RNA, 22 nt, Human
gcugcccugacuccagcagccu

SEQ ID NO: 542732 - RNA, 23 nt, Human
agcugcugggccugccguggccu

SEQ ID NO: 542733 - RNA, 22 nt, Human
cagaacauucacucauaugugg

SEQ ID NO: 542734 - RNA, 22 nt, Human
caggcugauaggguccaaaguu

SEQ ID NO: 542735 - RNA, 19 nt, Human
ccaggccuccugggagguc

SEQ ID NO: 542736 - RNA, 22 nt, Human
aaagccagagcaagcugucaca

SEQ ID NO: 542737 - RNA, 22 nt, Human
uccagcagggaauuaguagucu

SEQ ID NO: 542738 - RNA, 22 nt, Human
agaacagcagcacgucaagcug

SEQ ID NO: 542739 - RNA, 17 nt, Human
ggcagcugccacuuuuu

SEQ ID NO: 542740 - RNA, 22 nt, Human
gccuucccaagacgccugaguu

SEQ ID NO: 542741 - RNA, 22 nt, Human
uaugagaacugacagagugcca

SEQ ID NO: 542742 - RNA, 22 nt, Human
uguacaugugucuguauaucuu

SEQ ID NO: 542743 - RNA, 22 nt, Human
agagcuggcugugggugacuuu

SEQ ID NO: 542744 - RNA, 22 nt, Human
auaaaaacugacccauccuuug

SEQ ID NO: 542745 - RNA, 17 nt, Human
agcugccuugcuugagc

SEQ ID NO: 542746 - RNA, 22 nt, Human
aguaugaaucucuuuauucugc

SEQ ID NO: 542747 - RNA, 22 nt, Human
cacauuuacuuuuaucccuugg

SEQ ID NO: 542748 - RNA, 22 nt, Human
cugagccuugaugucccuuguc

SEQ ID NO: 542749 - RNA, 23 nt, Human
uucaagauacgguuuccaggcug

SEQ ID NO: 542750 - RNA, 22 nt, Human
uggcacuggcgcaggauggcgg

SEQ ID NO: 542751 - RNA, 22 nt, Human
gagggccaauggauuucaacug

SEQ ID NO: 542752 - RNA, 22 nt, Human
uuucacagguauccacgggucu

SEQ ID NO: 542753 - RNA, 22 nt, Human
cagcagcuacuuggagcagcag

SEQ ID NO: 542754 - RNA, 22 nt, Human
uucuucaaauagcagggaguca

SEQ ID NO: 542755 - RNA, 22 nt, Human
ucuccacacuuucucucccagg

SEQ ID NO: 542756 - RNA, 22 nt, Human
uaaaggagugugaugaaaggga

SEQ ID NO: 542757 - RNA, 22 nt, Human
auauauuugagaauauucauga

SEQ ID NO: 542758 - RNA, 22 nt, Human
acuauaaaaggauaaaccagaa

SEQ ID NO: 542759 - RNA, 22 nt, Human
ccaggccugugcaaggagggag

SEQ ID NO: 542760 - RNA, 22 nt, Human
auaaaaaggacagauguggucu

SEQ ID NO: 542761 - RNA, 22 nt, Human
ggugggguuuuaggcugcugca

SEQ ID NO: 542762 - RNA, 22 nt, Human
gaggccagcgcgcagcacuuuu

SEQ ID NO: 542763 - RNA, 22 nt, Human
ugugccuucucaguccugcuca

SEQ ID NO: 542764 - RNA, 22 nt, Human
cagcuuagauggauacaaaggu

SEQ ID NO: 542765 - RNA, 22 nt, Human
aggccaggcaacauucugaagu

SEQ ID NO: 542766 - RNA, 22 nt, Human
auccagggauaaaaguaagguu

SEQ ID NO: 542767 - RNA, 22 nt, Human
cuuauguaaacuacagauaaua

SEQ ID NO: 542768 - RNA, 21 nt, Human
uucuucuuggacuguuuuggc

SEQ ID NO: 542769 - RNA, 22 nt, Human
agggagccuuccuggcuguggu

SEQ ID NO: 542770 - RNA, 22 nt, Human
aaccaacauaggaaugcagaga

SEQ ID NO: 542771 - RNA, 22 nt, Human
gcugccuugaacuuggccuggg

SEQ ID NO: 542772 - RNA, 22 nt, Human
gucugcccucacgccagcuggg

SEQ ID NO: 542773 - RNA, 22 nt, Human
caauguguguguuuuucucaac

SEQ ID NO: 542774 - RNA, 22 nt, Human
aggcugaggcuuuccuuggaga

SEQ ID NO: 542775 - RNA, 22 nt, Human
acagguggucuuugcuccuuuu

SEQ ID NO: 542776 - RNA, 22 nt, Human
aggugauguccacagcuugcag

SEQ ID NO: 542777 - RNA, 22 nt, Human
cugugacuguguuggaugcaca

SEQ ID NO: 542778 - RNA, 22 nt, Human
acaaacuucccagacaagcucc

SEQ ID NO: 542779 - RNA, 20 nt, Human
agucccuuuggucagguauu

SEQ ID NO: 542780 - RNA, 22 nt, Human
ugaggcaggaaguuauauaaug

SEQ ID NO: 542781 - RNA, 22 nt, Human
uucuuacauuacuuuacaugug

SEQ ID NO: 542782 - RNA, 20 nt, Human
gguuacauugucuacaugug

SEQ ID NO: 542783 - RNA, 22 nt, Human
aaacagaaggguagguaaacau

SEQ ID NO: 542784 - RNA, 22 nt, Human
acaguggaguugggguagcccu

SEQ ID NO: 542785 - RNA, 22 nt, Human
cugggaaagcaagguuguggau

SEQ ID NO: 542786 - RNA, 22 nt, Human
uggagcccagacacuggcauug

SEQ ID NO: 542787 - RNA, 22 nt, Human
uguaucuuucuguacuuuuaug

SEQ ID NO: 542788 - RNA, 22 nt, Human
ccugagagcccuagccaggcgc

SEQ ID NO: 542789 - RNA, 22 nt, Human
gccucucucuacccaguaugau

SEQ ID NO: 542790 - RNA, 22 nt, Human
uauuaguagcuugaaauuggug

SEQ ID NO: 542791 - RNA, 22 nt, Human
ugaguaggauaggguggggcuu

SEQ ID NO: 542792 - RNA, 22 nt, Human
aaagcacagggugcuagagagu

SEQ ID NO: 542793 - RNA, 22 nt, Human
ucagacaggcuggacagcuugc

SEQ ID NO: 542794 - RNA, 22 nt, Human
ugccugugacccaaggaugcga

SEQ ID NO: 542795 - RNA, 22 nt, Human
guacaauaacuagucuuauagu

SEQ ID NO: 542796 - RNA, 22 nt, Human
agccagaguugaaugugagucu

SEQ ID NO: 542797 - RNA, 23 nt, Human
ccaaagucgaagucuaguccaga

SEQ ID NO: 542798 - RNA, 22 nt, Human
uccaggcugauccaugaagaau

SEQ ID NO: 542799 - RNA, 22 nt, Human
gugggcaguuggugauucucgu

SEQ ID NO: 542800 - RNA, 22 nt, Human
augaggcaucuaacauugcaaa

SEQ ID NO: 542801 - RNA, 22 nt, Human
cgcaggcugcagccaagaagag

SEQ ID NO: 542802 - RNA, 22 nt, Human
gcuuccuagaucugugguacuc

SEQ ID NO: 542803 - RNA, 22 nt, Human
ggggcagagcauagcuccaauu

SEQ ID NO: 542804 - RNA, 22 nt, Human
cucaaauagaacugaucuauaa

SEQ ID NO: 542805 - RNA, 22 nt, Human
cccugcagggaggauucugaag

SEQ ID NO: 542806 - RNA, 22 nt, Human
ggaccugcauuuuaacaagauc

SEQ ID NO: 542807 - RNA, 22 nt, Human
gaaaugguagaguaggaagauu

SEQ ID NO: 542808 - RNA, 22 nt, Human
ucuucauguuaguuggguuuuc

SEQ ID NO: 542809 - RNA, 23 nt, Human
ugcaggugugcagagggcucuug

SEQ ID NO: 542810 - RNA, 22 nt, Human
aggccagcuguuacuagagcca

SEQ ID NO: 542811 - RNA, 22 nt, Human
ugaacuucagugauuugcugca

SEQ ID NO: 542812 - RNA, 22 nt, Human
cauuucacaguauauucaaaau

SEQ ID NO: 542813 - RNA, 22 nt, Human
aggacuucaucaccuguauaaa

SEQ ID NO: 542814 - RNA, 22 nt, Human
cgccucagccguggucaucuuc

SEQ ID NO: 542815 - RNA, 22 nt, Human
ucugaaauaggaaagcaaaugg

SEQ ID NO: 542816 - RNA, 22 nt, Human
cuuuucaugccagcccaucaca

SEQ ID NO: 542817 - RNA, 22 nt, Human
uaaaauagcaugugcagugaaa

SEQ ID NO: 542818 - RNA, 22 nt, Human
gccagagugauguaacauauau

SEQ ID NO: 542819 - RNA, 22 nt, Human
aaauuauuacaagcuaguuggc

SEQ ID NO: 542820 - RNA, 22 nt, Human
ggucauuuucacuuucaaguua

SEQ ID NO: 542821 - RNA, 22 nt, Human
ccagcuuuucuuaucauuauaa

SEQ ID NO: 542822 - RNA, 22 nt, Human
cugcaagauuggaagaugcaau

SEQ ID NO: 542823 - RNA, 22 nt, Human
ugcccuuggguaacuugcugau

SEQ ID NO: 542824 - RNA, 22 nt, Human
uugauucuacuuaaaacauaug

SEQ ID NO: 542825 - RNA, 23 nt, Human
cauaaaauauuaguaugguagca

SEQ ID NO: 542826 - RNA, 21 nt, Human
uccagaggaggacagacucag

SEQ ID NO: 542827 - RNA, 22 nt, Human
cagguggguacaucacagagac

SEQ ID NO: 542828 - RNA, 22 nt, Human
gcagccacugggagugcuuaua

SEQ ID NO: 542829 - RNA, 22 nt, Human
gcuggcaucacuggcuucggug

SEQ ID NO: 542830 - RNA, 22 nt, Human
gcagggaccugccacugcuguc

SEQ ID NO: 542831 - RNA, 22 nt, Human
ccugcuggcggggacccaguga

SEQ ID NO: 542832 - RNA, 22 nt, Human
guguggcuagaagugucuuguu

SEQ ID NO: 542833 - RNA, 22 nt, Human
ugaagggcaaccccaggcccag

SEQ ID NO: 542834 - RNA, 22 nt, Human
cugcaggcucgaagacacggau

SEQ ID NO: 542835 - RNA, 22 nt, Human
gaaaugucauagucuucaagcc

SEQ ID NO: 542836 - RNA, 22 nt, Human
ggcauuugagccauuggccugu

SEQ ID NO: 542837 - RNA, 22 nt, Human
uccugggaagagaccugagcau

SEQ ID NO: 542838 - RNA, 17 nt, Human
cugucugcgcaugaggu

SEQ ID NO: 542839 - RNA, 22 nt, Human
gcacagggcaacaggucuguua

SEQ ID NO: 542840 - RNA, 22 nt, Human
gcccugucggaacugcgaccuc

SEQ ID NO: 542841 - RNA, 22 nt, Human
cuuauauuugucaacuuuacaa

SEQ ID NO: 542842 - RNA, 22 nt, Human
cacagccuugagcgaggacaag

SEQ ID NO: 542843 - RNA, 22 nt, Human
uccagaaacuucauuugcaagc

SEQ ID NO: 542844 - RNA, 22 nt, Human
aggucauuccagccauuccccu

SEQ ID NO: 542845 - RNA, 22 nt, Human
uuccucucaacaugccugccgg

SEQ ID NO: 542846 - RNA, 23 nt, Human
gggauauggaccuuggaggaguc

SEQ ID NO: 542847 - RNA, 22 nt, Human
gacugucauucuagugcccaug

SEQ ID NO: 542848 - RNA, 22 nt, Human
ggcacagcaggagcuaugugaa

SEQ ID NO: 542849 - RNA, 22 nt, Human
gcagacagccagacugcacugg

SEQ ID NO: 542850 - RNA, 22 nt, Human
ggagaaagucagcuccaagcag

SEQ ID NO: 542851 - RNA, 22 nt, Human
gacaaagucaacaguacucuca

SEQ ID NO: 542852 - RNA, 22 nt, Human
ccaggagcaccaggccugugcc

SEQ ID NO: 542853 - RNA, 22 nt, Human
ucaugcacaugugucaccauca

SEQ ID NO: 542854 - RNA, 22 nt, Human
uagcaaaagccacgauuacuuu

SEQ ID NO: 542855 - RNA, 22 nt, Human
acagcuaugacagauggauaau

SEQ ID NO: 542856 - RNA, 22 nt, Human
ucaggcagaguuaauuugcucc

SEQ ID NO: 542857 - RNA, 22 nt, Human
ccuuucaaaguuuugccaugcu

SEQ ID NO: 542858 - RNA, 22 nt, Human
caggccuuaucuccacccugca

SEQ ID NO: 542859 - RNA, 22 nt, Human
aggaagaguguuaccuaugggu

SEQ ID NO: 542860 - RNA, 22 nt, Human
aagacaaugcauuacuaagaag

SEQ ID NO: 542861 - RNA, 22 nt, Human
gccagccccuuagggcucuccc

SEQ ID NO: 542862 - RNA, 22 nt, Human
uugugaaaucguguuuggaagc

SEQ ID NO: 542863 - RNA, 22 nt, Human
ccagggcaauaggaacacuuuu

SEQ ID NO: 542864 - RNA, 22 nt, Human
ugcaggugucugggggcaacag

SEQ ID NO: 542865 - RNA, 22 nt, Human
uaggaagaucaaguuuaucuca

SEQ ID NO: 542866 - RNA, 22 nt, Human
ugcuuuauucccuucugaugug

SEQ ID NO: 542867 - RNA, 22 nt, Human
guuucaaagucagaaaaggagg

SEQ ID NO: 542868 - RNA, 22 nt, Human
uuucuaaguaagauuaacuucu

SEQ ID NO: 542869 - RNA, 22 nt, Human
cuagggaguggcagagcuggga

SEQ ID NO: 542870 - RNA, 22 nt, Human
ccuucaugucauuggacaccuu

SEQ ID NO: 542871 - RNA, 22 nt, Human
ugguuugcccacucgagugauu

SEQ ID NO: 542872 - RNA, 22 nt, Human
uguuucaggaccuaucuuuuag

SEQ ID NO: 542873 - RNA, 22 nt, Human
gccugccugaaggcuguaccag

SEQ ID NO: 542874 - RNA, 22 nt, Human
gauccuugcacuugacuuggca

SEQ ID NO: 542875 - RNA, 22 nt, Human
ugugccagccucuggcuguguc

SEQ ID NO: 542876 - RNA, 22 nt, Human
gccagggcucgcggucccucgu

SEQ ID NO: 542877 - RNA, 19 nt, Human
ugggccugcaucugggucu

SEQ ID NO: 542878 - RNA, 22 nt, Human
cuguaaacuaggucauuuuuaa

SEQ ID NO: 542879 - RNA, 22 nt, Human
acuuggagggagcuggguggaa

SEQ ID NO: 542880 - RNA, 22 nt, Human
acaauguucuacauauacauaa

SEQ ID NO: 542881 - RNA, 20 nt, Human
ucagggcaugggacagcccc

SEQ ID NO: 542882 - RNA, 22 nt, Human
aguaaaaauugaggugcaaaau

SEQ ID NO: 542883 - RNA, 22 nt, Human
gggugcccuggguaggucaguu

SEQ ID NO: 542884 - RNA, 22 nt, Human
uugacaauugggagauauaaag

SEQ ID NO: 542885 - RNA, 22 nt, Human
gggguccuggaggccagcugga

SEQ ID NO: 542886 - RNA, 22 nt, Human
ggguuccuccaguuccuagagc

SEQ ID NO: 542887 - RNA, 22 nt, Human
cagggccuuuuagcaucuucuc

SEQ ID NO: 542888 - RNA, 22 nt, Human
ugggcagaucuuugguggcuag

SEQ ID NO: 542889 - RNA, 22 nt, Human
cagcugagaccagaaugcaggu

SEQ ID NO: 542890 - RNA, 22 nt, Human
cugcagccuaggugcagcuggg

SEQ ID NO: 542891 - RNA, 22 nt, Human
ggcagcagaacuggcccuguau

SEQ ID NO: 542892 - RNA, 22 nt, Human
cugcccaggaaccagaggggca

SEQ ID NO: 542893 - RNA, 22 nt, Human
aagacuuauagucaguaauucu

SEQ ID NO: 542894 - RNA, 22 nt, Human
cauuuguacagaacagcuuuau

SEQ ID NO: 542895 - RNA, 22 nt, Human
uggaggcagucaaaugacugac

SEQ ID NO: 542896 - RNA, 22 nt, Human
cuccagugagugagcaggcgac

SEQ ID NO: 542897 - RNA, 22 nt, Human
gagggcugccacguugggcgag

SEQ ID NO: 542898 - RNA, 22 nt, Human
uggcugaacuaaugugcuguuu

SEQ ID NO: 542899 - RNA, 22 nt, Human
cuacauuucccagcugccuucc

SEQ ID NO: 542900 - RNA, 18 nt, Human
ucagagagaauaguaauu

SEQ ID NO: 542901 - RNA, 22 nt, Human
ucacagaagcuugaagauuuuc

SEQ ID NO: 542902 - RNA, 22 nt, Human
cagugaaguuuaaaguguagau

SEQ ID NO: 542903 - RNA, 22 nt, Human
aaagaaauaccuuucucagcuu

SEQ ID NO: 542904 - RNA, 22 nt, Human
gaagagcuggaauccagucugg

SEQ ID NO: 542905 - RNA, 22 nt, Human
gaggcaugucuggccuguccca

SEQ ID NO: 542906 - RNA, 22 nt, Human
cagcuuaccucccacagcucuc

SEQ ID NO: 542907 - RNA, 22 nt, Human
uuccucaguuagugccugaggc

SEQ ID NO: 542908 - RNA, 22 nt, Human
gggagcugaacugcugaaguug

SEQ ID NO: 542909 - RNA, 19 nt, Human
cuccaaguuaagagggagg

SEQ ID NO: 542910 - RNA, 22 nt, Human
uuuauuuauaagccacuugcug

SEQ ID NO: 542911 - RNA, 22 nt, Human
aacuaaaucuggcauuuagagc

SEQ ID NO: 542912 - RNA, 22 nt, Human
aagccagguguuuaggccagcg

SEQ ID NO: 542913 - RNA, 22 nt, Human
gggagaaguggaaaucucauua

SEQ ID NO: 542914 - RNA, 22 nt, Human
uucaggcaucccuacaguuagg

SEQ ID NO: 542915 - RNA, 22 nt, Human
uggagcaggugccaggugugug

SEQ ID NO: 542916 - RNA, 22 nt, Human
ugggcucagucugcuugguccu

SEQ ID NO: 542917 - RNA, 22 nt, Human
gaugauuuuaugucuugucauu

SEQ ID NO: 542918 - RNA, 22 nt, Human
aucagaaggggagguaaagaag

SEQ ID NO: 542919 - RNA, 21 nt, Human
gcccagcaaggugagaaggcc

SEQ ID NO: 542920 - RNA, 22 nt, Human
uguaugaagguuuaccugcugu

SEQ ID NO: 542921 - RNA, 21 nt, Human
ucagggcagugggagguuccu

SEQ ID NO: 542922 - RNA, 21 nt, Human
gcucuuggaaggggcucagcu

SEQ ID NO: 542923 - RNA, 22 nt, Human
acagcagcuaaaggugucuccu

SEQ ID NO: 542924 - RNA, 23 nt, Human
gugagcagcccacuaggaaugcc

SEQ ID NO: 542925 - RNA, 22 nt, Human
aaauaugugaucagugaauaaa

SEQ ID NO: 542926 - RNA, 22 nt, Human
cauuucaaaagaauugccagaa

SEQ ID NO: 542927 - RNA, 22 nt, Human
agggccugggguagcuuacugc

SEQ ID NO: 542928 - RNA, 22 nt, Human
uuugagaaaugggcucugugcu

SEQ ID NO: 542929 - RNA, 22 nt, Human
gcuggccugggcucaagaccag

SEQ ID NO: 542930 - RNA, 22 nt, Human
agugugugcuguuccccggagg

SEQ ID NO: 542931 - RNA, 22 nt, Human
ugcucagcacagaccaggccag

SEQ ID NO: 542932 - RNA, 22 nt, Human
gagggcucugaaaggaggucac

SEQ ID NO: 542933 - RNA, 19 nt, Human
gcagccaccgcggcggccg

SEQ ID NO: 542934 - RNA, 22 nt, Human
agacauaagugcuaugacauug

SEQ ID NO: 542935 - RNA, 22 nt, Human
gagagcugggaaagccguggag

SEQ ID NO: 542936 - RNA, 20 nt, Human
acagaaagcugccuuguccc

SEQ ID NO: 542937 - RNA, 22 nt, Human
aagguacaccaaaguucaaguu

SEQ ID NO: 542938 - RNA, 22 nt, Human
auauuauucuaguaacagugau

SEQ ID NO: 542939 - RNA, 22 nt, Human
ccucagaggugaacaucagugc

SEQ ID NO: 542940 - RNA, 22 nt, Human
gaguuauuggguggaaagguag

SEQ ID NO: 542941 - RNA, 22 nt, Human
ugguggggauucccucccuggc

SEQ ID NO: 542942 - RNA, 22 nt, Human
accagggcugacaaucugaugg

SEQ ID NO: 542943 - RNA, 22 nt, Human
acagguggccccgagggagugg

SEQ ID NO: 542944 - RNA, 22 nt, Human
ggcuucaggggcccagucagca

SEQ ID NO: 542945 - RNA, 22 nt, Human
uggagccaaugaacauuugcug

SEQ ID NO: 542946 - RNA, 22 nt, Human
uuguuacaucuuauguaagugg

SEQ ID NO: 542947 - RNA, 22 nt, Human
agagaugucgccuugcccaggg

SEQ ID NO: 542948 - RNA, 22 nt, Human
caaggccugccucuggcagaaa

SEQ ID NO: 542949 - RNA, 22 nt, Human
agguggcaggaggucagagaaa

SEQ ID NO: 542950 - RNA, 20 nt, Human
uccaagggcagcagaaucag

SEQ ID NO: 542951 - RNA, 22 nt, Human
auuacaguaacagcuacaaugc

SEQ ID NO: 542952 - RNA, 21 nt, Human
aggcacuguuugugguuuggg

SEQ ID NO: 542953 - RNA, 22 nt, Human
uugcacagaugcacaugguugc

SEQ ID NO: 542954 - RNA, 22 nt, Human
uuucucaucuggaaacagugcu

SEQ ID NO: 542955 - RNA, 22 nt, Human
aaguucaagaucaagguuccag

SEQ ID NO: 542956 - RNA, 22 nt, Human
cuuacacagucuggcacuucuu

SEQ ID NO: 542957 - RNA, 21 nt, Human
ucuggggaagacaucuaggau

SEQ ID NO: 542958 - RNA, 22 nt, Human
aaaguguagagacuuuggaacc

SEQ ID NO: 542959 - RNA, 22 nt, Human
acacacaacucauuguguaaua

SEQ ID NO: 542960 - RNA, 22 nt, Human
ugggcaagucacuucugucuuu

SEQ ID NO: 542961 - RNA, 22 nt, Human
agcugccuccauggucaaagau

SEQ ID NO: 542962 - RNA, 22 nt, Human
ucccugggccacagcugugagc

SEQ ID NO: 542963 - RNA, 22 nt, Human
gcccaggcuagcguagagugca

SEQ ID NO: 542964 - RNA, 22 nt, Human
ugcaggcugcaccccugcccug

SEQ ID NO: 542965 - RNA, 22 nt, Human
aacaaauguguggcaguguggg

SEQ ID NO: 542966 - RNA, 22 nt, Human
auauuauucuagcucuugugug

SEQ ID NO: 542967 - RNA, 22 nt, Human
aaggucauggcaaauuacuuuu

SEQ ID NO: 542968 - RNA, 22 nt, Human
aggaaugguuauggggauagua

SEQ ID NO: 542969 - RNA, 22 nt, Human
uagaaaucagcaggcauaugua

SEQ ID NO: 542970 - RNA, 22 nt, Human
uggccugcagaggcuguggggc

SEQ ID NO: 542971 - RNA, 22 nt, Human
acagcugugauuucuaucauga

SEQ ID NO: 542972 - RNA, 23 nt, Human
ggacacauuuauuucagaauuca

SEQ ID NO: 542973 - RNA, 22 nt, Human
gcagggugugucucauacaguu

SEQ ID NO: 542974 - RNA, 22 nt, Human
aagcagagaaucugggagcgag

SEQ ID NO: 542975 - RNA, 22 nt, Human
gugcccugacacaccuggugug

SEQ ID NO: 542976 - RNA, 22 nt, Human
auggccagagaggccagccugg

SEQ ID NO: 542977 - RNA, 22 nt, Human
uuuguacauguaagauugcauc

SEQ ID NO: 542978 - RNA, 22 nt, Human
augaacuagccagguugugcug

SEQ ID NO: 542979 - RNA, 19 nt, Human
agugucaucagcuacucag

SEQ ID NO: 542980 - RNA, 22 nt, Human
uucuacauucauguauuaccuc

SEQ ID NO: 542981 - RNA, 22 nt, Human
ucacauacacuaggauauuuuu

SEQ ID NO: 542982 - RNA, 22 nt, Human
ccagagaggccuuggcaagaca

SEQ ID NO: 542983 - RNA, 22 nt, Human
uccuuuguugagauaaauuggg

SEQ ID NO: 542984 - RNA, 22 nt, Human
ucaaaguuuguggcaauuuauu

SEQ ID NO: 542985 - RNA, 22 nt, Human
ccuggccagccagggcuggggu

SEQ ID NO: 542986 - RNA, 17 nt, Human
cccagcuggcagugccg

SEQ ID NO: 542987 - RNA, 22 nt, Human
ugaagccacacuagcuuguccu

SEQ ID NO: 542988 - RNA, 22 nt, Human
auuguucauuguacaccuagua

SEQ ID NO: 542989 - RNA, 22 nt, Human
uuaaauauuuucagcaggguca

SEQ ID NO: 542990 - RNA, 22 nt, Human
uacauugacuuggauuguuaga

SEQ ID NO: 542991 - RNA, 22 nt, Human
gggcagcauuugaaaaacagau

SEQ ID NO: 542992 - RNA, 17 nt, Human
agggucaggugaaguuc

SEQ ID NO: 542993 - RNA, 23 nt, Human
ugagcugguauuguccaucucca

SEQ ID NO: 542994 - RNA, 22 nt, Human
ucaguuuuuacggucacaggga

SEQ ID NO: 542995 - RNA, 22 nt, Human
ucucaguggacgugucugucuu

SEQ ID NO: 542996 - RNA, 22 nt, Human
cuccuuaaguaugggcugugca

SEQ ID NO: 542997 - RNA, 22 nt, Human
uaaauguguuguggaugaaguu

SEQ ID NO: 542998 - RNA, 23 nt, Human
gcaguuaguccacuuugcagaga

SEQ ID NO: 542999 - RNA, 22 nt, Human
gcugggcucaccaggccacuag

SEQ ID NO: 543000 - RNA, 22 nt, Human
ccugagugaauucccucacugu

SEQ ID NO: 543001 - RNA, 22 nt, Human
ccuuccagaguucagucugccc

SEQ ID NO: 543002 - RNA, 22 nt, Human
uuacagaugggguugcaauaaa

SEQ ID NO: 543003 - RNA, 22 nt, Human
aagggcugggucugguuaaccc

SEQ ID NO: 543004 - RNA, 22 nt, Human
acaaaaaccguggauucagcau

SEQ ID NO: 543005 - RNA, 20 nt, Human
ucagauuuuucuaacuuuga

SEQ ID NO: 543006 - RNA, 22 nt, Human
uggcucugucaaacugcacaca

SEQ ID NO: 543007 - RNA, 22 nt, Human
ccuucaugauggaaaggguuca

SEQ ID NO: 543008 - RNA, 22 nt, Human
aagacuuucaaguaugcaugca

SEQ ID NO: 543009 - RNA, 23 nt, Human
gugagcagcaccaugaggcuaga

SEQ ID NO: 543010 - RNA, 19 nt, Human
agacuuuuguaaguugaga

SEQ ID NO: 543011 - RNA, 22 nt, Human
uacaaagugugcccaugcugag

SEQ ID NO: 543012 - RNA, 21 nt, Human
ucucuggaauuagaccauguu

SEQ ID NO: 543013 - RNA, 22 nt, Human
cuagggaaauaaacugaguggu

SEQ ID NO: 543014 - RNA, 21 nt, Human
agagacagagaaaguaacauu

SEQ ID NO: 543015 - RNA, 22 nt, Human
caggagccgccaggcacguugg

SEQ ID NO: 543016 - RNA, 22 nt, Human
caagacuuagagcaucuugaaa

SEQ ID NO: 543017 - RNA, 22 nt, Human
gcugcucugaaaaugacuguug

SEQ ID NO: 543018 - RNA, 22 nt, Human
gcaggcagagagggguuuccag

SEQ ID NO: 543019 - RNA, 22 nt, Human
cugugccaucuuuuugcuaccu

SEQ ID NO: 543020 - RNA, 22 nt, Human
gaaagacauaguugcaagaugg

SEQ ID NO: 543021 - RNA, 22 nt, Human
gaggaagagagcucugccuugu

SEQ ID NO: 543022 - RNA, 22 nt, Human
uuuagggaauagaagaucugaa

SEQ ID NO: 543023 - RNA, 22 nt, Human
uccucaguuauaaauaggaaac

SEQ ID NO: 543024 - RNA, 22 nt, Human
auucuaaaucagagagcucugu

SEQ ID NO: 543025 - RNA, 22 nt, Human
agugaaccaggcugcgucccug

SEQ ID NO: 543026 - RNA, 22 nt, Human
gagggccaacuagcaccacuuu

SEQ ID NO: 543027 - RNA, 22 nt, Human
cucuuaguuuaucuuugacaaa

SEQ ID NO: 543028 - RNA, 22 nt, Human
cuggccuuggaagggagcccgu

SEQ ID NO: 543029 - RNA, 22 nt, Human
uuucaaaguaaggauuuucauc

SEQ ID NO: 543030 - RNA, 20 nt, Human
accccagccccucuaucuga

SEQ ID NO: 543031 - RNA, 22 nt, Human
acuacauucaugcucguguugg

SEQ ID NO: 543032 - RNA, 22 nt, Human
gggcaaagugguggaggcaguu

SEQ ID NO: 543033 - RNA, 22 nt, Human
cagcaggcugcgauugcucauu

SEQ ID NO: 543034 - RNA, 22 nt, Human
ucugccuguggauacaugcucu

SEQ ID NO: 543035 - RNA, 22 nt, Human
agggcccuagggaaugagacau

SEQ ID NO: 543036 - RNA, 22 nt, Human
gcagcuguaaagcagaaauagu

SEQ ID NO: 543037 - RNA, 22 nt, Human
ucuccaggagcaagucacccag

SEQ ID NO: 543038 - RNA, 22 nt, Human
ucaggugggaguagaaugcuag

SEQ ID NO: 543039 - RNA, 22 nt, Human
ggcuuuauaggguagaggauca

SEQ ID NO: 543040 - RNA, 22 nt, Human
cauccagggcagccauggccug

SEQ ID NO: 543041 - RNA, 22 nt, Human
agauauaauaauuuacaagugu

SEQ ID NO: 543042 - RNA, 22 nt, Human
cagcuguuugggcauggccaga

SEQ ID NO: 543043 - RNA, 22 nt, Human
uuauauaaagauaacuuuucuu

SEQ ID NO: 543044 - RNA, 22 nt, Human
caagggcuucaaguggccaaga

SEQ ID NO: 543045 - RNA, 22 nt, Human
cccagaguggagggugcagaau

SEQ ID NO: 543046 - RNA, 22 nt, Human
cugaggcugggcugaggguaua

SEQ ID NO: 543047 - RNA, 22 nt, Human
aggcuauuuccacucuucucau

SEQ ID NO: 543048 - RNA, 22 nt, Human
uggggcuccuccuggcaggagg

SEQ ID NO: 543049 - RNA, 20 nt, Human
acuuuacagagaagacugac

SEQ ID NO: 543050 - RNA, 22 nt, Human
cagggggugcaggcccugugac

SEQ ID NO: 543051 - RNA, 22 nt, Human
agaaauaugcugauuagaugaa

SEQ ID NO: 543052 - RNA, 22 nt, Human
ugggccuggaguuuguccagag

SEQ ID NO: 543053 - RNA, 22 nt, Human
gaaguuaguguaaugcagggug

SEQ ID NO: 543054 - RNA, 23 nt, Human
uggcugagauccuacuguuugcu

SEQ ID NO: 543055 - RNA, 22 nt, Human
gcuuccuaaaugcacagggcag

SEQ ID NO: 543056 - RNA, 21 nt, Human
uggcucuggguaggagagugc

SEQ ID NO: 543057 - RNA, 19 nt, Human
acacauuugcacaauccac

SEQ ID NO: 543058 - RNA, 22 nt, Human
gaagcuucguggcucuucaaau

SEQ ID NO: 543059 - RNA, 22 nt, Human
gcucagagauguucaguagcuu

SEQ ID NO: 543060 - RNA, 22 nt, Human
cagggcugagaauuuagagaca

SEQ ID NO: 543061 - RNA, 22 nt, Human
uucaacacaggaacaugauaua

SEQ ID NO: 543062 - RNA, 22 nt, Human
augaagcuaaacccugcagcca

SEQ ID NO: 543063 - RNA, 22 nt, Human
ggcugagcguggcugccguggg

SEQ ID NO: 543064 - RNA, 22 nt, Human
cagauccacccuuguagugaca

SEQ ID NO: 543065 - RNA, 22 nt, Human
guggcagguuauaagcaucuca

SEQ ID NO: 543066 - RNA, 22 nt, Human
gaacauuuggauuuguaaauuu

SEQ ID NO: 543067 - RNA, 22 nt, Human
aauauaauuuuauuccuagagu

SEQ ID NO: 543068 - RNA, 22 nt, Human
aguaacaagugccaacguuaga

SEQ ID NO: 543069 - RNA, 22 nt, Human
ucugcaggaggcuggcugcagg

SEQ ID NO: 543070 - RNA, 22 nt, Human
aggauggggucugcagccuggu

SEQ ID NO: 543071 - RNA, 22 nt, Human
uuaucaagggagaaacaggagg

SEQ ID NO: 543072 - RNA, 22 nt, Human
ccauuucacuggguaguugugg

SEQ ID NO: 543073 - RNA, 22 nt, Human
auugaaaauaaggccagaaaca

SEQ ID NO: 543074 - RNA, 22 nt, Human
caaagaugucauugguaagaca

SEQ ID NO: 543075 - RNA, 22 nt, Human
gaguggggcccacugcugggug

SEQ ID NO: 543076 - RNA, 22 nt, Human
gaggccacgguuuuccuugggg

SEQ ID NO: 543077 - RNA, 22 nt, Human
gucuggaggaggaagaaggcac

SEQ ID NO: 543078 - RNA, 17 nt, Human
gcauccaguaacaugcc

SEQ ID NO: 543079 - RNA, 22 nt, Human
aguuacagaauguacagagguu

SEQ ID NO: 543080 - RNA, 22 nt, Human
ucaaaauuucagcacuagcccu

SEQ ID NO: 543081 - RNA, 22 nt, Human
gugaagaugccucaggugaccc

SEQ ID NO: 543082 - RNA, 23 nt, Human
caagucauggauuggaguuucag

SEQ ID NO: 543083 - RNA, 21 nt, Human
agcacagcauauccaauguca

SEQ ID NO: 543084 - RNA, 22 nt, Human
guggcugcucgggcuccggccc

SEQ ID NO: 543085 - RNA, 22 nt, Human
ccuguggcugccacuuggguga

SEQ ID NO: 543086 - RNA, 15 nt, Human
uggcagcuuguuaag

SEQ ID NO: 543087 - RNA, 22 nt, Human
aaaucaaggagggauuauauuu

SEQ ID NO: 543088 - RNA, 22 nt, Human
ggaggaagcccucggugcccca

SEQ ID NO: 543089 - RNA, 22 nt, Human
aauucuauaggcaagcuauuuu

SEQ ID NO: 543090 - RNA, 22 nt, Human
ucacaugcccuguauuuaccag

SEQ ID NO: 543091 - RNA, 22 nt, Human
agcagccaaaugaagauuuuac

SEQ ID NO: 543092 - RNA, 22 nt, Human
uaggugggugacuuccaugggg

SEQ ID NO: 543093 - RNA, 22 nt, Human
ccuguccuccaagagcacaucu

SEQ ID NO: 543094 - RNA, 22 nt, Human
cauuuucagcacccaucugaaa

SEQ ID NO: 543095 - RNA, 22 nt, Human
ucuggccauggcaagccgagug

SEQ ID NO: 543096 - RNA, 22 nt, Human
ggccucagugggccgcugcagg

SEQ ID NO: 543097 - RNA, 22 nt, Human
caagauggagaagcagcaaggg

SEQ ID NO: 543098 - RNA, 22 nt, Human
caggaaagguagucacaaugua

SEQ ID NO: 543099 - RNA, 22 nt, Human
ucaggauaaaauguaauggcaa

SEQ ID NO: 543100 - RNA, 22 nt, Human
aggaaagcucccaguagggcuc

SEQ ID NO: 543101 - RNA, 23 nt, Human
cccagcagagaugaggagggguc

SEQ ID NO: 543102 - RNA, 22 nt, Human
ugcagaaggaggaggaaaucca

SEQ ID NO: 543103 - RNA, 22 nt, Human
cucagaagaacaaaggcucuac

SEQ ID NO: 543104 - RNA, 22 nt, Human
uuuugauaucaugaugaacaga

SEQ ID NO: 543105 - RNA, 22 nt, Human
aggcuggccagugcugcagugg

SEQ ID NO: 543106 - RNA, 22 nt, Human
gggacaucuuucuagucagggu

SEQ ID NO: 543107 - RNA, 22 nt, Human
ccugccugucccucaguccaca

SEQ ID NO: 543108 - RNA, 18 nt, Human
uccagcuugcacuuaaau

SEQ ID NO: 543109 - RNA, 22 nt, Human
ugccaggcuuuggucaaaggcu

SEQ ID NO: 543110 - RNA, 22 nt, Human
caaaguccuagaacagugcuug

SEQ ID NO: 543111 - RNA, 22 nt, Human
aaaggcuuagacacagaacugu

SEQ ID NO: 543112 - RNA, 22 nt, Human
cugugccauccgcuugaccugg

SEQ ID NO: 543113 - RNA, 22 nt, Human
ucacaugcuugaggaaagaaaa

SEQ ID NO: 543114 - RNA, 22 nt, Human
aggagccugagucacagugccu

SEQ ID NO: 543115 - RNA, 17 nt, Human
uggacccuugggccucc

SEQ ID NO: 543116 - RNA, 22 nt, Human
gagucacaaaagaugcccaggg

SEQ ID NO: 543117 - RNA, 22 nt, Human
gcuucugguagaauucaauaga

SEQ ID NO: 543118 - RNA, 22 nt, Human
ugcacuccaggcugggugacag

SEQ ID NO: 543119 - RNA, 22 nt, Human
cuuacagagaagaaaauguagu

SEQ ID NO: 543120 - RNA, 23 nt, Human
cugcagucgccggccugggugcc

SEQ ID NO: 543121 - RNA, 22 nt, Human
ugcaugcaaugugaagaaagcu

SEQ ID NO: 543122 - RNA, 22 nt, Human
aggcugccuguuccaaucuccu

SEQ ID NO: 543123 - RNA, 22 nt, Human
uguuagaaauuauuaguaauau

SEQ ID NO: 543124 - RNA, 22 nt, Human
ggggcuccagucuucacauuuu

SEQ ID NO: 543125 - RNA, 22 nt, Human
agcugcugcggaaagaugccac

SEQ ID NO: 543126 - RNA, 22 nt, Human
aucaaagugguuuucugugcuu

SEQ ID NO: 543127 - RNA, 22 nt, Human
uuguaugaauguauccuaauuu

SEQ ID NO: 543128 - RNA, 22 nt, Human
ucuaagaaagauuaagaaauuu

SEQ ID NO: 543129 - RNA, 22 nt, Human
ugcauuguuugauaggugaauu

SEQ ID NO: 543130 - RNA, 22 nt, Human
ucaggaaagaagaugcucagug

SEQ ID NO: 543131 - RNA, 22 nt, Human
gaggagcccagcaccaucacuu

SEQ ID NO: 543132 - RNA, 22 nt, Human
ccaaucuuaucuuuauuuucua

SEQ ID NO: 543133 - RNA, 22 nt, Human
agccaggcucaaggccugcucc

SEQ ID NO: 543134 - RNA, 22 nt, Human
aauauaaugcuguuuuaugcca

SEQ ID NO: 543135 - RNA, 22 nt, Human
cucaggccagguuucucccaca

SEQ ID NO: 543136 - RNA, 22 nt, Human
uguggccucucaggcuugauca

SEQ ID NO: 543137 - RNA, 22 nt, Human
guuuuucuagaaaucuccuccu

SEQ ID NO: 543138 - RNA, 22 nt, Human
gggcucucaaggcagggcccca

SEQ ID NO: 543139 - RNA, 20 nt, Human
guuuccaaauugugcauuuu

SEQ ID NO: 543140 - RNA, 22 nt, Human
ucaggccugcaggcuuccugga

SEQ ID NO: 543141 - RNA, 22 nt, Human
gcagcuuucuugcccuaaucuu

SEQ ID NO: 543142 - RNA, 22 nt, Human
augcccuggacuucuaguauuc

SEQ ID NO: 543143 - RNA, 19 nt, Human
ggcugccuuuccuuaccag

SEQ ID NO: 543144 - RNA, 18 nt, Human
gggcccuggcguccgccc

SEQ ID NO: 543145 - RNA, 22 nt, Human
aaagcuaugaggcaugcauuuc

SEQ ID NO: 543146 - RNA, 22 nt, Human
uucugaaaauugggucauacuu

SEQ ID NO: 543147 - RNA, 19 nt, Human
ugaaacaaacuuaaaagga

SEQ ID NO: 543148 - RNA, 22 nt, Human
ugaaaaacacuaauuggaaagc

SEQ ID NO: 543149 - RNA, 22 nt, Human
ggagaggcgaugagucacagcc

SEQ ID NO: 543150 - RNA, 22 nt, Human
acaggcagcacuaaucucuggu

SEQ ID NO: 543151 - RNA, 22 nt, Human
gacagcagggacauguaggaag

SEQ ID NO: 543152 - RNA, 22 nt, Human
aagaauaucuguuuuauuuagg

SEQ ID NO: 543153 - RNA, 22 nt, Human
cucugggcggcccaggccaacc

SEQ ID NO: 543154 - RNA, 22 nt, Human
cggcuggguagaggugccgggu

SEQ ID NO: 543155 - RNA, 22 nt, Human
ggcucagguuuaaagugcuuua

SEQ ID NO: 543156 - RNA, 18 nt, Human
gcugaaauucuaaacaaa

SEQ ID NO: 543157 - RNA, 22 nt, Human
cuuccaaacccaggguaugggc

SEQ ID NO: 543158 - RNA, 22 nt, Human
uuggcaggaauauugcagaggu

SEQ ID NO: 543159 - RNA, 22 nt, Human
gguguccuugcagaaggcggcg

SEQ ID NO: 543160 - RNA, 19 nt, Human
cuggaaugagaacaugccc

SEQ ID NO: 543161 - RNA, 22 nt, Human
cagagggcacaugguuuccuca

SEQ ID NO: 543162 - RNA, 22 nt, Human
uacauguggccagaaauuugag

SEQ ID NO: 543163 - RNA, 19 nt, Human
uuuacucuccaaggugagu

SEQ ID NO: 543164 - RNA, 22 nt, Human
aggggacacggcuucuccaggg

SEQ ID NO: 543165 - RNA, 22 nt, Human
uucauucuuauuugugaucugg

SEQ ID NO: 543166 - RNA, 22 nt, Human
uagaggugacacugagaccaua

SEQ ID NO: 543167 - RNA, 22 nt, Human
uacaugcucaguaacuuucagu

SEQ ID NO: 543168 - RNA, 22 nt, Human
aauaucaucucucuuuucugca

SEQ ID NO: 543169 - RNA, 19 nt, Human
ggcaggugugcuuaugcuu

SEQ ID NO: 543170 - RNA, 22 nt, Human
aguuauauuccauagauucaga

SEQ ID NO: 543171 - RNA, 22 nt, Human
gccuguguguuuagcucugggg

SEQ ID NO: 543172 - RNA, 22 nt, Human
ggaggccaaggcagguggauca

SEQ ID NO: 543173 - RNA, 22 nt, Human
uagagugguuaacaguuuagaa

SEQ ID NO: 543174 - RNA, 22 nt, Human
cauaacuugguguuggaaacug

SEQ ID NO: 543175 - RNA, 22 nt, Human
gcagcugguuaaugggagaauu

SEQ ID NO: 543176 - RNA, 22 nt, Human
gcuuccagaucccaugcucuua

SEQ ID NO: 543177 - RNA, 22 nt, Human
augcagcaguuuacaaagcaau

SEQ ID NO: 543178 - RNA, 22 nt, Human
acacuucucccaucuccuguug

SEQ ID NO: 543179 - RNA, 22 nt, Human
aggcagcaugggccccagcucc

SEQ ID NO: 543180 - RNA, 21 nt, Human
uguggcagauguugggaggca

SEQ ID NO: 543181 - RNA, 22 nt, Human
uugaacagcuguuacauuguua

SEQ ID NO: 543182 - RNA, 22 nt, Human
ggagccugugggaugagaugug

SEQ ID NO: 543183 - RNA, 22 nt, Human
uccugggcuugcuccuccagcu

SEQ ID NO: 543184 - RNA, 21 nt, Human
ggugggguaccuaagguagcu

SEQ ID NO: 543185 - RNA, 22 nt, Human
aucuuuagauuagaaacucuaa

SEQ ID NO: 543186 - RNA, 18 nt, Human
cgaggcaggcggaucacg

SEQ ID NO: 543187 - RNA, 22 nt, Human
uuucacaucagagguagauuag

SEQ ID NO: 543188 - RNA, 22 nt, Human
cacauuccuggugcucagcagc

SEQ ID NO: 543189 - RNA, 22 nt, Human
ucccaagagcaagaacuugcug

SEQ ID NO: 543190 - RNA, 22 nt, Human
uuguuaaaaugcauauucuggu

SEQ ID NO: 543191 - RNA, 23 nt, Human
uaaagcaaagucaagugcacucc

SEQ ID NO: 543192 - RNA, 22 nt, Human
guucacaguuuuauaccugaga

SEQ ID NO: 543193 - RNA, 22 nt, Human
agaagcagaaggaagcagggcc

SEQ ID NO: 543194 - RNA, 22 nt, Human
ggggaccuuuccauuucugaga

SEQ ID NO: 543195 - RNA, 21 nt, Human
uaggugggagccccaguaugc

SEQ ID NO: 543196 - RNA, 22 nt, Human
agggaagaggaccagagucucu

SEQ ID NO: 543197 - RNA, 22 nt, Human
gugccugguuuggggaguguuc

SEQ ID NO: 543198 - RNA, 22 nt, Human
cagaaauguucuaaugauucag

SEQ ID NO: 543199 - RNA, 22 nt, Human
aauuaggaauaaaugaguacuu

SEQ ID NO: 543200 - RNA, 22 nt, Human
uuuguuuagaaagagauuggug

SEQ ID NO: 543201 - RNA, 22 nt, Human
gagauggcaggugugugggaca

SEQ ID NO: 543202 - RNA, 22 nt, Human
aucugaaagcuaggaguucuca

SEQ ID NO: 543203 - RNA, 22 nt, Human
ccaggagccugggccaggcugg

SEQ ID NO: 543204 - RNA, 23 nt, Human
cccuguagcccaggacaggcuuu

SEQ ID NO: 543205 - RNA, 22 nt, Human
ggccugugcugagaaccuggcu

SEQ ID NO: 543206 - RNA, 22 nt, Human
ccagagaagguggagcuugugu

SEQ ID NO: 543207 - RNA, 22 nt, Human
agcugcugagagucugccgggc

SEQ ID NO: 543208 - RNA, 22 nt, Human
aguggcuguuuauaggugggua

SEQ ID NO: 543209 - RNA, 22 nt, Human
cugggaggauacacaagaucag

SEQ ID NO: 543210 - RNA, 17 nt, Human
uccagcccugcccgacg

SEQ ID NO: 543211 - RNA, 22 nt, Human
cagcuuuaggacucauaauaaa

SEQ ID NO: 543212 - RNA, 22 nt, Human
ugaggcagucacccccuccugc

SEQ ID NO: 543213 - RNA, 22 nt, Human
acauuuuuuagagucccacauu

SEQ ID NO: 543214 - RNA, 22 nt, Human
ucagaauucugaagggcacaaa

SEQ ID NO: 543215 - RNA, 22 nt, Human
gucccuggucuaccguggcuuc

SEQ ID NO: 543216 - RNA, 22 nt, Human
uauacacauaucuucuaggccu

SEQ ID NO: 543217 - RNA, 22 nt, Human
aggagccaggaaaccugcucug

SEQ ID NO: 543218 - RNA, 22 nt, Human
gguaugaaaugauuccauguua

SEQ ID NO: 543219 - RNA, 22 nt, Human
gaaggcugagcagacaggccaa

SEQ ID NO: 543220 - RNA, 20 nt, Human
agguauaagaaaugugauuu

SEQ ID NO: 543221 - RNA, 22 nt, Human
gagguauguaugcuacauucuu

SEQ ID NO: 543222 - RNA, 22 nt, Human
caaguagaaggaugugauugua

SEQ ID NO: 543223 - RNA, 22 nt, Human
cacucccuucaggagccuagga

SEQ ID NO: 543224 - RNA, 22 nt, Human
cccucuggcucuucucaggccg

SEQ ID NO: 543225 - RNA, 22 nt, Human
acuugaaacaucuuuaaaugua

SEQ ID NO: 543226 - RNA, 22 nt, Human
uggagagguugaauaacuuguc

SEQ ID NO: 543227 - RNA, 22 nt, Human
agaauuuaggaugcaugugaau

SEQ ID NO: 543228 - RNA, 22 nt, Human
ucauuuauaaggaugcaauuaa

SEQ ID NO: 543229 - RNA, 22 nt, Human
ucuucaugcaccucacagcuag

SEQ ID NO: 543230 - RNA, 22 nt, Human
ucaucugucccaggcuuuuuuc

SEQ ID NO: 543231 - RNA, 22 nt, Human
ugugagacaggaccuguugacu

SEQ ID NO: 543232 - RNA, 22 nt, Human
aauucuagcccaggcaaaacua

SEQ ID NO: 543233 - RNA, 21 nt, Human
gcugggccuguacuugcccug

SEQ ID NO: 543234 - RNA, 18 nt, Human
cagagugggccaagagac

SEQ ID NO: 543235 - RNA, 22 nt, Human
uagggcaguuauaacauuagug

SEQ ID NO: 543236 - RNA, 22 nt, Human
ggcaggcuuugagaaagagcau

SEQ ID NO: 543237 - RNA, 22 nt, Human
acucaagauagggaaaguacaa

SEQ ID NO: 543238 - RNA, 22 nt, Human
gguggagcuggaccaggagagg

SEQ ID NO: 543239 - RNA, 22 nt, Human
ucauuucacuucucuagggaga

SEQ ID NO: 543240 - RNA, 22 nt, Human
aagaacaugaacacaauguuua

SEQ ID NO: 543241 - RNA, 22 nt, Human
guucacaugcucucaugcuuuu

SEQ ID NO: 543242 - RNA, 22 nt, Human
cucucugagugagggacaagcu

SEQ ID NO: 543243 - RNA, 22 nt, Human
acauguacauacacauauguaa

SEQ ID NO: 543244 - RNA, 22 nt, Human
gcaggccucuguugagggccuu

SEQ ID NO: 543245 - RNA, 22 nt, Human
cugccaggggccucacaggcca

SEQ ID NO: 543246 - RNA, 22 nt, Human
ggggggugcugaucaguggagc

SEQ ID NO: 543247 - RNA, 22 nt, Human
ugggcuccguugccuggggcag

SEQ ID NO: 543248 - RNA, 22 nt, Human
cuauuuaucuauuucugaauga

SEQ ID NO: 543249 - RNA, 22 nt, Human
cuggccagugccugugggcccc

SEQ ID NO: 543250 - RNA, 22 nt, Human
uagcugccauugcuccaggaag

SEQ ID NO: 543251 - RNA, 18 nt, Human
gggcucacacaggucauc

SEQ ID NO: 543252 - RNA, 22 nt, Human
ucccagccuuucuuucuccagc

SEQ ID NO: 543253 - RNA, 22 nt, Human
agcagcuguuagaaacaggaag

SEQ ID NO: 543254 - RNA, 22 nt, Human
ucacagaaggcaucacagaaga

SEQ ID NO: 543255 - RNA, 22 nt, Human
ggcuggaaguccaagaucaagg

SEQ ID NO: 543256 - RNA, 22 nt, Human
ccuggccaaucuagggcuguua

SEQ ID NO: 543257 - RNA, 19 nt, Human
ugcaagugucuuggacaag

SEQ ID NO: 543258 - RNA, 22 nt, Human
gccuccuggguucaugccauuc

SEQ ID NO: 543259 - RNA, 22 nt, Human
aagugauuuagucuuauaaagg

SEQ ID NO: 543260 - RNA, 22 nt, Human
ucccagggauuaggacauggau

SEQ ID NO: 543261 - RNA, 22 nt, Human
aguuuuuccguggcuacgauaa

SEQ ID NO: 543262 - RNA, 22 nt, Human
ccagugccuuuuguggguuugu

SEQ ID NO: 543263 - RNA, 22 nt, Human
agcaguuuuccugagcuccuca

SEQ ID NO: 543264 - RNA, 22 nt, Human
cauaacaguggcuucagcaagu

SEQ ID NO: 543265 - RNA, 22 nt, Human
caaggccacuccagagacuggu

SEQ ID NO: 543266 - RNA, 22 nt, Human
aguucuggaacucuacagcaac

SEQ ID NO: 543267 - RNA, 20 nt, Human
ugcucugucuaaaacuuccc

SEQ ID NO: 543268 - RNA, 22 nt, Human
cauccaggcaccacaaccagcu

SEQ ID NO: 543269 - RNA, 22 nt, Human
agugcauuauauguuucaaugg

SEQ ID NO: 543270 - RNA, 22 nt, Human
caguuucuuuccauuguuaccu

SEQ ID NO: 543271 - RNA, 22 nt, Human
uccaggcaugucugaguccuuc

SEQ ID NO: 543272 - RNA, 22 nt, Human
gcaggagagucugugccagguu

SEQ ID NO: 543273 - RNA, 22 nt, Human
aggcugugcucagccaauggga

SEQ ID NO: 543274 - RNA, 21 nt, Human
caguauuuuaagcagugaguu

SEQ ID NO: 543275 - RNA, 22 nt, Human
uagcuguguagacacucagagc

SEQ ID NO: 543276 - RNA, 18 nt, Human
acugugguuuauguguag

SEQ ID NO: 543277 - RNA, 22 nt, Human
cauagaaacugagacaaggauu

SEQ ID NO: 543278 - RNA, 22 nt, Human
uggaaauuuugaacaguuucua

SEQ ID NO: 543279 - RNA, 22 nt, Human
aggucaaggccaaaagaguggu

SEQ ID NO: 543280 - RNA, 22 nt, Human
cagcucuggguaggaggaaucu

SEQ ID NO: 543281 - RNA, 22 nt, Human
ggguacaaagauuucauaagau

SEQ ID NO: 543282 - RNA, 22 nt, Human
aaagggcugucaaauaagcaac

SEQ ID NO: 543283 - RNA, 22 nt, Human
aggaaaggccuuugcauuuggu

SEQ ID NO: 543284 - RNA, 22 nt, Human
caguuuuaaauuguuagauaau

SEQ ID NO: 543285 - RNA, 22 nt, Human
aggcacuguacuagguacaggg

SEQ ID NO: 543286 - RNA, 22 nt, Human
ccuuaaauucuccauuugaaag

SEQ ID NO: 543287 - RNA, 22 nt, Human
uccuggcucgauugcuaccaau

SEQ ID NO: 543288 - RNA, 22 nt, Human
gaagcagcuuucuggugaggag

SEQ ID NO: 543289 - RNA, 22 nt, Human
auauugcaauagaugcaucauu

SEQ ID NO: 543290 - RNA, 22 nt, Human
cagcuguuccugguugguggga

SEQ ID NO: 543291 - RNA, 21 nt, Human
uggcccuggccacggcugcca

SEQ ID NO: 543292 - RNA, 21 nt, Human
ccacucaugacuccacucacc

SEQ ID NO: 543293 - RNA, 22 nt, Human
aguauacugaaaguaaauauga

SEQ ID NO: 543294 - RNA, 20 nt, Human
uuucaaguuguaagguauca

SEQ ID NO: 543295 - RNA, 22 nt, Human
gccugcugcauccaggcuauug

SEQ ID NO: 543296 - RNA, 18 nt, Human
ucagagagcagcuuuauu

SEQ ID NO: 543297 - RNA, 20 nt, Human
guucucacugaucugcaggg

SEQ ID NO: 543298 - RNA, 22 nt, Human
guaacacagaaaugaaauucca

SEQ ID NO: 543299 - RNA, 22 nt, Human
uaaagacacugguuuuaaucau

SEQ ID NO: 543300 - RNA, 22 nt, Human
caccaucagcagcaggugucaa

SEQ ID NO: 543301 - RNA, 20 nt, Human
ugcacacacccuguccucca

SEQ ID NO: 543302 - RNA, 18 nt, Human
agcagcugugccacacug

SEQ ID NO: 543303 - RNA, 22 nt, Human
caucagaagaaagacaaaugau

SEQ ID NO: 543304 - RNA, 19 nt, Human
uaacaaagucugaagucag

SEQ ID NO: 543305 - RNA, 22 nt, Human
ggccugugcugucagcccuagu

SEQ ID NO: 543306 - RNA, 22 nt, Human
gcugcaggagcuggagcugugg

SEQ ID NO: 543307 - RNA, 22 nt, Human
acagcucugcauggcaguuauu

SEQ ID NO: 543308 - RNA, 22 nt, Human
augcaaauaaagcaacuauaca

SEQ ID NO: 543309 - RNA, 23 nt, Human
guccuauuuuuugaaauacugag

SEQ ID NO: 543310 - RNA, 21 nt, Human
agcaacucugacuagaugagg

SEQ ID NO: 543311 - RNA, 22 nt, Human
cugggcucaagaagucuucccu

SEQ ID NO: 543312 - RNA, 22 nt, Human
ggcaguuucucaggcaggggua

SEQ ID NO: 543313 - RNA, 22 nt, Human
gcucugaggcugugaggugcug

SEQ ID NO: 543314 - RNA, 22 nt, Human
ggagugucagaaacaguguccu

SEQ ID NO: 543315 - RNA, 22 nt, Human
uauaacacucagaaagaaucau

SEQ ID NO: 543316 - RNA, 22 nt, Human
augcauauugauuauagauuca

SEQ ID NO: 543317 - RNA, 22 nt, Human
aagagcaggacagaaucagaac

SEQ ID NO: 543318 - RNA, 22 nt, Human
gugccaggcccagggagcgggg

SEQ ID NO: 543319 - RNA, 21 nt, Human
uuaccaauggcuucucuuucc

SEQ ID NO: 543320 - RNA, 22 nt, Human
ucuuuauuucugaaucccccau

SEQ ID NO: 543321 - RNA, 17 nt, Human
caguggucugagguaug

SEQ ID NO: 543322 - RNA, 22 nt, Human
aggagguggcaacugucgacag

SEQ ID NO: 543323 - RNA, 22 nt, Human
aaaugaacaguugcauucucug

SEQ ID NO: 543324 - RNA, 21 nt, Human
ugggcagauggcaguguggcu

SEQ ID NO: 543325 - RNA, 22 nt, Human
ccugggcauucuuugaguucuc

SEQ ID NO: 543326 - RNA, 22 nt, Human
ccugccagcauggcuuaucucc

SEQ ID NO: 543327 - RNA, 22 nt, Human
ccaggcuggagugcaauggugc

SEQ ID NO: 543328 - RNA, 22 nt, Human
uacuuugauaagguucuucuau

SEQ ID NO: 543329 - RNA, 22 nt, Human
acaaaugaaccugaaaucucag

SEQ ID NO: 543330 - RNA, 22 nt, Human
aggcuucuuagauuggcuggag

SEQ ID NO: 543331 - RNA, 22 nt, Human
gagggcaggggucuugcacggu

SEQ ID NO: 543332 - RNA, 19 nt, Human
auuccucaaggacagaaau

SEQ ID NO: 543333 - RNA, 22 nt, Human
gugcuuaaccuaguuucuagua

SEQ ID NO: 543334 - RNA, 22 nt, Human
gcaguggcagcugaggggguau

SEQ ID NO: 543335 - RNA, 22 nt, Human
uuguguguagacucagccauug

SEQ ID NO: 543336 - RNA, 22 nt, Human
guggccuggauagacuccaucu

SEQ ID NO: 543337 - RNA, 22 nt, Human
acaaauuuauugaagggcauau

SEQ ID NO: 543338 - RNA, 22 nt, Human
uggugucaggcacuagcaugca

SEQ ID NO: 543339 - RNA, 22 nt, Human
gggaccugaggagggguuucag

SEQ ID NO: 543340 - RNA, 22 nt, Human
cuggaagaggaagccagcugga

SEQ ID NO: 543341 - RNA, 22 nt, Human
auuucauccagaguccuauuag

SEQ ID NO: 543342 - RNA, 22 nt, Human
aacuagaaccacuuguauuucc

SEQ ID NO: 543343 - RNA, 22 nt, Human
cugagcaggauauucacagcag

SEQ ID NO: 543344 - RNA, 22 nt, Human
cacagugugacugaccuucagc

SEQ ID NO: 543345 - RNA, 22 nt, Human
gaaaucaaggcuacauucaggu

SEQ ID NO: 543346 - RNA, 20 nt, Human
aaaaacaguaaugcugaaga

SEQ ID NO: 543347 - RNA, 22 nt, Human
acagccagggcauugucgccga

SEQ ID NO: 543348 - RNA, 22 nt, Human
uuucaaaggaggcugagaggau

SEQ ID NO: 543349 - RNA, 22 nt, Human
aauucucagguaaaaguuaagu

SEQ ID NO: 543350 - RNA, 21 nt, Human
aggaagaaagguuggagguug

SEQ ID NO: 543351 - RNA, 22 nt, Human
uguggcaguaaaauugggcaac

SEQ ID NO: 543352 - RNA, 22 nt, Human
gccuggagcucggcugagggcg

SEQ ID NO: 543353 - RNA, 22 nt, Human
cugccugaguacaagucccaga

SEQ ID NO: 543354 - RNA, 22 nt, Human
uaacauccuacacuguugucuu

SEQ ID NO: 543355 - RNA, 22 nt, Human
cagccaucaguaaagacagcuu

SEQ ID NO: 543356 - RNA, 22 nt, Human
gcugcugggggaacaguuaaaa

SEQ ID NO: 543357 - RNA, 22 nt, Human
uucuguauauuguaaagacuca

SEQ ID NO: 543358 - RNA, 22 nt, Human
cucugaccauucccuugauuuu

SEQ ID NO: 543359 - RNA, 22 nt, Human
cuggggacgucgggcaguguuc

SEQ ID NO: 543360 - RNA, 18 nt, Human
uacaaacuccuugaaggc

SEQ ID NO: 543361 - RNA, 22 nt, Human
aagggcucugggcuacgcacug

SEQ ID NO: 543362 - RNA, 22 nt, Human
ugagaacauacaaacagagaaa

SEQ ID NO: 543363 - RNA, 22 nt, Human
ucagugucuugggcuugaaugc

SEQ ID NO: 543364 - RNA, 21 nt, Human
agagaauugccuuagauguuc

SEQ ID NO: 543365 - RNA, 22 nt, Human
cauuuaauccucacaagccuau

SEQ ID NO: 543366 - RNA, 22 nt, Human
ggucccugcugaagccuuggug

SEQ ID NO: 543367 - RNA, 22 nt, Human
aaagagaaaaagaucccggcuc

SEQ ID NO: 543368 - RNA, 18 nt, Human
cccacacagcaguagcuc

SEQ ID NO: 543369 - RNA, 22 nt, Human
cugggcaguaugaauauucaaa

SEQ ID NO: 543370 - RNA, 22 nt, Human
ggguggggcccaggaaaucuau

SEQ ID NO: 543371 - RNA, 23 nt, Human
cucccuggcccuugggagaccug

SEQ ID NO: 543372 - RNA, 22 nt, Human
aagaaacaaccacugcucuccu

SEQ ID NO: 543373 - RNA, 22 nt, Human
ucuggagcuuccucauuuacag

SEQ ID NO: 543374 - RNA, 22 nt, Human
uccaggcuccccugcgugcucc

SEQ ID NO: 543375 - RNA, 22 nt, Human
gcaaagcacacccucagaguuu

SEQ ID NO: 543376 - RNA, 22 nt, Human
ccaggcugaauauguuccaggg

SEQ ID NO: 543377 - RNA, 22 nt, Human
agucacccuccaacucuccacu

SEQ ID NO: 543378 - RNA, 22 nt, Human
ugcaccugagaggucucugagg

SEQ ID NO: 543379 - RNA, 22 nt, Human
uggggacaggagacuuacagcu

SEQ ID NO: 543380 - RNA, 22 nt, Human
ucccacacuacacgguuguugg

SEQ ID NO: 543381 - RNA, 22 nt, Human
cagaaggcuggcagauugagau

SEQ ID NO: 543382 - RNA, 22 nt, Human
ggcagugagcuggagggaagga

SEQ ID NO: 543383 - RNA, 22 nt, Human
gggagguucuguucgcacuuga

SEQ ID NO: 543384 - RNA, 22 nt, Human
cagcuuugccaaguaaggucuu

SEQ ID NO: 543385 - RNA, 22 nt, Human
aaaugcucaccacagggaugug

SEQ ID NO: 543386 - RNA, 22 nt, Human
uggaugcuguaggacacgcucu

SEQ ID NO: 543387 - RNA, 18 nt, Human
ucacaucaucccaugcuu

SEQ ID NO: 543388 - RNA, 22 nt, Human
gcaccugguuuauauaaucaua

SEQ ID NO: 543389 - RNA, 22 nt, Human
uaagacagggagggcucucagc

SEQ ID NO: 543390 - RNA, 22 nt, Human
gcuucauuuugcccucuggugg

SEQ ID NO: 543391 - RNA, 21 nt, Human
uguucacauggagcagaaugu

SEQ ID NO: 543392 - RNA, 22 nt, Human
guguaauugaaauugagaacca

SEQ ID NO: 543393 - RNA, 22 nt, Human
auaacauuuugacaacugguga

SEQ ID NO: 543394 - RNA, 22 nt, Human
gcagaggcaaucagguaugugg

SEQ ID NO: 543395 - RNA, 22 nt, Human
uugaaacauucuccuauugauu

SEQ ID NO: 543396 - RNA, 22 nt, Human
ucccagagcccaaguuggagag

SEQ ID NO: 543397 - RNA, 22 nt, Human
ucucagagagcuguguuuuccu

SEQ ID NO: 543398 - RNA, 22 nt, Human
guggagccaggggcuguaggua

SEQ ID NO: 543399 - RNA, 21 nt, Human
ucccugcuuucuggcccaguc

SEQ ID NO: 543400 - RNA, 20 nt, Human
ugcuccaucuaaagugauua

SEQ ID NO: 543401 - RNA, 22 nt, Human
ucaucacuguaucauugauaga

SEQ ID NO: 543402 - RNA, 22 nt, Human
ccagucccaucucugucgcuua

SEQ ID NO: 543403 - RNA, 22 nt, Human
uuucugaauuccuaggauguug

SEQ ID NO: 543404 - RNA, 22 nt, Human
auucaaguucuucugucuuugc

SEQ ID NO: 543405 - RNA, 22 nt, Human
cagcaucucugccugccugcaa

SEQ ID NO: 543406 - RNA, 22 nt, Human
ugaggguggcacaggcacaaag

SEQ ID NO: 543407 - RNA, 20 nt, Human
uccaugaguuagagacuaua

SEQ ID NO: 543408 - RNA, 22 nt, Human
ucccagaggcuccagucucuau

SEQ ID NO: 543409 - RNA, 22 nt, Human
cugccuggcuaaacucaagucg

SEQ ID NO: 543410 - RNA, 22 nt, Human
agaggcuccuucacucuggcac

SEQ ID NO: 543411 - RNA, 22 nt, Human
ccagcuggagccaagguggacu

SEQ ID NO: 543412 - RNA, 22 nt, Human
cuggugccuccucccugugcuu

SEQ ID NO: 543413 - RNA, 22 nt, Human
uucauacaguggcugcacucca

SEQ ID NO: 543414 - RNA, 22 nt, Human
cugggcuuaggaccuggugcgg

SEQ ID NO: 543415 - RNA, 22 nt, Human
ucuuuguuauugcuuuaucuau

SEQ ID NO: 543416 - RNA, 21 nt, Human
agaaauguaucauucuuuucc

SEQ ID NO: 543417 - RNA, 22 nt, Human
aaucaguuaggguguuaaugag

SEQ ID NO: 543418 - RNA, 22 nt, Human
acuggggaguugaagcacuuuc

SEQ ID NO: 543419 - RNA, 22 nt, Human
agccuccaucccaugcacaaag

SEQ ID NO: 543420 - RNA, 22 nt, Human
uguacagaacuugcugucccuu

SEQ ID NO: 543421 - RNA, 22 nt, Human
cuugaaagcuuugcgucuucua

SEQ ID NO: 543422 - RNA, 22 nt, Human
ggcucaggggccaggccugucc

SEQ ID NO: 543423 - RNA, 22 nt, Human
ccaaaguccauaguuuacauua

SEQ ID NO: 543424 - RNA, 22 nt, Human
agagugaaggccagguuacagu

SEQ ID NO: 543425 - RNA, 22 nt, Human
gaauucuucugucuuuaacuga

SEQ ID NO: 543426 - RNA, 22 nt, Human
ucccagcauuaaugccugucag

SEQ ID NO: 543427 - RNA, 22 nt, Human
ugggucuccaguucagggcagg

SEQ ID NO: 543428 - RNA, 22 nt, Human
aaugaacaggugaaugucagau

SEQ ID NO: 543429 - RNA, 22 nt, Human
acaaaauuaccuaguuauuuuc

SEQ ID NO: 543430 - RNA, 22 nt, Human
cugcuucugggaugauggagua

SEQ ID NO: 543431 - RNA, 17 nt, Human
gcuaggagagggaggag

SEQ ID NO: 543432 - RNA, 22 nt, Human
gagacugcauuguccaaggguu

SEQ ID NO: 543433 - RNA, 23 nt, Human
uuaggcacuuaguagggccagag

SEQ ID NO: 543434 - RNA, 22 nt, Human
gcagagugagccgaggcugcuc

SEQ ID NO: 543435 - RNA, 22 nt, Human
gagcagcugcagugcagacccu

SEQ ID NO: 543436 - RNA, 22 nt, Human
gcagaggccaucaacuuugcca

SEQ ID NO: 543437 - RNA, 22 nt, Human
gaaaguuuauagguuauauaau

SEQ ID NO: 543438 - RNA, 22 nt, Human
ccaaagugcugggguuacaggc

SEQ ID NO: 543439 - RNA, 22 nt, Human
uaacacauagauauuuuaacuu

SEQ ID NO: 543440 - RNA, 21 nt, Human
gcuugguuuugguuacuugcc

SEQ ID NO: 543441 - RNA, 22 nt, Human
uuguuucugaguuuucauguau

SEQ ID NO: 543442 - RNA, 22 nt, Human
ccacagggacuguuaaaacccu

SEQ ID NO: 543443 - RNA, 22 nt, Human
auucuuggagcagucaaagaag

SEQ ID NO: 543444 - RNA, 22 nt, Human
guccucaggaaagcagauaaca

SEQ ID NO: 543445 - RNA, 22 nt, Human
gaaugaaagauuugcauucuau

SEQ ID NO: 543446 - RNA, 23 nt, Human
uccuggcucugcacuugcuaaug

SEQ ID NO: 543447 - RNA, 22 nt, Human
auaucauuauguuaugagcaca

SEQ ID NO: 543448 - RNA, 22 nt, Human
cugugccuuggcgcugugccac

SEQ ID NO: 543449 - RNA, 22 nt, Human
gcagggcugggugggagacaga

SEQ ID NO: 543450 - RNA, 22 nt, Human
auuagcugaccucuaaggagcc

SEQ ID NO: 543451 - RNA, 23 nt, Human
cagcucagcacauaggagguacu

SEQ ID NO: 543452 - RNA, 22 nt, Human
uucagagccacuucaagucuaa

SEQ ID NO: 543453 - RNA, 22 nt, Human
gccuggagcccaguguggggcu

SEQ ID NO: 543454 - RNA, 21 nt, Human
agcuuugcuuuguacucauuu

SEQ ID NO: 543455 - RNA, 22 nt, Human
aggcgcagacauacagggucug

SEQ ID NO: 543456 - RNA, 22 nt, Human
agaaagaacguugguuaucuua

SEQ ID NO: 543457 - RNA, 22 nt, Human
agcuaggaaauugaggcugaga

SEQ ID NO: 543458 - RNA, 22 nt, Human
aaaucaugguggaagaaacaga

SEQ ID NO: 543459 - RNA, 21 nt, Human
uccauaagagaccaucuccua

SEQ ID NO: 543460 - RNA, 22 nt, Human
ggugccaggcuguagucagggu

SEQ ID NO: 543461 - RNA, 22 nt, Human
aaacagcuaauggccaggaaua

SEQ ID NO: 543462 - RNA, 22 nt, Human
uuccaagucacccuuaggguca

SEQ ID NO: 543463 - RNA, 22 nt, Human
uccuggugucgccuggucaguu

SEQ ID NO: 543464 - RNA, 22 nt, Human
agcagggcagugaucagaaagg

SEQ ID NO: 543465 - RNA, 22 nt, Human
gggcugacaguuuccccugaaa

SEQ ID NO: 543466 - RNA, 22 nt, Human
ccuccugggccuugcucuguga

SEQ ID NO: 543467 - RNA, 22 nt, Human
agagcugagcaccaagcauggu

SEQ ID NO: 543468 - RNA, 22 nt, Human
aagccaguccucuacugggcac

SEQ ID NO: 543469 - RNA, 22 nt, Human
acagaggcagugugagauacug

SEQ ID NO: 543470 - RNA, 22 nt, Human
gcuguuccugcuuagaggucgg

SEQ ID NO: 543471 - RNA, 22 nt, Human
auuccugacugcuagucauuca

SEQ ID NO: 543472 - RNA, 22 nt, Human
ccuguguccuaauccaucaggc

SEQ ID NO: 543473 - RNA, 22 nt, Human
agagucaaaauuuaccagaaug

SEQ ID NO: 543474 - RNA, 21 nt, Human
uucaagucucuaggacuucuc

SEQ ID NO: 543475 - RNA, 22 nt, Human
ccuuaaaagaacuaucucuucu

SEQ ID NO: 543476 - RNA, 22 nt, Human
agccuggaagaaccugaagucu

SEQ ID NO: 543477 - RNA, 22 nt, Human
aguagaaagaaggcacugggcc

SEQ ID NO: 543478 - RNA, 22 nt, Human
agaauuguaagcaauuugauua

SEQ ID NO: 543479 - RNA, 22 nt, Human
ucaaaagaaacaccauguuccu

SEQ ID NO: 543480 - RNA, 22 nt, Human
uccuuuuugguccaaggugacc

SEQ ID NO: 543481 - RNA, 22 nt, Human
agauuuccugcacugccuuuga

SEQ ID NO: 543482 - RNA, 22 nt, Human
ucagggucaggacccagcuguu

SEQ ID NO: 543483 - RNA, 22 nt, Human
ugagcucauagcucuuauuaug

SEQ ID NO: 543484 - RNA, 19 nt, Human
aaaccuguuaguagagcac

SEQ ID NO: 543485 - RNA, 22 nt, Human
uccauggguagcccugguugag

SEQ ID NO: 543486 - RNA, 21 nt, Human
gagcugggcgaggcuccgggg

SEQ ID NO: 543487 - RNA, 22 nt, Human
caggcucccacaagcucccagc

SEQ ID NO: 543488 - RNA, 22 nt, Human
augggaggcagacacuaaguuc

SEQ ID NO: 543489 - RNA, 22 nt, Human
uuuccaauucaagcuuuuacgu

SEQ ID NO: 543490 - RNA, 22 nt, Human
gaggucagucagaccaggguuu

SEQ ID NO: 543491 - RNA, 22 nt, Human
aggcccagcccguccucgugcu

SEQ ID NO: 543492 - RNA, 22 nt, Human
ucccagccuuccuuguggugaa

SEQ ID NO: 543493 - RNA, 22 nt, Human
cuggcugggagcgagcugcuca

SEQ ID NO: 543494 - RNA, 22 nt, Human
auaguuguguggggauucuggu

SEQ ID NO: 543495 - RNA, 22 nt, Human
gaggaaccaaucugugauauuc

SEQ ID NO: 543496 - RNA, 22 nt, Human
uauauuuaaauccagguugaaa

SEQ ID NO: 543497 - RNA, 22 nt, Human
ccaggacaggaguuggcuucgc

SEQ ID NO: 543498 - RNA, 22 nt, Human
auauuaaugagcaaguaaguga

SEQ ID NO: 543499 - RNA, 22 nt, Human
cuccucuggguccugguggcca

SEQ ID NO: 543500 - RNA, 22 nt, Human
acugggaagacaagaaagauag

SEQ ID NO: 543501 - RNA, 22 nt, Human
gcauacagagaggauguggcau

SEQ ID NO: 543502 - RNA, 20 nt, Human
agggucugaugugguggccc

SEQ ID NO: 543503 - RNA, 22 nt, Human
uuuaagagcuaguaugucauuu

SEQ ID NO: 543504 - RNA, 22 nt, Human
aguaucaaucacccuuugaagu

SEQ ID NO: 543505 - RNA, 22 nt, Human
auuucuuaaaacuucagggaga

SEQ ID NO: 543506 - RNA, 22 nt, Human
agaaacaucgcuuaguccucau

SEQ ID NO: 543507 - RNA, 22 nt, Human
aauaucuguggccauacaauuu

SEQ ID NO: 543508 - RNA, 22 nt, Human
uuuauucuagcucagaauaguu

SEQ ID NO: 543509 - RNA, 22 nt, Human
ucaaagcuuagauaauuucuuu

SEQ ID NO: 543510 - RNA, 22 nt, Human
ugggugaggaugaugaggcagc

SEQ ID NO: 543511 - RNA, 22 nt, Human
ucaguguuaaucagugguaccu

SEQ ID NO: 543512 - RNA, 22 nt, Human
ugaaaucaauugcaauguuuau

SEQ ID NO: 543513 - RNA, 22 nt, Human
caauuucaagauucuguucuuu

SEQ ID NO: 543514 - RNA, 22 nt, Human
uccaaagagguuaagaacgaga

SEQ ID NO: 543515 - RNA, 22 nt, Human
ugggcagaggcagcagaaaccu

SEQ ID NO: 543516 - RNA, 22 nt, Human
ccaggcucaggccugcucguug

SEQ ID NO: 543517 - RNA, 22 nt, Human
ugccuacauuccuugcuuaugg

SEQ ID NO: 543518 - RNA, 22 nt, Human
aagcacaggggaaauaaguugu

SEQ ID NO: 543519 - RNA, 22 nt, Human
ucuccucuauuucuguauguau

SEQ ID NO: 543520 - RNA, 22 nt, Human
aguacuucagaggcugcccagg

SEQ ID NO: 543521 - RNA, 22 nt, Human
aauacugucuuucacagauauu

SEQ ID NO: 543522 - RNA, 20 nt, Human
aaacgagccaucauucuggu

SEQ ID NO: 543523 - RNA, 22 nt, Human
acagugauugggguaucugcag

SEQ ID NO: 543524 - RNA, 22 nt, Human
uuuuaucaaucauuaagacauu

SEQ ID NO: 543525 - RNA, 22 nt, Human
ugauuuccuagcugacaugaaa

SEQ ID NO: 543526 - RNA, 22 nt, Human
uuggaaaagugaaacuagaugc

SEQ ID NO: 543527 - RNA, 22 nt, Human
aacaguguuuugcucuuugccc

SEQ ID NO: 543528 - RNA, 22 nt, Human
aggagcugcauggauaccuggu

SEQ ID NO: 543529 - RNA, 22 nt, Human
ucuauuaaugauucaauagugu

SEQ ID NO: 543530 - RNA, 22 nt, Human
ucacaagaauuuguagaugaaa

SEQ ID NO: 543531 - RNA, 22 nt, Human
uuauaauugcuuauuagaccca

SEQ ID NO: 543532 - RNA, 22 nt, Human
cucaagacugaucgcaguggaa

SEQ ID NO: 543533 - RNA, 22 nt, Human
ggccugugggaggacagcuggg

SEQ ID NO: 543534 - RNA, 22 nt, Human
acaguaauuaaaauggaucugc

SEQ ID NO: 543535 - RNA, 22 nt, Human
uugcccugucuuaagcuggcaa

SEQ ID NO: 543536 - RNA, 22 nt, Human
gaaggcugcgaggggagugccg

SEQ ID NO: 543537 - RNA, 22 nt, Human
aaaaguauuuugagcacuuuau

SEQ ID NO: 543538 - RNA, 21 nt, Human
agcagcugcaguuucuaucug

SEQ ID NO: 543539 - RNA, 22 nt, Human
ugcuucaggaagaaacgccagg

SEQ ID NO: 543540 - RNA, 22 nt, Human
ccuuucaaauuacaugacugcu

SEQ ID NO: 543541 - RNA, 22 nt, Human
uucaaacucugaguaguucugc

SEQ ID NO: 543542 - RNA, 22 nt, Human
cuguccugggggugguccuugc

SEQ ID NO: 543543 - RNA, 22 nt, Human
uugaaagauagugaagccagcc

SEQ ID NO: 543544 - RNA, 22 nt, Human
aggcaggaacccugugugcgcc

SEQ ID NO: 543545 - RNA, 22 nt, Human
gcugcccuacccgaggcacucu

SEQ ID NO: 543546 - RNA, 22 nt, Human
ccugagagccagugccugccca

SEQ ID NO: 543547 - RNA, 22 nt, Human
augggcugugggacccuggacc

SEQ ID NO: 543548 - RNA, 22 nt, Human
agaaacuucagcuauucuuuug

SEQ ID NO: 543549 - RNA, 22 nt, Human
agucaacauuugagaugcaaug

SEQ ID NO: 543550 - RNA, 22 nt, Human
cucuggagguggagguugcagu

SEQ ID NO: 543551 - RNA, 22 nt, Human
ugucaugcagguuuguuauaga

SEQ ID NO: 543552 - RNA, 22 nt, Human
aagcccaguuucacacugagac

SEQ ID NO: 543553 - RNA, 22 nt, Human
gcaaagaaagccaaggucuaac

SEQ ID NO: 543554 - RNA, 22 nt, Human
ugucauaaaacacaagcuguug

SEQ ID NO: 543555 - RNA, 22 nt, Human
uaugaaaagguggccaauguag

SEQ ID NO: 543556 - RNA, 21 nt, Human
uuacuuuugcagcaaccuaau

SEQ ID NO: 543557 - RNA, 15 nt, Human
gcuucuccagaugac

SEQ ID NO: 543558 - RNA, 22 nt, Human
auuucacaaaccauccugauuu

SEQ ID NO: 543559 - RNA, 22 nt, Human
uccaggccuugacaggucaguu

SEQ ID NO: 543560 - RNA, 22 nt, Human
agggccucugacgcccccagcc

SEQ ID NO: 543561 - RNA, 23 nt, Human
agcaauaagaagggauacaugug

SEQ ID NO: 543562 - RNA, 22 nt, Human
aaaaugugcaguuuuuaagcug

SEQ ID NO: 543563 - RNA, 22 nt, Human
uugaauaguguuuucaguauac

SEQ ID NO: 543564 - RNA, 22 nt, Human
caaugauggcuaggcagcugcu

SEQ ID NO: 543565 - RNA, 22 nt, Human
agaggcugggcaggacccacag

SEQ ID NO: 543566 - RNA, 22 nt, Human
cuuauucagaaggagaaaugga

SEQ ID NO: 543567 - RNA, 22 nt, Human
ugcucccaaacgaccuacugug

SEQ ID NO: 543568 - RNA, 20 nt, Human
acaaaguauugaggacaagu

SEQ ID NO: 543569 - RNA, 22 nt, Human
gaggcuggugguuaguuccauu

SEQ ID NO: 543570 - RNA, 22 nt, Human
gucaacaucggaaagcguguaa

SEQ ID NO: 543571 - RNA, 20 nt, Human
agcaccagugggggcagccc

SEQ ID NO: 543572 - RNA, 22 nt, Human
gaugucuuuuuccaggcucuuu

SEQ ID NO: 543573 - RNA, 22 nt, Human
caagucauuacugaaaugucac

SEQ ID NO: 543574 - RNA, 18 nt, Human
uuuguccuguggcagcug

SEQ ID NO: 543575 - RNA, 22 nt, Human
agcagcagaaaguugauggcag

SEQ ID NO: 543576 - RNA, 23 nt, Human
acugccugugccgaucucucuca

SEQ ID NO: 543577 - RNA, 22 nt, Human
cagcuggaugggagaccauguu

SEQ ID NO: 543578 - RNA, 22 nt, Human
uuccaggaagcaguuagcagcc

SEQ ID NO: 543579 - RNA, 22 nt, Human
auauguguacgugcaguauaua

SEQ ID NO: 543580 - RNA, 22 nt, Human
ugucccauggacacaacuucuu

SEQ ID NO: 543581 - RNA, 22 nt, Human
ucuguaguagguuguaguucuu

SEQ ID NO: 543582 - RNA, 22 nt, Human
agugccuugugugugggcagcc

SEQ ID NO: 543583 - RNA, 22 nt, Human
aucaaagaaugugacugaaaua

SEQ ID NO: 543584 - RNA, 22 nt, Human
aucucagggcuggagcccugga

SEQ ID NO: 543585 - RNA, 22 nt, Human
ucauuuguugcuguuaccugag

SEQ ID NO: 543586 - RNA, 22 nt, Human
aggcagaauguuggaaaggaag

SEQ ID NO: 543587 - RNA, 21 nt, Human
gcagccagccgagaccaugcc

SEQ ID NO: 543588 - RNA, 22 nt, Human
guggugaagccccaucucugcu

SEQ ID NO: 543589 - RNA, 22 nt, Human
gcucucagaugcuccagcagcc

SEQ ID NO: 543590 - RNA, 22 nt, Human
gcugcagccaaauucauuguca

SEQ ID NO: 543591 - RNA, 22 nt, Human
aagaacugugcuccaggcucca

SEQ ID NO: 543592 - RNA, 22 nt, Human
uggcugggcccccaccugccuc

SEQ ID NO: 543593 - RNA, 22 nt, Human
ugcuuuauuuuaaauaugccau

SEQ ID NO: 543594 - RNA, 22 nt, Human
cuucuuaaugcauaaacugugu

SEQ ID NO: 543595 - RNA, 22 nt, Human
ccagugccugugggcauggugc

SEQ ID NO: 543596 - RNA, 18 nt, Human
caggagcaggaguugaac

SEQ ID NO: 543597 - RNA, 22 nt, Human
gaaaugugaccuacuuccuugu

SEQ ID NO: 543598 - RNA, 22 nt, Human
acaggcuguugggguccagggu

SEQ ID NO: 543599 - RNA, 22 nt, Human
caggaaccuaaugaaggcucac

SEQ ID NO: 543600 - RNA, 22 nt, Human
acaugucaauuuaguacucuua

SEQ ID NO: 543601 - RNA, 22 nt, Human
agaguggcuugcucagcuagca

SEQ ID NO: 543602 - RNA, 22 nt, Human
augcagagacagauguggcaug

SEQ ID NO: 543603 - RNA, 21 nt, Human
auuuucauuuccaggggagga

SEQ ID NO: 543604 - RNA, 22 nt, Human
aaaacucugcaguuaguuucua

SEQ ID NO: 543605 - RNA, 22 nt, Human
ggcagcuccaaaaggaaacacu

SEQ ID NO: 543606 - RNA, 22 nt, Human
aaguucaagucuccugaguaua

SEQ ID NO: 543607 - RNA, 22 nt, Human
gcuggcucccauugguccuucc

SEQ ID NO: 543608 - RNA, 22 nt, Human
ugaagacagaccaaggagaaug

SEQ ID NO: 543609 - RNA, 21 nt, Human
uaaaugugagcagggcugggc

SEQ ID NO: 543610 - RNA, 22 nt, Human
cucccagguuccgacgccucuu

SEQ ID NO: 543611 - RNA, 22 nt, Human
gcacugaaauuauaugcauuug

SEQ ID NO: 543612 - RNA, 22 nt, Human
gccaaaucuugcacacucuugu

SEQ ID NO: 543613 - RNA, 22 nt, Human
aaaucauguuggcacaauaaaa

SEQ ID NO: 543614 - RNA, 22 nt, Human
cuuugcaugggucugaaggcuu

SEQ ID NO: 543615 - RNA, 21 nt, Human
agcagccauuucacagagacu

SEQ ID NO: 543616 - RNA, 22 nt, Human
ugagccuguggggugacaacca

SEQ ID NO: 543617 - RNA, 20 nt, Human
agcaguuuccuaacucagcu

SEQ ID NO: 543618 - RNA, 22 nt, Human
augcaguauaaaucauuucugg

SEQ ID NO: 543619 - RNA, 22 nt, Human
gaggaaaagagacagguuauug

SEQ ID NO: 543620 - RNA, 22 nt, Human
guuucauaugcaguuaacagca

SEQ ID NO: 543621 - RNA, 21 nt, Human
gaucuuuacuuuccuacuuac

SEQ ID NO: 543622 - RNA, 19 nt, Human
cuccucagucccagagguc

SEQ ID NO: 543623 - RNA, 22 nt, Human
auucauaucauagaguuauuga

SEQ ID NO: 543624 - RNA, 22 nt, Human
cuuccucccggcccaugcucug

SEQ ID NO: 543625 - RNA, 22 nt, Human
uccuggaggcaaaugagcacau

SEQ ID NO: 543626 - RNA, 22 nt, Human
uuccucugaaauggcuuggaaa

SEQ ID NO: 543627 - RNA, 22 nt, Human
uucuggauguuguagucugaga

SEQ ID NO: 543628 - RNA, 22 nt, Human
gcccacagcucguuccucuccu

SEQ ID NO: 543629 - RNA, 22 nt, Human
agccagggcucuccuucgcgug

SEQ ID NO: 543630 - RNA, 22 nt, Human
accagggcacaggagucugaag

SEQ ID NO: 543631 - RNA, 22 nt, Human
aggacagcaguuggugagguuc

SEQ ID NO: 543632 - RNA, 22 nt, Human
gagcagagucuauuuccacacu

SEQ ID NO: 543633 - RNA, 22 nt, Human
ccugggugaaaucucuccugca

SEQ ID NO: 543634 - RNA, 23 nt, Human
acacucuucccagaagguucuga

SEQ ID NO: 543635 - RNA, 20 nt, Human
ccagucccugagcaccaggg

SEQ ID NO: 543636 - RNA, 22 nt, Human
guggccucuguuggcuccuagg

SEQ ID NO: 543637 - RNA, 22 nt, Human
gcucugagaggaugcugagcag

SEQ ID NO: 543638 - RNA, 20 nt, Human
ugugcccaauguccagguuc

SEQ ID NO: 543639 - RNA, 22 nt, Human
cuuuguuuuacucagaggcaug

SEQ ID NO: 543640 - RNA, 22 nt, Human
uaacugaacaucucaaaucaag

SEQ ID NO: 543641 - RNA, 17 nt, Human
gugaagagucauugaau

SEQ ID NO: 543642 - RNA, 22 nt, Human
uggcagaaagaaccaugugcaa

SEQ ID NO: 543643 - RNA, 22 nt, Human
uugucugucccagcuugugcau

SEQ ID NO: 543644 - RNA, 22 nt, Human
gcuucucuggccugcagggcau

SEQ ID NO: 543645 - RNA, 22 nt, Human
acagggaaguucugcaacagga

SEQ ID NO: 543646 - RNA, 22 nt, Human
ccucugcagcagagagccagag

SEQ ID NO: 543647 - RNA, 22 nt, Human
caggaggaggguacaccaucag

SEQ ID NO: 543648 - RNA, 22 nt, Human
cagaaucucugggaguggauca

SEQ ID NO: 543649 - RNA, 22 nt, Human
auggggcugggauucuccucgg

SEQ ID NO: 543650 - RNA, 22 nt, Human
ugggaaggauacguuacaagau

SEQ ID NO: 543651 - RNA, 22 nt, Human
uuaugaaggaucagguacuugg

SEQ ID NO: 543652 - RNA, 22 nt, Human
ggggugugaguagagcugggga

SEQ ID NO: 543653 - RNA, 22 nt, Human
uuagaaauacaagugagguuga

SEQ ID NO: 543654 - RNA, 22 nt, Human
accaggcuggagugcaguggcg

SEQ ID NO: 543655 - RNA, 22 nt, Human
uuaugcaacaggugagcagaca

SEQ ID NO: 543656 - RNA, 22 nt, Human
ggagagguguauucaguggguc

SEQ ID NO: 543657 - RNA, 21 nt, Human
auuuccaaauaaggucacauu

SEQ ID NO: 543658 - RNA, 22 nt, Human
ucagaggagaccaaggggaaua

SEQ ID NO: 543659 - RNA, 22 nt, Human
ggccaccuuccaguugccugca

SEQ ID NO: 543660 - RNA, 22 nt, Human
ggcaggugaucuagagucaaua

SEQ ID NO: 543661 - RNA, 22 nt, Human
gaaagacucuugaugucuuugg

SEQ ID NO: 543662 - RNA, 22 nt, Human
uuugacagcauaauccuacacc

SEQ ID NO: 543663 - RNA, 23 nt, Human
agggcuccuuguugauuagcauu

SEQ ID NO: 543664 - RNA, 22 nt, Human
guauuugucuuguuggucucca

SEQ ID NO: 543665 - RNA, 22 nt, Human
aagaaauguagagccuaguaaa

SEQ ID NO: 543666 - RNA, 22 nt, Human
ucucaggaguagugggauccau

SEQ ID NO: 543667 - RNA, 22 nt, Human
gugacucuuaaagcaaaucuug

SEQ ID NO: 543668 - RNA, 22 nt, Human
ugcuuccugaggccgucuucuc

SEQ ID NO: 543669 - RNA, 22 nt, Human
auggccagcuuauaggggcuca

SEQ ID NO: 543670 - RNA, 22 nt, Human
uccugucuaaagaccugcaggc

SEQ ID NO: 543671 - RNA, 22 nt, Human
gccaggggacgcggagcgacga

SEQ ID NO: 543672 - RNA, 22 nt, Human
ugcugugauggagaauucugga

SEQ ID NO: 543673 - RNA, 22 nt, Human
ccagcauggcaccugagaugag

SEQ ID NO: 543674 - RNA, 22 nt, Human
cacauacuuguguguacauaug

SEQ ID NO: 543675 - RNA, 22 nt, Human
ugggaggacuugugggcuucau

SEQ ID NO: 543676 - RNA, 22 nt, Human
cuggcccauggugagcucuggg

SEQ ID NO: 543677 - RNA, 22 nt, Human
gugggccuucaacccugucugg

SEQ ID NO: 543678 - RNA, 22 nt, Human
ugccagaguuacaugaggguca

SEQ ID NO: 543679 - RNA, 22 nt, Human
gcuuucaaauccuaauuccaac

SEQ ID NO: 543680 - RNA, 22 nt, Human
acaacaguccaguauagacugu

SEQ ID NO: 543681 - RNA, 22 nt, Human
uaagaaacauuuuuaugacagu

SEQ ID NO: 543682 - RNA, 22 nt, Human
uguuugaauuuugcuaacgugu

SEQ ID NO: 543683 - RNA, 22 nt, Human
acugcuuuucuaagauucugug

SEQ ID NO: 543684 - RNA, 22 nt, Human
aaagcaaugaugguagacacgu

SEQ ID NO: 543685 - RNA, 22 nt, Human
gucuguggcaggggagaaguuu

SEQ ID NO: 543686 - RNA, 20 nt, Human
augcccuguccucuucuguu

SEQ ID NO: 543687 - RNA, 22 nt, Human
uccugccuguuuaccuguacuu

SEQ ID NO: 543688 - RNA, 22 nt, Human
agagcugguuuacucaggaauu

SEQ ID NO: 543689 - RNA, 22 nt, Human
acaguguguuggaggagacugu

SEQ ID NO: 543690 - RNA, 22 nt, Human
guguacauagaauugugcuuug

SEQ ID NO: 543691 - RNA, 22 nt, Human
ugccugucuccucugcagggug

SEQ ID NO: 543692 - RNA, 22 nt, Human
agaagccauagucugggaggca

SEQ ID NO: 543693 - RNA, 22 nt, Human
gagagugucuggaggaagcuaa

SEQ ID NO: 543694 - RNA, 22 nt, Human
aaguuuuccuguguccaagaug

SEQ ID NO: 543695 - RNA, 22 nt, Human
uugacaaaaaccucauuucacc

SEQ ID NO: 543696 - RNA, 22 nt, Human
aucuggcuauugacauguuaua

SEQ ID NO: 543697 - RNA, 22 nt, Human
uagagcugcuggacuguaacag

SEQ ID NO: 543698 - RNA, 22 nt, Human
ccucucccgggugccgcugggc

SEQ ID NO: 543699 - RNA, 22 nt, Human
uuagccaugugggaaaaacagc

SEQ ID NO: 543700 - RNA, 22 nt, Human
agcagcagcucauucuuccugu

SEQ ID NO: 543701 - RNA, 22 nt, Human
uggaagcaucacuucuugccug

SEQ ID NO: 543702 - RNA, 22 nt, Human
gaaugaguuaauauuugcuugg

SEQ ID NO: 543703 - RNA, 21 nt, Human
ucuggaagaaaaaaguauuau

SEQ ID NO: 543704 - RNA, 22 nt, Human
uauccaaagagauucauguucu

SEQ ID NO: 543705 - RNA, 22 nt, Human
gcugccugcuucaugugggaga

SEQ ID NO: 543706 - RNA, 22 nt, Human
caggagcagaggguggucagca

SEQ ID NO: 543707 - RNA, 22 nt, Human
gugggugauguacuggaggcca

SEQ ID NO: 543708 - RNA, 22 nt, Human
caggaucccuggccuccgccca

SEQ ID NO: 543709 - RNA, 23 nt, Human
aguuuuucugcaugguucuguau

SEQ ID NO: 543710 - RNA, 22 nt, Human
auguacauuuuccuaauguuuu

SEQ ID NO: 543711 - RNA, 22 nt, Human
ugauucaguugguuuuguucag

SEQ ID NO: 543712 - RNA, 22 nt, Human
aaggcagcaccgccuccugaaa

SEQ ID NO: 543713 - RNA, 22 nt, Human
cccucccaggaguggccagaga

SEQ ID NO: 543714 - RNA, 22 nt, Human
uggcucagaugcucuuccagug

SEQ ID NO: 543715 - RNA, 22 nt, Human
gaagaacacuucaugauucauu

SEQ ID NO: 543716 - RNA, 22 nt, Human
agaagggccagcuggacaccug

SEQ ID NO: 543717 - RNA, 18 nt, Human
acuggcuuuagcaucaga

SEQ ID NO: 543718 - RNA, 22 nt, Human
ucugagagagggucagaugcua

SEQ ID NO: 543719 - RNA, 22 nt, Human
cugugcauugucuugucuguag

SEQ ID NO: 543720 - RNA, 22 nt, Human
cuauuugucaguuuggcuuuaa

SEQ ID NO: 543721 - RNA, 22 nt, Human
uguggaaaauuggaacguuccu

SEQ ID NO: 543722 - RNA, 21 nt, Human
ucuguacaucauugagucccc

SEQ ID NO: 543723 - RNA, 22 nt, Human
gugcugagcugcagaugcgcuc

SEQ ID NO: 543724 - RNA, 22 nt, Human
ucucagagcuucagaaagcacc

SEQ ID NO: 543725 - RNA, 22 nt, Human
aacaucuuuacaacagaccuag

SEQ ID NO: 543726 - RNA, 16 nt, Human
cuucacagaggagagu

SEQ ID NO: 543727 - RNA, 22 nt, Human
aagccaguguccagaaugggca

SEQ ID NO: 543728 - RNA, 22 nt, Human
uccaugagacagauacuguaag

SEQ ID NO: 543729 - RNA, 22 nt, Human
aagcccagaugugagaacugag

SEQ ID NO: 543730 - RNA, 22 nt, Human
ugggauaguggccaggaccccc

SEQ ID NO: 543731 - RNA, 22 nt, Human
aggcaugaugugcaguggcaaa

SEQ ID NO: 543732 - RNA, 22 nt, Human
uuucauaauauccagagauuuu

SEQ ID NO: 543733 - RNA, 22 nt, Human
gaagcccuauccucuccuggga

SEQ ID NO: 543734 - RNA, 22 nt, Human
acauuucuugaugccucuguga

SEQ ID NO: 543735 - RNA, 22 nt, Human
cagccagcuggcacugugagua

SEQ ID NO: 543736 - RNA, 22 nt, Human
acaggcucaguucacuggauuu

SEQ ID NO: 543737 - RNA, 22 nt, Human
cccugccugugggcaucaacau

SEQ ID NO: 543738 - RNA, 20 nt, Human
ccugaggguuuguguucuuu

SEQ ID NO: 543739 - RNA, 22 nt, Human
uaaaggcaaauguguguuugug

SEQ ID NO: 543740 - RNA, 22 nt, Human
agcagccauagauagcaugcaa

SEQ ID NO: 543741 - RNA, 22 nt, Human
uaaguuaguccuuuuuaaaagu

SEQ ID NO: 543742 - RNA, 22 nt, Human
acagagaaagugggcugaagau

SEQ ID NO: 543743 - RNA, 22 nt, Human
auacuguuuugugacuuaucuu

SEQ ID NO: 543744 - RNA, 22 nt, Human
uucuuuucugcagcugguauuu

SEQ ID NO: 543745 - RNA, 22 nt, Human
caagagcucagaaacccuugcu

SEQ ID NO: 543746 - RNA, 22 nt, Human
ucuuccuaugccaacauucugu

SEQ ID NO: 543747 - RNA, 22 nt, Human
uuacaacuuuccugugucaaau

SEQ ID NO: 543748 - RNA, 22 nt, Human
uccccacaucucugcaucaggc

SEQ ID NO: 543749 - RNA, 22 nt, Human
agggcagcauugccuuucucca

SEQ ID NO: 543750 - RNA, 22 nt, Human
ugcuccugccguggucgggacu

SEQ ID NO: 543751 - RNA, 22 nt, Human
ggagauagacuuggugagccac

SEQ ID NO: 543752 - RNA, 22 nt, Human
aggcacugggggaugagcaagg

SEQ ID NO: 543753 - RNA, 22 nt, Human
auggcagaccuccuggccacaa

SEQ ID NO: 543754 - RNA, 22 nt, Human
gagagcugauagaugagcuacu

SEQ ID NO: 543755 - RNA, 22 nt, Human
gcaucuucacacaaagccagug

SEQ ID NO: 543756 - RNA, 22 nt, Human
cuuagaugaagucacagaaccc

SEQ ID NO: 543757 - RNA, 21 nt, Human
ugauccuuucccccauguugc

SEQ ID NO: 543758 - RNA, 22 nt, Human
agcagggcuccauuucacugcc

SEQ ID NO: 543759 - RNA, 22 nt, Human
aggcagggucuugcuauguugc

SEQ ID NO: 543760 - RNA, 20 nt, Human
ucaccuaaaccagcaguuuc

SEQ ID NO: 543761 - RNA, 22 nt, Human
auuguucaaagugcuuugcaug

SEQ ID NO: 543762 - RNA, 22 nt, Human
ggggcagaaguagugccccuga

SEQ ID NO: 543763 - RNA, 22 nt, Human
ucuuuuggguucuuaugauuua

SEQ ID NO: 543764 - RNA, 22 nt, Human
uggggcugugagacuacaggau

SEQ ID NO: 543765 - RNA, 22 nt, Human
gaggcucacugggcaaagacuc

SEQ ID NO: 543766 - RNA, 22 nt, Human
ccagagggcaaaaugaagcuua

SEQ ID NO: 543767 - RNA, 22 nt, Human
uuucaguuguuuuagcucugug

SEQ ID NO: 543768 - RNA, 22 nt, Human
gagcugugagggacacauugcu

SEQ ID NO: 543769 - RNA, 22 nt, Human
uuauuuuaccuuccucugagcu

SEQ ID NO: 543770 - RNA, 22 nt, Human
agggccagcugaugagaaugag

SEQ ID NO: 543771 - RNA, 22 nt, Human
gaauguuucauguguauguuag

SEQ ID NO: 543772 - RNA, 23 nt, Human
agcugggaauuuucugaagcuuu

SEQ ID NO: 543773 - RNA, 22 nt, Human
caggauggucucgaucuccuga

SEQ ID NO: 543774 - RNA, 22 nt, Human
uacaugcuccacuuucuccugu

SEQ ID NO: 543775 - RNA, 22 nt, Human
aauucaacagucaguuaucuca

SEQ ID NO: 543776 - RNA, 22 nt, Human
agcccugcauaaaucaguuggu

SEQ ID NO: 543777 - RNA, 22 nt, Human
augaguaagaccauaauuuuug

SEQ ID NO: 543778 - RNA, 22 nt, Human
agggacacaugugauuauuuau

SEQ ID NO: 543779 - RNA, 22 nt, Human
auuucuuccucugucaguaacu

SEQ ID NO: 543780 - RNA, 20 nt, Human
ucaaaggcaaaggugggugu

SEQ ID NO: 543781 - RNA, 22 nt, Human
agagcuggacgucugagcccua

SEQ ID NO: 543782 - RNA, 22 nt, Human
aagugauuuucuucuuaguuau

SEQ ID NO: 543783 - RNA, 22 nt, Human
agagcugcccacacagcagauu

SEQ ID NO: 543784 - RNA, 19 nt, Human
agugaaauggaguauucaa

SEQ ID NO: 543785 - RNA, 22 nt, Human
guucauucaucaaauauuuacu

SEQ ID NO: 543786 - RNA, 19 nt, Human
uugaaauuguuugauaugg

SEQ ID NO: 543787 - RNA, 22 nt, Human
gaaggccaagaggcuccaagau

SEQ ID NO: 543788 - RNA, 22 nt, Human
gcugagagcaaagcaugucuag

SEQ ID NO: 543789 - RNA, 22 nt, Human
acaguggaggccauaugguccu

SEQ ID NO: 543790 - RNA, 22 nt, Human
aagucauagucgggaaagacau

SEQ ID NO: 543791 - RNA, 22 nt, Human
uuucugaaaugcuggcuuugga

SEQ ID NO: 543792 - RNA, 22 nt, Human
gaugcaggauagcuucacccag

SEQ ID NO: 543793 - RNA, 22 nt, Human
gcaggugguuaaggucccaugu

SEQ ID NO: 543794 - RNA, 22 nt, Human
aaugaagcaagcugcuguguuu

SEQ ID NO: 543795 - RNA, 22 nt, Human
aauguacaaggguuccaguuuu

SEQ ID NO: 543796 - RNA, 21 nt, Human
ucauuugugaucugauuucca

SEQ ID NO: 543797 - RNA, 23 nt, Human
gggaagugaggagccccucagcc

SEQ ID NO: 543798 - RNA, 22 nt, Human
uugaaaacagcguagauucaca

SEQ ID NO: 543799 - RNA, 22 nt, Human
caggagugaguuggggucuaca

SEQ ID NO: 543800 - RNA, 22 nt, Human
gccuggcaaggcccuguugacu

SEQ ID NO: 543801 - RNA, 22 nt, Human
uucucauucugacucaguguag

SEQ ID NO: 543802 - RNA, 20 nt, Human
acuguucaagggccuggugg

SEQ ID NO: 543803 - RNA, 22 nt, Human
guguuuaauagguagcugaauc

SEQ ID NO: 543804 - RNA, 22 nt, Human
ucuuuccucugagcuccuguag

SEQ ID NO: 543805 - RNA, 22 nt, Human
aggaagcccuugucauuucugu

SEQ ID NO: 543806 - RNA, 22 nt, Human
auuguauuagcacaauacaauu

SEQ ID NO: 543807 - RNA, 22 nt, Human
gaggagcucugcuccauccuuc

SEQ ID NO: 543808 - RNA, 22 nt, Human
agcagcugcagagggcuccccc

SEQ ID NO: 543809 - RNA, 22 nt, Human
ucaggcagcauuaaacuucagc

SEQ ID NO: 543810 - RNA, 20 nt, Human
aagcacauuucuacaauaau

SEQ ID NO: 543811 - RNA, 21 nt, Human
gcagggaccgcgacuucuggg

SEQ ID NO: 543812 - RNA, 17 nt, Human
ugcauuguaggcuagcc

SEQ ID NO: 543813 - RNA, 22 nt, Human
uccaggcuagaagucacaggcc

SEQ ID NO: 543814 - RNA, 21 nt, Human
aagaaguuuggauuuuguccu

SEQ ID NO: 543815 - RNA, 22 nt, Human
aaucagaauuuauugaaucuuu

SEQ ID NO: 543816 - RNA, 22 nt, Human
cagacaggagacuggaucaugg

SEQ ID NO: 543817 - RNA, 22 nt, Human
cgggcuggcugcagcugcugga

SEQ ID NO: 543818 - RNA, 22 nt, Human
ugguggggccagacuucagcuc

SEQ ID NO: 543819 - RNA, 17 nt, Human
gcuuuggaaggguagac

SEQ ID NO: 543820 - RNA, 22 nt, Human
uuacaguuuaguccaagccaga

SEQ ID NO: 543821 - RNA, 22 nt, Human
gaggggauuggaaggaacaccc

SEQ ID NO: 543822 - RNA, 22 nt, Human
ucagagucaggaaugcuugauu

SEQ ID NO: 543823 - RNA, 22 nt, Human
ggagccuggcaaugcugcgucc

SEQ ID NO: 543824 - RNA, 22 nt, Human
ugaguuuugucuugcuagaagu

SEQ ID NO: 543825 - RNA, 22 nt, Human
aaugcaguuucauuuguagaau

SEQ ID NO: 543826 - RNA, 22 nt, Human
ucugagcuggagcccaucaccu

SEQ ID NO: 543827 - RNA, 22 nt, Human
aggccagggcacugcucuuuag

SEQ ID NO: 543828 - RNA, 22 nt, Human
uccagucauuuccauuguuccc

SEQ ID NO: 543829 - RNA, 19 nt, Human
ggucucagugcagcugcag

SEQ ID NO: 543830 - RNA, 22 nt, Human
ugacagcauaacacuggucuug

SEQ ID NO: 543831 - RNA, 22 nt, Human
aaggagcugggagggacacaug

SEQ ID NO: 543832 - RNA, 22 nt, Human
uaaaugcaaugugcuuuaccag

SEQ ID NO: 543833 - RNA, 22 nt, Human
cagcaguggaacuacccaggga

SEQ ID NO: 543834 - RNA, 22 nt, Human
agcccaggucuggcccagccug

SEQ ID NO: 543835 - RNA, 22 nt, Human
cagggagcuggcuggcgugagu

SEQ ID NO: 543836 - RNA, 22 nt, Human
guagaaauagugguugacagga

SEQ ID NO: 543837 - RNA, 22 nt, Human
gggccagguggaccccagccuc

SEQ ID NO: 543838 - RNA, 22 nt, Human
ucucagagcaucauuuucuuag

SEQ ID NO: 543839 - RNA, 22 nt, Human
gccccucccagucaggagcacu

SEQ ID NO: 543840 - RNA, 22 nt, Human
ugggcuggcugaggcauucacu

SEQ ID NO: 543841 - RNA, 22 nt, Human
cuuacaaaggagaggagauagg

SEQ ID NO: 543842 - RNA, 22 nt, Human
cugugcagugugggguaggccu

SEQ ID NO: 543843 - RNA, 22 nt, Human
cugggcagaauuuuaggauggc

SEQ ID NO: 543844 - RNA, 22 nt, Human
caggccuuucuggggaagugag

SEQ ID NO: 543845 - RNA, 22 nt, Human
cuucacugaugggacagcucaa

SEQ ID NO: 543846 - RNA, 22 nt, Human
uggacucagaaguguucuuuua

SEQ ID NO: 543847 - RNA, 22 nt, Human
gugggccucuugaggguggcua

SEQ ID NO: 543848 - RNA, 23 nt, Human
uggcugagguccagguaguuuca

SEQ ID NO: 543849 - RNA, 22 nt, Human
caacauuugugaugagcaaacu

SEQ ID NO: 543850 - RNA, 22 nt, Human
guauuuuuagguaaggaaagua

SEQ ID NO: 543851 - RNA, 22 nt, Human
uggcagagguaauucaaauccc

SEQ ID NO: 543852 - RNA, 22 nt, Human
ugcagugguugagagcccagac

SEQ ID NO: 543853 - RNA, 22 nt, Human
ucugucaacaugucaaagggcu

SEQ ID NO: 543854 - RNA, 22 nt, Human
caagaaacaccaaugacugcug

SEQ ID NO: 543855 - RNA, 22 nt, Human
auacaucucauguaagagauaa

SEQ ID NO: 543856 - RNA, 22 nt, Human
uucauucccaagaguaaacaua

SEQ ID NO: 543857 - RNA, 22 nt, Human
uuccugcccugccugugccacu

SEQ ID NO: 543858 - RNA, 22 nt, Human
gaugcacagugacccugccagu

SEQ ID NO: 543859 - RNA, 22 nt, Human
cacaggaauaagucaaacuuca

SEQ ID NO: 543860 - RNA, 22 nt, Human
ggaaaugucauagaaauauaag

SEQ ID NO: 543861 - RNA, 22 nt, Human
auaaucaaaguccuaugacauc

SEQ ID NO: 543862 - RNA, 22 nt, Human
cuccuggaccaccuuguggcca

SEQ ID NO: 543863 - RNA, 22 nt, Human
uggcacuguggauuucacaagu

SEQ ID NO: 543864 - RNA, 22 nt, Human
agagcugaaaaagcugacccgg

SEQ ID NO: 543865 - RNA, 22 nt, Human
gcuggccuuugaggaagcugcg

SEQ ID NO: 543866 - RNA, 22 nt, Human
cagcugccacuugcucucggcu

SEQ ID NO: 543867 - RNA, 22 nt, Human
uggccuugggcagguggccugc

SEQ ID NO: 543868 - RNA, 22 nt, Human
aacuacucaacucugccauugu

SEQ ID NO: 543869 - RNA, 22 nt, Human
cuggagagauccuccugaaaaa

SEQ ID NO: 543870 - RNA, 22 nt, Human
uucaugugaauauauuugucuu

SEQ ID NO: 543871 - RNA, 22 nt, Human
uggagcagaaauggccucuugu

SEQ ID NO: 543872 - RNA, 22 nt, Human
auauauuuugcggucacguggc

SEQ ID NO: 543873 - RNA, 22 nt, Human
gggaggagugaagauucaccug

SEQ ID NO: 543874 - RNA, 22 nt, Human
acauuucuaguuguucaucucc

SEQ ID NO: 543875 - RNA, 22 nt, Human
cugucaacacgggugugcgugc

SEQ ID NO: 543876 - RNA, 22 nt, Human
gcccuggauggcaggagccauc

SEQ ID NO: 543877 - RNA, 22 nt, Human
ucacuguaaaguaauacuguca

SEQ ID NO: 543878 - RNA, 22 nt, Human
gugugcagggggccagcgcagc

SEQ ID NO: 543879 - RNA, 22 nt, Human
aguacuuuacuucuuacaguuu

SEQ ID NO: 543880 - RNA, 22 nt, Human
uugaaaacauuuauauuagaau

SEQ ID NO: 543881 - RNA, 22 nt, Human
uagaacaugugaaaauauagcc

SEQ ID NO: 543882 - RNA, 22 nt, Human
aaaaauaggucaaccguguaug

SEQ ID NO: 543883 - RNA, 22 nt, Human
ucccagccacagguguagcccu

SEQ ID NO: 543884 - RNA, 22 nt, Human
gcaauauaaccaguugucaugc

SEQ ID NO: 543885 - RNA, 22 nt, Human
cucccagagaccaagcugagaa

SEQ ID NO: 543886 - RNA, 22 nt, Human
ucuacugcacuggugucucauc

SEQ ID NO: 543887 - RNA, 22 nt, Human
ucugaaggucugagaaccagga

SEQ ID NO: 543888 - RNA, 22 nt, Human
uacaaaacagugcucugguccu

SEQ ID NO: 543889 - RNA, 22 nt, Human
agcagggaauagcggaaagaau

SEQ ID NO: 543890 - RNA, 20 nt, Human
gccugcagguuggaugggau

SEQ ID NO: 543891 - RNA, 22 nt, Human
gcugucugacuccaaguuggag

SEQ ID NO: 543892 - RNA, 22 nt, Human
aagaucaagaucagagaacagc

SEQ ID NO: 543893 - RNA, 22 nt, Human
cagagcuguugcggggcuuggc

SEQ ID NO: 543894 - RNA, 22 nt, Human
gcagaugaggaagcuaaugcug

SEQ ID NO: 543895 - RNA, 22 nt, Human
gcagugugaccgagcuugcuuc

SEQ ID NO: 543896 - RNA, 22 nt, Human
uauguacauaacaugaaaugca

SEQ ID NO: 543897 - RNA, 22 nt, Human
ucaaagaugauaggaaaucaua

SEQ ID NO: 543898 - RNA, 22 nt, Human
ucucagagcuucaguuauuuuc

SEQ ID NO: 543899 - RNA, 22 nt, Human
ugcagcugauuaaagggcagac

SEQ ID NO: 543900 - RNA, 22 nt, Human
caguagcaggcaggugcuuuug

SEQ ID NO: 543901 - RNA, 22 nt, Human
cacugcuuaguugguaaaugug

SEQ ID NO: 543902 - RNA, 22 nt, Human
uaauaucuacuucauagaguuu

SEQ ID NO: 543903 - RNA, 22 nt, Human
aaugcaaacuucuuguuacuug

SEQ ID NO: 543904 - RNA, 22 nt, Human
aguaugaaaguuaaucaauuua

SEQ ID NO: 543905 - RNA, 22 nt, Human
uugacaaaguuuaguaauaauc

SEQ ID NO: 543906 - RNA, 22 nt, Human
agcaaggaaaguaggcacggaa

SEQ ID NO: 543907 - RNA, 22 nt, Human
ucagccugcgucauggugacac

SEQ ID NO: 543908 - RNA, 22 nt, Human
caggcagauuugcugcccucca

SEQ ID NO: 543909 - RNA, 23 nt, Human
agcagccagagauccucggcccu

SEQ ID NO: 543910 - RNA, 22 nt, Human
uuaaacagucccagaggcugac

SEQ ID NO: 543911 - RNA, 19 nt, Human
aguguuaacccaguguugg

SEQ ID NO: 543912 - RNA, 22 nt, Human
aguaugaagcugaaugauuuua

SEQ ID NO: 543913 - RNA, 22 nt, Human
caggaugugaggaggccauuug

SEQ ID NO: 543914 - RNA, 22 nt, Human
ucuuuucuguaacucagugucu

SEQ ID NO: 543915 - RNA, 22 nt, Human
gcaggaguggagaccaugggga

SEQ ID NO: 543916 - RNA, 22 nt, Human
ugaaggugucuuugugaacauc

SEQ ID NO: 543917 - RNA, 22 nt, Human
gaugaggcucaugcacccugcg

SEQ ID NO: 543918 - RNA, 22 nt, Human
augaguugaagcuacaagaggc

SEQ ID NO: 543919 - RNA, 22 nt, Human
acaggcugcccgcuccccaccu

SEQ ID NO: 543920 - RNA, 22 nt, Human
uugggacagaaaaggagaagau

SEQ ID NO: 543921 - RNA, 22 nt, Human
ggcucuggucagugaggggccu

SEQ ID NO: 543922 - RNA, 22 nt, Human
cauggcaggugcagauucugug

SEQ ID NO: 543923 - RNA, 22 nt, Human
ucuggccugaaaguccaugcuu

SEQ ID NO: 543924 - RNA, 22 nt, Human
ggcaggugguaaggauuucaua

SEQ ID NO: 543925 - RNA, 22 nt, Human
guauaucaccccaagcagcuga

SEQ ID NO: 543926 - RNA, 23 nt, Human
gccagccuugcucuccugcagcc

SEQ ID NO: 543927 - RNA, 22 nt, Human
ggucccaggcugcgggcuggug

SEQ ID NO: 543928 - RNA, 22 nt, Human
gcagggaaggggacggaaccag

SEQ ID NO: 543929 - RNA, 22 nt, Human
cugcugggucccccugcugauu

SEQ ID NO: 543930 - RNA, 22 nt, Human
cauuugaauuguucugugggaa

SEQ ID NO: 543931 - RNA, 22 nt, Human
cuaaauaaucccucuggucuua

SEQ ID NO: 543932 - RNA, 22 nt, Human
cuggcagccaagugggauacuc

SEQ ID NO: 543933 - RNA, 22 nt, Human
uucaagaugccagggacgcggc

SEQ ID NO: 543934 - RNA, 22 nt, Human
cauugcacugcagcccgggcaa

SEQ ID NO: 543935 - RNA, 22 nt, Human
auuugaaaucccuucuacugua

SEQ ID NO: 543936 - RNA, 22 nt, Human
agggucagggagugaguauuua

SEQ ID NO: 543937 - RNA, 22 nt, Human
cugcugcauuacucuucucaag

SEQ ID NO: 543938 - RNA, 22 nt, Human
augcauaauguauguauugacu

SEQ ID NO: 543939 - RNA, 22 nt, Human
uccugccuagcaggugaccuau

SEQ ID NO: 543940 - RNA, 22 nt, Human
ggcaggcucagcagccaaggag

SEQ ID NO: 543941 - RNA, 22 nt, Human
cccaggcaggagugugguggcu

SEQ ID NO: 543942 - RNA, 22 nt, Human
cagauggaacacagaaaggaga

SEQ ID NO: 543943 - RNA, 22 nt, Human
gugggcuggauuugcuugcaga

SEQ ID NO: 543944 - RNA, 22 nt, Human
gcagaaagcuccuugcgaucug

SEQ ID NO: 543945 - RNA, 22 nt, Human
uaucuacuccucuuucagaugc

SEQ ID NO: 543946 - RNA, 22 nt, Human
uuggaauuaaaaggagaacuuc

SEQ ID NO: 543947 - RNA, 22 nt, Human
cacucaggguacaauggagggc

SEQ ID NO: 543948 - RNA, 22 nt, Human
aggugcagcugacaccaugugg

SEQ ID NO: 543949 - RNA, 22 nt, Human
aaacagcugucauuguuuuaaa

SEQ ID NO: 543950 - RNA, 22 nt, Human
ugcuucugaaguggaugggugc

SEQ ID NO: 543951 - RNA, 22 nt, Human
acagacagggcaccugccuccu

SEQ ID NO: 543952 - RNA, 20 nt, Human
ccucucugaagaggucaucu

SEQ ID NO: 543953 - RNA, 22 nt, Human
guguuuuauuggugcagucaga

SEQ ID NO: 543954 - RNA, 22 nt, Human
uaaaaugaucucucauguucuu

SEQ ID NO: 543955 - RNA, 22 nt, Human
ugaaggcacuugccuaggggca

SEQ ID NO: 543956 - RNA, 22 nt, Human
cagggacagccuugggguggcg

SEQ ID NO: 543957 - RNA, 22 nt, Human
ggaggccuccugggggagguuc

SEQ ID NO: 543958 - RNA, 22 nt, Human
ucugccagaaguucugagagua

SEQ ID NO: 543959 - RNA, 18 nt, Human
cucagggcaucagucugg

SEQ ID NO: 543960 - RNA, 21 nt, Human
gauuuaguggcuguucuaccu

SEQ ID NO: 543961 - RNA, 22 nt, Human
caugggcucuucuggacugcac

SEQ ID NO: 543962 - RNA, 22 nt, Human
cgagcaugaugacggcuguggc

SEQ ID NO: 543963 - RNA, 22 nt, Human
ggaggccaggguggguggaucg

SEQ ID NO: 543964 - RNA, 20 nt, Human
ucacaucuggcagcugauga

SEQ ID NO: 543965 - RNA, 22 nt, Human
aggaaagaaaggaggugcauuu

SEQ ID NO: 543966 - RNA, 18 nt, Human
caggugggucuccugccc

SEQ ID NO: 543967 - RNA, 22 nt, Human
agcugaauguucucagaccaga

SEQ ID NO: 543968 - RNA, 22 nt, Human
uccccucugguugacccaggag

SEQ ID NO: 543969 - RNA, 22 nt, Human
ucccaggcaaaggcagcucauu

SEQ ID NO: 543970 - RNA, 22 nt, Human
agugcagggggaaagggugucu

SEQ ID NO: 543971 - RNA, 22 nt, Human
agugccagcuccacacagcagc

SEQ ID NO: 543972 - RNA, 22 nt, Human
agggacuggcucucugagcagg

SEQ ID NO: 543973 - RNA, 18 nt, Human
acaaggucaauugguuac

SEQ ID NO: 543974 - RNA, 18 nt, Human
uguacaguuaugagcauu

SEQ ID NO: 543975 - RNA, 22 nt, Human
uagugugguaaauaaauguuuu

SEQ ID NO: 543976 - RNA, 22 nt, Human
uuucacagaacucacuaaggag

SEQ ID NO: 543977 - RNA, 22 nt, Human
uaauuuaauuccauggauucua

SEQ ID NO: 543978 - RNA, 22 nt, Human
aaagcagauucugaugcaguag

SEQ ID NO: 543979 - RNA, 22 nt, Human
aacaacugaaaagcuuuuucug

SEQ ID NO: 543980 - RNA, 22 nt, Human
ccugggcuuccacgagcagagg

SEQ ID NO: 543981 - RNA, 18 nt, Human
uccucucuuuccccaggg

SEQ ID NO: 543982 - RNA, 22 nt, Human
gagcuuugcuggaagccugggg

SEQ ID NO: 543983 - RNA, 22 nt, Human
uggccugaguugucugcaggcc

SEQ ID NO: 543984 - RNA, 22 nt, Human
uccaguuugcacuguauaauag

SEQ ID NO: 543985 - RNA, 22 nt, Human
ucucugagcugcuucuugcaua

SEQ ID NO: 543986 - RNA, 22 nt, Human
uugccucccagcaugggcagcu

SEQ ID NO: 543987 - RNA, 22 nt, Human
cuccccagguucaggagguggg

SEQ ID NO: 543988 - RNA, 22 nt, Human
gugcagggagcccagaaggucc

SEQ ID NO: 543989 - RNA, 22 nt, Human
cauuaaauuccuuguucucaaa

SEQ ID NO: 543990 - RNA, 21 nt, Human
caggaaagaaaacguacauau

SEQ ID NO: 543991 - RNA, 22 nt, Human
ccacugggggcugcaggcacuc

SEQ ID NO: 543992 - RNA, 22 nt, Human
auggggcuguucucugcccugc

SEQ ID NO: 543993 - RNA, 20 nt, Human
ggcugcugguuuggcucugu

SEQ ID NO: 543994 - RNA, 22 nt, Human
cuuuauguuggggugucuuagu

SEQ ID NO: 543995 - RNA, 22 nt, Human
caacuauauagaaauugauugu

SEQ ID NO: 543996 - RNA, 22 nt, Human
uagcaaggcguggcacucaaau

SEQ ID NO: 543997 - RNA, 22 nt, Human
ucagagcucaugagcagagcca

SEQ ID NO: 543998 - RNA, 22 nt, Human
ccugcagaaaggguccccagga

SEQ ID NO: 543999 - RNA, 22 nt, Human
gacacagagauaggccuguguu

SEQ ID NO: 544000 - RNA, 22 nt, Human
uggggcagaguaggauuuuggc

SEQ ID NO: 544001 - RNA, 22 nt, Human
auauuugcaggaaacuaguuuu

SEQ ID NO: 544002 - RNA, 22 nt, Human
acacccaggcuggcgugcagug

SEQ ID NO: 544003 - RNA, 21 nt, Human
ugaaacaaucagacagagucu

SEQ ID NO: 544004 - RNA, 22 nt, Human
aaauacugugaauaaagguuuu

SEQ ID NO: 544005 - RNA, 22 nt, Human
ggagaagcagcuucuugaugaa

SEQ ID NO: 544006 - RNA, 22 nt, Human
gaaauuaagcaggggucugugg

SEQ ID NO: 544007 - RNA, 22 nt, Human
aagggacccuggaucaaaugga

SEQ ID NO: 544008 - RNA, 22 nt, Human
acagagguguguguaggacagu

SEQ ID NO: 544009 - RNA, 22 nt, Human
aaauccaguuugucauuuccca

SEQ ID NO: 544010 - RNA, 22 nt, Human
aaucauaauuuugugaauguag

SEQ ID NO: 544011 - RNA, 22 nt, Human
aggaaggagggcagauauuaag

SEQ ID NO: 544012 - RNA, 22 nt, Human
ggggagugguugccugugaucc

SEQ ID NO: 544013 - RNA, 22 nt, Human
guucacaucacuucacugaacc

SEQ ID NO: 544014 - RNA, 22 nt, Human
ucagaauucagagggagugggg

SEQ ID NO: 544015 - RNA, 22 nt, Human
ugcagcagguuccaaaggguua

SEQ ID NO: 544016 - RNA, 22 nt, Human
cuggaacagaagcacuggagag

SEQ ID NO: 544017 - RNA, 22 nt, Human
ugcagggccuuguugaugugcu

SEQ ID NO: 544018 - RNA, 22 nt, Human
uaagauaugguaggaaguuugg

SEQ ID NO: 544019 - RNA, 22 nt, Human
caaacuuuuccuggaaaagauu

SEQ ID NO: 544020 - RNA, 22 nt, Human
aucugcuugaaacuucuuauac

SEQ ID NO: 544021 - RNA, 22 nt, Human
ccagcagccaccuucucgaaau

SEQ ID NO: 544022 - RNA, 22 nt, Human
cagcugagucugagguucuuug

SEQ ID NO: 544023 - RNA, 22 nt, Human
aagaggaagucuccauggagag

SEQ ID NO: 544024 - RNA, 22 nt, Human
ggcagaggaaggaugaauucac

SEQ ID NO: 544025 - RNA, 22 nt, Human
aaguucuuguauuugccuuucu

SEQ ID NO: 544026 - RNA, 22 nt, Human
uucuccaggcuugggccagguc

SEQ ID NO: 544027 - RNA, 22 nt, Human
aagucugggccuccuucccaga

SEQ ID NO: 544028 - RNA, 20 nt, Human
aggcucaggguguuuaggaa

SEQ ID NO: 544029 - RNA, 22 nt, Human
ucuuucaaaugcuugaauugga

SEQ ID NO: 544030 - RNA, 22 nt, Human
cugucaggggcggguggagcgg

SEQ ID NO: 544031 - RNA, 22 nt, Human
guggcauuugaacaaucacaua

SEQ ID NO: 544032 - RNA, 22 nt, Human
aaacacuucuuaggucuuaagu

SEQ ID NO: 544033 - RNA, 22 nt, Human
cagcuuuauuucacguguuugu

SEQ ID NO: 544034 - RNA, 22 nt, Human
ugagcccaggaguuggaggcug

SEQ ID NO: 544035 - RNA, 22 nt, Human
aucuaaacuauaguaccuaguc

SEQ ID NO: 544036 - RNA, 22 nt, Human
gugcaggggaucagguugcagc

SEQ ID NO: 544037 - RNA, 22 nt, Human
agagccugugauugucaucacc

SEQ ID NO: 544038 - RNA, 19 nt, Human
aggguccagggagcggcuc

SEQ ID NO: 544039 - RNA, 22 nt, Human
gcacaggcacagagggccacug

SEQ ID NO: 544040 - RNA, 22 nt, Human
agcaaagcaucacuccaaucug

SEQ ID NO: 544041 - RNA, 18 nt, Human
accaggaagcuucuuguc

SEQ ID NO: 544042 - RNA, 22 nt, Human
agggucagcuggcugucagggg

SEQ ID NO: 544043 - RNA, 22 nt, Human
uccugggcccaggcugccaggg

SEQ ID NO: 544044 - RNA, 22 nt, Human
aggcugggaaauguagucuucc

SEQ ID NO: 544045 - RNA, 22 nt, Human
aauuucaaguggcaucuuugau

SEQ ID NO: 544046 - RNA, 22 nt, Human
ggggcaggagcccuucuucagc

SEQ ID NO: 544047 - RNA, 22 nt, Human
aaaguucugagaagcaguuuac

SEQ ID NO: 544048 - RNA, 22 nt, Human
uaagaaauuuaguuauagaaug

SEQ ID NO: 544049 - RNA, 21 nt, Human
uccagaccucccucuccuagc

SEQ ID NO: 544050 - RNA, 22 nt, Human
aggugucuuugcggcccgccgc

SEQ ID NO: 544051 - RNA, 22 nt, Human
ucaagcaucuuggucuacgauc

SEQ ID NO: 544052 - RNA, 22 nt, Human
gcucugucaacagcuagcugug

SEQ ID NO: 544053 - RNA, 18 nt, Human
cagaagcaggcagugcag

SEQ ID NO: 544054 - RNA, 22 nt, Human
uauggaaauaauuagacaagug

SEQ ID NO: 544055 - RNA, 22 nt, Human
aagacaugcaauuagcaaggaa

SEQ ID NO: 544056 - RNA, 22 nt, Human
ccugccugguguaagucuaagg

SEQ ID NO: 544057 - RNA, 22 nt, Human
gagcaggaugggagcuggggcc

SEQ ID NO: 544058 - RNA, 23 nt, Human
gugauuucagggaacagaaucag

SEQ ID NO: 544059 - RNA, 22 nt, Human
uggggacagggcucagcaauuu

SEQ ID NO: 544060 - RNA, 22 nt, Human
cauuuauugaguggccacagug

SEQ ID NO: 544061 - RNA, 22 nt, Human
agcccggcuuccccgguugcua

SEQ ID NO: 544062 - RNA, 18 nt, Human
ucuuccaacacugacacc

SEQ ID NO: 544063 - RNA, 19 nt, Human
guuuuucccagacgaggca

SEQ ID NO: 544064 - RNA, 20 nt, Human
agucccagaucaaauuucug

SEQ ID NO: 544065 - RNA, 19 nt, Human
uaaggccaaaaguaagugu

SEQ ID NO: 544066 - RNA, 22 nt, Human
ugggccugggagggcagacgcu

SEQ ID NO: 544067 - RNA, 22 nt, Human
ucaguggauuguagaaggcuua

SEQ ID NO: 544068 - RNA, 22 nt, Human
aggucaagaauugaugugguuu

SEQ ID NO: 544069 - RNA, 22 nt, Human
ugucucaguauacgaaacacuu

SEQ ID NO: 544070 - RNA, 20 nt, Human
auucacaggcacaaaacccu

SEQ ID NO: 544071 - RNA, 22 nt, Human
uuaaaaucgcuguugcuucugu

SEQ ID NO: 544072 - RNA, 22 nt, Human
ugcugccuuugggaccuggccu

SEQ ID NO: 544073 - RNA, 22 nt, Human
uugaaauacugcauuguucagu

SEQ ID NO: 544074 - RNA, 22 nt, Human
ucuguaaauccugcucagcaac

SEQ ID NO: 544075 - RNA, 22 nt, Human
ggcccaaggcccaggucgagcu

SEQ ID NO: 544076 - RNA, 22 nt, Human
gaauguuugacuaaagguagcu

SEQ ID NO: 544077 - RNA, 22 nt, Human
augaacacauguacacauuucu

SEQ ID NO: 544078 - RNA, 22 nt, Human
aggcucaguauagcuggcaagu

SEQ ID NO: 544079 - RNA, 20 nt, Human
aggcugccaggucucacauc

SEQ ID NO: 544080 - RNA, 22 nt, Human
gaaggaagccguuucucuccag

SEQ ID NO: 544081 - RNA, 22 nt, Human
gcaauuauuuuugcaccaaugu

SEQ ID NO: 544082 - RNA, 22 nt, Human
ccagcccuccuccaucagagga

SEQ ID NO: 544083 - RNA, 22 nt, Human
gcagccacucucauuccacgug

SEQ ID NO: 544084 - RNA, 22 nt, Human
ucacacaugcuaagccagagau

SEQ ID NO: 544085 - RNA, 22 nt, Human
agcugcugagccauguccugcu

SEQ ID NO: 544086 - RNA, 22 nt, Human
aaaauccuuagccgagugaggu

SEQ ID NO: 544087 - RNA, 22 nt, Human
acucugcuuauugcugcaggca

SEQ ID NO: 544088 - RNA, 18 nt, Human
acagugauuguucuaugc

SEQ ID NO: 544089 - RNA, 22 nt, Human
ggugaagggccuuaggagacag

SEQ ID NO: 544090 - RNA, 22 nt, Human
gggucccuggaauuacuugaca

SEQ ID NO: 544091 - RNA, 22 nt, Human
uaguuuuuucaacaaauggugc

SEQ ID NO: 544092 - RNA, 22 nt, Human
cagugcagaggccagggaggau

SEQ ID NO: 544093 - RNA, 22 nt, Human
ccagagcaauucucacagaacu

SEQ ID NO: 544094 - RNA, 22 nt, Human
uuuaaaaucagaugggaguugg

SEQ ID NO: 544095 - RNA, 21 nt, Human
gggcagaggggccuccugggu

SEQ ID NO: 544096 - RNA, 20 nt, Human
ccagcauguacacaugugga

SEQ ID NO: 544097 - RNA, 22 nt, Human
agcugccauggccugaauuuac

SEQ ID NO: 544098 - RNA, 21 nt, Human
ucagcuuugcaacugcacauc

SEQ ID NO: 544099 - RNA, 22 nt, Human
auuauucaacacuugagaaauu

SEQ ID NO: 544100 - RNA, 22 nt, Human
acuuuauuuccuauugcaucca

SEQ ID NO: 544101 - RNA, 22 nt, Human
ccagugcacagccaggcaggug

SEQ ID NO: 544102 - RNA, 22 nt, Human
uauuugcaggacauagauaugg

SEQ ID NO: 544103 - RNA, 22 nt, Human
ccccagccagcaggaccucuga

SEQ ID NO: 544104 - RNA, 22 nt, Human
aauguuucauuuaguugucucc

SEQ ID NO: 544105 - RNA, 22 nt, Human
aucaagaauugggagcuauuga

SEQ ID NO: 544106 - RNA, 18 nt, Human
gguccugaaugccugcua

SEQ ID NO: 544107 - RNA, 22 nt, Human
auacagaaaaugaugcagaguu

SEQ ID NO: 544108 - RNA, 21 nt, Human
ucuuccaagggcugcugagac

SEQ ID NO: 544109 - RNA, 22 nt, Human
auucaguucuaaggucagugcc

SEQ ID NO: 544110 - RNA, 21 nt, Human
ugcuuuaugggaaaaauguca

SEQ ID NO: 544111 - RNA, 22 nt, Human
cccuggcagaaugucucugggc

SEQ ID NO: 544112 - RNA, 22 nt, Human
aggucacauggauaaugaucag

SEQ ID NO: 544113 - RNA, 22 nt, Human
caagagcucuccacuagguugg

SEQ ID NO: 544114 - RNA, 19 nt, Human
guucaaacacugauucagc

SEQ ID NO: 544115 - RNA, 22 nt, Human
ugccugggccuucccaccucug

SEQ ID NO: 544116 - RNA, 22 nt, Human
acagaugguuauugucauuucu

SEQ ID NO: 544117 - RNA, 22 nt, Human
ucccagagucagagguggggcc

SEQ ID NO: 544118 - RNA, 22 nt, Human
cagggcuccaugcagggacucc

SEQ ID NO: 544119 - RNA, 18 nt, Human
ugucucaggcugaaacag

SEQ ID NO: 544120 - RNA, 22 nt, Human
auaugccauuagcuagaaauaa

SEQ ID NO: 544121 - RNA, 22 nt, Human
uggagcuggaauuucugggccu

SEQ ID NO: 544122 - RNA, 22 nt, Human
cagccucuugcacuuugaaggc

SEQ ID NO: 544123 - RNA, 22 nt, Human
cuuucacauaauugaccuugaa

SEQ ID NO: 544124 - RNA, 22 nt, Human
cacuuagucucaccaguucagu

SEQ ID NO: 544125 - RNA, 22 nt, Human
gggcugcacguauucugcucac

SEQ ID NO: 544126 - RNA, 22 nt, Human
gggcucuggaaaugggagcucc

SEQ ID NO: 544127 - RNA, 22 nt, Human
ggagccagugcccucuggugga

SEQ ID NO: 544128 - RNA, 22 nt, Human
ggagcauguggggugagcaggg

SEQ ID NO: 544129 - RNA, 22 nt, Human
uuucagagaggcuucaaaucuu

SEQ ID NO: 544130 - RNA, 22 nt, Human
guccucugggcuuugagcaguc

SEQ ID NO: 544131 - RNA, 22 nt, Human
uucaaucauuuuuacauagucc

SEQ ID NO: 544132 - RNA, 22 nt, Human
aguaugaagaauacauagauga

SEQ ID NO: 544133 - RNA, 22 nt, Human
cuggccgguauuugccucuggg

SEQ ID NO: 544134 - RNA, 22 nt, Human
uuuguaacuuuagaauugaucc

SEQ ID NO: 544135 - RNA, 22 nt, Human
agcaguuuggaaaauacuagaa

SEQ ID NO: 544136 - RNA, 22 nt, Human
ucaggggacuuaggagagaagu

SEQ ID NO: 544137 - RNA, 22 nt, Human
ccagccaggcauugcaaacuga

SEQ ID NO: 544138 - RNA, 22 nt, Human
caaggagaguaauugaaugaga

SEQ ID NO: 544139 - RNA, 22 nt, Human
gguggagcuguggacaggaagg

SEQ ID NO: 544140 - RNA, 22 nt, Human
ucacuccucauugcugcccauu

SEQ ID NO: 544141 - RNA, 22 nt, Human
caggccugcaggaaaggcuccc

SEQ ID NO: 544142 - RNA, 22 nt, Human
gagggguccaggaggcacuuac

SEQ ID NO: 544143 - RNA, 22 nt, Human
cugggccuucauugcucuccca

SEQ ID NO: 544144 - RNA, 22 nt, Human
uuacuucuuacaaaagaaauau

SEQ ID NO: 544145 - RNA, 22 nt, Human
uucaggauucucucccauuuac

SEQ ID NO: 544146 - RNA, 21 nt, Human
gcucucugcaugguggcucag

SEQ ID NO: 544147 - RNA, 22 nt, Human
uggcugcugcuuggucuucuuc

SEQ ID NO: 544148 - RNA, 22 nt, Human
gcaggcuggucugaccaucccu

SEQ ID NO: 544149 - RNA, 22 nt, Human
ugucuguaagguguuuauguua

SEQ ID NO: 544150 - RNA, 22 nt, Human
uuagcugcauuaucaaaguuau

SEQ ID NO: 544151 - RNA, 22 nt, Human
ccaguguucauaauuuuacacu

SEQ ID NO: 544152 - RNA, 22 nt, Human
agggcugcuccuccuucaggcc

SEQ ID NO: 544153 - RNA, 22 nt, Human
acaaaagugagugugucucaga

SEQ ID NO: 544154 - RNA, 22 nt, Human
ccagcaggguugguuucuucug

SEQ ID NO: 544155 - RNA, 22 nt, Human
aauuagaagcuguuagcaaaau

SEQ ID NO: 544156 - RNA, 22 nt, Human
cuuccaaagcacuuuauggacc

SEQ ID NO: 544157 - RNA, 22 nt, Human
aggugcuggaguagaagaaaaa

SEQ ID NO: 544158 - RNA, 22 nt, Human
gggcccugccuaaggaacacac

SEQ ID NO: 544159 - RNA, 22 nt, Human
aauaauuauuugagagcagacc

SEQ ID NO: 544160 - RNA, 22 nt, Human
ucaacacuaaagaauaaucuuu

SEQ ID NO: 544161 - RNA, 22 nt, Human
aaguccagcucuaaauaucuga

SEQ ID NO: 544162 - RNA, 23 nt, Human
acugaaaggauccuagcagagac

SEQ ID NO: 544163 - RNA, 22 nt, Human
gcccaugguuacuuuucuggcu

SEQ ID NO: 544164 - RNA, 22 nt, Human
gcaaauaauauacuuugaucuc

SEQ ID NO: 544165 - RNA, 22 nt, Human
agcagaggacaguucuuaggaa

SEQ ID NO: 544166 - RNA, 21 nt, Human
aagaggaagcauuauggcaua

SEQ ID NO: 544167 - RNA, 22 nt, Human
ccacacuaaacugcucaaacca

SEQ ID NO: 544168 - RNA, 22 nt, Human
gcauuuuagaauauuggagcaa

SEQ ID NO: 544169 - RNA, 19 nt, Human
ugaagcaauaccauuuuug

SEQ ID NO: 544170 - RNA, 22 nt, Human
cccucugcugccuggcuggguc

SEQ ID NO: 544171 - RNA, 22 nt, Human
augaggcagguggaggcugcca

SEQ ID NO: 544172 - RNA, 22 nt, Human
uuugacauuggcuuauucuguu

SEQ ID NO: 544173 - RNA, 22 nt, Human
acaucacagagcccagauaaag

SEQ ID NO: 544174 - RNA, 22 nt, Human
ugaaggagcucaaugaugaugc

SEQ ID NO: 544175 - RNA, 22 nt, Human
ucaguggaguauggaugaaguc

SEQ ID NO: 544176 - RNA, 22 nt, Human
gggcuucucccuaaggacucug

SEQ ID NO: 544177 - RNA, 22 nt, Human
ccacaucauggauacaguuaug

SEQ ID NO: 544178 - RNA, 22 nt, Human
uagucuuuugagaaguauaucu

SEQ ID NO: 544179 - RNA, 22 nt, Human
aacaguguguuuuguuauuaag

SEQ ID NO: 544180 - RNA, 19 nt, Human
gcucagagggcccugugcu

SEQ ID NO: 544181 - RNA, 22 nt, Human
ccuggagcacauggcaggaggc

SEQ ID NO: 544182 - RNA, 22 nt, Human
cacagcugaaguagccaugugg

SEQ ID NO: 544183 - RNA, 22 nt, Human
uaugaagauauaucugaucucu

SEQ ID NO: 544184 - RNA, 23 nt, Human
gagggcucugagugcuugggcca

SEQ ID NO: 544185 - RNA, 22 nt, Human
ggaggagggguuuacauuggaa

SEQ ID NO: 544186 - RNA, 22 nt, Human
ggaagccaggccaaugagaaca

SEQ ID NO: 544187 - RNA, 22 nt, Human
agcuggggguuggauaagggua

SEQ ID NO: 544188 - RNA, 22 nt, Human
ugugugcagccucugucuuugg

SEQ ID NO: 544189 - RNA, 22 nt, Human
aaaugcacaauaaaguaaaggc

SEQ ID NO: 544190 - RNA, 22 nt, Human
ggcugugaacccuggcagugug

SEQ ID NO: 544191 - RNA, 22 nt, Human
agcaccaucagaugcaauaucu

SEQ ID NO: 544192 - RNA, 22 nt, Human
ucaggagucugugcaguuccac

SEQ ID NO: 544193 - RNA, 22 nt, Human
agcagcugccagagagaguucc

SEQ ID NO: 544194 - RNA, 22 nt, Human
uggcagggaauacagauguuua

SEQ ID NO: 544195 - RNA, 22 nt, Human
gagaaagauggaaucuuacagg

SEQ ID NO: 544196 - RNA, 22 nt, Human
gugccugccccacuccucagca

SEQ ID NO: 544197 - RNA, 22 nt, Human
ggucacugcucuaaacaaaagu

SEQ ID NO: 544198 - RNA, 22 nt, Human
acaaauauuuacugaauccacu

SEQ ID NO: 544199 - RNA, 22 nt, Human
ucaggagagaaagaauacaauu

SEQ ID NO: 544200 - RNA, 22 nt, Human
cagagagaaucuuggcagcuga

SEQ ID NO: 544201 - RNA, 22 nt, Human
uccucuggggucagggcacuac

SEQ ID NO: 544202 - RNA, 22 nt, Human
cccagguggcagaagcugcagu

SEQ ID NO: 544203 - RNA, 22 nt, Human
caggaggaaaugugacccugcu

SEQ ID NO: 544204 - RNA, 22 nt, Human
guuuuauaggugaaauauuacu

SEQ ID NO: 544205 - RNA, 18 nt, Human
cguuuuuccgggauugca

SEQ ID NO: 544206 - RNA, 22 nt, Human
uacuuuuugucucuuugaaugu

SEQ ID NO: 544207 - RNA, 22 nt, Human
ugagcccuaagggucaagcagg

SEQ ID NO: 544208 - RNA, 22 nt, Human
ucccuggcugggggcugccuug

SEQ ID NO: 544209 - RNA, 22 nt, Human
uuccauauuuguguggcaaaag

SEQ ID NO: 544210 - RNA, 22 nt, Human
accagguggccccagcgugguu

SEQ ID NO: 544211 - RNA, 19 nt, Human
gcugggagcagacccuccc

SEQ ID NO: 544212 - RNA, 20 nt, Human
agacaaaaugacuucaugca

SEQ ID NO: 544213 - RNA, 22 nt, Human
uagggcaggugaagaaaagcua

SEQ ID NO: 544214 - RNA, 22 nt, Human
aauguguuaguauugauuuguc

SEQ ID NO: 544215 - RNA, 22 nt, Human
auugcuuuuccuuaacacaugc

SEQ ID NO: 544216 - RNA, 22 nt, Human
ccugggaaguuguggcugcagu

SEQ ID NO: 544217 - RNA, 22 nt, Human
ucagggagaggugagagccugu

SEQ ID NO: 544218 - RNA, 22 nt, Human
ccagagggccuuuggaguuauc

SEQ ID NO: 544219 - RNA, 22 nt, Human
acuggacagaggaaauauggag

SEQ ID NO: 544220 - RNA, 22 nt, Human
ggcaucaggguaggaagguauc

SEQ ID NO: 544221 - RNA, 22 nt, Human
acccugccugacaacagaggau

SEQ ID NO: 544222 - RNA, 22 nt, Human
uuaaauuuuagaaacagacucu

SEQ ID NO: 544223 - RNA, 22 nt, Human
ugcagcuguaacagaggccuca

SEQ ID NO: 544224 - RNA, 22 nt, Human
gagggcugauaacaggaauaca

SEQ ID NO: 544225 - RNA, 22 nt, Human
uccuucaguuaaagaucucaca

SEQ ID NO: 544226 - RNA, 22 nt, Human
auacaugaggcucauuuauguc

SEQ ID NO: 544227 - RNA, 21 nt, Human
ucaaagcacauauuugcacau

SEQ ID NO: 544228 - RNA, 22 nt, Human
gcuguggaugcuauggaucauc

SEQ ID NO: 544229 - RNA, 22 nt, Human
aaggcacuguacuaguuaguua

SEQ ID NO: 544230 - RNA, 22 nt, Human
uuauuagguuuacauaaagguu

SEQ ID NO: 544231 - RNA, 22 nt, Human
ugcuuccacuaaugagcugugu

SEQ ID NO: 544232 - RNA, 22 nt, Human
cagucccaaggaggaagcaguc

SEQ ID NO: 544233 - RNA, 22 nt, Human
cagagacauuaagugccaugau

SEQ ID NO: 544234 - RNA, 22 nt, Human
aauuagggagagguagcuaggu

SEQ ID NO: 544235 - RNA, 22 nt, Human
gggcucuggaaggugcaccaug

SEQ ID NO: 544236 - RNA, 22 nt, Human
uucuggaggccccuuccuucuc

SEQ ID NO: 544237 - RNA, 22 nt, Human
agcagcucuggcacuguagcau

SEQ ID NO: 544238 - RNA, 22 nt, Human
caugucuuauauccugucuuca

SEQ ID NO: 544239 - RNA, 22 nt, Human
ggcugccugccuccaagccggg

SEQ ID NO: 544240 - RNA, 22 nt, Human
uggcagagagagugcagucgac

SEQ ID NO: 544241 - RNA, 22 nt, Human
aguacaauuuaaugaagauagc

SEQ ID NO: 544242 - RNA, 22 nt, Human
cccaagaucuuucgugcacuaa

SEQ ID NO: 544243 - RNA, 22 nt, Human
aagcagugcgcucaucuaaggg

SEQ ID NO: 544244 - RNA, 22 nt, Human
acaaagguggaccauguggcuu

SEQ ID NO: 544245 - RNA, 17 nt, Human
gggcagggacuccuggg

SEQ ID NO: 544246 - RNA, 22 nt, Human
aaucagaaaggcuaaggaagca

SEQ ID NO: 544247 - RNA, 22 nt, Human
uuauuuguaaagguccauagua

SEQ ID NO: 544248 - RNA, 22 nt, Human
aggugagugugacugcaagaga

SEQ ID NO: 544249 - RNA, 22 nt, Human
acugaaggaaagccuuugcaug

SEQ ID NO: 544250 - RNA, 22 nt, Human
ugcauuauuugcaugugccugu

SEQ ID NO: 544251 - RNA, 22 nt, Human
acagagcaacuuuauuucaugg

SEQ ID NO: 544252 - RNA, 22 nt, Human
cuguuacacggaccuucaaauc

SEQ ID NO: 544253 - RNA, 22 nt, Human
cugaagcaaaggaucgagcuaa

SEQ ID NO: 544254 - RNA, 22 nt, Human
uccucaggaucuaggagugcuu

SEQ ID NO: 544255 - RNA, 23 nt, Human
uccuccuggauacaaagggaaca

SEQ ID NO: 544256 - RNA, 22 nt, Human
uccugccucuccaugcuaacua

SEQ ID NO: 544257 - RNA, 22 nt, Human
ggaaaaauagaguauacuuuaa

SEQ ID NO: 544258 - RNA, 22 nt, Human
gaaaacuaacggaaaaguuagg

SEQ ID NO: 544259 - RNA, 22 nt, Human
uggaagaugaauaaagauucua

SEQ ID NO: 544260 - RNA, 20 nt, Human
aaauuacugccacacauuuc

SEQ ID NO: 544261 - RNA, 22 nt, Human
uuucuaaggaaaguaccuggga

SEQ ID NO: 544262 - RNA, 22 nt, Human
augcucuggaguacgugaaauu

SEQ ID NO: 544263 - RNA, 23 nt, Human
cagcaggagggugccugggcugc

SEQ ID NO: 544264 - RNA, 22 nt, Human
uuugucuuggccucaguuuucu

SEQ ID NO: 544265 - RNA, 22 nt, Human
cuguggaccugcucuuagagac

SEQ ID NO: 544266 - RNA, 22 nt, Human
ugcagggccgcuggaggucaug

SEQ ID NO: 544267 - RNA, 22 nt, Human
uugcuuuacuuugccauucguu

SEQ ID NO: 544268 - RNA, 22 nt, Human
caggaaaaucugcccacacaag

SEQ ID NO: 544269 - RNA, 22 nt, Human
augcaguagauaggcacuuuua

SEQ ID NO: 544270 - RNA, 22 nt, Human
acaguaccugcucucaagcaaa

SEQ ID NO: 544271 - RNA, 22 nt, Human
aacuuuuucugggauggagggu

SEQ ID NO: 544272 - RNA, 22 nt, Human
cacaggcugcccgcagcuggga

SEQ ID NO: 544273 - RNA, 22 nt, Human
uacacauuacauaauacuaucu

SEQ ID NO: 544274 - RNA, 22 nt, Human
augcacaagguagauuauuauu

SEQ ID NO: 544275 - RNA, 22 nt, Human
cauccaauaccaguuugcaggc

SEQ ID NO: 544276 - RNA, 22 nt, Human
ugaagguggcauaggagagaug

SEQ ID NO: 544277 - RNA, 22 nt, Human
caggcugccaaggcuggggagg

SEQ ID NO: 544278 - RNA, 22 nt, Human
ugagcauggugggugcagagca

SEQ ID NO: 544279 - RNA, 22 nt, Human
acacauuuagcaccagguuuau

SEQ ID NO: 544280 - RNA, 22 nt, Human
agacaugucaccaauucuuacu

SEQ ID NO: 544281 - RNA, 22 nt, Human
ggaccaggccagccucccugcg

SEQ ID NO: 544282 - RNA, 22 nt, Human
auacacaucuauuuaagagaca

SEQ ID NO: 544283 - RNA, 22 nt, Human
uauuuguugaguuguuaugucu

SEQ ID NO: 544284 - RNA, 22 nt, Human
agaggcacccaguuaagcugca

SEQ ID NO: 544285 - RNA, 22 nt, Human
auguuuguagguaagugacacu

SEQ ID NO: 544286 - RNA, 22 nt, Human
ccaggguguagggauuccagau

SEQ ID NO: 544287 - RNA, 22 nt, Human
gggggaagacugggcuagugau

SEQ ID NO: 544288 - RNA, 18 nt, Human
uucacaggaaaugucuuu

SEQ ID NO: 544289 - RNA, 22 nt, Human
uaacaaaguaccauagauuggg

SEQ ID NO: 544290 - RNA, 22 nt, Human
ucuguggauuuuaguguucaug

SEQ ID NO: 544291 - RNA, 22 nt, Human
cuggguggcgucuggggccagu

SEQ ID NO: 544292 - RNA, 22 nt, Human
aaagagacugguggcauuuugc

SEQ ID NO: 544293 - RNA, 22 nt, Human
ugcuucuggcacuugagggggu

SEQ ID NO: 544294 - RNA, 22 nt, Human
ggaggggaggauuaaugacaaa

SEQ ID NO: 544295 - RNA, 22 nt, Human
cagugcaguuucccagaugcug

SEQ ID NO: 544296 - RNA, 22 nt, Human
gggcccagcgugguuccaucug

SEQ ID NO: 544297 - RNA, 22 nt, Human
acauuucucauucuccccuaac

SEQ ID NO: 544298 - RNA, 22 nt, Human
uuugccaggcuugcaugaauuu

SEQ ID NO: 544299 - RNA, 22 nt, Human
acacacuucacccuugagcuaa

SEQ ID NO: 544300 - RNA, 22 nt, Human
guguccacggcugagaaugauu

SEQ ID NO: 544301 - RNA, 22 nt, Human
auuacacagcgguuacuacuag

SEQ ID NO: 544302 - RNA, 22 nt, Human
cugugggcauuugagugugggu

SEQ ID NO: 544303 - RNA, 22 nt, Human
uuugcuuucuguugaacagagu

SEQ ID NO: 544304 - RNA, 22 nt, Human
uggagcugggaguccugggcug

SEQ ID NO: 544305 - RNA, 22 nt, Human
cauguguaugcauucauacaua

SEQ ID NO: 544306 - RNA, 19 nt, Human
ucuggagcugaugcaggug

SEQ ID NO: 544307 - RNA, 22 nt, Human
gaaagggcaugggcaugacaac

SEQ ID NO: 544308 - RNA, 22 nt, Human
gccaggcuggugucacaacucu

SEQ ID NO: 544309 - RNA, 22 nt, Human
uuuaauugcauuuaaagaugga

SEQ ID NO: 544310 - RNA, 22 nt, Human
acaagaauguagauuaguuaag

SEQ ID NO: 544311 - RNA, 22 nt, Human
cugaugcuauaagccacagugg

SEQ ID NO: 544312 - RNA, 22 nt, Human
cacccagcuuuugcauccuccg

SEQ ID NO: 544313 - RNA, 20 nt, Human
uguauauuuucugguguaaa

SEQ ID NO: 544314 - RNA, 22 nt, Human
gaaguucaggugggaauugagc

SEQ ID NO: 544315 - RNA, 22 nt, Human
uggggcuguccuuagucugaga

SEQ ID NO: 544316 - RNA, 22 nt, Human
cugaaggacacgugaggagcca

SEQ ID NO: 544317 - RNA, 22 nt, Human
auuguuaugaaaauaagauguu

SEQ ID NO: 544318 - RNA, 22 nt, Human
agggcagcuagcuguagaaaga

SEQ ID NO: 544319 - RNA, 20 nt, Human
gcauccagacacccagcugc

SEQ ID NO: 544320 - RNA, 22 nt, Human
uuguuuccuuucuauacaggau

SEQ ID NO: 544321 - RNA, 22 nt, Human
aguucuagaagacuuuuccauu

SEQ ID NO: 544322 - RNA, 22 nt, Human
acagauugaucuugagaauuau

SEQ ID NO: 544323 - RNA, 19 nt, Human
ggcuucaguuuagcaggcu

SEQ ID NO: 544324 - RNA, 22 nt, Human
ugacaacucuaguuaaugaauu

SEQ ID NO: 544325 - RNA, 19 nt, Human
uuagccauccacagugaaa

SEQ ID NO: 544326 - RNA, 22 nt, Human
gagguuggugaggggacacggu

SEQ ID NO: 544327 - RNA, 21 nt, Human
agcagagugcuuugacuuugu

SEQ ID NO: 544328 - RNA, 22 nt, Human
gcucuucauucucccaaauagg

SEQ ID NO: 544329 - RNA, 22 nt, Human
uggagguggcaucugacagcug

SEQ ID NO: 544330 - RNA, 22 nt, Human
cacauguacagaagcaggcugg

SEQ ID NO: 544331 - RNA, 22 nt, Human
ucucugauguauaucagagaac

SEQ ID NO: 544332 - RNA, 22 nt, Human
ugcugcacaauuggaaaguauc

SEQ ID NO: 544333 - RNA, 22 nt, Human
ugccaggcauguaguagacuug

SEQ ID NO: 544334 - RNA, 22 nt, Human
cagagcugguaagugguagagg

SEQ ID NO: 544335 - RNA, 22 nt, Human
agaggucuuuuggucugcagaa

SEQ ID NO: 544336 - RNA, 22 nt, Human
ggcacucagagauucaggcugu

SEQ ID NO: 544337 - RNA, 22 nt, Human
gcagggacaccuuugugaagcu

SEQ ID NO: 544338 - RNA, 22 nt, Human
cacagugaagcaugcagacauc

SEQ ID NO: 544339 - RNA, 22 nt, Human
ucacaguaaauccagaagaaau

SEQ ID NO: 544340 - RNA, 22 nt, Human
uaacugaauguauuacaacaga

SEQ ID NO: 544341 - RNA, 22 nt, Human
uaggaagcacuuaaagaauuug

SEQ ID NO: 544342 - RNA, 17 nt, Human
uagcugccccgaaugcu

SEQ ID NO: 544343 - RNA, 22 nt, Human
ucuuacauauagcaugaguaca

SEQ ID NO: 544344 - RNA, 22 nt, Human
agcugguuagcaaucuaaguga

SEQ ID NO: 544345 - RNA, 22 nt, Human
cuggccugagcacagcggcugc

SEQ ID NO: 544346 - RNA, 22 nt, Human
gggcccugaucugugagcgcag

SEQ ID NO: 544347 - RNA, 20 nt, Human
agugugcauuuagagucugc

SEQ ID NO: 544348 - RNA, 22 nt, Human
agggcagcugugagccacugug

SEQ ID NO: 544349 - RNA, 22 nt, Human
augaacuaagagucauuagugu

SEQ ID NO: 544350 - RNA, 22 nt, Human
aaauucucuaaagaaaacauga

SEQ ID NO: 544351 - RNA, 22 nt, Human
uggcucagcugacucggcuucu

SEQ ID NO: 544352 - RNA, 22 nt, Human
gccugggaacucugaucuccug

SEQ ID NO: 544353 - RNA, 22 nt, Human
gcagggguuuucugacuugagu

SEQ ID NO: 544354 - RNA, 22 nt, Human
gcuauacaaguguagaauagag

SEQ ID NO: 544355 - RNA, 22 nt, Human
aauauucauuugcagaagaagu

SEQ ID NO: 544356 - RNA, 22 nt, Human
gggugggaacaggaugccagga

SEQ ID NO: 544357 - RNA, 22 nt, Human
uaguuuuuaaguguacaauuuc

SEQ ID NO: 544358 - RNA, 20 nt, Human
aagcuggguaggagaggagc

SEQ ID NO: 544359 - RNA, 22 nt, Human
ccaggaaccgaugaucagaggg

SEQ ID NO: 544360 - RNA, 22 nt, Human
ucacacacauaaucuaagauua

SEQ ID NO: 544361 - RNA, 17 nt, Human
cugaagauaauggcaac

SEQ ID NO: 544362 - RNA, 22 nt, Human
caugggagguuggcuuggcaug

SEQ ID NO: 544363 - RNA, 22 nt, Human
uucuuauugggagaccuuuucu

SEQ ID NO: 544364 - RNA, 22 nt, Human
ggaggcucccacgcagcucaca

SEQ ID NO: 544365 - RNA, 22 nt, Human
auccaggguguggagagagcuc

SEQ ID NO: 544366 - RNA, 22 nt, Human
uaacagaagagcaggcagcccu

SEQ ID NO: 544367 - RNA, 22 nt, Human
agcaugaagacuucagagcuag

SEQ ID NO: 544368 - RNA, 22 nt, Human
uuuguaaaggccugaauuucag

SEQ ID NO: 544369 - RNA, 22 nt, Human
ggaaagggcagaggccuuggag

SEQ ID NO: 544370 - RNA, 19 nt, Human
acauagcuggcuacacugu

SEQ ID NO: 544371 - RNA, 22 nt, Human
gccugcagccccucugcaguag

SEQ ID NO: 544372 - RNA, 22 nt, Human
agaaacauuuagauuauauguc

SEQ ID NO: 544373 - RNA, 22 nt, Human
gaaagaggaaggagauguauua

SEQ ID NO: 544374 - RNA, 22 nt, Human
aaaguuugagugauuugacaca

SEQ ID NO: 544375 - RNA, 22 nt, Human
cacucugagaaguacaagcucc

SEQ ID NO: 544376 - RNA, 22 nt, Human
aaagaacuaaugugcaagguuu

SEQ ID NO: 544377 - RNA, 22 nt, Human
uggguagagacacagucugggg

SEQ ID NO: 544378 - RNA, 22 nt, Human
cugagccagcuggcaugugcua

SEQ ID NO: 544379 - RNA, 22 nt, Human
gagggcuccacacgggcccagc

SEQ ID NO: 544380 - RNA, 22 nt, Human
aggcucaggugccucauucaca

SEQ ID NO: 544381 - RNA, 22 nt, Human
caggccugaguguggaagucuu

SEQ ID NO: 544382 - RNA, 22 nt, Human
uccagggacacagaguccuucu

SEQ ID NO: 544383 - RNA, 22 nt, Human
ucuagcauuucuuuccugagga

SEQ ID NO: 544384 - RNA, 22 nt, Human
uauucccagccucuuucuaucu

SEQ ID NO: 544385 - RNA, 22 nt, Human
acagagauggcacagagaaggu

SEQ ID NO: 544386 - RNA, 22 nt, Human
uaauacaucauucaucuaagga

SEQ ID NO: 544387 - RNA, 22 nt, Human
guuauuuucauuggcucagacu

SEQ ID NO: 544388 - RNA, 22 nt, Human
caccagcagaagacugagggug

SEQ ID NO: 544389 - RNA, 22 nt, Human
aggacagcauaugggaaccagu

SEQ ID NO: 544390 - RNA, 22 nt, Human
gcagcugggccccagccucucc

SEQ ID NO: 544391 - RNA, 22 nt, Human
uagagcauuuagaggggcagga

SEQ ID NO: 544392 - RNA, 22 nt, Human
cccagcuaccucugcuaggaga

SEQ ID NO: 544393 - RNA, 22 nt, Human
caggcugucugaauggaggccc

SEQ ID NO: 544394 - RNA, 22 nt, Human
auguuaaaugguuuauuauuaa

SEQ ID NO: 544395 - RNA, 22 nt, Human
cugagaguucguuccacccucc

SEQ ID NO: 544396 - RNA, 22 nt, Human
uaugagauaauagauguguaaa

SEQ ID NO: 544397 - RNA, 22 nt, Human
agagccuggaccugagcuacaa

SEQ ID NO: 544398 - RNA, 22 nt, Human
cucagagcccaggguacacccg

SEQ ID NO: 544399 - RNA, 22 nt, Human
ccugaagggacuccagagagca

SEQ ID NO: 544400 - RNA, 22 nt, Human
acagggcagagugaaaugcuau

SEQ ID NO: 544401 - RNA, 22 nt, Human
ucauucuuuaccaaguugucac

SEQ ID NO: 544402 - RNA, 22 nt, Human
gcaggguccauggaggcagccc

SEQ ID NO: 544403 - RNA, 22 nt, Human
ugaaggaagaauaggcaguguu

SEQ ID NO: 544404 - RNA, 22 nt, Human
gaaggcugaguggguacggagg

SEQ ID NO: 544405 - RNA, 22 nt, Human
aggaagagcaucuuugggucug

SEQ ID NO: 544406 - RNA, 22 nt, Human
acacagaguauuuagaaggggu

SEQ ID NO: 544407 - RNA, 22 nt, Human
ggaccaaaugcuuuuuaauuga

SEQ ID NO: 544408 - RNA, 22 nt, Human
cugcagguuuauuuucuuaccu

SEQ ID NO: 544409 - RNA, 22 nt, Human
agggcuccaggggcugggugac

SEQ ID NO: 544410 - RNA, 22 nt, Human
cugcuuuguaaaauagacauaa

SEQ ID NO: 544411 - RNA, 22 nt, Human
uuugauaucuugguauacagau

SEQ ID NO: 544412 - RNA, 22 nt, Human
ucauggagacuuugagccuguu

SEQ ID NO: 544413 - RNA, 22 nt, Human
gcuggcauuacaggagagaacc

SEQ ID NO: 544414 - RNA, 22 nt, Human
acugggaagauggaggcaagca

SEQ ID NO: 544415 - RNA, 22 nt, Human
uaggaaagcaguagagccagga

SEQ ID NO: 544416 - RNA, 22 nt, Human
uggcaggauuugcccggaagga

SEQ ID NO: 544417 - RNA, 22 nt, Human
agugcugucuccuucccccggg

SEQ ID NO: 544418 - RNA, 22 nt, Human
uugaucagguugcuguggugua

SEQ ID NO: 544419 - RNA, 22 nt, Human
auucaaguacaguuuucuucuu

SEQ ID NO: 544420 - RNA, 21 nt, Human
cugaggcaugcaggccugggc

SEQ ID NO: 544421 - RNA, 22 nt, Human
uggaggaaguggacaguugugu

SEQ ID NO: 544422 - RNA, 22 nt, Human
uguguggauucaucucaaagag

SEQ ID NO: 544423 - RNA, 22 nt, Human
acaaaauuaugaagaggccuug

SEQ ID NO: 544424 - RNA, 22 nt, Human
ggccugcucuguuuagaggggg

SEQ ID NO: 544425 - RNA, 22 nt, Human
ugucuuuagaaagaagcagaca

SEQ ID NO: 544426 - RNA, 20 nt, Human
ucauccaggacaggaguggc

SEQ ID NO: 544427 - RNA, 22 nt, Human
caagcaggaggagaaguuucug

SEQ ID NO: 544428 - RNA, 22 nt, Human
aagaaugauuacaaagcaacga

SEQ ID NO: 544429 - RNA, 22 nt, Human
aaagaacagauguguggugcau

SEQ ID NO: 544430 - RNA, 22 nt, Human
ucaaacuucuauucucuguuuu

SEQ ID NO: 544431 - RNA, 22 nt, Human
gcucaggaaauaguuuaguguu

SEQ ID NO: 544432 - RNA, 22 nt, Human
cuggggcucucuggaaugcuug

SEQ ID NO: 544433 - RNA, 22 nt, Human
uacauguaagacaugagacucu

SEQ ID NO: 544434 - RNA, 22 nt, Human
aggcugaggaucguacuuucca

SEQ ID NO: 544435 - RNA, 22 nt, Human
uuugcuaaaagugaugaagaca

SEQ ID NO: 544436 - RNA, 22 nt, Human
ggcaggugccuucugugcuagc

SEQ ID NO: 544437 - RNA, 22 nt, Human
cagccagugguugaagaugcag

SEQ ID NO: 544438 - RNA, 17 nt, Human
gggcugacaguggccuc

SEQ ID NO: 544439 - RNA, 22 nt, Human
uugguuuacuaggauucaaauu

SEQ ID NO: 544440 - RNA, 22 nt, Human
ccucaggggugcccacagcugc

SEQ ID NO: 544441 - RNA, 22 nt, Human
uggcagagugcggcauccccug

SEQ ID NO: 544442 - RNA, 22 nt, Human
ccagucccaggcagaaauccag

SEQ ID NO: 544443 - RNA, 18 nt, Human
cugaggcuggcaggagcc

SEQ ID NO: 544444 - RNA, 22 nt, Human
aaggugggcagaucacaagguc

SEQ ID NO: 544445 - RNA, 22 nt, Human
uucuuuggggaauauucugguu

SEQ ID NO: 544446 - RNA, 19 nt, Human
uggaaaauggauugaauca

SEQ ID NO: 544447 - RNA, 22 nt, Human
gaggcucagagaagucauggua

SEQ ID NO: 544448 - RNA, 22 nt, Human
ugaauucaggggcuauuauauu

SEQ ID NO: 544449 - RNA, 22 nt, Human
gaaugcucucauuuuccaacau

SEQ ID NO: 544450 - RNA, 22 nt, Human
uuccagaggcucuaggggagaa

SEQ ID NO: 544451 - RNA, 22 nt, Human
ucacuuagauggggaucaucac

SEQ ID NO: 544452 - RNA, 22 nt, Human
uuuccaaaggaggaaccaguuu

SEQ ID NO: 544453 - RNA, 22 nt, Human
caggccacaaguuggguucaag

SEQ ID NO: 544454 - RNA, 22 nt, Human
aagccagcauuuucccauuccu

SEQ ID NO: 544455 - RNA, 22 nt, Human
uaucagaaagauauuacugggg

SEQ ID NO: 544456 - RNA, 22 nt, Human
aguuuucugauguguagugaga

SEQ ID NO: 544457 - RNA, 22 nt, Human
gucucagaccacccucuuuggc

SEQ ID NO: 544458 - RNA, 22 nt, Human
aagugucuuaacuccuuuuggg

SEQ ID NO: 544459 - RNA, 22 nt, Human
guaacaguuuggguuccaauug

SEQ ID NO: 544460 - RNA, 22 nt, Human
aucacuguuaucuagaagcaca

SEQ ID NO: 544461 - RNA, 16 nt, Human
uaaaucugugaucaca

SEQ ID NO: 544462 - RNA, 22 nt, Human
auugacaagcaguaugucuuag

SEQ ID NO: 544463 - RNA, 22 nt, Human
ccuuucucuggcagcaggacag

SEQ ID NO: 544464 - RNA, 22 nt, Human
uuccauaacugaccgaaugcau

SEQ ID NO: 544465 - RNA, 22 nt, Human
aaaaggaucagauuuugagcag

SEQ ID NO: 544466 - RNA, 22 nt, Human
ugaaaaggaguccuuguuuuca

SEQ ID NO: 544467 - RNA, 22 nt, Human
ugcacacacgcggcacaucugu

SEQ ID NO: 544468 - RNA, 20 nt, Human
cagauucuccacuaacauau

SEQ ID NO: 544469 - RNA, 22 nt, Human
gucccagaugucuggaacuccc

SEQ ID NO: 544470 - RNA, 22 nt, Human
gcuaggagugggauggaagucg

SEQ ID NO: 544471 - RNA, 22 nt, Human
ugcugccaccccucaccagagc

SEQ ID NO: 544472 - RNA, 22 nt, Human
uggagcaggugcucaggguaau

SEQ ID NO: 544473 - RNA, 22 nt, Human
acagaggaaggcugagcugccc

SEQ ID NO: 544474 - RNA, 22 nt, Human
uuccaggacuggguguuugaag

SEQ ID NO: 544475 - RNA, 22 nt, Human
aaucuucauuuugacaagauuc

SEQ ID NO: 544476 - RNA, 22 nt, Human
ucugaaaugaacucuugaacuu

SEQ ID NO: 544477 - RNA, 22 nt, Human
ccugggcugggcgucucauggg

SEQ ID NO: 544478 - RNA, 22 nt, Human
gugcuuucugcugcauuccucu

SEQ ID NO: 544479 - RNA, 22 nt, Human
ugcacuggggucccagcgcacg

SEQ ID NO: 544480 - RNA, 22 nt, Human
ccauggccgccgcugcucagga

SEQ ID NO: 544481 - RNA, 22 nt, Human
guucuucaggcugugcucuaga

SEQ ID NO: 544482 - RNA, 22 nt, Human
uugaaggacaucuuguuucuag

SEQ ID NO: 544483 - RNA, 22 nt, Human
agggcagcuaaggugcugacug

SEQ ID NO: 544484 - RNA, 22 nt, Human
aagggcaggugggcauuucugg

SEQ ID NO: 544485 - RNA, 22 nt, Human
uggccuggcugcccugucugga

SEQ ID NO: 544486 - RNA, 22 nt, Human
ucaaagaauguuaugaggguag

SEQ ID NO: 544487 - RNA, 19 nt, Human
uucuguaaggacauuaauc

SEQ ID NO: 544488 - RNA, 22 nt, Human
cagggcucccuugcaaggaggg

SEQ ID NO: 544489 - RNA, 20 nt, Human
accuccuggaagcaggugcc

SEQ ID NO: 544490 - RNA, 22 nt, Human
gugucccaaagauuagaaauca

SEQ ID NO: 544491 - RNA, 21 nt, Human
ugucagagcuuguaggacauu

SEQ ID NO: 544492 - RNA, 22 nt, Human
uuuuugcaccaaccuaauagaa

SEQ ID NO: 544493 - RNA, 18 nt, Human
uggaagcuggcagauuuu

SEQ ID NO: 544494 - RNA, 22 nt, Human
uacaggcacugaaaugcuuauu

SEQ ID NO: 544495 - RNA, 22 nt, Human
cucuggaguucuucaagcuacu

SEQ ID NO: 544496 - RNA, 22 nt, Human
agaauuguugggguaauaaaag

SEQ ID NO: 544497 - RNA, 22 nt, Human
aggaauggugcucagcagaaau

SEQ ID NO: 544498 - RNA, 22 nt, Human
ugucucugguauuaggugaaaa

SEQ ID NO: 544499 - RNA, 22 nt, Human
ucugcucuccauacuuccgcac

SEQ ID NO: 544500 - RNA, 22 nt, Human
agcagguguuuguaucauaagg

SEQ ID NO: 544501 - RNA, 22 nt, Human
cucccaagauaaauaaggcagu

SEQ ID NO: 544502 - RNA, 22 nt, Human
gcugucaggaacaugccuuggu

SEQ ID NO: 544503 - RNA, 22 nt, Human
uggcaggagacacauggcauag

SEQ ID NO: 544504 - RNA, 22 nt, Human
ggcuugcuucuuguccaggaau

SEQ ID NO: 544505 - RNA, 22 nt, Human
agaaaucaauaucuauauguug

SEQ ID NO: 544506 - RNA, 22 nt, Human
aucuagaaaaggugacuaaaau

SEQ ID NO: 544507 - RNA, 22 nt, Human
ggcuggcacaaagcuccaaauc

SEQ ID NO: 544508 - RNA, 22 nt, Human
gucugaauucuguguaacucua

SEQ ID NO: 544509 - RNA, 22 nt, Human
uccaggcaggguuaaggguccu

SEQ ID NO: 544510 - RNA, 22 nt, Human
aagaauaagaggauuuagaaca

SEQ ID NO: 544511 - RNA, 22 nt, Human
caaacauuuuaaauaagggaua

SEQ ID NO: 544512 - RNA, 22 nt, Human
cugccagcaaugugaccaugcu

SEQ ID NO: 544513 - RNA, 22 nt, Human
aaaucagacuugaauuuucauc

SEQ ID NO: 544514 - RNA, 22 nt, Human
acaugcaugucuaugggcaggu

SEQ ID NO: 544515 - RNA, 22 nt, Human
cagggccagagagggcuggcug

SEQ ID NO: 544516 - RNA, 22 nt, Human
gcugccugggcaggaggcgcug

SEQ ID NO: 544517 - RNA, 22 nt, Human
uggcuggggccacaguuuuccu

SEQ ID NO: 544518 - RNA, 22 nt, Human
gggauggggucaacauguaccu

SEQ ID NO: 544519 - RNA, 23 nt, Human
ugauuacaggaaguucaaguguu

SEQ ID NO: 544520 - RNA, 22 nt, Human
guuauaaauaccuaauaggauu

SEQ ID NO: 544521 - RNA, 22 nt, Human
auuaaauguuccuuaaauuaua

SEQ ID NO: 544522 - RNA, 22 nt, Human
uguccccaagguucagcccaca

SEQ ID NO: 544523 - RNA, 22 nt, Human
auuagggaaacugacuugucuc

SEQ ID NO: 544524 - RNA, 22 nt, Human
gaaguuaggcuuuccuaugcuu

SEQ ID NO: 544525 - RNA, 22 nt, Human
aaauaacuugguuucaucagag

SEQ ID NO: 544526 - RNA, 22 nt, Human
acuggagcccguggaggcgcag

SEQ ID NO: 544527 - RNA, 22 nt, Human
agcagccacacgccuccuucuc

SEQ ID NO: 544528 - RNA, 22 nt, Human
cugaggaugguguggucuucuc

SEQ ID NO: 544529 - RNA, 22 nt, Human
uggcugaauaaaauaugguguu

SEQ ID NO: 544530 - RNA, 22 nt, Human
uacaugaaguugucuaaacugg

SEQ ID NO: 544531 - RNA, 23 nt, Human
cagggcugguagggaagagcgug

SEQ ID NO: 544532 - RNA, 22 nt, Human
ugcccccugguggccagagccg

SEQ ID NO: 544533 - RNA, 22 nt, Human
aacuucuaaucuguacaguuuu

SEQ ID NO: 544534 - RNA, 22 nt, Human
ggguacaguucuuccaguguca

SEQ ID NO: 544535 - RNA, 22 nt, Human
aggacacacagaauacaaaucc

SEQ ID NO: 544536 - RNA, 22 nt, Human
gcucccucugcucaggcacuug

SEQ ID NO: 544537 - RNA, 22 nt, Human
aagcaucucuauguggagagug

SEQ ID NO: 544538 - RNA, 22 nt, Human
acaaaggugcgucccuucagcu

SEQ ID NO: 544539 - RNA, 22 nt, Human
gcuggccacacugcugauggag

SEQ ID NO: 544540 - RNA, 17 nt, Human
agaugcuggccacaugu

SEQ ID NO: 544541 - RNA, 18 nt, Human
guaggucaguaccaagca

SEQ ID NO: 544542 - RNA, 22 nt, Human
gguccuugggucuccuguguuu

SEQ ID NO: 544543 - RNA, 21 nt, Human
uuggacuuuugcgugauugag

SEQ ID NO: 544544 - RNA, 22 nt, Human
gaaaugcaggcuuggauucagc

SEQ ID NO: 544545 - RNA, 22 nt, Human
uccugccucacaguugaaguuu

SEQ ID NO: 544546 - RNA, 22 nt, Human
aaagcaguauauugguaguugu

SEQ ID NO: 544547 - RNA, 22 nt, Human
aaaguuugcaauuuauguuaau

SEQ ID NO: 544548 - RNA, 22 nt, Human
cacauuuaaagguugaagcuga

SEQ ID NO: 544549 - RNA, 22 nt, Human
uuacagauacuuuguaggcaag

SEQ ID NO: 544550 - RNA, 22 nt, Human
ucacagacauggugagguaaca

SEQ ID NO: 544551 - RNA, 22 nt, Human
aaaagcagaucuccaaagucua

SEQ ID NO: 544552 - RNA, 20 nt, Human
gcagugauuugucuauguuu

SEQ ID NO: 544553 - RNA, 22 nt, Human
uagggcuguuuaaaagugaggu

SEQ ID NO: 544554 - RNA, 22 nt, Human
aaaguguaaaagcauguuaggg

SEQ ID NO: 544555 - RNA, 22 nt, Human
ugcaaaaugacuucugaaaaga

SEQ ID NO: 544556 - RNA, 22 nt, Human
uccugggaagcgccggccugcg

SEQ ID NO: 544557 - RNA, 22 nt, Human
uuuacaagucagggacuguucu

SEQ ID NO: 544558 - RNA, 22 nt, Human
caagaauauaaauacuuucaaa

SEQ ID NO: 544559 - RNA, 22 nt, Human
uuauuagcugggcuucagggug

SEQ ID NO: 544560 - RNA, 22 nt, Human
acugggccuacccagauuggca

SEQ ID NO: 544561 - RNA, 22 nt, Human
aaauauugguaggaugcuuguu

SEQ ID NO: 544562 - RNA, 22 nt, Human
gcugagagcacauagaaggggc

SEQ ID NO: 544563 - RNA, 22 nt, Human
cgcugggcgccgaccugcuggc

SEQ ID NO: 544564 - RNA, 22 nt, Human
uaauuucaccguugcuagaaau

SEQ ID NO: 544565 - RNA, 22 nt, Human
gaggcagcaggcugaggaggau

SEQ ID NO: 544566 - RNA, 22 nt, Human
ugcacacaguggacaagucuug

SEQ ID NO: 544567 - RNA, 23 nt, Human
uggcucugagagguucagaugcu

SEQ ID NO: 544568 - RNA, 22 nt, Human
aaugauguauuaguacaacaca

SEQ ID NO: 544569 - RNA, 22 nt, Human
cucucugggggccaugccaaga

SEQ ID NO: 544570 - RNA, 22 nt, Human
ucucagggccucccucuguuuc

SEQ ID NO: 544571 - RNA, 22 nt, Human
uuuacaauucucuaccaguguu

SEQ ID NO: 544572 - RNA, 22 nt, Human
cacauccuucagcugagcccag

SEQ ID NO: 544573 - RNA, 22 nt, Human
cugcucuggcguacucggcauc

SEQ ID NO: 544574 - RNA, 22 nt, Human
agagccuggggauuggcaaggg

SEQ ID NO: 544575 - RNA, 22 nt, Human
agugggcaggcagggugcgcag

SEQ ID NO: 544576 - RNA, 22 nt, Human
ucugccuggauuccauucucca

SEQ ID NO: 544577 - RNA, 22 nt, Human
auaggcuuauauaaaaacaucu

SEQ ID NO: 544578 - RNA, 22 nt, Human
agcugucugucuccugaggaga

SEQ ID NO: 544579 - RNA, 22 nt, Human
auguuacagaaagcaaagauga

SEQ ID NO: 544580 - RNA, 22 nt, Human
ggcuguggccagcggggcugag

SEQ ID NO: 544581 - RNA, 20 nt, Human
aaagucuuaugguuaauuuu

SEQ ID NO: 544582 - RNA, 22 nt, Human
cagcaguguggaagcugagggg

SEQ ID NO: 544583 - RNA, 23 nt, Human
uagauguuuggggaacuuugccc

SEQ ID NO: 544584 - RNA, 23 nt, Human
ucagcugcuuccuccugccugcc

SEQ ID NO: 544585 - RNA, 22 nt, Human
agggcucaucugagacugacau

SEQ ID NO: 544586 - RNA, 22 nt, Human
uuucaaacuuaaauaccuuucc

SEQ ID NO: 544587 - RNA, 22 nt, Human
gucuuucuuaauucaagugcuu

SEQ ID NO: 544588 - RNA, 22 nt, Human
aagauuacuacggaacaugacc

SEQ ID NO: 544589 - RNA, 16 nt, Human
cagaggcaccuggcuc

SEQ ID NO: 544590 - RNA, 19 nt, Human
ggcugccuggagcgagggc

SEQ ID NO: 544591 - RNA, 22 nt, Human
gccuucaguaguauccucauga

SEQ ID NO: 544592 - RNA, 19 nt, Human
cagcaagaaugaaggcaua

SEQ ID NO: 544593 - RNA, 22 nt, Human
cuuuggaaaagcauaccaagga

SEQ ID NO: 544594 - RNA, 22 nt, Human
augaggcagauguugcaugagg

SEQ ID NO: 544595 - RNA, 22 nt, Human
agggacuauuuacccaucucac

SEQ ID NO: 544596 - RNA, 22 nt, Human
uuagaaaauuugcuucuuugga

SEQ ID NO: 544597 - RNA, 22 nt, Human
agcuggagcuucaagcagguaa

SEQ ID NO: 544598 - RNA, 22 nt, Human
uguuuuaguucugucuugcaug

SEQ ID NO: 544599 - RNA, 22 nt, Human
gcuguucacagacucugcucug

SEQ ID NO: 544600 - RNA, 22 nt, Human
ccaggccauucccagaguugcu

SEQ ID NO: 544601 - RNA, 22 nt, Human
uugguuuaggaacuggcuugga

SEQ ID NO: 544602 - RNA, 22 nt, Human
agagaacagcauugcagcuuug

SEQ ID NO: 544603 - RNA, 22 nt, Human
ugauuuccaauaaggagaaugu

SEQ ID NO: 544604 - RNA, 22 nt, Human
caguacuuaguucucaugguuu

SEQ ID NO: 544605 - RNA, 22 nt, Human
cagcucugccaucaucugccuu

SEQ ID NO: 544606 - RNA, 22 nt, Human
cuauucaacuugacuguuucac

SEQ ID NO: 544607 - RNA, 22 nt, Human
aggaccaguaugagagcaucug

SEQ ID NO: 544608 - RNA, 22 nt, Human
uguguuuauaguguaucuucca

SEQ ID NO: 544609 - RNA, 17 nt, Human
cccuggcucuaggugga

SEQ ID NO: 544610 - RNA, 22 nt, Human
ccucccacauccuagcucugcu

SEQ ID NO: 544611 - RNA, 20 nt, Human
cacaggcuauaugagagcca

SEQ ID NO: 544612 - RNA, 22 nt, Human
gagggugcugugccaagaugac

SEQ ID NO: 544613 - RNA, 22 nt, Human
agugaaauuuguuuagauaggu

SEQ ID NO: 544614 - RNA, 22 nt, Human
aagauggcaucuccuauagaug

SEQ ID NO: 544615 - RNA, 22 nt, Human
ggcaccuggauguagcagugaa

SEQ ID NO: 544616 - RNA, 22 nt, Human
gccuggcauuggagccggggca

SEQ ID NO: 544617 - RNA, 22 nt, Human
ugccucagagugggcuugcuau

SEQ ID NO: 544618 - RNA, 22 nt, Human
uuauuucauguaaaauuuaugu

SEQ ID NO: 544619 - RNA, 19 nt, Human
gucagcaccauggacaggg

SEQ ID NO: 544620 - RNA, 22 nt, Human
uuggaaaaacacgauagugguu

SEQ ID NO: 544621 - RNA, 22 nt, Human
aucaggauagucuguaaauugu

SEQ ID NO: 544622 - RNA, 20 nt, Human
uuguuucugcuauuuucuaa

SEQ ID NO: 544623 - RNA, 22 nt, Human
cucugagacucaagugaguggg

SEQ ID NO: 544624 - RNA, 22 nt, Human
acuucuggugucauacugcauu

SEQ ID NO: 544625 - RNA, 23 nt, Human
gcugccucuguuggucuucaguu

SEQ ID NO: 544626 - RNA, 22 nt, Human
ccuucucuacuccugaugcaug

SEQ ID NO: 544627 - RNA, 22 nt, Human
ccacuguuuuucaguuaacuuu

SEQ ID NO: 544628 - RNA, 22 nt, Human
uccugccucuugccuucuucac

SEQ ID NO: 544629 - RNA, 22 nt, Human
ggagagaaauugagguagcaag

SEQ ID NO: 544630 - RNA, 22 nt, Human
uggugagauaacuuucggcaag

SEQ ID NO: 544631 - RNA, 22 nt, Human
aggcagcagagguugaggaaag

SEQ ID NO: 544632 - RNA, 22 nt, Human
aguucugggaaaaacauggcca

SEQ ID NO: 544633 - RNA, 22 nt, Human
uccugggaacucggaaagcucu

SEQ ID NO: 544634 - RNA, 22 nt, Human
ucucagucuuugcaaggaugcu

SEQ ID NO: 544635 - RNA, 22 nt, Human
cuucaagagaaugcagggaugu

SEQ ID NO: 544636 - RNA, 22 nt, Human
gugccugggcaugagcuuguug

SEQ ID NO: 544637 - RNA, 22 nt, Human
uaugugugcuuuuuccaugcau

SEQ ID NO: 544638 - RNA, 22 nt, Human
gcuggcaccugcaccaagcagg

SEQ ID NO: 544639 - RNA, 22 nt, Human
aguauuucaguuacuuuaaaau

SEQ ID NO: 544640 - RNA, 22 nt, Human
uguuuucuuccuaauugcucau

SEQ ID NO: 544641 - RNA, 19 nt, Human
uggagacugagagugagca

SEQ ID NO: 544642 - RNA, 20 nt, Human
ucagaggcugccagcugggg

SEQ ID NO: 544643 - RNA, 22 nt, Human
caucaaauggcaagugaaagcu

SEQ ID NO: 544644 - RNA, 22 nt, Human
accagugcuuccugcuggagcu

SEQ ID NO: 544645 - RNA, 22 nt, Human
acugggaggcaucuggagcuga

SEQ ID NO: 544646 - RNA, 22 nt, Human
ugauuuuuggaucugagcugca

SEQ ID NO: 544647 - RNA, 22 nt, Human
uuuacaaggcagaacugauuaa

SEQ ID NO: 544648 - RNA, 22 nt, Human
ucuaacauuguuuuucacagau

SEQ ID NO: 544649 - RNA, 22 nt, Human
cagcuauuuucucauuaaggau

SEQ ID NO: 544650 - RNA, 22 nt, Human
agcaggugaugugagucuggaa

SEQ ID NO: 544651 - RNA, 22 nt, Human
auucuucauguugaagcuguca

SEQ ID NO: 544652 - RNA, 22 nt, Human
ugcagaagacacaagguaacgu

SEQ ID NO: 544653 - RNA, 22 nt, Human
cugaaggaagcagaagcgaggu

SEQ ID NO: 544654 - RNA, 22 nt, Human
agcuucuugaccaagccuguaa

SEQ ID NO: 544655 - RNA, 22 nt, Human
aaaggucaaaaucgugacauug

SEQ ID NO: 544656 - RNA, 22 nt, Human
gccuggcucugagggagcuccu

SEQ ID NO: 544657 - RNA, 22 nt, Human
ugagaguauuuuggcauuauca

SEQ ID NO: 544658 - RNA, 22 nt, Human
uguacuguauucaucuuuaacu

SEQ ID NO: 544659 - RNA, 22 nt, Human
uggaugugucgcccuggcucuc

SEQ ID NO: 544660 - RNA, 22 nt, Human
uacagcuuuucauauuuguguu

SEQ ID NO: 544661 - RNA, 22 nt, Human
gccuggguccacugaucaugcu

SEQ ID NO: 544662 - RNA, 22 nt, Human
cuaaagaauuuugcuugaccag

SEQ ID NO: 544663 - RNA, 22 nt, Human
aaaugucaaggugauagaugca

SEQ ID NO: 544664 - RNA, 22 nt, Human
ggagaggugaauggcugcucua

SEQ ID NO: 544665 - RNA, 22 nt, Human
gccccugggagcagagccacca

SEQ ID NO: 544666 - RNA, 22 nt, Human
gcucugcugucuucuugcaggc

SEQ ID NO: 544667 - RNA, 22 nt, Human
auuuuucucuccacuccauuaa

SEQ ID NO: 544668 - RNA, 22 nt, Human
agcugccaaguuucucaguuua

SEQ ID NO: 544669 - RNA, 22 nt, Human
agggucaagucacugguucacg

SEQ ID NO: 544670 - RNA, 22 nt, Human
gucccagaggacagggucacau

SEQ ID NO: 544671 - RNA, 22 nt, Human
ugcaguggaagagguggagauc

SEQ ID NO: 544672 - RNA, 22 nt, Human
ucuguucaugucuuuuuaagug

SEQ ID NO: 544673 - RNA, 22 nt, Human
acuucauguacuguucaaggcc

SEQ ID NO: 544674 - RNA, 22 nt, Human
guucuuuugguagagugugcau

SEQ ID NO: 544675 - RNA, 22 nt, Human
caaggcagucccuacucccugc

SEQ ID NO: 544676 - RNA, 22 nt, Human
uaggaagaaacuuucccugcag

SEQ ID NO: 544677 - RNA, 22 nt, Human
cacaucccuggaguuacccagu

SEQ ID NO: 544678 - RNA, 22 nt, Human
gcacagggagcaggucucuggu

SEQ ID NO: 544679 - RNA, 22 nt, Human
ugcagggaauccagucuagggu

SEQ ID NO: 544680 - RNA, 22 nt, Human
aaagcucuuaaauugaccugcu

SEQ ID NO: 544681 - RNA, 22 nt, Human
cggcagcuccgcgccguaggac

SEQ ID NO: 544682 - RNA, 22 nt, Human
aguuuacagaugcuacaggagc

SEQ ID NO: 544683 - RNA, 22 nt, Human
uaugcacacaggcuuaauucau

SEQ ID NO: 544684 - RNA, 22 nt, Human
agaggccaguggcugugcuguc

SEQ ID NO: 544685 - RNA, 22 nt, Human
uggguagaggaauugggcuacc

SEQ ID NO: 544686 - RNA, 22 nt, Human
ugcccauggaccaagcaagggg

SEQ ID NO: 544687 - RNA, 22 nt, Human
uauucucagcaacacacaugga

SEQ ID NO: 544688 - RNA, 22 nt, Human
aagacauuacuggaaucugacu

SEQ ID NO: 544689 - RNA, 22 nt, Human
agaauuagguaaguucaucuga

SEQ ID NO: 544690 - RNA, 22 nt, Human
gcucuggcuacuguggcuaccg

SEQ ID NO: 544691 - RNA, 22 nt, Human
cacaggugcuccucggggagcu

SEQ ID NO: 544692 - RNA, 22 nt, Human
cccugcaggcucagacuggagu

SEQ ID NO: 544693 - RNA, 19 nt, Human
ccucucccaugcuuaccuc

SEQ ID NO: 544694 - RNA, 22 nt, Human
gcugggaaguggcagagcugga

SEQ ID NO: 544695 - RNA, 22 nt, Human
acacacacaagcagguugugga

SEQ ID NO: 544696 - RNA, 20 nt, Human
uuauuucaguugcuagauug

SEQ ID NO: 544697 - RNA, 22 nt, Human
uuucuaagaauauugcucuuaa

SEQ ID NO: 544698 - RNA, 22 nt, Human
cugggcuggauaauucuuugcu

SEQ ID NO: 544699 - RNA, 22 nt, Human
ugggaaggggagcuggaaagga

SEQ ID NO: 544700 - RNA, 22 nt, Human
ucuuuuuauauugacaaaaggu

SEQ ID NO: 544701 - RNA, 22 nt, Human
acagagcaugcucaguguguga

SEQ ID NO: 544702 - RNA, 22 nt, Human
uugcuaaaaggugaaaagugua

SEQ ID NO: 544703 - RNA, 22 nt, Human
ugcagugaugcuucuggcucag

SEQ ID NO: 544704 - RNA, 20 nt, Human
gcagggcaucuuggccccca

SEQ ID NO: 544705 - RNA, 22 nt, Human
guaugaaguaagauauuguuca

SEQ ID NO: 544706 - RNA, 17 nt, Human
ccucacagggaccagac

SEQ ID NO: 544707 - RNA, 22 nt, Human
gcagggcagaccuccagccuau

SEQ ID NO: 544708 - RNA, 22 nt, Human
uacuuuucuuugucaugcaucu

SEQ ID NO: 544709 - RNA, 18 nt, Human
uucuuuucaugugaucuc

SEQ ID NO: 544710 - RNA, 21 nt, Human
aucuuaaaaggucuuaacuuu

SEQ ID NO: 544711 - RNA, 20 nt, Human
uugaaaaugcauugugcagu

SEQ ID NO: 544712 - RNA, 22 nt, Human
ugaggggagcccgcccuggacg

SEQ ID NO: 544713 - RNA, 22 nt, Human
gccauuuggcaaaacugacuuc

SEQ ID NO: 544714 - RNA, 22 nt, Human
ggaaagaaagugugaacaacuu

SEQ ID NO: 544715 - RNA, 22 nt, Human
aggcaguguauugcuagcggcu

SEQ ID NO: 544716 - RNA, 22 nt, Human
uuuaaauuuguguuuagagggu

SEQ ID NO: 544717 - RNA, 20 nt, Human
aauauaauucucugaauuua

SEQ ID NO: 544718 - RNA, 22 nt, Human
uacacaucacuguaucuuucag

SEQ ID NO: 544719 - RNA, 22 nt, Human
uuuuucauugcagccucucucc

SEQ ID NO: 544720 - RNA, 22 nt, Human
aaggaaagacauauaaaugacu

SEQ ID NO: 544721 - RNA, 22 nt, Human
gauuucuucucucccaagagga

SEQ ID NO: 544722 - RNA, 20 nt, Human
ugcaggcuucgcucuaggag

SEQ ID NO: 544723 - RNA, 22 nt, Human
uuccugugugcucucauuuagu

SEQ ID NO: 544724 - RNA, 22 nt, Human
uuuccuacccuuccaggcagag

SEQ ID NO: 544725 - RNA, 22 nt, Human
cuuguacaggaauccaugguau

SEQ ID NO: 544726 - RNA, 22 nt, Human
cuucauuaaccaaaaugcaaua

SEQ ID NO: 544727 - RNA, 22 nt, Human
uauuagggaacugcaagacuaa

SEQ ID NO: 544728 - RNA, 22 nt, Human
acucuucaguacaauaauaucu

SEQ ID NO: 544729 - RNA, 22 nt, Human
ugauuaacugucuauuaaucau

SEQ ID NO: 544730 - RNA, 22 nt, Human
gcugggcuugguuucccugcuu

SEQ ID NO: 544731 - RNA, 23 nt, Human
uaaauuaccuuuccagugcaggg

SEQ ID NO: 544732 - RNA, 22 nt, Human
cccuggaggcaaagguugcagu

SEQ ID NO: 544733 - RNA, 22 nt, Human
ugggauggagccugaguauagu

SEQ ID NO: 544734 - RNA, 22 nt, Human
caaggccaaagggccacuguca

SEQ ID NO: 544735 - RNA, 22 nt, Human
augcaaaugucaccacuucuaa

SEQ ID NO: 544736 - RNA, 22 nt, Human
ugcuuccuugagcucuccaauc

SEQ ID NO: 544737 - RNA, 22 nt, Human
uguuuucaugguuaugugucua

SEQ ID NO: 544738 - RNA, 22 nt, Human
uaaagcaauuacucaguggcuu

SEQ ID NO: 544739 - RNA, 21 nt, Human
gugucaugguugacuuuggca

SEQ ID NO: 544740 - RNA, 22 nt, Human
aggcccuggguuagggcccacu

SEQ ID NO: 544741 - RNA, 22 nt, Human
gagaggcugaaaucacaggagc

SEQ ID NO: 544742 - RNA, 22 nt, Human
ggcgguggcgugaagguggcug

SEQ ID NO: 544743 - RNA, 22 nt, Human
cugccuugcaccggcucucugg

SEQ ID NO: 544744 - RNA, 22 nt, Human
uaauuauuaugacaacaauugc

SEQ ID NO: 544745 - RNA, 22 nt, Human
uucaggccucuaaagggaaagc

SEQ ID NO: 544746 - RNA, 22 nt, Human
gcuucuaucccuccacugcacu

SEQ ID NO: 544747 - RNA, 22 nt, Human
gggguguggacggcugugccag

SEQ ID NO: 544748 - RNA, 20 nt, Human
ggcagagcuaugucuguugc

SEQ ID NO: 544749 - RNA, 22 nt, Human
guggcagagggugagcuggacu

SEQ ID NO: 544750 - RNA, 22 nt, Human
ggcaggugccaguuggcuuggg

SEQ ID NO: 544751 - RNA, 22 nt, Human
aggucauuaaaguuaaaugagg

SEQ ID NO: 544752 - RNA, 22 nt, Human
aaucauguuuacgugacauguc

SEQ ID NO: 544753 - RNA, 22 nt, Human
cccaguggcccagcauguggug

SEQ ID NO: 544754 - RNA, 22 nt, Human
auguuauuuuggaaaauacaaa

SEQ ID NO: 544755 - RNA, 22 nt, Human
uguauagaguuggaagaugacu

SEQ ID NO: 544756 - RNA, 22 nt, Human
gcugucccgaaccccugguaau

SEQ ID NO: 544757 - RNA, 22 nt, Human
ugggcucagccaugaccuccac

SEQ ID NO: 544758 - RNA, 23 nt, Human
ucucugaguuguacuuucccuug

SEQ ID NO: 544759 - RNA, 21 nt, Human
cuggacugaggagacagucgc

SEQ ID NO: 544760 - RNA, 22 nt, Human
agugcagagagcaauacucuac

SEQ ID NO: 544761 - RNA, 20 nt, Human
ccacauuuuacuguuugcca

SEQ ID NO: 544762 - RNA, 22 nt, Human
agcaugcaggaaccacauggca

SEQ ID NO: 544763 - RNA, 22 nt, Human
aaacacagauuucuuuguccca

SEQ ID NO: 544764 - RNA, 22 nt, Human
cagccagggagcaaagaguuga

SEQ ID NO: 544765 - RNA, 22 nt, Human
agugaaaugauucugagcaaga

SEQ ID NO: 544766 - RNA, 22 nt, Human
aggagaauuaggaacucaagau

SEQ ID NO: 544767 - RNA, 22 nt, Human
acccagcucuuugauggucuug

SEQ ID NO: 544768 - RNA, 22 nt, Human
gagcugccagacaugggaauga

SEQ ID NO: 544769 - RNA, 22 nt, Human
uugcaaagagucauguaaguca

SEQ ID NO: 544770 - RNA, 22 nt, Human
acaccagggccuagccagggcg

SEQ ID NO: 544771 - RNA, 22 nt, Human
uagaauaaguugaugauauaug

SEQ ID NO: 544772 - RNA, 22 nt, Human
gcaggugauucacccugggccu

SEQ ID NO: 544773 - RNA, 22 nt, Human
aggagaggcucuaacucugugu

SEQ ID NO: 544774 - RNA, 22 nt, Human
gaggccuguagucauggaugua

SEQ ID NO: 544775 - RNA, 18 nt, Human
ggcuuugcugggguuucu

SEQ ID NO: 544776 - RNA, 19 nt, Human
aucagcaagguaggaugug

SEQ ID NO: 544777 - RNA, 22 nt, Human
aguaaugaagauuuguugcaca

SEQ ID NO: 544778 - RNA, 22 nt, Human
ggggccagcaauguugaggaau

SEQ ID NO: 544779 - RNA, 22 nt, Human
uuuguacauccuaauucugagu

SEQ ID NO: 544780 - RNA, 22 nt, Human
acugaaggguaaugugggagcc

SEQ ID NO: 544781 - RNA, 23 nt, Human
aaguucaagucacagccugucuu

SEQ ID NO: 544782 - RNA, 22 nt, Human
cugagccuguguuucucuggca

SEQ ID NO: 544783 - RNA, 22 nt, Human
gacaaaacacauuaguuuaaaa

SEQ ID NO: 544784 - RNA, 22 nt, Human
cagggcccauggcucagguagg

SEQ ID NO: 544785 - RNA, 22 nt, Human
gcagaugggagccccaggggag

SEQ ID NO: 544786 - RNA, 22 nt, Human
gcgagugccgagagggcagggc

SEQ ID NO: 544787 - RNA, 22 nt, Human
aggagcuggguuccuuuggugg

SEQ ID NO: 544788 - RNA, 22 nt, Human
ucagaggugguaaaggacagca

SEQ ID NO: 544789 - RNA, 22 nt, Human
gcaggguaggugacagguaguc

SEQ ID NO: 544790 - RNA, 22 nt, Human
cugaggaguuuggguuguucaa

SEQ ID NO: 544791 - RNA, 22 nt, Human
acucagcugaugaagcacaagu

SEQ ID NO: 544792 - RNA, 22 nt, Human
aagugcuaggauuacaggugug

SEQ ID NO: 544793 - RNA, 22 nt, Human
uucuagaugauaaaccagcagc

SEQ ID NO: 544794 - RNA, 22 nt, Human
cagguucccuagcagcaaagcc

SEQ ID NO: 544795 - RNA, 22 nt, Human
uggcugggagcuggaacugggc

SEQ ID NO: 544796 - RNA, 22 nt, Human
ugcagugagaagcaguuaugau

SEQ ID NO: 544797 - RNA, 22 nt, Human
guggcagcaaaauccugcauuc

SEQ ID NO: 544798 - RNA, 22 nt, Human
uucugggcaguuggaaauuuca

SEQ ID NO: 544799 - RNA, 22 nt, Human
uagauacaggcucucugagccu

SEQ ID NO: 544800 - RNA, 22 nt, Human
accaggcagagcugggccuuaa

SEQ ID NO: 544801 - RNA, 22 nt, Human
uaaaucucacuggguauauugg

SEQ ID NO: 544802 - RNA, 22 nt, Human
augagcuucccagacaggaugg

SEQ ID NO: 544803 - RNA, 20 nt, Human
gagauccucaucuguaaagu

SEQ ID NO: 544804 - RNA, 17 nt, Human
uucucuuccuggauagu

SEQ ID NO: 544805 - RNA, 22 nt, Human
aggcucagagaugaguaagcac

SEQ ID NO: 544806 - RNA, 22 nt, Human
aaagccaaaugaaagaugguuc

SEQ ID NO: 544807 - RNA, 23 nt, Human
ccucccaggcugcgagucccgag

SEQ ID NO: 544808 - RNA, 22 nt, Human
uuucugaagucuucuaacagau

SEQ ID NO: 544809 - RNA, 22 nt, Human
acaaaaccagaaaaucucuacc

SEQ ID NO: 544810 - RNA, 22 nt, Human
ggaggggagguccagcugaucu

SEQ ID NO: 544811 - RNA, 21 nt, Human
gcaguuaauagcagagcacac

SEQ ID NO: 544812 - RNA, 22 nt, Human
aagcugccuuccaugugaggaa

SEQ ID NO: 544813 - RNA, 22 nt, Human
ccuggaugauccaugucaugga

SEQ ID NO: 544814 - RNA, 22 nt, Human
gcugccacucugagcuugcuuc

SEQ ID NO: 544815 - RNA, 22 nt, Human
uuguaugaucaaaagaaaugua

SEQ ID NO: 544816 - RNA, 23 nt, Human
cagaagcaccuguugacugcugc

SEQ ID NO: 544817 - RNA, 22 nt, Human
uccuggcuaacacggugacacc

SEQ ID NO: 544818 - RNA, 17 nt, Human
uccaggcagcaacugag

SEQ ID NO: 544819 - RNA, 22 nt, Human
aauauuugaacagucacugagu

SEQ ID NO: 544820 - RNA, 22 nt, Human
aggaagugcuaagagaacauca

SEQ ID NO: 544821 - RNA, 22 nt, Human
uaccuuggguugaguucauucu

SEQ ID NO: 544822 - RNA, 22 nt, Human
cuuugcuagugauuuguuuagg

SEQ ID NO: 544823 - RNA, 22 nt, Human
ggcuuuaucaaaugagacccug

SEQ ID NO: 544824 - RNA, 22 nt, Human
gagaaguuagcucuguuuaggu

SEQ ID NO: 544825 - RNA, 22 nt, Human
agcaccugcuaugugucaggga

SEQ ID NO: 544826 - RNA, 22 nt, Human
acuuuguagguuucagugaaac

SEQ ID NO: 544827 - RNA, 22 nt, Human
uucauuuggccucugcuuaaaa

SEQ ID NO: 544828 - RNA, 22 nt, Human
ugcaggggcuugucugggccug

SEQ ID NO: 544829 - RNA, 22 nt, Human
uuagccauggacugaauugacu

SEQ ID NO: 544830 - RNA, 22 nt, Human
gcugggcagccuggccgcugcc

SEQ ID NO: 544831 - RNA, 19 nt, Human
gcuguauuaaagauacaug

SEQ ID NO: 544832 - RNA, 22 nt, Human
gaguccuguugucccagauggg

SEQ ID NO: 544833 - RNA, 22 nt, Human
gggaagugagcuggaaucaagg

SEQ ID NO: 544834 - RNA, 22 nt, Human
guauuaggaaauaugaagaaag

SEQ ID NO: 544835 - RNA, 22 nt, Human
ugcagggcauaggguccaguuu

SEQ ID NO: 544836 - RNA, 22 nt, Human
aauguguauaugaacauacagg

SEQ ID NO: 544837 - RNA, 22 nt, Human
agugggccaaauggaggcaagu

SEQ ID NO: 544838 - RNA, 22 nt, Human
uuccagaaccuuccugcuggaa

SEQ ID NO: 544839 - RNA, 22 nt, Human
aacacaguuucucuaugagagu

SEQ ID NO: 544840 - RNA, 22 nt, Human
uagguucaggagauauugcaca

SEQ ID NO: 544841 - RNA, 22 nt, Human
uggcagcagggccccuggagga

SEQ ID NO: 544842 - RNA, 22 nt, Human
ccugcugguguccaggcuuugg

SEQ ID NO: 544843 - RNA, 20 nt, Human
aagaaggccugcccagacac

SEQ ID NO: 544844 - RNA, 22 nt, Human
uucaaagaccuuacuuggcaaa

SEQ ID NO: 544845 - RNA, 22 nt, Human
gcagagugagauaugaacccag

SEQ ID NO: 544846 - RNA, 22 nt, Human
cuacuuuaauuuucugcagaga

SEQ ID NO: 544847 - RNA, 22 nt, Human
uuuagaaguucacacauuuaaa

SEQ ID NO: 544848 - RNA, 22 nt, Human
caggucagagguagaugagaug

SEQ ID NO: 544849 - RNA, 22 nt, Human
gcacagccggaccgaggaaaag

SEQ ID NO: 544850 - RNA, 22 nt, Human
caagaauuguacaaacugggug

SEQ ID NO: 544851 - RNA, 20 nt, Human
ggcugcugugggcagagagg

SEQ ID NO: 544852 - RNA, 22 nt, Human
cugugggagcacaugacagaua

SEQ ID NO: 544853 - RNA, 22 nt, Human
cugccuggguucaaguccuguu

SEQ ID NO: 544854 - RNA, 22 nt, Human
aaacaauguugucuccaagagg

SEQ ID NO: 544855 - RNA, 22 nt, Human
ucaccaggauugggcuguaggc

SEQ ID NO: 544856 - RNA, 22 nt, Human
gagggauggugugagaggcuca

SEQ ID NO: 544857 - RNA, 22 nt, Human
aggcagugagugugacuucaca

SEQ ID NO: 544858 - RNA, 22 nt, Human
gugugguggcccuccuucaggc

SEQ ID NO: 544859 - RNA, 22 nt, Human
aggguaggguaaaugaugcauc

SEQ ID NO: 544860 - RNA, 22 nt, Human
aaaaagguugauccagauuagg

SEQ ID NO: 544861 - RNA, 22 nt, Human
cugggaguguucuaggucacau

SEQ ID NO: 544862 - RNA, 22 nt, Human
auuucauugaaguuaauucuuc

SEQ ID NO: 544863 - RNA, 22 nt, Human
uaugcacagaaguuugcugaau

SEQ ID NO: 544864 - RNA, 22 nt, Human
auguaaggcugccuaugacacu

SEQ ID NO: 544865 - RNA, 22 nt, Human
uaaguuuucuggaauaacuugg

SEQ ID NO: 544866 - RNA, 22 nt, Human
gagaggggaccugugugucuag

SEQ ID NO: 544867 - RNA, 22 nt, Human
gaugguuuaugauagaugggaa

SEQ ID NO: 544868 - RNA, 22 nt, Human
uuccagaggcuucagggaagaa

SEQ ID NO: 544869 - RNA, 22 nt, Human
auuucuguaguccacauucuuu

SEQ ID NO: 544870 - RNA, 22 nt, Human
auucuggaagcaagcuuuuaaa

SEQ ID NO: 544871 - RNA, 22 nt, Human
aaacagaguuugguaaauagcc

SEQ ID NO: 544872 - RNA, 22 nt, Human
ggcaggcugggugucauggagu

SEQ ID NO: 544873 - RNA, 22 nt, Human
ggggauggaggcgugugguccu

SEQ ID NO: 544874 - RNA, 22 nt, Human
uggaacacuggcuuuccacugu

SEQ ID NO: 544875 - RNA, 22 nt, Human
auuucccuccagggaaagcuua

SEQ ID NO: 544876 - RNA, 22 nt, Human
ucugccugccgagaacaccuac

SEQ ID NO: 544877 - RNA, 22 nt, Human
gggugaagcuccugcaggggcc

SEQ ID NO: 544878 - RNA, 22 nt, Human
augcccugcugccaucuggccg

SEQ ID NO: 544879 - RNA, 22 nt, Human
uuaucaguuguguguauacacg

SEQ ID NO: 544880 - RNA, 22 nt, Human
ggggaugguagaccggugacgu

SEQ ID NO: 544881 - RNA, 22 nt, Human
aaaggucaagcuggacucaggu

SEQ ID NO: 544882 - RNA, 22 nt, Human
gccuguguggaugcgccggugc

SEQ ID NO: 544883 - RNA, 22 nt, Human
cagggcuguggaaaacuggugc

SEQ ID NO: 544884 - RNA, 22 nt, Human
cugguucaaguccuggcucugu

SEQ ID NO: 544885 - RNA, 22 nt, Human
aggggugaaagagggcccucaa

SEQ ID NO: 544886 - RNA, 22 nt, Human
ugguccuggggaucugcaguga

SEQ ID NO: 544887 - RNA, 22 nt, Human
ucuuuuauagugaauuuucuug

SEQ ID NO: 544888 - RNA, 22 nt, Human
uaggcagauguuaacaggaaaa

SEQ ID NO: 544889 - RNA, 22 nt, Human
ucaguauccacaaaugcucaaa

SEQ ID NO: 544890 - RNA, 22 nt, Human
ucaggaucaggggccuuuccuu

SEQ ID NO: 544891 - RNA, 22 nt, Human
cugggcagaguccggaagaugg

SEQ ID NO: 544892 - RNA, 22 nt, Human
gguggcaggcccugagcauccc

SEQ ID NO: 544893 - RNA, 22 nt, Human
ucuucagcagggccucucugag

SEQ ID NO: 544894 - RNA, 22 nt, Human
cacacugucagguaaauaacac

SEQ ID NO: 544895 - RNA, 22 nt, Human
uacuguuucuacuacuuaggga

SEQ ID NO: 544896 - RNA, 22 nt, Human
uuuaagaaguuauguuauaaau

SEQ ID NO: 544897 - RNA, 22 nt, Human
accugcuuuguaguguuugcug

SEQ ID NO: 544898 - RNA, 22 nt, Human
uugggaaggcguggaagcagaa

SEQ ID NO: 544899 - RNA, 22 nt, Human
gcagccagggagagaaccaggg

SEQ ID NO: 544900 - RNA, 22 nt, Human
aggcuggugcuuccuagggcag

SEQ ID NO: 544901 - RNA, 22 nt, Human
cauuucugggagacaugcuaga

SEQ ID NO: 544902 - RNA, 22 nt, Human
aacauucuuuggaggauuauuc

SEQ ID NO: 544903 - RNA, 21 nt, Human
gcacagugccaggcacacagu

SEQ ID NO: 544904 - RNA, 22 nt, Human
uuauaggcuuaguucugugugu

SEQ ID NO: 544905 - RNA, 22 nt, Human
caaaggcuuugcuaugaugcau

SEQ ID NO: 544906 - RNA, 22 nt, Human
cagccagcuucagauccaagcc

SEQ ID NO: 544907 - RNA, 22 nt, Human
ugcacacaaguuggagaaugaa

SEQ ID NO: 544908 - RNA, 22 nt, Human
ucuugggagucccaggacauag

SEQ ID NO: 544909 - RNA, 22 nt, Human
gccagggggucagcaggcacuu

SEQ ID NO: 544910 - RNA, 22 nt, Human
agcugccaaguuggaguagcaa

SEQ ID NO: 544911 - RNA, 22 nt, Human
uaagauguuuugguuugauaag

SEQ ID NO: 544912 - RNA, 22 nt, Human
aaauacuguccaccauggagca

SEQ ID NO: 544913 - RNA, 19 nt, Human
ucugcuggcagaauucccu

SEQ ID NO: 544914 - RNA, 22 nt, Human
agagauauggaugucagaaacu

SEQ ID NO: 544915 - RNA, 22 nt, Human
gcugucacaucaaggcacuaaa

SEQ ID NO: 544916 - RNA, 22 nt, Human
aaaugucuuuaucucauguaac

SEQ ID NO: 544917 - RNA, 22 nt, Human
aaauaguuagcccugcauauau

SEQ ID NO: 544918 - RNA, 22 nt, Human
ggcucagcuuggugcgcagaaa

SEQ ID NO: 544919 - RNA, 22 nt, Human
ugcauuuuugagguuaacucaa

SEQ ID NO: 544920 - RNA, 22 nt, Human
ccagcagcagcguccaaggaga

SEQ ID NO: 544921 - RNA, 22 nt, Human
cuccucugucuaccacgagggu

SEQ ID NO: 544922 - RNA, 22 nt, Human
gaacagagaagcuuuacuaaag

SEQ ID NO: 544923 - RNA, 22 nt, Human
agcccugcuucaccauuuacuu

SEQ ID NO: 544924 - RNA, 22 nt, Human
cagaguaaggagcugucaaacg

SEQ ID NO: 544925 - RNA, 22 nt, Human
aggcacugacagauucuguguc

SEQ ID NO: 544926 - RNA, 19 nt, Human
caugagcugcucacuuccc

SEQ ID NO: 544927 - RNA, 22 nt, Human
ugcuucuggggacaggcugccu

SEQ ID NO: 544928 - RNA, 20 nt, Human
gcacagcugaguucaggguc

SEQ ID NO: 544929 - RNA, 19 nt, Human
ccagcccugucacuucuug

SEQ ID NO: 544930 - RNA, 22 nt, Human
ggcucugccacuucuuggcugu

SEQ ID NO: 544931 - RNA, 22 nt, Human
ucaaaguauaauugcuuuuuug

SEQ ID NO: 544932 - RNA, 22 nt, Human
ugcaucuaaguggcuaacaacc

SEQ ID NO: 544933 - RNA, 22 nt, Human
ggcagcuccucucagcaaaaga

SEQ ID NO: 544934 - RNA, 22 nt, Human
acucaggagggaucagcuauca

SEQ ID NO: 544935 - RNA, 22 nt, Human
uuuuggaaugaggaacauccag

SEQ ID NO: 544936 - RNA, 22 nt, Human
gaggcagagacuccaccuucag

SEQ ID NO: 544937 - RNA, 22 nt, Human
ccacugucuuuuccaggcugaa

SEQ ID NO: 544938 - RNA, 22 nt, Human
agugggcugagcuugcugggug

SEQ ID NO: 544939 - RNA, 22 nt, Human
aagcaagacagaaguuacugcc

SEQ ID NO: 544940 - RNA, 22 nt, Human
cugagauggaguuuugcucuug

SEQ ID NO: 544941 - RNA, 22 nt, Human
cucugcccucacuuggggccug

SEQ ID NO: 544942 - RNA, 22 nt, Human
ccaaggcuggagugcaguggcg

SEQ ID NO: 544943 - RNA, 20 nt, Human
ucuguuauugcauguacaua

SEQ ID NO: 544944 - RNA, 17 nt, Human
ccagguggaaucgugga

SEQ ID NO: 544945 - RNA, 21 nt, Human
ugggggagaauugguugcuuu

SEQ ID NO: 544946 - RNA, 22 nt, Human
gcaggcugugaggcucagaugg

SEQ ID NO: 544947 - RNA, 22 nt, Human
gccuggagugcaguggcgugau

SEQ ID NO: 544948 - RNA, 22 nt, Human
aguucuuuucuagauucuggau

SEQ ID NO: 544949 - RNA, 19 nt, Human
ccugggagucagcugaagg

SEQ ID NO: 544950 - RNA, 17 nt, Human
cucugcagugcauggcu

SEQ ID NO: 544951 - RNA, 22 nt, Human
uuauuauuccccaagucauuau

SEQ ID NO: 544952 - RNA, 22 nt, Human
gccaggcauuuauugauugaau

SEQ ID NO: 544953 - RNA, 22 nt, Human
uagagagcuguuugaaagcagg

SEQ ID NO: 544954 - RNA, 22 nt, Human
uaagucguggaugauucuucgg

SEQ ID NO: 544955 - RNA, 22 nt, Human
uaaagcauguacugugugcuag

SEQ ID NO: 544956 - RNA, 22 nt, Human
ucagggucagauuccagagccu

SEQ ID NO: 544957 - RNA, 22 nt, Human
cuggcuggccggaggcaucccu

SEQ ID NO: 544958 - RNA, 17 nt, Human
ucagcaggggccaagcu

SEQ ID NO: 544959 - RNA, 22 nt, Human
cccaggugggcaccucgaggaa

SEQ ID NO: 544960 - RNA, 22 nt, Human
gcugccacgaucucugcuguag

SEQ ID NO: 544961 - RNA, 22 nt, Human
uccucuugggaauaccuuucua

SEQ ID NO: 544962 - RNA, 22 nt, Human
uucaaagauuuucccaaagcuc

SEQ ID NO: 544963 - RNA, 22 nt, Human
uucuuuaaaauagugagaaaga

SEQ ID NO: 544964 - RNA, 22 nt, Human
gcucagagaaucagcagacacc

SEQ ID NO: 544965 - RNA, 22 nt, Human
cagggcucagggacugcagaaa

SEQ ID NO: 544966 - RNA, 22 nt, Human
gcuccucuucucccacugaaug

SEQ ID NO: 544967 - RNA, 22 nt, Human
agcgugaaggcgggcagucggc

SEQ ID NO: 544968 - RNA, 22 nt, Human
uggccucugggaaagcagauuc

SEQ ID NO: 544969 - RNA, 22 nt, Human
uccaggccaauguagcaggccc

SEQ ID NO: 544970 - RNA, 22 nt, Human
guggggaaaggaguggggcuca

SEQ ID NO: 544971 - RNA, 17 nt, Human
aaaauucuguaaagagg

SEQ ID NO: 544972 - RNA, 22 nt, Human
uuccuuccgggcaccaggcacu

SEQ ID NO: 544973 - RNA, 22 nt, Human
ggagcuguuggcagcuaucuug

SEQ ID NO: 544974 - RNA, 22 nt, Human
gcagugggaagguuggcacaug

SEQ ID NO: 544975 - RNA, 22 nt, Human
accugucugcaugaucuaaaac

SEQ ID NO: 544976 - RNA, 22 nt, Human
gcccugagggguggugucugua

SEQ ID NO: 544977 - RNA, 22 nt, Human
ggccaggcuggucucagacuuc

SEQ ID NO: 544978 - RNA, 22 nt, Human
cauguugaauggccuugauuuu

SEQ ID NO: 544979 - RNA, 22 nt, Human
guucuucaucuuaaccaucugu

SEQ ID NO: 544980 - RNA, 22 nt, Human
gggagguguuccaguguuggua

SEQ ID NO: 544981 - RNA, 22 nt, Human
cugagcugguggaagcaugcag

SEQ ID NO: 544982 - RNA, 22 nt, Human
ggcugccugcuccuccugcacg

SEQ ID NO: 544983 - RNA, 18 nt, Human
gcugcugguggagggagc

SEQ ID NO: 544984 - RNA, 22 nt, Human
gcagccucaaacuccccagcuc

SEQ ID NO: 544985 - RNA, 22 nt, Human
ucucugagaaguuccuuuguga

SEQ ID NO: 544986 - RNA, 22 nt, Human
guuugcauuccaauuuagggga

SEQ ID NO: 544987 - RNA, 22 nt, Human
cagcuccccucuguggggcagu

SEQ ID NO: 544988 - RNA, 22 nt, Human
ugucacauguguggcauuuuuc

SEQ ID NO: 544989 - RNA, 22 nt, Human
gggacuggcacagggcugggag

SEQ ID NO: 544990 - RNA, 22 nt, Human
uucugaauccucgaaacauagc

SEQ ID NO: 544991 - RNA, 22 nt, Human
guauuuuaagugacuacuaggu

SEQ ID NO: 544992 - RNA, 22 nt, Human
gggaccuggcaccuuugcucug

SEQ ID NO: 544993 - RNA, 22 nt, Human
uucaagucaaggaaagaggucu

SEQ ID NO: 544994 - RNA, 22 nt, Human
uugaggagcacuagucagguau

SEQ ID NO: 544995 - RNA, 22 nt, Human
gccuggaggggccaggguggua

SEQ ID NO: 544996 - RNA, 22 nt, Human
uuuucuggucacauguuauuaa

SEQ ID NO: 544997 - RNA, 22 nt, Human
caaggccaguucaccaagggca

SEQ ID NO: 544998 - RNA, 22 nt, Human
cagcuguuguguaucaggcaga

SEQ ID NO: 544999 - RNA, 22 nt, Human
agcagcugaucaaagcacuuau

SEQ ID NO: 545000 - RNA, 22 nt, Human
cuaaagaagcuagcaaucuaua

SEQ ID NO: 545001 - RNA, 22 nt, Human
ugguccuggccuugaccccagg

SEQ ID NO: 545002 - RNA, 22 nt, Human
uggagacugugcuaagggaguu

SEQ ID NO: 545003 - RNA, 22 nt, Human
agccaggccuuagggagaggca

SEQ ID NO: 545004 - RNA, 22 nt, Human
uucugaggcauagaggaugaga

SEQ ID NO: 545005 - RNA, 22 nt, Human
ugaagcagauggucuggucauu

SEQ ID NO: 545006 - RNA, 22 nt, Human
gccuggagaggaagccggugga

SEQ ID NO: 545007 - RNA, 22 nt, Human
aaaguuaguaaaaugggauaua

SEQ ID NO: 545008 - RNA, 22 nt, Human
ggcacacagcggaauuugcucu

SEQ ID NO: 545009 - RNA, 22 nt, Human
uugcaugcaccuaacaaauuau

SEQ ID NO: 545010 - RNA, 16 nt, Human
gaagcagaggguguug

SEQ ID NO: 545011 - RNA, 22 nt, Human
acaguagauggcucagagacag

SEQ ID NO: 545012 - RNA, 22 nt, Human
gcagaagcuguucgaaggccgc

SEQ ID NO: 545013 - RNA, 22 nt, Human
uuacaaagaaaauuaggcauuu

SEQ ID NO: 545014 - RNA, 22 nt, Human
caggggcucccugggugccagu

SEQ ID NO: 545015 - RNA, 22 nt, Human
acaaaguccugguguauggcca

SEQ ID NO: 545016 - RNA, 22 nt, Human
uuggaauuugcuucagcuaaua

SEQ ID NO: 545017 - RNA, 20 nt, Human
gugggcagcaggcauacugg

SEQ ID NO: 545018 - RNA, 22 nt, Human
cucugguguccuuuagaauuua

SEQ ID NO: 545019 - RNA, 22 nt, Human
cauugaaauauggaaacugaug

SEQ ID NO: 545020 - RNA, 22 nt, Human
uggaacaaucccgguuuagcuc

SEQ ID NO: 545021 - RNA, 22 nt, Human
uggcugaguuucaugcaucaug

SEQ ID NO: 545022 - RNA, 22 nt, Human
cagcugccccuccagggcuggg

SEQ ID NO: 545023 - RNA, 22 nt, Human
ccagcuuuauagcuucaaagga

SEQ ID NO: 545024 - RNA, 22 nt, Human
uuagaaaaaggcuguggucuua

SEQ ID NO: 545025 - RNA, 22 nt, Human
uucaggaugacaccauguccag

SEQ ID NO: 545026 - RNA, 22 nt, Human
ccagugggaacacuggcauugc

SEQ ID NO: 545027 - RNA, 22 nt, Human
gcucccacgcaauucuuuucag

SEQ ID NO: 545028 - RNA, 22 nt, Human
aggggaagauuauacuuuugaa

SEQ ID NO: 545029 - RNA, 22 nt, Human
gggcagauggggcacaggcuga

SEQ ID NO: 545030 - RNA, 22 nt, Human
agugaaauaugcccauugcugu

SEQ ID NO: 545031 - RNA, 22 nt, Human
ccuuagacuggagcuaugccgu

SEQ ID NO: 545032 - RNA, 22 nt, Human
ggcuucuccccuuugagucuuc

SEQ ID NO: 545033 - RNA, 22 nt, Human
auuuccaaaaccacuuauugcc

SEQ ID NO: 545034 - RNA, 22 nt, Human
agaaaucaggaacaguaaggag

SEQ ID NO: 545035 - RNA, 22 nt, Human
acacacaauuaguuuuaugcuu

SEQ ID NO: 545036 - RNA, 22 nt, Human
gagggucccugcucagggccag

SEQ ID NO: 545037 - RNA, 22 nt, Human
acaggugaccugcucauaugaa

SEQ ID NO: 545038 - RNA, 22 nt, Human
ugggacagggaaucugaucccc

SEQ ID NO: 545039 - RNA, 22 nt, Human
ugggcugccggcaggcucugcc

SEQ ID NO: 545040 - RNA, 22 nt, Human
ggcagccagcaaugagaaguuu

SEQ ID NO: 545041 - RNA, 22 nt, Human
gcuuuccuggcccugucccugc

SEQ ID NO: 545042 - RNA, 22 nt, Human
cuggccaguuacugcuauuggc

SEQ ID NO: 545043 - RNA, 22 nt, Human
agauuucaauggauauugcaag

SEQ ID NO: 545044 - RNA, 22 nt, Human
ucucugagcccagugucccccu

SEQ ID NO: 545045 - RNA, 22 nt, Human
ccuuccaggagucucugcaggu

SEQ ID NO: 545046 - RNA, 22 nt, Human
uuauugcagauggugugagaga

SEQ ID NO: 545047 - RNA, 22 nt, Human
agagucugaaugcucagaguug

SEQ ID NO: 545048 - RNA, 22 nt, Human
aggcucagucuguucaugcacu

SEQ ID NO: 545049 - RNA, 22 nt, Human
ucuaaacacgucucuuugaaua

SEQ ID NO: 545050 - RNA, 22 nt, Human
gugcugucaauugcuuucagua

SEQ ID NO: 545051 - RNA, 22 nt, Human
ugcuugucagugugcuagaaac

SEQ ID NO: 545052 - RNA, 20 nt, Human
acaauacagguugugucuga

SEQ ID NO: 545053 - RNA, 21 nt, Human
uagagccagugguguucugac

SEQ ID NO: 545054 - RNA, 22 nt, Human
ucaaaucucaucuugaauugua

SEQ ID NO: 545055 - RNA, 22 nt, Human
uucaggaugcagagguuguagu

SEQ ID NO: 545056 - RNA, 22 nt, Human
cugaggccagcugcagagcucu

SEQ ID NO: 545057 - RNA, 22 nt, Human
agggcacaagacucugagcccc

SEQ ID NO: 545058 - RNA, 22 nt, Human
auuuuuucuguaaacuggccuu

SEQ ID NO: 545059 - RNA, 22 nt, Human
acuguucaucucuuagaaagua

SEQ ID NO: 545060 - RNA, 22 nt, Human
aagaauguggguggauaugaug

SEQ ID NO: 545061 - RNA, 22 nt, Human
ggcaggcacugugcuaggcgcu

SEQ ID NO: 545062 - RNA, 22 nt, Human
cccuggaguccggagcucaccu

SEQ ID NO: 545063 - RNA, 22 nt, Human
uccccaccccagaacuacuagg

SEQ ID NO: 545064 - RNA, 22 nt, Human
agccuguggaucccugcacugg

SEQ ID NO: 545065 - RNA, 18 nt, Human
gagcugccauauuuaguu

SEQ ID NO: 545066 - RNA, 17 nt, Human
ugccagccugucccagg

SEQ ID NO: 545067 - RNA, 22 nt, Human
caggcagcucaaccuugggagc

SEQ ID NO: 545068 - RNA, 22 nt, Human
aaaucuggccccuugccuauuu

SEQ ID NO: 545069 - RNA, 22 nt, Human
uacagugucuggauaucaaagg

SEQ ID NO: 545070 - RNA, 22 nt, Human
agccuggcccugcugaacucug

SEQ ID NO: 545071 - RNA, 22 nt, Human
uaagaaacugucacaguacuau

SEQ ID NO: 545072 - RNA, 21 nt, Human
ucccacucuaaauggacugaa

SEQ ID NO: 545073 - RNA, 22 nt, Human
gggcuccuggcagucaugcuca

SEQ ID NO: 545074 - RNA, 22 nt, Human
caacauauaauauuugaguucu

SEQ ID NO: 545075 - RNA, 22 nt, Human
uggugcuguggaggggcagaag

SEQ ID NO: 545076 - RNA, 22 nt, Human
ugucccagacacaguaugcgcu

SEQ ID NO: 545077 - RNA, 22 nt, Human
agcagggcaaagucaggcuaac

SEQ ID NO: 545078 - RNA, 22 nt, Human
ggaagggaguaguuggaaugca

SEQ ID NO: 545079 - RNA, 22 nt, Human
ggcugaguugagaggauuacuu

SEQ ID NO: 545080 - RNA, 22 nt, Human
uuugucaaaucaaaccacauuc

SEQ ID NO: 545081 - RNA, 22 nt, Human
aggagagaauguuccaggcuug

SEQ ID NO: 545082 - RNA, 18 nt, Human
aggcacuggaauuaaggg

SEQ ID NO: 545083 - RNA, 21 nt, Human
cccagggaagccgcagucacc

SEQ ID NO: 545084 - RNA, 18 nt, Human
guucaaggucaagagaga

SEQ ID NO: 545085 - RNA, 22 nt, Human
aaggaagaugaaaguacugcua

SEQ ID NO: 545086 - RNA, 22 nt, Human
gccugcaggcuguaguuuguga

SEQ ID NO: 545087 - RNA, 22 nt, Human
aaugauuuccccuacacagaag

SEQ ID NO: 545088 - RNA, 22 nt, Human
ugaaaucugcaugcaaaguccu

SEQ ID NO: 545089 - RNA, 21 nt, Human
gcagaggaaugguauacauaa

SEQ ID NO: 545090 - RNA, 22 nt, Human
ugagcagaaguuauaaauaaga

SEQ ID NO: 545091 - RNA, 22 nt, Human
gccugaggaaugcuccugacuu

SEQ ID NO: 545092 - RNA, 23 nt, Human
uggagcugggcucagacccuggg

SEQ ID NO: 545093 - RNA, 22 nt, Human
uuucugaacaaagccauuauca

SEQ ID NO: 545094 - RNA, 22 nt, Human
uagcugcugcagcacagggagg

SEQ ID NO: 545095 - RNA, 22 nt, Human
uaggggugaggccaggcaucag

SEQ ID NO: 545096 - RNA, 22 nt, Human
gggagccaugcuggucuucuuu

SEQ ID NO: 545097 - RNA, 22 nt, Human
gaggcuguuagggccugaggua

SEQ ID NO: 545098 - RNA, 22 nt, Human
ggccuggagucagggaaagcaa

SEQ ID NO: 545099 - RNA, 22 nt, Human
agcuagagcugagaagcacuug

SEQ ID NO: 545100 - RNA, 22 nt, Human
uucagaaugcuauuucugaaau

SEQ ID NO: 545101 - RNA, 22 nt, Human
agagcugagaauguggcuuccu

SEQ ID NO: 545102 - RNA, 22 nt, Human
ucucauugguauauacaugugu

SEQ ID NO: 545103 - RNA, 22 nt, Human
agucagggccuggccugcugaa

SEQ ID NO: 545104 - RNA, 22 nt, Human
agagccaaguugucaaggcacu

SEQ ID NO: 545105 - RNA, 22 nt, Human
gccaaggccucugcaggaugag

SEQ ID NO: 545106 - RNA, 22 nt, Human
uccuuaauaaguacuucauugu

SEQ ID NO: 545107 - RNA, 22 nt, Human
ccaggcucugugugggcuagag

SEQ ID NO: 545108 - RNA, 22 nt, Human
gcagggacagggcagggccuuu

SEQ ID NO: 545109 - RNA, 22 nt, Human
cagauggcacagauuuagagug

SEQ ID NO: 545110 - RNA, 22 nt, Human
gcccugcccugagccguagacc

SEQ ID NO: 545111 - RNA, 22 nt, Human
aucaaaguuucccagaaguugu

SEQ ID NO: 545112 - RNA, 17 nt, Human
uguuccauuugaccacc

SEQ ID NO: 545113 - RNA, 22 nt, Human
ucagagccccuccgcuguccca

SEQ ID NO: 545114 - RNA, 22 nt, Human
ggaggugggauuaggaccuaaa

SEQ ID NO: 545115 - RNA, 22 nt, Human
agcuguguggugucugacagcu

SEQ ID NO: 545116 - RNA, 22 nt, Human
uggaagaauuuggggauaaauu

SEQ ID NO: 545117 - RNA, 22 nt, Human
gccucugcugacaagauggaca

SEQ ID NO: 545118 - RNA, 22 nt, Human
uguacagacuguauuuacaagu

SEQ ID NO: 545119 - RNA, 22 nt, Human
aggccugcagcaggagcaaacc

SEQ ID NO: 545120 - RNA, 22 nt, Human
uauucacauucucaggccuggu

SEQ ID NO: 545121 - RNA, 19 nt, Human
agggucaggacaaggacuu

SEQ ID NO: 545122 - RNA, 22 nt, Human
gcaugggcuuucucagaguucu

SEQ ID NO: 545123 - RNA, 22 nt, Human
gaugauuacacuuuuaaaacag

SEQ ID NO: 545124 - RNA, 22 nt, Human
caaugucauuucacugggcuua

SEQ ID NO: 545125 - RNA, 17 nt, Human
cagugcagagcccuuuc

SEQ ID NO: 545126 - RNA, 22 nt, Human
cagcuuuggcccagucgggagg

SEQ ID NO: 545127 - RNA, 22 nt, Human
cuggcaggaagaggaaagguca

SEQ ID NO: 545128 - RNA, 22 nt, Human
aggcugaggcagguggaucacc

SEQ ID NO: 545129 - RNA, 22 nt, Human
uacauucuacuuuuucacuccc

SEQ ID NO: 545130 - RNA, 22 nt, Human
cacaaaugacugaaacgacugu

SEQ ID NO: 545131 - RNA, 22 nt, Human
gccuggagugguccugcugccc

SEQ ID NO: 545132 - RNA, 22 nt, Human
auguguaugagugugcuucuuu

SEQ ID NO: 545133 - RNA, 22 nt, Human
ugggcucauggcccagcacugg

SEQ ID NO: 545134 - RNA, 22 nt, Human
agaggccaugcuagaggccugg

SEQ ID NO: 545135 - RNA, 22 nt, Human
agguaaugcauauaaagugcuu

SEQ ID NO: 545136 - RNA, 22 nt, Human
agaggcugucccuugcuauucc

SEQ ID NO: 545137 - RNA, 22 nt, Human
uuuuccuucugauacuccauuu

SEQ ID NO: 545138 - RNA, 22 nt, Human
cugauucuguaauuuuuccuaa

SEQ ID NO: 545139 - RNA, 22 nt, Human
cauagaaaagaguagguaaugu

SEQ ID NO: 545140 - RNA, 22 nt, Human
cuccacagccccuccaguggca

SEQ ID NO: 545141 - RNA, 22 nt, Human
ggccucugcaacuggcuguggc

SEQ ID NO: 545142 - RNA, 22 nt, Human
ucagaggaaagggaacauaguc

SEQ ID NO: 545143 - RNA, 22 nt, Human
gagccaggguuugaaacuagac

SEQ ID NO: 545144 - RNA, 22 nt, Human
aggcugagcugaccugguuugg

SEQ ID NO: 545145 - RNA, 22 nt, Human
acauuugaggauguuaagaaug

SEQ ID NO: 545146 - RNA, 22 nt, Human
ccagcccugccagagagagcug

SEQ ID NO: 545147 - RNA, 22 nt, Human
ggacccugggcuugcuccuggg

SEQ ID NO: 545148 - RNA, 21 nt, Human
uccagggaauuucaacuuuua

SEQ ID NO: 545149 - RNA, 22 nt, Human
agcaggugagcacagccaggcu

SEQ ID NO: 545150 - RNA, 22 nt, Human
ucugucacuuuuauuuacugaa

SEQ ID NO: 545151 - RNA, 22 nt, Human
ugaggccucuugguauggugug

SEQ ID NO: 545152 - RNA, 22 nt, Human
cucccugggcagauguggcucu

SEQ ID NO: 545153 - RNA, 22 nt, Human
gcacugagucugucaugcugca

SEQ ID NO: 545154 - RNA, 22 nt, Human
cacugaagguaggaccaaggcu

SEQ ID NO: 545155 - RNA, 22 nt, Human
augggcugggaauacacagggg

SEQ ID NO: 545156 - RNA, 22 nt, Human
gguggcaguuacaggggcaaau

SEQ ID NO: 545157 - RNA, 19 nt, Human
ugaggggcucacagucuca

SEQ ID NO: 545158 - RNA, 22 nt, Human
gccugcuuccuagccuuccaag

SEQ ID NO: 545159 - RNA, 22 nt, Human
aaaagcagguacucagcuuggg

SEQ ID NO: 545160 - RNA, 22 nt, Human
ccagacaggggcuguuccugcu

SEQ ID NO: 545161 - RNA, 22 nt, Human
uuggacuuaacaaagggugaug

SEQ ID NO: 545162 - RNA, 22 nt, Human
ccuggcucgcugaccucagggg

SEQ ID NO: 545163 - RNA, 20 nt, Human
accugggaaaaccuuuuccu

SEQ ID NO: 545164 - RNA, 22 nt, Human
uauuccaagcacagcaacccag

SEQ ID NO: 545165 - RNA, 22 nt, Human
cccucagcuccacccucagcag

SEQ ID NO: 545166 - RNA, 22 nt, Human
aagagcaucgguggagccccca

SEQ ID NO: 545167 - RNA, 22 nt, Human
uguccucaaggagcuucagucu

SEQ ID NO: 545168 - RNA, 22 nt, Human
acuuucuauucccacagagaua

SEQ ID NO: 545169 - RNA, 22 nt, Human
agggcagaggcggacacggaag

SEQ ID NO: 545170 - RNA, 22 nt, Human
uauuuaaaauagugcuccagca

SEQ ID NO: 545171 - RNA, 22 nt, Human
acaaauguuacauaaguuugga

SEQ ID NO: 545172 - RNA, 22 nt, Human
gaugagggccugguggcugugc

SEQ ID NO: 545173 - RNA, 22 nt, Human
gcugcuggaacaaaucacccca

SEQ ID NO: 545174 - RNA, 22 nt, Human
agggcugcaucugccuggugaa

SEQ ID NO: 545175 - RNA, 22 nt, Human
ucuuucaagggcccuaguuugg

SEQ ID NO: 545176 - RNA, 21 nt, Human
ucauuuuuauugcuaccuugc

SEQ ID NO: 545177 - RNA, 18 nt, Human
cccucuccugcuaguggg

SEQ ID NO: 545178 - RNA, 22 nt, Human
ccagagaccagaacauggggau

SEQ ID NO: 545179 - RNA, 22 nt, Human
agguaaagacugcaaggagaau

SEQ ID NO: 545180 - RNA, 22 nt, Human
auuguaacaacaauaguuuagg

SEQ ID NO: 545181 - RNA, 22 nt, Human
uuuaucugaaaaaacucuugga

SEQ ID NO: 545182 - RNA, 22 nt, Human
ugugaggagaggcccagcuccc

SEQ ID NO: 545183 - RNA, 22 nt, Human
aagggcuggagacugggucuuc

SEQ ID NO: 545184 - RNA, 22 nt, Human
ggcagcacgacaggaguggaag

SEQ ID NO: 545185 - RNA, 22 nt, Human
ugaauaugugacuuugauuuca

SEQ ID NO: 545186 - RNA, 22 nt, Human
gggaaagaagaucuagauacug

SEQ ID NO: 545187 - RNA, 22 nt, Human
caguauagaaaguuuuaaauug

SEQ ID NO: 545188 - RNA, 19 nt, Human
ggaccagguccugggcagc

SEQ ID NO: 545189 - RNA, 22 nt, Human
cugaaggauuuaguucuuugcu

SEQ ID NO: 545190 - RNA, 22 nt, Human
ucugaacauccuacaacauuuu

SEQ ID NO: 545191 - RNA, 22 nt, Human
caaaugcaggucagcagguguc

SEQ ID NO: 545192 - RNA, 22 nt, Human
ugaggggaaggcaugauaaaua

SEQ ID NO: 545193 - RNA, 22 nt, Human
uaguguuuucuagaaugguuuu

SEQ ID NO: 545194 - RNA, 20 nt, Human
agauggugaaggccagggag

SEQ ID NO: 545195 - RNA, 22 nt, Human
uccugaccugaacuggggucuu

SEQ ID NO: 545196 - RNA, 22 nt, Human
ggcaggcuccaagcauccuaug

SEQ ID NO: 545197 - RNA, 22 nt, Human
gcagggcaggauuugaacccag

SEQ ID NO: 545198 - RNA, 22 nt, Human
ccauuaaaauugugacauagga

SEQ ID NO: 545199 - RNA, 19 nt, Human
uguccuguccugcucugac

SEQ ID NO: 545200 - RNA, 22 nt, Human
ugcacacauucuauggggcuga

SEQ ID NO: 545201 - RNA, 22 nt, Human
aaucaguuucuuggcaaguuua

SEQ ID NO: 545202 - RNA, 22 nt, Human
cuucugugaaugaaguguggga

SEQ ID NO: 545203 - RNA, 22 nt, Human
caggaaagaaaugagaacacca

SEQ ID NO: 545204 - RNA, 22 nt, Human
gccaaugacagucucaguucug

SEQ ID NO: 545205 - RNA, 22 nt, Human
cccugugccagagaggcaggag

SEQ ID NO: 545206 - RNA, 22 nt, Human
gagcucagccugaggccuggcu

SEQ ID NO: 545207 - RNA, 22 nt, Human
cauuugcuuccugggucuugaa

SEQ ID NO: 545208 - RNA, 21 nt, Human
gaaggagaaagcaagugcugc

SEQ ID NO: 545209 - RNA, 22 nt, Human
ugcugugacgccucaggaaucc

SEQ ID NO: 545210 - RNA, 22 nt, Human
ggaagaggcugagccagguccc

SEQ ID NO: 545211 - RNA, 22 nt, Human
acagguggcuuauuggcugauu

SEQ ID NO: 545212 - RNA, 22 nt, Human
gaaaggagggcucacaaaagug

SEQ ID NO: 545213 - RNA, 22 nt, Human
ugggggagccuucacaguagcu

SEQ ID NO: 545214 - RNA, 22 nt, Human
cagccuucugaaugaacguacu

SEQ ID NO: 545215 - RNA, 23 nt, Human
agaaggugggccugcugaguuau

SEQ ID NO: 545216 - RNA, 22 nt, Human
uucuggggacauaacaguaagc

SEQ ID NO: 545217 - RNA, 22 nt, Human
uccagggcuggguuggcucagc

SEQ ID NO: 545218 - RNA, 22 nt, Human
uggucacaguguauugaucagg

SEQ ID NO: 545219 - RNA, 22 nt, Human
agauguggccggcuagggagag

SEQ ID NO: 545220 - RNA, 22 nt, Human
ugucaguguauacauacaguau

SEQ ID NO: 545221 - RNA, 22 nt, Human
ccuggcugggguagaagugagg

SEQ ID NO: 545222 - RNA, 22 nt, Human
uggcugaggcuuuucuuaaaga

SEQ ID NO: 545223 - RNA, 22 nt, Human
gguggccucgguggugcacagg

SEQ ID NO: 545224 - RNA, 19 nt, Human
ugaaggagggggauggcca

SEQ ID NO: 545225 - RNA, 21 nt, Human
cuguuucuugugaagugacac

SEQ ID NO: 545226 - RNA, 22 nt, Human
agcucccagagcucgagaguaa

SEQ ID NO: 545227 - RNA, 21 nt, Human
gugcucugggcagcagagggc

SEQ ID NO: 545228 - RNA, 22 nt, Human
gcucucagguacaaagcugugu

SEQ ID NO: 545229 - RNA, 22 nt, Human
ugcuggaggggccugaccagga

SEQ ID NO: 545230 - RNA, 22 nt, Human
gccuggaguagcauggcaagcc

SEQ ID NO: 545231 - RNA, 22 nt, Human
auuucaguguuuuaagaguuca

SEQ ID NO: 545232 - RNA, 22 nt, Human
uucaaagucagccaucuggcua

SEQ ID NO: 545233 - RNA, 21 nt, Human
cagcagaagcaucuauggaag

SEQ ID NO: 545234 - RNA, 22 nt, Human
uucacauuugcccuuaugugug

SEQ ID NO: 545235 - RNA, 22 nt, Human
caucucaugggcaugccaagcu

SEQ ID NO: 545236 - RNA, 22 nt, Human
cacccacccacugcucauuggc

SEQ ID NO: 545237 - RNA, 22 nt, Human
cuuugauauaaguauacauagu

SEQ ID NO: 545238 - RNA, 22 nt, Human
cucaagaaucuagggaggauuc

SEQ ID NO: 545239 - RNA, 22 nt, Human
ucccagcccagauuugugugac

SEQ ID NO: 545240 - RNA, 22 nt, Human
uguuacagaaauauugcuucuu

SEQ ID NO: 545241 - RNA, 22 nt, Human
gcugcccucccagggcaagcuu

SEQ ID NO: 545242 - RNA, 22 nt, Human
aggggcagccucacaauccucu

SEQ ID NO: 545243 - RNA, 22 nt, Human
gacuccagggauuggaagaugu

SEQ ID NO: 545244 - RNA, 22 nt, Human
uccaggcagucauuaaucucua

SEQ ID NO: 545245 - RNA, 22 nt, Human
uuucuucagccuucacaaccug

SEQ ID NO: 545246 - RNA, 22 nt, Human
agucccagccuguaggauuggg

SEQ ID NO: 545247 - RNA, 22 nt, Human
ugggcugccagcucuccagaug

SEQ ID NO: 545248 - RNA, 20 nt, Human
uauuuacaacuuagagccuc

SEQ ID NO: 545249 - RNA, 22 nt, Human
agccagugaugaagacucugga

SEQ ID NO: 545250 - RNA, 22 nt, Human
caccauuuaagaaagccaaauu

SEQ ID NO: 545251 - RNA, 22 nt, Human
ugccucagagaccugacaguac

SEQ ID NO: 545252 - RNA, 22 nt, Human
uacaacauguaaagugguuuaa

SEQ ID NO: 545253 - RNA, 21 nt, Human
ccagcugucuguccuuaggca

SEQ ID NO: 545254 - RNA, 22 nt, Human
ucaaaaauaagauauucuggac

SEQ ID NO: 545255 - RNA, 22 nt, Human
caugucuguguacacaugcaca

SEQ ID NO: 545256 - RNA, 22 nt, Human
ucagggaaauuuccauguguuu

SEQ ID NO: 545257 - RNA, 22 nt, Human
ccugggagagccaucuguggcc

SEQ ID NO: 545258 - RNA, 22 nt, Human
uaaaacuucucauuuuuauggu

SEQ ID NO: 545259 - RNA, 22 nt, Human
ggaagauuucccguagcugugc

SEQ ID NO: 545260 - RNA, 22 nt, Human
aacaaaugauuguugguuggag

SEQ ID NO: 545261 - RNA, 22 nt, Human
uagccucucuccuccacaaccu

SEQ ID NO: 545262 - RNA, 22 nt, Human
auguuugaaauuguaaguauau

SEQ ID NO: 545263 - RNA, 22 nt, Human
uaaacaaggguuacugagcaug

SEQ ID NO: 545264 - RNA, 22 nt, Human
caggcccagcccagcccuucga

SEQ ID NO: 545265 - RNA, 21 nt, Human
ggcagaaguagcauggacggg

SEQ ID NO: 545266 - RNA, 22 nt, Human
ccugggcuuucaaaaccagccu

SEQ ID NO: 545267 - RNA, 22 nt, Human
cagaggacuucccacucaucug

SEQ ID NO: 545268 - RNA, 22 nt, Human
gucuuuaugguaugaaaacuga

SEQ ID NO: 545269 - RNA, 22 nt, Human
gaggaggcuaagugggcucugg

SEQ ID NO: 545270 - RNA, 22 nt, Human
gagcagcuagauaaagcccuuc

SEQ ID NO: 545271 - RNA, 22 nt, Human
ucccaggcuaggccucugcguu

SEQ ID NO: 545272 - RNA, 22 nt, Human
ucagcagugcagggugaggcag

SEQ ID NO: 545273 - RNA, 22 nt, Human
cuauauauaucaucuuccaguu

SEQ ID NO: 545274 - RNA, 22 nt, Human
cuggcuggucaugucaugagcc

SEQ ID NO: 545275 - RNA, 22 nt, Human
ugcuggcuguauaugugagagu

SEQ ID NO: 545276 - RNA, 17 nt, Human
aagcauuuaauuugcua

SEQ ID NO: 545277 - RNA, 22 nt, Human
cagucccagaagagccugggag

SEQ ID NO: 545278 - RNA, 22 nt, Human
aagggugggcaccgccagguca

SEQ ID NO: 545279 - RNA, 22 nt, Human
uuacaauguaaggcaugguucu

SEQ ID NO: 545280 - RNA, 22 nt, Human
uacaaagucccauugccaugga

SEQ ID NO: 545281 - RNA, 21 nt, Human
uaucaagauguuaugguugaa

SEQ ID NO: 545282 - RNA, 22 nt, Human
uggcaguggcucagagugcaga

SEQ ID NO: 545283 - RNA, 22 nt, Human
cucaggaggccauucucaaggu

SEQ ID NO: 545284 - RNA, 22 nt, Human
aauaugucucuggcuagacauu

SEQ ID NO: 545285 - RNA, 22 nt, Human
uuucaucaccccaaaucuaugg

SEQ ID NO: 545286 - RNA, 22 nt, Human
caaaguaauauggucccaguga

SEQ ID NO: 545287 - RNA, 22 nt, Human
cuccagaaauucaacagcaaau

SEQ ID NO: 545288 - RNA, 22 nt, Human
uccagccuaauguucuucccac

SEQ ID NO: 545289 - RNA, 22 nt, Human
uuugaaaggaaguuaauacuuu

SEQ ID NO: 545290 - RNA, 22 nt, Human
uuaaagcaggcaucauuccuca

SEQ ID NO: 545291 - RNA, 19 nt, Human
aucuacaauuauucucagu

SEQ ID NO: 545292 - RNA, 22 nt, Human
agccaaggcagcuagagcucug

SEQ ID NO: 545293 - RNA, 22 nt, Human
guggccuggaaaggcuggucug

SEQ ID NO: 545294 - RNA, 22 nt, Human
guugggcugggagcugcccuga

SEQ ID NO: 545295 - RNA, 22 nt, Human
gcugccacuuggucaugucaug

SEQ ID NO: 545296 - RNA, 22 nt, Human
ucagguggcuuggagggggacg

SEQ ID NO: 545297 - RNA, 22 nt, Human
acaugauucuugauaggcauug

SEQ ID NO: 545298 - RNA, 22 nt, Human
ggaagaaagcacacaaacuuga

SEQ ID NO: 545299 - RNA, 22 nt, Human
gcagcguggggacaggagcuca

SEQ ID NO: 545300 - RNA, 22 nt, Human
ugaaaaaccucaguccgcuuua

SEQ ID NO: 545301 - RNA, 19 nt, Human
ucaggcaguuauucacaaa

SEQ ID NO: 545302 - RNA, 22 nt, Human
uggggagugaugccucggauaa

SEQ ID NO: 545303 - RNA, 22 nt, Human
uuacaagauaaccugaugcugu

SEQ ID NO: 545304 - RNA, 22 nt, Human
aggccuggccugggcggcauug

SEQ ID NO: 545305 - RNA, 22 nt, Human
agacacaggauucugcauuucu

SEQ ID NO: 545306 - RNA, 22 nt, Human
aaauccuaaugacaaguuuagu

SEQ ID NO: 545307 - RNA, 22 nt, Human
gaacauuuccagaaaggaacua

SEQ ID NO: 545308 - RNA, 22 nt, Human
ugcugcugacauuuggggcuug

SEQ ID NO: 545309 - RNA, 22 nt, Human
agggaaggagguuagaacccac

SEQ ID NO: 545310 - RNA, 22 nt, Human
aggccagagaggggaccagccu

SEQ ID NO: 545311 - RNA, 18 nt, Human
ugcuggcaacuacuauug

SEQ ID NO: 545312 - RNA, 22 nt, Human
ugagauuuucagcaucacuuca

SEQ ID NO: 545313 - RNA, 23 nt, Human
gagagcugacugucaagacuguu

SEQ ID NO: 545314 - RNA, 22 nt, Human
agcagagcugcaguggccugcu

SEQ ID NO: 545315 - RNA, 22 nt, Human
ucagaggaugcuguucuuuaau

SEQ ID NO: 545316 - RNA, 21 nt, Human
accuuuaauucaagcaucagg

SEQ ID NO: 545317 - RNA, 22 nt, Human
cucagagaagucuuugcuaaac

SEQ ID NO: 545318 - RNA, 22 nt, Human
aaaugguaguagcauuccauau

SEQ ID NO: 545319 - RNA, 22 nt, Human
gaaaaaugagcugaugucaggg

SEQ ID NO: 545320 - RNA, 22 nt, Human
caagauaauuuauucugaguuu

SEQ ID NO: 545321 - RNA, 20 nt, Human
ugggccucuggugccucugg

SEQ ID NO: 545322 - RNA, 22 nt, Human
caggggaguuuuaugcaacaga

SEQ ID NO: 545323 - RNA, 22 nt, Human
acaauacaggcuucuggacuua

SEQ ID NO: 545324 - RNA, 22 nt, Human
caaggccagagccagcgauaag

SEQ ID NO: 545325 - RNA, 22 nt, Human
aggccugaaguguggagugggg

SEQ ID NO: 545326 - RNA, 22 nt, Human
uggcucagaaggcugccuucac

SEQ ID NO: 545327 - RNA, 22 nt, Human
aggagcugcagauucugccuug

SEQ ID NO: 545328 - RNA, 18 nt, Human
ugcaaaggacacugagau

SEQ ID NO: 545329 - RNA, 19 nt, Human
ugcuucuggaaugcaaggc

SEQ ID NO: 545330 - RNA, 22 nt, Human
ggcccacuugaaauggagcuca

SEQ ID NO: 545331 - RNA, 22 nt, Human
aucagaaaucuaggauucagaa

SEQ ID NO: 545332 - RNA, 20 nt, Human
gcaaggcacagugaggaggg

SEQ ID NO: 545333 - RNA, 22 nt, Human
auuuguaucaaucucaauauau

SEQ ID NO: 545334 - RNA, 22 nt, Human
cauggcagagaaggggaacugg

SEQ ID NO: 545335 - RNA, 22 nt, Human
uacuuuucauaaugaagcagca

SEQ ID NO: 545336 - RNA, 22 nt, Human
aggugucugugaugggagcgau

SEQ ID NO: 545337 - RNA, 22 nt, Human
ugcagggauuguuggcauccau

SEQ ID NO: 545338 - RNA, 22 nt, Human
gaaggcugcugggaaguguggu

SEQ ID NO: 545339 - RNA, 22 nt, Human
gaggcugggaaguccaagauca

SEQ ID NO: 545340 - RNA, 19 nt, Human
gcgaggaagucacuguggc

SEQ ID NO: 545341 - RNA, 22 nt, Human
aagggcucccugccugaggugg

SEQ ID NO: 545342 - RNA, 22 nt, Human
ucagggcacguuucugcaaugc

SEQ ID NO: 545343 - RNA, 22 nt, Human
ccaguggacuucucccuguggu

SEQ ID NO: 545344 - RNA, 22 nt, Human
ggcacagcugaugcagacacac

SEQ ID NO: 545345 - RNA, 22 nt, Human
agcagggcuugccgcuuguccu

SEQ ID NO: 545346 - RNA, 22 nt, Human
uucaagucuuccaugguauucu

SEQ ID NO: 545347 - RNA, 22 nt, Human
uccaagcucucuaugccaugau

SEQ ID NO: 545348 - RNA, 22 nt, Human
ggcuuugacaugcugaauuaaa

SEQ ID NO: 545349 - RNA, 22 nt, Human
ccacccuuggguucggaggccg

SEQ ID NO: 545350 - RNA, 22 nt, Human
ugcuggcuacauuauugcuguc

SEQ ID NO: 545351 - RNA, 22 nt, Human
gcaaacaaggacauacauccug

SEQ ID NO: 545352 - RNA, 22 nt, Human
acagucaggccgagaugggccu

SEQ ID NO: 545353 - RNA, 19 nt, Human
gguuccucacgcuaagggc

SEQ ID NO: 545354 - RNA, 20 nt, Human
cagucccaauccagggccag

SEQ ID NO: 545355 - RNA, 22 nt, Human
auuuuaucugcuuacuuucagg

SEQ ID NO: 545356 - RNA, 22 nt, Human
auacauacauguacacauaaau

SEQ ID NO: 545357 - RNA, 22 nt, Human
ucugagagcaaggcauuagcag

SEQ ID NO: 545358 - RNA, 22 nt, Human
cagacaggaaguucagaagaaa

SEQ ID NO: 545359 - RNA, 22 nt, Human
ugcucuccggcuuccguggccu

SEQ ID NO: 545360 - RNA, 22 nt, Human
ugggcagggaucucuuuugcaa

SEQ ID NO: 545361 - RNA, 22 nt, Human
uaggcugggcauucuggccagg

SEQ ID NO: 545362 - RNA, 22 nt, Human
acauacacaagcguacaugaac

SEQ ID NO: 545363 - RNA, 22 nt, Human
ugccuaggaaaccucaugcuuc

SEQ ID NO: 545364 - RNA, 22 nt, Human
auuuguugaauaaauuaguauu

SEQ ID NO: 545365 - RNA, 22 nt, Human
agugcagcugggacuguagggu

SEQ ID NO: 545366 - RNA, 22 nt, Human
ugggagaggcugccaucuugca

SEQ ID NO: 545367 - RNA, 22 nt, Human
aagagguugucugugaugaguu

SEQ ID NO: 545368 - RNA, 22 nt, Human
aaaugcaauucaggaagacaag

SEQ ID NO: 545369 - RNA, 22 nt, Human
acuguggcgucaggaagaaauu

SEQ ID NO: 545370 - RNA, 21 nt, Human
gggcuggacaugguggcucau

SEQ ID NO: 545371 - RNA, 22 nt, Human
auugaaagaguuuucugcugca

SEQ ID NO: 545372 - RNA, 22 nt, Human
ccauaagguugaaaacuguaca

SEQ ID NO: 545373 - RNA, 22 nt, Human
guuccugguggucauggcagcu

SEQ ID NO: 545374 - RNA, 22 nt, Human
ugccugucagggggagugggaa

SEQ ID NO: 545375 - RNA, 22 nt, Human
ugaaggagaaauggaaaguggg

SEQ ID NO: 545376 - RNA, 22 nt, Human
agcaaggugacaucaugcugag

SEQ ID NO: 545377 - RNA, 20 nt, Human
accugccacagagaaaggua

SEQ ID NO: 545378 - RNA, 22 nt, Human
uuuaugccuccagaucuugcuu

SEQ ID NO: 545379 - RNA, 22 nt, Human
ucaaaugcggucauggcuuuua

SEQ ID NO: 545380 - RNA, 22 nt, Human
gaggcucagagagguccacaua

SEQ ID NO: 545381 - RNA, 22 nt, Human
ccucaggggucacugugaggag

SEQ ID NO: 545382 - RNA, 22 nt, Human
ccugggcuguugcaucauccuu

SEQ ID NO: 545383 - RNA, 22 nt, Human
aaagccagcaaggugaguuuca

SEQ ID NO: 545384 - RNA, 22 nt, Human
uaaugcaguacugauauaaaca

SEQ ID NO: 545385 - RNA, 22 nt, Human
gcuguucagaugcgauucagga

SEQ ID NO: 545386 - RNA, 23 nt, Human
uagcaaaguuguuugggaaauuu

SEQ ID NO: 545387 - RNA, 22 nt, Human
uccuugaagagugggcggucga

SEQ ID NO: 545388 - RNA, 22 nt, Human
gugucccaggccucuggaauua

SEQ ID NO: 545389 - RNA, 22 nt, Human
ggcgagggagcagugcgguggg

SEQ ID NO: 545390 - RNA, 22 nt, Human
gcuggccaggugcuuugguucu

SEQ ID NO: 545391 - RNA, 22 nt, Human
ucagcacuuuuacucucuuugc

SEQ ID NO: 545392 - RNA, 22 nt, Human
aaauuucaguuggaaugagcuc

SEQ ID NO: 545393 - RNA, 22 nt, Human
cugggguggaggagcuccccug

SEQ ID NO: 545394 - RNA, 22 nt, Human
auuuuaauaagauucccaagua

SEQ ID NO: 545395 - RNA, 22 nt, Human
ucucagggcagcaaggaagcau

SEQ ID NO: 545396 - RNA, 22 nt, Human
uggcagagugcagaagaggcau

SEQ ID NO: 545397 - RNA, 22 nt, Human
ucuggagugaaugaaguagugu

SEQ ID NO: 545398 - RNA, 22 nt, Human
agucucugcacaguaagaagca

SEQ ID NO: 545399 - RNA, 22 nt, Human
ugaagccauuacuguguuaggg

SEQ ID NO: 545400 - RNA, 22 nt, Human
gugcucugaguuugcaugucag

SEQ ID NO: 545401 - RNA, 22 nt, Human
ccugggcucaccaugccuugga

SEQ ID NO: 545402 - RNA, 22 nt, Human
ccacucugauuucaagggagau

SEQ ID NO: 545403 - RNA, 21 nt, Human
aaaugaaugugguagugcaag

SEQ ID NO: 545404 - RNA, 21 nt, Human
auggagccuaagaguggaggu

SEQ ID NO: 545405 - RNA, 19 nt, Human
ucaggaguuaguugugcuc

SEQ ID NO: 545406 - RNA, 22 nt, Human
cacauaagaaaugaauaugaga

SEQ ID NO: 545407 - RNA, 22 nt, Human
gcucccagcauugcugcugaau

SEQ ID NO: 545408 - RNA, 22 nt, Human
uggggugugagaaguagaggga

SEQ ID NO: 545409 - RNA, 22 nt, Human
uggagaaggccggccaggagug

SEQ ID NO: 545410 - RNA, 22 nt, Human
uguggcagcuggagguggagaa

SEQ ID NO: 545411 - RNA, 22 nt, Human
cuacacaguucugccuaauggc

SEQ ID NO: 545412 - RNA, 22 nt, Human
ugggaagaguuagagacagcug

SEQ ID NO: 545413 - RNA, 22 nt, Human
uaugcauaugaccccaagcuug

SEQ ID NO: 545414 - RNA, 22 nt, Human
gagaagucauuugaccaccuag

SEQ ID NO: 545415 - RNA, 22 nt, Human
auagaacagaaacagaugcaca

SEQ ID NO: 545416 - RNA, 22 nt, Human
agagcagugcugaagaguaggg

SEQ ID NO: 545417 - RNA, 22 nt, Human
cuccuggaagcccgcccugcug

SEQ ID NO: 545418 - RNA, 22 nt, Human
ucugaaauaacugaugccagau

SEQ ID NO: 545419 - RNA, 22 nt, Human
gagcagagcuucucaaaguaaa

SEQ ID NO: 545420 - RNA, 22 nt, Human
gccaggcuguuuuuauuacugu

SEQ ID NO: 545421 - RNA, 22 nt, Human
auuccacuuuaugucuguauga

SEQ ID NO: 545422 - RNA, 22 nt, Human
ccuggcaguuuugcccaggauu

SEQ ID NO: 545423 - RNA, 21 nt, Human
uggcugaguggaugcaugaau

SEQ ID NO: 545424 - RNA, 22 nt, Human
agucccagugagaugaaccagg

SEQ ID NO: 545425 - RNA, 22 nt, Human
uuuguuuucaaugugucauuca

SEQ ID NO: 545426 - RNA, 22 nt, Human
uuuagcagagcauaugauaucc

SEQ ID NO: 545427 - RNA, 18 nt, Human
accugccuguucuucucu

SEQ ID NO: 545428 - RNA, 22 nt, Human
uucaagaucuggguuuucagcu

SEQ ID NO: 545429 - RNA, 22 nt, Human
ugggcucucgucccugcagaag

SEQ ID NO: 545430 - RNA, 22 nt, Human
aggagcugucagagugccagag

SEQ ID NO: 545431 - RNA, 22 nt, Human
aaguuagugccuccuuaaauuu

SEQ ID NO: 545432 - RNA, 22 nt, Human
uuucauuuugguuaugccauaa

SEQ ID NO: 545433 - RNA, 22 nt, Human
uagaaacucaggauacucuucc

SEQ ID NO: 545434 - RNA, 22 nt, Human
agccaacuaggagauuaaggua

SEQ ID NO: 545435 - RNA, 22 nt, Human
cagguggcuaacggccucauag

SEQ ID NO: 545436 - RNA, 22 nt, Human
uggagggcaucuguggucaggc

SEQ ID NO: 545437 - RNA, 22 nt, Human
gcucugcugaagccccuugcau

SEQ ID NO: 545438 - RNA, 22 nt, Human
ugaaagguguccaauauuucuc

SEQ ID NO: 545439 - RNA, 22 nt, Human
gcuucugggcaccugaacagga

SEQ ID NO: 545440 - RNA, 22 nt, Human
uccugcaggccagaggggugag

SEQ ID NO: 545441 - RNA, 22 nt, Human
ggcgcucaguguugccccagag

SEQ ID NO: 545442 - RNA, 21 nt, Human
acagaguaguugaaacagaga

SEQ ID NO: 545443 - RNA, 22 nt, Human
auccugggaagcugacauugaa

SEQ ID NO: 545444 - RNA, 22 nt, Human
aggcagcaugcucugcuucuac

SEQ ID NO: 545445 - RNA, 20 nt, Human
accuggcucucaggagcaac

SEQ ID NO: 545446 - RNA, 22 nt, Human
ggggcagcuaccggaaguaggg

SEQ ID NO: 545447 - RNA, 22 nt, Human
acuuuccuagacuucagugaca

SEQ ID NO: 545448 - RNA, 22 nt, Human
uuuacagcuagacauaccugag

SEQ ID NO: 545449 - RNA, 22 nt, Human
uuucacaggauucugauguagu

SEQ ID NO: 545450 - RNA, 22 nt, Human
uucauguaauuccauaagguaa

SEQ ID NO: 545451 - RNA, 22 nt, Human
uuucaaguggcgagauaaggaa

SEQ ID NO: 545452 - RNA, 22 nt, Human
ggcuccuguggcaagacagcuu

SEQ ID NO: 545453 - RNA, 22 nt, Human
aggaugaauaacugaaauggug

SEQ ID NO: 545454 - RNA, 22 nt, Human
auucuacuuuguguaauuaucu

SEQ ID NO: 545455 - RNA, 22 nt, Human
uggccuggaaccuggcagggac

SEQ ID NO: 545456 - RNA, 21 nt, Human
ggccugaguauaggacaggcc

SEQ ID NO: 545457 - RNA, 22 nt, Human
aaacuuuaggaaggaauuuaca

SEQ ID NO: 545458 - RNA, 22 nt, Human
augagguuugagccucuugacc

SEQ ID NO: 545459 - RNA, 23 nt, Human
gcugacugugaaauucuggagcu

SEQ ID NO: 545460 - RNA, 22 nt, Human
cagggccaccguguuugcugcu

SEQ ID NO: 545461 - RNA, 22 nt, Human
gaggcugaauggccagaagcca

SEQ ID NO: 545462 - RNA, 19 nt, Human
gagcugagaguagcacugg

SEQ ID NO: 545463 - RNA, 22 nt, Human
uaacaguauagccuaacauuuc

SEQ ID NO: 545464 - RNA, 22 nt, Human
uccaggaggaggaaggcugcca

SEQ ID NO: 545465 - RNA, 22 nt, Human
uucuagaacaggcaaaaccaau

SEQ ID NO: 545466 - RNA, 22 nt, Human
aaaauacacauacuaggggaaa

SEQ ID NO: 545467 - RNA, 22 nt, Human
ugcuucugacuaagcugcauga

SEQ ID NO: 545468 - RNA, 22 nt, Human
uauuuacccuggcagcuguagc

SEQ ID NO: 545469 - RNA, 22 nt, Human
auaucaaacgaaguuauuuuaa

SEQ ID NO: 545470 - RNA, 22 nt, Human
uauuccaaugucaguuauauca

SEQ ID NO: 545471 - RNA, 22 nt, Human
ucugggcugcuaugaggcagag

SEQ ID NO: 545472 - RNA, 22 nt, Human
agaggccaggcugcagagggau

SEQ ID NO: 545473 - RNA, 23 nt, Human
gccuucagcucgggaaggcuccc

SEQ ID NO: 545474 - RNA, 22 nt, Human
cuuaaauuggaugaguuaaguu

SEQ ID NO: 545475 - RNA, 22 nt, Human
ugggaaauguguuucuggacca

SEQ ID NO: 545476 - RNA, 22 nt, Human
uguauuuuuagaccuuuagacc

SEQ ID NO: 545477 - RNA, 20 nt, Human
ugcagguguguccaagcacu

SEQ ID NO: 545478 - RNA, 22 nt, Human
ggacauuuagaacagaguauuu

SEQ ID NO: 545479 - RNA, 22 nt, Human
cagcuuuuaggacugugagaaa

SEQ ID NO: 545480 - RNA, 20 nt, Human
aggcagagcgcacuuuuaga

SEQ ID NO: 545481 - RNA, 22 nt, Human
cucuggaauuaaggaagccugu

SEQ ID NO: 545482 - RNA, 22 nt, Human
ucaggggcuugaggugcauguc

SEQ ID NO: 545483 - RNA, 22 nt, Human
aggcugagauagguggaucauu

SEQ ID NO: 545484 - RNA, 22 nt, Human
ggaggguggcagcguccugggc

SEQ ID NO: 545485 - RNA, 22 nt, Human
cucuggccgcagcucagcucug

SEQ ID NO: 545486 - RNA, 22 nt, Human
ggcaguuuggcaggauggaggg

SEQ ID NO: 545487 - RNA, 22 nt, Human
uuauuacacugaaagaauugcg

SEQ ID NO: 545488 - RNA, 22 nt, Human
cuggggcuucaaugcuucggug

SEQ ID NO: 545489 - RNA, 22 nt, Human
gcaguccucucauuggccuccu

SEQ ID NO: 545490 - RNA, 22 nt, Human
ggcugccuggaccuccucuuuc

SEQ ID NO: 545491 - RNA, 22 nt, Human
gucaggcccuggcagccgugac

SEQ ID NO: 545492 - RNA, 22 nt, Human
cuggccuuuaaaaugaccuuau

SEQ ID NO: 545493 - RNA, 22 nt, Human
gccacccugagcugggccaggg

SEQ ID NO: 545494 - RNA, 18 nt, Human
cugaggcuuagagagguu

SEQ ID NO: 545495 - RNA, 22 nt, Human
aggauguggcugagacuucugg

SEQ ID NO: 545496 - RNA, 22 nt, Human
cugcacaaauuaaucaguuaau

SEQ ID NO: 545497 - RNA, 17 nt, Human
ugaguagggaagaggag

SEQ ID NO: 545498 - RNA, 22 nt, Human
gaagagaaaggcaaggaguuuu

SEQ ID NO: 545499 - RNA, 22 nt, Human
acagguggacacagcagcaguc

SEQ ID NO: 545500 - RNA, 22 nt, Human
cugcccugcuugaugacagcga

SEQ ID NO: 545501 - RNA, 22 nt, Human
agcaggaacucagggaguucuc

SEQ ID NO: 545502 - RNA, 22 nt, Human
uucaaguagcuaaauuagcugc

SEQ ID NO: 545503 - RNA, 22 nt, Human
gggauggcucaaaggagucagg

SEQ ID NO: 545504 - RNA, 19 nt, Human
uaugacaaguacuaguucu

SEQ ID NO: 545505 - RNA, 22 nt, Human
ugcagaagaauguaggcauaag

SEQ ID NO: 545506 - RNA, 22 nt, Human
uggaagaaugcuccacagggaa

SEQ ID NO: 545507 - RNA, 22 nt, Human
cagcaccauuugcagccucuuu

SEQ ID NO: 545508 - RNA, 22 nt, Human
ugaggggagguuggggcacauc

SEQ ID NO: 545509 - RNA, 21 nt, Human
agcuggcagauauggugucug

SEQ ID NO: 545510 - RNA, 22 nt, Human
cuggggugucucgucugccauu

SEQ ID NO: 545511 - RNA, 22 nt, Human
uugucugugaaauggaaauagu

SEQ ID NO: 545512 - RNA, 22 nt, Human
cucaggccauuccuaccaaggg

SEQ ID NO: 545513 - RNA, 22 nt, Human
ugccuggcugaggugacagguu

SEQ ID NO: 545514 - RNA, 22 nt, Human
ggaaucagaauuaggauuugaa

SEQ ID NO: 545515 - RNA, 22 nt, Human
agcaaggucucccugcaccugg

SEQ ID NO: 545516 - RNA, 22 nt, Human
aggcaguggagcuggaauaggc

SEQ ID NO: 545517 - RNA, 22 nt, Human
agauguuuuguguauuucauca

SEQ ID NO: 545518 - RNA, 22 nt, Human
gcaguggaagccucuuuaagca

SEQ ID NO: 545519 - RNA, 22 nt, Human
guuaaaagaacaacucggaggu

SEQ ID NO: 545520 - RNA, 22 nt, Human
augaguaagugaaucuccaaag

SEQ ID NO: 545521 - RNA, 22 nt, Human
aggggagcaucugugaugguua

SEQ ID NO: 545522 - RNA, 22 nt, Human
uucaacaaugcacuugaguaua

SEQ ID NO: 545523 - RNA, 22 nt, Human
caggcagagucagauuagacuu

SEQ ID NO: 545524 - RNA, 22 nt, Human
aaauuaacuaucacuuuuguga

SEQ ID NO: 545525 - RNA, 22 nt, Human
aggcugagucgggaggaucacu

SEQ ID NO: 545526 - RNA, 22 nt, Human
uuuauuugucuugccauuuagu

SEQ ID NO: 545527 - RNA, 22 nt, Human
aaaugcagcagcuaauugaaaa

SEQ ID NO: 545528 - RNA, 22 nt, Human
agucucugccagcuuguccucu

SEQ ID NO: 545529 - RNA, 22 nt, Human
gcacauacccacugucaagcac

SEQ ID NO: 545530 - RNA, 22 nt, Human
uuaguuuucccaucuuuauggu

SEQ ID NO: 545531 - RNA, 22 nt, Human
gagauggcucucagaucuuuga

SEQ ID NO: 545532 - RNA, 22 nt, Human
gggcugagucugcugccuguca

SEQ ID NO: 545533 - RNA, 22 nt, Human
aauuuauuauauccuaggggaa

SEQ ID NO: 545534 - RNA, 22 nt, Human
ugcaaauagccugaugaaagaa

SEQ ID NO: 545535 - RNA, 23 nt, Human
uggccugcagaguuucugcuggg

SEQ ID NO: 545536 - RNA, 23 nt, Human
agaguuuucuguuuucuguaggg

SEQ ID NO: 545537 - RNA, 22 nt, Human
ugcugcagguguguucagugag

SEQ ID NO: 545538 - RNA, 22 nt, Human
agauacauuaguaguuacuugu

SEQ ID NO: 545539 - RNA, 22 nt, Human
cauuguuaccaucuuuuaccua

SEQ ID NO: 545540 - RNA, 22 nt, Human
gggcagguggagggcccagcca

SEQ ID NO: 545541 - RNA, 22 nt, Human
gcuggcagagagcuggugagga

SEQ ID NO: 545542 - RNA, 22 nt, Human
accagggcaaauguuuguacuc

SEQ ID NO: 545543 - RNA, 22 nt, Human
guuuacauauuuuaauugguga

SEQ ID NO: 545544 - RNA, 22 nt, Human
gcagcagaugcuuucauggaca

SEQ ID NO: 545545 - RNA, 18 nt, Human
gggaagaggaucuggccc

SEQ ID NO: 545546 - RNA, 22 nt, Human
agcaaggaguagaacaagagug

SEQ ID NO: 545547 - RNA, 20 nt, Human
uggggucuaguuggccuggg

SEQ ID NO: 545548 - RNA, 22 nt, Human
agagacugucacauaacagagg

SEQ ID NO: 545549 - RNA, 22 nt, Human
cagaauaugacaagauuuuccu

SEQ ID NO: 545550 - RNA, 22 nt, Human
cugcugugcaggugccuaugau

SEQ ID NO: 545551 - RNA, 22 nt, Human
acauuugagucauauuugcuua

SEQ ID NO: 545552 - RNA, 21 nt, Human
aggcucagagaucaaacagua

SEQ ID NO: 545553 - RNA, 22 nt, Human
uacauguucaaauuugucuuuc

SEQ ID NO: 545554 - RNA, 22 nt, Human
uucuagcuuuuugcaccaaggu

SEQ ID NO: 545555 - RNA, 22 nt, Human
aaggcugagggcuguaccuggc

SEQ ID NO: 545556 - RNA, 22 nt, Human
aguugacauccagagacauucu

SEQ ID NO: 545557 - RNA, 22 nt, Human
ucugaaauagaagugucuuucu

SEQ ID NO: 545558 - RNA, 22 nt, Human
auuuugcugugguacauuagga

SEQ ID NO: 545559 - RNA, 22 nt, Human
cccugcagcuuuugcauaguca

SEQ ID NO: 545560 - RNA, 22 nt, Human
uaagaauagucccuagaugugu

SEQ ID NO: 545561 - RNA, 21 nt, Human
aucacauuggcuguuauuauu

SEQ ID NO: 545562 - RNA, 22 nt, Human
uuuguuuacucauucauugaug

SEQ ID NO: 545563 - RNA, 22 nt, Human
agaccugcagggccaggccugc

SEQ ID NO: 545564 - RNA, 17 nt, Human
auacaguuuauuuuaca

SEQ ID NO: 545565 - RNA, 22 nt, Human
gagggcuguggggcaugaccag

SEQ ID NO: 545566 - RNA, 22 nt, Human
ggucucagcccucgccagcagc

SEQ ID NO: 545567 - RNA, 19 nt, Human
aaaugugaugguacaauuc

SEQ ID NO: 545568 - RNA, 22 nt, Human
cagcuggcgggcagagccgcca

SEQ ID NO: 545569 - RNA, 22 nt, Human
acugggcuuauuucuugugaac

SEQ ID NO: 545570 - RNA, 17 nt, Human
cucuggggacaguucua

SEQ ID NO: 545571 - RNA, 22 nt, Human
agauguggauccuaggguagaa

SEQ ID NO: 545572 - RNA, 22 nt, Human
ucagugaaccuucuguggcagg

SEQ ID NO: 545573 - RNA, 22 nt, Human
aggcagguccccuggaaggcac

SEQ ID NO: 545574 - RNA, 22 nt, Human
gcucccagcuggagccucaaca

SEQ ID NO: 545575 - RNA, 22 nt, Human
gcugccugucccaggaugagga

SEQ ID NO: 545576 - RNA, 22 nt, Human
cuucagaacuauaaaaaguacu

SEQ ID NO: 545577 - RNA, 22 nt, Human
gcagggcucauucuaguacaau

SEQ ID NO: 545578 - RNA, 22 nt, Human
agagaaaacucauugagguguc

SEQ ID NO: 545579 - RNA, 22 nt, Human
uggccucuuaggacauccucua

SEQ ID NO: 545580 - RNA, 22 nt, Human
uuugcaaugugaaauuaaagaa

SEQ ID NO: 545581 - RNA, 22 nt, Human
aagcaaaagguuacacuucugg

SEQ ID NO: 545582 - RNA, 22 nt, Human
gaugauuuucuguguuagaaga

SEQ ID NO: 545583 - RNA, 22 nt, Human
gccuguguccuucccagugggg

SEQ ID NO: 545584 - RNA, 20 nt, Human
ucuaaacaguuggcaugggg

SEQ ID NO: 545585 - RNA, 22 nt, Human
gaccugguccuuguacuuugaa

SEQ ID NO: 545586 - RNA, 17 nt, Human
gcacugaacaauccugu

SEQ ID NO: 545587 - RNA, 22 nt, Human
aaagcagccacagagagagcgu

SEQ ID NO: 545588 - RNA, 22 nt, Human
gguuggaggugggaauagcuag

SEQ ID NO: 545589 - RNA, 22 nt, Human
ggccucucucccuggcuugcag

SEQ ID NO: 545590 - RNA, 22 nt, Human
aaggaagagaauccuucucaga

SEQ ID NO: 545591 - RNA, 22 nt, Human
gguggccuuuuaugagcagggu

SEQ ID NO: 545592 - RNA, 22 nt, Human
gcugccuguggcccuucugggu

SEQ ID NO: 545593 - RNA, 23 nt, Human
agucaguguaaguuuggaaugca

SEQ ID NO: 545594 - RNA, 22 nt, Human
acacagggggcauucuaggagu

SEQ ID NO: 545595 - RNA, 22 nt, Human
ugaaccacaugcaaagugaaua

SEQ ID NO: 545596 - RNA, 22 nt, Human
uuccugggugguccugguagag

SEQ ID NO: 545597 - RNA, 19 nt, Human
ugcaggaggacugagcaga

SEQ ID NO: 545598 - RNA, 22 nt, Human
ugaaggccagcagagugaaggc

SEQ ID NO: 545599 - RNA, 19 nt, Human
gugauuucuuuccacaagc

SEQ ID NO: 545600 - RNA, 22 nt, Human
guauaucaggcagaauguucuc

SEQ ID NO: 545601 - RNA, 22 nt, Human
auugugcaauguuuuacaauuu

SEQ ID NO: 545602 - RNA, 22 nt, Human
cccagacauaacagcagagagg

SEQ ID NO: 545603 - RNA, 22 nt, Human
caugucuugcccugauuaguag

SEQ ID NO: 545604 - RNA, 22 nt, Human
aucccacaccccuacaacauau

SEQ ID NO: 545605 - RNA, 22 nt, Human
cauggcaggaggcugcuggcag

SEQ ID NO: 545606 - RNA, 22 nt, Human
gaggcaguggucugaugcaagg

SEQ ID NO: 545607 - RNA, 22 nt, Human
ugucacaguuuguacuuuauag

SEQ ID NO: 545608 - RNA, 22 nt, Human
ggcucaggacacagugguuuag

SEQ ID NO: 545609 - RNA, 22 nt, Human
uggagagcaagucgcagacaug

SEQ ID NO: 545610 - RNA, 22 nt, Human
agcaaacacaagagguaauuuc

SEQ ID NO: 545611 - RNA, 22 nt, Human
uugaaucuauguauucagugua

SEQ ID NO: 545612 - RNA, 22 nt, Human
cagggacccgcacagguagcau

SEQ ID NO: 545613 - RNA, 18 nt, Human
ucugagggugcgggagcu

SEQ ID NO: 545614 - RNA, 22 nt, Human
gcagagcuaucuucuggauuug

SEQ ID NO: 545615 - RNA, 22 nt, Human
augacaaacccaggauguaaca

SEQ ID NO: 545616 - RNA, 22 nt, Human
acaggacaggcugggcuagacu

SEQ ID NO: 545617 - RNA, 22 nt, Human
agauuucacaugcugcucuauu

SEQ ID NO: 545618 - RNA, 22 nt, Human
aucuggcucaccuggguaaaua

SEQ ID NO: 545619 - RNA, 22 nt, Human
gcaggaaagguugagacuuugc

SEQ ID NO: 545620 - RNA, 22 nt, Human
uugguccugcagaggggucugg

SEQ ID NO: 545621 - RNA, 22 nt, Human
caaagucagccagcuaguaggu

SEQ ID NO: 545622 - RNA, 22 nt, Human
uggcagcagccauggaaggccc

SEQ ID NO: 545623 - RNA, 22 nt, Human
agucuuugguuauaagagacag

SEQ ID NO: 545624 - RNA, 20 nt, Human
ccugggcuccaggagccccg

SEQ ID NO: 545625 - RNA, 22 nt, Human
acauuuguugccauucauggag

SEQ ID NO: 545626 - RNA, 20 nt, Human
agcauuugaaauaugacuau

SEQ ID NO: 545627 - RNA, 22 nt, Human
uccaugugccaaggggcagagg

SEQ ID NO: 545628 - RNA, 22 nt, Human
gugagagcucagcugcccuggg

SEQ ID NO: 545629 - RNA, 22 nt, Human
ugggugcaggaugagugcuggc

SEQ ID NO: 545630 - RNA, 22 nt, Human
ggagucccagcaaagccuuccc

SEQ ID NO: 545631 - RNA, 21 nt, Human
gucuuuuuaauugcgauuucc

SEQ ID NO: 545632 - RNA, 22 nt, Human
gcuggggagcuagaccucagca

SEQ ID NO: 545633 - RNA, 17 nt, Human
ucugucuugacugucac

SEQ ID NO: 545634 - RNA, 22 nt, Human
agaccaugggcucugaagagca

SEQ ID NO: 545635 - RNA, 22 nt, Human
uguggagaagaaggccacugca

SEQ ID NO: 545636 - RNA, 22 nt, Human
auuuuuccugggugcuuuaguu

SEQ ID NO: 545637 - RNA, 22 nt, Human
cuaguauuuaaaggcuaugauu

SEQ ID NO: 545638 - RNA, 22 nt, Human
gaggggaugcagagaggcuuau

SEQ ID NO: 545639 - RNA, 22 nt, Human
gcgucucaaggcccccaggcca

SEQ ID NO: 545640 - RNA, 22 nt, Human
uugcauuguaggauguuagaag

SEQ ID NO: 545641 - RNA, 22 nt, Human
caaagguaaagaucugcugugg

SEQ ID NO: 545642 - RNA, 22 nt, Human
aaaucaguucucccuuucuuca

SEQ ID NO: 545643 - RNA, 22 nt, Human
auuaaacaauguaaaguucuug

SEQ ID NO: 545644 - RNA, 22 nt, Human
gaggcugguaggaaaggaaaca

SEQ ID NO: 545645 - RNA, 22 nt, Human
caucacagauguuguguggagu

SEQ ID NO: 545646 - RNA, 22 nt, Human
uggaagaaaauucaaucgaguu

SEQ ID NO: 545647 - RNA, 22 nt, Human
aguuaacaaguuggcaaucaac

SEQ ID NO: 545648 - RNA, 22 nt, Human
augaauauguacacaucuguca

SEQ ID NO: 545649 - RNA, 22 nt, Human
uggcuaggcuccaagagcugga

SEQ ID NO: 545650 - RNA, 22 nt, Human
guagggacuguucucaccugag

SEQ ID NO: 545651 - RNA, 22 nt, Human
cacagccugcugcacucaagaa

SEQ ID NO: 545652 - RNA, 22 nt, Human
ucuaaauggaaagaaaauaccu

SEQ ID NO: 545653 - RNA, 22 nt, Human
gccagcugaaauuucaguucug

SEQ ID NO: 545654 - RNA, 22 nt, Human
ugaggccacuuccccacagccc

SEQ ID NO: 545655 - RNA, 22 nt, Human
uagaaacaagggagaggauucu

SEQ ID NO: 545656 - RNA, 22 nt, Human
ccagggucuuggagaggagugc

SEQ ID NO: 545657 - RNA, 22 nt, Human
auacaguaauuuguaacucauc

SEQ ID NO: 545658 - RNA, 22 nt, Human
guguggcugauugacaugguca

SEQ ID NO: 545659 - RNA, 21 nt, Human
ccccagcaccuugccagccug

SEQ ID NO: 545660 - RNA, 22 nt, Human
uauugaugcuuggauugggcca

SEQ ID NO: 545661 - RNA, 16 nt, Human
uagggcugggaaggag

SEQ ID NO: 545662 - RNA, 22 nt, Human
uccccacacagauacagaguag

SEQ ID NO: 545663 - RNA, 22 nt, Human
uuuuuccuuggaugugucucuc

SEQ ID NO: 545664 - RNA, 22 nt, Human
uuccuaaaagaauacacuggau

SEQ ID NO: 545665 - RNA, 22 nt, Human
gaggcugagacucugaauuuuu

SEQ ID NO: 545666 - RNA, 22 nt, Human
ugaucuccugaccuuguaaucc

SEQ ID NO: 545667 - RNA, 22 nt, Human
uaguaugggaagaacuuuguag

SEQ ID NO: 545668 - RNA, 19 nt, Human
caucucugcaaggagcugc

SEQ ID NO: 545669 - RNA, 22 nt, Human
gcacuguucucagagcauuaga

SEQ ID NO: 545670 - RNA, 17 nt, Human
ggcugcugugcuggugc

SEQ ID NO: 545671 - RNA, 20 nt, Human
aucagcaacugccacucagu

SEQ ID NO: 545672 - RNA, 22 nt, Human
auaaauaucacuguugucccuc

SEQ ID NO: 545673 - RNA, 22 nt, Human
gcuggcugggucccugagaggc

SEQ ID NO: 545674 - RNA, 22 nt, Human
uuuggcuugcacuggcaccaac

SEQ ID NO: 545675 - RNA, 21 nt, Human
uccuucaguucugcacuuucu

SEQ ID NO: 545676 - RNA, 22 nt, Human
cuucccacuaguaucacagagc

SEQ ID NO: 545677 - RNA, 22 nt, Human
ugugaaaugcuauuuccaugag

SEQ ID NO: 545678 - RNA, 22 nt, Human
ggccucuguuuggagccaggau

SEQ ID NO: 545679 - RNA, 22 nt, Human
ugaaguuuaagguuagauaagu

SEQ ID NO: 545680 - RNA, 22 nt, Human
aggaagaugggagagcucugga

SEQ ID NO: 545681 - RNA, 22 nt, Human
cauguacauucuguagauggag

SEQ ID NO: 545682 - RNA, 22 nt, Human
uaauguuuagaagcagacagcu

SEQ ID NO: 545683 - RNA, 22 nt, Human
uuuauacauggagaauuuuugc

SEQ ID NO: 545684 - RNA, 22 nt, Human
ccucagcucuucccugugcaca

SEQ ID NO: 545685 - RNA, 22 nt, Human
aaauacugcugcuauuccuuuu

SEQ ID NO: 545686 - RNA, 21 nt, Human
aaagagguuaauauuguaagu

SEQ ID NO: 545687 - RNA, 22 nt, Human
gcagcuggcccugacacgcaga

SEQ ID NO: 545688 - RNA, 22 nt, Human
gcugccugcucacccggccugg

SEQ ID NO: 545689 - RNA, 22 nt, Human
ggucucagacuggcaggcagug

SEQ ID NO: 545690 - RNA, 22 nt, Human
ugguccugccccgugcacagag

SEQ ID NO: 545691 - RNA, 22 nt, Human
uucccaggcugugcuaccagag

SEQ ID NO: 545692 - RNA, 23 nt, Human
ucguugaauagcaauagcacaac

SEQ ID NO: 545693 - RNA, 22 nt, Human
ucuugccucuuccccuuuccau

SEQ ID NO: 545694 - RNA, 22 nt, Human
gcagcuggagcaucuucucauc

SEQ ID NO: 545695 - RNA, 22 nt, Human
aacaucuuuguaguguucuccu

SEQ ID NO: 545696 - RNA, 22 nt, Human
agaaacuauuaugguaaacaaa

SEQ ID NO: 545697 - RNA, 22 nt, Human
cuucuaagcugagaaugccuuu

SEQ ID NO: 545698 - RNA, 22 nt, Human
gggggacuaacuggauccugga

SEQ ID NO: 545699 - RNA, 21 nt, Human
cuagagugggaccggagucua

SEQ ID NO: 545700 - RNA, 19 nt, Human
aucugccuuagugcugcug

SEQ ID NO: 545701 - RNA, 22 nt, Human
cugggaguacugggggauguca

SEQ ID NO: 545702 - RNA, 22 nt, Human
agcugccugcuuaugagcucca

SEQ ID NO: 545703 - RNA, 22 nt, Human
uagagcuguaucaaagagccuu

SEQ ID NO: 545704 - RNA, 22 nt, Human
ucaggaagucucaauuagcuac

SEQ ID NO: 545705 - RNA, 22 nt, Human
auacauauaugguacuuccugg

SEQ ID NO: 545706 - RNA, 22 nt, Human
aaaugucagagcuggaaggggc

SEQ ID NO: 545707 - RNA, 22 nt, Human
aaugcuuuaauugcauguagug

SEQ ID NO: 545708 - RNA, 22 nt, Human
ggcgugggaaguggggcuucug

SEQ ID NO: 545709 - RNA, 22 nt, Human
cagugaggugcccagccugccc

SEQ ID NO: 545710 - RNA, 17 nt, Human
ggccuugggcugcucuu

SEQ ID NO: 545711 - RNA, 22 nt, Human
aagaugugcauggguaugcaau

SEQ ID NO: 545712 - RNA, 22 nt, Human
ccuucaaauucucuuagcugaa

SEQ ID NO: 545713 - RNA, 22 nt, Human
aaagcucucccacuguaugaag

SEQ ID NO: 545714 - RNA, 22 nt, Human
ccccugccauagucaaaucuaa

SEQ ID NO: 545715 - RNA, 23 nt, Human
ucagaaugcacugaauuuacccu

SEQ ID NO: 545716 - RNA, 22 nt, Human
gaggaagucucucuacaagaaa

SEQ ID NO: 545717 - RNA, 22 nt, Human
gagcucagauucuggugucaga

SEQ ID NO: 545718 - RNA, 22 nt, Human
ccuggcuggcaagaucgugaag

SEQ ID NO: 545719 - RNA, 22 nt, Human
ccagggaguuuccaaucugaga

SEQ ID NO: 545720 - RNA, 22 nt, Human
uucauguuugccuauuugacuu

SEQ ID NO: 545721 - RNA, 22 nt, Human
uugauuuauagaauguucaagc

SEQ ID NO: 545722 - RNA, 22 nt, Human
cagacccugggccacagaggag

SEQ ID NO: 545723 - RNA, 23 nt, Human
aaauuauugcucuucaauugccu

SEQ ID NO: 545724 - RNA, 22 nt, Human
gaggcucauugcauugugcauu

SEQ ID NO: 545725 - RNA, 21 nt, Human
gcaaggcuuuuguguuuccca

SEQ ID NO: 545726 - RNA, 18 nt, Human
aaguccuuccuuugcuuu

SEQ ID NO: 545727 - RNA, 21 nt, Human
ccugggccaaauucccuggac

SEQ ID NO: 545728 - RNA, 22 nt, Human
cuggugagacgguugacaggag

SEQ ID NO: 545729 - RNA, 22 nt, Human
ugugggccucagcaggacucca

SEQ ID NO: 545730 - RNA, 22 nt, Human
uucuuuucggccugugagaagg

SEQ ID NO: 545731 - RNA, 22 nt, Human
ggugggaucaaagagucauucg

SEQ ID NO: 545732 - RNA, 22 nt, Human
ccaggcugggcggggaaccugg

SEQ ID NO: 545733 - RNA, 20 nt, Human
cccaggcagagcuagcggca

SEQ ID NO: 545734 - RNA, 22 nt, Human
aaugagaauguaagugaagaga

SEQ ID NO: 545735 - RNA, 22 nt, Human
aaaaaugucauuauggaacuga

SEQ ID NO: 545736 - RNA, 22 nt, Human
ugggcugcuucuauuggugguc

SEQ ID NO: 545737 - RNA, 22 nt, Human
caauuauucagugacuuaagag

SEQ ID NO: 545738 - RNA, 22 nt, Human
uuaagaagugauuuuccucauu

SEQ ID NO: 545739 - RNA, 22 nt, Human
uggcuucaaagguagcauacaa

SEQ ID NO: 545740 - RNA, 22 nt, Human
aaauucuucagguaauuuugau

SEQ ID NO: 545741 - RNA, 22 nt, Human
cccauggggacaccaugaagga

SEQ ID NO: 545742 - RNA, 19 nt, Human
uuucaauggcuuagagaaa

SEQ ID NO: 545743 - RNA, 22 nt, Human
gagggccacguucagggcucuc

SEQ ID NO: 545744 - RNA, 22 nt, Human
auccagaaugucuugcuggaga

SEQ ID NO: 545745 - RNA, 22 nt, Human
caucaaauaggaauauuuggca

SEQ ID NO: 545746 - RNA, 20 nt, Human
uauuuguauuugggaaaguu

SEQ ID NO: 545747 - RNA, 22 nt, Human
uaaaugugggggccacgggcuu

SEQ ID NO: 545748 - RNA, 22 nt, Human
aagggcaggaaaagauggaugu

SEQ ID NO: 545749 - RNA, 22 nt, Human
uccuggcuccacugagcaggcc

SEQ ID NO: 545750 - RNA, 22 nt, Human
caaagcagcggauugggauagu

SEQ ID NO: 545751 - RNA, 22 nt, Human
cuggagcccugaaugggcagga

SEQ ID NO: 545752 - RNA, 22 nt, Human
guuauacaguuuugggucugcu

SEQ ID NO: 545753 - RNA, 22 nt, Human
ugagcaguaggucugaauagug

SEQ ID NO: 545754 - RNA, 22 nt, Human
cagaagaguagcugaacaaguu

SEQ ID NO: 545755 - RNA, 22 nt, Human
auguuggagucguaaggcaugg

SEQ ID NO: 545756 - RNA, 20 nt, Human
agagagagguaaauugagca

SEQ ID NO: 545757 - RNA, 20 nt, Human
cugcagggugagugggcgau

SEQ ID NO: 545758 - RNA, 22 nt, Human
cagacccucgggugaguuggcc

SEQ ID NO: 545759 - RNA, 22 nt, Human
gagaaaugcaugcaugucauca

SEQ ID NO: 545760 - RNA, 17 nt, Human
gagagcugcugcuuccg

SEQ ID NO: 545761 - RNA, 22 nt, Human
acuuccuggcugggugaccugg

SEQ ID NO: 545762 - RNA, 22 nt, Human
ggaggagcacuucugagcucag

SEQ ID NO: 545763 - RNA, 22 nt, Human
acauuugagcaucuacuaagug

SEQ ID NO: 545764 - RNA, 22 nt, Human
acccugggucauauacagugug

SEQ ID NO: 545765 - RNA, 22 nt, Human
gcccucagaguuccccacagug

SEQ ID NO: 545766 - RNA, 22 nt, Human
auauuuucacagaacuugcaaa

SEQ ID NO: 545767 - RNA, 22 nt, Human
ucuucccagcugcugcgaugcc

SEQ ID NO: 545768 - RNA, 22 nt, Human
auaccuuuuagacauguaguug

SEQ ID NO: 545769 - RNA, 22 nt, Human
caagaacaguuugccaaauugg

SEQ ID NO: 545770 - RNA, 19 nt, Human
gaaaacaugggugaggguc

SEQ ID NO: 545771 - RNA, 22 nt, Human
aauauuucuggugcuucucacu

SEQ ID NO: 545772 - RNA, 22 nt, Human
aaggcacucauucaaggagaua

SEQ ID NO: 545773 - RNA, 20 nt, Human
agagccuggaaaaagacauc

SEQ ID NO: 545774 - RNA, 22 nt, Human
ggccucucauguccugggcuuc

SEQ ID NO: 545775 - RNA, 22 nt, Human
caggcuggagugcaauggcaca

SEQ ID NO: 545776 - RNA, 22 nt, Human
uguaugaagacuucuucugugu

SEQ ID NO: 545777 - RNA, 22 nt, Human
uaggaagaagcagccuugcuua

SEQ ID NO: 545778 - RNA, 22 nt, Human
gucuaaacacaaugcaagaagu

SEQ ID NO: 545779 - RNA, 22 nt, Human
uagggcagaguccaggaugggc

SEQ ID NO: 545780 - RNA, 22 nt, Human
ugggcagguuguuauuugacau

SEQ ID NO: 545781 - RNA, 22 nt, Human
agcagagcccuuccauggccuu

SEQ ID NO: 545782 - RNA, 22 nt, Human
ucacugaagacugggcucuaaa

SEQ ID NO: 545783 - RNA, 17 nt, Human
ugccugugauaagcaca

SEQ ID NO: 545784 - RNA, 22 nt, Human
acacuuuguuguggcauauacg

SEQ ID NO: 545785 - RNA, 22 nt, Human
agaagccauguuuaguaggaug

SEQ ID NO: 545786 - RNA, 22 nt, Human
ugaguucauauaguucaagaua

SEQ ID NO: 545787 - RNA, 22 nt, Human
uuucacaaguaaaguccuaagu

SEQ ID NO: 545788 - RNA, 20 nt, Human
ucugcccaccccggcuccca

SEQ ID NO: 545789 - RNA, 22 nt, Human
uggaggagaccauuccacucag

SEQ ID NO: 545790 - RNA, 19 nt, Human
aaacucauagacucauauu

SEQ ID NO: 545791 - RNA, 22 nt, Human
ugggugcaggucuugugccagg

SEQ ID NO: 545792 - RNA, 20 nt, Human
augcaaaucccaaaaucagg

SEQ ID NO: 545793 - RNA, 20 nt, Human
gcugggcuaccacuggcccu

SEQ ID NO: 545794 - RNA, 22 nt, Human
agagauaugaguaguugugaca

SEQ ID NO: 545795 - RNA, 22 nt, Human
ggcuggccucaggguccucgcu

SEQ ID NO: 545796 - RNA, 17 nt, Human
cugggccucugcccuuu

SEQ ID NO: 545797 - RNA, 19 nt, Human
aggugagugugggaaaggg

SEQ ID NO: 545798 - RNA, 22 nt, Human
auggggcucugcggcugcuccc

SEQ ID NO: 545799 - RNA, 22 nt, Human
ugagcagagcaauaggacucuc

SEQ ID NO: 545800 - RNA, 22 nt, Human
agaauucuuggugguuagaaua

SEQ ID NO: 545801 - RNA, 22 nt, Human
ggugcaugguggaggugacccu

SEQ ID NO: 545802 - RNA, 22 nt, Human
cauaagaaauuuaacagaacuu

SEQ ID NO: 545803 - RNA, 22 nt, Human
augcauugucugguuucauuuu

SEQ ID NO: 545804 - RNA, 22 nt, Human
aaauacagauucugacucagag

SEQ ID NO: 545805 - RNA, 22 nt, Human
caggaaccaggagagucccuga

SEQ ID NO: 545806 - RNA, 22 nt, Human
ggagcagccgcgucucagggca

SEQ ID NO: 545807 - RNA, 21 nt, Human
uacacaaagcgugguccagag

SEQ ID NO: 545808 - RNA, 22 nt, Human
cauuucugucacguucuuuuau

SEQ ID NO: 545809 - RNA, 22 nt, Human
uuugcaaaugcucugcagagcu

SEQ ID NO: 545810 - RNA, 22 nt, Human
uagcucuagcacuggauaaucc

SEQ ID NO: 545811 - RNA, 22 nt, Human
uacaagagugagauuaucaugu

SEQ ID NO: 545812 - RNA, 22 nt, Human
gaaggagcuaaagggagcccug

SEQ ID NO: 545813 - RNA, 22 nt, Human
gggaguggguuuggccuaggcc

SEQ ID NO: 545814 - RNA, 22 nt, Human
aauggccagcugggagaguuga

SEQ ID NO: 545815 - RNA, 22 nt, Human
cugagccaaaaagcagagcuug

SEQ ID NO: 545816 - RNA, 22 nt, Human
agcaugaaaggcgugccaacuu

SEQ ID NO: 545817 - RNA, 19 nt, Human
cuggaaggagggacuguuc

SEQ ID NO: 545818 - RNA, 22 nt, Human
cuggcuccaucacugggugaug

SEQ ID NO: 545819 - RNA, 22 nt, Human
ugagaaauggcagcauuacugg

SEQ ID NO: 545820 - RNA, 19 nt, Human
gcaugcuugguggcuucug

SEQ ID NO: 545821 - RNA, 22 nt, Human
cacagcuaccugcaugccugcu

SEQ ID NO: 545822 - RNA, 22 nt, Human
agaccagcugccucccagggcc

SEQ ID NO: 545823 - RNA, 22 nt, Human
aaggaccuauauugucagagga

SEQ ID NO: 545824 - RNA, 22 nt, Human
cccuccugugccugaggccagc

SEQ ID NO: 545825 - RNA, 18 nt, Human
acagaaauagcugugccu

SEQ ID NO: 545826 - RNA, 22 nt, Human
acaaugcaccagcaucuucacc

SEQ ID NO: 545827 - RNA, 22 nt, Human
ucaggggacagccagcuggagg

SEQ ID NO: 545828 - RNA, 22 nt, Human
gucucccaaccccugugcccag

SEQ ID NO: 545829 - RNA, 22 nt, Human
auaauuuacaacugcuuuuaau

SEQ ID NO: 545830 - RNA, 22 nt, Human
aagcaggaagcucagguccuug

SEQ ID NO: 545831 - RNA, 18 nt, Human
agcagcugucagaaugcc

SEQ ID NO: 545832 - RNA, 22 nt, Human
aaugcacacauuugguacugaa

SEQ ID NO: 545833 - RNA, 23 nt, Human
cagcugguugugggaguggcugc

SEQ ID NO: 545834 - RNA, 22 nt, Human
ugcucugcaagcaggagcaaga

SEQ ID NO: 545835 - RNA, 22 nt, Human
acacaucagaaauaugaaugag

SEQ ID NO: 545836 - RNA, 22 nt, Human
gcaguuaccuauuuuguagaaa

SEQ ID NO: 545837 - RNA, 22 nt, Human
ugggcuuuaucaugggucuggu

SEQ ID NO: 545838 - RNA, 20 nt, Human
acccugccaggcaugugaau

SEQ ID NO: 545839 - RNA, 22 nt, Human
aucaguggggacgagaaguuua

SEQ ID NO: 545840 - RNA, 22 nt, Human
ggcagcuguggacgucgucauu

SEQ ID NO: 545841 - RNA, 22 nt, Human
caugcaguuucucuaugcguag

SEQ ID NO: 545842 - RNA, 22 nt, Human
uggccuuccuggugacucauga

SEQ ID NO: 545843 - RNA, 22 nt, Human
uggccuuguguuuuagagaaag

SEQ ID NO: 545844 - RNA, 22 nt, Human
accacccucagcagagcugaaa

SEQ ID NO: 545845 - RNA, 22 nt, Human
aagggcugaaagaccuugggca

SEQ ID NO: 545846 - RNA, 22 nt, Human
uaaaugugaccuucauuuuaua

SEQ ID NO: 545847 - RNA, 22 nt, Human
auuaaagaaacccagcauguga

SEQ ID NO: 545848 - RNA, 21 nt, Human
uccucugcagugagguggccu

SEQ ID NO: 545849 - RNA, 22 nt, Human
aacucuauuuacccuacuaaac

SEQ ID NO: 545850 - RNA, 22 nt, Human
aauuucacagugaacuuugagg

SEQ ID NO: 545851 - RNA, 22 nt, Human
aaucaagaaaaugaggauucuu

SEQ ID NO: 545852 - RNA, 22 nt, Human
guggagcaaucagagggucagu

SEQ ID NO: 545853 - RNA, 22 nt, Human
aaaagcaguuaucugggaggaa

SEQ ID NO: 545854 - RNA, 22 nt, Human
caguagcacuagauaugugugg

SEQ ID NO: 545855 - RNA, 22 nt, Human
augaaauuaaucaacacauaca

SEQ ID NO: 545856 - RNA, 22 nt, Human
uaauuuaauuucaugccagccu

SEQ ID NO: 545857 - RNA, 23 nt, Human
aggcagcagguuguccaggguga

SEQ ID NO: 545858 - RNA, 22 nt, Human
agcugugguguuuucaagcccu

SEQ ID NO: 545859 - RNA, 22 nt, Human
ccucugcugcuguugagcaccg

SEQ ID NO: 545860 - RNA, 22 nt, Human
aggcuccugcaggugaggugcu

SEQ ID NO: 545861 - RNA, 22 nt, Human
ucacucagguucaugucuuugu

SEQ ID NO: 545862 - RNA, 22 nt, Human
uuucagaguuaguagagcaugu

SEQ ID NO: 545863 - RNA, 22 nt, Human
auuagagguacaaaccuucacu

SEQ ID NO: 545864 - RNA, 22 nt, Human
gcaugggcaccagucucuaggu

SEQ ID NO: 545865 - RNA, 22 nt, Human
auuuuaauaagauccauuuggu

SEQ ID NO: 545866 - RNA, 22 nt, Human
cucucccuagguuagcggucag

SEQ ID NO: 545867 - RNA, 22 nt, Human
cagguggccaguacucaaggau

SEQ ID NO: 545868 - RNA, 20 nt, Human
aggccaggaaauguaguucu

SEQ ID NO: 545869 - RNA, 22 nt, Human
uuauuauugauucgcucucaaa

SEQ ID NO: 545870 - RNA, 22 nt, Human
cagugagggcauucagugcugg

SEQ ID NO: 545871 - RNA, 22 nt, Human
cacugcagaucagaggcugaga

SEQ ID NO: 545872 - RNA, 22 nt, Human
auucuuuaauucaauugaagga

SEQ ID NO: 545873 - RNA, 22 nt, Human
cccuggcucuucaccaccugcc

SEQ ID NO: 545874 - RNA, 22 nt, Human
uauuauuaugcauagcaugaaa

SEQ ID NO: 545875 - RNA, 22 nt, Human
uaacacauaagcugagaccaug

SEQ ID NO: 545876 - RNA, 22 nt, Human
cacaacuuuaggaaccacauuc

SEQ ID NO: 545877 - RNA, 22 nt, Human
uugauuuuuccagcuucuagag

SEQ ID NO: 545878 - RNA, 22 nt, Human
uggaagggggaagacagcucug

SEQ ID NO: 545879 - RNA, 17 nt, Human
cugaggcccagggccca

SEQ ID NO: 545880 - RNA, 22 nt, Human
acccagagcugggcuuggcaaa

SEQ ID NO: 545881 - RNA, 22 nt, Human
gggcuucucuuuagugagcuga

SEQ ID NO: 545882 - RNA, 22 nt, Human
aggggccugguuggccucuguu

SEQ ID NO: 545883 - RNA, 22 nt, Human
cauuucugugacacuuccaucu

SEQ ID NO: 545884 - RNA, 22 nt, Human
agagauauuauuuaccaaguua

SEQ ID NO: 545885 - RNA, 22 nt, Human
cagagccauuauggagacuugc

SEQ ID NO: 545886 - RNA, 22 nt, Human
agggaggucuggcugcccugag

SEQ ID NO: 545887 - RNA, 22 nt, Human
ccagcccugucaccaacuggag

SEQ ID NO: 545888 - RNA, 22 nt, Human
ugaggcaguucuuacuuguauu

SEQ ID NO: 545889 - RNA, 23 nt, Human
acacauuuuucccguucugaggu

SEQ ID NO: 545890 - RNA, 22 nt, Human
uggcagucuggguuggcaguua

SEQ ID NO: 545891 - RNA, 22 nt, Human
cgggcagugcccagcggggcag

SEQ ID NO: 545892 - RNA, 22 nt, Human
uggcucagcagguuagaaacua

SEQ ID NO: 545893 - RNA, 22 nt, Human
aaugcuagugugauauguaagg

SEQ ID NO: 545894 - RNA, 22 nt, Human
cccauggagugccugagggcca

SEQ ID NO: 545895 - RNA, 22 nt, Human
uccugcugugcuuauuauccug

SEQ ID NO: 545896 - RNA, 22 nt, Human
gugggagcugcggaggccuggg

SEQ ID NO: 545897 - RNA, 22 nt, Human
gagcagaugugugccaggaugc

SEQ ID NO: 545898 - RNA, 22 nt, Human
cucaguuucuucauauuguagg

SEQ ID NO: 545899 - RNA, 21 nt, Human
ccagacuggccuaugugguag

SEQ ID NO: 545900 - RNA, 22 nt, Human
cugaaauauagaugugaacagu

SEQ ID NO: 545901 - RNA, 22 nt, Human
acugucuguccugcucuccgug

SEQ ID NO: 545902 - RNA, 22 nt, Human
auauucguggucaaguaaggcc

SEQ ID NO: 545903 - RNA, 22 nt, Human
cugccucuccccagaguggccc

SEQ ID NO: 545904 - RNA, 22 nt, Human
ugggggagauugugcaucucua

SEQ ID NO: 545905 - RNA, 22 nt, Human
uuuacaaccucauauucugaug

SEQ ID NO: 545906 - RNA, 22 nt, Human
ccagaugguauaguagggagag

SEQ ID NO: 545907 - RNA, 22 nt, Human
guggccagccccauggacaguu

SEQ ID NO: 545908 - RNA, 22 nt, Human
cuggccagggugcgaucguggu

SEQ ID NO: 545909 - RNA, 23 nt, Human
ugcucccaggugacgcugcuguu

SEQ ID NO: 545910 - RNA, 22 nt, Human
ugcagagagauccucaggguuu

SEQ ID NO: 545911 - RNA, 22 nt, Human
cuguugcaucauggcucuuaau

SEQ ID NO: 545912 - RNA, 22 nt, Human
gacauuuauuggauuuuacgag

SEQ ID NO: 545913 - RNA, 22 nt, Human
uauaucaccaaaaacaguucug

SEQ ID NO: 545914 - RNA, 22 nt, Human
auguacacaugcaugcaugugc

SEQ ID NO: 545915 - RNA, 16 nt, Human
ggagagugucugcaaa

SEQ ID NO: 545916 - RNA, 22 nt, Human
uaacaaguuucauuuauagaau

SEQ ID NO: 545917 - RNA, 22 nt, Human
ccgcccacacuaaauaugagcg

SEQ ID NO: 545918 - RNA, 22 nt, Human
agccacuuuacuuucauauuuu

SEQ ID NO: 545919 - RNA, 22 nt, Human
aagcacuugcuuagaugugguu

SEQ ID NO: 545920 - RNA, 22 nt, Human
guucuccacugcagagucucuc

SEQ ID NO: 545921 - RNA, 22 nt, Human
caggcagcagaggaguguggga

SEQ ID NO: 545922 - RNA, 22 nt, Human
uucacagacauugcagacugaa

SEQ ID NO: 545923 - RNA, 22 nt, Human
aauacuauguagccaaaauaau

SEQ ID NO: 545924 - RNA, 22 nt, Human
cugggcugaaaguguuccuuga

SEQ ID NO: 545925 - RNA, 22 nt, Human
uuaaagcugcugaauccuauuu

SEQ ID NO: 545926 - RNA, 22 nt, Human
gaggugggagggcagucccuaa

SEQ ID NO: 545927 - RNA, 22 nt, Human
agccuggagguaaugaggaaac

SEQ ID NO: 545928 - RNA, 22 nt, Human
agaggggaguccuaaucugauu

SEQ ID NO: 545929 - RNA, 22 nt, Human
cugaaggagguagagugacaua

SEQ ID NO: 545930 - RNA, 22 nt, Human
gcuggggcugggcugaggaaga

SEQ ID NO: 545931 - RNA, 22 nt, Human
uucuugaaaauagccauguaca

SEQ ID NO: 545932 - RNA, 22 nt, Human
uggcucagugcauucacaguaa

SEQ ID NO: 545933 - RNA, 23 nt, Human
uuuugugugacuuaauaucucuu

SEQ ID NO: 545934 - RNA, 22 nt, Human
aaaacuuucagggauacagaaa

SEQ ID NO: 545935 - RNA, 22 nt, Human
ucacugcagagaccucuaguca

SEQ ID NO: 545936 - RNA, 23 nt, Human
gcuuuauaguucucccaacauua

SEQ ID NO: 545937 - RNA, 22 nt, Human
uguuucuucucacacaaacuca

SEQ ID NO: 545938 - RNA, 22 nt, Human
guuucauuaccugacccaugag

SEQ ID NO: 545939 - RNA, 22 nt, Human
auuauaaaccuuugaggguggg

SEQ ID NO: 545940 - RNA, 17 nt, Human
gcucugccucucccacc

SEQ ID NO: 545941 - RNA, 22 nt, Human
ugcagccaucuuucuuggagga

SEQ ID NO: 545942 - RNA, 22 nt, Human
cugggcucuucucacccuguuu

SEQ ID NO: 545943 - RNA, 22 nt, Human
gcccucgcuucuuccuaggggu

SEQ ID NO: 545944 - RNA, 22 nt, Human
cucagcuacgcuuucaccagcu

SEQ ID NO: 545945 - RNA, 22 nt, Human
ggagacagugguagggccuaag

SEQ ID NO: 545946 - RNA, 22 nt, Human
ugaaaucauugggguugaauaa

SEQ ID NO: 545947 - RNA, 22 nt, Human
aacacugagaggggaguggcac

SEQ ID NO: 545948 - RNA, 22 nt, Human
uguguucaaugacuucaucuuu

SEQ ID NO: 545949 - RNA, 19 nt, Human
gcaggguggcagagcucuu

SEQ ID NO: 545950 - RNA, 18 nt, Human
ucuggcucaggacugaac

SEQ ID NO: 545951 - RNA, 22 nt, Human
gaggaaccacucugagaagcca

SEQ ID NO: 545952 - RNA, 22 nt, Human
agccaggguuagaagauaguca

SEQ ID NO: 545953 - RNA, 18 nt, Human
uccugggaacuugcuagc

SEQ ID NO: 545954 - RNA, 22 nt, Human
cuggcccagagagcagagcuua

SEQ ID NO: 545955 - RNA, 22 nt, Human
ugcaggcucaccugccagggcc

SEQ ID NO: 545956 - RNA, 22 nt, Human
ucaggcugguccccacagugga

SEQ ID NO: 545957 - RNA, 22 nt, Human
uucaacauguucuacauaaggg

SEQ ID NO: 545958 - RNA, 22 nt, Human
gcagagccccucaagccagccu

SEQ ID NO: 545959 - RNA, 22 nt, Human
uaaagcaaaaaugaacugccau

SEQ ID NO: 545960 - RNA, 20 nt, Human
auaaaacucuaaucuggccu

SEQ ID NO: 545961 - RNA, 22 nt, Human
gcugucugcugggucgcucagg

SEQ ID NO: 545962 - RNA, 22 nt, Human
gcuggagcuugagaggacaggg

SEQ ID NO: 545963 - RNA, 22 nt, Human
uagaaacaaguuucucuuuggg

SEQ ID NO: 545964 - RNA, 22 nt, Human
acagggccucagccagggcaga

SEQ ID NO: 545965 - RNA, 22 nt, Human
aaaugaacaucaagaauagccu

SEQ ID NO: 545966 - RNA, 21 nt, Human
uuacuuuagaaauugccuuuu

SEQ ID NO: 545967 - RNA, 22 nt, Human
uugagaagaaauaguuugcaau

SEQ ID NO: 545968 - RNA, 22 nt, Human
acacagauauuuugaauacaua

SEQ ID NO: 545969 - RNA, 22 nt, Human
uuuucuuaugugcagcuauaug

SEQ ID NO: 545970 - RNA, 22 nt, Human
augucuuuuauggagaugucau

SEQ ID NO: 545971 - RNA, 22 nt, Human
ggggcuggcucacuaagagacu

SEQ ID NO: 545972 - RNA, 22 nt, Human
caggcagagugagguggucuaa

SEQ ID NO: 545973 - RNA, 22 nt, Human
cccuggaggaaaaucugaggcu

SEQ ID NO: 545974 - RNA, 22 nt, Human
uuugaaagccuggcuuuucucu

SEQ ID NO: 545975 - RNA, 22 nt, Human
gagggguggcccuggcguguac

SEQ ID NO: 545976 - RNA, 22 nt, Human
aaggcugagguagggccuaaaa

SEQ ID NO: 545977 - RNA, 16 nt, Human
gagccaggugccuuga

SEQ ID NO: 545978 - RNA, 22 nt, Human
acauuuaacccucagguuucug

SEQ ID NO: 545979 - RNA, 22 nt, Human
accaagcuucguggaggaaguu

SEQ ID NO: 545980 - RNA, 22 nt, Human
cuggcucaauaaauauuagcug

SEQ ID NO: 545981 - RNA, 22 nt, Human
cagccagaaccuaggaugagcu

SEQ ID NO: 545982 - RNA, 21 nt, Human
uccuguaagcuuggguggcuc

SEQ ID NO: 545983 - RNA, 22 nt, Human
uguaaauugaaggaaauuugug

SEQ ID NO: 545984 - RNA, 22 nt, Human
uggccaugaaggaggcagcaga

SEQ ID NO: 545985 - RNA, 22 nt, Human
gccucugcggggcccgagcccg

SEQ ID NO: 545986 - RNA, 22 nt, Human
cagcuuuugcagacuucuugcc

SEQ ID NO: 545987 - RNA, 22 nt, Human
gccuccccugcaauuguccuug

SEQ ID NO: 545988 - RNA, 22 nt, Human
caggaggcagagguugcaguga

SEQ ID NO: 545989 - RNA, 21 nt, Human
aagcuucccugcucuccaggg

SEQ ID NO: 545990 - RNA, 22 nt, Human
uuguaacacucccacucuucuu

SEQ ID NO: 545991 - RNA, 22 nt, Human
cccacgucgaacuugcuccaga

SEQ ID NO: 545992 - RNA, 19 nt, Human
accaggcuuauggucagug

SEQ ID NO: 545993 - RNA, 22 nt, Human
uacaaagagguaauugcauaua

SEQ ID NO: 545994 - RNA, 22 nt, Human
ggugcagaaggaagggagcugg

SEQ ID NO: 545995 - RNA, 23 nt, Human
aggaaagcauucauuuuuaccau

SEQ ID NO: 545996 - RNA, 22 nt, Human
gaggcagcauucgcauagacag

SEQ ID NO: 545997 - RNA, 19 nt, Human
cacaaaugaugaggaccug

SEQ ID NO: 545998 - RNA, 22 nt, Human
caaguuauuccuuuacacuaua

SEQ ID NO: 545999 - RNA, 21 nt, Human
ugagccaggcugacggcugug

SEQ ID NO: 546000 - RNA, 22 nt, Human
cugagccagcgggcucacuuuu

SEQ ID NO: 546001 - RNA, 18 nt, Human
aggugcagccucugaggc

SEQ ID NO: 546002 - RNA, 22 nt, Human
agcuuacaccccccaagauucu

SEQ ID NO: 546003 - RNA, 22 nt, Human
cacaggccugucucuuucuaac

SEQ ID NO: 546004 - RNA, 22 nt, Human
auacaaguggccacuugaauuc

SEQ ID NO: 546005 - RNA, 23 nt, Human
gggcucagauuucauucugugcc

SEQ ID NO: 546006 - RNA, 22 nt, Human
auuugauuagcuguguaauuuu

SEQ ID NO: 546007 - RNA, 22 nt, Human
gaggggcuggcuguggucccau

SEQ ID NO: 546008 - RNA, 22 nt, Human
cauucacaauggauugcuucaa

SEQ ID NO: 546009 - RNA, 22 nt, Human
cugguuuagcuguaagguuccc

SEQ ID NO: 546010 - RNA, 22 nt, Human
agcaauauuucagcuagcaggu

SEQ ID NO: 546011 - RNA, 22 nt, Human
ucagagagcagaacuuuuuuac

SEQ ID NO: 546012 - RNA, 22 nt, Human
cugaagaggacgcagcagcaag

SEQ ID NO: 546013 - RNA, 22 nt, Human
auccagaagcauguguaauuug

SEQ ID NO: 546014 - RNA, 22 nt, Human
ugugggcccuaggcaccuuguc

SEQ ID NO: 546015 - RNA, 22 nt, Human
auuuaaaugcuuaagaggguuu

SEQ ID NO: 546016 - RNA, 20 nt, Human
cuaggaacuauggucuggcu

SEQ ID NO: 546017 - RNA, 21 nt, Human
aacauuucaggauccaaauug

SEQ ID NO: 546018 - RNA, 22 nt, Human
agcaggaggguuuuguagaguc

SEQ ID NO: 546019 - RNA, 22 nt, Human
ugccugugucacagugauguuu

SEQ ID NO: 546020 - RNA, 22 nt, Human
ccugagaccaaguugcagccau

SEQ ID NO: 546021 - RNA, 22 nt, Human
caucaucaaaacaaauggaguc

SEQ ID NO: 546022 - RNA, 22 nt, Human
uguucuuaacuuuuguguauau

SEQ ID NO: 546023 - RNA, 22 nt, Human
aggccugagccccagguuuguu

SEQ ID NO: 546024 - RNA, 22 nt, Human
auaauuaucucagacacuuguu

SEQ ID NO: 546025 - RNA, 22 nt, Human
gagggcugaugcuuacuuauuu

SEQ ID NO: 546026 - RNA, 20 nt, Human
ccuuuauuauuuguaugaug

SEQ ID NO: 546027 - RNA, 22 nt, Human
cuggaaagugcuuuucugagag

SEQ ID NO: 546028 - RNA, 22 nt, Human
ugcugaggagguggcugugcuu

SEQ ID NO: 546029 - RNA, 22 nt, Human
gucaccagugcuaagaggugga

SEQ ID NO: 546030 - RNA, 22 nt, Human
cucugagaaagcugugagcuaa

SEQ ID NO: 546031 - RNA, 22 nt, Human
gugaggugguacaauauuaacu

SEQ ID NO: 546032 - RNA, 22 nt, Human
auauauucuuaaagaaucugac

SEQ ID NO: 546033 - RNA, 22 nt, Human
auggcagacgaggcagcagggg

SEQ ID NO: 546034 - RNA, 22 nt, Human
agaagccagcuucagcugcccg

SEQ ID NO: 546035 - RNA, 22 nt, Human
guacaguuuucaguguucacug

SEQ ID NO: 546036 - RNA, 22 nt, Human
ccaggcauccauugcuuccucu

SEQ ID NO: 546037 - RNA, 20 nt, Human
gcuccccuucucugggccuc

SEQ ID NO: 546038 - RNA, 22 nt, Human
agguauuuuauagauaaguaaa

SEQ ID NO: 546039 - RNA, 22 nt, Human
caggcacuucugcugcuugucu

SEQ ID NO: 546040 - RNA, 22 nt, Human
cagcucuucccucuucuuguag

SEQ ID NO: 546041 - RNA, 22 nt, Human
ucagggaacuacuucucccuau

SEQ ID NO: 546042 - RNA, 22 nt, Human
ugauggcuaucccuggaagggc

SEQ ID NO: 546043 - RNA, 22 nt, Human
agaauauaguuaccaaauucug

SEQ ID NO: 546044 - RNA, 22 nt, Human
acacauuuucaacacugucaag

SEQ ID NO: 546045 - RNA, 22 nt, Human
agguagagcuccaguagaaaau

SEQ ID NO: 546046 - RNA, 19 nt, Human
ucugcagaaggcauacaug

SEQ ID NO: 546047 - RNA, 20 nt, Human
gcugggggugugcugaguga

SEQ ID NO: 546048 - RNA, 22 nt, Human
uguccucagauaugucuacucu

SEQ ID NO: 546049 - RNA, 22 nt, Human
gugguaaucggauucuuaccgg

SEQ ID NO: 546050 - RNA, 23 nt, Human
aaacuacaacgccaggcacugag

SEQ ID NO: 546051 - RNA, 22 nt, Human
acacagugguguuuacaaaauu

SEQ ID NO: 546052 - RNA, 22 nt, Human
ucaagucucaauguauuauggu

SEQ ID NO: 546053 - RNA, 22 nt, Human
ugcauauuuuauaaagauggaa

SEQ ID NO: 546054 - RNA, 22 nt, Human
ugcagcuguuacggacccuguc

SEQ ID NO: 546055 - RNA, 22 nt, Human
augaagaaaaauccagcugucc

SEQ ID NO: 546056 - RNA, 22 nt, Human
cucagaagaacccaggguccca

SEQ ID NO: 546057 - RNA, 23 nt, Human
ccuggggagcuguauccagagug

SEQ ID NO: 546058 - RNA, 22 nt, Human
uuugucaucaguuauuaauaug

SEQ ID NO: 546059 - RNA, 22 nt, Human
cagcucugaggaacacuccuuu

SEQ ID NO: 546060 - RNA, 21 nt, Human
gagcauggcuuacaucagcag

SEQ ID NO: 546061 - RNA, 22 nt, Human
cccaguuucaacuuuccagugg

SEQ ID NO: 546062 - RNA, 22 nt, Human
uggugguuaugcgcuuuguggg

SEQ ID NO: 546063 - RNA, 22 nt, Human
ucuggcucuauaacuccuagcu

SEQ ID NO: 546064 - RNA, 22 nt, Human
aaguucuaauuuugcauucagg

SEQ ID NO: 546065 - RNA, 22 nt, Human
uacagagagauaaguguaaaag

SEQ ID NO: 546066 - RNA, 22 nt, Human
acaaaaagcuccauuacugucc

SEQ ID NO: 546067 - RNA, 22 nt, Human
aaggaggaauaaagagguggug

SEQ ID NO: 546068 - RNA, 22 nt, Human
augcagcuucaggauuaugaug

SEQ ID NO: 546069 - RNA, 22 nt, Human
gggugggccacugagcagcgug

SEQ ID NO: 546070 - RNA, 22 nt, Human
agaggaacccagacagggcuuu

SEQ ID NO: 546071 - RNA, 22 nt, Human
cccuggcaugcaugucccuggc

SEQ ID NO: 546072 - RNA, 22 nt, Human
cccaggcuggauuucgguggca

SEQ ID NO: 546073 - RNA, 22 nt, Human
uaaggcaaguuuuuaguggaca

SEQ ID NO: 546074 - RNA, 22 nt, Human
uauuucugucagccagauaugg

SEQ ID NO: 546075 - RNA, 22 nt, Human
auucuaagucuuguucacauuc

SEQ ID NO: 546076 - RNA, 22 nt, Human
gauugaaacauaggcagucgag

SEQ ID NO: 546077 - RNA, 22 nt, Human
uucagaaucuaugugccagcuc

SEQ ID NO: 546078 - RNA, 22 nt, Human
ccugggcuuucggcggcuuccu

SEQ ID NO: 546079 - RNA, 22 nt, Human
cuggagccccagacagggagag

SEQ ID NO: 546080 - RNA, 22 nt, Human
cugaaaaacgggauuuggcugg

SEQ ID NO: 546081 - RNA, 22 nt, Human
gcuggccugggcagccugucgg

SEQ ID NO: 546082 - RNA, 22 nt, Human
aucuggcugagcgaggcccaca

SEQ ID NO: 546083 - RNA, 22 nt, Human
gagguggauguugcagugagcu

SEQ ID NO: 546084 - RNA, 22 nt, Human
uccaacuaggcacacagcuggu

SEQ ID NO: 546085 - RNA, 22 nt, Human
ggcacagagcccagcuuccuag

SEQ ID NO: 546086 - RNA, 22 nt, Human
ucuuuuggaaaugaugugcagg

SEQ ID NO: 546087 - RNA, 23 nt, Human
ugggccuggccucccaguccagc

SEQ ID NO: 546088 - RNA, 22 nt, Human
uugaaacugaguguguuugggg

SEQ ID NO: 546089 - RNA, 22 nt, Human
aagaucaccuugacaugaaaag

SEQ ID NO: 546090 - RNA, 20 nt, Human
gcuucaguuuccucacuggu

SEQ ID NO: 546091 - RNA, 22 nt, Human
uccuuaaagugcaccuccucau

SEQ ID NO: 546092 - RNA, 22 nt, Human
ucccagggugcgccugcccucg

SEQ ID NO: 546093 - RNA, 22 nt, Human
cagcagagguuuugcuccauga

SEQ ID NO: 546094 - RNA, 22 nt, Human
ugguaauuuacgcauuucugua

SEQ ID NO: 546095 - RNA, 22 nt, Human
cuggagcuaggaaguccaagau

SEQ ID NO: 546096 - RNA, 22 nt, Human
auggaagguccuacagagcgca

SEQ ID NO: 546097 - RNA, 22 nt, Human
aggcauaugauuguaaccuuua

SEQ ID NO: 546098 - RNA, 22 nt, Human
uugcaaaggggaauaaagcaau

SEQ ID NO: 546099 - RNA, 22 nt, Human
acccaggguagagugcaguggc

SEQ ID NO: 546100 - RNA, 22 nt, Human
uaaagcagucuguguaugugaa

SEQ ID NO: 546101 - RNA, 22 nt, Human
cuccuucccuucaaguguuccu

SEQ ID NO: 546102 - RNA, 22 nt, Human
agcccugcacaggucuguggcu

SEQ ID NO: 546103 - RNA, 22 nt, Human
gagagcugcauucucagacaca

SEQ ID NO: 546104 - RNA, 22 nt, Human
ggacagcccauacacaugucug

SEQ ID NO: 546105 - RNA, 22 nt, Human
uucuucagcccauaucuuccag

SEQ ID NO: 546106 - RNA, 22 nt, Human
ggagcugggacccugucaucug

SEQ ID NO: 546107 - RNA, 22 nt, Human
uaacuguaguuauaaagcuauc

SEQ ID NO: 546108 - RNA, 22 nt, Human
aauguucugcaacuguuuucau

SEQ ID NO: 546109 - RNA, 22 nt, Human
ccacauacaaauggggugcugu

SEQ ID NO: 546110 - RNA, 22 nt, Human
acaugcauacaagcacauguag

SEQ ID NO: 546111 - RNA, 22 nt, Human
gcuguucugcgucccaggcugg

SEQ ID NO: 546112 - RNA, 22 nt, Human
aagguccuguagccacagagcc

SEQ ID NO: 546113 - RNA, 22 nt, Human
gcauuucuuccuggugugagcc

SEQ ID NO: 546114 - RNA, 19 nt, Human
cugaggugcaguaagaggc

SEQ ID NO: 546115 - RNA, 22 nt, Human
ccacuugugaaauaaucaaaua

SEQ ID NO: 546116 - RNA, 20 nt, Human
auuauucauacaugugugac

SEQ ID NO: 546117 - RNA, 22 nt, Human
uggguaggggacguggaagaaa

SEQ ID NO: 546118 - RNA, 22 nt, Human
gcaugucaugucauguaggaau

SEQ ID NO: 546119 - RNA, 22 nt, Human
acaaacuuccaucaugaauuuu

SEQ ID NO: 546120 - RNA, 22 nt, Human
uaagacuucauuaguaauaugg

SEQ ID NO: 546121 - RNA, 22 nt, Human
guuucauauauaguaacugaaa

SEQ ID NO: 546122 - RNA, 22 nt, Human
cuuaaauucuuaaugcccucau

SEQ ID NO: 546123 - RNA, 22 nt, Human
cacagcuucaguuucugacuug

SEQ ID NO: 546124 - RNA, 22 nt, Human
auaagaauaauuaaguuagucc

SEQ ID NO: 546125 - RNA, 22 nt, Human
cuccagaagacccauccucaug

SEQ ID NO: 546126 - RNA, 22 nt, Human
gcucagaggcacgaccucuugg

SEQ ID NO: 546127 - RNA, 22 nt, Human
gggaaauugucaacacucucaa

SEQ ID NO: 546128 - RNA, 22 nt, Human
gguggggcuaggaccucaggau

SEQ ID NO: 546129 - RNA, 22 nt, Human
ggggcaggagguguucucuuuu

SEQ ID NO: 546130 - RNA, 22 nt, Human
cugggccaucagaggggcugga

SEQ ID NO: 546131 - RNA, 22 nt, Human
ccuaggcccuaggcuuccauca

SEQ ID NO: 546132 - RNA, 22 nt, Human
aagucaaguacuacaggaaaca

SEQ ID NO: 546133 - RNA, 22 nt, Human
ccagccuucugagcugccugga

SEQ ID NO: 546134 - RNA, 22 nt, Human
uggggcagcagaccuuucuugg

SEQ ID NO: 546135 - RNA, 22 nt, Human
cagugagggaagaucucagcac

SEQ ID NO: 546136 - RNA, 22 nt, Human
cauuucacuauucacuaaaagg

SEQ ID NO: 546137 - RNA, 22 nt, Human
ucacaggguuuggaagccuccu

SEQ ID NO: 546138 - RNA, 22 nt, Human
aaaucugggagcagcucggcca

SEQ ID NO: 546139 - RNA, 22 nt, Human
uucauugugauucuuggcuagc

SEQ ID NO: 546140 - RNA, 22 nt, Human
cagggcacggagaagucacccc

SEQ ID NO: 546141 - RNA, 22 nt, Human
ggagcuggucagccuugagcau

SEQ ID NO: 546142 - RNA, 22 nt, Human
cugggaguugacgaggcuugua

SEQ ID NO: 546143 - RNA, 20 nt, Human
cauuccugaggaauucaugu

SEQ ID NO: 546144 - RNA, 22 nt, Human
uuugugugugcucacauagaug

SEQ ID NO: 546145 - RNA, 22 nt, Human
aaaugcaaguucauauuuuguu

SEQ ID NO: 546146 - RNA, 23 nt, Human
cuagggcaguauuucacagacac

SEQ ID NO: 546147 - RNA, 22 nt, Human
auacauaauuacuuccgauguu

SEQ ID NO: 546148 - RNA, 22 nt, Human
ucuggcagggucagggcccagg

SEQ ID NO: 546149 - RNA, 22 nt, Human
caggccugugacaccgugucug

SEQ ID NO: 546150 - RNA, 22 nt, Human
cccccagccagcagugcucagc

SEQ ID NO: 546151 - RNA, 22 nt, Human
uuugucuuuccccuccucauug

SEQ ID NO: 546152 - RNA, 21 nt, Human
cagaaguaaggguaacuucuc

SEQ ID NO: 546153 - RNA, 21 nt, Human
ccagcuccaggaccuuggauc

SEQ ID NO: 546154 - RNA, 22 nt, Human
acucugggccccagguggagcu

SEQ ID NO: 546155 - RNA, 22 nt, Human
agcaggugggaucaagcuggca

SEQ ID NO: 546156 - RNA, 22 nt, Human
gccugagauucccggagccgug

SEQ ID NO: 546157 - RNA, 22 nt, Human
aauggaacuuguaauuaugucc

SEQ ID NO: 546158 - RNA, 22 nt, Human
uggcccugucugcacacaggau

SEQ ID NO: 546159 - RNA, 22 nt, Human
gaagcagaaguacgauuuacua

SEQ ID NO: 546160 - RNA, 22 nt, Human
aucugcuuguugcaugucuguu

SEQ ID NO: 546161 - RNA, 22 nt, Human
gacaugcaacaauuuggcauuu

SEQ ID NO: 546162 - RNA, 22 nt, Human
ggccuugggauguggcugcagc

SEQ ID NO: 546163 - RNA, 22 nt, Human
caauguuugugaucuacugacu

SEQ ID NO: 546164 - RNA, 22 nt, Human
uucauagaagcagaaaguaaac

SEQ ID NO: 546165 - RNA, 22 nt, Human
ggcugccauaacugauaccaua

SEQ ID NO: 546166 - RNA, 22 nt, Human
uuacaagugucagguacuggca

SEQ ID NO: 546167 - RNA, 21 nt, Human
ugggccugauucccaggguca

SEQ ID NO: 546168 - RNA, 22 nt, Human
ugcuggaggccugacuguguuu

SEQ ID NO: 546169 - RNA, 22 nt, Human
agucucuuuguauaaauaggca

SEQ ID NO: 546170 - RNA, 22 nt, Human
acucaggaagaaagcagcuggu

SEQ ID NO: 546171 - RNA, 22 nt, Human
cagaguguggcaucuuccaacu

SEQ ID NO: 546172 - RNA, 22 nt, Human
gggaagagggagcuggaaugau

SEQ ID NO: 546173 - RNA, 22 nt, Human
ugcugaaugguaaagaaguaua

SEQ ID NO: 546174 - RNA, 22 nt, Human
cugccugcugccuguggagggu

SEQ ID NO: 546175 - RNA, 22 nt, Human
uguuaacauacugcuuucuaau

SEQ ID NO: 546176 - RNA, 22 nt, Human
uguaggaagauauaaaauaucu

SEQ ID NO: 546177 - RNA, 18 nt, Human
gcugggguugagcucucc

SEQ ID NO: 546178 - RNA, 22 nt, Human
cugggccuuugggaguucggug

SEQ ID NO: 546179 - RNA, 22 nt, Human
gauggccuggguccccuuccgg

SEQ ID NO: 546180 - RNA, 22 nt, Human
uuggaauugcucauaagagaga

SEQ ID NO: 546181 - RNA, 22 nt, Human
uuuaacauguucaagaaacaua

SEQ ID NO: 546182 - RNA, 22 nt, Human
aaaaguuaccucuguaauauaa

SEQ ID NO: 546183 - RNA, 18 nt, Human
agcaggugcuguuucuuu

SEQ ID NO: 546184 - RNA, 22 nt, Human
gcucccaacucaggccuccucc

SEQ ID NO: 546185 - RNA, 22 nt, Human
uggccugaggcucggcaugggu

SEQ ID NO: 546186 - RNA, 22 nt, Human
ucaaagacuauauauuuuauuu

SEQ ID NO: 546187 - RNA, 22 nt, Human
aaccaggacaauuugaauagaa

SEQ ID NO: 546188 - RNA, 22 nt, Human
guggcgcagaggguggcagaga

SEQ ID NO: 546189 - RNA, 22 nt, Human
cauucaaacauuaauuuauuca

SEQ ID NO: 546190 - RNA, 20 nt, Human
cccuggccuguuucaugccc

SEQ ID NO: 546191 - RNA, 22 nt, Human
aauguguagcauuuaaugcagu

SEQ ID NO: 546192 - RNA, 22 nt, Human
gcugccuggcugaugaaaauuc

SEQ ID NO: 546193 - RNA, 22 nt, Human
acaccauacucauguugguucc

SEQ ID NO: 546194 - RNA, 22 nt, Human
uguggggcucccuggcagccug

SEQ ID NO: 546195 - RNA, 22 nt, Human
uucuuacauauuuucauauggu

SEQ ID NO: 546196 - RNA, 22 nt, Human
cagcugcccugccuugcccuua

SEQ ID NO: 546197 - RNA, 20 nt, Human
caugacacuguuccucugcc

SEQ ID NO: 546198 - RNA, 22 nt, Human
cccagccucuguuugcuccucu

SEQ ID NO: 546199 - RNA, 22 nt, Human
uuuucuuauagagcuuaaaguu

SEQ ID NO: 546200 - RNA, 22 nt, Human
guauugcauuguuucaagcugu

SEQ ID NO: 546201 - RNA, 22 nt, Human
guuauacacauuccuggugagg

SEQ ID NO: 546202 - RNA, 22 nt, Human
aauguguagggugccuguuuuu

SEQ ID NO: 546203 - RNA, 22 nt, Human
ucugguuagccaauaaugccaa

SEQ ID NO: 546204 - RNA, 22 nt, Human
uauuuccagcaguaagaagaca

SEQ ID NO: 546205 - RNA, 22 nt, Human
aaacaugaugccuguacuaaga

SEQ ID NO: 546206 - RNA, 22 nt, Human
uagaacaaugaauuucuggagg

SEQ ID NO: 546207 - RNA, 22 nt, Human
gcacauuucucaaagaauuguc

SEQ ID NO: 546208 - RNA, 22 nt, Human
aaugaucuggcucaggauauca

SEQ ID NO: 546209 - RNA, 22 nt, Human
ugagaaaaguacauggagaagc

SEQ ID NO: 546210 - RNA, 22 nt, Human
ccaggagcagauauggacauaa

SEQ ID NO: 546211 - RNA, 22 nt, Human
uggcugagaaaaaagagcuaua

SEQ ID NO: 546212 - RNA, 22 nt, Human
ggaggcucugcuccguguguuc

SEQ ID NO: 546213 - RNA, 22 nt, Human
uaaggccaauuaacaaccaggg

SEQ ID NO: 546214 - RNA, 22 nt, Human
caaauguguaaggaaguguuag

SEQ ID NO: 546215 - RNA, 22 nt, Human
aaauugugagcuauagaucuag

SEQ ID NO: 546216 - RNA, 19 nt, Human
aucugagauuauaaacaga

SEQ ID NO: 546217 - RNA, 22 nt, Human
cugcagggcagggccuccuggc

SEQ ID NO: 546218 - RNA, 22 nt, Human
agcaggagauggggcgugaugu

SEQ ID NO: 546219 - RNA, 22 nt, Human
augcagggagguaagaggugcc

SEQ ID NO: 546220 - RNA, 22 nt, Human
ucagucucuggggcuucuguuu

SEQ ID NO: 546221 - RNA, 22 nt, Human
ugucccaguuuugcagguuaga

SEQ ID NO: 546222 - RNA, 22 nt, Human
ucacugcagacaaccucaguca

SEQ ID NO: 546223 - RNA, 22 nt, Human
uagggcucugcucaucaguugu

SEQ ID NO: 546224 - RNA, 22 nt, Human
uuuuuaguagagguggguuuca

SEQ ID NO: 546225 - RNA, 22 nt, Human
cagggcaguuuuacuucucucu

SEQ ID NO: 546226 - RNA, 22 nt, Human
uaugucaaaguuaagaaauagg

SEQ ID NO: 546227 - RNA, 22 nt, Human
ucucaaacuacacuguaaauug

SEQ ID NO: 546228 - RNA, 22 nt, Human
gcagagcuguuaauggagcuga

SEQ ID NO: 546229 - RNA, 22 nt, Human
agauuauuuaagacaggaacca

SEQ ID NO: 546230 - RNA, 22 nt, Human
ugcuaucucuauauccauuuau

SEQ ID NO: 546231 - RNA, 22 nt, Human
cagccccucccucaggcaggug

SEQ ID NO: 546232 - RNA, 22 nt, Human
uacagugucugcaacugcacac

SEQ ID NO: 546233 - RNA, 22 nt, Human
gaagauauucucuaaauacuuu

SEQ ID NO: 546234 - RNA, 22 nt, Human
uauucacaaaaugagguccuca

SEQ ID NO: 546235 - RNA, 22 nt, Human
acugccuguagcccugagaugu

SEQ ID NO: 546236 - RNA, 22 nt, Human
ggggcugacgggcauguggcuu

SEQ ID NO: 546237 - RNA, 18 nt, Human
gaggccugagaaccaggu

SEQ ID NO: 546238 - RNA, 22 nt, Human
aggcaguggcugagaccagggg

SEQ ID NO: 546239 - RNA, 23 nt, Human
uccuuugucuuugcauagauggu

SEQ ID NO: 546240 - RNA, 22 nt, Human
gggcugacgaaggccaugugug

SEQ ID NO: 546241 - RNA, 23 nt, Human
auuuccuacuauaaaagagguaa

SEQ ID NO: 546242 - RNA, 22 nt, Human
ucccagagcaguacuccaggag

SEQ ID NO: 546243 - RNA, 22 nt, Human
aagacaagcaucaaaucaggca

SEQ ID NO: 546244 - RNA, 22 nt, Human
augcugugccuggaaagcggcu

SEQ ID NO: 546245 - RNA, 22 nt, Human
uaugcagugguaucauuuuaaa

SEQ ID NO: 546246 - RNA, 22 nt, Human
cugcagccucaaccuccugagc

SEQ ID NO: 546247 - RNA, 22 nt, Human
gagauuuucagcuugacuggga

SEQ ID NO: 546248 - RNA, 21 nt, Human
uggccucccacacuuccaugg

SEQ ID NO: 546249 - RNA, 22 nt, Human
gcuagaggcaacaacuuuauag

SEQ ID NO: 546250 - RNA, 22 nt, Human
ugggcaggugcuauuuuccaug

SEQ ID NO: 546251 - RNA, 22 nt, Human
cagcuggccugaucccuguggc

SEQ ID NO: 546252 - RNA, 22 nt, Human
gcagugggagcuuaggcagugc

SEQ ID NO: 546253 - RNA, 22 nt, Human
gcaggaugggagcuucacucug

SEQ ID NO: 546254 - RNA, 22 nt, Human
ucacauuuuaucuauuuuaagu

SEQ ID NO: 546255 - RNA, 22 nt, Human
gugguccuguccugacggcuuc

SEQ ID NO: 546256 - RNA, 22 nt, Human
cucuugggagugcucuggagaa

SEQ ID NO: 546257 - RNA, 20 nt, Human
agcugaggcaccugagguua

SEQ ID NO: 546258 - RNA, 22 nt, Human
ucauuacaguguuuauaugucu

SEQ ID NO: 546259 - RNA, 22 nt, Human
agugacagcugggaaggugaaa

SEQ ID NO: 546260 - RNA, 22 nt, Human
gcugcagcuuuaggauccagug

SEQ ID NO: 546261 - RNA, 22 nt, Human
aaacagugauguugaguguaaa

SEQ ID NO: 546262 - RNA, 22 nt, Human
uggcaaauauuuuguuuuguaa

SEQ ID NO: 546263 - RNA, 22 nt, Human
ccugggccucacccagcucuug

SEQ ID NO: 546264 - RNA, 22 nt, Human
uuucacagguacaaacacuccu

SEQ ID NO: 546265 - RNA, 22 nt, Human
aguguacauaguuaggaacauc

SEQ ID NO: 546266 - RNA, 21 nt, Human
uucccagcaccuagcacaggu

SEQ ID NO: 546267 - RNA, 22 nt, Human
aggcacaggccucagcacccag

SEQ ID NO: 546268 - RNA, 21 nt, Human
aagcagggacugcccaggucc

SEQ ID NO: 546269 - RNA, 22 nt, Human
aaagagggacaggcgcagacac

SEQ ID NO: 546270 - RNA, 23 nt, Human
aacacaaagcugauuccaguggc

SEQ ID NO: 546271 - RNA, 22 nt, Human
gggcacugcuggaggcucccug

SEQ ID NO: 546272 - RNA, 18 nt, Human
auuuugaacaaugcugua

SEQ ID NO: 546273 - RNA, 22 nt, Human
cacugcauggaugauggcugua

SEQ ID NO: 546274 - RNA, 22 nt, Human
aauaagugaguuuagcaaguuu

SEQ ID NO: 546275 - RNA, 22 nt, Human
cugcccaggggagugcugucgg

SEQ ID NO: 546276 - RNA, 19 nt, Human
agcugggcugucacaguga

SEQ ID NO: 546277 - RNA, 22 nt, Human
cagagcuggcggugagaagaca

SEQ ID NO: 546278 - RNA, 22 nt, Human
uccugagaugcugauuucgggg

SEQ ID NO: 546279 - RNA, 22 nt, Human
gcgaaaaauguguaaauauguu

SEQ ID NO: 546280 - RNA, 22 nt, Human
ccagucagucaguugcuggcau

SEQ ID NO: 546281 - RNA, 18 nt, Human
gcaaggcucaggccaggc

SEQ ID NO: 546282 - RNA, 22 nt, Human
cuggagagaccgaaagaggcug

SEQ ID NO: 546283 - RNA, 22 nt, Human
ugugccuggcauucugggcuuc

SEQ ID NO: 546284 - RNA, 22 nt, Human
gcaaaguuccuacuuuacugga

SEQ ID NO: 546285 - RNA, 22 nt, Human
cccagcacaggcaauuccauac

SEQ ID NO: 546286 - RNA, 22 nt, Human
ugauugaagaggugaggaaguu

SEQ ID NO: 546287 - RNA, 22 nt, Human
aaaagcaagaggcuggauuaaa

SEQ ID NO: 546288 - RNA, 22 nt, Human
guuauguaucuugauugggugg

SEQ ID NO: 546289 - RNA, 22 nt, Human
cuccccaccuucgcggucccug

SEQ ID NO: 546290 - RNA, 22 nt, Human
aaagcaggguccaaggagaugu

SEQ ID NO: 546291 - RNA, 22 nt, Human
agcccaggagguggagguugca

SEQ ID NO: 546292 - RNA, 22 nt, Human
gaaaugcaaauucucucucgcu

SEQ ID NO: 546293 - RNA, 22 nt, Human
aggcacugcagauuacaggcgc

SEQ ID NO: 546294 - RNA, 22 nt, Human
aaaggcaaaauucuuagcagga

SEQ ID NO: 546295 - RNA, 22 nt, Human
aaaggucagcugccaucguucu

SEQ ID NO: 546296 - RNA, 22 nt, Human
uuccuguccgcaauggccuggg

SEQ ID NO: 546297 - RNA, 22 nt, Human
aggcacuggguaauuaguagcu

SEQ ID NO: 546298 - RNA, 22 nt, Human
gauauuuugagaaauccuauga

SEQ ID NO: 546299 - RNA, 22 nt, Human
auauuagggucucuaaauucua

SEQ ID NO: 546300 - RNA, 22 nt, Human
cugggcuuugguacugugauua

SEQ ID NO: 546301 - RNA, 22 nt, Human
cacucuccagcacaccccauuu

SEQ ID NO: 546302 - RNA, 21 nt, Human
uccugggagucugagauccug

SEQ ID NO: 546303 - RNA, 17 nt, Human
cccagagaugcugccuu

SEQ ID NO: 546304 - RNA, 22 nt, Human
gcaggaagaggcucgaagcccc

SEQ ID NO: 546305 - RNA, 22 nt, Human
ccaggugcucuugccagggcug

SEQ ID NO: 546306 - RNA, 22 nt, Human
gggcuggaggaccggccucgga

SEQ ID NO: 546307 - RNA, 22 nt, Human
aggcuucccaagcagcugcaaa

SEQ ID NO: 546308 - RNA, 18 nt, Human
acccauuauauuuguagc

SEQ ID NO: 546309 - RNA, 22 nt, Human
uaccuugggguuuuguugcucu

SEQ ID NO: 546310 - RNA, 22 nt, Human
ggcuucuguccucuggaucugu

SEQ ID NO: 546311 - RNA, 22 nt, Human
auucuagaguuucaauccaagg

SEQ ID NO: 546312 - RNA, 22 nt, Human
ggcagcaguccauggcccaagg

SEQ ID NO: 546313 - RNA, 22 nt, Human
uuuguguguauauccuuccaga

SEQ ID NO: 546314 - RNA, 22 nt, Human
acauucuaugguugaugaguug

SEQ ID NO: 546315 - RNA, 22 nt, Human
acuccagaauccuagggucagc

SEQ ID NO: 546316 - RNA, 22 nt, Human
uuggcagugaugcagcuuguuc

SEQ ID NO: 546317 - RNA, 22 nt, Human
acagcaguuacugaaauaaagu

SEQ ID NO: 546318 - RNA, 20 nt, Human
agucacaugcauacacaagu

SEQ ID NO: 546319 - RNA, 21 nt, Human
gaaaggucuuaacuuacagag

SEQ ID NO: 546320 - RNA, 22 nt, Human
uugacagcaaagauugugccua

SEQ ID NO: 546321 - RNA, 22 nt, Human
ucagcacuauacauuuugaaua

SEQ ID NO: 546322 - RNA, 16 nt, Human
ggagguggguaaggug

SEQ ID NO: 546323 - RNA, 22 nt, Human
auuacagaaauauggucaaaga

SEQ ID NO: 546324 - RNA, 22 nt, Human
guuucuaagggagagcugccag

SEQ ID NO: 546325 - RNA, 17 nt, Human
agagagaaaagggccau

SEQ ID NO: 546326 - RNA, 21 nt, Human
caaaugcuggcuggaugagga

SEQ ID NO: 546327 - RNA, 22 nt, Human
uaauuuuaacugugcuguuugg

SEQ ID NO: 546328 - RNA, 22 nt, Human
auccagagagguuaggugacau

SEQ ID NO: 546329 - RNA, 22 nt, Human
cagaggccccagaacuagcucu

SEQ ID NO: 546330 - RNA, 22 nt, Human
uuacaguauuguuaaacucuuu

SEQ ID NO: 546331 - RNA, 18 nt, Human
ccuggcagccaugcgcgc

SEQ ID NO: 546332 - RNA, 22 nt, Human
gcugagagcggccagcugggaa

SEQ ID NO: 546333 - RNA, 22 nt, Human
aauaauacaugagauuaauguu

SEQ ID NO: 546334 - RNA, 22 nt, Human
ccagaagaccggggagucaggg

SEQ ID NO: 546335 - RNA, 22 nt, Human
gaggccuggcugucagucccca

SEQ ID NO: 546336 - RNA, 22 nt, Human
uccugcagcugauaaauacagu

SEQ ID NO: 546337 - RNA, 22 nt, Human
gugcagcugagggccucuucua

SEQ ID NO: 546338 - RNA, 20 nt, Human
caguccaaucagaggccacc

SEQ ID NO: 546339 - RNA, 22 nt, Human
agcugcccuucucuugcccuug

SEQ ID NO: 546340 - RNA, 22 nt, Human
caaaguacagugcuuccuggga

SEQ ID NO: 546341 - RNA, 22 nt, Human
aaagguuaagguguucaagaaa

SEQ ID NO: 546342 - RNA, 22 nt, Human
cugaggcugaagagggccuacg

SEQ ID NO: 546343 - RNA, 22 nt, Human
gcagagccgugaauggauuuca

SEQ ID NO: 546344 - RNA, 22 nt, Human
ccacuguagagauuugaaugcc

SEQ ID NO: 546345 - RNA, 22 nt, Human
gggcugucaugugucagugacc

SEQ ID NO: 546346 - RNA, 22 nt, Human
uagaaaugauuuugaugcuuca

SEQ ID NO: 546347 - RNA, 22 nt, Human
aaguucaaggugauaguggcag

SEQ ID NO: 546348 - RNA, 22 nt, Human
gcaaauucuuaacuggacugug

SEQ ID NO: 546349 - RNA, 22 nt, Human
uuauggcauauuccucauugua

SEQ ID NO: 546350 - RNA, 23 nt, Human
aggcacugaaugugucagugagu

SEQ ID NO: 546351 - RNA, 20 nt, Human
uucauuuguugagcaccuuc

SEQ ID NO: 546352 - RNA, 22 nt, Human
uggaggagggcuggugucugua

SEQ ID NO: 546353 - RNA, 22 nt, Human
auuuguaacacgugacagguug

SEQ ID NO: 546354 - RNA, 22 nt, Human
agaguguuucagucuuccuaga

SEQ ID NO: 546355 - RNA, 22 nt, Human
uacaaagugggaaacgaagguu

SEQ ID NO: 546356 - RNA, 22 nt, Human
cacaauuuuaauacacagucaa

SEQ ID NO: 546357 - RNA, 22 nt, Human
ugcaggcuggauuugcuuuugu

SEQ ID NO: 546358 - RNA, 22 nt, Human
guuuauuauucaacuucauguu

SEQ ID NO: 546359 - RNA, 22 nt, Human
caucuuuaaaggggagacaccc

SEQ ID NO: 546360 - RNA, 22 nt, Human
guaagagcacugucuccugcug

SEQ ID NO: 546361 - RNA, 22 nt, Human
uguuacaguacuacaauucugc

SEQ ID NO: 546362 - RNA, 22 nt, Human
agccucugucaagcuuuucaaa

SEQ ID NO: 546363 - RNA, 19 nt, Human
gagaggccugugcuugaag

SEQ ID NO: 546364 - RNA, 22 nt, Human
uggcagcugucuguggggucuc

SEQ ID NO: 546365 - RNA, 21 nt, Human
agauuauaaagaaccuucuua

SEQ ID NO: 546366 - RNA, 22 nt, Human
agagcugcaggguggacccagg

SEQ ID NO: 546367 - RNA, 22 nt, Human
uuuagcagaucuauguauguga

SEQ ID NO: 546368 - RNA, 22 nt, Human
cccuggagugugacgaggcauu

SEQ ID NO: 546369 - RNA, 22 nt, Human
ccaaacaaauccccauucuuag

SEQ ID NO: 546370 - RNA, 22 nt, Human
ccccaccugugcgucugccgca

SEQ ID NO: 546371 - RNA, 22 nt, Human
ucuuccagcaaugugaaaucac

SEQ ID NO: 546372 - RNA, 22 nt, Human
gugcucuguguauuaggauguc

SEQ ID NO: 546373 - RNA, 22 nt, Human
aagauggucuugagauauuaua

SEQ ID NO: 546374 - RNA, 22 nt, Human
auaguacacauccuacaauguu

SEQ ID NO: 546375 - RNA, 22 nt, Human
uccuuaaaugugaucuagauuu

SEQ ID NO: 546376 - RNA, 22 nt, Human
gcuggcuuuugaagucuagcua

SEQ ID NO: 546377 - RNA, 22 nt, Human
gcaaagguagccaaggagcuca

SEQ ID NO: 546378 - RNA, 22 nt, Human
cagggaggaugggcuguuuugc

SEQ ID NO: 546379 - RNA, 22 nt, Human
ugaaacauugcacuguaugaau

SEQ ID NO: 546380 - RNA, 22 nt, Human
cagugaggcucugcugagcggu

SEQ ID NO: 546381 - RNA, 22 nt, Human
gcacauacugcaaagauuacua

SEQ ID NO: 546382 - RNA, 22 nt, Human
ugggccacuugaaaguggaugu

SEQ ID NO: 546383 - RNA, 22 nt, Human
gcaugagggggguuaggaaguu

SEQ ID NO: 546384 - RNA, 22 nt, Human
ggagugacucucggggccacua

SEQ ID NO: 546385 - RNA, 22 nt, Human
caguaaauuugagggaucuaau

SEQ ID NO: 546386 - RNA, 22 nt, Human
gcucugugccacaugcaguguu

SEQ ID NO: 546387 - RNA, 22 nt, Human
ucaguguuuccuagagcauaua

SEQ ID NO: 546388 - RNA, 22 nt, Human
cagcaagacaaggaacaaacug

SEQ ID NO: 546389 - RNA, 22 nt, Human
uucagaggcuguaugacuagau

SEQ ID NO: 546390 - RNA, 22 nt, Human
gaggcacagucccgaggcaagg

SEQ ID NO: 546391 - RNA, 22 nt, Human
cagcaaaagccagcauaagcuc

SEQ ID NO: 546392 - RNA, 22 nt, Human
agccugugugaagcccucagag

SEQ ID NO: 546393 - RNA, 22 nt, Human
ggaggggagauguuugggcuca

SEQ ID NO: 546394 - RNA, 22 nt, Human
auaacagugaccucucagcacc

SEQ ID NO: 546395 - RNA, 22 nt, Human
ucagggaaugggcccagucccu

SEQ ID NO: 546396 - RNA, 22 nt, Human
ucaaacaugaaagcuugauuuu

SEQ ID NO: 546397 - RNA, 22 nt, Human
auuauguagcuaaaaauugugu

SEQ ID NO: 546398 - RNA, 22 nt, Human
uucauucaucucuaaaaugccu

SEQ ID NO: 546399 - RNA, 22 nt, Human
ugcugggggcuuucuggauacc

SEQ ID NO: 546400 - RNA, 22 nt, Human
agcugcagugaacuguuuuguc

SEQ ID NO: 546401 - RNA, 22 nt, Human
agggccaggaucacagccaaga

SEQ ID NO: 546402 - RNA, 22 nt, Human
ugucuacuugggcucuacagca

SEQ ID NO: 546403 - RNA, 22 nt, Human
aggcuucuaggguuggcagcgg

SEQ ID NO: 546404 - RNA, 19 nt, Human
acauuuagaauguacuugc

SEQ ID NO: 546405 - RNA, 22 nt, Human
uaugaagcucucacuguguguc

SEQ ID NO: 546406 - RNA, 22 nt, Human
cucaggcucuguacucccuuug

SEQ ID NO: 546407 - RNA, 22 nt, Human
uaagucaucacauugcagagau

SEQ ID NO: 546408 - RNA, 22 nt, Human
aaaugcauuuuuaauuagaccc

SEQ ID NO: 546409 - RNA, 22 nt, Human
ccuggagcuuuuccauccugga

SEQ ID NO: 546410 - RNA, 22 nt, Human
gaagcucucaaacucuccccuu

SEQ ID NO: 546411 - RNA, 22 nt, Human
uauuaaagagagaaucaucauc

SEQ ID NO: 546412 - RNA, 22 nt, Human
uguauuuugugaggaucacucu

SEQ ID NO: 546413 - RNA, 23 nt, Human
uggagcugggcagcugggaaagu

SEQ ID NO: 546414 - RNA, 22 nt, Human
augccaaauucucagccucuuu

SEQ ID NO: 546415 - RNA, 22 nt, Human
agauacauagcugugagcacac

SEQ ID NO: 546416 - RNA, 22 nt, Human
cccagucauccugcaggugaaa

SEQ ID NO: 546417 - RNA, 22 nt, Human
guucacaguuaggacaacugcu

SEQ ID NO: 546418 - RNA, 22 nt, Human
ccugggcaucucaugcaccugc

SEQ ID NO: 546419 - RNA, 22 nt, Human
gggcucaggaguuugaggcugc

SEQ ID NO: 546420 - RNA, 22 nt, Human
agccucugacugucagcaaggu

SEQ ID NO: 546421 - RNA, 22 nt, Human
ccagcagcuguggcuuugccuc

SEQ ID NO: 546422 - RNA, 23 nt, Human
ugagaagccauuagagcaggugg

SEQ ID NO: 546423 - RNA, 22 nt, Human
cagcuguucuugggacagacag

SEQ ID NO: 546424 - RNA, 22 nt, Human
auuuuccaaaauaauuguuacu

SEQ ID NO: 546425 - RNA, 22 nt, Human
gccucagagggcccuagggaca

SEQ ID NO: 546426 - RNA, 22 nt, Human
guggggacgggauggcucacug

SEQ ID NO: 546427 - RNA, 22 nt, Human
uggaggaaaaaaccaggcagag

SEQ ID NO: 546428 - RNA, 22 nt, Human
acaguguuuuagaaaagcuuga

SEQ ID NO: 546429 - RNA, 22 nt, Human
uuggccuuaaccucucugugcc

SEQ ID NO: 546430 - RNA, 22 nt, Human
agccagggucucucgcucuguu

SEQ ID NO: 546431 - RNA, 22 nt, Human
ccugcugguuuuuacaaagaug

SEQ ID NO: 546432 - RNA, 22 nt, Human
ugccaggccucaggagucucca

SEQ ID NO: 546433 - RNA, 22 nt, Human
aaguccugugugcuuacacuug

SEQ ID NO: 546434 - RNA, 22 nt, Human
gccuuguuucauuacacguggu

SEQ ID NO: 546435 - RNA, 22 nt, Human
auuacaaaagaagggagaaggu

SEQ ID NO: 546436 - RNA, 22 nt, Human
uaauugaaaucauuucaauuca

SEQ ID NO: 546437 - RNA, 22 nt, Human
uggggcagcuccaucuauucca

SEQ ID NO: 546438 - RNA, 16 nt, Human
gcaggaguaccacuug

SEQ ID NO: 546439 - RNA, 22 nt, Human
agggcagcucucaccucuggcc

SEQ ID NO: 546440 - RNA, 22 nt, Human
ucaggaguaaagacagaguucc

SEQ ID NO: 546441 - RNA, 22 nt, Human
ggcagugaaaaaguauguuucc

SEQ ID NO: 546442 - RNA, 22 nt, Human
uaaaggcuuuuagugaugguaa

SEQ ID NO: 546443 - RNA, 22 nt, Human
ggucccaggauugguugcgcag

SEQ ID NO: 546444 - RNA, 22 nt, Human
ucauacauaacuuguacaguga

SEQ ID NO: 546445 - RNA, 22 nt, Human
uuauugagaccguaagucaggu

SEQ ID NO: 546446 - RNA, 22 nt, Human
gaggcagcggcucacagagaaa

SEQ ID NO: 546447 - RNA, 20 nt, Human
cuccugggacugcugguuau

SEQ ID NO: 546448 - RNA, 22 nt, Human
gugaaggacuagcauggagggc

SEQ ID NO: 546449 - RNA, 22 nt, Human
uaagcaaauagcuagaucagag

SEQ ID NO: 546450 - RNA, 22 nt, Human
uauuugaagauucuucugaugu

SEQ ID NO: 546451 - RNA, 22 nt, Human
uggaaauuuauucaucauucau

SEQ ID NO: 546452 - RNA, 22 nt, Human
cugggguccuugccauguguca

SEQ ID NO: 546453 - RNA, 22 nt, Human
acagagcacugcccugugccgc

SEQ ID NO: 546454 - RNA, 22 nt, Human
cuucuucucuacauccuuugau

SEQ ID NO: 546455 - RNA, 17 nt, Human
ucuguucaugcauaccu

SEQ ID NO: 546456 - RNA, 22 nt, Human
gccaggcgggucucaaacuccu

SEQ ID NO: 546457 - RNA, 20 nt, Human
aacauugcuucaauguaacc

SEQ ID NO: 546458 - RNA, 22 nt, Human
aucagaaacucuuagagcaggg

SEQ ID NO: 546459 - RNA, 22 nt, Human
agaaacuaaagccaagggcucu

SEQ ID NO: 546460 - RNA, 22 nt, Human
agcagccaggaaucugcagagc

SEQ ID NO: 546461 - RNA, 22 nt, Human
ugaaggcagcaugcacacuagu

SEQ ID NO: 546462 - RNA, 22 nt, Human
guuuucuuugaaugcuucuaga

SEQ ID NO: 546463 - RNA, 22 nt, Human
uuucuucucugauuaaggcuca

SEQ ID NO: 546464 - RNA, 22 nt, Human
ccaaagcaagucacaugaucaa

SEQ ID NO: 546465 - RNA, 22 nt, Human
acugggcuguaaagagaggcaa

SEQ ID NO: 546466 - RNA, 22 nt, Human
ucaucagucagaacuuaagcuu

SEQ ID NO: 546467 - RNA, 22 nt, Human
ggaagccaggcugggggaucug

SEQ ID NO: 546468 - RNA, 22 nt, Human
ugcuuccaauucaaaucugugg

SEQ ID NO: 546469 - RNA, 22 nt, Human
uagcuuuuaagucauaaccuca

SEQ ID NO: 546470 - RNA, 22 nt, Human
uucaaucauuccaacacuuuaa

SEQ ID NO: 546471 - RNA, 22 nt, Human
ggaagaggcucucauugagggc

SEQ ID NO: 546472 - RNA, 22 nt, Human
agccaggcgcaguggcuuaugc

SEQ ID NO: 546473 - RNA, 22 nt, Human
cuuucuuaauuuuuaaggacac

SEQ ID NO: 546474 - RNA, 22 nt, Human
cacuggcaugugaggcgguggc

SEQ ID NO: 546475 - RNA, 22 nt, Human
gugagggcagcuuggucagugu

SEQ ID NO: 546476 - RNA, 20 nt, Human
ucacuguaauugccuacauu

SEQ ID NO: 546477 - RNA, 22 nt, Human
ucuuuagagcacgggaaaaaca

SEQ ID NO: 546478 - RNA, 22 nt, Human
gcagaggcauuucugacgcugc

SEQ ID NO: 546479 - RNA, 22 nt, Human
uggagaugcacgagcaggugga

SEQ ID NO: 546480 - RNA, 22 nt, Human
gagugcaggccugagcaccauc

SEQ ID NO: 546481 - RNA, 22 nt, Human
cccaguggaaggaguagaagac

SEQ ID NO: 546482 - RNA, 22 nt, Human
aaguuaggcuuaguugagauuu

SEQ ID NO: 546483 - RNA, 22 nt, Human
uuuuucauauuccccucucugg

SEQ ID NO: 546484 - RNA, 22 nt, Human
gcaggcaguuauuuaguagaau

SEQ ID NO: 546485 - RNA, 22 nt, Human
cuuuacauaaggauaaaccugg

SEQ ID NO: 546486 - RNA, 22 nt, Human
uuuacagaauguugaauuuggg

SEQ ID NO: 546487 - RNA, 22 nt, Human
auuuccauguccaaaaauuagu

SEQ ID NO: 546488 - RNA, 22 nt, Human
ccuuuuauacucuguccucugg

SEQ ID NO: 546489 - RNA, 23 nt, Human
uugucugugcuuuuccaguugcu

SEQ ID NO: 546490 - RNA, 22 nt, Human
acuaucaacaucauugcucuag

SEQ ID NO: 546491 - RNA, 21 nt, Human
ucccagcugggucagugcugc

SEQ ID NO: 546492 - RNA, 22 nt, Human
auuuacagaagcauguaauagc

SEQ ID NO: 546493 - RNA, 22 nt, Human
gcagaagaccaugguggaaaga

SEQ ID NO: 546494 - RNA, 22 nt, Human
acagaaugggauuugaauauuu

SEQ ID NO: 546495 - RNA, 22 nt, Human
uacauguuauuucacuauuggu

SEQ ID NO: 546496 - RNA, 22 nt, Human
gcugucccaugguugcaagaug

SEQ ID NO: 546497 - RNA, 22 nt, Human
ggucagggggaucugugaggua

SEQ ID NO: 546498 - RNA, 22 nt, Human
ucagggcaagauugguuaauaa

SEQ ID NO: 546499 - RNA, 22 nt, Human
gugcugagugcagagugcagag

SEQ ID NO: 546500 - RNA, 22 nt, Human
uccauuggucucugugcccagg

SEQ ID NO: 546501 - RNA, 22 nt, Human
ggccucaguuucuccauggguu

SEQ ID NO: 546502 - RNA, 22 nt, Human
agcucccagaaggcccugcgcc

SEQ ID NO: 546503 - RNA, 22 nt, Human
agggaggugguuccccagugga

SEQ ID NO: 546504 - RNA, 22 nt, Human
acuuuacaggcacuucaaguau

SEQ ID NO: 546505 - RNA, 22 nt, Human
acagaaauaacuuuuuauguuu

SEQ ID NO: 546506 - RNA, 22 nt, Human
uaagaauaccucucagcucuuu

SEQ ID NO: 546507 - RNA, 22 nt, Human
uacagaaacagcgugguuagaa

SEQ ID NO: 546508 - RNA, 22 nt, Human
guucacagcugggacaagacug

SEQ ID NO: 546509 - RNA, 22 nt, Human
cccugcagagggaugggggcag

SEQ ID NO: 546510 - RNA, 22 nt, Human
ucuuccuagaaggaagaaaucu

SEQ ID NO: 546511 - RNA, 22 nt, Human
cagcucagucuugaagcacugg

SEQ ID NO: 546512 - RNA, 22 nt, Human
ucccugguuacguauaaagaug

SEQ ID NO: 546513 - RNA, 22 nt, Human
gcugucuuccuugcuccaaggg

SEQ ID NO: 546514 - RNA, 22 nt, Human
uaauaguugugacuuuguaaag

SEQ ID NO: 546515 - RNA, 22 nt, Human
ucuuuacacaagacaagaauaa

SEQ ID NO: 546516 - RNA, 22 nt, Human
ucucaccaaagccuugaccaua

SEQ ID NO: 546517 - RNA, 22 nt, Human
gaucuugagcaaguuguguaac

SEQ ID NO: 546518 - RNA, 22 nt, Human
uaauuacuggaaauuucaaaua

SEQ ID NO: 546519 - RNA, 22 nt, Human
cagguccuuuaguguccagaac

SEQ ID NO: 546520 - RNA, 22 nt, Human
gcaaagcaaucaggaguagcau

SEQ ID NO: 546521 - RNA, 22 nt, Human
cuuuucaugagucuguuauggg

SEQ ID NO: 546522 - RNA, 22 nt, Human
cauuuguaauacugacuugcag

SEQ ID NO: 546523 - RNA, 22 nt, Human
acacugugcagauucccuguga

SEQ ID NO: 546524 - RNA, 22 nt, Human
uuacaucuaaacugugaacaau

SEQ ID NO: 546525 - RNA, 22 nt, Human
cacauuucuaggaaauuaaaug

SEQ ID NO: 546526 - RNA, 22 nt, Human
agagggaucacccuguuucugg

SEQ ID NO: 546527 - RNA, 22 nt, Human
gcuuuuuuagguaagacccagg

SEQ ID NO: 546528 - RNA, 22 nt, Human
uccuaguucucugccagucgcu

SEQ ID NO: 546529 - RNA, 22 nt, Human
cugagaggugacagcgugcugg

SEQ ID NO: 546530 - RNA, 22 nt, Human
auaucaagauuauuagggucau

SEQ ID NO: 546531 - RNA, 22 nt, Human
aggccucuucagggagcaugga

SEQ ID NO: 546532 - RNA, 22 nt, Human
uuuugucuaagaacuuugcaaa

SEQ ID NO: 546533 - RNA, 22 nt, Human
cccugcagugugaccucaccua

SEQ ID NO: 546534 - RNA, 22 nt, Human
ucagcuccucaugcaggggaua

SEQ ID NO: 546535 - RNA, 23 nt, Human
gguggcaggaguggaugcugagc

SEQ ID NO: 546536 - RNA, 22 nt, Human
caggcccuggcagggcugaguc

SEQ ID NO: 546537 - RNA, 22 nt, Human
ucugaaauuguuaguaaaaaug

SEQ ID NO: 546538 - RNA, 22 nt, Human
uccagaggcuccaaagggagau

SEQ ID NO: 546539 - RNA, 22 nt, Human
acaggaaaugaaaugguaucua

SEQ ID NO: 546540 - RNA, 22 nt, Human
uuucagaucauuuuuuaaguac

SEQ ID NO: 546541 - RNA, 22 nt, Human
acugcucucugcaaguagaugg

SEQ ID NO: 546542 - RNA, 22 nt, Human
uuguuuaaaauguagcaagaaa

SEQ ID NO: 546543 - RNA, 22 nt, Human
ucauaauacaaagaguucugca

SEQ ID NO: 546544 - RNA, 22 nt, Human
agcuuuaccugaaauuugaucc

SEQ ID NO: 546545 - RNA, 22 nt, Human
aaggcaguagguguuucaaacu

SEQ ID NO: 546546 - RNA, 22 nt, Human
uugugucccccuuugagagcca

SEQ ID NO: 546547 - RNA, 22 nt, Human
uaaguuagagcacaauucuuac

SEQ ID NO: 546548 - RNA, 22 nt, Human
gucaggaugagggaugaggagu

SEQ ID NO: 546549 - RNA, 22 nt, Human
cuuggggcugucacucuggcau

SEQ ID NO: 546550 - RNA, 22 nt, Human
gaugaggggucauuggcuggga

SEQ ID NO: 546551 - RNA, 22 nt, Human
caucugcuguaauuaacaagcc

SEQ ID NO: 546552 - RNA, 22 nt, Human
aagcagcaugcuaugcuggugg

SEQ ID NO: 546553 - RNA, 22 nt, Human
aaaggaagaugccaggacucug

SEQ ID NO: 546554 - RNA, 22 nt, Human
uguacaauagcuauuaucucca

SEQ ID NO: 546555 - RNA, 22 nt, Human
ggugauuuucgaguuucauguu

SEQ ID NO: 546556 - RNA, 22 nt, Human
agcauuuaguuaguaaauguuu

SEQ ID NO: 546557 - RNA, 22 nt, Human
ucauuugugcugucagcaugca

SEQ ID NO: 546558 - RNA, 20 nt, Human
ggcagagggccugggagaag

SEQ ID NO: 546559 - RNA, 22 nt, Human
aacuggaaagaucaguaggaag

SEQ ID NO: 546560 - RNA, 22 nt, Human
gcaguggcaccgcuggcucugg

SEQ ID NO: 546561 - RNA, 22 nt, Human
gaagggggaaaaugacaacaga

SEQ ID NO: 546562 - RNA, 22 nt, Human
caaauacuggguaaguuaauuu

SEQ ID NO: 546563 - RNA, 22 nt, Human
ugcaagcaauccaggaaggcua

SEQ ID NO: 546564 - RNA, 16 nt, Human
agaggccuugaggaag

SEQ ID NO: 546565 - RNA, 22 nt, Human
gcagggcuaauggggcaaguag

SEQ ID NO: 546566 - RNA, 22 nt, Human
uggcugaguguuccaaggagca

SEQ ID NO: 546567 - RNA, 22 nt, Human
gaggggcacaguaaaggguccc

SEQ ID NO: 546568 - RNA, 22 nt, Human
gacucagugauuugacaugccu

SEQ ID NO: 546569 - RNA, 22 nt, Human
ggccagggccuggggacugucc

SEQ ID NO: 546570 - RNA, 22 nt, Human
gaaggcaaggagggaagccacc

SEQ ID NO: 546571 - RNA, 22 nt, Human
ccaggcucaggugcgagagaca

SEQ ID NO: 546572 - RNA, 22 nt, Human
cuggcaggagcauucacagagg

SEQ ID NO: 546573 - RNA, 22 nt, Human
gccagaguugaggcaguuuauu

SEQ ID NO: 546574 - RNA, 22 nt, Human
gcagggcaaauguggaaaggag

SEQ ID NO: 546575 - RNA, 22 nt, Human
ccaaguacagauuccuccacug

SEQ ID NO: 546576 - RNA, 22 nt, Human
gcuggcuggaggagggagguug

SEQ ID NO: 546577 - RNA, 22 nt, Human
ucugaacagcauggaaucauuu

SEQ ID NO: 546578 - RNA, 22 nt, Human
gcaaagcagaacccucucuauc

SEQ ID NO: 546579 - RNA, 22 nt, Human
uauguuuuucaagugcacacua

SEQ ID NO: 546580 - RNA, 22 nt, Human
gguggggcucagcaaucugugu

SEQ ID NO: 546581 - RNA, 22 nt, Human
ucccugccuccuggcagugcca

SEQ ID NO: 546582 - RNA, 22 nt, Human
acauguaggagagucacaaugc

SEQ ID NO: 546583 - RNA, 22 nt, Human
uuaugaaagacauuucuguugg

SEQ ID NO: 546584 - RNA, 22 nt, Human
gacauguauuagucaugcacag

SEQ ID NO: 546585 - RNA, 22 nt, Human
aucacagauuugauacuuuugu

SEQ ID NO: 546586 - RNA, 22 nt, Human
uugaucucuuguguaugguaga

SEQ ID NO: 546587 - RNA, 22 nt, Human
uugauuaaaaugagacaucauu

SEQ ID NO: 546588 - RNA, 18 nt, Human
uguuccaaggaaggaauc

SEQ ID NO: 546589 - RNA, 22 nt, Human
uuuuaaucaugcuucuaugucc

SEQ ID NO: 546590 - RNA, 22 nt, Human
cucucuucccgugaguguugca

SEQ ID NO: 546591 - RNA, 19 nt, Human
uucuggagguuacccugag

SEQ ID NO: 546592 - RNA, 19 nt, Human
uucuaugauuaacaugaga

SEQ ID NO: 546593 - RNA, 22 nt, Human
uggcagagcccagaacugagca

SEQ ID NO: 546594 - RNA, 23 nt, Human
uuacuacacaaguaacgauuccc

SEQ ID NO: 546595 - RNA, 22 nt, Human
aggcuccuuguucaucauccau

SEQ ID NO: 546596 - RNA, 16 nt, Human
gaggcuggcagauguc

SEQ ID NO: 546597 - RNA, 22 nt, Human
ugaagccacuuuccagaaucac

SEQ ID NO: 546598 - RNA, 22 nt, Human
augaggcagcugcuggagaacg

SEQ ID NO: 546599 - RNA, 20 nt, Human
gccugccucagcuagcugag

SEQ ID NO: 546600 - RNA, 22 nt, Human
augaugguggguaauguguaaa

SEQ ID NO: 546601 - RNA, 22 nt, Human
ccagcagagggucuuggccauu

SEQ ID NO: 546602 - RNA, 20 nt, Human
gggcccugggauucagagca

SEQ ID NO: 546603 - RNA, 22 nt, Human
ggcugugccucaaggcuacuca

SEQ ID NO: 546604 - RNA, 22 nt, Human
gcuugcucaacccccgucucuc

SEQ ID NO: 546605 - RNA, 22 nt, Human
ugugccaugaggcucugauaug

SEQ ID NO: 546606 - RNA, 22 nt, Human
aggggaggagcuuuucuugccu

SEQ ID NO: 546607 - RNA, 22 nt, Human
uuagcuaaacuguaacuagaau

SEQ ID NO: 546608 - RNA, 22 nt, Human
uucugugaaucuuuuuucccac

SEQ ID NO: 546609 - RNA, 22 nt, Human
cagaggaagcagacacaucuug

SEQ ID NO: 546610 - RNA, 22 nt, Human
cauuggaaugcauuugaagaga

SEQ ID NO: 546611 - RNA, 17 nt, Human
ucuguccagggagugug

SEQ ID NO: 546612 - RNA, 22 nt, Human
agcugcagucaagcugggccac

SEQ ID NO: 546613 - RNA, 22 nt, Human
ggcugccagugagugcagaccg

SEQ ID NO: 546614 - RNA, 22 nt, Human
uguacaguuaaucuuaagccau

SEQ ID NO: 546615 - RNA, 22 nt, Human
gcuguucugcaccagacuucag

SEQ ID NO: 546616 - RNA, 22 nt, Human
ucacauuuuaucugagauugac

SEQ ID NO: 546617 - RNA, 22 nt, Human
guguaauuauauaaagaucuac

SEQ ID NO: 546618 - RNA, 22 nt, Human
uuugaauggacugagaaucuug

SEQ ID NO: 546619 - RNA, 22 nt, Human
agcaagaagggcaaggaaguuu

SEQ ID NO: 546620 - RNA, 22 nt, Human
uggcugagugauauuugcaaag

SEQ ID NO: 546621 - RNA, 22 nt, Human
ccagggcauguaacuaauggug

SEQ ID NO: 546622 - RNA, 22 nt, Human
ccaggcucacagcaucccagga

SEQ ID NO: 546623 - RNA, 22 nt, Human
aaauacaguguguguucuuuga

SEQ ID NO: 546624 - RNA, 21 nt, Human
aagcaggaacuucaaagggac

SEQ ID NO: 546625 - RNA, 22 nt, Human
acuauacauugaauguuaaggu

SEQ ID NO: 546626 - RNA, 17 nt, Human
aggcagguaagaguuau

SEQ ID NO: 546627 - RNA, 22 nt, Human
ccaaggcuucccagagaugcuc

SEQ ID NO: 546628 - RNA, 22 nt, Human
uaaaaguauacuuucaaaggag

SEQ ID NO: 546629 - RNA, 22 nt, Human
gaagcagcuggugagauggagc

SEQ ID NO: 546630 - RNA, 22 nt, Human
aaaaguaauugcaauuuuguag

SEQ ID NO: 546631 - RNA, 22 nt, Human
ucucacuuuccagacuuuucaa

SEQ ID NO: 546632 - RNA, 22 nt, Human
gaauucuuuucuuucugaaagu

SEQ ID NO: 546633 - RNA, 22 nt, Human
ucuugacauuguuguuagcagg

SEQ ID NO: 546634 - RNA, 23 nt, Human
ucucagugaaucucagaauucgc

SEQ ID NO: 546635 - RNA, 22 nt, Human
gcagguggaucaccacgucagg

SEQ ID NO: 546636 - RNA, 22 nt, Human
agauuuauguggucacacucag

SEQ ID NO: 546637 - RNA, 22 nt, Human
accaggaggccuggagcacaaa

SEQ ID NO: 546638 - RNA, 22 nt, Human
caggaagaaggguggugagucc

SEQ ID NO: 546639 - RNA, 22 nt, Human
cagagccccucagcucucuccc

SEQ ID NO: 546640 - RNA, 22 nt, Human
guuacaauguccuuacaugaaa

SEQ ID NO: 546641 - RNA, 22 nt, Human
uugcaagggauaccauacuaag

SEQ ID NO: 546642 - RNA, 22 nt, Human
augaaauugaucuugaacuuuu

SEQ ID NO: 546643 - RNA, 22 nt, Human
aggugacaggacaggagcuggu

SEQ ID NO: 546644 - RNA, 22 nt, Human
uccuuaggcaauuugggagagu

SEQ ID NO: 546645 - RNA, 22 nt, Human
gaguggggcgaagucggcgagu

SEQ ID NO: 546646 - RNA, 22 nt, Human
uccuucagaggacggcagccag

SEQ ID NO: 546647 - RNA, 22 nt, Human
auguaugagagauucuuuuauu

SEQ ID NO: 546648 - RNA, 22 nt, Human
uaaaucacaucgaaaucugggu

SEQ ID NO: 546649 - RNA, 22 nt, Human
cucuucagauaaaagggauauu

SEQ ID NO: 546650 - RNA, 22 nt, Human
gagugaaaaaggaagggccaua

SEQ ID NO: 546651 - RNA, 22 nt, Human
ggugaagguggaacgcagagca

SEQ ID NO: 546652 - RNA, 22 nt, Human
cuggagccagccagggcccucu

SEQ ID NO: 546653 - RNA, 22 nt, Human
acugggcuagaguggaagcugg

SEQ ID NO: 546654 - RNA, 22 nt, Human
agccacagcgaaccucucuucc

SEQ ID NO: 546655 - RNA, 22 nt, Human
auguaacuguuauauuuuguug

SEQ ID NO: 546656 - RNA, 20 nt, Human
agugaauagagacauugccc

SEQ ID NO: 546657 - RNA, 22 nt, Human
uggcagcacaagguggcccaug

SEQ ID NO: 546658 - RNA, 22 nt, Human
ccuggcugugcauugccggccc

SEQ ID NO: 546659 - RNA, 22 nt, Human
gaguauuccucagucauuuugu

SEQ ID NO: 546660 - RNA, 22 nt, Human
ucugucaggagauuggcagcug

SEQ ID NO: 546661 - RNA, 22 nt, Human
cagcugcccauccugggaaaug

SEQ ID NO: 546662 - RNA, 22 nt, Human
aaaugcacugaacacauguugu

SEQ ID NO: 546663 - RNA, 22 nt, Human
gcugucuggaggcucugaggga

SEQ ID NO: 546664 - RNA, 22 nt, Human
aacuuaguuaagauuaagucuc

SEQ ID NO: 546665 - RNA, 22 nt, Human
ugagggugggcccugggcaucu

SEQ ID NO: 546666 - RNA, 22 nt, Human
aagcuuccugaaugcucauuua

SEQ ID NO: 546667 - RNA, 22 nt, Human
acugugggaaccacugaaucag

SEQ ID NO: 546668 - RNA, 22 nt, Human
ccugggccuggcgggucggcuc

SEQ ID NO: 546669 - RNA, 22 nt, Human
ucuggcucaggucagacaggga

SEQ ID NO: 546670 - RNA, 22 nt, Human
ucauacauucagcagauauuug

SEQ ID NO: 546671 - RNA, 22 nt, Human
ggagcugaugacgucaccaugg

SEQ ID NO: 546672 - RNA, 17 nt, Human
ucaaauguacagaacua

SEQ ID NO: 546673 - RNA, 22 nt, Human
gccagcugcuggaacagcgcga

SEQ ID NO: 546674 - RNA, 22 nt, Human
gccagagguaucaaagauagua

SEQ ID NO: 546675 - RNA, 22 nt, Human
ggucccaggcucccucuugucc

SEQ ID NO: 546676 - RNA, 22 nt, Human
gcaguguuguuaaaagauuaga

SEQ ID NO: 546677 - RNA, 22 nt, Human
cugauuucaugcuaucaauguu

SEQ ID NO: 546678 - RNA, 22 nt, Human
gcagugguccaguucacaccca

SEQ ID NO: 546679 - RNA, 22 nt, Human
gcaagaaaaaggcuucaugaac

SEQ ID NO: 546680 - RNA, 22 nt, Human
cagggcucacucggcuggcguc

SEQ ID NO: 546681 - RNA, 22 nt, Human
gguggggagucaggcauucuug

SEQ ID NO: 546682 - RNA, 22 nt, Human
auuuugaagggaauugaaguuc

SEQ ID NO: 546683 - RNA, 22 nt, Human
uaacauuaaaagagauaauuga

SEQ ID NO: 546684 - RNA, 22 nt, Human
ugcauuguuuagaacucuuugg

SEQ ID NO: 546685 - RNA, 22 nt, Human
ccaggcuccucaugaucuuguu

SEQ ID NO: 546686 - RNA, 22 nt, Human
ucugcaggccucgacaaggcca

SEQ ID NO: 546687 - RNA, 22 nt, Human
uaaagcaauuugagcaaguucu

SEQ ID NO: 546688 - RNA, 22 nt, Human
ugcaucuuacguuuugaaaggg

SEQ ID NO: 546689 - RNA, 22 nt, Human
ugcacacacucguguauaugag

SEQ ID NO: 546690 - RNA, 23 nt, Human
ugagcccaggaggucaaggcugc

SEQ ID NO: 546691 - RNA, 22 nt, Human
gcugcaggcgccugcggucucu

SEQ ID NO: 546692 - RNA, 22 nt, Human
caggacaguauaggcuuuagga

SEQ ID NO: 546693 - RNA, 22 nt, Human
aguaugaagaugaugaaaaaua

SEQ ID NO: 546694 - RNA, 22 nt, Human
caggggcuguggcacauggugu

SEQ ID NO: 546695 - RNA, 22 nt, Human
cauauuucagucuaagaugugu

SEQ ID NO: 546696 - RNA, 22 nt, Human
aagagcaggcugcuguggagua

SEQ ID NO: 546697 - RNA, 22 nt, Human
gggcacuguggggcccaugcug

SEQ ID NO: 546698 - RNA, 22 nt, Human
agaagccaacagggcaggagag

SEQ ID NO: 546699 - RNA, 22 nt, Human
gcagaacaacguaggaguggag

SEQ ID NO: 546700 - RNA, 22 nt, Human
ucaacacucuuuggcacaguua

SEQ ID NO: 546701 - RNA, 22 nt, Human
caucuggcuagcuaucauugug

SEQ ID NO: 546702 - RNA, 22 nt, Human
agaauuagucacaauuauagga

SEQ ID NO: 546703 - RNA, 22 nt, Human
uugaagacacagacauauagag

SEQ ID NO: 546704 - RNA, 22 nt, Human
ccagggugugggcgucggcacg

SEQ ID NO: 546705 - RNA, 22 nt, Human
agagccugugggagaugcagcu

SEQ ID NO: 546706 - RNA, 22 nt, Human
acugucugcccugagaugccag

SEQ ID NO: 546707 - RNA, 19 nt, Human
aggugaggggcaccauguc

SEQ ID NO: 546708 - RNA, 19 nt, Human
uggcauugguccagauaaa

SEQ ID NO: 546709 - RNA, 22 nt, Human
aaaagagguuaaccaggugugu

SEQ ID NO: 546710 - RNA, 23 nt, Human
acaaaugucuagagaggguguga

SEQ ID NO: 546711 - RNA, 22 nt, Human
ccuggcaggcaagaggaaggga

SEQ ID NO: 546712 - RNA, 22 nt, Human
ccagagccggauugugaagugc

SEQ ID NO: 546713 - RNA, 22 nt, Human
uagcagagcacaucuucauucu

SEQ ID NO: 546714 - RNA, 22 nt, Human
agcuuaggaggaugaugaacau

SEQ ID NO: 546715 - RNA, 22 nt, Human
cacagcuucugagugaggauuu

SEQ ID NO: 546716 - RNA, 22 nt, Human
gcagcagagaacacaaugaugg

SEQ ID NO: 546717 - RNA, 22 nt, Human
auuuucaucauggguuuaacau

SEQ ID NO: 546718 - RNA, 22 nt, Human
acuguacacgugucauuuacag

SEQ ID NO: 546719 - RNA, 22 nt, Human
gccuggagacagcagaggcggc

SEQ ID NO: 546720 - RNA, 22 nt, Human
ggcagggaagcuggcaucacgg

SEQ ID NO: 546721 - RNA, 22 nt, Human
agaggugggagccuggucacau

SEQ ID NO: 546722 - RNA, 22 nt, Human
cucugagaggugagaagcagca

SEQ ID NO: 546723 - RNA, 22 nt, Human
cucagacuggagccccaaggac

SEQ ID NO: 546724 - RNA, 18 nt, Human
gagcagaggcucaacugg

SEQ ID NO: 546725 - RNA, 22 nt, Human
uaaagcaagacacacccauagc

SEQ ID NO: 546726 - RNA, 22 nt, Human
gugagcaggauuucauggugua

SEQ ID NO: 546727 - RNA, 22 nt, Human
gaaacagguggcaggcuagauu

SEQ ID NO: 546728 - RNA, 22 nt, Human
uugggccucucaaagugcuggg

SEQ ID NO: 546729 - RNA, 22 nt, Human
ccucuguccuggggaguggagc

SEQ ID NO: 546730 - RNA, 21 nt, Human
uuguucuuccagaagcaaagu

SEQ ID NO: 546731 - RNA, 22 nt, Human
ccuggccuggcacucccucugc

SEQ ID NO: 546732 - RNA, 22 nt, Human
uaaagacaugguguaggugaac

SEQ ID NO: 546733 - RNA, 22 nt, Human
guuucuuuugugaucaccaacc

SEQ ID NO: 546734 - RNA, 22 nt, Human
aaagucuuuauuuuguaucuuu

SEQ ID NO: 546735 - RNA, 23 nt, Human
ucuuuacauacugaugaguucuc

SEQ ID NO: 546736 - RNA, 22 nt, Human
gaaggccuaggaaggaagccuu

SEQ ID NO: 546737 - RNA, 22 nt, Human
ucagugaucuaaggguauggcc

SEQ ID NO: 546738 - RNA, 22 nt, Human
cugugcccuuucgcugcacugu

SEQ ID NO: 546739 - RNA, 23 nt, Human
auuaccagccugacaccaacaaa

SEQ ID NO: 546740 - RNA, 22 nt, Human
uagaaguuuaaauucaccaugc

SEQ ID NO: 546741 - RNA, 22 nt, Human
uccugggagcccuugcuccacc

SEQ ID NO: 546742 - RNA, 22 nt, Human
aaugaaacucgaaauaaucaca

SEQ ID NO: 546743 - RNA, 22 nt, Human
ugcugccagggcucugcccaca

SEQ ID NO: 546744 - RNA, 22 nt, Human
uauuggaauuuaguuagagaau

SEQ ID NO: 546745 - RNA, 22 nt, Human
aucagaauguuuuggugugcuc

SEQ ID NO: 546746 - RNA, 22 nt, Human
gcugccucccccauggcuggaa

SEQ ID NO: 546747 - RNA, 22 nt, Human
uucaguauuugaaaccauaggc

SEQ ID NO: 546748 - RNA, 22 nt, Human
aagggcucugugcuugucccau

SEQ ID NO: 546749 - RNA, 22 nt, Human
uuucuaaaugguggcugcauug

SEQ ID NO: 546750 - RNA, 22 nt, Human
uaaggccaggcuguggucggca

SEQ ID NO: 546751 - RNA, 19 nt, Human
uucauuuguaucugcucac

SEQ ID NO: 546752 - RNA, 22 nt, Human
aguccggggucuggacaccugg

SEQ ID NO: 546753 - RNA, 22 nt, Human
ggggagcagaagcagcaacaac

SEQ ID NO: 546754 - RNA, 22 nt, Human
uucacauaaugauacaaagcuu

SEQ ID NO: 546755 - RNA, 22 nt, Human
cagcccagcagucuuagccugc

SEQ ID NO: 546756 - RNA, 22 nt, Human
uucuuaacucaaauauauaucc

SEQ ID NO: 546757 - RNA, 22 nt, Human
acacagggcagagagcuggcuc

SEQ ID NO: 546758 - RNA, 22 nt, Human
agagcugaauuuggguggugga

SEQ ID NO: 546759 - RNA, 22 nt, Human
uuccaaaugcccaucuacacag

SEQ ID NO: 546760 - RNA, 22 nt, Human
cugggccuggagcccacgagcc

SEQ ID NO: 546761 - RNA, 22 nt, Human
uuucaucucucuaaaagacagu

SEQ ID NO: 546762 - RNA, 21 nt, Human
ugcagcagaguaagcagggga

SEQ ID NO: 546763 - RNA, 22 nt, Human
uuugaucucccagacuaaggag

SEQ ID NO: 546764 - RNA, 22 nt, Human
ucuucauguauuugacaaccau

SEQ ID NO: 546765 - RNA, 22 nt, Human
ugcuuuauaaccauuucugugg

SEQ ID NO: 546766 - RNA, 22 nt, Human
ggcagagacuggguuggcagag

SEQ ID NO: 546767 - RNA, 22 nt, Human
aacuacuaccacagucaagaca

SEQ ID NO: 546768 - RNA, 22 nt, Human
aguuauauaacuaucuagaugc

SEQ ID NO: 546769 - RNA, 22 nt, Human
gaaacaauacuuguccucacua

SEQ ID NO: 546770 - RNA, 22 nt, Human
aaaggcaguggguauguggauc

SEQ ID NO: 546771 - RNA, 22 nt, Human
uguauguguauguacauaugca

SEQ ID NO: 546772 - RNA, 22 nt, Human
cuuucuuuguccaccaacaaug

SEQ ID NO: 546773 - RNA, 21 nt, Human
uuugaaagcccuauguuuuca

SEQ ID NO: 546774 - RNA, 22 nt, Human
uacaaauggguuaaaauauagu

SEQ ID NO: 546775 - RNA, 22 nt, Human
uuauuauguggaugaaagaugu

SEQ ID NO: 546776 - RNA, 16 nt, Human
cacauauauuuauaug

SEQ ID NO: 546777 - RNA, 22 nt, Human
acugagaguugugcauucaugc

SEQ ID NO: 546778 - RNA, 22 nt, Human
aaggagaguacaggaguuggua

SEQ ID NO: 546779 - RNA, 22 nt, Human
gcagugaguuaugaucaugcca

SEQ ID NO: 546780 - RNA, 22 nt, Human
gucaccauugcccacuccaugg

SEQ ID NO: 546781 - RNA, 22 nt, Human
cagucaacagagagcccgucag

SEQ ID NO: 546782 - RNA, 18 nt, Human
aaaugcuaggcuacauga

SEQ ID NO: 546783 - RNA, 22 nt, Human
auucacagggggagaaggguau

SEQ ID NO: 546784 - RNA, 22 nt, Human
aagcagcuuucuuuccugugaa

SEQ ID NO: 546785 - RNA, 22 nt, Human
ucagaaaggccacauggugcag

SEQ ID NO: 546786 - RNA, 22 nt, Human
uacauguauugauuucucuucu

SEQ ID NO: 546787 - RNA, 22 nt, Human
ggaaagccaggugcucuggugu

SEQ ID NO: 546788 - RNA, 22 nt, Human
cuguugugaaauguccaucaac

SEQ ID NO: 546789 - RNA, 22 nt, Human
uuuuuccaccguacuuccugag

SEQ ID NO: 546790 - RNA, 22 nt, Human
ucagacagggagucagaaaaua

SEQ ID NO: 546791 - RNA, 21 nt, Human
cucacaggaugcaguguuacu

SEQ ID NO: 546792 - RNA, 22 nt, Human
cugccaggcacgugcagcauca

SEQ ID NO: 546793 - RNA, 22 nt, Human
caaagcagccugcaguguggac

SEQ ID NO: 546794 - RNA, 22 nt, Human
guucagggagggacagaugaag

SEQ ID NO: 546795 - RNA, 22 nt, Human
agguccuguccuuggucucuga

SEQ ID NO: 546796 - RNA, 22 nt, Human
cccuuccuccucgccugucaga

SEQ ID NO: 546797 - RNA, 22 nt, Human
aaugaacacagcccucuacuuu

SEQ ID NO: 546798 - RNA, 22 nt, Human
aggauccuccuuagaaaagacc

SEQ ID NO: 546799 - RNA, 22 nt, Human
uaagacacaugcguacaagaua

SEQ ID NO: 546800 - RNA, 22 nt, Human
cagaagaaaucauuaucuggac

SEQ ID NO: 546801 - RNA, 22 nt, Human
aaaggcaggcuuucacaucuca

SEQ ID NO: 546802 - RNA, 22 nt, Human
agagggcugcugcacagugcuc

SEQ ID NO: 546803 - RNA, 19 nt, Human
aagcagcccuggcaagagc

SEQ ID NO: 546804 - RNA, 22 nt, Human
aaaacugaaauacgauccaaug

SEQ ID NO: 546805 - RNA, 22 nt, Human
uaugcauauagaugcacacaca

SEQ ID NO: 546806 - RNA, 22 nt, Human
uggcagcacuagguacugagcu

SEQ ID NO: 546807 - RNA, 22 nt, Human
ugggcucagucugcaccugcgg

SEQ ID NO: 546808 - RNA, 22 nt, Human
ucagggcaggcgagcagcugcu

SEQ ID NO: 546809 - RNA, 22 nt, Human
gaacaacuuugaaacaugaaga

SEQ ID NO: 546810 - RNA, 22 nt, Human
ggcucugcccagaugaagagga

SEQ ID NO: 546811 - RNA, 22 nt, Human
caggaaccugugcguagggaug

SEQ ID NO: 546812 - RNA, 22 nt, Human
ucucuucuugauuuucacugga

SEQ ID NO: 546813 - RNA, 22 nt, Human
uacacauguuuggcaaguaugu

SEQ ID NO: 546814 - RNA, 22 nt, Human
acauaaaguacugagagacucu

SEQ ID NO: 546815 - RNA, 22 nt, Human
agaaauguaauugcaacugucu

SEQ ID NO: 546816 - RNA, 22 nt, Human
cucugcagauucaucccuucac

SEQ ID NO: 546817 - RNA, 22 nt, Human
uuucacagcaacacugucugca

SEQ ID NO: 546818 - RNA, 22 nt, Human
cccagccugugacagccguccu

SEQ ID NO: 546819 - RNA, 22 nt, Human
agcaggcuugguccccagccuc

SEQ ID NO: 546820 - RNA, 22 nt, Human
aacuacagaaaagguaagcucu

SEQ ID NO: 546821 - RNA, 22 nt, Human
aaggcaguuugggccaccaucu

SEQ ID NO: 546822 - RNA, 19 nt, Human
ugcagaagacacaguggug

SEQ ID NO: 546823 - RNA, 22 nt, Human
ucuucagcuguagucauuguuc

SEQ ID NO: 546824 - RNA, 22 nt, Human
caggacaaagcccuuugagaaa

SEQ ID NO: 546825 - RNA, 22 nt, Human
uucaaacagaugacucugcucu

SEQ ID NO: 546826 - RNA, 22 nt, Human
guuuagaauucuaacuuuaagg

SEQ ID NO: 546827 - RNA, 20 nt, Human
ccugcugggaacccucugaa

SEQ ID NO: 546828 - RNA, 22 nt, Human
uagaaaucuuguuacuaugugu

SEQ ID NO: 546829 - RNA, 21 nt, Human
uuuucuggaguaugucuccuc

SEQ ID NO: 546830 - RNA, 21 nt, Human
uaaacauaaccuuguauggcu

SEQ ID NO: 546831 - RNA, 22 nt, Human
ggcucuggcuacuccacccugu

SEQ ID NO: 546832 - RNA, 22 nt, Human
ggcuguccuuggccaaggcacu

SEQ ID NO: 546833 - RNA, 22 nt, Human
accaagcuagaacauuacaggc

SEQ ID NO: 546834 - RNA, 22 nt, Human
uggcccugcacccagagcaguu

SEQ ID NO: 546835 - RNA, 22 nt, Human
gagcugccaguguaugaauucu

SEQ ID NO: 546836 - RNA, 22 nt, Human
ccuggugccacuagagaauguc

SEQ ID NO: 546837 - RNA, 22 nt, Human
uccucagggguuucagguguac

SEQ ID NO: 546838 - RNA, 22 nt, Human
caugaagcuugaagcaguccac

SEQ ID NO: 546839 - RNA, 22 nt, Human
gugccagggggcacugaacaga

SEQ ID NO: 546840 - RNA, 21 nt, Human
cagugggcugcugcgcuccag

SEQ ID NO: 546841 - RNA, 22 nt, Human
gaaguuuauuucaaucuauuca

SEQ ID NO: 546842 - RNA, 22 nt, Human
gagacugcauagauggccacaa

SEQ ID NO: 546843 - RNA, 22 nt, Human
ugucucugaacagcuuacuaaa

SEQ ID NO: 546844 - RNA, 22 nt, Human
aacugcauucagaaagcucacu

SEQ ID NO: 546845 - RNA, 22 nt, Human
agguggcuguggcuucccuugu

SEQ ID NO: 546846 - RNA, 22 nt, Human
cacugggcugauaccaggcuuc

SEQ ID NO: 546847 - RNA, 22 nt, Human
uccugcagacauuuacaccuuu

SEQ ID NO: 546848 - RNA, 22 nt, Human
acucuucaugcuaugcucaacu

SEQ ID NO: 546849 - RNA, 22 nt, Human
cagagaaagacuugcccuuagu

SEQ ID NO: 546850 - RNA, 22 nt, Human
ucaggccuccagguuaccauuu

SEQ ID NO: 546851 - RNA, 22 nt, Human
cagcuccagcccaggcagcucc

SEQ ID NO: 546852 - RNA, 22 nt, Human
auaaguaggaaaauuugaauau

SEQ ID NO: 546853 - RNA, 22 nt, Human
uggccuuggcagugagaagagu

SEQ ID NO: 546854 - RNA, 22 nt, Human
gacacuauaugacacuucaguu

SEQ ID NO: 546855 - RNA, 22 nt, Human
acauucuucuugugaauuuacu

SEQ ID NO: 546856 - RNA, 22 nt, Human
cucagagaggcaguggaaguca

SEQ ID NO: 546857 - RNA, 22 nt, Human
augccugagacuguuaauuggc

SEQ ID NO: 546858 - RNA, 22 nt, Human
uaaaucaguuucucuuauuggu

SEQ ID NO: 546859 - RNA, 19 nt, Human
caguggagauuggaggagg

SEQ ID NO: 546860 - RNA, 22 nt, Human
gaggcaggcccugaaugaguca

SEQ ID NO: 546861 - RNA, 23 nt, Human
aaaguguagccagguuaagaacc

SEQ ID NO: 546862 - RNA, 22 nt, Human
gacuuuggcaucuagacauugu

SEQ ID NO: 546863 - RNA, 22 nt, Human
aaucagucauuagcucugaccu

SEQ ID NO: 546864 - RNA, 22 nt, Human
aucuccagauugugaucaucag

SEQ ID NO: 546865 - RNA, 22 nt, Human
aaaacugagguuuccugaagaa

SEQ ID NO: 546866 - RNA, 22 nt, Human
cagaaccaggaacugauggaga

SEQ ID NO: 546867 - RNA, 22 nt, Human
aaguccagugcuuuagauucca

SEQ ID NO: 546868 - RNA, 22 nt, Human
auuuucuagauagaugaugcau

SEQ ID NO: 546869 - RNA, 23 nt, Human
uccuccuuuugcuugugcuuccc

SEQ ID NO: 546870 - RNA, 22 nt, Human
augaccagccgagauaaacaga

SEQ ID NO: 546871 - RNA, 22 nt, Human
uggggacacagagguucguugg

SEQ ID NO: 546872 - RNA, 22 nt, Human
aaugagacacgugaagcagaug

SEQ ID NO: 546873 - RNA, 22 nt, Human
uaguauucagcuucucaggcaa

SEQ ID NO: 546874 - RNA, 22 nt, Human
agaagcuggaggaagacuaagc

SEQ ID NO: 546875 - RNA, 22 nt, Human
aaggaagaaucaucacguuggg

SEQ ID NO: 546876 - RNA, 22 nt, Human
uaccugggcccaccagugccug

SEQ ID NO: 546877 - RNA, 22 nt, Human
caguuucugggcguucacaggu

SEQ ID NO: 546878 - RNA, 22 nt, Human
uaaaucacccaucuccuaaucu

SEQ ID NO: 546879 - RNA, 22 nt, Human
agcccagcagaaaguccagccu

SEQ ID NO: 546880 - RNA, 22 nt, Human
cucugagguuuccucacaagcu

SEQ ID NO: 546881 - RNA, 19 nt, Human
ggcccaaguacugagugcc

SEQ ID NO: 546882 - RNA, 22 nt, Human
gagugcaguaugagaggcugcu

SEQ ID NO: 546883 - RNA, 22 nt, Human
gcccucugcacagcucugagca

SEQ ID NO: 546884 - RNA, 18 nt, Human
aggaagcaggaggaaggc

SEQ ID NO: 546885 - RNA, 22 nt, Human
ucugucucuuuguucugugagu

SEQ ID NO: 546886 - RNA, 22 nt, Human
ccacagggccuuuccugcuggc

SEQ ID NO: 546887 - RNA, 22 nt, Human
aucacgucaugguuugaucugg

SEQ ID NO: 546888 - RNA, 22 nt, Human
uggcacagaaaaaugcuccauu

SEQ ID NO: 546889 - RNA, 22 nt, Human
guuacaaauguaaauucugggg

SEQ ID NO: 546890 - RNA, 22 nt, Human
ucugaacagaaaagaugcacaa

SEQ ID NO: 546891 - RNA, 22 nt, Human
acaggugugagaacaugccuug

SEQ ID NO: 546892 - RNA, 22 nt, Human
ugcucuggagggugaagcuuuu

SEQ ID NO: 546893 - RNA, 22 nt, Human
aagcccagcugaaagcauuuuu

SEQ ID NO: 546894 - RNA, 22 nt, Human
aggaggaggugggacacaguga

SEQ ID NO: 546895 - RNA, 22 nt, Human
accagagucaauuauuuugcca

SEQ ID NO: 546896 - RNA, 22 nt, Human
gggcacuggaggccaaggagcu

SEQ ID NO: 546897 - RNA, 22 nt, Human
agaucacagagccaagauucca

SEQ ID NO: 546898 - RNA, 22 nt, Human
acugagcugugacaaugcuuaa

SEQ ID NO: 546899 - RNA, 22 nt, Human
gcccagcaccucucucaggguu

SEQ ID NO: 546900 - RNA, 22 nt, Human
accacugggcgggcagccugcu

SEQ ID NO: 546901 - RNA, 22 nt, Human
accugccuaucagcugccugcu

SEQ ID NO: 546902 - RNA, 22 nt, Human
ggcccugagcugaaguacugug

SEQ ID NO: 546903 - RNA, 22 nt, Human
uaagucaguagaacugugguca

SEQ ID NO: 546904 - RNA, 22 nt, Human
gccuuggccuuccuaggccuga

SEQ ID NO: 546905 - RNA, 22 nt, Human
aauuauauuguggugugaaugu

SEQ ID NO: 546906 - RNA, 22 nt, Human
aauacuuugccaaguucgaaga

SEQ ID NO: 546907 - RNA, 20 nt, Human
cuguggcucaugcaucugcc

SEQ ID NO: 546908 - RNA, 22 nt, Human
cuucuggcaaaacaggcagaaa

SEQ ID NO: 546909 - RNA, 22 nt, Human
ucugucauguuuccauuacaug

SEQ ID NO: 546910 - RNA, 22 nt, Human
aaacaaguguaaacuagucugu

SEQ ID NO: 546911 - RNA, 22 nt, Human
aagagguaaccauagcaaccac

SEQ ID NO: 546912 - RNA, 22 nt, Human
aucaguuucacuugcuugcaaa

SEQ ID NO: 546913 - RNA, 22 nt, Human
ugaggcaggagaaucacaugaa

SEQ ID NO: 546914 - RNA, 22 nt, Human
aauuauauguuaaucuucaauu

SEQ ID NO: 546915 - RNA, 22 nt, Human
uccaauauuucucacauaugga

SEQ ID NO: 546916 - RNA, 22 nt, Human
aacauuuaugauugagguaaau

SEQ ID NO: 546917 - RNA, 21 nt, Human
gcagggacaaagcuucaggag

SEQ ID NO: 546918 - RNA, 22 nt, Human
cugcagcuccucucugugcccc

SEQ ID NO: 546919 - RNA, 22 nt, Human
ugagcaggcucccacuucagug

SEQ ID NO: 546920 - RNA, 22 nt, Human
caggcugcagaggccuuucaug

SEQ ID NO: 546921 - RNA, 19 nt, Human
aaggaacccuggguugcuc

SEQ ID NO: 546922 - RNA, 22 nt, Human
gauauauuuggaccagagcauu

SEQ ID NO: 546923 - RNA, 22 nt, Human
uucuggagaugacuuuuagaaa

SEQ ID NO: 546924 - RNA, 22 nt, Human
augaaacugaaggacaaccaga

SEQ ID NO: 546925 - RNA, 22 nt, Human
uacagauacagaucuagauaca

SEQ ID NO: 546926 - RNA, 22 nt, Human
ucuccuuugaaaguuaggacug

SEQ ID NO: 546927 - RNA, 20 nt, Human
agcagcuguguuuucauccu

SEQ ID NO: 546928 - RNA, 22 nt, Human
ccagaggaggggggucuuucug

SEQ ID NO: 546929 - RNA, 22 nt, Human
cccucccaagcacucugacaua

SEQ ID NO: 546930 - RNA, 22 nt, Human
aagagcuggauggaaucuggga

SEQ ID NO: 546931 - RNA, 22 nt, Human
cugggccagauccagccucaca

SEQ ID NO: 546932 - RNA, 22 nt, Human
uuuuaagaaauguaugacuguc

SEQ ID NO: 546933 - RNA, 22 nt, Human
acaguggagcucagaugaaaau

SEQ ID NO: 546934 - RNA, 22 nt, Human
caggccugauacacugaacucu

SEQ ID NO: 546935 - RNA, 22 nt, Human
aucaacauaugcaugggaaagu

SEQ ID NO: 546936 - RNA, 22 nt, Human
ggugcaggacgaaguggggguu

SEQ ID NO: 546937 - RNA, 22 nt, Human
agaagaaaugugaaggccacug

SEQ ID NO: 546938 - RNA, 22 nt, Human
uuucacagcuuccacuuaagga

SEQ ID NO: 546939 - RNA, 22 nt, Human
uuggagcccugaggaucuggau

SEQ ID NO: 546940 - RNA, 22 nt, Human
aucagugcuaaagcaaaugccc

SEQ ID NO: 546941 - RNA, 22 nt, Human
ggaaaucaugggagaguuggaa

SEQ ID NO: 546942 - RNA, 22 nt, Human
acaggcaggcuucggccagagc

SEQ ID NO: 546943 - RNA, 22 nt, Human
uaccugggaagugggaccugag

SEQ ID NO: 546944 - RNA, 22 nt, Human
auguguuaguuugugauuauac

SEQ ID NO: 546945 - RNA, 22 nt, Human
augugaaaauccaauggcagca

SEQ ID NO: 546946 - RNA, 22 nt, Human
uaaguuuuaagcaaucugauaa

SEQ ID NO: 546947 - RNA, 22 nt, Human
aagcaauaagccagauuuggau

SEQ ID NO: 546948 - RNA, 22 nt, Human
cagcugcaugucuguggugguc

SEQ ID NO: 546949 - RNA, 22 nt, Human
cagggcaguuugugccuaugag

SEQ ID NO: 546950 - RNA, 22 nt, Human
aaugcuuuagcagugauuagug

SEQ ID NO: 546951 - RNA, 22 nt, Human
cuugucugugucggauaaaacu

SEQ ID NO: 546952 - RNA, 22 nt, Human
gugcauugcgaugcagacgacc

SEQ ID NO: 546953 - RNA, 20 nt, Human
aaucacaguuaacucuuucu

SEQ ID NO: 546954 - RNA, 22 nt, Human
aacaucuuguacugcacauuuu

SEQ ID NO: 546955 - RNA, 22 nt, Human
uccugucugucuuuggucccuu

SEQ ID NO: 546956 - RNA, 22 nt, Human
aagucagagcaacugagacauu

SEQ ID NO: 546957 - RNA, 22 nt, Human
ucugccuguugagccuaaggcc

SEQ ID NO: 546958 - RNA, 22 nt, Human
acugcuggggcucauucaucuc

SEQ ID NO: 546959 - RNA, 22 nt, Human
ugucuccuacugccuguggauc

SEQ ID NO: 546960 - RNA, 22 nt, Human
uccaauauucauuaaaaugcag

SEQ ID NO: 546961 - RNA, 22 nt, Human
agucagaggaaugggccaggcu

SEQ ID NO: 546962 - RNA, 22 nt, Human
ccagcaugagacgaugaugaag

SEQ ID NO: 546963 - RNA, 22 nt, Human
ucaacauauaggcaaccuguaa

SEQ ID NO: 546964 - RNA, 22 nt, Human
uccaugagggacacuggaugcu

SEQ ID NO: 546965 - RNA, 22 nt, Human
gcccugcuuggucauggccuuc

SEQ ID NO: 546966 - RNA, 22 nt, Human
uguaucuuagugugaaaauauu

SEQ ID NO: 546967 - RNA, 22 nt, Human
gggcgccgugggaaacagccgg

SEQ ID NO: 546968 - RNA, 22 nt, Human
cagugaguucaucaagacauga

SEQ ID NO: 546969 - RNA, 22 nt, Human
uuauaaagauuguuauguaucu

SEQ ID NO: 546970 - RNA, 22 nt, Human
agaaaagguugaaaguaggauu

SEQ ID NO: 546971 - RNA, 22 nt, Human
caagaaaugggauuugacugcc

SEQ ID NO: 546972 - RNA, 22 nt, Human
cuucuuuccuuccuccaguggc

SEQ ID NO: 546973 - RNA, 22 nt, Human
gcagagucugggcuaccucuug

SEQ ID NO: 546974 - RNA, 22 nt, Human
gagcugggucuccaccuuggca

SEQ ID NO: 546975 - RNA, 22 nt, Human
cacaacuuagcagcuugaaaca

SEQ ID NO: 546976 - RNA, 22 nt, Human
caugagugucaucucagcagcu

SEQ ID NO: 546977 - RNA, 22 nt, Human
uuccgcuggggccgccuggcgg

SEQ ID NO: 546978 - RNA, 23 nt, Human
cagaggguuccauggagcauggu

SEQ ID NO: 546979 - RNA, 18 nt, Human
ggcagggaaaagauaggg

SEQ ID NO: 546980 - RNA, 22 nt, Human
uggcagucggacuucuaucuca

SEQ ID NO: 546981 - RNA, 22 nt, Human
ggaggccaucuggcuggaggcu

SEQ ID NO: 546982 - RNA, 22 nt, Human
cuccccacauuucucccugucu

SEQ ID NO: 546983 - RNA, 22 nt, Human
agcuauuucucuuauuauaucc

SEQ ID NO: 546984 - RNA, 22 nt, Human
aaguccaugaucaagauguggc

SEQ ID NO: 546985 - RNA, 22 nt, Human
acauuugucuucuuucagauua

SEQ ID NO: 546986 - RNA, 22 nt, Human
caucuuuguaacuuccacauaa

SEQ ID NO: 546987 - RNA, 22 nt, Human
aaggcucuuggagugaaugcag

SEQ ID NO: 546988 - RNA, 21 nt, Human
ggagggcagcccagacuggcu

SEQ ID NO: 546989 - RNA, 23 nt, Human
aucagucuugguagcugugccca

SEQ ID NO: 546990 - RNA, 22 nt, Human
agcugccaccucugccuuuggg

SEQ ID NO: 546991 - RNA, 22 nt, Human
ugcucagcaaaaagcuugugag

SEQ ID NO: 546992 - RNA, 22 nt, Human
cugcaguguucuggaaugcauu

SEQ ID NO: 546993 - RNA, 22 nt, Human
uuuaauauuucuuuccugaagc

SEQ ID NO: 546994 - RNA, 18 nt, Human
cagcucuucuccaguaac

SEQ ID NO: 546995 - RNA, 22 nt, Human
cuguucugaacugccugcaugc

SEQ ID NO: 546996 - RNA, 18 nt, Human
aucucccauuggccaagg

SEQ ID NO: 546997 - RNA, 22 nt, Human
gauuuuaauuauaggagguccu

SEQ ID NO: 546998 - RNA, 22 nt, Human
ugcaguuugcccuuugcucacu

SEQ ID NO: 546999 - RNA, 22 nt, Human
ugcccuguuccugccuccagcu

SEQ ID NO: 547000 - RNA, 22 nt, Human
gucccagagagcacuaguccau

SEQ ID NO: 547001 - RNA, 22 nt, Human
aauauuuguuaguguuuuaaug

SEQ ID NO: 547002 - RNA, 22 nt, Human
acugccaggauggcacuagagg

SEQ ID NO: 547003 - RNA, 22 nt, Human
caggggcugagaaggaacgucc

SEQ ID NO: 547004 - RNA, 22 nt, Human
uggaggcaugacagugucugga

SEQ ID NO: 547005 - RNA, 22 nt, Human
cuguauuugaaagaaaagauuu

SEQ ID NO: 547006 - RNA, 22 nt, Human
uccucaguauuguggagcagau

SEQ ID NO: 547007 - RNA, 22 nt, Human
caacaacaugggauucauuucu

SEQ ID NO: 547008 - RNA, 22 nt, Human
gauggcagguaguggucucauc

SEQ ID NO: 547009 - RNA, 22 nt, Human
ucccaggcuggggccaggugac

SEQ ID NO: 547010 - RNA, 22 nt, Human
cacagggcaccaguuggccauc

SEQ ID NO: 547011 - RNA, 22 nt, Human
uggcuccuaucaaggagugggu

SEQ ID NO: 547012 - RNA, 22 nt, Human
uugguuccuucugaaaguauug

SEQ ID NO: 547013 - RNA, 22 nt, Human
aggcacuguggguguggccgga

SEQ ID NO: 547014 - RNA, 22 nt, Human
ggcuucugccacgagagggaag

SEQ ID NO: 547015 - RNA, 21 nt, Human
ugacauuuccaauauaaagcc

SEQ ID NO: 547016 - RNA, 22 nt, Human
guuuauuagaguuuucugucug

SEQ ID NO: 547017 - RNA, 23 nt, Human
ggccucagcgcacagaaacugcu

SEQ ID NO: 547018 - RNA, 22 nt, Human
guuugcaaauuauguuaaaagu

SEQ ID NO: 547019 - RNA, 22 nt, Human
ccacugccgugggccuugggga

SEQ ID NO: 547020 - RNA, 22 nt, Human
uucaagauggcaccagugagug

SEQ ID NO: 547021 - RNA, 22 nt, Human
guggucagagaugacagugggu

SEQ ID NO: 547022 - RNA, 22 nt, Human
ugggcacaaacaucugccuguu

SEQ ID NO: 547023 - RNA, 22 nt, Human
cuucaguguugguucauuacga

SEQ ID NO: 547024 - RNA, 22 nt, Human
cuuaaaaucuggcaguuagcua

SEQ ID NO: 547025 - RNA, 23 nt, Human
agaagcagcuucuggaguaucgg

SEQ ID NO: 547026 - RNA, 22 nt, Human
gccagagccggcuucacaggau

SEQ ID NO: 547027 - RNA, 22 nt, Human
gugagcuguuggaguggcagag

SEQ ID NO: 547028 - RNA, 22 nt, Human
uucauuuaaucagaaucucuaa

SEQ ID NO: 547029 - RNA, 22 nt, Human
acugucugcaaaacucauacuc

SEQ ID NO: 547030 - RNA, 22 nt, Human
uaucuucacuuauaucuuucuu

SEQ ID NO: 547031 - RNA, 22 nt, Human
auacaguauuaccuguucagga

SEQ ID NO: 547032 - RNA, 22 nt, Human
agugccuggaccccaugacaua

SEQ ID NO: 547033 - RNA, 22 nt, Human
uacccagcuucaagucaggacu

SEQ ID NO: 547034 - RNA, 22 nt, Human
aguugcuggcaccugugaguau

SEQ ID NO: 547035 - RNA, 22 nt, Human
auggaauuucuccggcuccacc

SEQ ID NO: 547036 - RNA, 22 nt, Human
agucccagaucuacaggaggga

SEQ ID NO: 547037 - RNA, 22 nt, Human
aacaguaacgagauguccuaac

SEQ ID NO: 547038 - RNA, 22 nt, Human
aggucauuggggacuaucuccg

SEQ ID NO: 547039 - RNA, 22 nt, Human
aagcagaugggacuccaaggca

SEQ ID NO: 547040 - RNA, 22 nt, Human
aucaaauuaugugcuacaagaa

SEQ ID NO: 547041 - RNA, 22 nt, Human
gcuucaugggugugcaaccugu

SEQ ID NO: 547042 - RNA, 22 nt, Human
ugugucccuuggaaccucagcu

SEQ ID NO: 547043 - RNA, 21 nt, Human
aggcagcaggauccagggaca

SEQ ID NO: 547044 - RNA, 22 nt, Human
auggauaagaacaaauaucuga

SEQ ID NO: 547045 - RNA, 22 nt, Human
cuguugucccugggagcucagc

SEQ ID NO: 547046 - RNA, 22 nt, Human
ggcggggguccaggagccugca

SEQ ID NO: 547047 - RNA, 22 nt, Human
aaaguguugggauuacaggugu

SEQ ID NO: 547048 - RNA, 22 nt, Human
cugagccacugcuuguucagug

SEQ ID NO: 547049 - RNA, 22 nt, Human
ucccacugugccuguuguaauc

SEQ ID NO: 547050 - RNA, 22 nt, Human
gccugucuacacuuucucugca

SEQ ID NO: 547051 - RNA, 22 nt, Human
cagggcugucuccaaaggcccc

SEQ ID NO: 547052 - RNA, 22 nt, Human
uggcccugacuuggaggccuga

SEQ ID NO: 547053 - RNA, 22 nt, Human
agacucuggagucagcuaggau

SEQ ID NO: 547054 - RNA, 22 nt, Human
cucugcugaucucagcugggcu

SEQ ID NO: 547055 - RNA, 22 nt, Human
cccuggagguggagguugcagg

SEQ ID NO: 547056 - RNA, 22 nt, Human
gaaaguuucuucauuaagaugu

SEQ ID NO: 547057 - RNA, 22 nt, Human
ugcuggcccaguauggacugca

SEQ ID NO: 547058 - RNA, 22 nt, Human
agcagugagugggaggaccaug

SEQ ID NO: 547059 - RNA, 22 nt, Human
cugguucauccccuuccaggaa

SEQ ID NO: 547060 - RNA, 22 nt, Human
ccuguucuguuaauuaaacuuu

SEQ ID NO: 547061 - RNA, 22 nt, Human
ucagaauuuugguuugguuggu

SEQ ID NO: 547062 - RNA, 22 nt, Human
cucugcaaggcccuccaguagc

SEQ ID NO: 547063 - RNA, 22 nt, Human
gaaacccaaacuaagacaguag

SEQ ID NO: 547064 - RNA, 22 nt, Human
acaguucuuaaaacuugaauua

SEQ ID NO: 547065 - RNA, 22 nt, Human
aggcuuaacuuuacuguuaugc

SEQ ID NO: 547066 - RNA, 22 nt, Human
ugccuguguauuuccggccugc

SEQ ID NO: 547067 - RNA, 22 nt, Human
cagcagaacaggcagggaagcu

SEQ ID NO: 547068 - RNA, 22 nt, Human
guauuuauaggggaaugagagu

SEQ ID NO: 547069 - RNA, 22 nt, Human
guuuuucuaaguagcgauauuu

SEQ ID NO: 547070 - RNA, 22 nt, Human
guccucuguuuccaucugacuu

SEQ ID NO: 547071 - RNA, 22 nt, Human
ugucuuuauauauuuggaaaau

SEQ ID NO: 547072 - RNA, 22 nt, Human
uuguaaacuuguuugaagguau

SEQ ID NO: 547073 - RNA, 22 nt, Human
augcacaauguuuugauuugag

SEQ ID NO: 547074 - RNA, 20 nt, Human
acagauauuugauuuucagu

SEQ ID NO: 547075 - RNA, 22 nt, Human
aaagaccugaaauauaaucuag

SEQ ID NO: 547076 - RNA, 22 nt, Human
uaagucauaagucaacaaagga

SEQ ID NO: 547077 - RNA, 22 nt, Human
gccuucagcggccgcucgcugc

SEQ ID NO: 547078 - RNA, 22 nt, Human
ugcagggcuuccucuuggaguu

SEQ ID NO: 547079 - RNA, 18 nt, Human
gaagggagcuggaaugca

SEQ ID NO: 547080 - RNA, 22 nt, Human
uccccucuggaggcugcagggg

SEQ ID NO: 547081 - RNA, 20 nt, Human
ucacaggggaccaggagcag

SEQ ID NO: 547082 - RNA, 22 nt, Human
caggcagaaauuuuguuucauu

SEQ ID NO: 547083 - RNA, 22 nt, Human
ccacaggaccagaggagaucac

SEQ ID NO: 547084 - RNA, 22 nt, Human
aggcuggggaauugaauuugcu

SEQ ID NO: 547085 - RNA, 22 nt, Human
ugcagccaggaaauauuugcug

SEQ ID NO: 547086 - RNA, 22 nt, Human
gcagagccaggagagacccuug

SEQ ID NO: 547087 - RNA, 22 nt, Human
ccagcccuugaggucuguccau

SEQ ID NO: 547088 - RNA, 22 nt, Human
aggaauauggauuugcucagcu

SEQ ID NO: 547089 - RNA, 22 nt, Human
gucucagaguccuacuuauucc

SEQ ID NO: 547090 - RNA, 22 nt, Human
guggcccaggcuuggcgcuggc

SEQ ID NO: 547091 - RNA, 20 nt, Human
cccugagacaaaggaggggc

SEQ ID NO: 547092 - RNA, 22 nt, Human
agggccugacacccuugccagc

SEQ ID NO: 547093 - RNA, 22 nt, Human
cuuggacuuuagucucucucca

SEQ ID NO: 547094 - RNA, 22 nt, Human
agaaaccuggggguuguacaua

SEQ ID NO: 547095 - RNA, 18 nt, Human
cagggcuguggggucacu

SEQ ID NO: 547096 - RNA, 22 nt, Human
guacaaaguggaccugauagua

SEQ ID NO: 547097 - RNA, 22 nt, Human
cuacuucugugaugaaacuaca

SEQ ID NO: 547098 - RNA, 22 nt, Human
aaaaucuaaguagcgaguaagg

SEQ ID NO: 547099 - RNA, 22 nt, Human
augaaacucuagcuuucagcac

SEQ ID NO: 547100 - RNA, 22 nt, Human
ccagcuggugacauccccaacc

SEQ ID NO: 547101 - RNA, 21 nt, Human
agcugagguaaggcaagagag

SEQ ID NO: 547102 - RNA, 21 nt, Human
agccugcaauguagguaccgg

SEQ ID NO: 547103 - RNA, 22 nt, Human
aauagauucaugguuaagagca

SEQ ID NO: 547104 - RNA, 22 nt, Human
gagcuuuaccuuagguucuguu

SEQ ID NO: 547105 - RNA, 22 nt, Human
acagggucaagggugcuacaag

SEQ ID NO: 547106 - RNA, 22 nt, Human
aaagauuugaaauuaggcauca

SEQ ID NO: 547107 - RNA, 22 nt, Human
uuuugaaagggugauuuggcuu

SEQ ID NO: 547108 - RNA, 20 nt, Human
aggaaaaggguggugguaga

SEQ ID NO: 547109 - RNA, 22 nt, Human
caucugccuaaguggcccuguu

SEQ ID NO: 547110 - RNA, 22 nt, Human
aauguuugcaucuauucacaug

SEQ ID NO: 547111 - RNA, 22 nt, Human
uacaaaguuuucuuggauugag

SEQ ID NO: 547112 - RNA, 22 nt, Human
uugaaaacuuucuagaccaaga

SEQ ID NO: 547113 - RNA, 22 nt, Human
cacccaggacaggccagaugug

SEQ ID NO: 547114 - RNA, 21 nt, Human
gggcucuccugaggccaugaa

SEQ ID NO: 547115 - RNA, 22 nt, Human
caugcagugacucagacacagg

SEQ ID NO: 547116 - RNA, 22 nt, Human
ccuggcagcgccgaagcuggcc

SEQ ID NO: 547117 - RNA, 22 nt, Human
uggaagcacuuggguuuuguug

SEQ ID NO: 547118 - RNA, 22 nt, Human
acagucauagcagccuuuguua

SEQ ID NO: 547119 - RNA, 22 nt, Human
uuugaaagucaaccuuccaguu

SEQ ID NO: 547120 - RNA, 22 nt, Human
aggaauucaagaccagcugggc

SEQ ID NO: 547121 - RNA, 22 nt, Human
uuccucagagagacagaaacua

SEQ ID NO: 547122 - RNA, 19 nt, Human
ggcggguggacuggagccc

SEQ ID NO: 547123 - RNA, 22 nt, Human
guuaauuuaguagaguccagau

SEQ ID NO: 547124 - RNA, 22 nt, Human
ggcagguggcacugcugcuccc

SEQ ID NO: 547125 - RNA, 22 nt, Human
uugcaagacacuuggaagcaca

SEQ ID NO: 547126 - RNA, 22 nt, Human
cuguauaugugcauacacacac

SEQ ID NO: 547127 - RNA, 22 nt, Human
gagcuagaauuaggccaauuuc

SEQ ID NO: 547128 - RNA, 22 nt, Human
cauacauugcucauucaguauc

SEQ ID NO: 547129 - RNA, 22 nt, Human
uugaauucauuucucauugagu

SEQ ID NO: 547130 - RNA, 22 nt, Human
gaaacuuucaugaauauaagau

SEQ ID NO: 547131 - RNA, 22 nt, Human
gcauuuuauaaagaguuauuug

SEQ ID NO: 547132 - RNA, 22 nt, Human
aggcucagggacggggccccuu

SEQ ID NO: 547133 - RNA, 22 nt, Human
gcugccugauguccagcaggac

SEQ ID NO: 547134 - RNA, 21 nt, Human
ucucugguuggaguugugcca

SEQ ID NO: 547135 - RNA, 22 nt, Human
ccaaggaggccccaggucagcu

SEQ ID NO: 547136 - RNA, 22 nt, Human
uguacacaauucuuaacauaca

SEQ ID NO: 547137 - RNA, 22 nt, Human
cuccuucaaaagucauaguaaa

SEQ ID NO: 547138 - RNA, 22 nt, Human
gaaggcaggcuucugauuaggu

SEQ ID NO: 547139 - RNA, 22 nt, Human
agccagcaggugagugcagccu

SEQ ID NO: 547140 - RNA, 22 nt, Human
cugcuuugauuagaagaguaca

SEQ ID NO: 547141 - RNA, 22 nt, Human
uuaccaaaucccgugcacauuc

SEQ ID NO: 547142 - RNA, 22 nt, Human
uaacauuucggugacaguggga

SEQ ID NO: 547143 - RNA, 22 nt, Human
aacaaauuaguugcaagacugg

SEQ ID NO: 547144 - RNA, 22 nt, Human
guagaaaugguguguuucuucu

SEQ ID NO: 547145 - RNA, 22 nt, Human
ucccuggggauguuggccugcc

SEQ ID NO: 547146 - RNA, 22 nt, Human
guacaugucaaaaaaugcauaa

SEQ ID NO: 547147 - RNA, 22 nt, Human
aaggacagaaacagauugcugg

SEQ ID NO: 547148 - RNA, 22 nt, Human
aagauucuugacuagaaugauu

SEQ ID NO: 547149 - RNA, 22 nt, Human
acaaaguuucuucuaacaucug

SEQ ID NO: 547150 - RNA, 22 nt, Human
uugaucauuuuucugguaaaau

SEQ ID NO: 547151 - RNA, 23 nt, Human
auuugacagagcauagcauuucu

SEQ ID NO: 547152 - RNA, 19 nt, Human
ccugugacuaucuuuguaa

SEQ ID NO: 547153 - RNA, 19 nt, Human
cugugcaggccgggcugag

SEQ ID NO: 547154 - RNA, 22 nt, Human
ucugcucuaguugcuuccugcc

SEQ ID NO: 547155 - RNA, 22 nt, Human
uuggcuuccaggaucucagcag

SEQ ID NO: 547156 - RNA, 22 nt, Human
caggcugcggucggcucugguc

SEQ ID NO: 547157 - RNA, 22 nt, Human
ucuucauggucugguucuccag

SEQ ID NO: 547158 - RNA, 20 nt, Human
aggcugaguucuaugcacuu

SEQ ID NO: 547159 - RNA, 22 nt, Human
aagcaaagaguuuaguggguga

SEQ ID NO: 547160 - RNA, 22 nt, Human
gcuccagcucguggcucccagc

SEQ ID NO: 547161 - RNA, 22 nt, Human
auggaaaggcuguggaaacuua

SEQ ID NO: 547162 - RNA, 22 nt, Human
aaugucuucaguucuguauugu

SEQ ID NO: 547163 - RNA, 22 nt, Human
uccugcaggcuugaguccucag

SEQ ID NO: 547164 - RNA, 22 nt, Human
agcagcuccugccaugagugcu

SEQ ID NO: 547165 - RNA, 22 nt, Human
agcugcaguaaagcucuccagg

SEQ ID NO: 547166 - RNA, 22 nt, Human
uuguaaacugcugcaggagugc

SEQ ID NO: 547167 - RNA, 22 nt, Human
aaaugcacugaauauuccaaau

SEQ ID NO: 547168 - RNA, 22 nt, Human
ugcaggugcagcgauacuguga

SEQ ID NO: 547169 - RNA, 22 nt, Human
ccaucagcuccaguaucuucug

SEQ ID NO: 547170 - RNA, 22 nt, Human
aauuauauugaaguugaauguc

SEQ ID NO: 547171 - RNA, 22 nt, Human
aagggcagcuauuaucgucauc

SEQ ID NO: 547172 - RNA, 22 nt, Human
cccaggcauuuucaacuuuagu

SEQ ID NO: 547173 - RNA, 20 nt, Human
caggaugauuggacacgaug

SEQ ID NO: 547174 - RNA, 22 nt, Human
ggaagagccuggggugucaggc

SEQ ID NO: 547175 - RNA, 22 nt, Human
aauuucagaccauuugcaauua

SEQ ID NO: 547176 - RNA, 22 nt, Human
augcuuuguuuaaagauuuuca

SEQ ID NO: 547177 - RNA, 22 nt, Human
aacaaaguuucaggaagauaga

SEQ ID NO: 547178 - RNA, 22 nt, Human
ucaguguuggcauucagaaaug

SEQ ID NO: 547179 - RNA, 22 nt, Human
cugggagagaagcgaagcuggg

SEQ ID NO: 547180 - RNA, 22 nt, Human
ggucuuccgagaggccugugcu

SEQ ID NO: 547181 - RNA, 22 nt, Human
auauuucaugggguuccauacu

SEQ ID NO: 547182 - RNA, 22 nt, Human
gccagcuggcugcaggucccag

SEQ ID NO: 547183 - RNA, 22 nt, Human
aggaggggcaaugauagucugg

SEQ ID NO: 547184 - RNA, 22 nt, Human
uccaggaggugaggggaccaaa

SEQ ID NO: 547185 - RNA, 22 nt, Human
aggauccuuuggccacuucuua

SEQ ID NO: 547186 - RNA, 22 nt, Human
ugagcagggacuuugaguguag

SEQ ID NO: 547187 - RNA, 22 nt, Human
aggucucugaguacugcuggac

SEQ ID NO: 547188 - RNA, 22 nt, Human
ggcuggcauccagggaaaucca

SEQ ID NO: 547189 - RNA, 22 nt, Human
aucuucuauagauauucugaag

SEQ ID NO: 547190 - RNA, 22 nt, Human
ucaccaggcaacuauguacucc

SEQ ID NO: 547191 - RNA, 22 nt, Human
uaugcauaauuggauaaguaga

SEQ ID NO: 547192 - RNA, 22 nt, Human
gcuuuucuauaagaacuuucaa

SEQ ID NO: 547193 - RNA, 22 nt, Human
agcagggcccacuaggggagau

SEQ ID NO: 547194 - RNA, 22 nt, Human
cuggagccggcgagccccagcc

SEQ ID NO: 547195 - RNA, 23 nt, Human
cuuuucauugccuuagcgcagag

SEQ ID NO: 547196 - RNA, 22 nt, Human
aaggaaaggaugagcaugcauu

SEQ ID NO: 547197 - RNA, 22 nt, Human
agaauaguggcaaugacugcac

SEQ ID NO: 547198 - RNA, 22 nt, Human
uggaaugaauauguuuuaagga

SEQ ID NO: 547199 - RNA, 22 nt, Human
ccucacagcuugggcaaacggc

SEQ ID NO: 547200 - RNA, 22 nt, Human
cucucuggaagggggagcugau

SEQ ID NO: 547201 - RNA, 22 nt, Human
auaauaacaccugaauaggaaa

SEQ ID NO: 547202 - RNA, 22 nt, Human
aaauuauucucauguguuucuu

SEQ ID NO: 547203 - RNA, 22 nt, Human
cugccuagaaaaccaggcuccu

SEQ ID NO: 547204 - RNA, 22 nt, Human
acccuggagguggaggugcagu

SEQ ID NO: 547205 - RNA, 22 nt, Human
uacauugugauguuucaauaca

SEQ ID NO: 547206 - RNA, 22 nt, Human
agucagcacuccugaggaucac

SEQ ID NO: 547207 - RNA, 22 nt, Human
acugucucucuagcaguucagg

SEQ ID NO: 547208 - RNA, 22 nt, Human
uuuguuaaaaugcagauucugu

SEQ ID NO: 547209 - RNA, 21 nt, Human
cccaggucguggucuucccag

SEQ ID NO: 547210 - RNA, 19 nt, Human
cacacccaugcuugccaag

SEQ ID NO: 547211 - RNA, 22 nt, Human
aucauucagccuaagcaaguac

SEQ ID NO: 547212 - RNA, 20 nt, Human
ucugggcagggcacauggaa

SEQ ID NO: 547213 - RNA, 22 nt, Human
ccuccugggcuccugucugcac

SEQ ID NO: 547214 - RNA, 22 nt, Human
aggccugaggaccagauaaaug

SEQ ID NO: 547215 - RNA, 18 nt, Human
ucugggcuucccgaggcu

SEQ ID NO: 547216 - RNA, 21 nt, Human
cucuuuguggcaauguauuuu

SEQ ID NO: 547217 - RNA, 22 nt, Human
gauaauauuagaagauacaaau

SEQ ID NO: 547218 - RNA, 22 nt, Human
gauuucuguugagaaacauggg

SEQ ID NO: 547219 - RNA, 22 nt, Human
acucuucauucaaguaugcaaa

SEQ ID NO: 547220 - RNA, 22 nt, Human
aauguuacgaucaacaacacau

SEQ ID NO: 547221 - RNA, 22 nt, Human
uccagaaaaaguaauuuauuug

SEQ ID NO: 547222 - RNA, 22 nt, Human
ccuuuucuauguaccagcagug

SEQ ID NO: 547223 - RNA, 22 nt, Human
uguuuaagcugaugagguaucg

SEQ ID NO: 547224 - RNA, 22 nt, Human
caguccaggccuggaggagcca

SEQ ID NO: 547225 - RNA, 21 nt, Human
uucuucaugaugauuaauggc

SEQ ID NO: 547226 - RNA, 22 nt, Human
gcugucacacaugggaucucag

SEQ ID NO: 547227 - RNA, 22 nt, Human
gcucucugguuccagucaggaa

SEQ ID NO: 547228 - RNA, 22 nt, Human
uucaucaucuacaaccaggacc

SEQ ID NO: 547229 - RNA, 22 nt, Human
ggagcagacauaaccuuacaga

SEQ ID NO: 547230 - RNA, 22 nt, Human
agcugauuccacuuuuucccca

SEQ ID NO: 547231 - RNA, 22 nt, Human
auaauggccgggggcugaaugc

SEQ ID NO: 547232 - RNA, 22 nt, Human
acguuuucagugacugugcuuc

SEQ ID NO: 547233 - RNA, 22 nt, Human
aucaauaucagaucagacagga

SEQ ID NO: 547234 - RNA, 22 nt, Human
uucaaacaggggucagggagau

SEQ ID NO: 547235 - RNA, 22 nt, Human
uugcaucuagggcaacccagag

SEQ ID NO: 547236 - RNA, 22 nt, Human
ccaggcugcuguugguguccgc

SEQ ID NO: 547237 - RNA, 23 nt, Human
ccuggcagcaaacgaggagguua

SEQ ID NO: 547238 - RNA, 22 nt, Human
ucagaaaucuugucaaggcauc

SEQ ID NO: 547239 - RNA, 22 nt, Human
auacaaaguauugauccugagu

SEQ ID NO: 547240 - RNA, 22 nt, Human
gaagcaaaaugucugcacauau

SEQ ID NO: 547241 - RNA, 22 nt, Human
guacauuggcaacucucuuaga

SEQ ID NO: 547242 - RNA, 22 nt, Human
cuguggcauugugaggacugca

SEQ ID NO: 547243 - RNA, 22 nt, Human
acacacagcgccuaccaugugc

SEQ ID NO: 547244 - RNA, 18 nt, Human
uucaucaugacucugugg

SEQ ID NO: 547245 - RNA, 23 nt, Human
aggcgagcucuucuccagcacgu

SEQ ID NO: 547246 - RNA, 19 nt, Human
ucccaggaagcaaauguca

SEQ ID NO: 547247 - RNA, 22 nt, Human
uugcccugcggguccugcgcaa

SEQ ID NO: 547248 - RNA, 22 nt, Human
ccugggagguggagguugcagc

SEQ ID NO: 547249 - RNA, 22 nt, Human
agguaaaauagauaguauuucu

SEQ ID NO: 547250 - RNA, 22 nt, Human
uggcaauaaagaccaacagguu

SEQ ID NO: 547251 - RNA, 22 nt, Human
ugcauauacccgcauuuacaua

SEQ ID NO: 547252 - RNA, 22 nt, Human
caggacugauguuccuccagcc

SEQ ID NO: 547253 - RNA, 22 nt, Human
uaccugcagcgggaauccauua

SEQ ID NO: 547254 - RNA, 22 nt, Human
ugggggcugugcacaggcucac

SEQ ID NO: 547255 - RNA, 22 nt, Human
gugccaaaagcuauaauuuggu

SEQ ID NO: 547256 - RNA, 22 nt, Human
ucucagaggucuucagccucug

SEQ ID NO: 547257 - RNA, 22 nt, Human
ggaagccccagacccagagucu

SEQ ID NO: 547258 - RNA, 22 nt, Human
ugggcugaaaugcuguggacua

SEQ ID NO: 547259 - RNA, 22 nt, Human
uaugcacauucacacaaaaaug

SEQ ID NO: 547260 - RNA, 22 nt, Human
ugucucugauaaguaguucagu

SEQ ID NO: 547261 - RNA, 22 nt, Human
ggagccaguuuagaccucaguu

SEQ ID NO: 547262 - RNA, 22 nt, Human
gccugggugucgaucacuagug

SEQ ID NO: 547263 - RNA, 22 nt, Human
ugcugaggucaccuugcugcua

SEQ ID NO: 547264 - RNA, 22 nt, Human
caggcugauuaggccucgucca

SEQ ID NO: 547265 - RNA, 22 nt, Human
acagauggugagccgcugaugu

SEQ ID NO: 547266 - RNA, 22 nt, Human
auguaucaugcaggguccauga

SEQ ID NO: 547267 - RNA, 22 nt, Human
gcaaaguauuaaguauuaaguu

SEQ ID NO: 547268 - RNA, 22 nt, Human
cuuauacacccucuucccaggc

SEQ ID NO: 547269 - RNA, 22 nt, Human
guggccugaugccagcccugug

SEQ ID NO: 547270 - RNA, 22 nt, Human
caaaguuuuaguaaacauauau

SEQ ID NO: 547271 - RNA, 22 nt, Human
ugcaguuuuggccauugaaggc

SEQ ID NO: 547272 - RNA, 22 nt, Human
cacagcuaugagcagccuagcu

SEQ ID NO: 547273 - RNA, 22 nt, Human
ugcccugcaugcagggagcugu

SEQ ID NO: 547274 - RNA, 22 nt, Human
guuucuuaaaagaggaguuaga

SEQ ID NO: 547275 - RNA, 22 nt, Human
aaagaacaaauuagcuguuuua

SEQ ID NO: 547276 - RNA, 22 nt, Human
gugggccugaugcugccaugag

SEQ ID NO: 547277 - RNA, 21 nt, Human
agguggggcugcaccucugcu

SEQ ID NO: 547278 - RNA, 22 nt, Human
agugaccaaucaugguuagauu

SEQ ID NO: 547279 - RNA, 20 nt, Human
acugagcugcauggagagga

SEQ ID NO: 547280 - RNA, 19 nt, Human
uugguucauggaugcccaa

SEQ ID NO: 547281 - RNA, 22 nt, Human
gaauguuuuuauaaguguuaca

SEQ ID NO: 547282 - RNA, 22 nt, Human
aaagacaguggauucaaaaucc

SEQ ID NO: 547283 - RNA, 22 nt, Human
ggcacugagcugccuuggggca

SEQ ID NO: 547284 - RNA, 22 nt, Human
caggacauugauccauuggcac

SEQ ID NO: 547285 - RNA, 22 nt, Human
ugucucagaguaucccugaacu

SEQ ID NO: 547286 - RNA, 23 nt, Human
ucaauuaucaauggaaagaaguu

SEQ ID NO: 547287 - RNA, 22 nt, Human
ggagccagaaaugcugugguug

SEQ ID NO: 547288 - RNA, 22 nt, Human
agagcuggggccagagucaagg

SEQ ID NO: 547289 - RNA, 22 nt, Human
ugcaagagacauggguugugug

SEQ ID NO: 547290 - RNA, 22 nt, Human
agcucccagcuccuuugagaga

SEQ ID NO: 547291 - RNA, 22 nt, Human
agcagaugagccucaugacugg

SEQ ID NO: 547292 - RNA, 22 nt, Human
cucugagcccgcugcagcccca

SEQ ID NO: 547293 - RNA, 20 nt, Human
cuugccaguucccuggcaga

SEQ ID NO: 547294 - RNA, 23 nt, Human
gcagaggagcaagcuggacacca

SEQ ID NO: 547295 - RNA, 22 nt, Human
aauaaacaaauccuuccuuccc

SEQ ID NO: 547296 - RNA, 22 nt, Human
uucauuuguaacucuguuaggg

SEQ ID NO: 547297 - RNA, 22 nt, Human
ugcauuuuuaacaaggcuaauu

SEQ ID NO: 547298 - RNA, 22 nt, Human
uguucuugggaaucuuacaguu

SEQ ID NO: 547299 - RNA, 22 nt, Human
ccagggcagggaccacgugucu

SEQ ID NO: 547300 - RNA, 22 nt, Human
acugggcucauaaugucauaga

SEQ ID NO: 547301 - RNA, 22 nt, Human
ggcagauggagaagcagcaggu

SEQ ID NO: 547302 - RNA, 22 nt, Human
aggagucauaaaugugaacaaa

SEQ ID NO: 547303 - RNA, 22 nt, Human
caguuacauauuuaguagguua

SEQ ID NO: 547304 - RNA, 22 nt, Human
uuuuccucaggaaugcuaagcu

SEQ ID NO: 547305 - RNA, 22 nt, Human
aauguugagcuugaaaguaggu

SEQ ID NO: 547306 - RNA, 22 nt, Human
aagagggguggucugugaggau

SEQ ID NO: 547307 - RNA, 22 nt, Human
ucccacacuugaaacaaggcug

SEQ ID NO: 547308 - RNA, 22 nt, Human
cacagcuagauggauagauaga

SEQ ID NO: 547309 - RNA, 22 nt, Human
ugggaauacaaguuauucaccu

SEQ ID NO: 547310 - RNA, 22 nt, Human
ggagaugccagaauugcaaauu

SEQ ID NO: 547311 - RNA, 19 nt, Human
ucuaacagaagugucgucc

SEQ ID NO: 547312 - RNA, 22 nt, Human
aguggcuuggcugcacuacagg

SEQ ID NO: 547313 - RNA, 22 nt, Human
aaacaugagcacuugcuucaua

SEQ ID NO: 547314 - RNA, 22 nt, Human
auaaaguuuaaaagucaauagu

SEQ ID NO: 547315 - RNA, 22 nt, Human
auguuugugggauaaacaaaug

SEQ ID NO: 547316 - RNA, 22 nt, Human
uggcagagguauauugggagga

SEQ ID NO: 547317 - RNA, 22 nt, Human
ucacaaauauuuuaacaguagg

SEQ ID NO: 547318 - RNA, 22 nt, Human
ucuuuggauaucgcuagaccgu

SEQ ID NO: 547319 - RNA, 22 nt, Human
acuuuguuguuccuugucuaaa

SEQ ID NO: 547320 - RNA, 22 nt, Human
guguacauauugagucugcuga

SEQ ID NO: 547321 - RNA, 19 nt, Human
agcauccagucaugggauc

SEQ ID NO: 547322 - RNA, 22 nt, Human
ucugaaauacugcagguucucu

SEQ ID NO: 547323 - RNA, 22 nt, Human
aaaaaauuaucauaguuccuga

SEQ ID NO: 547324 - RNA, 22 nt, Human
agcaccuggucuccuggcgcug

SEQ ID NO: 547325 - RNA, 22 nt, Human
uaacagaauuugcuaaacuccg

SEQ ID NO: 547326 - RNA, 22 nt, Human
gcccggcagucacacacccagg

SEQ ID NO: 547327 - RNA, 22 nt, Human
aacauaaauuugaaguggcaaa

SEQ ID NO: 547328 - RNA, 22 nt, Human
gggcucuguguucuagcucucg

SEQ ID NO: 547329 - RNA, 22 nt, Human
ccacagggucagccacucugca

SEQ ID NO: 547330 - RNA, 22 nt, Human
ggcugccucaaagcucaagcuc

SEQ ID NO: 547331 - RNA, 22 nt, Human
ccaggccucaccugcccaccua

SEQ ID NO: 547332 - RNA, 22 nt, Human
cagagagagucaaaucuuugcu

SEQ ID NO: 547333 - RNA, 22 nt, Human
aauuugcaugaugagaacaaua

SEQ ID NO: 547334 - RNA, 22 nt, Human
ccaggcaucacgggcauguggc

SEQ ID NO: 547335 - RNA, 22 nt, Human
agcagggaggcggugugcuggc

SEQ ID NO: 547336 - RNA, 22 nt, Human
cuguuucaauuugaggaucagc

SEQ ID NO: 547337 - RNA, 22 nt, Human
agucaguguucuccggagaggc

SEQ ID NO: 547338 - RNA, 22 nt, Human
ucuuugcaugcauuuucccuua

SEQ ID NO: 547339 - RNA, 22 nt, Human
acugucagggaucaugaaagcu

SEQ ID NO: 547340 - RNA, 22 nt, Human
agcagccaauuggaggaugaag

SEQ ID NO: 547341 - RNA, 22 nt, Human
uucuuucugggguccuucggcu

SEQ ID NO: 547342 - RNA, 22 nt, Human
ucuuccuaguuacauaugcaca

SEQ ID NO: 547343 - RNA, 22 nt, Human
cuugcucacaguaccuggcuug

SEQ ID NO: 547344 - RNA, 22 nt, Human
cuacauaaauauuuaugugucu

SEQ ID NO: 547345 - RNA, 21 nt, Human
aauuacagauggaauuacaga

SEQ ID NO: 547346 - RNA, 22 nt, Human
uacauguuuacuccaagucagg

SEQ ID NO: 547347 - RNA, 22 nt, Human
aaggcucuggguuucauaggug

SEQ ID NO: 547348 - RNA, 22 nt, Human
acacauuuauggaucgcagaaa

SEQ ID NO: 547349 - RNA, 22 nt, Human
ucauugcauuuauucacuggca

SEQ ID NO: 547350 - RNA, 22 nt, Human
ugcagggcuccuggcuccaauc

SEQ ID NO: 547351 - RNA, 22 nt, Human
gagugcagaugaacagaagauu

SEQ ID NO: 547352 - RNA, 22 nt, Human
aagcaaggcccagagcaucagc

SEQ ID NO: 547353 - RNA, 22 nt, Human
agcuucucaggagucugaggca

SEQ ID NO: 547354 - RNA, 22 nt, Human
gagaccucuugguaucgcuagg

SEQ ID NO: 547355 - RNA, 22 nt, Human
aaggaaccauuugugugcaugg

SEQ ID NO: 547356 - RNA, 22 nt, Human
ucauuucaguggcacagaagau

SEQ ID NO: 547357 - RNA, 22 nt, Human
acacagggaggaggugcugugc

SEQ ID NO: 547358 - RNA, 21 nt, Human
gggcucaguggaaaagagugu

SEQ ID NO: 547359 - RNA, 17 nt, Human
ccugccugagccauagc

SEQ ID NO: 547360 - RNA, 22 nt, Human
ggaggggcagccauggaacucc

SEQ ID NO: 547361 - RNA, 22 nt, Human
uugaagauggaucgccacucuc

SEQ ID NO: 547362 - RNA, 22 nt, Human
aaauguguguauguacauauau

SEQ ID NO: 547363 - RNA, 22 nt, Human
gggccuccgugugcuggugcuc

SEQ ID NO: 547364 - RNA, 20 nt, Human
caugccugcugguaucuggc

SEQ ID NO: 547365 - RNA, 22 nt, Human
agccagagagccccagguucua

SEQ ID NO: 547366 - RNA, 23 nt, Human
agccagggcacugguggagauug

SEQ ID NO: 547367 - RNA, 22 nt, Human
ccagagcugauuccugggacuu

SEQ ID NO: 547368 - RNA, 15 nt, Human
ugauuuccuacuaac

SEQ ID NO: 547369 - RNA, 22 nt, Human
agaaagcuggagucaagcagag

SEQ ID NO: 547370 - RNA, 22 nt, Human
auucacaauuagaaguagauaa

SEQ ID NO: 547371 - RNA, 22 nt, Human
gcugcuggaugcgcuugauggu

SEQ ID NO: 547372 - RNA, 22 nt, Human
cagagccagcuguccuuggcau

SEQ ID NO: 547373 - RNA, 22 nt, Human
agaaaucauucccaaacccaua

SEQ ID NO: 547374 - RNA, 17 nt, Human
uugggagagaaagguau

SEQ ID NO: 547375 - RNA, 22 nt, Human
uagaggcauuaaugaauaaaca

SEQ ID NO: 547376 - RNA, 16 nt, Human
gaggggagcaguaggc

SEQ ID NO: 547377 - RNA, 22 nt, Human
ucucagagaggggccgggccuu

SEQ ID NO: 547378 - RNA, 23 nt, Human
aacagccaacuuuagcggguggc

SEQ ID NO: 547379 - RNA, 22 nt, Human
uagauggcaccuucuguguguc

SEQ ID NO: 547380 - RNA, 22 nt, Human
gagcaggaacagaucccuugga

SEQ ID NO: 547381 - RNA, 22 nt, Human
agguggccggugccagccgggc

SEQ ID NO: 547382 - RNA, 22 nt, Human
uagcagagcugcaauauagacc

SEQ ID NO: 547383 - RNA, 22 nt, Human
gaccaccagagguccgugggua

SEQ ID NO: 547384 - RNA, 22 nt, Human
augagacaggacuguaugcagg

SEQ ID NO: 547385 - RNA, 22 nt, Human
uauuuagaaugcguguacgugu

SEQ ID NO: 547386 - RNA, 22 nt, Human
aacauuuacaaauccuucugca

SEQ ID NO: 547387 - RNA, 22 nt, Human
uggccuuguguuuaagcaagaa

SEQ ID NO: 547388 - RNA, 22 nt, Human
aaguccuuggagaauagaaagg

SEQ ID NO: 547389 - RNA, 22 nt, Human
ccaggcucacugacuaccacau

SEQ ID NO: 547390 - RNA, 22 nt, Human
acagaauaguagcuuaaaguca

SEQ ID NO: 547391 - RNA, 22 nt, Human
ccagccuggagggcaguggugg

SEQ ID NO: 547392 - RNA, 22 nt, Human
gcccagaaguugaggcugcagu

SEQ ID NO: 547393 - RNA, 18 nt, Human
ugagagugugugcucuug

SEQ ID NO: 547394 - RNA, 22 nt, Human
ucugggccucaguuucuucauc

SEQ ID NO: 547395 - RNA, 22 nt, Human
acagaauauuguaagugccacu

SEQ ID NO: 547396 - RNA, 22 nt, Human
ccagcccucacugaggccucuc

SEQ ID NO: 547397 - RNA, 22 nt, Human
caggccuggagugcaauggcac

SEQ ID NO: 547398 - RNA, 22 nt, Human
ucuuugaaagcuguucuagagu

SEQ ID NO: 547399 - RNA, 22 nt, Human
cucaugauguagcgaaugagaa

SEQ ID NO: 547400 - RNA, 22 nt, Human
uuauuuguggcauccauguugg

SEQ ID NO: 547401 - RNA, 19 nt, Human
gggcuccuugggccucucu

SEQ ID NO: 547402 - RNA, 22 nt, Human
cauuagggucucucagcugaau

SEQ ID NO: 547403 - RNA, 23 nt, Human
aguguuaaauuucgcaccuaaau

SEQ ID NO: 547404 - RNA, 22 nt, Human
ggagacaguauggcuuguagcu

SEQ ID NO: 547405 - RNA, 21 nt, Human
cuguccaguaauuccuggcac

SEQ ID NO: 547406 - RNA, 22 nt, Human
gagaaagaugaagaguggcguu

SEQ ID NO: 547407 - RNA, 22 nt, Human
uucagcuaugcgcuuugggcaa

SEQ ID NO: 547408 - RNA, 22 nt, Human
augguucauauuaugcaucuga

SEQ ID NO: 547409 - RNA, 22 nt, Human
acauuugagcauauuucuuguc

SEQ ID NO: 547410 - RNA, 22 nt, Human
ucagaacuuaaagccgauuggg

SEQ ID NO: 547411 - RNA, 18 nt, Human
ucuaggagaguaccuacc

SEQ ID NO: 547412 - RNA, 22 nt, Human
uaucuguuccaggcacucagcu

SEQ ID NO: 547413 - RNA, 22 nt, Human
aucauuccacauguaccacuag

SEQ ID NO: 547414 - RNA, 22 nt, Human
acacuaaucuuuuauuugguuu

SEQ ID NO: 547415 - RNA, 22 nt, Human
uugggggcauauugaguagugg

SEQ ID NO: 547416 - RNA, 22 nt, Human
aaauauuagggagaacagggac

SEQ ID NO: 547417 - RNA, 22 nt, Human
gagccagccuucuucugagguc

SEQ ID NO: 547418 - RNA, 22 nt, Human
cuaugaccccagcaugaauaag

SEQ ID NO: 547419 - RNA, 22 nt, Human
gaggaacccaagcucaccguca

SEQ ID NO: 547420 - RNA, 22 nt, Human
uggcuggcuagugggcaggauu

SEQ ID NO: 547421 - RNA, 23 nt, Human
cacaccaggagccgucugggcca

SEQ ID NO: 547422 - RNA, 22 nt, Human
ugucucagaggcaggaagagcc

SEQ ID NO: 547423 - RNA, 22 nt, Human
cccucccagaugggcuugaggu

SEQ ID NO: 547424 - RNA, 22 nt, Human
ucuccuggaagaauaccacacu

SEQ ID NO: 547425 - RNA, 22 nt, Human
gcacccagaggucagcagugcu

SEQ ID NO: 547426 - RNA, 22 nt, Human
uuguuucaugaguguaaaggga

SEQ ID NO: 547427 - RNA, 18 nt, Human
ggcuguggacaagauuag

SEQ ID NO: 547428 - RNA, 22 nt, Human
ccagggcaaaugagaucauagc

SEQ ID NO: 547429 - RNA, 22 nt, Human
ccuuuucuacaagcaaaugugc

SEQ ID NO: 547430 - RNA, 22 nt, Human
ucaucuaagagucuuacauuua

SEQ ID NO: 547431 - RNA, 22 nt, Human
guuucuuagacagacauuaucu

SEQ ID NO: 547432 - RNA, 22 nt, Human
uucugggguuaugggugauucu

SEQ ID NO: 547433 - RNA, 22 nt, Human
cucuguccuaugcuugauagaa

SEQ ID NO: 547434 - RNA, 22 nt, Human
agcugcugaaugacacugcaag

SEQ ID NO: 547435 - RNA, 22 nt, Human
uuuauuuauccuucuggauugc

SEQ ID NO: 547436 - RNA, 22 nt, Human
uucucagugaaguuuagaacau

SEQ ID NO: 547437 - RNA, 23 nt, Human
agaagcaaugcuuuuuuuccucu

SEQ ID NO: 547438 - RNA, 23 nt, Human
cagagcuggcucagagcugccug

SEQ ID NO: 547439 - RNA, 22 nt, Human
cauguuaaaauauacauucuga

SEQ ID NO: 547440 - RNA, 22 nt, Human
caaaugcagucccuuuguugcu

SEQ ID NO: 547441 - RNA, 22 nt, Human
uuacauuaagccaauggauucu

SEQ ID NO: 547442 - RNA, 22 nt, Human
caacacuucuuauacuuacuga

SEQ ID NO: 547443 - RNA, 22 nt, Human
ucgcagaggcacgagugcagaa

SEQ ID NO: 547444 - RNA, 22 nt, Human
uggcucagucauggaugaguaa

SEQ ID NO: 547445 - RNA, 22 nt, Human
uggcccugccacucacugcuga

SEQ ID NO: 547446 - RNA, 22 nt, Human
ggcuggaaguccaagaucaaga

SEQ ID NO: 547447 - RNA, 22 nt, Human
ucagucucaucaacucuauucc

SEQ ID NO: 547448 - RNA, 22 nt, Human
acaugcuagguacagaucuaaa

SEQ ID NO: 547449 - RNA, 22 nt, Human
ugcccugcggcuaucuagauga

SEQ ID NO: 547450 - RNA, 22 nt, Human
uuaaaguucauuaaaugagcca

SEQ ID NO: 547451 - RNA, 22 nt, Human
gcuaaggagggucuugcaaauu

SEQ ID NO: 547452 - RNA, 22 nt, Human
acccagccuacaaagcucaccu

SEQ ID NO: 547453 - RNA, 22 nt, Human
uguggggugugguccaggcauc

SEQ ID NO: 547454 - RNA, 20 nt, Human
cuguaucagguuacaaagua

SEQ ID NO: 547455 - RNA, 22 nt, Human
aagauacauaaagguagagucu

SEQ ID NO: 547456 - RNA, 22 nt, Human
ugcugccacugguagucucauu

SEQ ID NO: 547457 - RNA, 22 nt, Human
ccaggccagcaggcacaccugc

SEQ ID NO: 547458 - RNA, 22 nt, Human
uaucacauaguguuuaguaaau

SEQ ID NO: 547459 - RNA, 18 nt, Human
gaugggagcaagagaaga

SEQ ID NO: 547460 - RNA, 22 nt, Human
agauaaaaugguucaaaggcua

SEQ ID NO: 547461 - RNA, 22 nt, Human
uucuuuaucaguuacucauagg

SEQ ID NO: 547462 - RNA, 22 nt, Human
ucaguguuacauuauauagaac

SEQ ID NO: 547463 - RNA, 22 nt, Human
ugcagaccucccauggcugccu

SEQ ID NO: 547464 - RNA, 22 nt, Human
uuaagucacuuaucuaaagaca

SEQ ID NO: 547465 - RNA, 22 nt, Human
aaacaugagcaucucuucaagc

SEQ ID NO: 547466 - RNA, 22 nt, Human
agaaaguuuugugcuauauaug

SEQ ID NO: 547467 - RNA, 23 nt, Human
uuacaugugugcacacauucugg

SEQ ID NO: 547468 - RNA, 22 nt, Human
acuaagugauucuaagcaucuu

SEQ ID NO: 547469 - RNA, 22 nt, Human
cugacaggguagacagagggca

SEQ ID NO: 547470 - RNA, 17 nt, Human
acacagccagguucucc

SEQ ID NO: 547471 - RNA, 22 nt, Human
uuucaaagucaagaaggauacu

SEQ ID NO: 547472 - RNA, 22 nt, Human
gggccuucagccuuggacugag

SEQ ID NO: 547473 - RNA, 22 nt, Human
ggcaggcauuagagauucccag

SEQ ID NO: 547474 - RNA, 22 nt, Human
ccccuuccacagugcuuccuaa

SEQ ID NO: 547475 - RNA, 18 nt, Human
agaauuaccaaagugcuu

SEQ ID NO: 547476 - RNA, 22 nt, Human
augccuggacugacaugcacug

SEQ ID NO: 547477 - RNA, 22 nt, Human
acagacauuuucuguauugccu

SEQ ID NO: 547478 - RNA, 22 nt, Human
cugcuuuggacaacuauucuug

SEQ ID NO: 547479 - RNA, 20 nt, Human
aggaaggaaguuugcaugga

SEQ ID NO: 547480 - RNA, 22 nt, Human
cuauuacauuucuggacauuca

SEQ ID NO: 547481 - RNA, 19 nt, Human
ggagaagcaucuagaaaua

SEQ ID NO: 547482 - RNA, 22 nt, Human
uccccacagcagaagaucugag

SEQ ID NO: 547483 - RNA, 22 nt, Human
gggugagacagaaagagcaaaa

SEQ ID NO: 547484 - RNA, 23 nt, Human
cagaaaacccagagcucaguccc

SEQ ID NO: 547485 - RNA, 22 nt, Human
gccaccagugggggccugggca

SEQ ID NO: 547486 - RNA, 22 nt, Human
guuauuaucuugaggaaucugu

SEQ ID NO: 547487 - RNA, 22 nt, Human
uucuguuuuagaaauaaguagu

SEQ ID NO: 547488 - RNA, 16 nt, Human
gccuggaguggcaggg

SEQ ID NO: 547489 - RNA, 22 nt, Human
caagcagauauuuuagucaaga

SEQ ID NO: 547490 - RNA, 22 nt, Human
ucaggcagguggcuggcuaugg

SEQ ID NO: 547491 - RNA, 22 nt, Human
ugggaagcugcauuuuaacaag

SEQ ID NO: 547492 - RNA, 22 nt, Human
uuagugaugacuagacuuuugu

SEQ ID NO: 547493 - RNA, 22 nt, Human
uggcagcuggagggcaauggcc

SEQ ID NO: 547494 - RNA, 20 nt, Human
aguuauaguaucuagccaug

SEQ ID NO: 547495 - RNA, 22 nt, Human
ccugucagcugauggcuaugua

SEQ ID NO: 547496 - RNA, 22 nt, Human
aaugucugcucuacucaggagg

SEQ ID NO: 547497 - RNA, 22 nt, Human
caggccuuaguaggugcucccu

SEQ ID NO: 547498 - RNA, 22 nt, Human
gcugcccugugguccagcaggu

SEQ ID NO: 547499 - RNA, 20 nt, Human
aagaaaacgucuucagggga

SEQ ID NO: 547500 - RNA, 22 nt, Human
aggaagauguguuuagcagguu

SEQ ID NO: 547501 - RNA, 22 nt, Human
auacaagacucagcacagacgg

SEQ ID NO: 547502 - RNA, 22 nt, Human
cacaaaugguuguagacauuaa

SEQ ID NO: 547503 - RNA, 22 nt, Human
ucagggcagguuaacuugggug

SEQ ID NO: 547504 - RNA, 22 nt, Human
uguguuuugaacucaucuacug

SEQ ID NO: 547505 - RNA, 22 nt, Human
cuggcuuccucaggagcagugg

SEQ ID NO: 547506 - RNA, 22 nt, Human
gggcucuggugccuucacagaa

SEQ ID NO: 547507 - RNA, 22 nt, Human
gauguuuggcucaaacgagugu

SEQ ID NO: 547508 - RNA, 22 nt, Human
gccucugcaauuacauugugcc

SEQ ID NO: 547509 - RNA, 22 nt, Human
auggccagccacuccugauggc

SEQ ID NO: 547510 - RNA, 22 nt, Human
uuaacagaggacacaucaaacu

SEQ ID NO: 547511 - RNA, 22 nt, Human
acacagugugugcagucggacg

SEQ ID NO: 547512 - RNA, 22 nt, Human
ugcaagagguaaaaugaaagga

SEQ ID NO: 547513 - RNA, 22 nt, Human
ugccuuuuccaguuccuagaag

SEQ ID NO: 547514 - RNA, 22 nt, Human
caggcccauucuaggcuugcua

SEQ ID NO: 547515 - RNA, 22 nt, Human
cccuggaggaccccaauguggc

SEQ ID NO: 547516 - RNA, 22 nt, Human
cugccuggaaggagcaagggga

SEQ ID NO: 547517 - RNA, 22 nt, Human
gugcauuggugcgccacuucac

SEQ ID NO: 547518 - RNA, 22 nt, Human
aguguuccacacaucuggggaa

SEQ ID NO: 547519 - RNA, 22 nt, Human
cauuucuguucucuuccuguac

SEQ ID NO: 547520 - RNA, 22 nt, Human
gccaggcagcaggaagccagug

SEQ ID NO: 547521 - RNA, 22 nt, Human
agguggggccaaaugcuacagu

SEQ ID NO: 547522 - RNA, 22 nt, Human
ugaguaggaaaggaaauguuuu

SEQ ID NO: 547523 - RNA, 22 nt, Human
gaaaugucucuugauuuuugga

SEQ ID NO: 547524 - RNA, 22 nt, Human
agcaggguuuggggauuggcac

SEQ ID NO: 547525 - RNA, 22 nt, Human
auuuguacaaauuuauguuagu

SEQ ID NO: 547526 - RNA, 22 nt, Human
ccuggcugcuuucacuauggag

SEQ ID NO: 547527 - RNA, 22 nt, Human
uauauucaacaggcuaauguca

SEQ ID NO: 547528 - RNA, 22 nt, Human
auauuuguauuucgugugugua

SEQ ID NO: 547529 - RNA, 22 nt, Human
ugccugugggugaugauuugau

SEQ ID NO: 547530 - RNA, 20 nt, Human
gaauguuucacuugcuccau

SEQ ID NO: 547531 - RNA, 22 nt, Human
cagucucucagcuuucagcugu

SEQ ID NO: 547532 - RNA, 22 nt, Human
ggaaagaaucaagugauccugu

SEQ ID NO: 547533 - RNA, 22 nt, Human
aaccauuagucaaucagcaaga

SEQ ID NO: 547534 - RNA, 22 nt, Human
acccugccaaggauggccccga

SEQ ID NO: 547535 - RNA, 22 nt, Human
cugcugcucagugucaucaugu

SEQ ID NO: 547536 - RNA, 22 nt, Human
agcagagucugugugcacuuua

SEQ ID NO: 547537 - RNA, 22 nt, Human
uagaaacagaauaugagugaga

SEQ ID NO: 547538 - RNA, 22 nt, Human
ccuggagcgcgggucaagcugg

SEQ ID NO: 547539 - RNA, 22 nt, Human
aggguggccaugagggagagau

SEQ ID NO: 547540 - RNA, 22 nt, Human
gaaguuagucauugaagcccca

SEQ ID NO: 547541 - RNA, 22 nt, Human
ggaagcugcauaacuagcgugg

SEQ ID NO: 547542 - RNA, 22 nt, Human
auaugauuccacuauuguaugg

SEQ ID NO: 547543 - RNA, 22 nt, Human
cuucugagaggggcuaggagca

SEQ ID NO: 547544 - RNA, 22 nt, Human
uucaagucauguuaacugcuuc

SEQ ID NO: 547545 - RNA, 22 nt, Human
cauauuugguauaacuuaagca

SEQ ID NO: 547546 - RNA, 22 nt, Human
cugcagccuccugggguacaug

SEQ ID NO: 547547 - RNA, 22 nt, Human
aucaugcugacacaguuuaucu

SEQ ID NO: 547548 - RNA, 22 nt, Human
caaagauaaucacagaauaccc

SEQ ID NO: 547549 - RNA, 22 nt, Human
gaguuguucaacgugugugaaa

SEQ ID NO: 547550 - RNA, 22 nt, Human
uucuugauguaccaacuuggga

SEQ ID NO: 547551 - RNA, 22 nt, Human
ggggcagccuccaggaaagcug

SEQ ID NO: 547552 - RNA, 22 nt, Human
cucagggacguuagaggacagg

SEQ ID NO: 547553 - RNA, 22 nt, Human
cagcuguuaccaaucuuagggc

SEQ ID NO: 547554 - RNA, 22 nt, Human
uuauuauuuuguguacagcaaa

SEQ ID NO: 547555 - RNA, 22 nt, Human
acagccagaggugguccugggu

SEQ ID NO: 547556 - RNA, 20 nt, Human
uacaguguauguauuuaggc

SEQ ID NO: 547557 - RNA, 22 nt, Human
agugggaccggugcuauuccag

SEQ ID NO: 547558 - RNA, 22 nt, Human
uuaaaaugaauauugauuagca

SEQ ID NO: 547559 - RNA, 22 nt, Human
cagaagcauugacuccuugcuc

SEQ ID NO: 547560 - RNA, 22 nt, Human
agccauccuacuaccucagcau

SEQ ID NO: 547561 - RNA, 22 nt, Human
guaaaucauaaaauuugagcuc

SEQ ID NO: 547562 - RNA, 21 nt, Human
ccaccaggucuucugcucggg

SEQ ID NO: 547563 - RNA, 22 nt, Human
ugggggaagagcuuguuaaagu

SEQ ID NO: 547564 - RNA, 20 nt, Human
ugugugcacacaugacauuc

SEQ ID NO: 547565 - RNA, 22 nt, Human
cuaccuaauaauuugauauuca

SEQ ID NO: 547566 - RNA, 22 nt, Human
ugcauguuaagaaaauauugag

SEQ ID NO: 547567 - RNA, 22 nt, Human
uagggcugccuauggcuagaua

SEQ ID NO: 547568 - RNA, 22 nt, Human
gcagagcaguacucucuugacu

SEQ ID NO: 547569 - RNA, 22 nt, Human
gaaucucaaggcuugugaggau

SEQ ID NO: 547570 - RNA, 18 nt, Human
ccagauggccagucugcu

SEQ ID NO: 547571 - RNA, 22 nt, Human
cauaacauccuugcuacuuuga

SEQ ID NO: 547572 - RNA, 22 nt, Human
ucagagucuuggcaauagguua

SEQ ID NO: 547573 - RNA, 22 nt, Human
uaauacuuuugccuuguauuca

SEQ ID NO: 547574 - RNA, 22 nt, Human
agggcagcacaaggcauggacu

SEQ ID NO: 547575 - RNA, 20 nt, Human
ugugaggagcauggccgcug

SEQ ID NO: 547576 - RNA, 22 nt, Human
agcagagccagaauuggaccag

SEQ ID NO: 547577 - RNA, 22 nt, Human
cagcugugagagugcauugaag

SEQ ID NO: 547578 - RNA, 22 nt, Human
caugcacuuaccugaaauucaa

SEQ ID NO: 547579 - RNA, 22 nt, Human
ugguacuuggaggcagaaaaau

SEQ ID NO: 547580 - RNA, 22 nt, Human
caagaugaaacuacagggagga

SEQ ID NO: 547581 - RNA, 22 nt, Human
agccccaggcccggacgccucu

SEQ ID NO: 547582 - RNA, 22 nt, Human
gccugucucuuggaacuuggua

SEQ ID NO: 547583 - RNA, 22 nt, Human
aaugcacagcguuccaugcuug

SEQ ID NO: 547584 - RNA, 22 nt, Human
uggagagcgcgacgggaggaag

SEQ ID NO: 547585 - RNA, 22 nt, Human
ugagcaggugagucuagggcag

SEQ ID NO: 547586 - RNA, 22 nt, Human
ccaaaggcggaacugagucucu

SEQ ID NO: 547587 - RNA, 22 nt, Human
aggcaguuucugggacagcaua

SEQ ID NO: 547588 - RNA, 22 nt, Human
uaaacagagaagacuuugagca

SEQ ID NO: 547589 - RNA, 22 nt, Human
aaaugcacacaccaggaaacua

SEQ ID NO: 547590 - RNA, 22 nt, Human
acaggcugagcguccaucuuca

SEQ ID NO: 547591 - RNA, 22 nt, Human
uuugucagucaugucugcuuuu

SEQ ID NO: 547592 - RNA, 22 nt, Human
ggcccaugcauccugugcagcc

SEQ ID NO: 547593 - RNA, 22 nt, Human
cuggucagagcaacugcucaca

SEQ ID NO: 547594 - RNA, 20 nt, Human
ccucaggaugagggugagca

SEQ ID NO: 547595 - RNA, 22 nt, Human
ucuuaaaccacaaaauucagag

SEQ ID NO: 547596 - RNA, 22 nt, Human
uguacagauaaagacuguaaau

SEQ ID NO: 547597 - RNA, 23 nt, Human
cagugugacgaggugaggcaggc

SEQ ID NO: 547598 - RNA, 19 nt, Human
ucccucagucugccaggcc

SEQ ID NO: 547599 - RNA, 22 nt, Human
ucugucauaaacacacacaagc

SEQ ID NO: 547600 - RNA, 22 nt, Human
guggccuuuccugaagaaauga

SEQ ID NO: 547601 - RNA, 22 nt, Human
uccagagggcgauggcuggggg

SEQ ID NO: 547602 - RNA, 22 nt, Human
gccuuugcaccaucagugcaau

SEQ ID NO: 547603 - RNA, 22 nt, Human
aagagggcugcaaucuuauugc

SEQ ID NO: 547604 - RNA, 22 nt, Human
gggcccugugauuucuugagga

SEQ ID NO: 547605 - RNA, 23 nt, Human
acagcaagaggaccagaugugag

SEQ ID NO: 547606 - RNA, 22 nt, Human
cugaggugcuagggucccugcu

SEQ ID NO: 547607 - RNA, 22 nt, Human
uaagaagguaguuuccaaguca

SEQ ID NO: 547608 - RNA, 22 nt, Human
ucuguucaguuguaccuucccc

SEQ ID NO: 547609 - RNA, 22 nt, Human
aggcagcuggcagcacccaggg

SEQ ID NO: 547610 - RNA, 22 nt, Human
aaguguuuaacggugauugagc

SEQ ID NO: 547611 - RNA, 22 nt, Human
uucuucaacaaggacacuguua

SEQ ID NO: 547612 - RNA, 22 nt, Human
gccugggagugcacagugaggu

SEQ ID NO: 547613 - RNA, 22 nt, Human
gaaugcacucacccaucacuca

SEQ ID NO: 547614 - RNA, 22 nt, Human
cccaggccccagggcuugucag

SEQ ID NO: 547615 - RNA, 22 nt, Human
cuccagaacugggagagaauaa

SEQ ID NO: 547616 - RNA, 22 nt, Human
uugcauauccuccaacacaugg

SEQ ID NO: 547617 - RNA, 22 nt, Human
ccugugccauccugagcauccc

SEQ ID NO: 547618 - RNA, 22 nt, Human
gugcccugaguggguaggagag

SEQ ID NO: 547619 - RNA, 22 nt, Human
acacauuauagagaguauaaua

SEQ ID NO: 547620 - RNA, 22 nt, Human
accagcuguguccuggcugcag

SEQ ID NO: 547621 - RNA, 22 nt, Human
auggcagagggauugaacagcu

SEQ ID NO: 547622 - RNA, 22 nt, Human
aaagggaggggcgauaagccgg

SEQ ID NO: 547623 - RNA, 22 nt, Human
uacauacagccaaguaugaagu

SEQ ID NO: 547624 - RNA, 22 nt, Human
cuggagccuagguugaccuggg

SEQ ID NO: 547625 - RNA, 22 nt, Human
cccagcacuuugaauaugucac

SEQ ID NO: 547626 - RNA, 22 nt, Human
ugugaagguaaggaggggcaag

SEQ ID NO: 547627 - RNA, 22 nt, Human
gugugcaguagagaaagagcag

SEQ ID NO: 547628 - RNA, 22 nt, Human
cagauggcauuuccuuucuggc

SEQ ID NO: 547629 - RNA, 22 nt, Human
agcagggcagcugaugcgcacg

SEQ ID NO: 547630 - RNA, 22 nt, Human
gcagggacaucuuugucuagua

SEQ ID NO: 547631 - RNA, 22 nt, Human
uuuuuuccaacuuaagacuuca

SEQ ID NO: 547632 - RNA, 22 nt, Human
gccagagguucaacaacugucu

SEQ ID NO: 547633 - RNA, 22 nt, Human
ugcccccagacagaauccaguu

SEQ ID NO: 547634 - RNA, 22 nt, Human
cuggggacuuugguucuccaug

SEQ ID NO: 547635 - RNA, 22 nt, Human
ccucagggacuccaugcugcag

SEQ ID NO: 547636 - RNA, 22 nt, Human
uaaggcuucuuggaauacugca

SEQ ID NO: 547637 - RNA, 21 nt, Human
auggaaauuggcaaaugcuac

SEQ ID NO: 547638 - RNA, 22 nt, Human
agagcaaagggacauggaagag

SEQ ID NO: 547639 - RNA, 22 nt, Human
uggcagcuacagacagagguga

SEQ ID NO: 547640 - RNA, 22 nt, Human
aacaggcaaacugugggauccc

SEQ ID NO: 547641 - RNA, 21 nt, Human
uuuaaggccagcaggagguga

SEQ ID NO: 547642 - RNA, 22 nt, Human
aauguuucaauuaagucuuuua

SEQ ID NO: 547643 - RNA, 22 nt, Human
agcagcugcagggagggucugc

SEQ ID NO: 547644 - RNA, 22 nt, Human
uaguuaggaaaguccagggagc

SEQ ID NO: 547645 - RNA, 22 nt, Human
ugaaaacacuuuaguuuagguc

SEQ ID NO: 547646 - RNA, 23 nt, Human
ugauuacaagggccaaagaaagg

SEQ ID NO: 547647 - RNA, 22 nt, Human
caggaggagcauuagcgucuca

SEQ ID NO: 547648 - RNA, 22 nt, Human
ugcagguggcagcggggcacca

SEQ ID NO: 547649 - RNA, 22 nt, Human
uggggcucaccuaggcuggaag

SEQ ID NO: 547650 - RNA, 22 nt, Human
uucccucuccuacucaggaaag

SEQ ID NO: 547651 - RNA, 22 nt, Human
uuauuauuggugaguuaaggaa

SEQ ID NO: 547652 - RNA, 22 nt, Human
uuuuaaaggauagcucugguug

SEQ ID NO: 547653 - RNA, 22 nt, Human
gcuaguuucuugaauacucuaa

SEQ ID NO: 547654 - RNA, 22 nt, Human
aaagacauggaacuagagaugg

SEQ ID NO: 547655 - RNA, 22 nt, Human
ggaagcugccaguccaccagcu

SEQ ID NO: 547656 - RNA, 22 nt, Human
caggggccggcuguccgugccc

SEQ ID NO: 547657 - RNA, 22 nt, Human
aagguccuuuugcagugugauc

SEQ ID NO: 547658 - RNA, 22 nt, Human
uguaugaaguuacugagccucu

SEQ ID NO: 547659 - RNA, 22 nt, Human
auuacagaagauaugcucaaca

SEQ ID NO: 547660 - RNA, 22 nt, Human
uggcagaauuuuaaagacagau

SEQ ID NO: 547661 - RNA, 22 nt, Human
gcaguuuuauuaugauggaaau

SEQ ID NO: 547662 - RNA, 22 nt, Human
uuucauaaacaguagaagacua

SEQ ID NO: 547663 - RNA, 22 nt, Human
cagagccaaaccucagggcccg

SEQ ID NO: 547664 - RNA, 22 nt, Human
augaggcaggauuaagcuauca

SEQ ID NO: 547665 - RNA, 22 nt, Human
cagaggaagcuggguguggagu

SEQ ID NO: 547666 - RNA, 22 nt, Human
uuucugaagauacagcuuugcu

SEQ ID NO: 547667 - RNA, 22 nt, Human
cagcucccaguggcagcuccuu

SEQ ID NO: 547668 - RNA, 22 nt, Human
auggaaagggaagcaaggaaca

SEQ ID NO: 547669 - RNA, 22 nt, Human
uaauuucacugauaugaaguca

SEQ ID NO: 547670 - RNA, 22 nt, Human
ugcugccuccaacuccugggcu

SEQ ID NO: 547671 - RNA, 22 nt, Human
uaaguucaaugaacucaguucu

SEQ ID NO: 547672 - RNA, 22 nt, Human
cauauugcugucauugucccuc

SEQ ID NO: 547673 - RNA, 22 nt, Human
uccuucaggccucauucucaua

SEQ ID NO: 547674 - RNA, 22 nt, Human
uucaaguagucacacaugauau

SEQ ID NO: 547675 - RNA, 20 nt, Human
cgcccaggagggcccaugug

SEQ ID NO: 547676 - RNA, 19 nt, Human
cugggccagagcuguccuc

SEQ ID NO: 547677 - RNA, 22 nt, Human
ucagggaagagagaucuccuag

SEQ ID NO: 547678 - RNA, 22 nt, Human
uccagagguauguagagaguau

SEQ ID NO: 547679 - RNA, 22 nt, Human
aagugacacauggcacuucuau

SEQ ID NO: 547680 - RNA, 22 nt, Human
acuuuaaagcagaauggcuaug

SEQ ID NO: 547681 - RNA, 22 nt, Human
uaccuugaaaagaaggugcuca

SEQ ID NO: 547682 - RNA, 22 nt, Human
cgagaguggacagggcgcagcu

SEQ ID NO: 547683 - RNA, 22 nt, Human
ucccagggccgcaaacgaguuu

SEQ ID NO: 547684 - RNA, 22 nt, Human
aaauggcauucagcaaccuuuc

SEQ ID NO: 547685 - RNA, 22 nt, Human
gcucucugggugugucuagaua

SEQ ID NO: 547686 - RNA, 22 nt, Human
ugugguggggucugguauucca

SEQ ID NO: 547687 - RNA, 22 nt, Human
cggggccuagcugcacacccuc

SEQ ID NO: 547688 - RNA, 22 nt, Human
ggccccaggaccuccacggucc

SEQ ID NO: 547689 - RNA, 22 nt, Human
ugggaccugcucuuggaaugag

SEQ ID NO: 547690 - RNA, 22 nt, Human
cucugggcugccuuuuagcucu

SEQ ID NO: 547691 - RNA, 18 nt, Human
gagaggcccggcugugcc

SEQ ID NO: 547692 - RNA, 22 nt, Human
caggacccaucagccaggcacu

SEQ ID NO: 547693 - RNA, 22 nt, Human
uaagaugggggaaagaaauagu

SEQ ID NO: 547694 - RNA, 21 nt, Human
gggccuggcugcgcaggacgg

SEQ ID NO: 547695 - RNA, 22 nt, Human
agaggccagaaaguaugccacc

SEQ ID NO: 547696 - RNA, 22 nt, Human
uuccauuguuucugucuucacu

SEQ ID NO: 547697 - RNA, 22 nt, Human
cguaugaaauuuuugacauuug

SEQ ID NO: 547698 - RNA, 22 nt, Human
ccuggcucuucagagguuccua

SEQ ID NO: 547699 - RNA, 22 nt, Human
uuucagagaauuagaagcugau

SEQ ID NO: 547700 - RNA, 22 nt, Human
ugcagugaggcaguuggguugg

SEQ ID NO: 547701 - RNA, 22 nt, Human
aggaaggacugcagcauuuggu

SEQ ID NO: 547702 - RNA, 22 nt, Human
uguuccauaaguggugcuuugu

SEQ ID NO: 547703 - RNA, 22 nt, Human
aagcaucaacacuauauugaug

SEQ ID NO: 547704 - RNA, 22 nt, Human
ugugauuauuugauuaacaugu

SEQ ID NO: 547705 - RNA, 23 nt, Human
ucuguacaauugagaagagaaca

SEQ ID NO: 547706 - RNA, 22 nt, Human
gccagggaaacugcagaccagc

SEQ ID NO: 547707 - RNA, 22 nt, Human
uccagggaccucccugagagcu

SEQ ID NO: 547708 - RNA, 22 nt, Human
gaagaagguggcccagggguag

SEQ ID NO: 547709 - RNA, 18 nt, Human
acagaggcagacauguau

SEQ ID NO: 547710 - RNA, 22 nt, Human
gagauaaauuuuugauaaauau

SEQ ID NO: 547711 - RNA, 22 nt, Human
gcugagugauugauauuuuagu

SEQ ID NO: 547712 - RNA, 22 nt, Human
ggcaggugaggcaugugccugg

SEQ ID NO: 547713 - RNA, 22 nt, Human
caacauuugaguaaagaaaugg

SEQ ID NO: 547714 - RNA, 22 nt, Human
ggcuggcuggcuuagcagagga

SEQ ID NO: 547715 - RNA, 22 nt, Human
uuuguaaaauuagggaauucaa

SEQ ID NO: 547716 - RNA, 22 nt, Human
gacugcagugaaggcacauggg

SEQ ID NO: 547717 - RNA, 23 nt, Human
uggaggaaacacaucagaagacc

SEQ ID NO: 547718 - RNA, 22 nt, Human
aaugcagugagccauuaaaugg

SEQ ID NO: 547719 - RNA, 22 nt, Human
cucugguuucgcaggaaauaga

SEQ ID NO: 547720 - RNA, 22 nt, Human
cagggccaggcugauggccugg

SEQ ID NO: 547721 - RNA, 19 nt, Human
ucucuucucccugguuuua

SEQ ID NO: 547722 - RNA, 22 nt, Human
accauuugaaggaaucauugac

SEQ ID NO: 547723 - RNA, 22 nt, Human
aucaggauucaguaucuccagc

SEQ ID NO: 547724 - RNA, 22 nt, Human
acaguauauaugguuaucugau

SEQ ID NO: 547725 - RNA, 22 nt, Human
ugugaaagucaaauuaauugaa

SEQ ID NO: 547726 - RNA, 22 nt, Human
uggaauggaaacaaacugagga

SEQ ID NO: 547727 - RNA, 22 nt, Human
gcaggagcaaacugcagugugg

SEQ ID NO: 547728 - RNA, 19 nt, Human
agccagggugagaaggagc

SEQ ID NO: 547729 - RNA, 22 nt, Human
ugggccacacacagaagaauca

SEQ ID NO: 547730 - RNA, 20 nt, Human
uggcaggaggcagcagugga

SEQ ID NO: 547731 - RNA, 22 nt, Human
ugcagaagugagucaugaggaa

SEQ ID NO: 547732 - RNA, 22 nt, Human
cuccuugguguaguacugagca

SEQ ID NO: 547733 - RNA, 22 nt, Human
gguuucaaauuaaagucuuaag

SEQ ID NO: 547734 - RNA, 22 nt, Human
uuccaguucccaugaggauuaa

SEQ ID NO: 547735 - RNA, 22 nt, Human
ccuggagcacagcccaguccca

SEQ ID NO: 547736 - RNA, 22 nt, Human
uggcccugcuggacacgccugc

SEQ ID NO: 547737 - RNA, 22 nt, Human
acagagucucagggaugaaagc

SEQ ID NO: 547738 - RNA, 22 nt, Human
gguuugcaugugauguugggca

SEQ ID NO: 547739 - RNA, 22 nt, Human
accauuaaucucacaaggauaa

SEQ ID NO: 547740 - RNA, 22 nt, Human
cccugcugaaucccauggaguc

SEQ ID NO: 547741 - RNA, 22 nt, Human
ggauggagaugaccauggugac

SEQ ID NO: 547742 - RNA, 22 nt, Human
ccagcuaggcuugcacucuugu

SEQ ID NO: 547743 - RNA, 22 nt, Human
uacauacauuaccucauuuagu

SEQ ID NO: 547744 - RNA, 22 nt, Human
gcagcagaggcccuacucuuug

SEQ ID NO: 547745 - RNA, 22 nt, Human
uagcagaggcugucugacuuaa

SEQ ID NO: 547746 - RNA, 22 nt, Human
gccugagagacccauggggcaa

SEQ ID NO: 547747 - RNA, 22 nt, Human
ugguggcagcugagugucaggu

SEQ ID NO: 547748 - RNA, 22 nt, Human
uuugaaaggagcuuuauccaga

SEQ ID NO: 547749 - RNA, 18 nt, Human
ugcaggcuguugaaacug

SEQ ID NO: 547750 - RNA, 22 nt, Human
ugcucugucaagaaaagaugcc

SEQ ID NO: 547751 - RNA, 20 nt, Human
guccugggagccacagcaca

SEQ ID NO: 547752 - RNA, 22 nt, Human
gaguuauuaauggcugaguuug

SEQ ID NO: 547753 - RNA, 22 nt, Human
uacauucaacaugucacuaugu

SEQ ID NO: 547754 - RNA, 22 nt, Human
uuccucuccucccaccagguga

SEQ ID NO: 547755 - RNA, 19 nt, Human
agggagaauuccaagagga

SEQ ID NO: 547756 - RNA, 22 nt, Human
ggcugugaacacucuuagcauc

SEQ ID NO: 547757 - RNA, 22 nt, Human
aucuuuaggaaccuaaccuauu

SEQ ID NO: 547758 - RNA, 22 nt, Human
agaugugguaguugaagggaag

SEQ ID NO: 547759 - RNA, 22 nt, Human
aaaugccucugcuguacacaau

SEQ ID NO: 547760 - RNA, 22 nt, Human
aggagagagaacacuugggucc

SEQ ID NO: 547761 - RNA, 22 nt, Human
uguccugggaaugggaugcagu

SEQ ID NO: 547762 - RNA, 22 nt, Human
cagagccagcaguggggacagg

SEQ ID NO: 547763 - RNA, 22 nt, Human
ucccagggucaguggugaggcc

SEQ ID NO: 547764 - RNA, 17 nt, Human
ugaaaucagcacccagg

SEQ ID NO: 547765 - RNA, 22 nt, Human
caguggaaaucagagugagagu

SEQ ID NO: 547766 - RNA, 22 nt, Human
gauacaaauucaugucugaauu

SEQ ID NO: 547767 - RNA, 22 nt, Human
aguuaguagacuuuuccauuua

SEQ ID NO: 547768 - RNA, 22 nt, Human
ggcagcugaccuagcaccaucc

SEQ ID NO: 547769 - RNA, 20 nt, Human
uguuccaagcuaaugaauga

SEQ ID NO: 547770 - RNA, 21 nt, Human
uucaauacuauuucaauaguc

SEQ ID NO: 547771 - RNA, 22 nt, Human
augggcugagaaucaagaauau

SEQ ID NO: 547772 - RNA, 22 nt, Human
aaaugcagugguucuacuucuc

SEQ ID NO: 547773 - RNA, 22 nt, Human
ccagcuccgggaguugcugcug

SEQ ID NO: 547774 - RNA, 22 nt, Human
augggaggguggaaaggcucug

SEQ ID NO: 547775 - RNA, 22 nt, Human
uuccuuccauagcaaaacaugc

SEQ ID NO: 547776 - RNA, 22 nt, Human
ucucuggaguauaaccagggau

SEQ ID NO: 547777 - RNA, 22 nt, Human
uuugaaaggugucgagaugugu

SEQ ID NO: 547778 - RNA, 17 nt, Human
agcaggcugcagaggcc

SEQ ID NO: 547779 - RNA, 22 nt, Human
cccuccuggaggcggaugccca

SEQ ID NO: 547780 - RNA, 21 nt, Human
caucagauuuagaaguucuau

SEQ ID NO: 547781 - RNA, 22 nt, Human
cagcacacagugacucgcaccu

SEQ ID NO: 547782 - RNA, 22 nt, Human
acauugaacaguacaaaugauc

SEQ ID NO: 547783 - RNA, 22 nt, Human
aucuggcucauucagggaacgg

SEQ ID NO: 547784 - RNA, 22 nt, Human
agagucagaaagcagacagggg

SEQ ID NO: 547785 - RNA, 22 nt, Human
uauuucagcaagaagaaugugg

SEQ ID NO: 547786 - RNA, 22 nt, Human
cuggggaggcagggcugccccu

SEQ ID NO: 547787 - RNA, 22 nt, Human
aacaugaaacccaaacagaaua

SEQ ID NO: 547788 - RNA, 22 nt, Human
uggagcccagggugagaaggag

SEQ ID NO: 547789 - RNA, 22 nt, Human
ucuggcuccaccuccuuuacua

SEQ ID NO: 547790 - RNA, 22 nt, Human
agagugucugguagcugcucug

SEQ ID NO: 547791 - RNA, 22 nt, Human
ccaggcagcucugauuuauguc

SEQ ID NO: 547792 - RNA, 22 nt, Human
ugcaaucagguaccauuugauu

SEQ ID NO: 547793 - RNA, 18 nt, Human
uuucacaaccuccagagg

SEQ ID NO: 547794 - RNA, 22 nt, Human
gcucccaggaagagaagggcca

SEQ ID NO: 547795 - RNA, 22 nt, Human
uggccugcucugacuuuggggg

SEQ ID NO: 547796 - RNA, 16 nt, Human
gcugggagggagaggu

SEQ ID NO: 547797 - RNA, 21 nt, Human
uaaaucucuguauucuucagu

SEQ ID NO: 547798 - RNA, 22 nt, Human
ccagcccuugagauggaaggga

SEQ ID NO: 547799 - RNA, 22 nt, Human
cagugcaggcugggggcccugc

SEQ ID NO: 547800 - RNA, 20 nt, Human
aaagcaguaugcaaguagag

SEQ ID NO: 547801 - RNA, 22 nt, Human
agugaaauggaugcugcuacug

SEQ ID NO: 547802 - RNA, 22 nt, Human
uaugcacauauaaccugcacug

SEQ ID NO: 547803 - RNA, 19 nt, Human
caaguuaaaaugaggucau

SEQ ID NO: 547804 - RNA, 22 nt, Human
gucuacaaagcauauaaaagag

SEQ ID NO: 547805 - RNA, 22 nt, Human
ucuccucugcgcggcagugccc

SEQ ID NO: 547806 - RNA, 22 nt, Human
uguccuuuucuuuagugcagcu

SEQ ID NO: 547807 - RNA, 22 nt, Human
uccauaagcagguucuuccuga

SEQ ID NO: 547808 - RNA, 22 nt, Human
uuaaaaucacagucacccagua

SEQ ID NO: 547809 - RNA, 22 nt, Human
ggcucugcccagguggacagca

SEQ ID NO: 547810 - RNA, 22 nt, Human
gucagcuacugcagggaacuuu

SEQ ID NO: 547811 - RNA, 22 nt, Human
ugggcagauguggcucuccuug

SEQ ID NO: 547812 - RNA, 22 nt, Human
gaauucugucgcuuacuagaug

SEQ ID NO: 547813 - RNA, 22 nt, Human
acaggaaauuggcauaucaguu

SEQ ID NO: 547814 - RNA, 22 nt, Human
ugcagggccccucugcaugagu

SEQ ID NO: 547815 - RNA, 22 nt, Human
ucuucauguauacucaugguac

SEQ ID NO: 547816 - RNA, 22 nt, Human
uccuggauggagcugcccucgc

SEQ ID NO: 547817 - RNA, 22 nt, Human
acuguccauucacucauauuca

SEQ ID NO: 547818 - RNA, 22 nt, Human
auacaugugggucuaaacauau

SEQ ID NO: 547819 - RNA, 22 nt, Human
uccuuuccagccucaccucagc

SEQ ID NO: 547820 - RNA, 22 nt, Human
gaauucuuugaucuuaaucuug

SEQ ID NO: 547821 - RNA, 22 nt, Human
uuuuaucuucauuccuaucuac

SEQ ID NO: 547822 - RNA, 22 nt, Human
cuuaagaauauugaaguugugg

SEQ ID NO: 547823 - RNA, 22 nt, Human
caggaguggugugagggacucc

SEQ ID NO: 547824 - RNA, 22 nt, Human
aaagucauuguaauauaugcua

SEQ ID NO: 547825 - RNA, 21 nt, Human
acagggcaugcagcuggcugu

SEQ ID NO: 547826 - RNA, 20 nt, Human
uucuacaaaacugauucuga

SEQ ID NO: 547827 - RNA, 22 nt, Human
gggacuucauagcuaggcacuu

SEQ ID NO: 547828 - RNA, 22 nt, Human
agucucuuucuaaauaagguca

SEQ ID NO: 547829 - RNA, 22 nt, Human
cccacacauuuuucacuuaccg

SEQ ID NO: 547830 - RNA, 22 nt, Human
ggaagccaguugcuuggugugg

SEQ ID NO: 547831 - RNA, 19 nt, Human
uuugaauccagcugguaac

SEQ ID NO: 547832 - RNA, 22 nt, Human
aacagucugggaguuccuuaua

SEQ ID NO: 547833 - RNA, 22 nt, Human
gcccagcugcacccuggugggu

SEQ ID NO: 547834 - RNA, 22 nt, Human
agaaauguacgauguuaugcag

SEQ ID NO: 547835 - RNA, 22 nt, Human
ucccuggagauaacuucuggga

SEQ ID NO: 547836 - RNA, 20 nt, Human
gcagcagugcaaguccucuu

SEQ ID NO: 547837 - RNA, 22 nt, Human
cuggcccuguggaggcaggaac

SEQ ID NO: 547838 - RNA, 22 nt, Human
ggacaggguaaguacuagugug

SEQ ID NO: 547839 - RNA, 22 nt, Human
agcaaggggcagugaaagugug

SEQ ID NO: 547840 - RNA, 22 nt, Human
guaaucucagcuacuugggagg

SEQ ID NO: 547841 - RNA, 22 nt, Human
uuguuuuugugaggcagcccau

SEQ ID NO: 547842 - RNA, 21 nt, Human
aucuuuauuacgcagagaaga

SEQ ID NO: 547843 - RNA, 22 nt, Human
auggggggaugaaggaguccaa

SEQ ID NO: 547844 - RNA, 22 nt, Human
ccacaggcugcugcaggucccg

SEQ ID NO: 547845 - RNA, 22 nt, Human
aaacuucauggauaauauaaag

SEQ ID NO: 547846 - RNA, 22 nt, Human
uuaaguaagaccuuaugucuug

SEQ ID NO: 547847 - RNA, 22 nt, Human
uuaaaugacuuuuauuauucuc

SEQ ID NO: 547848 - RNA, 22 nt, Human
ugggcaggcaagugaauaccuu

SEQ ID NO: 547849 - RNA, 22 nt, Human
ucagcacugucuuuuauuugaa

SEQ ID NO: 547850 - RNA, 22 nt, Human
uuuuaaaggcagauuauggcuu

SEQ ID NO: 547851 - RNA, 22 nt, Human
ucccagagcagaugugcuaaag

SEQ ID NO: 547852 - RNA, 22 nt, Human
aaaguuuuagaacuaggaagca

SEQ ID NO: 547853 - RNA, 21 nt, Human
uagcuuuaauauucccacauu

SEQ ID NO: 547854 - RNA, 22 nt, Human
cagaggccaccuguggccacug

SEQ ID NO: 547855 - RNA, 23 nt, Human
ccugcucaggcgugugcccugcu

SEQ ID NO: 547856 - RNA, 22 nt, Human
cucaaggacuuauucaugccug

SEQ ID NO: 547857 - RNA, 20 nt, Human
agguccugguucucugggau

SEQ ID NO: 547858 - RNA, 23 nt, Human
ugaaaguucugaagagaucaugc

SEQ ID NO: 547859 - RNA, 22 nt, Human
uuuuaccacugggugacaugga

SEQ ID NO: 547860 - RNA, 18 nt, Human
cucaggccuuucccugug

SEQ ID NO: 547861 - RNA, 22 nt, Human
gcauuucaugccguggaagucc

SEQ ID NO: 547862 - RNA, 22 nt, Human
aagcugcccucauucccagugc

SEQ ID NO: 547863 - RNA, 22 nt, Human
cggggcugcucguccuccugug

SEQ ID NO: 547864 - RNA, 22 nt, Human
ugcaggcugccuucacagagcc

SEQ ID NO: 547865 - RNA, 22 nt, Human
aaguguuuaugguuauuguuaa

SEQ ID NO: 547866 - RNA, 22 nt, Human
ucacugcucucuaagcaucgcc

SEQ ID NO: 547867 - RNA, 22 nt, Human
ugcauauugugaaaauguagau

SEQ ID NO: 547868 - RNA, 22 nt, Human
cuaaaauuaucaagauaauucc

SEQ ID NO: 547869 - RNA, 22 nt, Human
caggugggcuugggagaacacu

SEQ ID NO: 547870 - RNA, 21 nt, Human
auuauuauuucuguguccagc

SEQ ID NO: 547871 - RNA, 22 nt, Human
gaaagccaucuggcugcuggga

SEQ ID NO: 547872 - RNA, 22 nt, Human
agaaauuaggaaaguaacacuu

SEQ ID NO: 547873 - RNA, 22 nt, Human
acuuccugcaaucguccacucc

SEQ ID NO: 547874 - RNA, 22 nt, Human
uacaaagugaaauaauucugag

SEQ ID NO: 547875 - RNA, 22 nt, Human
cagagacagggcagggagugug

SEQ ID NO: 547876 - RNA, 22 nt, Human
uaggcugggcugagcuggacgg

SEQ ID NO: 547877 - RNA, 22 nt, Human
agccccucuguggcucugccuc

SEQ ID NO: 547878 - RNA, 22 nt, Human
uuucugacugguguauaauagg

SEQ ID NO: 547879 - RNA, 22 nt, Human
uaauaacaauuguaggacauga

SEQ ID NO: 547880 - RNA, 22 nt, Human
ccugagggcgccgagcucccag

SEQ ID NO: 547881 - RNA, 22 nt, Human
caauguuuacuggggacccaga

SEQ ID NO: 547882 - RNA, 22 nt, Human
gucuucuguucugugaggcuuc

SEQ ID NO: 547883 - RNA, 22 nt, Human
ucaaagucacaacucucuaauu

SEQ ID NO: 547884 - RNA, 22 nt, Human
cugucaucacaguugagcagcc

SEQ ID NO: 547885 - RNA, 22 nt, Human
uguaacagagcuuuuuuauagc

SEQ ID NO: 547886 - RNA, 22 nt, Human
ugccagaagugcuuuauaagug

SEQ ID NO: 547887 - RNA, 20 nt, Human
agguguccacguggcagggu

SEQ ID NO: 547888 - RNA, 22 nt, Human
ucagaaaaugaaauggacucuc

SEQ ID NO: 547889 - RNA, 22 nt, Human
cagcugagaaaggcaggcucac

SEQ ID NO: 547890 - RNA, 20 nt, Human
acugugaaugcugaauuagc

SEQ ID NO: 547891 - RNA, 22 nt, Human
aauuuuguucuuggaaaucagg

SEQ ID NO: 547892 - RNA, 22 nt, Human
uuucuuuugaauaguguguggu

SEQ ID NO: 547893 - RNA, 22 nt, Human
gcucccuguucucagccaugau

SEQ ID NO: 547894 - RNA, 22 nt, Human
ggaaagaccugagauaggaaua

SEQ ID NO: 547895 - RNA, 22 nt, Human
ggccucugcccucacuccuguc

SEQ ID NO: 547896 - RNA, 22 nt, Human
uggcuuccugcauggauccucu

SEQ ID NO: 547897 - RNA, 22 nt, Human
cacagcugugagaagggagccu

SEQ ID NO: 547898 - RNA, 20 nt, Human
uggcaggaauagggccagag

SEQ ID NO: 547899 - RNA, 22 nt, Human
ugucauucauuuaaguauguuu

SEQ ID NO: 547900 - RNA, 22 nt, Human
ccaaaguccuuucuccaccugc

SEQ ID NO: 547901 - RNA, 19 nt, Human
gagcacagcggcauuuggu

SEQ ID NO: 547902 - RNA, 20 nt, Human
uuugauuucacaaggccagu

SEQ ID NO: 547903 - RNA, 20 nt, Human
aauaaacuacugagagaugu

SEQ ID NO: 547904 - RNA, 22 nt, Human
uaauauacuucccauaguuuga

SEQ ID NO: 547905 - RNA, 22 nt, Human
acaacuuucuggguuaucugau

SEQ ID NO: 547906 - RNA, 22 nt, Human
aggguccugggugcaguugcuu

SEQ ID NO: 547907 - RNA, 22 nt, Human
cugcagagcaaguaacauccuc

SEQ ID NO: 547908 - RNA, 22 nt, Human
uuuucucaggugcuuaucuaag

SEQ ID NO: 547909 - RNA, 22 nt, Human
ucccaaggcacagggcagggac

SEQ ID NO: 547910 - RNA, 22 nt, Human
cagcugggagcuccauuagaua

SEQ ID NO: 547911 - RNA, 22 nt, Human
uggagccaaggccaguucucag

SEQ ID NO: 547912 - RNA, 22 nt, Human
cugagaucuuuauacgaggcac

SEQ ID NO: 547913 - RNA, 22 nt, Human
aauaaacaaaucuuuccugugg

SEQ ID NO: 547914 - RNA, 22 nt, Human
uauuucuuucagguauguguug

SEQ ID NO: 547915 - RNA, 22 nt, Human
uuggaaaaauugccugaugucu

SEQ ID NO: 547916 - RNA, 19 nt, Human
ccuggguccacucagacua

SEQ ID NO: 547917 - RNA, 22 nt, Human
aauuuggcagugucuugaagua

SEQ ID NO: 547918 - RNA, 22 nt, Human
ggcagugaugucaaacagugaa

SEQ ID NO: 547919 - RNA, 22 nt, Human
uucugucacuuaggaggucaua

SEQ ID NO: 547920 - RNA, 22 nt, Human
uuuccucugggcccugccaccc

SEQ ID NO: 547921 - RNA, 22 nt, Human
gaugauuuuguuggugauucaa

SEQ ID NO: 547922 - RNA, 22 nt, Human
gcugauuauuacaugucugugg

SEQ ID NO: 547923 - RNA, 22 nt, Human
aaaaguugcaaaauugcucuuc

SEQ ID NO: 547924 - RNA, 22 nt, Human
agagaagacuuacagccacagu

SEQ ID NO: 547925 - RNA, 22 nt, Human
uaaacaagaaacauuuucuguu

SEQ ID NO: 547926 - RNA, 22 nt, Human
cuuucucuguguuucacaugcu

SEQ ID NO: 547927 - RNA, 22 nt, Human
ggcuccacccugcuuccagaag

SEQ ID NO: 547928 - RNA, 22 nt, Human
gcaaggaagcagaguugcuauc

SEQ ID NO: 547929 - RNA, 22 nt, Human
agcaguggcugaagauguuccu

SEQ ID NO: 547930 - RNA, 22 nt, Human
caugagauuugggaggggccag

SEQ ID NO: 547931 - RNA, 22 nt, Human
auguaagguucagaguauguga

SEQ ID NO: 547932 - RNA, 22 nt, Human
aucagacaauuguugaguacug

SEQ ID NO: 547933 - RNA, 22 nt, Human
gcaguggcaugaugugggcuca

SEQ ID NO: 547934 - RNA, 22 nt, Human
cacaaaauaucaagcacuuuua

SEQ ID NO: 547935 - RNA, 22 nt, Human
gagguggccaagcgaggaaggg

SEQ ID NO: 547936 - RNA, 22 nt, Human
agauuucccacuccauguauug

SEQ ID NO: 547937 - RNA, 22 nt, Human
aaacacuagcaggaagcacuga

SEQ ID NO: 547938 - RNA, 22 nt, Human
cugaaugaggaaaagagugagg

SEQ ID NO: 547939 - RNA, 22 nt, Human
caaggcugcugcgggucgcacc

SEQ ID NO: 547940 - RNA, 22 nt, Human
aagaagguguggaaagaugcuc

SEQ ID NO: 547941 - RNA, 22 nt, Human
cagaagcacuaggaggaaacgu

SEQ ID NO: 547942 - RNA, 22 nt, Human
cauguccacaguucugagaggc

SEQ ID NO: 547943 - RNA, 22 nt, Human
uaaucacaucaggguaaauggg

SEQ ID NO: 547944 - RNA, 22 nt, Human
ccaggcugggcuacaaguugag

SEQ ID NO: 547945 - RNA, 22 nt, Human
ggucaggguauaaucaagugag

SEQ ID NO: 547946 - RNA, 22 nt, Human
auugcuggcugccaucuugccc

SEQ ID NO: 547947 - RNA, 22 nt, Human
aaguaugcuaauuaacuagcac

SEQ ID NO: 547948 - RNA, 22 nt, Human
agaggcuccaccuucucugucc

SEQ ID NO: 547949 - RNA, 22 nt, Human
acuugccuguuacauuucuagu

SEQ ID NO: 547950 - RNA, 22 nt, Human
gucauuguguggacauggagaa

SEQ ID NO: 547951 - RNA, 22 nt, Human
uggggccuggucagagcugcac

SEQ ID NO: 547952 - RNA, 22 nt, Human
agaaaauuuaaagagacacaca

SEQ ID NO: 547953 - RNA, 22 nt, Human
gagccuggauugaagugggugg

SEQ ID NO: 547954 - RNA, 22 nt, Human
ggcagcuggggcagugcccugu

SEQ ID NO: 547955 - RNA, 22 nt, Human
ugaggaggucagagucuggcug

SEQ ID NO: 547956 - RNA, 22 nt, Human
aaggcugagccagggccccuau

SEQ ID NO: 547957 - RNA, 22 nt, Human
ugccucugaggaagauuguguu

SEQ ID NO: 547958 - RNA, 22 nt, Human
caggcagccuucucgucucaca

SEQ ID NO: 547959 - RNA, 22 nt, Human
uugaagcacaaugucuuuuauc

SEQ ID NO: 547960 - RNA, 22 nt, Human
gacaggcuucauccucagaguu

SEQ ID NO: 547961 - RNA, 22 nt, Human
uauuuugagguauuuuugagcu

SEQ ID NO: 547962 - RNA, 22 nt, Human
ugggccugagcucaccaggggc

SEQ ID NO: 547963 - RNA, 22 nt, Human
ucagagugaccuuacauggucu

SEQ ID NO: 547964 - RNA, 22 nt, Human
ccaaaguauuaaaucuuagcaa

SEQ ID NO: 547965 - RNA, 22 nt, Human
uauuucuucgggauucaagcua

SEQ ID NO: 547966 - RNA, 22 nt, Human
cagggagcuggugccagccgac

SEQ ID NO: 547967 - RNA, 21 nt, Human
uggcucugaaagagugcugca

SEQ ID NO: 547968 - RNA, 22 nt, Human
uucuuauaaguuaauauuucca

SEQ ID NO: 547969 - RNA, 22 nt, Human
ggcugccuccucgagacaggau

SEQ ID NO: 547970 - RNA, 22 nt, Human
aaugcugcucucauaauuauag

SEQ ID NO: 547971 - RNA, 22 nt, Human
aaugagcugcugcuguuccacc

SEQ ID NO: 547972 - RNA, 22 nt, Human
uuuacagcuucuauacuaugug

SEQ ID NO: 547973 - RNA, 22 nt, Human
ggaggcggagcuugcagugagc

SEQ ID NO: 547974 - RNA, 22 nt, Human
uccaggcuagguuuacaggaca

SEQ ID NO: 547975 - RNA, 22 nt, Human
gagguggguguaucacagguca

SEQ ID NO: 547976 - RNA, 22 nt, Human
ugcuccugagguuggagaucca

SEQ ID NO: 547977 - RNA, 22 nt, Human
cuugcuuaccuaguuagcucca

SEQ ID NO: 547978 - RNA, 22 nt, Human
gccuucugugcuccuggccuuu

SEQ ID NO: 547979 - RNA, 22 nt, Human
agggacaguuacaucaucagac

SEQ ID NO: 547980 - RNA, 22 nt, Human
aucagcaagauugugucuugua

SEQ ID NO: 547981 - RNA, 22 nt, Human
uccugccuuagagcaaggaaaa

SEQ ID NO: 547982 - RNA, 22 nt, Human
agaagauuuagguugacgcuau

SEQ ID NO: 547983 - RNA, 22 nt, Human
ccugugcuuuaggccucaaacu

SEQ ID NO: 547984 - RNA, 22 nt, Human
uucaauucuaaacuaauauucu

SEQ ID NO: 547985 - RNA, 22 nt, Human
aguggggaagagcaugggcccu

SEQ ID NO: 547986 - RNA, 20 nt, Human
aagagaagaagucuuugaaa

SEQ ID NO: 547987 - RNA, 22 nt, Human
gcucuggguagccacugccugg

SEQ ID NO: 547988 - RNA, 22 nt, Human
aggcacugcuucuaaguaggaa

SEQ ID NO: 547989 - RNA, 22 nt, Human
uugcauugaaaauauauuuuaa

SEQ ID NO: 547990 - RNA, 22 nt, Human
gcugccugaaauguugccuagc

SEQ ID NO: 547991 - RNA, 22 nt, Human
ugaaaugagagcacagaauaaa

SEQ ID NO: 547992 - RNA, 22 nt, Human
uugguucacauuagauuuccuu

SEQ ID NO: 547993 - RNA, 22 nt, Human
cagccaggagccucugcaacua

SEQ ID NO: 547994 - RNA, 19 nt, Human
guauuucaggacaagacgu

SEQ ID NO: 547995 - RNA, 23 nt, Human
aauauauguguuuuucugcuuca

SEQ ID NO: 547996 - RNA, 22 nt, Human
ucaggcugaaggaggccuaucu

SEQ ID NO: 547997 - RNA, 22 nt, Human
cagcugugauuccugcugucca

SEQ ID NO: 547998 - RNA, 22 nt, Human
aggcucagcaucugauucauau

SEQ ID NO: 547999 - RNA, 22 nt, Human
cugcuuuagacaacugcuggga

SEQ ID NO: 548000 - RNA, 21 nt, Human
ucacacacguuuccaagggca

SEQ ID NO: 548001 - RNA, 22 nt, Human
cugcugagagcugaaggcugua

SEQ ID NO: 548002 - RNA, 22 nt, Human
accagcagaguugaggaggaca

SEQ ID NO: 548003 - RNA, 22 nt, Human
ugccaggcugcccuccagucug

SEQ ID NO: 548004 - RNA, 20 nt, Human
gcugccuuguccugcuuggu

SEQ ID NO: 548005 - RNA, 22 nt, Human
gcccagcacauugcugaggacc

SEQ ID NO: 548006 - RNA, 22 nt, Human
uccagccaacugccuagggagc

SEQ ID NO: 548007 - RNA, 22 nt, Human
ggggauggugggaaggcaaucu

SEQ ID NO: 548008 - RNA, 22 nt, Human
uagauguuccacauauauaugu

SEQ ID NO: 548009 - RNA, 22 nt, Human
acaauucucucauaucuuauua

SEQ ID NO: 548010 - RNA, 22 nt, Human
ucaucuucuauuaauagggaga

SEQ ID NO: 548011 - RNA, 22 nt, Human
cugccacuuacuaggcauggug

SEQ ID NO: 548012 - RNA, 22 nt, Human
caggggcucugggugaugugag

SEQ ID NO: 548013 - RNA, 22 nt, Human
agcauuuaggagaauuugagaa

SEQ ID NO: 548014 - RNA, 22 nt, Human
agaugauggccauguccucucc

SEQ ID NO: 548015 - RNA, 22 nt, Human
cagaacuguuauaacagcuguu

SEQ ID NO: 548016 - RNA, 22 nt, Human
gcugucugucucugugacuuaa

SEQ ID NO: 548017 - RNA, 22 nt, Human
caggccucaggggcucaggcug

SEQ ID NO: 548018 - RNA, 22 nt, Human
ugagaauucuacaauagaucaa

SEQ ID NO: 548019 - RNA, 22 nt, Human
uggccagcccucuucccacacu

SEQ ID NO: 548020 - RNA, 22 nt, Human
ggcucuggugggaagguuagau

SEQ ID NO: 548021 - RNA, 22 nt, Human
aaguucaaguaguguuacaugg

SEQ ID NO: 548022 - RNA, 22 nt, Human
gcccugucccuuggcuucuagg

SEQ ID NO: 548023 - RNA, 22 nt, Human
acagauggcacuuuuuaggacu

SEQ ID NO: 548024 - RNA, 23 nt, Human
uggaagcagaaguuucaauaucc

SEQ ID NO: 548025 - RNA, 21 nt, Human
ugcagcugacacugguaugcc

SEQ ID NO: 548026 - RNA, 22 nt, Human
uucuaaaauaaguuuaucuggu

SEQ ID NO: 548027 - RNA, 22 nt, Human
ugcagucuuuccucgaguuugu

SEQ ID NO: 548028 - RNA, 22 nt, Human
agccuggaauuaaggaaaugca

SEQ ID NO: 548029 - RNA, 22 nt, Human
accccagcccugcuucugggag

SEQ ID NO: 548030 - RNA, 22 nt, Human
aaaugcacaaaguaaguguaau

SEQ ID NO: 548031 - RNA, 22 nt, Human
ggcugcugggaauaugccagcu

SEQ ID NO: 548032 - RNA, 22 nt, Human
auuucuucagguucuucuagga

SEQ ID NO: 548033 - RNA, 22 nt, Human
uuacagauggaucuagcaaaau

SEQ ID NO: 548034 - RNA, 22 nt, Human
aauuuuguuuaagugaucugcu

SEQ ID NO: 548035 - RNA, 18 nt, Human
uaggaaccacuugcagag

SEQ ID NO: 548036 - RNA, 22 nt, Human
cuggcccuaugagccuccugau

SEQ ID NO: 548037 - RNA, 22 nt, Human
cguuccucuacuccagcuaccc

SEQ ID NO: 548038 - RNA, 22 nt, Human
gaggagagggcugcgggcccac

SEQ ID NO: 548039 - RNA, 22 nt, Human
uuucuucuaggacuaauaagag

SEQ ID NO: 548040 - RNA, 23 nt, Human
agaaaaacaggauuguguuccua

SEQ ID NO: 548041 - RNA, 20 nt, Human
aauguauuguuuuguuucag

SEQ ID NO: 548042 - RNA, 21 nt, Human
caucaacucuugugcucacac

SEQ ID NO: 548043 - RNA, 22 nt, Human
gcugggcugagaaguuaagcaa

SEQ ID NO: 548044 - RNA, 22 nt, Human
aaaaaugcugugguagcugugu

SEQ ID NO: 548045 - RNA, 22 nt, Human
gcccugggauuggguggaggcu

SEQ ID NO: 548046 - RNA, 22 nt, Human
uucaacuagauuuauacaauuc

SEQ ID NO: 548047 - RNA, 22 nt, Human
uuauuccauucaguucaacaag

SEQ ID NO: 548048 - RNA, 22 nt, Human
guuccuauauagccuuaaggau

SEQ ID NO: 548049 - RNA, 22 nt, Human
aaagguuugcauggaauuuacc

SEQ ID NO: 548050 - RNA, 21 nt, Human
uucaaagagugggcauuguca

SEQ ID NO: 548051 - RNA, 22 nt, Human
aacacuuaaggagagaucaaau

SEQ ID NO: 548052 - RNA, 22 nt, Human
ucagacaguuugcagugugccu

SEQ ID NO: 548053 - RNA, 22 nt, Human
aggcugcagaacagucaggugc

SEQ ID NO: 548054 - RNA, 22 nt, Human
agaucaaagccaugagagauuu

SEQ ID NO: 548055 - RNA, 22 nt, Human
auuagggcuggaugcaaggaaa

SEQ ID NO: 548056 - RNA, 22 nt, Human
caccuagggcaucccugcccca

SEQ ID NO: 548057 - RNA, 22 nt, Human
ucccaccaggugaccauuucau

SEQ ID NO: 548058 - RNA, 22 nt, Human
aguauuuagagacacaagaugg

SEQ ID NO: 548059 - RNA, 22 nt, Human
ugugcucuggaguugccuucac

SEQ ID NO: 548060 - RNA, 22 nt, Human
ggaacacagugccuuacaaacu

SEQ ID NO: 548061 - RNA, 22 nt, Human
ugaaggaauggaggaucagagc

SEQ ID NO: 548062 - RNA, 22 nt, Human
acaguggaaagaacauggauuu

SEQ ID NO: 548063 - RNA, 22 nt, Human
acaguggaaaugugggagggga

SEQ ID NO: 548064 - RNA, 22 nt, Human
agaguucugcucuucucaguga

SEQ ID NO: 548065 - RNA, 22 nt, Human
gaggcagccagagguucucauu

SEQ ID NO: 548066 - RNA, 22 nt, Human
uugaaagaggcaaaguuugauc

SEQ ID NO: 548067 - RNA, 20 nt, Human
uucuugaauacccaacccca

SEQ ID NO: 548068 - RNA, 20 nt, Human
ugccaggcugcacgccugcc

SEQ ID NO: 548069 - RNA, 23 nt, Human
ucugagagaacaaugccuccuau

SEQ ID NO: 548070 - RNA, 22 nt, Human
gaggccuggagccgccuaggcg

SEQ ID NO: 548071 - RNA, 22 nt, Human
ggaggcccagagaggugaagug

SEQ ID NO: 548072 - RNA, 22 nt, Human
caggaaaaugucaauggaaagc

SEQ ID NO: 548073 - RNA, 22 nt, Human
ggcugccugggagcccuccucu

SEQ ID NO: 548074 - RNA, 20 nt, Human
cucugcagcaaggccugggu

SEQ ID NO: 548075 - RNA, 22 nt, Human
uuauuaugugcuagagaaugua

SEQ ID NO: 548076 - RNA, 21 nt, Human
agagucugcauuucugacaag

SEQ ID NO: 548077 - RNA, 19 nt, Human
caggaugaucccaugacac

SEQ ID NO: 548078 - RNA, 23 nt, Human
aaagugcaguugaggaaucauag

SEQ ID NO: 548079 - RNA, 22 nt, Human
acacauauguggcaacuguaga

SEQ ID NO: 548080 - RNA, 22 nt, Human
cuuccaagaugaacagcaagcg

SEQ ID NO: 548081 - RNA, 22 nt, Human
aaggcagguauugaugccacag

SEQ ID NO: 548082 - RNA, 23 nt, Human
ucccaucuauugugaucaaugcc

SEQ ID NO: 548083 - RNA, 22 nt, Human
uuucaauuuccaggcuagaauu

SEQ ID NO: 548084 - RNA, 22 nt, Human
ucacagugagccaugucagaga

SEQ ID NO: 548085 - RNA, 22 nt, Human
gaaugcucuuugguccuagacu

SEQ ID NO: 548086 - RNA, 22 nt, Human
ugaguuaaaugagaacaugaaa

SEQ ID NO: 548087 - RNA, 22 nt, Human
ggguccagcuacaucagggugg

SEQ ID NO: 548088 - RNA, 22 nt, Human
acagaacuuccugcuggagugg

SEQ ID NO: 548089 - RNA, 22 nt, Human
ccagguggacggcgaguacagg

SEQ ID NO: 548090 - RNA, 22 nt, Human
uagcagagagguuucagcuaau

SEQ ID NO: 548091 - RNA, 22 nt, Human
ugaucaaagugcuggaauuaca

SEQ ID NO: 548092 - RNA, 22 nt, Human
cagugcaguugguggcaggggu

SEQ ID NO: 548093 - RNA, 22 nt, Human
gaguguucccacaccccaguug

SEQ ID NO: 548094 - RNA, 22 nt, Human
aguccagguggaccuuggccag

SEQ ID NO: 548095 - RNA, 22 nt, Human
gggcaggaacaaaucaaaugau

SEQ ID NO: 548096 - RNA, 22 nt, Human
gaacuguaguuaauacuacaca

SEQ ID NO: 548097 - RNA, 22 nt, Human
uauuaauaugugugugcaugua

SEQ ID NO: 548098 - RNA, 22 nt, Human
ucccuggacaacagacuucacu

SEQ ID NO: 548099 - RNA, 22 nt, Human
cauuuagagucuugcaauuuua

SEQ ID NO: 548100 - RNA, 22 nt, Human
ugaguuuuguaauauucaagau

SEQ ID NO: 548101 - RNA, 22 nt, Human
acuuggaaaauucaaaauggca

SEQ ID NO: 548102 - RNA, 22 nt, Human
caaaaaacacagaugucugugu

SEQ ID NO: 548103 - RNA, 22 nt, Human
cagccugcauuuguaucuguau

SEQ ID NO: 548104 - RNA, 22 nt, Human
gagagcugcagccgagaggggg

SEQ ID NO: 548105 - RNA, 21 nt, Human
cccuugccugcacuccucggc

SEQ ID NO: 548106 - RNA, 22 nt, Human
gcccgcagagaucuuuaacaaa

SEQ ID NO: 548107 - RNA, 22 nt, Human
aaguguuucuuggaauguugcg

SEQ ID NO: 548108 - RNA, 22 nt, Human
auucagcuaagugcuucaugcu

SEQ ID NO: 548109 - RNA, 22 nt, Human
ggagaccagaaggaagcuucga

SEQ ID NO: 548110 - RNA, 22 nt, Human
uggaggcaccacuggcugcccg

SEQ ID NO: 548111 - RNA, 22 nt, Human
caacugggauaaagagcuaaag

SEQ ID NO: 548112 - RNA, 22 nt, Human
uacauauguaaacauguauaaa

SEQ ID NO: 548113 - RNA, 22 nt, Human
uggcugugggauaugugacuga

SEQ ID NO: 548114 - RNA, 22 nt, Human
caccugccucauuugucccugc

SEQ ID NO: 548115 - RNA, 22 nt, Human
cugggcaggagggcucuaugga

SEQ ID NO: 548116 - RNA, 22 nt, Human
ugaaaaaacaaguuggcccauu

SEQ ID NO: 548117 - RNA, 20 nt, Human
auuuggcaugaaguauugau

SEQ ID NO: 548118 - RNA, 22 nt, Human
uuaaaaaccaucuuccuuuccu

SEQ ID NO: 548119 - RNA, 22 nt, Human
uugaaacugucagcuuuuacgc

SEQ ID NO: 548120 - RNA, 22 nt, Human
gaggaaagagucaaaucugaag

SEQ ID NO: 548121 - RNA, 22 nt, Human
caagaaauucuguucagauagc

SEQ ID NO: 548122 - RNA, 22 nt, Human
ugggccuuacuuggggcugacu

SEQ ID NO: 548123 - RNA, 20 nt, Human
uugauucccucuaaacucgc

SEQ ID NO: 548124 - RNA, 22 nt, Human
cagcuccugcagcuggcuccca

SEQ ID NO: 548125 - RNA, 22 nt, Human
auuuccuauagauauggugagu

SEQ ID NO: 548126 - RNA, 22 nt, Human
aggcuggcuggcaggggacaca

SEQ ID NO: 548127 - RNA, 22 nt, Human
uucacaaucuggcuuagcauug

SEQ ID NO: 548128 - RNA, 22 nt, Human
ucugccugcuaacuccugcacc

SEQ ID NO: 548129 - RNA, 21 nt, Human
gcagugcagcuuggaggguag

SEQ ID NO: 548130 - RNA, 22 nt, Human
auaugugucgugcuacugccca

SEQ ID NO: 548131 - RNA, 22 nt, Human
agugccuagauauuguuugaac

SEQ ID NO: 548132 - RNA, 22 nt, Human
auuauuacuccugauuguacug

SEQ ID NO: 548133 - RNA, 21 nt, Human
acagcaagccuuccuuucagg

SEQ ID NO: 548134 - RNA, 21 nt, Human
gcagcuggucucagagcuugc

SEQ ID NO: 548135 - RNA, 23 nt, Human
ucugggcaccuuguugacaugau

SEQ ID NO: 548136 - RNA, 22 nt, Human
agcccccaaaagugcuuaugau

SEQ ID NO: 548137 - RNA, 22 nt, Human
ggugaagccagggcaucaauau

SEQ ID NO: 548138 - RNA, 19 nt, Human
gcugugugaccuugggcaa

SEQ ID NO: 548139 - RNA, 22 nt, Human
gaauuugaaaagugaugggaau

SEQ ID NO: 548140 - RNA, 22 nt, Human
guuagggaucaggaacaagagc

SEQ ID NO: 548141 - RNA, 23 nt, Human
cugugcccggggcuccaccugau

SEQ ID NO: 548142 - RNA, 22 nt, Human
aagaggcagcccgcugaggcug

SEQ ID NO: 548143 - RNA, 22 nt, Human
cuggauuuaauuaacuguugcu

SEQ ID NO: 548144 - RNA, 22 nt, Human
gggcuggcgggaaaggcaauuc

SEQ ID NO: 548145 - RNA, 22 nt, Human
caguccagcucaucaguggcac

SEQ ID NO: 548146 - RNA, 20 nt, Human
gcaggcuccgggcuugggag

SEQ ID NO: 548147 - RNA, 22 nt, Human
caagucauuguuuagucauguu

SEQ ID NO: 548148 - RNA, 22 nt, Human
uuucauguuuucuuaaauggca

SEQ ID NO: 548149 - RNA, 22 nt, Human
aaagucacgcugaugggaaaug

SEQ ID NO: 548150 - RNA, 22 nt, Human
aucaccaggcaaaaugucagag

SEQ ID NO: 548151 - RNA, 22 nt, Human
ugagcagaacacgggauccaug

SEQ ID NO: 548152 - RNA, 22 nt, Human
aggcaaggugcuacagacagug

SEQ ID NO: 548153 - RNA, 22 nt, Human
gagacagcagggccagggccug

SEQ ID NO: 548154 - RNA, 22 nt, Human
acagauaaaaguuguuuaaaau

SEQ ID NO: 548155 - RNA, 22 nt, Human
acauauuuugaaagcuuucuaa

SEQ ID NO: 548156 - RNA, 22 nt, Human
gagcucagacucgggccugggg

SEQ ID NO: 548157 - RNA, 22 nt, Human
ucuugggauugcccugcaguuc

SEQ ID NO: 548158 - RNA, 22 nt, Human
ucucaaauuuguuagauaaaau

SEQ ID NO: 548159 - RNA, 22 nt, Human
cagggcuguaaauuagugcuga

SEQ ID NO: 548160 - RNA, 22 nt, Human
caggcagacauuuuugacauag

SEQ ID NO: 548161 - RNA, 22 nt, Human
ggagccugcgggagcucccauu

SEQ ID NO: 548162 - RNA, 22 nt, Human
uucagaaauaaaauaucccaac

SEQ ID NO: 548163 - RNA, 23 nt, Human
augcaguauaugucaguaguuua

SEQ ID NO: 548164 - RNA, 22 nt, Human
cugcagcuccccugagaucaag

SEQ ID NO: 548165 - RNA, 22 nt, Human
ucugucaaaugagcaaguaacu

SEQ ID NO: 548166 - RNA, 22 nt, Human
acacagggcugcgccugacccc

SEQ ID NO: 548167 - RNA, 22 nt, Human
uuccuugguagagagaauauuu

SEQ ID NO: 548168 - RNA, 22 nt, Human
ccuuucucauuuuaagcauuag

SEQ ID NO: 548169 - RNA, 22 nt, Human
ggagcagucuggugauacucag

SEQ ID NO: 548170 - RNA, 22 nt, Human
ccagagccccugagcuucccug

SEQ ID NO: 548171 - RNA, 22 nt, Human
ucagaugguuccaucauuuuuc

SEQ ID NO: 548172 - RNA, 21 nt, Human
agcagaggggacauguuugau

SEQ ID NO: 548173 - RNA, 19 nt, Human
guggccugcgcugggugcg

SEQ ID NO: 548174 - RNA, 22 nt, Human
gggcacagagggucuugaagaa

SEQ ID NO: 548175 - RNA, 22 nt, Human
cugggagucaccaggagcaagg

SEQ ID NO: 548176 - RNA, 21 nt, Human
acugugaagaugcuauaaacu

SEQ ID NO: 548177 - RNA, 20 nt, Human
cucugcuuuaggagagucag

SEQ ID NO: 548178 - RNA, 22 nt, Human
uccacugcagcuucugauggaa

SEQ ID NO: 548179 - RNA, 23 nt, Human
ucauuucagguugcaugguacca

SEQ ID NO: 548180 - RNA, 22 nt, Human
ucaauuuaagguacuacuuugg

SEQ ID NO: 548181 - RNA, 22 nt, Human
cacguuuuaugacagaagaagc

SEQ ID NO: 548182 - RNA, 22 nt, Human
gggagagagaaaacguggcgca

SEQ ID NO: 548183 - RNA, 22 nt, Human
agauacauggaacgucaaaccu

SEQ ID NO: 548184 - RNA, 22 nt, Human
ugcagggaaaguguuggcagca

SEQ ID NO: 548185 - RNA, 22 nt, Human
ugcuucaugcuucugacaauag

SEQ ID NO: 548186 - RNA, 22 nt, Human
cagagccaugguaugggcuugu

SEQ ID NO: 548187 - RNA, 22 nt, Human
uugauacauagcacaguuuagg

SEQ ID NO: 548188 - RNA, 22 nt, Human
gucaaauauacuaagagguaaa

SEQ ID NO: 548189 - RNA, 22 nt, Human
augguacaaaauguauaaaguc

SEQ ID NO: 548190 - RNA, 22 nt, Human
agucuucagagaaauuaacucu

SEQ ID NO: 548191 - RNA, 21 nt, Human
aguucauacugaguaacaaaa

SEQ ID NO: 548192 - RNA, 22 nt, Human
auuaugagaggagaaaagucag

SEQ ID NO: 548193 - RNA, 22 nt, Human
aaguucaaguguaaucuuuauu

SEQ ID NO: 548194 - RNA, 22 nt, Human
cccaggagguggagguugcagu

SEQ ID NO: 548195 - RNA, 22 nt, Human
agggugccugcugcagguucag

SEQ ID NO: 548196 - RNA, 22 nt, Human
uuucacaaagcauagcacuuua

SEQ ID NO: 548197 - RNA, 22 nt, Human
agagugguacuucuuuuucuuc

SEQ ID NO: 548198 - RNA, 22 nt, Human
ccagagucccuugcagcucagu

SEQ ID NO: 548199 - RNA, 22 nt, Human
ggccagaggccacagcuguguc

SEQ ID NO: 548200 - RNA, 22 nt, Human
ucucuggccccauggcugagcu

SEQ ID NO: 548201 - RNA, 19 nt, Human
gacuccaacuuuaagcaug

SEQ ID NO: 548202 - RNA, 22 nt, Human
ucuggcucccuggagcuccaca

SEQ ID NO: 548203 - RNA, 23 nt, Human
cuggggcucauugcaguagccau

SEQ ID NO: 548204 - RNA, 22 nt, Human
cuaauuauguuguuauaaucaa

SEQ ID NO: 548205 - RNA, 22 nt, Human
ucugaaauaggagccauguaga

SEQ ID NO: 548206 - RNA, 22 nt, Human
agcaggcuaaucuugcugaaca

SEQ ID NO: 548207 - RNA, 20 nt, Human
cucuuuugacucuuugcaag

SEQ ID NO: 548208 - RNA, 22 nt, Human
agccagcuggugggucagcugg

SEQ ID NO: 548209 - RNA, 22 nt, Human
uuggcuucuggcagucuggacg

SEQ ID NO: 548210 - RNA, 22 nt, Human
ugccauccaucaguauuugugg

SEQ ID NO: 548211 - RNA, 21 nt, Human
uguggcugccucuggcccugg

SEQ ID NO: 548212 - RNA, 22 nt, Human
uagcagcugugaguaaaagcca

SEQ ID NO: 548213 - RNA, 22 nt, Human
uauuuuaaagacugccagccua

SEQ ID NO: 548214 - RNA, 22 nt, Human
uggcucaguggcagccgcagcu

SEQ ID NO: 548215 - RNA, 22 nt, Human
acuggcugcguuccugugagac

SEQ ID NO: 548216 - RNA, 22 nt, Human
caugaagcacagcucucuuuuu

SEQ ID NO: 548217 - RNA, 17 nt, Human
uuucuccuuccaucuca

SEQ ID NO: 548218 - RNA, 22 nt, Human
aggcugaggagggauguugcuu

SEQ ID NO: 548219 - RNA, 20 nt, Human
ucccagucagccagagugag

SEQ ID NO: 548220 - RNA, 22 nt, Human
ggaguauaucguguaucauaug

SEQ ID NO: 548221 - RNA, 22 nt, Human
acauuucucagguaagucauuu

SEQ ID NO: 548222 - RNA, 22 nt, Human
gcuuccaaugcuucuaucacau

SEQ ID NO: 548223 - RNA, 22 nt, Human
gccuugccucagccauggaaac

SEQ ID NO: 548224 - RNA, 22 nt, Human
aauaacaggcucaucagaugcu

SEQ ID NO: 548225 - RNA, 22 nt, Human
gggccuggugcuucugacuccu

SEQ ID NO: 548226 - RNA, 22 nt, Human
ugaggcagugauguuuaagcac

SEQ ID NO: 548227 - RNA, 22 nt, Human
augcuuuacaguuuuccaaaca

SEQ ID NO: 548228 - RNA, 22 nt, Human
agggccuggaacuggagaccac

SEQ ID NO: 548229 - RNA, 21 nt, Human
uccagggaacuucucaggaau

SEQ ID NO: 548230 - RNA, 22 nt, Human
uacaaaguuugggguccucaaa

SEQ ID NO: 548231 - RNA, 22 nt, Human
aguuguaauaacaauaccaaaa

SEQ ID NO: 548232 - RNA, 22 nt, Human
uaagcagagcccucuuuauuag

SEQ ID NO: 548233 - RNA, 22 nt, Human
gugcagaggucacaaaagugaa

SEQ ID NO: 548234 - RNA, 22 nt, Human
gaagcaaagagcuagugccgcu

SEQ ID NO: 548235 - RNA, 22 nt, Human
ggacagcauuccuaguuccaaa

SEQ ID NO: 548236 - RNA, 22 nt, Human
gaaaaggaaauuuauagagauc

SEQ ID NO: 548237 - RNA, 19 nt, Human
cuguggcugaccucuggcc

SEQ ID NO: 548238 - RNA, 22 nt, Human
ucagacagaaggacuauuugaa

SEQ ID NO: 548239 - RNA, 22 nt, Human
gagccugaugaaacaggcagac

SEQ ID NO: 548240 - RNA, 22 nt, Human
uaucacacauaacuaagcugca

SEQ ID NO: 548241 - RNA, 22 nt, Human
ucagccuuguggcccugcucca

SEQ ID NO: 548242 - RNA, 22 nt, Human
acauuugugcaacguauccaca

SEQ ID NO: 548243 - RNA, 21 nt, Human
uucuuuccccagaggacuaaa

SEQ ID NO: 548244 - RNA, 22 nt, Human
cuucuggaggcuccagggaggu

SEQ ID NO: 548245 - RNA, 22 nt, Human
guacuucccugggaggcaagca

SEQ ID NO: 548246 - RNA, 18 nt, Human
ggcugugcguggaggcug

SEQ ID NO: 548247 - RNA, 22 nt, Human
aaauuccaccagaaucaguaau

SEQ ID NO: 548248 - RNA, 22 nt, Human
acagauggggcacaaagccaca

SEQ ID NO: 548249 - RNA, 22 nt, Human
aucuaagagagagagcaugucu

SEQ ID NO: 548250 - RNA, 22 nt, Human
gccacagcagggcccucucagg

SEQ ID NO: 548251 - RNA, 22 nt, Human
cucaacaugccuacucagucug

SEQ ID NO: 548252 - RNA, 22 nt, Human
uggugagauguauggaggguug

SEQ ID NO: 548253 - RNA, 22 nt, Human
ggcuggcacagagggcuggugu

SEQ ID NO: 548254 - RNA, 22 nt, Human
agggcagaaauauugauacugu

SEQ ID NO: 548255 - RNA, 22 nt, Human
guucagcccacagagggggccg

SEQ ID NO: 548256 - RNA, 22 nt, Human
cagagccagcccacuguucccg

SEQ ID NO: 548257 - RNA, 22 nt, Human
uaguggaggccuguugugugca

SEQ ID NO: 548258 - RNA, 22 nt, Human
aggucacacuuggaucauagaa

SEQ ID NO: 548259 - RNA, 22 nt, Human
ggcgcuggccacgguggcucug

SEQ ID NO: 548260 - RNA, 22 nt, Human
acauuucuaauuuaauguaaca

SEQ ID NO: 548261 - RNA, 22 nt, Human
acauacauguaaaggaaauuau

SEQ ID NO: 548262 - RNA, 22 nt, Human
uacaaaguaauguauaauaucg

SEQ ID NO: 548263 - RNA, 23 nt, Human
agucuuaauacagcucuuuucua

SEQ ID NO: 548264 - RNA, 22 nt, Human
ugcuucugaaaugcaggucuuc

SEQ ID NO: 548265 - RNA, 22 nt, Human
agagcuguuaauuuugcacugg

SEQ ID NO: 548266 - RNA, 22 nt, Human
uuaggaaaucacuuugcucacc

SEQ ID NO: 548267 - RNA, 22 nt, Human
ccaccccaaaugaagaccucuc

SEQ ID NO: 548268 - RNA, 22 nt, Human
ggcucagguuuccuucccagcu

SEQ ID NO: 548269 - RNA, 22 nt, Human
guguuuuauggagucauaacgu

SEQ ID NO: 548270 - RNA, 20 nt, Human
agcuggccuguccuaggccu

SEQ ID NO: 548271 - RNA, 22 nt, Human
gggcugugggacccggcacuuu

SEQ ID NO: 548272 - RNA, 22 nt, Human
gaugggaggaaccugggucccu

SEQ ID NO: 548273 - RNA, 23 nt, Human
aucuguugugccucuuauaugua

SEQ ID NO: 548274 - RNA, 22 nt, Human
ugaaaacuccaaguuucaucag

SEQ ID NO: 548275 - RNA, 22 nt, Human
gcuggccugggcagaggcuaug

SEQ ID NO: 548276 - RNA, 22 nt, Human
ucuuuugugauucuuuaguuac

SEQ ID NO: 548277 - RNA, 22 nt, Human
ggaggccaugaggcucuaggug

SEQ ID NO: 548278 - RNA, 22 nt, Human
ucaaaguaccauuaucagugga

SEQ ID NO: 548279 - RNA, 22 nt, Human
agggaagagcuugcaagaaacc

SEQ ID NO: 548280 - RNA, 22 nt, Human
uuugugaaaugaagucacaacu

SEQ ID NO: 548281 - RNA, 22 nt, Human
uauaauuuaucaugucacaguu

SEQ ID NO: 548282 - RNA, 22 nt, Human
gugaagcagggaaggaaaggau

SEQ ID NO: 548283 - RNA, 22 nt, Human
acacugcucacuucuucccuug

SEQ ID NO: 548284 - RNA, 22 nt, Human
agcucauggugcuaucucaggg

SEQ ID NO: 548285 - RNA, 22 nt, Human
gcuggccugaccugaggcuggg

SEQ ID NO: 548286 - RNA, 22 nt, Human
agggcugccugcucugcauuga

SEQ ID NO: 548287 - RNA, 22 nt, Human
cugggcuccuaaccauccaggu

SEQ ID NO: 548288 - RNA, 22 nt, Human
auaucagacagaaagcauugac

SEQ ID NO: 548289 - RNA, 22 nt, Human
aggaagagcccgggugacauaa

SEQ ID NO: 548290 - RNA, 22 nt, Human
ugucuucaucucagacacaguu

SEQ ID NO: 548291 - RNA, 19 nt, Human
gccugggaugggcagaacu

SEQ ID NO: 548292 - RNA, 22 nt, Human
cucuccagaucugcugagccag

SEQ ID NO: 548293 - RNA, 22 nt, Human
ucaagaaaugugcuuggauaua

SEQ ID NO: 548294 - RNA, 20 nt, Human
agacccucuggacugggccc

SEQ ID NO: 548295 - RNA, 22 nt, Human
uggcuggagcauuccuugucuu

SEQ ID NO: 548296 - RNA, 22 nt, Human
uuacugaaaauucuucaggauu

SEQ ID NO: 548297 - RNA, 22 nt, Human
caggugggccaugaaaaaugac

SEQ ID NO: 548298 - RNA, 22 nt, Human
aaagguuaguucuuagaagugc

SEQ ID NO: 548299 - RNA, 22 nt, Human
ggcuucuggugggagcaugacu

SEQ ID NO: 548300 - RNA, 22 nt, Human
acagaaggcggggacaaggcgg

SEQ ID NO: 548301 - RNA, 22 nt, Human
agcacacagucuuccuuccucc

SEQ ID NO: 548302 - RNA, 22 nt, Human
uucaacagcuuccaaagugugu

SEQ ID NO: 548303 - RNA, 22 nt, Human
agacccucuccaugcccacugc

SEQ ID NO: 548304 - RNA, 22 nt, Human
ucucagagaccugaacucccug

SEQ ID NO: 548305 - RNA, 22 nt, Human
ugggcucaaucugcuucuguuu

SEQ ID NO: 548306 - RNA, 22 nt, Human
gugggcuguuguucccuguucu

SEQ ID NO: 548307 - RNA, 22 nt, Human
acaguucccgucuugcacagcu

SEQ ID NO: 548308 - RNA, 22 nt, Human
gggcauggugaugugcaccugu

SEQ ID NO: 548309 - RNA, 22 nt, Human
gccugagaguugaaguucagug

SEQ ID NO: 548310 - RNA, 22 nt, Human
ucuacacaagugaguggcacaa

SEQ ID NO: 548311 - RNA, 22 nt, Human
acagagcugggaucugaaccca

SEQ ID NO: 548312 - RNA, 22 nt, Human
gaguucaguguuucuaguagug

SEQ ID NO: 548313 - RNA, 22 nt, Human
agacaucauguuacagauuaag

SEQ ID NO: 548314 - RNA, 22 nt, Human
uaucuacaggugucagguaaga

SEQ ID NO: 548315 - RNA, 22 nt, Human
aaugaugaguucuaauagaccc

SEQ ID NO: 548316 - RNA, 22 nt, Human
guuucuuaauagcaggggccaa

SEQ ID NO: 548317 - RNA, 20 nt, Human
cuucuucauuaacccuacug

SEQ ID NO: 548318 - RNA, 22 nt, Human
acccagcuggaugcauggaggc

SEQ ID NO: 548319 - RNA, 22 nt, Human
gggcagcaugucacuagcaugg

SEQ ID NO: 548320 - RNA, 22 nt, Human
ucacauuuauuucaaaguuacu

SEQ ID NO: 548321 - RNA, 21 nt, Human
uggcucugagccucauggcug

SEQ ID NO: 548322 - RNA, 22 nt, Human
accccagcucugagccacacca

SEQ ID NO: 548323 - RNA, 22 nt, Human
ucucaggaucuaauacauggua

SEQ ID NO: 548324 - RNA, 22 nt, Human
gcuggcuguguuccuucugcca

SEQ ID NO: 548325 - RNA, 22 nt, Human
ugggccugacucaccugccucc

SEQ ID NO: 548326 - RNA, 22 nt, Human
uagaaucuaguucauucauuug

SEQ ID NO: 548327 - RNA, 18 nt, Human
uggcucuggacuugcucc

SEQ ID NO: 548328 - RNA, 22 nt, Human
aaucuucacagagaaaauuagg

SEQ ID NO: 548329 - RNA, 22 nt, Human
aaaaaguauuggccaugguuga

SEQ ID NO: 548330 - RNA, 22 nt, Human
aggccuggcuuugguuugcuga

SEQ ID NO: 548331 - RNA, 22 nt, Human
cuggugcuguagccugauugag

SEQ ID NO: 548332 - RNA, 22 nt, Human
ugacaucauuggccauugggga

SEQ ID NO: 548333 - RNA, 22 nt, Human
gaggcugguucugaaguacugu

SEQ ID NO: 548334 - RNA, 22 nt, Human
aaauuugauaagccauuguuac

SEQ ID NO: 548335 - RNA, 22 nt, Human
aggcugugcacagggcaccugc

SEQ ID NO: 548336 - RNA, 22 nt, Human
agugucugccaacugcaugguc

SEQ ID NO: 548337 - RNA, 22 nt, Human
ccuggugcuuaccagagcuuuu

SEQ ID NO: 548338 - RNA, 22 nt, Human
ucucaguguuuaaaaagauuuc

SEQ ID NO: 548339 - RNA, 22 nt, Human
ccagccuuacugcccuucagug

SEQ ID NO: 548340 - RNA, 22 nt, Human
cacaggggcaaacuguagggga

SEQ ID NO: 548341 - RNA, 22 nt, Human
ugaaacuaggccaaucaaauua

SEQ ID NO: 548342 - RNA, 22 nt, Human
uaugcacaauaugaucuauuug

SEQ ID NO: 548343 - RNA, 22 nt, Human
cugccugugucuauuccuuuuu

SEQ ID NO: 548344 - RNA, 22 nt, Human
acaaaacaguguuccugccccu

SEQ ID NO: 548345 - RNA, 22 nt, Human
ccauuugucaccucugcacucc

SEQ ID NO: 548346 - RNA, 22 nt, Human
gaggaagggcugccugccgggc

SEQ ID NO: 548347 - RNA, 22 nt, Human
uguaacacucaaucuguuuaac

SEQ ID NO: 548348 - RNA, 22 nt, Human
gagcuuuacuucugacuggugc

SEQ ID NO: 548349 - RNA, 22 nt, Human
gaggcaguuugccaugccagga

SEQ ID NO: 548350 - RNA, 22 nt, Human
aauaugauccuuaaccuucaug

SEQ ID NO: 548351 - RNA, 22 nt, Human
ucauuucuaucuaugcagcuuc

SEQ ID NO: 548352 - RNA, 22 nt, Human
acagcuuuuaugggaccagcca

SEQ ID NO: 548353 - RNA, 20 nt, Human
uuauuuguuuacuuuggucc

SEQ ID NO: 548354 - RNA, 22 nt, Human
caaaagcaaagucccugaaugu

SEQ ID NO: 548355 - RNA, 22 nt, Human
agccuccacagaugcaaagggc

SEQ ID NO: 548356 - RNA, 22 nt, Human
gguggguauaguuagggccucu

SEQ ID NO: 548357 - RNA, 22 nt, Human
gagcugggaagauagcuugagc

SEQ ID NO: 548358 - RNA, 22 nt, Human
ugugacagaucuuuaaauaaug

SEQ ID NO: 548359 - RNA, 22 nt, Human
ugaaaguuaggauguaguaauu

SEQ ID NO: 548360 - RNA, 22 nt, Human
caaggaaucccauuucuaacuc

SEQ ID NO: 548361 - RNA, 22 nt, Human
cccaggaguaagugacauuguu

SEQ ID NO: 548362 - RNA, 22 nt, Human
gcuggggacuccccaccauagc

SEQ ID NO: 548363 - RNA, 22 nt, Human
auacagaagaacuauagccacu

SEQ ID NO: 548364 - RNA, 22 nt, Human
cugucuguucagauucauuacu

SEQ ID NO: 548365 - RNA, 22 nt, Human
cuuauuagugucugucugaguu

SEQ ID NO: 548366 - RNA, 22 nt, Human
caauacaauuaccaguuaauca

SEQ ID NO: 548367 - RNA, 22 nt, Human
uccuggccgccgcguggggccg

SEQ ID NO: 548368 - RNA, 22 nt, Human
caggcugccgugaagcaggccu

SEQ ID NO: 548369 - RNA, 22 nt, Human
aacagcugcuucuaucuuuuca

SEQ ID NO: 548370 - RNA, 22 nt, Human
cccacucccugcacgccugccg

SEQ ID NO: 548371 - RNA, 22 nt, Human
agcaggugcauggcgagcgcgg

SEQ ID NO: 548372 - RNA, 22 nt, Human
ucugucacugagcucaggauuc

SEQ ID NO: 548373 - RNA, 22 nt, Human
agguucccagagauagagcugu

SEQ ID NO: 548374 - RNA, 22 nt, Human
gcucccacugcagcccugagcc

SEQ ID NO: 548375 - RNA, 22 nt, Human
ucauugcagugauguuguaugu

SEQ ID NO: 548376 - RNA, 19 nt, Human
gggaaauucacuugcuucc

SEQ ID NO: 548377 - RNA, 22 nt, Human
gugaaauuguauuuggcauuga

SEQ ID NO: 548378 - RNA, 22 nt, Human
ggcugggcuccgggagcaugcg

SEQ ID NO: 548379 - RNA, 22 nt, Human
agguccuguuucuucccugggg

SEQ ID NO: 548380 - RNA, 21 nt, Human
gcagcaguguucuagaauacu

SEQ ID NO: 548381 - RNA, 22 nt, Human
gcagugacagggcugcugccuu

SEQ ID NO: 548382 - RNA, 22 nt, Human
uuuguaacaaguugaucuggua

SEQ ID NO: 548383 - RNA, 22 nt, Human
ucugcuguaaagaauuucugcc

SEQ ID NO: 548384 - RNA, 22 nt, Human
cagcagagaccaagugauuuga

SEQ ID NO: 548385 - RNA, 22 nt, Human
aaacaaagccagggaaguuaug

SEQ ID NO: 548386 - RNA, 22 nt, Human
agcuuccugaugcaagagggcu

SEQ ID NO: 548387 - RNA, 22 nt, Human
ugcaagaggaauucuagaagca

SEQ ID NO: 548388 - RNA, 22 nt, Human
ugggaguguucuuggcuugcuu

SEQ ID NO: 548389 - RNA, 22 nt, Human
cacaggaaucagcauuaauggc

SEQ ID NO: 548390 - RNA, 22 nt, Human
caugcucuccauuggacacaga

SEQ ID NO: 548391 - RNA, 22 nt, Human
uuugggcugagaugugggccga

SEQ ID NO: 548392 - RNA, 22 nt, Human
gcugucuguucgagcguguguu

SEQ ID NO: 548393 - RNA, 22 nt, Human
agacaggacacaagcugcauaa

SEQ ID NO: 548394 - RNA, 20 nt, Human
agaaacauuucuugagaacu

SEQ ID NO: 548395 - RNA, 22 nt, Human
aagcagcauugugguaggggag

SEQ ID NO: 548396 - RNA, 22 nt, Human
ucagcucuguguacaguuagca

SEQ ID NO: 548397 - RNA, 22 nt, Human
uucuucaaaauccagcaugauu

SEQ ID NO: 548398 - RNA, 22 nt, Human
aacagcuuagaaauguugcuaa

SEQ ID NO: 548399 - RNA, 20 nt, Human
aauaaaagaagccuucaccc

SEQ ID NO: 548400 - RNA, 21 nt, Human
cgcagagcgaacuugcggcgc

SEQ ID NO: 548401 - RNA, 22 nt, Human
ucaaguauaucuagucauuagg

SEQ ID NO: 548402 - RNA, 22 nt, Human
gcuguauuuauuuucuaggguu

SEQ ID NO: 548403 - RNA, 22 nt, Human
caacauguguuagacaauagac

SEQ ID NO: 548404 - RNA, 22 nt, Human
ucuuacauauacgucauuuagu

SEQ ID NO: 548405 - RNA, 22 nt, Human
aaauuugucaacuucauauguu

SEQ ID NO: 548406 - RNA, 22 nt, Human
cugguucaauacuaaacuucuu

SEQ ID NO: 548407 - RNA, 22 nt, Human
ccaggcccuugcaagucccacc

SEQ ID NO: 548408 - RNA, 22 nt, Human
caucuucagguguuuuccauca

SEQ ID NO: 548409 - RNA, 22 nt, Human
cugcccugucuuuuucugauga

SEQ ID NO: 548410 - RNA, 22 nt, Human
uguagaaagaauauguuucaua

SEQ ID NO: 548411 - RNA, 20 nt, Human
ggcagcaggaguuuccucuu

SEQ ID NO: 548412 - RNA, 22 nt, Human
cuggcucuaagugucagcuccc

SEQ ID NO: 548413 - RNA, 22 nt, Human
ucuggcucugacacuacuguua

SEQ ID NO: 548414 - RNA, 22 nt, Human
aacauguauuuuccuuggcaac

SEQ ID NO: 548415 - RNA, 22 nt, Human
caauuucuuguuaauucucagg

SEQ ID NO: 548416 - RNA, 22 nt, Human
gcaggagaaaugaagauugggu

SEQ ID NO: 548417 - RNA, 22 nt, Human
agaucuuuugguuauuauaaga

SEQ ID NO: 548418 - RNA, 22 nt, Human
ccaagggcugcugaggugucca

SEQ ID NO: 548419 - RNA, 22 nt, Human
uauuuauucuuuguacugccuu

SEQ ID NO: 548420 - RNA, 22 nt, Human
gcuggcagaagagcugguucaa

SEQ ID NO: 548421 - RNA, 22 nt, Human
caugauuuugucuuguguuaau

SEQ ID NO: 548422 - RNA, 22 nt, Human
ccacagcuucgcagucugcugc

SEQ ID NO: 548423 - RNA, 23 nt, Human
agcuuuggugaugugacagauaa

SEQ ID NO: 548424 - RNA, 22 nt, Human
uuuguacauauaaaucuuguau

SEQ ID NO: 548425 - RNA, 22 nt, Human
gguguccaucaggcugugcuuc

SEQ ID NO: 548426 - RNA, 22 nt, Human
gucagaggaggcugaguaggaa

SEQ ID NO: 548427 - RNA, 22 nt, Human
cagaggaaaguauuucuggaag

SEQ ID NO: 548428 - RNA, 22 nt, Human
caaggcuggaguguaauggcau

SEQ ID NO: 548429 - RNA, 22 nt, Human
ucccagaggcaguugguaacuu

SEQ ID NO: 548430 - RNA, 22 nt, Human
cacauaauaaauguuccugaug

SEQ ID NO: 548431 - RNA, 22 nt, Human
ucuucaugauacccuaagccac

SEQ ID NO: 548432 - RNA, 22 nt, Human
cagagcugugauaaauagauau

SEQ ID NO: 548433 - RNA, 22 nt, Human
ucucuuauuuugccuuugacaa

SEQ ID NO: 548434 - RNA, 22 nt, Human
uauuaagauacguaguuguaaa

SEQ ID NO: 548435 - RNA, 22 nt, Human
agccaagcacucaacuccugga

SEQ ID NO: 548436 - RNA, 22 nt, Human
ugugaaagcaagucuaguucuc

SEQ ID NO: 548437 - RNA, 22 nt, Human
gagcagugacuggagcaugaga

SEQ ID NO: 548438 - RNA, 22 nt, Human
auguaauuugcccucaaguuaa

SEQ ID NO: 548439 - RNA, 22 nt, Human
ucuuccaaaugcagcuaaagcu

SEQ ID NO: 548440 - RNA, 22 nt, Human
uccaacuuucuccuccggcuug

SEQ ID NO: 548441 - RNA, 22 nt, Human
ccugcucugccaaguccucuuu

SEQ ID NO: 548442 - RNA, 22 nt, Human
gccaauggcucaugagcaggac

SEQ ID NO: 548443 - RNA, 23 nt, Human
cugugugugccgaggguggccac

SEQ ID NO: 548444 - RNA, 22 nt, Human
uucuaaaaccaauucugcuucu

SEQ ID NO: 548445 - RNA, 22 nt, Human
uaaaugugucuuuuuaaggccu

SEQ ID NO: 548446 - RNA, 21 nt, Human
gggugggguuccagccuuuuc

SEQ ID NO: 548447 - RNA, 22 nt, Human
cauaauuucuguaucagcacca

SEQ ID NO: 548448 - RNA, 20 nt, Human
ugaaggugacuccuuucuug

SEQ ID NO: 548449 - RNA, 22 nt, Human
cagaggucccuguucuuaagga

SEQ ID NO: 548450 - RNA, 22 nt, Human
guucaaagcuccugguacagua

SEQ ID NO: 548451 - RNA, 22 nt, Human
uguuuguucccucucuuuccug

SEQ ID NO: 548452 - RNA, 22 nt, Human
uauuucccagggagcaacaagc

SEQ ID NO: 548453 - RNA, 23 nt, Human
gaauacaaagcagaugguccagc

SEQ ID NO: 548454 - RNA, 22 nt, Human
ggcucagguugggucacaugac

SEQ ID NO: 548455 - RNA, 22 nt, Human
cugggugguucuaacuguugau

SEQ ID NO: 548456 - RNA, 22 nt, Human
aacucaguguguuucuuaguau

SEQ ID NO: 548457 - RNA, 22 nt, Human
uccugggcuguggccccgggca

SEQ ID NO: 548458 - RNA, 23 nt, Human
ugaaaucagaacccuuaccucuc

SEQ ID NO: 548459 - RNA, 22 nt, Human
cacucugacuggcccugcagga

SEQ ID NO: 548460 - RNA, 22 nt, Human
aggccaggguagggcccauugu

SEQ ID NO: 548461 - RNA, 18 nt, Human
gcugccugcauuccucac

SEQ ID NO: 548462 - RNA, 22 nt, Human
ggguuucaugguucucacaaug

SEQ ID NO: 548463 - RNA, 22 nt, Human
ugagaagcugcuugugcuguau

SEQ ID NO: 548464 - RNA, 22 nt, Human
uggcacugggacagaugcucuc

SEQ ID NO: 548465 - RNA, 16 nt, Human
agcagccagcacugga

SEQ ID NO: 548466 - RNA, 22 nt, Human
cugaggcacugucagcugaggc

SEQ ID NO: 548467 - RNA, 22 nt, Human
uggcugagcucccuguguguug

SEQ ID NO: 548468 - RNA, 22 nt, Human
ucuguauuuuaagaugcuguuu

SEQ ID NO: 548469 - RNA, 22 nt, Human
caggaugggugucggccagcac

SEQ ID NO: 548470 - RNA, 22 nt, Human
uugaaacaguagcucauagacc

SEQ ID NO: 548471 - RNA, 22 nt, Human
agaaauguugaauacacaaaau

SEQ ID NO: 548472 - RNA, 22 nt, Human
uaacuucuggaaaugcaucugc

SEQ ID NO: 548473 - RNA, 22 nt, Human
ugcaggaggcuuuauucaggau

SEQ ID NO: 548474 - RNA, 22 nt, Human
uucuucuucuggcugcaccugg

SEQ ID NO: 548475 - RNA, 22 nt, Human
gauaaacacaaggugauuucau

SEQ ID NO: 548476 - RNA, 22 nt, Human
gccuggagcagacgugucccgg

SEQ ID NO: 548477 - RNA, 22 nt, Human
ugucagagcaaugagguucagc

SEQ ID NO: 548478 - RNA, 22 nt, Human
aauauauagaaguacccguugu

SEQ ID NO: 548479 - RNA, 22 nt, Human
gcucacugccauucucuagaug

SEQ ID NO: 548480 - RNA, 20 nt, Human
uuacucaguuccugccaugc

SEQ ID NO: 548481 - RNA, 22 nt, Human
cucugucaggcugcagaugcuc

SEQ ID NO: 548482 - RNA, 22 nt, Human
acucucucacagcuuggcugau

SEQ ID NO: 548483 - RNA, 22 nt, Human
uuguuuguaugcugagaagaau

SEQ ID NO: 548484 - RNA, 22 nt, Human
ucuguucaucucaugggagaau

SEQ ID NO: 548485 - RNA, 22 nt, Human
aggugcuugguaaauauuuuag

SEQ ID NO: 548486 - RNA, 22 nt, Human
gacccaggcccaaggcugccag

SEQ ID NO: 548487 - RNA, 22 nt, Human
augcugagacuggagcagcugg

SEQ ID NO: 548488 - RNA, 22 nt, Human
aaagcacaugaguaguguagua

SEQ ID NO: 548489 - RNA, 21 nt, Human
auauuucucauaagguuaugg

SEQ ID NO: 548490 - RNA, 22 nt, Human
gugauuuugagaccuauauagu

SEQ ID NO: 548491 - RNA, 23 nt, Human
ugaaacauuuaggguagaauuuc

SEQ ID NO: 548492 - RNA, 22 nt, Human
uucacacagaaucugaggagcu

SEQ ID NO: 548493 - RNA, 22 nt, Human
acauuacauaagauuguaaccu

SEQ ID NO: 548494 - RNA, 22 nt, Human
gcugaaauuagacugcagaagu

SEQ ID NO: 548495 - RNA, 22 nt, Human
uugagaguuugggggcaauaug

SEQ ID NO: 548496 - RNA, 22 nt, Human
uuccagauuucuacacaagacc

SEQ ID NO: 548497 - RNA, 22 nt, Human
uuaugcauauagcagauacgag

SEQ ID NO: 548498 - RNA, 22 nt, Human
aucuagaaaguguugaagauca

SEQ ID NO: 548499 - RNA, 22 nt, Human
uucaaguuaccuuuaaacagcu

SEQ ID NO: 548500 - RNA, 22 nt, Human
ggugaggcuaagugacacaggg

SEQ ID NO: 548501 - RNA, 22 nt, Human
cucuggaguucccuugaucuga

SEQ ID NO: 548502 - RNA, 22 nt, Human
uuagauauguuuuugcuaaugc

SEQ ID NO: 548503 - RNA, 21 nt, Human
guccagagagccggcuccuga

SEQ ID NO: 548504 - RNA, 22 nt, Human
auacaucuagagucauaaaaac

SEQ ID NO: 548505 - RNA, 22 nt, Human
cacaagagagugcgcguugcaa

SEQ ID NO: 548506 - RNA, 22 nt, Human
acugaaaaugaauuagaaacag

SEQ ID NO: 548507 - RNA, 23 nt, Human
aaaaucuucugccuaugaagaaa

SEQ ID NO: 548508 - RNA, 22 nt, Human
ggcugcaguuugucuuuugcuu

SEQ ID NO: 548509 - RNA, 20 nt, Human
acccagcucugugcccuggg

SEQ ID NO: 548510 - RNA, 22 nt, Human
aaauucuaaggucacaauguug

SEQ ID NO: 548511 - RNA, 22 nt, Human
gaaucacgguauucugcacggg

SEQ ID NO: 548512 - RNA, 22 nt, Human
uugauaaaaugauaucuucuuu

SEQ ID NO: 548513 - RNA, 22 nt, Human
gaguuauucuagguccuuugua

SEQ ID NO: 548514 - RNA, 22 nt, Human
gccuccugguugcuucuccaac

SEQ ID NO: 548515 - RNA, 22 nt, Human
caaaagaagcucuuggggcuag

SEQ ID NO: 548516 - RNA, 22 nt, Human
ucuuuucuggacucugcaugga

SEQ ID NO: 548517 - RNA, 22 nt, Human
uuugaaaggaauuaggaugaca

SEQ ID NO: 548518 - RNA, 22 nt, Human
ugucucugagaugacucccacc

SEQ ID NO: 548519 - RNA, 22 nt, Human
agccaggcggggcagguuuccu

SEQ ID NO: 548520 - RNA, 22 nt, Human
ugucaugcccaggagcaaggua

SEQ ID NO: 548521 - RNA, 20 nt, Human
uaaagacauaagcuacuauc

SEQ ID NO: 548522 - RNA, 20 nt, Human
uguaaaacaaggugaauccu

SEQ ID NO: 548523 - RNA, 22 nt, Human
caagugaucagacacugaaguc

SEQ ID NO: 548524 - RNA, 22 nt, Human
agagugcagaggucaaagaaca

SEQ ID NO: 548525 - RNA, 22 nt, Human
cagcuggcagaaccugcaucca

SEQ ID NO: 548526 - RNA, 22 nt, Human
gugucauggaaaauugcaaugg

SEQ ID NO: 548527 - RNA, 22 nt, Human
uuucaugauccauuuacaaaau

SEQ ID NO: 548528 - RNA, 22 nt, Human
agaccacagucaggcuccuggu

SEQ ID NO: 548529 - RNA, 20 nt, Human
aauuucuccuggguaacaga

SEQ ID NO: 548530 - RNA, 22 nt, Human
aguggcaguuugggagcuacag

SEQ ID NO: 548531 - RNA, 22 nt, Human
ccaggcuagaaacugaggcaca

SEQ ID NO: 548532 - RNA, 21 nt, Human
uagcagagaguuaacuucucc

SEQ ID NO: 548533 - RNA, 22 nt, Human
uucuuaagugagaaagcaggag

SEQ ID NO: 548534 - RNA, 22 nt, Human
ucugggcccugagauguucuuc

SEQ ID NO: 548535 - RNA, 17 nt, Human
ugcauuguuggaaauuu

SEQ ID NO: 548536 - RNA, 18 nt, Human
aggcccuggccucgaaca

SEQ ID NO: 548537 - RNA, 18 nt, Human
gcuuugcagaaauacaga

SEQ ID NO: 548538 - RNA, 22 nt, Human
cugugccuggggggcagagcug

SEQ ID NO: 548539 - RNA, 22 nt, Human
gaagagcugcucagaacaugau

SEQ ID NO: 548540 - RNA, 22 nt, Human
cagcagagcuuauuaacuaaaa

SEQ ID NO: 548541 - RNA, 21 nt, Human
ucuuguccuugcucucccacu

SEQ ID NO: 548542 - RNA, 21 nt, Human
ugcuucucuagaucaacuacu

SEQ ID NO: 548543 - RNA, 22 nt, Human
ggucccugaagaggccuggggu

SEQ ID NO: 548544 - RNA, 22 nt, Human
guacagaaaguacccauagaag

SEQ ID NO: 548545 - RNA, 22 nt, Human
aggagccccucuucaguccugg

SEQ ID NO: 548546 - RNA, 22 nt, Human
agaaacugaauuauuucugagg

SEQ ID NO: 548547 - RNA, 22 nt, Human
uccaggcugggcugaagggugc

SEQ ID NO: 548548 - RNA, 22 nt, Human
augcccugaaagauucaaaggc

SEQ ID NO: 548549 - RNA, 22 nt, Human
uucugggacaucuggacaguuu

SEQ ID NO: 548550 - RNA, 22 nt, Human
cacacaaauauucuggaggcaa

SEQ ID NO: 548551 - RNA, 22 nt, Human
cagcauugaucccaggcugugg

SEQ ID NO: 548552 - RNA, 22 nt, Human
agaggaaguaaucaggaccugc

SEQ ID NO: 548553 - RNA, 22 nt, Human
cccaccaguacagaugguagau

SEQ ID NO: 548554 - RNA, 22 nt, Human
aguauuucuaguugguucuacu

SEQ ID NO: 548555 - RNA, 22 nt, Human
cauuuaaagguuguggguaaaa

SEQ ID NO: 548556 - RNA, 22 nt, Human
acauagcucaguaucacuuacu

SEQ ID NO: 548557 - RNA, 21 nt, Human
agcaccaaaugcaggcucugg

SEQ ID NO: 548558 - RNA, 22 nt, Human
uccuugaauccuagcauccuau

SEQ ID NO: 548559 - RNA, 22 nt, Human
aggcagcagggccacuggcuga

SEQ ID NO: 548560 - RNA, 22 nt, Human
agaagugcuccagugaguuggg

SEQ ID NO: 548561 - RNA, 22 nt, Human
gugucccagcagcacauuggcu

SEQ ID NO: 548562 - RNA, 23 nt, Human
uguccuaugcagcuaaaauuccu

SEQ ID NO: 548563 - RNA, 22 nt, Human
gaugcacuuucuuuucaacagu

SEQ ID NO: 548564 - RNA, 18 nt, Human
acagacacuuaguaugag

SEQ ID NO: 548565 - RNA, 22 nt, Human
uuucuggacagcaagaucaguu

SEQ ID NO: 548566 - RNA, 22 nt, Human
ggagcugcauuuagggagccuu

SEQ ID NO: 548567 - RNA, 22 nt, Human
cagcaggcccagaguuucaugg

SEQ ID NO: 548568 - RNA, 22 nt, Human
agggagagacauuuccuucuug

SEQ ID NO: 548569 - RNA, 22 nt, Human
acacucuuucacuaccuuaauu

SEQ ID NO: 548570 - RNA, 22 nt, Human
ugcaggcuggggaggcagacuu

SEQ ID NO: 548571 - RNA, 22 nt, Human
gucuccaguguucaggugacug

SEQ ID NO: 548572 - RNA, 22 nt, Human
uauuccuauuucuaaacauaug

SEQ ID NO: 548573 - RNA, 22 nt, Human
cacugcaguaacucuaggacug

SEQ ID NO: 548574 - RNA, 22 nt, Human
ucaaggaggugcuuggcuucac

SEQ ID NO: 548575 - RNA, 22 nt, Human
uccagggagauacuggcugcca

SEQ ID NO: 548576 - RNA, 22 nt, Human
auugcuuuugagcuagaauuuu

SEQ ID NO: 548577 - RNA, 22 nt, Human
uucuagauugccuguaaguaaa

SEQ ID NO: 548578 - RNA, 22 nt, Human
ucagggcagccuaaggcaccuc

SEQ ID NO: 548579 - RNA, 22 nt, Human
uggcuccuaggauggugccugg

SEQ ID NO: 548580 - RNA, 22 nt, Human
ucacugcaaucucugccuucca

SEQ ID NO: 548581 - RNA, 22 nt, Human
cagagccaaaaccguaacagcc

SEQ ID NO: 548582 - RNA, 22 nt, Human
agcugccauccgaggugucaga

SEQ ID NO: 548583 - RNA, 22 nt, Human
ccuaagaauuaaugaauacacc

SEQ ID NO: 548584 - RNA, 22 nt, Human
cuuacauugucucuugcugagc

SEQ ID NO: 548585 - RNA, 22 nt, Human
acccaggcugcuucucaguggc

SEQ ID NO: 548586 - RNA, 22 nt, Human
aacaacagcugcuaaagaguug

SEQ ID NO: 548587 - RNA, 22 nt, Human
cugggcagcuaccaccacugcu

SEQ ID NO: 548588 - RNA, 19 nt, Human
ucagggcaguccggucccc

SEQ ID NO: 548589 - RNA, 22 nt, Human
aggcacuguggaagacaugguu

SEQ ID NO: 548590 - RNA, 22 nt, Human
gaggugagaagggggucagaug

SEQ ID NO: 548591 - RNA, 22 nt, Human
gccuguuggguaacagaguuca

SEQ ID NO: 548592 - RNA, 22 nt, Human
guguuccauguuugagguaguu

SEQ ID NO: 548593 - RNA, 22 nt, Human
agagcuguucagcagccagguu

SEQ ID NO: 548594 - RNA, 20 nt, Human
gcaggcagggaaugggggug

SEQ ID NO: 548595 - RNA, 23 nt, Human
uacauucuguauuuuuauagagu

SEQ ID NO: 548596 - RNA, 17 nt, Human
ucaugcccaacuauuac

SEQ ID NO: 548597 - RNA, 22 nt, Human
uuucacauuuguuuuaagaagu

SEQ ID NO: 548598 - RNA, 21 nt, Human
gauuucacuuaccuucauuua

SEQ ID NO: 548599 - RNA, 22 nt, Human
gguggggcccuggcacugguau

SEQ ID NO: 548600 - RNA, 23 nt, Human
acaaaguaauuccugcuuccaaa

SEQ ID NO: 548601 - RNA, 22 nt, Human
uagccucuggaauccuuucucu

SEQ ID NO: 548602 - RNA, 22 nt, Human
uggcagcaguggagguagaaag

SEQ ID NO: 548603 - RNA, 22 nt, Human
caacagaagguguacuacugaa

SEQ ID NO: 548604 - RNA, 22 nt, Human
uguacacugcaggaugcauugc

SEQ ID NO: 548605 - RNA, 22 nt, Human
ucaggcugcuguacugugaaug

SEQ ID NO: 548606 - RNA, 22 nt, Human
auucacaaaaugauauagauac

SEQ ID NO: 548607 - RNA, 22 nt, Human
ggccagagagcagccaggauuc

SEQ ID NO: 548608 - RNA, 19 nt, Human
agacagagacugaaauaga

SEQ ID NO: 548609 - RNA, 22 nt, Human
aagaaugagcucaaagaucuua

SEQ ID NO: 548610 - RNA, 22 nt, Human
uacaguaaccagucuacuuaga

SEQ ID NO: 548611 - RNA, 22 nt, Human
uauggucauuuguuagugcuuu

SEQ ID NO: 548612 - RNA, 22 nt, Human
gccugagaucagccaagccccu

SEQ ID NO: 548613 - RNA, 22 nt, Human
ggagucaccaaguaggagucuu

SEQ ID NO: 548614 - RNA, 22 nt, Human
cuuccccaaccccgacugugug

SEQ ID NO: 548615 - RNA, 22 nt, Human
cuucaaagauuugauaaagcca

SEQ ID NO: 548616 - RNA, 22 nt, Human
caaagcaagggcugaagacucc

SEQ ID NO: 548617 - RNA, 21 nt, Human
ucucugggaggacuugugaga

SEQ ID NO: 548618 - RNA, 22 nt, Human
ucccaggacaggccacauggaa

SEQ ID NO: 548619 - RNA, 21 nt, Human
ugaaaguuggagucaaaugua

SEQ ID NO: 548620 - RNA, 22 nt, Human
ggccugugucggccccggguuc

SEQ ID NO: 548621 - RNA, 22 nt, Human
accauuaagaaucugguuuccu

SEQ ID NO: 548622 - RNA, 22 nt, Human
guggggcaguggccugggagca

SEQ ID NO: 548623 - RNA, 22 nt, Human
auucaguuucauggcacagcua

SEQ ID NO: 548624 - RNA, 22 nt, Human
agaauaugaggaaacugugaau

SEQ ID NO: 548625 - RNA, 22 nt, Human
uuccaacaauguguuauuguuc

SEQ ID NO: 548626 - RNA, 22 nt, Human
aggcuggcuuggcucuccugug

SEQ ID NO: 548627 - RNA, 22 nt, Human
uacauuccuguuagcaucuaag

SEQ ID NO: 548628 - RNA, 22 nt, Human
aaucacaguggguacuagauug

SEQ ID NO: 548629 - RNA, 22 nt, Human
ugcuggcuuugcgagaugcauu

SEQ ID NO: 548630 - RNA, 18 nt, Human
ccagcaugccagaggcug

SEQ ID NO: 548631 - RNA, 22 nt, Human
cugaaggauuagagagcacuua

SEQ ID NO: 548632 - RNA, 22 nt, Human
guuucuuucuauugacugaaca

SEQ ID NO: 548633 - RNA, 17 nt, Human
ucgguuugccaggcuuc

SEQ ID NO: 548634 - RNA, 22 nt, Human
gaugcagggcuggcaggagcuu

SEQ ID NO: 548635 - RNA, 22 nt, Human
aauaauuuuagcucagaguugu

SEQ ID NO: 548636 - RNA, 22 nt, Human
uauugaguuacagaaaauacuu

SEQ ID NO: 548637 - RNA, 22 nt, Human
acacaccaugauuuauuuaccc

SEQ ID NO: 548638 - RNA, 22 nt, Human
aaguugaaugcguacgugacau

SEQ ID NO: 548639 - RNA, 22 nt, Human
aacuuacaauguuagagucuca

SEQ ID NO: 548640 - RNA, 22 nt, Human
uuguacaaaggauuuggaagag

SEQ ID NO: 548641 - RNA, 22 nt, Human
auaugcacacucugcccacaga

SEQ ID NO: 548642 - RNA, 22 nt, Human
ggagguggagcuggaaguucca

SEQ ID NO: 548643 - RNA, 23 nt, Human
gaggcagcuccugcagugcccug

SEQ ID NO: 548644 - RNA, 22 nt, Human
agccccaguccgcugcgggcgg

SEQ ID NO: 548645 - RNA, 19 nt, Human
uuucacaaagagagcguga

SEQ ID NO: 548646 - RNA, 22 nt, Human
acaguggauauauuaaaugaga

SEQ ID NO: 548647 - RNA, 22 nt, Human
agugauggagcuuccucugcua

SEQ ID NO: 548648 - RNA, 22 nt, Human
aacaaaguguacuuccauacug

SEQ ID NO: 548649 - RNA, 20 nt, Human
aguuuauuccaggagaacug

SEQ ID NO: 548650 - RNA, 22 nt, Human
gaugaaaaauugcugugucaua

SEQ ID NO: 548651 - RNA, 22 nt, Human
ugaugaaaauaugauucugagg

SEQ ID NO: 548652 - RNA, 22 nt, Human
caaaguuaugaaugauaagauu

SEQ ID NO: 548653 - RNA, 22 nt, Human
ucuggcucuguguccucaccca

SEQ ID NO: 548654 - RNA, 22 nt, Human
uugccuuuaaccccugaaaggc

SEQ ID NO: 548655 - RNA, 22 nt, Human
agcagguggccacgaggaggag

SEQ ID NO: 548656 - RNA, 22 nt, Human
cagaaaaccugacucuagaacu

SEQ ID NO: 548657 - RNA, 22 nt, Human
gcugccagcucacucuccugag

SEQ ID NO: 548658 - RNA, 22 nt, Human
uguacaauggcuauaauacccu

SEQ ID NO: 548659 - RNA, 22 nt, Human
ggcaguggugggaggcucgcuc

SEQ ID NO: 548660 - RNA, 20 nt, Human
guuuuaugccaguucugugu

SEQ ID NO: 548661 - RNA, 21 nt, Human
aaaggccauaaucacggagca

SEQ ID NO: 548662 - RNA, 22 nt, Human
aggagcucauguggcugccugu

SEQ ID NO: 548663 - RNA, 22 nt, Human
ugggcagacuaaggucaaagcu

SEQ ID NO: 548664 - RNA, 19 nt, Human
guggccucggagcgcgcgg

SEQ ID NO: 548665 - RNA, 22 nt, Human
guacauuuuacuuuguuugaau

SEQ ID NO: 548666 - RNA, 22 nt, Human
ucagugauugguggacugccua

SEQ ID NO: 548667 - RNA, 22 nt, Human
ugcccuggaaccaucuacaguc

SEQ ID NO: 548668 - RNA, 22 nt, Human
cucugugcccuacugcucagcu

SEQ ID NO: 548669 - RNA, 22 nt, Human
accuucaauuauuuuuguucca

SEQ ID NO: 548670 - RNA, 22 nt, Human
aagggcucuucuauuuauggcc

SEQ ID NO: 548671 - RNA, 22 nt, Human
gaacuacagugcauuuucuuaa

SEQ ID NO: 548672 - RNA, 19 nt, Human
ucaaggcucccugagggau

SEQ ID NO: 548673 - RNA, 22 nt, Human
uucagagauggaaggcagaaug

SEQ ID NO: 548674 - RNA, 22 nt, Human
acaggggcaggcaggacccuuu

SEQ ID NO: 548675 - RNA, 22 nt, Human
ggcugccugaacuuuggggaaa

SEQ ID NO: 548676 - RNA, 19 nt, Human
cauaaauguacaagauaca

SEQ ID NO: 548677 - RNA, 22 nt, Human
cugccagcagaggccagcgcug

SEQ ID NO: 548678 - RNA, 17 nt, Human
uuuuguucaucuucaaa

SEQ ID NO: 548679 - RNA, 22 nt, Human
gggaaggaaaucuugcuuguga

SEQ ID NO: 548680 - RNA, 22 nt, Human
ccagaaaaugcagaacauagaa

SEQ ID NO: 548681 - RNA, 22 nt, Human
ugccagcaguagcaguaggcca

SEQ ID NO: 548682 - RNA, 22 nt, Human
gcugagcugaggcagggcuggg

SEQ ID NO: 548683 - RNA, 22 nt, Human
auccugcuuguuacuuauagag

SEQ ID NO: 548684 - RNA, 22 nt, Human
cagcucuacguuucuaugaauc

SEQ ID NO: 548685 - RNA, 22 nt, Human
ucaguggagagcuuccaggauu

SEQ ID NO: 548686 - RNA, 22 nt, Human
gggcagagguucaacuucaaca

SEQ ID NO: 548687 - RNA, 22 nt, Human
gaagagcugugauucaggcuua

SEQ ID NO: 548688 - RNA, 22 nt, Human
accuuucauuaaagucuguagu

SEQ ID NO: 548689 - RNA, 22 nt, Human
ggguacagagagaugagguaac

SEQ ID NO: 548690 - RNA, 22 nt, Human
caguguggugagauuccaggug

SEQ ID NO: 548691 - RNA, 22 nt, Human
cuuagaaaugcagauucucagg

SEQ ID NO: 548692 - RNA, 21 nt, Human
uaagugcaaagagacagauac

SEQ ID NO: 548693 - RNA, 22 nt, Human
gggcagagaaauggacaguugg

SEQ ID NO: 548694 - RNA, 17 nt, Human
guccugggaggagagag

SEQ ID NO: 548695 - RNA, 22 nt, Human
cuugcuuuguccagaaauucag

SEQ ID NO: 548696 - RNA, 22 nt, Human
uauugaaauucuucauguccuc

SEQ ID NO: 548697 - RNA, 22 nt, Human
agcagcucacaggauuccugaa

SEQ ID NO: 548698 - RNA, 22 nt, Human
ggcugccuccugcugggcugga

SEQ ID NO: 548699 - RNA, 22 nt, Human
cuggggcuguaggaggacuuau

SEQ ID NO: 548700 - RNA, 20 nt, Human
auucuaaagcucugcucuuu

SEQ ID NO: 548701 - RNA, 22 nt, Human
cuuauucagcaaguuuggguac

SEQ ID NO: 548702 - RNA, 22 nt, Human
agugggguccucaguaugguuc

SEQ ID NO: 548703 - RNA, 22 nt, Human
gcugcccuaauaucacauguua

SEQ ID NO: 548704 - RNA, 22 nt, Human
guacucaguaauauaacauauu

SEQ ID NO: 548705 - RNA, 22 nt, Human
auuaaaauuccaagguaugcca

SEQ ID NO: 548706 - RNA, 22 nt, Human
ggaaggggagcuaaaucuacug

SEQ ID NO: 548707 - RNA, 22 nt, Human
cagaaauguuuguuaauauugu

SEQ ID NO: 548708 - RNA, 22 nt, Human
aggaaaaaccuguuaaugguag

SEQ ID NO: 548709 - RNA, 22 nt, Human
gccugaaguuucaugccucuau

SEQ ID NO: 548710 - RNA, 22 nt, Human
acagaguauuggaaaggcagug

SEQ ID NO: 548711 - RNA, 22 nt, Human
agaccauggccauccuaggaaa

SEQ ID NO: 548712 - RNA, 22 nt, Human
gcugaggaggugugguuaggug

SEQ ID NO: 548713 - RNA, 21 nt, Human
acugagagauguuggaucaua

SEQ ID NO: 548714 - RNA, 22 nt, Human
gcucccuccaugaggcagaccg

SEQ ID NO: 548715 - RNA, 19 nt, Human
acugccugcagguguuggg

SEQ ID NO: 548716 - RNA, 22 nt, Human
ccuuuggguucaaucucggucu

SEQ ID NO: 548717 - RNA, 22 nt, Human
auuuccuagccucucuugcagu

SEQ ID NO: 548718 - RNA, 22 nt, Human
cuuuacaaagcaauuuugucuc

SEQ ID NO: 548719 - RNA, 22 nt, Human
uguguucauguugauucauagc

SEQ ID NO: 548720 - RNA, 22 nt, Human
cucagcuaguaacguacauguc

SEQ ID NO: 548721 - RNA, 22 nt, Human
aagcaacagaaacauucuaaua

SEQ ID NO: 548722 - RNA, 22 nt, Human
uuccauaaaggugauaguauac

SEQ ID NO: 548723 - RNA, 22 nt, Human
uggugccauuagcccugcuguu

SEQ ID NO: 548724 - RNA, 22 nt, Human
uaaggcacccuucugaguagag

SEQ ID NO: 548725 - RNA, 22 nt, Human
ucugagagauacaaggaggcaa

SEQ ID NO: 548726 - RNA, 22 nt, Human
uucuacaugguugcucagaggg

SEQ ID NO: 548727 - RNA, 20 nt, Human
agcaagaguaaggacagcga

SEQ ID NO: 548728 - RNA, 22 nt, Human
ggucugagcuugagcccaugcu

SEQ ID NO: 548729 - RNA, 22 nt, Human
ugaagcaggaaacuucuuguuu

SEQ ID NO: 548730 - RNA, 22 nt, Human
gcaaagacggacucaggagugc

SEQ ID NO: 548731 - RNA, 22 nt, Human
gugcugucguggaacugggcug

SEQ ID NO: 548732 - RNA, 22 nt, Human
aguggugcccaccugagccuga

SEQ ID NO: 548733 - RNA, 22 nt, Human
ucuggcuccuggcuccacugcc

SEQ ID NO: 548734 - RNA, 21 nt, Human
agggccugugcucuccagguc

SEQ ID NO: 548735 - RNA, 22 nt, Human
guccucuguguaggcugcagac

SEQ ID NO: 548736 - RNA, 22 nt, Human
acagagcauauaaagugcuuug

SEQ ID NO: 548737 - RNA, 22 nt, Human
cagucccagacccagaaggugg

SEQ ID NO: 548738 - RNA, 22 nt, Human
ggcucuggcaaggggaggcuac

SEQ ID NO: 548739 - RNA, 19 nt, Human
aguuauuucuaaauuuacc

SEQ ID NO: 548740 - RNA, 22 nt, Human
uauuuuguauuuaugcaagaaa

SEQ ID NO: 548741 - RNA, 22 nt, Human
gauucacagaacuuagucaagc

SEQ ID NO: 548742 - RNA, 22 nt, Human
gagcagugaugggaggacguca

SEQ ID NO: 548743 - RNA, 22 nt, Human
ccucacugaagaggugacauuu

SEQ ID NO: 548744 - RNA, 22 nt, Human
agcuuccucaccucagaggucu

SEQ ID NO: 548745 - RNA, 22 nt, Human
ggacacaguggaagacagcuug

SEQ ID NO: 548746 - RNA, 22 nt, Human
ugcccacaggaagacaccagcg

SEQ ID NO: 548747 - RNA, 22 nt, Human
gccuucugcgcucgugucuccg

SEQ ID NO: 548748 - RNA, 22 nt, Human
aggcugaggcagguggaucacu

SEQ ID NO: 548749 - RNA, 22 nt, Human
uccuugaauggacauuacacug

SEQ ID NO: 548750 - RNA, 22 nt, Human
acaguguaauaugggagucagu

SEQ ID NO: 548751 - RNA, 22 nt, Human
uuccucagagggcgcuggggaa

SEQ ID NO: 548752 - RNA, 22 nt, Human
gugauuucuaaucaucugaaug

SEQ ID NO: 548753 - RNA, 22 nt, Human
acuuguguaacacagaaagaac

SEQ ID NO: 548754 - RNA, 22 nt, Human
gcagggcagcuuagucccuguc

SEQ ID NO: 548755 - RNA, 20 nt, Human
cuggggacagcaauggcugu

SEQ ID NO: 548756 - RNA, 22 nt, Human
aaagauaugucuccaaagagau

SEQ ID NO: 548757 - RNA, 22 nt, Human
aaauauguaaccaaggugaagu

SEQ ID NO: 548758 - RNA, 22 nt, Human
ggcaggugcugggagcaucuca

SEQ ID NO: 548759 - RNA, 22 nt, Human
uuugcauugcauacaaggaacu

SEQ ID NO: 548760 - RNA, 22 nt, Human
uagcuagagguagauggguuag

SEQ ID NO: 548761 - RNA, 22 nt, Human
cuugaaagcacuccuuugacug

SEQ ID NO: 548762 - RNA, 22 nt, Human
cagaguggugcaagggcagugu

SEQ ID NO: 548763 - RNA, 22 nt, Human
uaauuauugucugaagaguuau

SEQ ID NO: 548764 - RNA, 22 nt, Human
gaagagcuuagacagaaucaaa

SEQ ID NO: 548765 - RNA, 22 nt, Human
agccugugugcuuuggacaggg

SEQ ID NO: 548766 - RNA, 22 nt, Human
agcagagguguuuauuauggga

SEQ ID NO: 548767 - RNA, 22 nt, Human
gauauugcaccucuaauacauu

SEQ ID NO: 548768 - RNA, 22 nt, Human
accucagagggauguuacaggc

SEQ ID NO: 548769 - RNA, 22 nt, Human
cacauacauucauguuacucua

SEQ ID NO: 548770 - RNA, 20 nt, Human
aacacacugguggcaucagg

SEQ ID NO: 548771 - RNA, 22 nt, Human
uuggaacagaaacagacaaaua

SEQ ID NO: 548772 - RNA, 22 nt, Human
uuaaacaguguuucaugugggg

SEQ ID NO: 548773 - RNA, 22 nt, Human
agcagggcucugccaugggccc

SEQ ID NO: 548774 - RNA, 22 nt, Human
auauucaaauuacauuuacuaa

SEQ ID NO: 548775 - RNA, 22 nt, Human
uggcccugcuuaugucucucuu

SEQ ID NO: 548776 - RNA, 22 nt, Human
cccugcagccggccagcucauu

SEQ ID NO: 548777 - RNA, 22 nt, Human
acccagcaugacaccugcacau

SEQ ID NO: 548778 - RNA, 22 nt, Human
aagaacaguguccugggacucg

SEQ ID NO: 548779 - RNA, 22 nt, Human
agagcagaguggcuguagcuug

SEQ ID NO: 548780 - RNA, 22 nt, Human
ugcagcucugaacagucaugaa

SEQ ID NO: 548781 - RNA, 22 nt, Human
guuccuaagcacugugcauucu

SEQ ID NO: 548782 - RNA, 22 nt, Human
gagcacagccaaaguaagaagg

SEQ ID NO: 548783 - RNA, 22 nt, Human
aaauguuucuacuugugagcau

SEQ ID NO: 548784 - RNA, 22 nt, Human
cugggaugucuauagaacacuu

SEQ ID NO: 548785 - RNA, 22 nt, Human
aucaaauacaaagggcauaagg

SEQ ID NO: 548786 - RNA, 22 nt, Human
uagcagaggcuacugcuccuug

SEQ ID NO: 548787 - RNA, 22 nt, Human
cagagcugggaucccaugggcg

SEQ ID NO: 548788 - RNA, 22 nt, Human
gaggcuguucaguguccagcuu

SEQ ID NO: 548789 - RNA, 22 nt, Human
uagcagggccaggcugggaacc

SEQ ID NO: 548790 - RNA, 22 nt, Human
auccagagacccaaggacagaa

SEQ ID NO: 548791 - RNA, 22 nt, Human
caaagggcucuagacucagcag

SEQ ID NO: 548792 - RNA, 22 nt, Human
aggcugagggcuccugagggca

SEQ ID NO: 548793 - RNA, 22 nt, Human
uuucacuguuaggaguaugcua

SEQ ID NO: 548794 - RNA, 22 nt, Human
agagcugcaccuaugcagaccu

SEQ ID NO: 548795 - RNA, 22 nt, Human
aaagguaacugggguuuugcca

SEQ ID NO: 548796 - RNA, 22 nt, Human
agaugcugugucuguucccuug

SEQ ID NO: 548797 - RNA, 22 nt, Human
guauuauugucaugaaauaaua

SEQ ID NO: 548798 - RNA, 22 nt, Human
ucuuuucauugagaacacacug

SEQ ID NO: 548799 - RNA, 23 nt, Human
uucuuucaagaaguucacagugc

SEQ ID NO: 548800 - RNA, 22 nt, Human
ggaggccacgguuuagcaccga

SEQ ID NO: 548801 - RNA, 22 nt, Human
caggcugaggguuaggccuuag

SEQ ID NO: 548802 - RNA, 22 nt, Human
gcagacuggucuucagccuugg

SEQ ID NO: 548803 - RNA, 22 nt, Human
ugugugugggcggaacggcccc

SEQ ID NO: 548804 - RNA, 21 nt, Human
uggcagaguugaguaguuaug

SEQ ID NO: 548805 - RNA, 22 nt, Human
cucaucaccacauauaacaaag

SEQ ID NO: 548806 - RNA, 22 nt, Human
cccaggucccgccccagcucua

SEQ ID NO: 548807 - RNA, 22 nt, Human
agggggaggcugugcugcgucu

SEQ ID NO: 548808 - RNA, 22 nt, Human
agaauauugaaaguucuugaca

SEQ ID NO: 548809 - RNA, 22 nt, Human
ucagguggaauuaauuaagaga

SEQ ID NO: 548810 - RNA, 20 nt, Human
ugcucuggggguggagagac

SEQ ID NO: 548811 - RNA, 21 nt, Human
ccugccaggaaacugaguguc

SEQ ID NO: 548812 - RNA, 22 nt, Human
cggcugaggaucuccaggccug

SEQ ID NO: 548813 - RNA, 22 nt, Human
aguuccagcugugaccagaaaa

SEQ ID NO: 548814 - RNA, 22 nt, Human
agggaaggaggccauguguccc

SEQ ID NO: 548815 - RNA, 22 nt, Human
cagagauuauuauaacuaauua

SEQ ID NO: 548816 - RNA, 22 nt, Human
ucuucagugcauguuaccuaua

SEQ ID NO: 548817 - RNA, 22 nt, Human
uccagaaaauucagaaauuguu

SEQ ID NO: 548818 - RNA, 22 nt, Human
gcaggugguggcgcgcgcccug

SEQ ID NO: 548819 - RNA, 22 nt, Human
ucuggagccacaaaccucagcu

SEQ ID NO: 548820 - RNA, 22 nt, Human
gcuggucacucugggagcugcu

SEQ ID NO: 548821 - RNA, 22 nt, Human
ggcugcuggggacgugggagag

SEQ ID NO: 548822 - RNA, 22 nt, Human
ucuuuguacaggaaggcacugu

SEQ ID NO: 548823 - RNA, 22 nt, Human
gcacaugagcugcugggauggg

SEQ ID NO: 548824 - RNA, 22 nt, Human
aaauccuggccucaaguggucc

SEQ ID NO: 548825 - RNA, 22 nt, Human
auccaguuccaaagaucauuua

SEQ ID NO: 548826 - RNA, 22 nt, Human
aaagagcauggaaaguucagga

SEQ ID NO: 548827 - RNA, 22 nt, Human
cuguacucaagguaaaccagga

SEQ ID NO: 548828 - RNA, 22 nt, Human
caugcuccaaaaacaagagaau

SEQ ID NO: 548829 - RNA, 20 nt, Human
ugggagcuggugaggucuca

SEQ ID NO: 548830 - RNA, 22 nt, Human
ugcaugcacgugcuauguauga

SEQ ID NO: 548831 - RNA, 22 nt, Human
ggcaggucagguccaugaccaa

SEQ ID NO: 548832 - RNA, 22 nt, Human
gaccugccugagcugccucugc

SEQ ID NO: 548833 - RNA, 22 nt, Human
aaaaccuucagguuuggaguuu

SEQ ID NO: 548834 - RNA, 22 nt, Human
gcccccagaagggccacagauu

SEQ ID NO: 548835 - RNA, 22 nt, Human
ucugagaggcagaccuuccuaa

SEQ ID NO: 548836 - RNA, 22 nt, Human
guauuuuacuuacgcaugacuu

SEQ ID NO: 548837 - RNA, 22 nt, Human
aacuucuugguccugagcuguu

SEQ ID NO: 548838 - RNA, 22 nt, Human
ugagaucauauguacaaggucu

SEQ ID NO: 548839 - RNA, 22 nt, Human
caucacaaaaugauuauucccu

SEQ ID NO: 548840 - RNA, 22 nt, Human
gguggcucggccagugcaggcc

SEQ ID NO: 548841 - RNA, 22 nt, Human
cagacacaccaggcccauucug

SEQ ID NO: 548842 - RNA, 22 nt, Human
auggagauuuuuagaauuacag

SEQ ID NO: 548843 - RNA, 22 nt, Human
ccagaaaauauggcuaagguga

SEQ ID NO: 548844 - RNA, 22 nt, Human
gcuuuacauuuuggaaagguga

SEQ ID NO: 548845 - RNA, 22 nt, Human
aggccucugggccugcggguuu

SEQ ID NO: 548846 - RNA, 22 nt, Human
cagcagggaagcugugcuguuu

SEQ ID NO: 548847 - RNA, 22 nt, Human
agagggcauuaacucugucuug

SEQ ID NO: 548848 - RNA, 22 nt, Human
agguccuggugaccauggaguu

SEQ ID NO: 548849 - RNA, 22 nt, Human
aauguuugaacuuugcauauuu

SEQ ID NO: 548850 - RNA, 22 nt, Human
uggcucaggugugagcugaaga

SEQ ID NO: 548851 - RNA, 22 nt, Human
ugcuuaaaggauaguuuaaacu

SEQ ID NO: 548852 - RNA, 22 nt, Human
gcucugggaauucagaaagccu

SEQ ID NO: 548853 - RNA, 22 nt, Human
cuacauggagaagaaaauucuu

SEQ ID NO: 548854 - RNA, 22 nt, Human
uggcugaggagggucuucuggu

SEQ ID NO: 548855 - RNA, 22 nt, Human
uuaaaauccaguguugguggau

SEQ ID NO: 548856 - RNA, 22 nt, Human
caggaccuggaaugcuugugaa

SEQ ID NO: 548857 - RNA, 22 nt, Human
agcaaagcacuuugcauacaua

SEQ ID NO: 548858 - RNA, 22 nt, Human
aaauugugcucacacugauauu

SEQ ID NO: 548859 - RNA, 22 nt, Human
ggcucugcagugacuugagggg

SEQ ID NO: 548860 - RNA, 22 nt, Human
uuucagauuaucucaacuuugg

SEQ ID NO: 548861 - RNA, 22 nt, Human
uggggguguccuggugcacaca

SEQ ID NO: 548862 - RNA, 22 nt, Human
ugaggccugcauugaacuagaa

SEQ ID NO: 548863 - RNA, 22 nt, Human
auugauuugaacaaagauauua

SEQ ID NO: 548864 - RNA, 22 nt, Human
agagugggccucugagucccag

SEQ ID NO: 548865 - RNA, 22 nt, Human
uggcugagagucauccugugug

SEQ ID NO: 548866 - RNA, 22 nt, Human
acagagaaacuaaggaguuugg

SEQ ID NO: 548867 - RNA, 22 nt, Human
auaaaucuauuggacaugugug

SEQ ID NO: 548868 - RNA, 22 nt, Human
gagagcugugguuugaccaggc

SEQ ID NO: 548869 - RNA, 22 nt, Human
ucacagaagggaaagaugccaa

SEQ ID NO: 548870 - RNA, 22 nt, Human
ucccagcagcauagcucagaau

SEQ ID NO: 548871 - RNA, 22 nt, Human
ucuucaugucuugccugauaua

SEQ ID NO: 548872 - RNA, 22 nt, Human
gucuuuuuuacaccuuacauca

SEQ ID NO: 548873 - RNA, 22 nt, Human
auuucauagauuguaaaucccu

SEQ ID NO: 548874 - RNA, 22 nt, Human
cagagcucuauguucauggagg

SEQ ID NO: 548875 - RNA, 22 nt, Human
ucagccucucugaguccagacc

SEQ ID NO: 548876 - RNA, 22 nt, Human
auacuacaagguaugugcuaaa

SEQ ID NO: 548877 - RNA, 22 nt, Human
ugccucuguggaaauggugguc

SEQ ID NO: 548878 - RNA, 22 nt, Human
accaggggugucaacagcauuu

SEQ ID NO: 548879 - RNA, 22 nt, Human
acagaggaagcauauagcacaa

SEQ ID NO: 548880 - RNA, 22 nt, Human
aggcaauccccugaggauacuu

SEQ ID NO: 548881 - RNA, 22 nt, Human
cugaggccucuguucaccagaa

SEQ ID NO: 548882 - RNA, 22 nt, Human
uuugaaagaaaccagugaguga

SEQ ID NO: 548883 - RNA, 22 nt, Human
aacagaaaagguagguggcuuu

SEQ ID NO: 548884 - RNA, 16 nt, Human
cagaguguaaacagga

SEQ ID NO: 548885 - RNA, 22 nt, Human
cugggaaggggaagguccucuc

SEQ ID NO: 548886 - RNA, 22 nt, Human
uugagaagaauguguugaguuu

SEQ ID NO: 548887 - RNA, 21 nt, Human
aggcucagagagaaacucuug

SEQ ID NO: 548888 - RNA, 22 nt, Human
aagauggcuuagaguccuggug

SEQ ID NO: 548889 - RNA, 22 nt, Human
aguggcagcugucaugcccuag

SEQ ID NO: 548890 - RNA, 22 nt, Human
uggaggaauaacagcaaccuua

SEQ ID NO: 548891 - RNA, 22 nt, Human
cucuuuuucaccucugucagcg

SEQ ID NO: 548892 - RNA, 22 nt, Human
acauaugcgaucauaggaugca

SEQ ID NO: 548893 - RNA, 22 nt, Human
uccuuuggagcuugacugguag

SEQ ID NO: 548894 - RNA, 22 nt, Human
uuugaaugagaauuauugucau

SEQ ID NO: 548895 - RNA, 19 nt, Human
auacacuaauauaaaccac

SEQ ID NO: 548896 - RNA, 22 nt, Human
ccagugcccagcugcccaggca

SEQ ID NO: 548897 - RNA, 22 nt, Human
gcguggggcagcccagggcuuc

SEQ ID NO: 548898 - RNA, 22 nt, Human
ccugaagagcacucuagaguug

SEQ ID NO: 548899 - RNA, 22 nt, Human
aaguguuuaaugguuuugauga

SEQ ID NO: 548900 - RNA, 22 nt, Human
gagggcagaaaauuaugcggug

SEQ ID NO: 548901 - RNA, 20 nt, Human
aguggggagucaggagugcc

SEQ ID NO: 548902 - RNA, 22 nt, Human
ccagucugaggccuggugaggg

SEQ ID NO: 548903 - RNA, 22 nt, Human
uuugggcaauucagugggaccu

SEQ ID NO: 548904 - RNA, 22 nt, Human
gccucuggucccucaugcugug

SEQ ID NO: 548905 - RNA, 22 nt, Human
ucucuggaauuuugagagugac

SEQ ID NO: 548906 - RNA, 18 nt, Human
gagaggagccagaauuuu

SEQ ID NO: 548907 - RNA, 22 nt, Human
ugcauuauaacugaauguuguu

SEQ ID NO: 548908 - RNA, 22 nt, Human
gugagagccugucuggaugucg

SEQ ID NO: 548909 - RNA, 22 nt, Human
cugugcuggcagaccuggaguu

SEQ ID NO: 548910 - RNA, 22 nt, Human
ucucugagcucaggagcugcag

SEQ ID NO: 548911 - RNA, 19 nt, Human
ucaucucacagggccuggc

SEQ ID NO: 548912 - RNA, 22 nt, Human
ugggcuggcguggagaguuuag

SEQ ID NO: 548913 - RNA, 22 nt, Human
gugcaguugauaguuuuaguga

SEQ ID NO: 548914 - RNA, 22 nt, Human
uuaaaagucugaugauuuacau

SEQ ID NO: 548915 - RNA, 22 nt, Human
cugccugugauuuuucucuagu

SEQ ID NO: 548916 - RNA, 19 nt, Human
gacucacaccuuccgcugu

SEQ ID NO: 548917 - RNA, 22 nt, Human
cugcugugggcaggguagcugg

SEQ ID NO: 548918 - RNA, 22 nt, Human
ugcaggaauuuuuugcagaaag

SEQ ID NO: 548919 - RNA, 22 nt, Human
gcaggcuccaaggccugggaga

SEQ ID NO: 548920 - RNA, 22 nt, Human
gaaaagaacugcaugggauuaa

SEQ ID NO: 548921 - RNA, 22 nt, Human
gcugcugcgcuugucuacuguu

SEQ ID NO: 548922 - RNA, 22 nt, Human
cagcuguuacucugaguaaaug

SEQ ID NO: 548923 - RNA, 22 nt, Human
gauuuagagaauguuuuguaag

SEQ ID NO: 548924 - RNA, 22 nt, Human
ggucccagguugacagggagac

SEQ ID NO: 548925 - RNA, 22 nt, Human
ggagaagauuggaauuaagcac

SEQ ID NO: 548926 - RNA, 22 nt, Human
uguacagcugccuuuuuuacuu

SEQ ID NO: 548927 - RNA, 22 nt, Human
uuguaaaggcuguuauugacuu

SEQ ID NO: 548928 - RNA, 22 nt, Human
uuuaagacuuagauuuauuggg

SEQ ID NO: 548929 - RNA, 22 nt, Human
gccacuggcgcugugcagagug

SEQ ID NO: 548930 - RNA, 22 nt, Human
gaaaccagcuagaggcagaggg

SEQ ID NO: 548931 - RNA, 22 nt, Human
cuggcucagacagcugugcagu

SEQ ID NO: 548932 - RNA, 22 nt, Human
cagugcuguuguaagcucauug

SEQ ID NO: 548933 - RNA, 22 nt, Human
aggcugaggcggguagaucacc

SEQ ID NO: 548934 - RNA, 22 nt, Human
cuguagccagaagcagaaggcc

SEQ ID NO: 548935 - RNA, 22 nt, Human
gagcagcucgagaaggaagcag

SEQ ID NO: 548936 - RNA, 22 nt, Human
cugggcucugcaguugauguuu

SEQ ID NO: 548937 - RNA, 22 nt, Human
caaggcagcuauugucuccaua

SEQ ID NO: 548938 - RNA, 22 nt, Human
gagaagcaaucgugacaucucc

SEQ ID NO: 548939 - RNA, 22 nt, Human
uccaagaugguugguguggugg

SEQ ID NO: 548940 - RNA, 22 nt, Human
ucccagagauuuccucuccuuc

SEQ ID NO: 548941 - RNA, 22 nt, Human
acacauuauaggcaaucaaaag

SEQ ID NO: 548942 - RNA, 22 nt, Human
acagaauugaagcugaguaaau

SEQ ID NO: 548943 - RNA, 22 nt, Human
accaacauguccucacacagcc

SEQ ID NO: 548944 - RNA, 22 nt, Human
ccauguggugggaaggagaaug

SEQ ID NO: 548945 - RNA, 22 nt, Human
gcagcugaaagggaucucuaca

SEQ ID NO: 548946 - RNA, 22 nt, Human
ucuggcagggguucugcacuug

SEQ ID NO: 548947 - RNA, 22 nt, Human
uuguguguuuguagaaaaucca

SEQ ID NO: 548948 - RNA, 22 nt, Human
ugcaggagcagagauggcugga

SEQ ID NO: 548949 - RNA, 22 nt, Human
uaguaucuauuaguaacaagag

SEQ ID NO: 548950 - RNA, 22 nt, Human
ugcagccuugccuccucccagc

SEQ ID NO: 548951 - RNA, 22 nt, Human
agcccuggcccggcugugcuuu

SEQ ID NO: 548952 - RNA, 22 nt, Human
agcugcucugauaaaccuacuu

SEQ ID NO: 548953 - RNA, 22 nt, Human
ucugccugucuccuugaauugu

SEQ ID NO: 548954 - RNA, 22 nt, Human
agggaaaguaagcauuucauua

SEQ ID NO: 548955 - RNA, 22 nt, Human
uuagaacaauauucucccuaca

SEQ ID NO: 548956 - RNA, 22 nt, Human
agggucugacaaugugacuuag

SEQ ID NO: 548957 - RNA, 22 nt, Human
uagcuuuagugaaaaauaucag

SEQ ID NO: 548958 - RNA, 22 nt, Human
guggcugcuaagucuccuuccu

SEQ ID NO: 548959 - RNA, 22 nt, Human
uacaaaguauauuucuagcugu

SEQ ID NO: 548960 - RNA, 22 nt, Human
uuuccucuucuggcaggcaggg

SEQ ID NO: 548961 - RNA, 22 nt, Human
cugcugcugagagcucagccug

SEQ ID NO: 548962 - RNA, 22 nt, Human
uuuaaacuaacaguacacguug

SEQ ID NO: 548963 - RNA, 20 nt, Human
uucaaagacccucaggucca

SEQ ID NO: 548964 - RNA, 22 nt, Human
cacaaaaucuuucucgauuauu

SEQ ID NO: 548965 - RNA, 22 nt, Human
cagaguuuuaucauacguggau

SEQ ID NO: 548966 - RNA, 22 nt, Human
uuuacacaaaagauagcacacc

SEQ ID NO: 548967 - RNA, 22 nt, Human
ucuagaaucuaaacuauaguuu

SEQ ID NO: 548968 - RNA, 22 nt, Human
uucacaggauauaugugcaggg

SEQ ID NO: 548969 - RNA, 22 nt, Human
cagaguggcaugaaugaagccu

SEQ ID NO: 548970 - RNA, 22 nt, Human
ugacagcugagccccaggcaag

SEQ ID NO: 548971 - RNA, 22 nt, Human
gccuggaguucagccaaguccc

SEQ ID NO: 548972 - RNA, 22 nt, Human
auuuaggaauguucugcacaaa

SEQ ID NO: 548973 - RNA, 22 nt, Human
acaguaaaacauuuuuauuagg

SEQ ID NO: 548974 - RNA, 20 nt, Human
cccagggaccugagcuccau

SEQ ID NO: 548975 - RNA, 22 nt, Human
acaaaguauuuuuagguuugua

SEQ ID NO: 548976 - RNA, 22 nt, Human
ccugcucagagcgucuugugug

SEQ ID NO: 548977 - RNA, 22 nt, Human
cagagcagggguuucccagguu

SEQ ID NO: 548978 - RNA, 21 nt, Human
cauuuacaugacagauugguu

SEQ ID NO: 548979 - RNA, 20 nt, Human
cugcugagagccuggcuugc

SEQ ID NO: 548980 - RNA, 22 nt, Human
uucaacaaguauuuauugagca

SEQ ID NO: 548981 - RNA, 22 nt, Human
gaaaucugucuuuguuugaaua

SEQ ID NO: 548982 - RNA, 22 nt, Human
gcauggcagugaggauggugcu

SEQ ID NO: 548983 - RNA, 19 nt, Human
ccugggaggcggagguugc

SEQ ID NO: 548984 - RNA, 22 nt, Human
acuuuugguucuguaacuguga

SEQ ID NO: 548985 - RNA, 22 nt, Human
uaaaauugcggugaauauuucc

SEQ ID NO: 548986 - RNA, 22 nt, Human
uugccaggagcucaucugaggg

SEQ ID NO: 548987 - RNA, 22 nt, Human
uggcaaauucaucuuuaguucu

SEQ ID NO: 548988 - RNA, 23 nt, Human
ggagugcaauggcgccaucucgg

SEQ ID NO: 548989 - RNA, 18 nt, Human
cugcuuugccuucauucc

SEQ ID NO: 548990 - RNA, 23 nt, Human
uuugaaugggucuauuuuucuua

SEQ ID NO: 548991 - RNA, 22 nt, Human
cugggcaguuuuacaucauugc

SEQ ID NO: 548992 - RNA, 22 nt, Human
uccaauauuucucauauaugga

SEQ ID NO: 548993 - RNA, 22 nt, Human
uuauuucuugucuauguagcca

SEQ ID NO: 548994 - RNA, 19 nt, Human
uuuaagcaauaguaucuug

SEQ ID NO: 548995 - RNA, 22 nt, Human
cacaucaagcauccaugaguuu

SEQ ID NO: 548996 - RNA, 22 nt, Human
ucaggcagagcuguggagcucu

SEQ ID NO: 548997 - RNA, 22 nt, Human
cucaggauagauuguccucuca

SEQ ID NO: 548998 - RNA, 20 nt, Human
gcccugugaugucuugaccu

SEQ ID NO: 548999 - RNA, 22 nt, Human
ucaauuucucagaaauggucuu

SEQ ID NO: 549000 - RNA, 23 nt, Human
ccucucucccuguuuggcaaaua

SEQ ID NO: 549001 - RNA, 22 nt, Human
acacccagcuuuugaaugcccu

SEQ ID NO: 549002 - RNA, 19 nt, Human
cagugcccgacgcaggucu

SEQ ID NO: 549003 - RNA, 22 nt, Human
gcagccagaagacucagaacaa

SEQ ID NO: 549004 - RNA, 22 nt, Human
gaggcuggcagaaaagcacagg

SEQ ID NO: 549005 - RNA, 21 nt, Human
uccauuguuuucccaggguuu

SEQ ID NO: 549006 - RNA, 17 nt, Human
ucaggauccaggguucu

SEQ ID NO: 549007 - RNA, 22 nt, Human
gcuggccaguguggugaccacc

SEQ ID NO: 549008 - RNA, 22 nt, Human
uggguagagcaggcuggggcuu

SEQ ID NO: 549009 - RNA, 21 nt, Human
cagagcagcguucugcugugg

SEQ ID NO: 549010 - RNA, 22 nt, Human
gccagagucuucugacccugug

SEQ ID NO: 549011 - RNA, 22 nt, Human
auauuauagacagagucuucug

SEQ ID NO: 549012 - RNA, 22 nt, Human
uugguucauuuucucaucuaga

SEQ ID NO: 549013 - RNA, 22 nt, Human
aagaguuuucuauaaucuuggc

SEQ ID NO: 549014 - RNA, 22 nt, Human
gggcugacaaccaucugacaag

SEQ ID NO: 549015 - RNA, 22 nt, Human
augggcugacccagucguggca

SEQ ID NO: 549016 - RNA, 22 nt, Human
aaagaauuuguacacccuacua

SEQ ID NO: 549017 - RNA, 22 nt, Human
uuguagauuggagaguguguga

SEQ ID NO: 549018 - RNA, 22 nt, Human
cagauuucuauuucaaauacau

SEQ ID NO: 549019 - RNA, 22 nt, Human
aacauauuuggcugauauuccc

SEQ ID NO: 549020 - RNA, 22 nt, Human
caagacuuuggaggaauuugga

SEQ ID NO: 549021 - RNA, 22 nt, Human
cugcagggagaggggacagccu

SEQ ID NO: 549022 - RNA, 22 nt, Human
gagcagcugagcuggaaugaga

SEQ ID NO: 549023 - RNA, 22 nt, Human
agguaaggcuguaagcuaagcc

SEQ ID NO: 549024 - RNA, 22 nt, Human
uuauuauugugaccugagaaug

SEQ ID NO: 549025 - RNA, 22 nt, Human
ccagggaaacuuuggaguggag

SEQ ID NO: 549026 - RNA, 22 nt, Human
aaauacugggcucaaaaggguu

SEQ ID NO: 549027 - RNA, 22 nt, Human
uguuuuuaaaauguccugguua

SEQ ID NO: 549028 - RNA, 22 nt, Human
agacacugagcauuuuccuagc

SEQ ID NO: 549029 - RNA, 22 nt, Human
ugucauuuaguccucugugugu

SEQ ID NO: 549030 - RNA, 22 nt, Human
ucagccuccgaaagugcuggga

SEQ ID NO: 549031 - RNA, 22 nt, Human
guccucaggaaggcuuucugac

SEQ ID NO: 549032 - RNA, 22 nt, Human
ucaguuuucucaucuguaauuu

SEQ ID NO: 549033 - RNA, 22 nt, Human
gcuggcagccaagugaagaggg

SEQ ID NO: 549034 - RNA, 22 nt, Human
agggucaacaggagucaagaug

SEQ ID NO: 549035 - RNA, 22 nt, Human
cauuagaagaacaguuauauua

SEQ ID NO: 549036 - RNA, 22 nt, Human
uuuguaacucucccuuuguaua

SEQ ID NO: 549037 - RNA, 22 nt, Human
ucagggacgugagcucagaguc

SEQ ID NO: 549038 - RNA, 22 nt, Human
aaauuuuagaccaggcaaaacu

SEQ ID NO: 549039 - RNA, 19 nt, Human
auacacauacguaaacuga

SEQ ID NO: 549040 - RNA, 22 nt, Human
agcaaagaaauggaggcucaga

SEQ ID NO: 549041 - RNA, 22 nt, Human
ucaggcagcuccaggaauggua

SEQ ID NO: 549042 - RNA, 22 nt, Human
agauggguaacuggagucugcu

SEQ ID NO: 549043 - RNA, 23 nt, Human
aggugcagcccuggaccugcccc

SEQ ID NO: 549044 - RNA, 22 nt, Human
ccagaagaccccguccaccucc

SEQ ID NO: 549045 - RNA, 22 nt, Human
gggcuccaacggugagcaugga

SEQ ID NO: 549046 - RNA, 22 nt, Human
aggcaggcuggucugaagagug

SEQ ID NO: 549047 - RNA, 22 nt, Human
agaauucuggaguugggaggaa

SEQ ID NO: 549048 - RNA, 22 nt, Human
uggcagagcuggcugcggauga

SEQ ID NO: 549049 - RNA, 22 nt, Human
aggcccuguccauggugcugaa

SEQ ID NO: 549050 - RNA, 22 nt, Human
ugggccugacacuuacuaggga

SEQ ID NO: 549051 - RNA, 22 nt, Human
cuggggcugcggacgggagccc

SEQ ID NO: 549052 - RNA, 21 nt, Human
auccauccaucuuggccuaac

SEQ ID NO: 549053 - RNA, 22 nt, Human
ugaaggaaagagggaacauccc

SEQ ID NO: 549054 - RNA, 22 nt, Human
uaaaugcaagugcuccugggag

SEQ ID NO: 549055 - RNA, 18 nt, Human
cucugcuaaugggcagcu

SEQ ID NO: 549056 - RNA, 22 nt, Human
ugggcugcugagaaugagagag

SEQ ID NO: 549057 - RNA, 22 nt, Human
gcuggccauucucuuugagaug

SEQ ID NO: 549058 - RNA, 22 nt, Human
cuguuauucaagacaaaggcag

SEQ ID NO: 549059 - RNA, 22 nt, Human
cuguguggacugguugaggccc

SEQ ID NO: 549060 - RNA, 22 nt, Human
ggaaagagcccagcagugcuug

SEQ ID NO: 549061 - RNA, 19 nt, Human
ugcuuccucaccaucuccc

SEQ ID NO: 549062 - RNA, 22 nt, Human
gacuauuuuauaaacuagugaa

SEQ ID NO: 549063 - RNA, 22 nt, Human
ggaggagacccugugucaguuu

SEQ ID NO: 549064 - RNA, 22 nt, Human
agaggggaggcgaaccagaguc

SEQ ID NO: 549065 - RNA, 22 nt, Human
uaaguaaauuuauaaugugauu

SEQ ID NO: 549066 - RNA, 22 nt, Human
guggccagaaucuugaggccuu

SEQ ID NO: 549067 - RNA, 22 nt, Human
uguucaauccccagguccugaa

SEQ ID NO: 549068 - RNA, 22 nt, Human
gcugucugagaacaugguggaa

SEQ ID NO: 549069 - RNA, 22 nt, Human
ugggcugagcacugaggaagga

SEQ ID NO: 549070 - RNA, 22 nt, Human
agcccugccauucucuggagcu

SEQ ID NO: 549071 - RNA, 21 nt, Human
gcagccagacgggauucaguu

SEQ ID NO: 549072 - RNA, 22 nt, Human
uuacagaguagugcagaacuca

SEQ ID NO: 549073 - RNA, 22 nt, Human
ugcugcagaaauucugugagga

SEQ ID NO: 549074 - RNA, 22 nt, Human
aauacuuuugaacugaaaggca

SEQ ID NO: 549075 - RNA, 22 nt, Human
caguuucucucaauaagcaucg

SEQ ID NO: 549076 - RNA, 22 nt, Human
guagaauaaauguacacaucug

SEQ ID NO: 549077 - RNA, 22 nt, Human
ggugaaggcacaagagggcaag

SEQ ID NO: 549078 - RNA, 22 nt, Human
ugucucugaggugagggucagc

SEQ ID NO: 549079 - RNA, 22 nt, Human
uccagcagcccgaaggcccauc

SEQ ID NO: 549080 - RNA, 22 nt, Human
gccagggaggcuguaggguccu

SEQ ID NO: 549081 - RNA, 22 nt, Human
acauacaucaaguaucacaaga

SEQ ID NO: 549082 - RNA, 22 nt, Human
gacaucauagggugggaggaaa

SEQ ID NO: 549083 - RNA, 20 nt, Human
gccuggcacccggggcuggc

SEQ ID NO: 549084 - RNA, 22 nt, Human
ugcaagagcuguggcaaaagca

SEQ ID NO: 549085 - RNA, 22 nt, Human
cuggaguggccggugcuguggc

SEQ ID NO: 549086 - RNA, 22 nt, Human
auuauacaaggcuggugccuaa

SEQ ID NO: 549087 - RNA, 22 nt, Human
ggcccucccugagccagguggg

SEQ ID NO: 549088 - RNA, 22 nt, Human
ugcacccucaucagucaaaugg

SEQ ID NO: 549089 - RNA, 22 nt, Human
uagggcucgggcacaggacagg

SEQ ID NO: 549090 - RNA, 22 nt, Human
uccaggcagggcagccaucaag

SEQ ID NO: 549091 - RNA, 22 nt, Human
ugccucugggugaccaaggagc

SEQ ID NO: 549092 - RNA, 22 nt, Human
gaggcucagggaguauaugaau

SEQ ID NO: 549093 - RNA, 21 nt, Human
agcugcaggccucccagggau

SEQ ID NO: 549094 - RNA, 19 nt, Human
cagaaauagcgaaguguaa

SEQ ID NO: 549095 - RNA, 22 nt, Human
ccagccaggcuggcuguggagg

SEQ ID NO: 549096 - RNA, 22 nt, Human
aacagcagggggaccugcuggu

SEQ ID NO: 549097 - RNA, 21 nt, Human
aggggacagaguagcuccagg

SEQ ID NO: 549098 - RNA, 22 nt, Human
caaguuaguuauucuugugagc

SEQ ID NO: 549099 - RNA, 22 nt, Human
aaggaggaauucugaguucaug

SEQ ID NO: 549100 - RNA, 22 nt, Human
ggugagggaguggaacgaggug

SEQ ID NO: 549101 - RNA, 22 nt, Human
ucauuuuucacacagggucacc

SEQ ID NO: 549102 - RNA, 23 nt, Human
uaauuauggaauaauuugcaacg

SEQ ID NO: 549103 - RNA, 22 nt, Human
augcaaaugcuagagaauguug

SEQ ID NO: 549104 - RNA, 22 nt, Human
ucccuuaaaacucauguguugu

SEQ ID NO: 549105 - RNA, 19 nt, Human
ggugugaagugaggaguua

SEQ ID NO: 549106 - RNA, 20 nt, Human
uucugcuugcaaauaucaag

SEQ ID NO: 549107 - RNA, 22 nt, Human
uauagaaguaagcauugugaug

SEQ ID NO: 549108 - RNA, 22 nt, Human
cauguuaauaugcauugaguac

SEQ ID NO: 549109 - RNA, 22 nt, Human
cucccuggcuuuguccugaggc

SEQ ID NO: 549110 - RNA, 22 nt, Human
acaggaacgaauguacauuguu

SEQ ID NO: 549111 - RNA, 22 nt, Human
cauacauugaaggagaaaggaa

SEQ ID NO: 549112 - RNA, 22 nt, Human
gggcugagccacagcuuuuguu

SEQ ID NO: 549113 - RNA, 22 nt, Human
cacaccuguaauaccagcuacu

SEQ ID NO: 549114 - RNA, 21 nt, Human
aggaaaggccagcacguaggg

SEQ ID NO: 549115 - RNA, 22 nt, Human
cacugcaguuccccagugcgca

SEQ ID NO: 549116 - RNA, 22 nt, Human
uccugagaauagaguugcaugu

SEQ ID NO: 549117 - RNA, 22 nt, Human
cauaauauacuacauugaugaa

SEQ ID NO: 549118 - RNA, 22 nt, Human
guacacacaaucucuggucagu

SEQ ID NO: 549119 - RNA, 22 nt, Human
uuccagaagccuccauauuacu

SEQ ID NO: 549120 - RNA, 22 nt, Human
cacuacuugaaagaauuacaga

SEQ ID NO: 549121 - RNA, 22 nt, Human
ccuccagggcagacggggagca

SEQ ID NO: 549122 - RNA, 22 nt, Human
aauaugugggugcuaaucaaaa

SEQ ID NO: 549123 - RNA, 22 nt, Human
ggaagaacagguuuauuuuccu

SEQ ID NO: 549124 - RNA, 22 nt, Human
gcuguggcuguacagagaccau

SEQ ID NO: 549125 - RNA, 22 nt, Human
gcuucuccucccgcucccaggc

SEQ ID NO: 549126 - RNA, 22 nt, Human
gaauuuaucuacguuaaguaug

SEQ ID NO: 549127 - RNA, 19 nt, Human
ccagagucaugucuccccc

SEQ ID NO: 549128 - RNA, 22 nt, Human
uugcucuguaauaaucuggggu

SEQ ID NO: 549129 - RNA, 22 nt, Human
uggcucuguugugcugagccag

SEQ ID NO: 549130 - RNA, 20 nt, Human
ugcguguguauuuauuuucu

SEQ ID NO: 549131 - RNA, 22 nt, Human
acaguucaagucuuagacaaca

SEQ ID NO: 549132 - RNA, 17 nt, Human
agugacuuggaaagagc

SEQ ID NO: 549133 - RNA, 22 nt, Human
auuauuauuguugauguuaggg

SEQ ID NO: 549134 - RNA, 22 nt, Human
caggcagcucgaugccuuguug

SEQ ID NO: 549135 - RNA, 22 nt, Human
gaaugaauagguguccagaugg

SEQ ID NO: 549136 - RNA, 22 nt, Human
gguccugcauugccagcaagcu

SEQ ID NO: 549137 - RNA, 22 nt, Human
ugggggcagccaggcugucaag

SEQ ID NO: 549138 - RNA, 23 nt, Human
cugcagagaacugagggacagcc

SEQ ID NO: 549139 - RNA, 22 nt, Human
caaugguggugucagaagagau

SEQ ID NO: 549140 - RNA, 22 nt, Human
acacuuuaugucuagaucuggg

SEQ ID NO: 549141 - RNA, 19 nt, Human
uggcugagcuggacugagg

SEQ ID NO: 549142 - RNA, 22 nt, Human
cugucagcacucuacuacagau

SEQ ID NO: 549143 - RNA, 22 nt, Human
uuccagggcuaauuccugugga

SEQ ID NO: 549144 - RNA, 22 nt, Human
uugauuccuugaaauauccuug

SEQ ID NO: 549145 - RNA, 21 nt, Human
aaaaagcuggggcaugcaugc

SEQ ID NO: 549146 - RNA, 22 nt, Human
caugaagcauguuuugucauga

SEQ ID NO: 549147 - RNA, 22 nt, Human
uuuuccuaguaggccuauuaga

SEQ ID NO: 549148 - RNA, 22 nt, Human
gagcagaacaggccggguggga

SEQ ID NO: 549149 - RNA, 22 nt, Human
ucugaaauucacaguugaguca

SEQ ID NO: 549150 - RNA, 22 nt, Human
aggaaacagugaacuuggcagg

SEQ ID NO: 549151 - RNA, 22 nt, Human
ggcacugauaauguccucucuc

SEQ ID NO: 549152 - RNA, 20 nt, Human
ccuccuggucaggugugcag

SEQ ID NO: 549153 - RNA, 22 nt, Human
ugaaauguguaauguggaugcc

SEQ ID NO: 549154 - RNA, 22 nt, Human
acugcuuuagaccuagagcucu

SEQ ID NO: 549155 - RNA, 22 nt, Human
ugagaaccaugaaaagcuguca

SEQ ID NO: 549156 - RNA, 22 nt, Human
ucaaagucuaucuguaauuacu

SEQ ID NO: 549157 - RNA, 22 nt, Human
cuuguacauagagaagaagccu

SEQ ID NO: 549158 - RNA, 22 nt, Human
acuccuggguugcaguccucaa

SEQ ID NO: 549159 - RNA, 22 nt, Human
aaggccuugccugacagcacca

SEQ ID NO: 549160 - RNA, 22 nt, Human
aagauuuucagcuaauggugca

SEQ ID NO: 549161 - RNA, 22 nt, Human
gagcacagggaauagacagaua

SEQ ID NO: 549162 - RNA, 18 nt, Human
aguguuuauuuaggugaa

SEQ ID NO: 549163 - RNA, 22 nt, Human
caguguggagggagagagccug

SEQ ID NO: 549164 - RNA, 22 nt, Human
uggcaugggcaaaccagggaaa

SEQ ID NO: 549165 - RNA, 22 nt, Human
ugcuccuggaugagguacucca

SEQ ID NO: 549166 - RNA, 22 nt, Human
agugugggggcuuuggugucac

SEQ ID NO: 549167 - RNA, 22 nt, Human
aaauagauuuaacauccauccc

SEQ ID NO: 549168 - RNA, 17 nt, Human
gcugccaccuuuggagc

SEQ ID NO: 549169 - RNA, 22 nt, Human
uggaagagaaaggaguggaucu

SEQ ID NO: 549170 - RNA, 22 nt, Human
gucccuggaauggacucugcgc

SEQ ID NO: 549171 - RNA, 22 nt, Human
aaugugaggccuugguaguuau

SEQ ID NO: 549172 - RNA, 22 nt, Human
caguggaauacgagcagauguc

SEQ ID NO: 549173 - RNA, 22 nt, Human
aggguauguuuuuaucuacugu

SEQ ID NO: 549174 - RNA, 22 nt, Human
aaggcugaggagggccugcagg

SEQ ID NO: 549175 - RNA, 22 nt, Human
ugggagcagccaacauggccuu

SEQ ID NO: 549176 - RNA, 19 nt, Human
guucuuuucaccucugugc

SEQ ID NO: 549177 - RNA, 22 nt, Human
uguuuuaugagccauauaaccu

SEQ ID NO: 549178 - RNA, 22 nt, Human
cuuuucacaggaggauaagccc

SEQ ID NO: 549179 - RNA, 22 nt, Human
gaacauuugaugaugacauugg

SEQ ID NO: 549180 - RNA, 22 nt, Human
uaguauuuuagaaaaccaugaa

SEQ ID NO: 549181 - RNA, 22 nt, Human
ucaggagggugacaggcccugg

SEQ ID NO: 549182 - RNA, 17 nt, Human
uucaagauauugaaaug

SEQ ID NO: 549183 - RNA, 20 nt, Human
cugaaccaaggcuuucucag

SEQ ID NO: 549184 - RNA, 22 nt, Human
uguauuuuuaggaaugcgcuau

SEQ ID NO: 549185 - RNA, 22 nt, Human
auuugaagaaaguuuucuagau

SEQ ID NO: 549186 - RNA, 22 nt, Human
gagcucagcccaaagagcagug

SEQ ID NO: 549187 - RNA, 23 nt, Human
aucaaacuggugagaaugucagu

SEQ ID NO: 549188 - RNA, 22 nt, Human
uggcaagagcaaaauguacagu

SEQ ID NO: 549189 - RNA, 21 nt, Human
gcagaugggaagagacgaggc

SEQ ID NO: 549190 - RNA, 22 nt, Human
aaaauauggggugagcccagag

SEQ ID NO: 549191 - RNA, 22 nt, Human
cccagcuugucugauucagccu

SEQ ID NO: 549192 - RNA, 22 nt, Human
uagcagcaauuacacaguccgu

SEQ ID NO: 549193 - RNA, 22 nt, Human
cagcauggugccagugagucca

SEQ ID NO: 549194 - RNA, 22 nt, Human
ucaaugauaucagcaggaugug

SEQ ID NO: 549195 - RNA, 22 nt, Human
cuuccaauagcaacaaagauua

SEQ ID NO: 549196 - RNA, 22 nt, Human
uuggccuucugguguucauuuu

SEQ ID NO: 549197 - RNA, 22 nt, Human
ugaggcagauauuuauuggguu

SEQ ID NO: 549198 - RNA, 22 nt, Human
agucacaguuccuacccaguaa

SEQ ID NO: 549199 - RNA, 21 nt, Human
aggcucagcagguguauaaag

SEQ ID NO: 549200 - RNA, 22 nt, Human
ucucaacaccacuugcugaaga

SEQ ID NO: 549201 - RNA, 22 nt, Human
gcugaaggaggcucugguacua

SEQ ID NO: 549202 - RNA, 22 nt, Human
gccucugcaccaguacugugcc

SEQ ID NO: 549203 - RNA, 22 nt, Human
uugcaaaagccgaggcacucca

SEQ ID NO: 549204 - RNA, 20 nt, Human
ucucccugcccaucucagau

SEQ ID NO: 549205 - RNA, 22 nt, Human
ggcauccaguucugaucaacaa

SEQ ID NO: 549206 - RNA, 22 nt, Human
cagcuggcuccaccucugggcu

SEQ ID NO: 549207 - RNA, 22 nt, Human
aauucuacauugguucacauuu

SEQ ID NO: 549208 - RNA, 22 nt, Human
gucagcugggcaucugcagaug

SEQ ID NO: 549209 - RNA, 22 nt, Human
ccucagagaaagguauggcuga

SEQ ID NO: 549210 - RNA, 22 nt, Human
ggaggccaaggugggcggauca

SEQ ID NO: 549211 - RNA, 22 nt, Human
uggcagugccccuugaccagug

SEQ ID NO: 549212 - RNA, 22 nt, Human
uuugauaacagugaauaucaug

SEQ ID NO: 549213 - RNA, 22 nt, Human
aaggcacuagcaagcugccugg

SEQ ID NO: 549214 - RNA, 20 nt, Human
ugugccuggcuuuguccuga

SEQ ID NO: 549215 - RNA, 22 nt, Human
agaauuuuaucuaaagggagua

SEQ ID NO: 549216 - RNA, 22 nt, Human
acuccuggggauccauuccuuu

SEQ ID NO: 549217 - RNA, 22 nt, Human
gcugcuggcgcugggcguccgg

SEQ ID NO: 549218 - RNA, 22 nt, Human
ggagcuguucaggacugcuuca

SEQ ID NO: 549219 - RNA, 22 nt, Human
aaucagaaagaucuugaugaga

SEQ ID NO: 549220 - RNA, 22 nt, Human
cagcccuggaacagcugacuca

SEQ ID NO: 549221 - RNA, 19 nt, Human
uugcauuguaguuggacug

SEQ ID NO: 549222 - RNA, 22 nt, Human
aaacaaacauagguuugaaagu

SEQ ID NO: 549223 - RNA, 22 nt, Human
ucccacugugaauccaaggccu

SEQ ID NO: 549224 - RNA, 22 nt, Human
aaccugcaguuuuuauucugag

SEQ ID NO: 549225 - RNA, 19 nt, Human
aagagcagggaaagaauug

SEQ ID NO: 549226 - RNA, 22 nt, Human
gguucaguuuacauuaaaaucu

SEQ ID NO: 549227 - RNA, 22 nt, Human
aucuggcucgcuaggcucuggg

SEQ ID NO: 549228 - RNA, 22 nt, Human
aggcuuuggaaucagaguucug

SEQ ID NO: 549229 - RNA, 22 nt, Human
aaauauagugacacuuauaguc

SEQ ID NO: 549230 - RNA, 22 nt, Human
uccaggcuggccucgcgugaca

SEQ ID NO: 549231 - RNA, 22 nt, Human
agagaaggucacuaaggaccca

SEQ ID NO: 549232 - RNA, 22 nt, Human
guuucaaguagcugcugauuau

SEQ ID NO: 549233 - RNA, 22 nt, Human
uuuacagaugaggauacugagg

SEQ ID NO: 549234 - RNA, 22 nt, Human
gggcagugguccaggcuacagc

SEQ ID NO: 549235 - RNA, 22 nt, Human
aucuaacugggcuauuuuauug

SEQ ID NO: 549236 - RNA, 22 nt, Human
gccucugcaucuucgccgcacu

SEQ ID NO: 549237 - RNA, 22 nt, Human
aagucuggugcuguccucaccc

SEQ ID NO: 549238 - RNA, 22 nt, Human
ccuggccagaggcgugccugug

SEQ ID NO: 549239 - RNA, 22 nt, Human
aaacuacugauuugugaauuga

SEQ ID NO: 549240 - RNA, 22 nt, Human
cuugugcaauugacauugaauc

SEQ ID NO: 549241 - RNA, 22 nt, Human
gcucaggaaaacagucuaguaa

SEQ ID NO: 549242 - RNA, 18 nt, Human
acauuucuccuucugacc

SEQ ID NO: 549243 - RNA, 22 nt, Human
cucuggaggucagguguggugg

SEQ ID NO: 549244 - RNA, 22 nt, Human
aagccaggcaugcuuggacagu

SEQ ID NO: 549245 - RNA, 22 nt, Human
aagucacagcuaaauagcuaag

SEQ ID NO: 549246 - RNA, 19 nt, Human
gucuucugaauguggcugc

SEQ ID NO: 549247 - RNA, 22 nt, Human
caggaggccaacugugggacuu

SEQ ID NO: 549248 - RNA, 22 nt, Human
guuauuaguaagacucgcacau

SEQ ID NO: 549249 - RNA, 22 nt, Human
augucaaaugcugcaaacucau

SEQ ID NO: 549250 - RNA, 22 nt, Human
gugggggcuggcucguccugug

SEQ ID NO: 549251 - RNA, 22 nt, Human
ucaggaguccugccugcagccu

SEQ ID NO: 549252 - RNA, 22 nt, Human
ucaucaaaggauugcaugauuu

SEQ ID NO: 549253 - RNA, 22 nt, Human
uagaaacagagagauaugcccc

SEQ ID NO: 549254 - RNA, 22 nt, Human
aagggcaggcagagaucauaua

SEQ ID NO: 549255 - RNA, 18 nt, Human
ucucuuuccucaguggag

SEQ ID NO: 549256 - RNA, 22 nt, Human
ugguuccugguucacuuggcag

SEQ ID NO: 549257 - RNA, 22 nt, Human
gaggccacagcuaucagggaca

SEQ ID NO: 549258 - RNA, 22 nt, Human
cugagccaguagucagggacaa

SEQ ID NO: 549259 - RNA, 22 nt, Human
cagcucaggcucuccaugcucc

SEQ ID NO: 549260 - RNA, 22 nt, Human
uuugaaauguaucaguauaggu

SEQ ID NO: 549261 - RNA, 20 nt, Human
ggugcagguaacgcugugcu

SEQ ID NO: 549262 - RNA, 22 nt, Human
gagccaggaggcagagacugca

SEQ ID NO: 549263 - RNA, 22 nt, Human
gcuggagauaguaggauccaua

SEQ ID NO: 549264 - RNA, 22 nt, Human
uuucacagcuggguggcagagu

SEQ ID NO: 549265 - RNA, 22 nt, Human
ggcacuguuuuuguauucaguu

SEQ ID NO: 549266 - RNA, 22 nt, Human
cugcuggagguuggagcaugca

SEQ ID NO: 549267 - RNA, 22 nt, Human
ucaggugggaccugcuaggaca

SEQ ID NO: 549268 - RNA, 22 nt, Human
cccagcauggagugaggacuca

SEQ ID NO: 549269 - RNA, 22 nt, Human
gaagccaguacugugcucugca

SEQ ID NO: 549270 - RNA, 20 nt, Human
ccaagagcaugcaugaggaa

SEQ ID NO: 549271 - RNA, 22 nt, Human
aaaguuaguuucuuauaugucu

SEQ ID NO: 549272 - RNA, 22 nt, Human
gugucccacucuggaggugaag

SEQ ID NO: 549273 - RNA, 22 nt, Human
ucagccugcuccaagugcugcc

SEQ ID NO: 549274 - RNA, 22 nt, Human
ucaggcagguuggcugcagguc

SEQ ID NO: 549275 - RNA, 22 nt, Human
ugcccuguggguaucugauggc

SEQ ID NO: 549276 - RNA, 22 nt, Human
uuauuuaaaauguagguuggga

SEQ ID NO: 549277 - RNA, 22 nt, Human
uaaagcaggccacauaugugau

SEQ ID NO: 549278 - RNA, 22 nt, Human
gcaggcagagucaauuugaucc

SEQ ID NO: 549279 - RNA, 22 nt, Human
gccagggcaggggagcaucugc

SEQ ID NO: 549280 - RNA, 21 nt, Human
aggcccagcuuuccucuugcu

SEQ ID NO: 549281 - RNA, 22 nt, Human
gccugagcaggcguggaccaug

SEQ ID NO: 549282 - RNA, 22 nt, Human
agcugcaggccucuccugggga

SEQ ID NO: 549283 - RNA, 22 nt, Human
uuuccuuugcccaauacauguc

SEQ ID NO: 549284 - RNA, 22 nt, Human
uauguaaaguagauggcaggua

SEQ ID NO: 549285 - RNA, 22 nt, Human
uggggacauagccagucuggcu

SEQ ID NO: 549286 - RNA, 22 nt, Human
gcagaagggaauaaggagcuuu

SEQ ID NO: 549287 - RNA, 22 nt, Human
ucucagaguuuuuuuccaggac

SEQ ID NO: 549288 - RNA, 22 nt, Human
uagaacacuugaccacugcucc

SEQ ID NO: 549289 - RNA, 22 nt, Human
gagugucugaauuagagcacaa

SEQ ID NO: 549290 - RNA, 22 nt, Human
uuuggaaacacggucaucuucc

SEQ ID NO: 549291 - RNA, 22 nt, Human
gagugcaguuggggugagggga

SEQ ID NO: 549292 - RNA, 22 nt, Human
ggggccuguagagcuucaggga

SEQ ID NO: 549293 - RNA, 22 nt, Human
uggaaggaacagaguuugaaac

SEQ ID NO: 549294 - RNA, 22 nt, Human
agcugcuguggggcucggccug

SEQ ID NO: 549295 - RNA, 22 nt, Human
uuugaaagcuacuuucggguca

SEQ ID NO: 549296 - RNA, 22 nt, Human
agaggccuaauugcuacccuuu

SEQ ID NO: 549297 - RNA, 22 nt, Human
ugaggccaaugacccugggcag

SEQ ID NO: 549298 - RNA, 20 nt, Human
accauuaauguaagcuuugu

SEQ ID NO: 549299 - RNA, 22 nt, Human
ccaguggaguuuuuauacccag

SEQ ID NO: 549300 - RNA, 22 nt, Human
aggugggcccagugggcuccag

SEQ ID NO: 549301 - RNA, 22 nt, Human
caggguggaagcuguagagugg

SEQ ID NO: 549302 - RNA, 22 nt, Human
uauuucugaauccaaaagguca

SEQ ID NO: 549303 - RNA, 22 nt, Human
cagcccucaucucagcuucuuu

SEQ ID NO: 549304 - RNA, 21 nt, Human
ugcagugaggggagcugucag

SEQ ID NO: 549305 - RNA, 22 nt, Human
cuucuucauguauugauagucu

SEQ ID NO: 549306 - RNA, 20 nt, Human
gggcuagaccagggcagagg

SEQ ID NO: 549307 - RNA, 22 nt, Human
aacaaauguaaaaugcagaugc

SEQ ID NO: 549308 - RNA, 22 nt, Human
cagcccuuuccuucucagcuuu

SEQ ID NO: 549309 - RNA, 22 nt, Human
aggcucugcagugcuggaggac

SEQ ID NO: 549310 - RNA, 22 nt, Human
aaauggaauguguuuauaauuc

SEQ ID NO: 549311 - RNA, 22 nt, Human
uuugugaacaaacaugaagaug

SEQ ID NO: 549312 - RNA, 22 nt, Human
ccaaggagcugcaggcacuugu

SEQ ID NO: 549313 - RNA, 22 nt, Human
aaguaagucuuacauucacauu

SEQ ID NO: 549314 - RNA, 22 nt, Human
gagacaucauaaugaaguuucc

SEQ ID NO: 549315 - RNA, 22 nt, Human
ucuguauauauuaaugaaauuc

SEQ ID NO: 549316 - RNA, 19 nt, Human
cagaccuguccagccugug

SEQ ID NO: 549317 - RNA, 22 nt, Human
gcaaguuauuuccauuuaaagc

SEQ ID NO: 549318 - RNA, 22 nt, Human
aggagccaaauuacuagcucug

SEQ ID NO: 549319 - RNA, 22 nt, Human
gacuacucaaacuuucucuaua

SEQ ID NO: 549320 - RNA, 22 nt, Human
aaauaggagcuuaagcacuucu

SEQ ID NO: 549321 - RNA, 22 nt, Human
ccucugggcagguagcagcagc

SEQ ID NO: 549322 - RNA, 22 nt, Human
agcuaggauaagcagagacugg

SEQ ID NO: 549323 - RNA, 22 nt, Human
uuuuaaacugcagaauuuagaa

SEQ ID NO: 549324 - RNA, 22 nt, Human
uaaagcauguguuagaagugca

SEQ ID NO: 549325 - RNA, 21 nt, Human
uuucuaaggaggaagaaaaga

SEQ ID NO: 549326 - RNA, 22 nt, Human
ugcuucugggccugguguuccc

SEQ ID NO: 549327 - RNA, 21 nt, Human
uuugcugaaugauuccagggc

SEQ ID NO: 549328 - RNA, 22 nt, Human
uggcaagagggaugcaagguuu

SEQ ID NO: 549329 - RNA, 22 nt, Human
ugggaagcuuuaaauggguguc

SEQ ID NO: 549330 - RNA, 22 nt, Human
aggugccagugcuguggucccc

SEQ ID NO: 549331 - RNA, 22 nt, Human
cagggaagagccgaugcugcag

SEQ ID NO: 549332 - RNA, 22 nt, Human
uagcagaggcaaggaugugaau

SEQ ID NO: 549333 - RNA, 22 nt, Human
gaaguggaauuacugggucaua

SEQ ID NO: 549334 - RNA, 22 nt, Human
cauuuuaagaugaccugguuuc

SEQ ID NO: 549335 - RNA, 22 nt, Human
ucagauggcauagguuggaauu

SEQ ID NO: 549336 - RNA, 22 nt, Human
cauguguaaggcucacaggcag

SEQ ID NO: 549337 - RNA, 22 nt, Human
ugcacacaguucucaggaaaga

SEQ ID NO: 549338 - RNA, 22 nt, Human
aaagcaugacucaagaauuacu

SEQ ID NO: 549339 - RNA, 22 nt, Human
ugcugcucucagccaccaggaa

SEQ ID NO: 549340 - RNA, 22 nt, Human
guucugaguccuccuuugaagg

SEQ ID NO: 549341 - RNA, 22 nt, Human
cccagccuggugcacugugggg

SEQ ID NO: 549342 - RNA, 23 nt, Human
ugacacauuuccuuuccacugca

SEQ ID NO: 549343 - RNA, 22 nt, Human
uacaguuacugcauuucuaaua

SEQ ID NO: 549344 - RNA, 22 nt, Human
guuacauuuggugauuuggugc

SEQ ID NO: 549345 - RNA, 22 nt, Human
gggcaggagagaacagucaugg

SEQ ID NO: 549346 - RNA, 22 nt, Human
guguccuuuuaugugacugguu

SEQ ID NO: 549347 - RNA, 22 nt, Human
gcaaggcugcugccacccaucu

SEQ ID NO: 549348 - RNA, 22 nt, Human
ccagggcugcugugggacucca

SEQ ID NO: 549349 - RNA, 22 nt, Human
guuugcauuuauuagucuucug

SEQ ID NO: 549350 - RNA, 22 nt, Human
ugucaaaaugacuuuacuacag

SEQ ID NO: 549351 - RNA, 22 nt, Human
aggauccuguauggagaagcug

SEQ ID NO: 549352 - RNA, 22 nt, Human
uucauagugauuguucagauag

SEQ ID NO: 549353 - RNA, 22 nt, Human
acagguggaaacaugguguugg

SEQ ID NO: 549354 - RNA, 22 nt, Human
gucauuuuuuucguaauagugg

SEQ ID NO: 549355 - RNA, 22 nt, Human
gugaaaauaaggcugguucuug

SEQ ID NO: 549356 - RNA, 22 nt, Human
ugggaaagccagcagugucacc

SEQ ID NO: 549357 - RNA, 22 nt, Human
ccuggccucagccuagggcuga

SEQ ID NO: 549358 - RNA, 22 nt, Human
uucacaggugacuggggauaac

SEQ ID NO: 549359 - RNA, 22 nt, Human
ugaaucaaugaauugcacuuca

SEQ ID NO: 549360 - RNA, 22 nt, Human
agccaaagaucagugugcaagu

SEQ ID NO: 549361 - RNA, 22 nt, Human
acaacaggguaaggcaggccau

SEQ ID NO: 549362 - RNA, 22 nt, Human
cccagacuccucuggcuggugg

SEQ ID NO: 549363 - RNA, 22 nt, Human
gcacugugcuagaagccagggg

SEQ ID NO: 549364 - RNA, 22 nt, Human
ugcaaauugcaugauguguauc

SEQ ID NO: 549365 - RNA, 22 nt, Human
gacacagauaucucugagauua

SEQ ID NO: 549366 - RNA, 22 nt, Human
agugcauauaugaagaguauga

SEQ ID NO: 549367 - RNA, 22 nt, Human
accauuuuggguauuuucagag

SEQ ID NO: 549368 - RNA, 18 nt, Human
ucuuggaguaaugaucaa

SEQ ID NO: 549369 - RNA, 22 nt, Human
ugacaucacguccuuucagaga

SEQ ID NO: 549370 - RNA, 22 nt, Human
ucugagaggauuccugucccga

SEQ ID NO: 549371 - RNA, 22 nt, Human
aaaguagaacauuuucuuaucu

SEQ ID NO: 549372 - RNA, 22 nt, Human
ucaugacaacuauauuauucca

SEQ ID NO: 549373 - RNA, 22 nt, Human
aggugucugggcuuuggaguca

SEQ ID NO: 549374 - RNA, 22 nt, Human
ccagaagaacuuaauucaaaac

SEQ ID NO: 549375 - RNA, 22 nt, Human
cagaaauggagcccaggaaucu

SEQ ID NO: 549376 - RNA, 22 nt, Human
aauuagagaucaguucuuugac

SEQ ID NO: 549377 - RNA, 22 nt, Human
auaugugaaugauaucacuuug

SEQ ID NO: 549378 - RNA, 22 nt, Human
aaacauguaauucugcuuaaga

SEQ ID NO: 549379 - RNA, 22 nt, Human
acaggcuuuuuuagaaugacau

SEQ ID NO: 549380 - RNA, 22 nt, Human
uuucagaggaggaaggcaguua

SEQ ID NO: 549381 - RNA, 22 nt, Human
aggggagccccugguccuggug

SEQ ID NO: 549382 - RNA, 22 nt, Human
gccugggauucucaaaggggug

SEQ ID NO: 549383 - RNA, 22 nt, Human
cauuuguuggucagauuguagu

SEQ ID NO: 549384 - RNA, 22 nt, Human
augucuuuauaaauguauaaug

SEQ ID NO: 549385 - RNA, 22 nt, Human
ugggcagagucguggggaauag

SEQ ID NO: 549386 - RNA, 22 nt, Human
cccagccucuggauucugcccu

SEQ ID NO: 549387 - RNA, 22 nt, Human
acagcuguggccacuugcaucc

SEQ ID NO: 549388 - RNA, 22 nt, Human
ucauaacagcuaagucccuuuc

SEQ ID NO: 549389 - RNA, 22 nt, Human
gcaggcaggcuuccuugaacug

SEQ ID NO: 549390 - RNA, 22 nt, Human
aaaugcagaaugauuucaucua

SEQ ID NO: 549391 - RNA, 22 nt, Human
ugaugcaauagagagauagaua

SEQ ID NO: 549392 - RNA, 22 nt, Human
cuggcucuucagugcuugguuc

SEQ ID NO: 549393 - RNA, 22 nt, Human
ggggcugggauuugaacccagg

SEQ ID NO: 549394 - RNA, 20 nt, Human
gaaauucucguauuaguuua

SEQ ID NO: 549395 - RNA, 22 nt, Human
uguagcacagagcuuugacacu

SEQ ID NO: 549396 - RNA, 22 nt, Human
ugcaggcugggaagagggacaa

SEQ ID NO: 549397 - RNA, 22 nt, Human
augcaagacauaaauaaucuuu

SEQ ID NO: 549398 - RNA, 22 nt, Human
aucaaguuuucuuaguugacug

SEQ ID NO: 549399 - RNA, 22 nt, Human
guggcuuggaccagucacagug

SEQ ID NO: 549400 - RNA, 22 nt, Human
ugugcccauuccacuugaguac

SEQ ID NO: 549401 - RNA, 22 nt, Human
ucagacaggcuucuuucucccu

SEQ ID NO: 549402 - RNA, 22 nt, Human
ugcugucugauucagggugauu

SEQ ID NO: 549403 - RNA, 22 nt, Human
augucuaaaagauaaaguuuaa

SEQ ID NO: 549404 - RNA, 22 nt, Human
uggcagagucucuccuuuccag

SEQ ID NO: 549405 - RNA, 19 nt, Human
acaaagcugugagcagcuu

SEQ ID NO: 549406 - RNA, 22 nt, Human
auaguguuacccuucuuaaagu

SEQ ID NO: 549407 - RNA, 22 nt, Human
aaucacaaauuuagacagagcu

SEQ ID NO: 549408 - RNA, 22 nt, Human
cucuggcuucuaccuugcaguu

SEQ ID NO: 549409 - RNA, 22 nt, Human
caggagaagucucuagggggug

SEQ ID NO: 549410 - RNA, 20 nt, Human
agccugccagcuggcccaga

SEQ ID NO: 549411 - RNA, 22 nt, Human
gaugugggguugagggaccagc

SEQ ID NO: 549412 - RNA, 23 nt, Human
cuguggcugaguccuguuggagu

SEQ ID NO: 549413 - RNA, 20 nt, Human
ucugucucugagcuagacuu

SEQ ID NO: 549414 - RNA, 22 nt, Human
uguaucaaaccaaauuaauucu

SEQ ID NO: 549415 - RNA, 22 nt, Human
augggggccugaacaggcaaaa

SEQ ID NO: 549416 - RNA, 22 nt, Human
aggcagguguuaccucugguuu

SEQ ID NO: 549417 - RNA, 22 nt, Human
acagugugguuugagcacuggg

SEQ ID NO: 549418 - RNA, 22 nt, Human
auuuauugagacuuaacaaccc

SEQ ID NO: 549419 - RNA, 19 nt, Human
gcccugcaggagguggggc

SEQ ID NO: 549420 - RNA, 22 nt, Human
ggagccaggcaaucuguacuuu

SEQ ID NO: 549421 - RNA, 22 nt, Human
ggccuggaagaggacagagaaa

SEQ ID NO: 549422 - RNA, 22 nt, Human
gggcucuuuucugagcuucacu

SEQ ID NO: 549423 - RNA, 22 nt, Human
cagcagaaguccgacuccaguc

SEQ ID NO: 549424 - RNA, 22 nt, Human
ucucaggagccacagcgggagu

SEQ ID NO: 549425 - RNA, 22 nt, Human
ucuguuuuguaccagauacagc

SEQ ID NO: 549426 - RNA, 22 nt, Human
uacauacacaaauauacuguuu

SEQ ID NO: 549427 - RNA, 22 nt, Human
augccagucaaagaagaugaca

SEQ ID NO: 549428 - RNA, 22 nt, Human
ucuggggauggucuacuuucug

SEQ ID NO: 549429 - RNA, 22 nt, Human
ucaccuaauugaagucaggagu

SEQ ID NO: 549430 - RNA, 22 nt, Human
ggaacagacugacuucuugaau

SEQ ID NO: 549431 - RNA, 22 nt, Human
acauucuuaacaguuaaaaacu

SEQ ID NO: 549432 - RNA, 22 nt, Human
cauuugaaccuggauguucuua

SEQ ID NO: 549433 - RNA, 22 nt, Human
accugggagucacaccugagaa

SEQ ID NO: 549434 - RNA, 22 nt, Human
ccccacacucuuuacauucaua

SEQ ID NO: 549435 - RNA, 22 nt, Human
uucaacaacuugguucaaaugg

SEQ ID NO: 549436 - RNA, 22 nt, Human
gugcuucucuucacacccaacu

SEQ ID NO: 549437 - RNA, 22 nt, Human
cugcccaggcugaaggaacauc

SEQ ID NO: 549438 - RNA, 22 nt, Human
aucaaaguaauuaacacugaga

SEQ ID NO: 549439 - RNA, 22 nt, Human
aggcuccaugcaaaggcuguuu

SEQ ID NO: 549440 - RNA, 22 nt, Human
aaguguuuaaauuauuugcagg

SEQ ID NO: 549441 - RNA, 22 nt, Human
agucaguuuuaccaaucucagu

SEQ ID NO: 549442 - RNA, 23 nt, Human
gugcaugugucuuuacaguagca

SEQ ID NO: 549443 - RNA, 22 nt, Human
auguguagaacuguaaugccca

SEQ ID NO: 549444 - RNA, 22 nt, Human
gugugagggacagagaaagggg

SEQ ID NO: 549445 - RNA, 22 nt, Human
gcagaacauuucacaguaucuu

SEQ ID NO: 549446 - RNA, 22 nt, Human
gccuggggaacuugauccuguc

SEQ ID NO: 549447 - RNA, 22 nt, Human
cagugaaguucuacugaauggu

SEQ ID NO: 549448 - RNA, 22 nt, Human
ucaaaguaccagagugaacuga

SEQ ID NO: 549449 - RNA, 22 nt, Human
uccagaaacuuuuccagucuca

SEQ ID NO: 549450 - RNA, 22 nt, Human
cugcugagccgcacccaggagc

SEQ ID NO: 549451 - RNA, 22 nt, Human
cugccaggccuccgcugucccc

SEQ ID NO: 549452 - RNA, 22 nt, Human
ucucuucauuugcuauggguca

SEQ ID NO: 549453 - RNA, 23 nt, Human
ugccucugccucccuagucugca

SEQ ID NO: 549454 - RNA, 22 nt, Human
aaagucauggaaaaucuuggaa

SEQ ID NO: 549455 - RNA, 22 nt, Human
cagucacauugcccugcauuua

SEQ ID NO: 549456 - RNA, 22 nt, Human
ccagcuuucucagaggcuucua

SEQ ID NO: 549457 - RNA, 22 nt, Human
guacauuuugagguuaaaacaa

SEQ ID NO: 549458 - RNA, 23 nt, Human
cuuauucauucauguagcccauu

SEQ ID NO: 549459 - RNA, 22 nt, Human
cucaggacccgguccagguggg

SEQ ID NO: 549460 - RNA, 22 nt, Human
aucauaaaccacuuuguaaucu

SEQ ID NO: 549461 - RNA, 22 nt, Human
auuuggggcucaccagggcuga

SEQ ID NO: 549462 - RNA, 22 nt, Human
auauacuguguuccauggacca

SEQ ID NO: 549463 - RNA, 22 nt, Human
acauuucucagggaguuuugcu

SEQ ID NO: 549464 - RNA, 22 nt, Human
gagugugcuuagagagcugcau

SEQ ID NO: 549465 - RNA, 22 nt, Human
agcacagcuucaccgagcccau

SEQ ID NO: 549466 - RNA, 22 nt, Human
ugaggcuugauuugcccgagag

SEQ ID NO: 549467 - RNA, 22 nt, Human
cccagugccaggcacaggcagc

SEQ ID NO: 549468 - RNA, 19 nt, Human
guuucauuaagauaggaaa

SEQ ID NO: 549469 - RNA, 22 nt, Human
ugagccugggcuuucucuggag

SEQ ID NO: 549470 - RNA, 22 nt, Human
ggcagaaggccucccagcuccu

SEQ ID NO: 549471 - RNA, 22 nt, Human
accugaaaccaacuuguguacu

SEQ ID NO: 549472 - RNA, 22 nt, Human
ggcuucagaggagaagagggug

SEQ ID NO: 549473 - RNA, 22 nt, Human
ucagacagcuugggauaacuga

SEQ ID NO: 549474 - RNA, 22 nt, Human
agagccuggacuuuucugagcc

SEQ ID NO: 549475 - RNA, 22 nt, Human
uauauguaagcuauguaagagu

SEQ ID NO: 549476 - RNA, 22 nt, Human
aagaucaggcguggaaaacacu

SEQ ID NO: 549477 - RNA, 22 nt, Human
aaagaguucuaugaucuuucca

SEQ ID NO: 549478 - RNA, 22 nt, Human
ucagggcaucucuuaaguggug

SEQ ID NO: 549479 - RNA, 22 nt, Human
ucucccaaccucuggugggugc

SEQ ID NO: 549480 - RNA, 23 nt, Human
agaggcacuaauuauucagagau

SEQ ID NO: 549481 - RNA, 22 nt, Human
aguccauagaggcugcuuucau

SEQ ID NO: 549482 - RNA, 22 nt, Human
aaugaucuacucucauuaucuc

SEQ ID NO: 549483 - RNA, 22 nt, Human
gugcccugugaacuguaaggaa

SEQ ID NO: 549484 - RNA, 22 nt, Human
uguguuggcugccggcacagga

SEQ ID NO: 549485 - RNA, 22 nt, Human
gaagcccacguuuggugaugua

SEQ ID NO: 549486 - RNA, 22 nt, Human
aacauguaaauaucauuguacu

SEQ ID NO: 549487 - RNA, 22 nt, Human
uggggugguaauacaccguucu

SEQ ID NO: 549488 - RNA, 22 nt, Human
cagggagcaggcucuguccauc

SEQ ID NO: 549489 - RNA, 22 nt, Human
gugauucauccuggcauucauu

SEQ ID NO: 549490 - RNA, 22 nt, Human
aguaaugaauacgguauuugaa

SEQ ID NO: 549491 - RNA, 22 nt, Human
cauuaacaauuguuuaugcugu

SEQ ID NO: 549492 - RNA, 22 nt, Human
cauaauuuuuuuaagucagaac

SEQ ID NO: 549493 - RNA, 22 nt, Human
gaguggggcguggauccagcgu

SEQ ID NO: 549494 - RNA, 22 nt, Human
cccugcugucaggugcugggag

SEQ ID NO: 549495 - RNA, 22 nt, Human
gguggccucucaugcaagguag

SEQ ID NO: 549496 - RNA, 22 nt, Human
ucaagaaacugugcuacagagu

SEQ ID NO: 549497 - RNA, 22 nt, Human
cuggggcucacuuuggucaggc

SEQ ID NO: 549498 - RNA, 22 nt, Human
ggcuucagugacuggugcccuc

SEQ ID NO: 549499 - RNA, 22 nt, Human
cagcuugugcaaagguccuggg

SEQ ID NO: 549500 - RNA, 22 nt, Human
gucaaacaaauuaacauaucca

SEQ ID NO: 549501 - RNA, 22 nt, Human
gcagggcaaugaucccgagagg

SEQ ID NO: 549502 - RNA, 20 nt, Human
cuuguacaugauaaagauuu

SEQ ID NO: 549503 - RNA, 22 nt, Human
gaaccaaguaggauacaaggag

SEQ ID NO: 549504 - RNA, 21 nt, Human
ucugccugagacuuugcuggu

SEQ ID NO: 549505 - RNA, 18 nt, Human
cugcugcaggcacucagg

SEQ ID NO: 549506 - RNA, 22 nt, Human
cucugaauggacacuccagugu

SEQ ID NO: 549507 - RNA, 22 nt, Human
uucacagaauggcaaguuaugg

SEQ ID NO: 549508 - RNA, 22 nt, Human
uaaugccuuaugucaaauguaa

SEQ ID NO: 549509 - RNA, 22 nt, Human
aaaugcaugagaaaguauucug

SEQ ID NO: 549510 - RNA, 22 nt, Human
cugggagaugacucagagcagg

SEQ ID NO: 549511 - RNA, 22 nt, Human
ucucacuggguauaaaugagua

SEQ ID NO: 549512 - RNA, 19 nt, Human
ucauucaggaccaguggau

SEQ ID NO: 549513 - RNA, 22 nt, Human
cccugcaguccuuucuuggcuc

SEQ ID NO: 549514 - RNA, 22 nt, Human
uugcauugaugucuauacgcug

SEQ ID NO: 549515 - RNA, 18 nt, Human
uccgaggcaccauaaaaa

SEQ ID NO: 549516 - RNA, 22 nt, Human
ccugggcuuugagggcaggaug

SEQ ID NO: 549517 - RNA, 22 nt, Human
gauucuuuacaucucugcugac

SEQ ID NO: 549518 - RNA, 17 nt, Human
caggaaaauaugaguga

SEQ ID NO: 549519 - RNA, 22 nt, Human
gagaggcugguaaagucugaac

SEQ ID NO: 549520 - RNA, 22 nt, Human
uacauauacugagugauuugcu

SEQ ID NO: 549521 - RNA, 22 nt, Human
gccagaagggguggauccaggc

SEQ ID NO: 549522 - RNA, 22 nt, Human
ccugcagaccacacucaguccu

SEQ ID NO: 549523 - RNA, 23 nt, Human
aggugccaacugagagcugagag

SEQ ID NO: 549524 - RNA, 22 nt, Human
acagugaugggggugcaggaag

SEQ ID NO: 549525 - RNA, 22 nt, Human
aacaugauggggaagaacaaga

SEQ ID NO: 549526 - RNA, 22 nt, Human
cauucuuauauuuacucauuca

SEQ ID NO: 549527 - RNA, 20 nt, Human
auguccagugacuggaccau

SEQ ID NO: 549528 - RNA, 22 nt, Human
caacauaugauuuuguauauaa

SEQ ID NO: 549529 - RNA, 22 nt, Human
cugguggggaguccuggucucc

SEQ ID NO: 549530 - RNA, 22 nt, Human
caggcagcguccugcuuccugu

SEQ ID NO: 549531 - RNA, 22 nt, Human
cugucuggauauaccuuggcca

SEQ ID NO: 549532 - RNA, 22 nt, Human
agcagggaggcccagggcacug

SEQ ID NO: 549533 - RNA, 22 nt, Human
cagccucugacaccacagucgu

SEQ ID NO: 549534 - RNA, 22 nt, Human
cagacagagucuucccaucagu

SEQ ID NO: 549535 - RNA, 22 nt, Human
agcaacagcagguuugcacucc

SEQ ID NO: 549536 - RNA, 22 nt, Human
ugucccagucaaggcugucauc

SEQ ID NO: 549537 - RNA, 22 nt, Human
cacugcuuuuuuggcuauguac

SEQ ID NO: 549538 - RNA, 17 nt, Human
aagacaagacaaaugca

SEQ ID NO: 549539 - RNA, 22 nt, Human
agucucagcaagcauggcuagu

SEQ ID NO: 549540 - RNA, 22 nt, Human
caggaagaaagaggugaggugu

SEQ ID NO: 549541 - RNA, 22 nt, Human
aggagguggccugagcgugccc

SEQ ID NO: 549542 - RNA, 22 nt, Human
ucagaaagcuuagugucuugca

SEQ ID NO: 549543 - RNA, 22 nt, Human
ugggaaaguguagccugcaggc

SEQ ID NO: 549544 - RNA, 22 nt, Human
augccuguaaucccagugcuuu

SEQ ID NO: 549545 - RNA, 22 nt, Human
cacccuagcugucauuucaguu

SEQ ID NO: 549546 - RNA, 22 nt, Human
auuggccugaaacugguucagc

SEQ ID NO: 549547 - RNA, 22 nt, Human
caaugauguuuagauaaaaucc

SEQ ID NO: 549548 - RNA, 22 nt, Human
uccuuggagaaucuuguuuuac

SEQ ID NO: 549549 - RNA, 22 nt, Human
uguucccugguaaacugacucc

SEQ ID NO: 549550 - RNA, 22 nt, Human
uagcagggucucaggagucagg

SEQ ID NO: 549551 - RNA, 22 nt, Human
cuggcaggcagacuucugcaag

SEQ ID NO: 549552 - RNA, 22 nt, Human
auagauauuugaguuguuucca

SEQ ID NO: 549553 - RNA, 22 nt, Human
acaaguauuggugaggauguag

SEQ ID NO: 549554 - RNA, 20 nt, Human
agcacagcgcgguguuccuu

SEQ ID NO: 549555 - RNA, 22 nt, Human
aauuaguauugcgauucauuag

SEQ ID NO: 549556 - RNA, 22 nt, Human
ucugaacauccagcaaugcaca

SEQ ID NO: 549557 - RNA, 22 nt, Human
ucucagugcuauccauauucca

SEQ ID NO: 549558 - RNA, 22 nt, Human
gcaaggcugugcacuuugcauu

SEQ ID NO: 549559 - RNA, 22 nt, Human
uaagaauauugggaauggaugg

SEQ ID NO: 549560 - RNA, 22 nt, Human
gccccagcucugccacaacuag

SEQ ID NO: 549561 - RNA, 22 nt, Human
cagagccacuuggagaugagaa

SEQ ID NO: 549562 - RNA, 22 nt, Human
cugcagcugucucuacugggca

SEQ ID NO: 549563 - RNA, 22 nt, Human
ccugccagcugugggccagccu

SEQ ID NO: 549564 - RNA, 22 nt, Human
aguguaucuagguaucuauagu

SEQ ID NO: 549565 - RNA, 19 nt, Human
gggcaguggcacuagggag

SEQ ID NO: 549566 - RNA, 22 nt, Human
ccugguguugugaaguagccgu

SEQ ID NO: 549567 - RNA, 22 nt, Human
uagcagaggaaaagagaacauu

SEQ ID NO: 549568 - RNA, 22 nt, Human
uacuuauugguucagaaguuua

SEQ ID NO: 549569 - RNA, 22 nt, Human
auucuacaaaagaacuggaucu

SEQ ID NO: 549570 - RNA, 22 nt, Human
uuucuggauucauacagaugua

SEQ ID NO: 549571 - RNA, 22 nt, Human
uggcagagaaccugggcuuugu

SEQ ID NO: 549572 - RNA, 22 nt, Human
ucuacagacagagcagguggga

SEQ ID NO: 549573 - RNA, 22 nt, Human
gcagaggagaugaagauacuuu

SEQ ID NO: 549574 - RNA, 22 nt, Human
auuugcaugcuucuauugugaa

SEQ ID NO: 549575 - RNA, 22 nt, Human
uggcagaggcucugugauguug

SEQ ID NO: 549576 - RNA, 22 nt, Human
agccaggcgggucuuugcuccu

SEQ ID NO: 549577 - RNA, 22 nt, Human
aacagcauaccaauguacauau

SEQ ID NO: 549578 - RNA, 22 nt, Human
guucaaauggcugcaguuacca

SEQ ID NO: 549579 - RNA, 22 nt, Human
cuuucaaugugccugccuuggg

SEQ ID NO: 549580 - RNA, 22 nt, Human
aagguucccucucuggaagccu

SEQ ID NO: 549581 - RNA, 19 nt, Human
caggucuucuuggaggacu

SEQ ID NO: 549582 - RNA, 22 nt, Human
gacagggcauggugcagaguuc

SEQ ID NO: 549583 - RNA, 22 nt, Human
uaacaguauccccauuugcaag

SEQ ID NO: 549584 - RNA, 22 nt, Human
uccagggccaagucauggaacc

SEQ ID NO: 549585 - RNA, 22 nt, Human
cucacaggcaucucaucaggcu

SEQ ID NO: 549586 - RNA, 22 nt, Human
aaguguuuauuuauaacgaucu

SEQ ID NO: 549587 - RNA, 22 nt, Human
gguggcagcgucuaucugacau

SEQ ID NO: 549588 - RNA, 22 nt, Human
agcagggcucuguggagggugg

SEQ ID NO: 549589 - RNA, 22 nt, Human
uacaaagucacauugaaaugaa

SEQ ID NO: 549590 - RNA, 22 nt, Human
ugaaacaaaauuaagauucucg

SEQ ID NO: 549591 - RNA, 22 nt, Human
auuuccagcagcauauuugucu

SEQ ID NO: 549592 - RNA, 22 nt, Human
acacauuaugagcaguugucuu

SEQ ID NO: 549593 - RNA, 22 nt, Human
ucuggccugggccugccggugc

SEQ ID NO: 549594 - RNA, 22 nt, Human
uuccagaauuuuguucugcuug

SEQ ID NO: 549595 - RNA, 23 nt, Human
aaagacugcugagaauuuuagga

SEQ ID NO: 549596 - RNA, 22 nt, Human
aaaaauuuaugguucuucucug

SEQ ID NO: 549597 - RNA, 22 nt, Human
ugccuguggaaaggcuggugcu

SEQ ID NO: 549598 - RNA, 22 nt, Human
agcagguggacagaggaagaaa

SEQ ID NO: 549599 - RNA, 23 nt, Human
uguagcaucucuuauuucucagc

SEQ ID NO: 549600 - RNA, 22 nt, Human
cacagaggucugggcccagcag

SEQ ID NO: 549601 - RNA, 22 nt, Human
ggaggaggggcgcuuugucuau

SEQ ID NO: 549602 - RNA, 22 nt, Human
cccaggcagucuggcucuaaag

SEQ ID NO: 549603 - RNA, 22 nt, Human
uaagaacaguagaacaguaggu

SEQ ID NO: 549604 - RNA, 23 nt, Human
agcaggcugcuucuccacagcug

SEQ ID NO: 549605 - RNA, 22 nt, Human
acaaggcugaacagugaagccg

SEQ ID NO: 549606 - RNA, 22 nt, Human
caauuucucuuuauaucucaca

SEQ ID NO: 549607 - RNA, 22 nt, Human
cugcccuguuuggacagcccgg

SEQ ID NO: 549608 - RNA, 22 nt, Human
aagagacaaugucuuuuggaua

SEQ ID NO: 549609 - RNA, 22 nt, Human
uugauuaaacaggcauauucaa

SEQ ID NO: 549610 - RNA, 22 nt, Human
gauuucaagcccccagagauuc

SEQ ID NO: 549611 - RNA, 22 nt, Human
gagguggcagaggccuggaccu

SEQ ID NO: 549612 - RNA, 22 nt, Human
agggcucaggggccccaagcug

SEQ ID NO: 549613 - RNA, 18 nt, Human
ccuggcacacuggcucau

SEQ ID NO: 549614 - RNA, 22 nt, Human
agcagaugcgucugagugggag

SEQ ID NO: 549615 - RNA, 23 nt, Human
aacacauugcuaauuacauucaa

SEQ ID NO: 549616 - RNA, 22 nt, Human
cugccugugccaccgccucauu

SEQ ID NO: 549617 - RNA, 22 nt, Human
auucagcucugaaucagcagac

SEQ ID NO: 549618 - RNA, 22 nt, Human
caguacuuggucaaggaagcag

SEQ ID NO: 549619 - RNA, 22 nt, Human
gaggccugucgcuaggccucug

SEQ ID NO: 549620 - RNA, 22 nt, Human
cagagcugcaaaugccccuccg

SEQ ID NO: 549621 - RNA, 22 nt, Human
cauauaaauacaacauguguua

SEQ ID NO: 549622 - RNA, 22 nt, Human
cuuucauucuuagauauuagug

SEQ ID NO: 549623 - RNA, 22 nt, Human
cucagaauuacaucccauuuua

SEQ ID NO: 549624 - RNA, 22 nt, Human
agagcuguuuggacaucugagu

SEQ ID NO: 549625 - RNA, 22 nt, Human
aguguuucuggcaaaugaaagu

SEQ ID NO: 549626 - RNA, 22 nt, Human
acuccagggcuccaucccuugu

SEQ ID NO: 549627 - RNA, 22 nt, Human
cugaaauugaugacagggaugg

SEQ ID NO: 549628 - RNA, 22 nt, Human
cugcugagcaucagggcugccc

SEQ ID NO: 549629 - RNA, 22 nt, Human
caggaggcagagguugcagcga

SEQ ID NO: 549630 - RNA, 22 nt, Human
uuaauagauuugauuuuaaagg

SEQ ID NO: 549631 - RNA, 22 nt, Human
uucaagauaauaggaaugaaaa

SEQ ID NO: 549632 - RNA, 22 nt, Human
aguguuuauggaaucuuaguua

SEQ ID NO: 549633 - RNA, 22 nt, Human
uagaaaucauuuagaaguauug

SEQ ID NO: 549634 - RNA, 22 nt, Human
ccugugugcugaugacgacaga

SEQ ID NO: 549635 - RNA, 22 nt, Human
auugaaaauauaauucuaggag

SEQ ID NO: 549636 - RNA, 22 nt, Human
acagauauaugauuguguaaau

SEQ ID NO: 549637 - RNA, 22 nt, Human
gccccuggcuggccagcuccuc

SEQ ID NO: 549638 - RNA, 22 nt, Human
cugccuggccacaacccagggu

SEQ ID NO: 549639 - RNA, 22 nt, Human
cagggcugaacugagcuuguga

SEQ ID NO: 549640 - RNA, 22 nt, Human
uggucagacaaaggagaauguu

SEQ ID NO: 549641 - RNA, 20 nt, Human
agggcagagggauuacaggc

SEQ ID NO: 549642 - RNA, 22 nt, Human
gccaccucuuugucucugccgc

SEQ ID NO: 549643 - RNA, 23 nt, Human
ugagcugggccugcaggggucuc

SEQ ID NO: 549644 - RNA, 22 nt, Human
ucagcagucacauguuguccca

SEQ ID NO: 549645 - RNA, 22 nt, Human
gggcugacuccuauuggaugaa

SEQ ID NO: 549646 - RNA, 22 nt, Human
agcacacaggccaccuccacuu

SEQ ID NO: 549647 - RNA, 22 nt, Human
caggcagccugagggaucuggg

SEQ ID NO: 549648 - RNA, 22 nt, Human
acaagaaagguaggauucaggu

SEQ ID NO: 549649 - RNA, 22 nt, Human
agauuuguccugcuuucuaccu

SEQ ID NO: 549650 - RNA, 22 nt, Human
gcaggccagcugugcagauggg

SEQ ID NO: 549651 - RNA, 22 nt, Human
gagagugaggccugggaaucua

SEQ ID NO: 549652 - RNA, 22 nt, Human
ccugagauguguaacagauggu

SEQ ID NO: 549653 - RNA, 22 nt, Human
acauuucaguaaguguuaauuu

SEQ ID NO: 549654 - RNA, 22 nt, Human
cugcucuggggaagccagaugu

SEQ ID NO: 549655 - RNA, 22 nt, Human
uggagccagcccaggccccucu

SEQ ID NO: 549656 - RNA, 22 nt, Human
uugcccuguggggccuccagcc

SEQ ID NO: 549657 - RNA, 19 nt, Human
ugaguggagugcaaugaag

SEQ ID NO: 549658 - RNA, 22 nt, Human
ugauuauauucuaacuucauaa

SEQ ID NO: 549659 - RNA, 22 nt, Human
accaggcaacugugaaugggcu

SEQ ID NO: 549660 - RNA, 22 nt, Human
cgcaggcuggcgcggaguggca

SEQ ID NO: 549661 - RNA, 22 nt, Human
ccagccucacuggcaucaccua

SEQ ID NO: 549662 - RNA, 22 nt, Human
uagguuccauuuaaacaaagaa

SEQ ID NO: 549663 - RNA, 22 nt, Human
accugccucagugcagcuggau

SEQ ID NO: 549664 - RNA, 22 nt, Human
uauuucugggaguucagaaauu

SEQ ID NO: 549665 - RNA, 22 nt, Human
ccagcuuguuugaagcucguca

SEQ ID NO: 549666 - RNA, 17 nt, Human
ugaggccugcaucagug

SEQ ID NO: 549667 - RNA, 22 nt, Human
guuaauaaagguauagaaucag

SEQ ID NO: 549668 - RNA, 22 nt, Human
cagagcccagggccuacguccc

SEQ ID NO: 549669 - RNA, 22 nt, Human
auaugaaaguaagcaugugugu

SEQ ID NO: 549670 - RNA, 22 nt, Human
agguggaguuaagugugaacug

SEQ ID NO: 549671 - RNA, 22 nt, Human
aagggcucugcugucucucccc

SEQ ID NO: 549672 - RNA, 22 nt, Human
cuuucugaaguuuaaguucuaa

SEQ ID NO: 549673 - RNA, 22 nt, Human
uguacagauugaucauggagag

SEQ ID NO: 549674 - RNA, 22 nt, Human
agggaguuccgaucugugcacc

SEQ ID NO: 549675 - RNA, 22 nt, Human
uuucacaggaauacccggcuuu

SEQ ID NO: 549676 - RNA, 20 nt, Human
gccagaguuaugaugagagg

SEQ ID NO: 549677 - RNA, 22 nt, Human
cugagcugggacucaguagcaa

SEQ ID NO: 549678 - RNA, 22 nt, Human
acauuuguaugcguuuuuacug

SEQ ID NO: 549679 - RNA, 22 nt, Human
uggaagagcaggcagacaaugc

SEQ ID NO: 549680 - RNA, 22 nt, Human
uuucucauagucaugccucuua

SEQ ID NO: 549681 - RNA, 17 nt, Human
gccagggagaggaagcc

SEQ ID NO: 549682 - RNA, 22 nt, Human
auacauguugagaaaauaucug

SEQ ID NO: 549683 - RNA, 22 nt, Human
ggcauauguagcguguguucug

SEQ ID NO: 549684 - RNA, 22 nt, Human
uauuauguaaagguuauugcag

SEQ ID NO: 549685 - RNA, 17 nt, Human
gagauggcauuggcagc

SEQ ID NO: 549686 - RNA, 22 nt, Human
aaucuacauagagaucaaauga

SEQ ID NO: 549687 - RNA, 22 nt, Human
aauuucaguaugaaguuucaca

SEQ ID NO: 549688 - RNA, 22 nt, Human
ggcuagggaaaaugauuggaua

SEQ ID NO: 549689 - RNA, 20 nt, Human
aagggagaauaaugauugua

SEQ ID NO: 549690 - RNA, 22 nt, Human
cgucuuccucuuacgaugcgcu

SEQ ID NO: 549691 - RNA, 22 nt, Human
ugccugggguuggcaaacugcu

SEQ ID NO: 549692 - RNA, 22 nt, Human
gcuuccucgcugggcagaggca

SEQ ID NO: 549693 - RNA, 22 nt, Human
aagccaggcugcacuugcuggg

SEQ ID NO: 549694 - RNA, 22 nt, Human
aauauucaaguuauucuuucuu

SEQ ID NO: 549695 - RNA, 20 nt, Human
caaagcaguaggauaaaaau

SEQ ID NO: 549696 - RNA, 22 nt, Human
ccugucuguaucgguucagagu

SEQ ID NO: 549697 - RNA, 22 nt, Human
gggcugcugcccaggaggcacc

SEQ ID NO: 549698 - RNA, 22 nt, Human
cugccucugcgucccacagagu

SEQ ID NO: 549699 - RNA, 22 nt, Human
ccagaugggaagaagcaugacu

SEQ ID NO: 549700 - RNA, 22 nt, Human
ccuuccccaggugcucacuguc

SEQ ID NO: 549701 - RNA, 22 nt, Human
uggugcccacucuggacccagc

SEQ ID NO: 549702 - RNA, 22 nt, Human
caggagacaauggcuguggggc

SEQ ID NO: 549703 - RNA, 22 nt, Human
ucacauaaauuuaccagaugau

SEQ ID NO: 549704 - RNA, 22 nt, Human
ccagccagcugguuggacgccu

SEQ ID NO: 549705 - RNA, 22 nt, Human
aaacucuuuugcauauuagagg

SEQ ID NO: 549706 - RNA, 21 nt, Human
ggcagcugaccgcgcggugca

SEQ ID NO: 549707 - RNA, 22 nt, Human
agguggcuccucccauggcugg

SEQ ID NO: 549708 - RNA, 22 nt, Human
uugaauaaaugagcagugaauu

SEQ ID NO: 549709 - RNA, 22 nt, Human
ccucccaccauuuagagagagc

SEQ ID NO: 549710 - RNA, 22 nt, Human
cacacaucuuaucccaguuauu

SEQ ID NO: 549711 - RNA, 22 nt, Human
agcagagcgccugcucagaggg

SEQ ID NO: 549712 - RNA, 22 nt, Human
auugaaucugcacuaguauuuu

SEQ ID NO: 549713 - RNA, 22 nt, Human
ggcucagguuaccagucccucc

SEQ ID NO: 549714 - RNA, 22 nt, Human
ggcaggcuugauauggggggac

SEQ ID NO: 549715 - RNA, 22 nt, Human
caaaacauucucugcagcaggg

SEQ ID NO: 549716 - RNA, 22 nt, Human
ugcucugggcaacagccucccu

SEQ ID NO: 549717 - RNA, 22 nt, Human
ugagguggugcuaaucucugcu

SEQ ID NO: 549718 - RNA, 22 nt, Human
cagggccaguucucgcagcagu

SEQ ID NO: 549719 - RNA, 22 nt, Human
cggcagagacggcgcuuugaac

SEQ ID NO: 549720 - RNA, 22 nt, Human
ucuuucuacauuuuauaugcuu

SEQ ID NO: 549721 - RNA, 22 nt, Human
uuucacaugguacugccuguuu

SEQ ID NO: 549722 - RNA, 22 nt, Human
gcacugcagccucagauggugg

SEQ ID NO: 549723 - RNA, 22 nt, Human
gcugucucauacaaggcccugc

SEQ ID NO: 549724 - RNA, 22 nt, Human
gcuguucuuugcaucucuggug

SEQ ID NO: 549725 - RNA, 22 nt, Human
uggcacuggaaucguagccuug

SEQ ID NO: 549726 - RNA, 22 nt, Human
uguaaagaaagacgcagaguua

SEQ ID NO: 549727 - RNA, 22 nt, Human
aaacuugauuuagaacuaaggc

SEQ ID NO: 549728 - RNA, 22 nt, Human
cagcuuccaucuccacugcccu

SEQ ID NO: 549729 - RNA, 22 nt, Human
ccauuaaagcaccacuguaaua

SEQ ID NO: 549730 - RNA, 22 nt, Human
uggagguguccaacucgugggu

SEQ ID NO: 549731 - RNA, 21 nt, Human
ggugggcacaggagagcagag

SEQ ID NO: 549732 - RNA, 22 nt, Human
agaucaaaaacuuaauggcuuu

SEQ ID NO: 549733 - RNA, 20 nt, Human
auguagaugaaagcaaaggc

SEQ ID NO: 549734 - RNA, 22 nt, Human
cuggggacucauucagagcaua

SEQ ID NO: 549735 - RNA, 22 nt, Human
ucagaggaccuuacugagaacc

SEQ ID NO: 549736 - RNA, 22 nt, Human
uuuagacacacuuuguauauuu

SEQ ID NO: 549737 - RNA, 23 nt, Human
gcagagcugcccuauugccuugg

SEQ ID NO: 549738 - RNA, 22 nt, Human
cagggcagcuuccuuuguuagg

SEQ ID NO: 549739 - RNA, 22 nt, Human
aaucagaaaauucaguggaauu

SEQ ID NO: 549740 - RNA, 22 nt, Human
cugaggcaguuuaauuuuugaa

SEQ ID NO: 549741 - RNA, 22 nt, Human
cugaggcaggggcagcuggaga

SEQ ID NO: 549742 - RNA, 22 nt, Human
ucagggaaauagcagggcugaa

SEQ ID NO: 549743 - RNA, 22 nt, Human
ucugcaugaugaacaaaugagc

SEQ ID NO: 549744 - RNA, 22 nt, Human
gaguguuccagaaacuggcccu

SEQ ID NO: 549745 - RNA, 22 nt, Human
aagauuuccuucaguagagcua

SEQ ID NO: 549746 - RNA, 22 nt, Human
aaaauauuuuagggccaggaga

SEQ ID NO: 549747 - RNA, 22 nt, Human
gcagacagaugagggugcuggg

SEQ ID NO: 549748 - RNA, 22 nt, Human
uaggagaggugaauggcacacu

SEQ ID NO: 549749 - RNA, 18 nt, Human
aggagaaagggaccaggg

SEQ ID NO: 549750 - RNA, 22 nt, Human
ccacagggauaggaauggggcu

SEQ ID NO: 549751 - RNA, 22 nt, Human
aaguuuuugguagagaaaagua

SEQ ID NO: 549752 - RNA, 22 nt, Human
ggccaggcacugugugagauau

SEQ ID NO: 549753 - RNA, 22 nt, Human
ggcugcuucucacucauuugca

SEQ ID NO: 549754 - RNA, 22 nt, Human
uccucaggcugccuggaagacu

SEQ ID NO: 549755 - RNA, 22 nt, Human
auggacaggcugagcuuccuca

SEQ ID NO: 549756 - RNA, 22 nt, Human
uuauugaguuguaagagcucuu

SEQ ID NO: 549757 - RNA, 22 nt, Human
aaguccuuuccaguccugugau

SEQ ID NO: 549758 - RNA, 22 nt, Human
cuuuguuuauauuucuccucga

SEQ ID NO: 549759 - RNA, 22 nt, Human
caagacaagaucuaagcaugcu

SEQ ID NO: 549760 - RNA, 22 nt, Human
cccaggaggccaagguugcagu

SEQ ID NO: 549761 - RNA, 22 nt, Human
gcccccucuuuggagccagcca

SEQ ID NO: 549762 - RNA, 22 nt, Human
ggagggagucagcugauuagaa

SEQ ID NO: 549763 - RNA, 22 nt, Human
ugcuucuggcagauugagugag

SEQ ID NO: 549764 - RNA, 22 nt, Human
ggagggcaucaaucaggccugg

SEQ ID NO: 549765 - RNA, 22 nt, Human
cugagccagggccacacaugga

SEQ ID NO: 549766 - RNA, 22 nt, Human
gcagcagcccagggcucucaga

SEQ ID NO: 549767 - RNA, 22 nt, Human
uucuaauacacgguaugacuuu

SEQ ID NO: 549768 - RNA, 22 nt, Human
ccaaggagcucauauucuuguu

SEQ ID NO: 549769 - RNA, 22 nt, Human
uccuucagccaugggcucucca

SEQ ID NO: 549770 - RNA, 17 nt, Human
gagugcugguggagcuc

SEQ ID NO: 549771 - RNA, 22 nt, Human
ucuguuuaugugucuaaauaaa

SEQ ID NO: 549772 - RNA, 22 nt, Human
aguaaacauaauuuaccuguag

SEQ ID NO: 549773 - RNA, 22 nt, Human
gagagaaaggauaacagcucaa

SEQ ID NO: 549774 - RNA, 22 nt, Human
agaaauguggaucguuuuaaaa

SEQ ID NO: 549775 - RNA, 22 nt, Human
uggagcugagaaguggagcucu

SEQ ID NO: 549776 - RNA, 22 nt, Human
gagcaacaguuuaugguuuuuc

SEQ ID NO: 549777 - RNA, 22 nt, Human
cugcccugccuggccagugugg

SEQ ID NO: 549778 - RNA, 22 nt, Human
augcagaaagcggcaaacaggu

SEQ ID NO: 549779 - RNA, 22 nt, Human
gggguggccaaggacucugacc

SEQ ID NO: 549780 - RNA, 22 nt, Human
uguaaagauuagauuacaugaa

SEQ ID NO: 549781 - RNA, 22 nt, Human
gaauguuuaaggaaggcguggc

SEQ ID NO: 549782 - RNA, 22 nt, Human
gauaccagacagggagggagaa

SEQ ID NO: 549783 - RNA, 22 nt, Human
uugaaucuggguacuuguaaua

SEQ ID NO: 549784 - RNA, 22 nt, Human
uuauucacucauuaaagcagga

SEQ ID NO: 549785 - RNA, 22 nt, Human
gggcaugagaggcaggcaagug

SEQ ID NO: 549786 - RNA, 22 nt, Human
uuauaacaucaaucagaguuaa

SEQ ID NO: 549787 - RNA, 22 nt, Human
acaauuucugaucagugaauuu

SEQ ID NO: 549788 - RNA, 22 nt, Human
uuugggaagaggaaucucugga

SEQ ID NO: 549789 - RNA, 19 nt, Human
agaaaucucgagauuuguu

SEQ ID NO: 549790 - RNA, 22 nt, Human
gaagagcuaaaggcacaggcuu

SEQ ID NO: 549791 - RNA, 22 nt, Human
gagagcuggccagcuucaguau

SEQ ID NO: 549792 - RNA, 22 nt, Human
aggcuuaagccugaggccccag

SEQ ID NO: 549793 - RNA, 22 nt, Human
caagagcuacccugugccauau

SEQ ID NO: 549794 - RNA, 22 nt, Human
cacaaauggccguguucaaaga

SEQ ID NO: 549795 - RNA, 22 nt, Human
uuugggaacucuaucauggaaa

SEQ ID NO: 549796 - RNA, 22 nt, Human
gaauuaaaauaguuuuggucga

SEQ ID NO: 549797 - RNA, 22 nt, Human
cacagcuuccauuagaaugaga

SEQ ID NO: 549798 - RNA, 22 nt, Human
aaaugucuuugaguauuucugc

SEQ ID NO: 549799 - RNA, 22 nt, Human
aguaggcauagaaagaagcacc

SEQ ID NO: 549800 - RNA, 22 nt, Human
aaggaagaaaugaauaggugga

SEQ ID NO: 549801 - RNA, 22 nt, Human
uaccugcaaaguuccuuuugcc

SEQ ID NO: 549802 - RNA, 22 nt, Human
gcuucaugcuugcuccaaagcu

SEQ ID NO: 549803 - RNA, 22 nt, Human
aggaggugagcggucauguggu

SEQ ID NO: 549804 - RNA, 22 nt, Human
uuguaauuaauggcagcaauua

SEQ ID NO: 549805 - RNA, 22 nt, Human
uggcagagaugaagaguuguuu

SEQ ID NO: 549806 - RNA, 22 nt, Human
ugugagcagagccugacaugag

SEQ ID NO: 549807 - RNA, 22 nt, Human
ggggaccuucccagagcaguug

SEQ ID NO: 549808 - RNA, 22 nt, Human
ucucuucuuguguuuuccugcc

SEQ ID NO: 549809 - RNA, 22 nt, Human
guuugcauauuugcacaggaau

SEQ ID NO: 549810 - RNA, 22 nt, Human
auuuugaaauacuugaaggaaa

SEQ ID NO: 549811 - RNA, 17 nt, Human
ccuggcugggaaucuga

SEQ ID NO: 549812 - RNA, 22 nt, Human
ugaaugugaugcuaaacauaug

SEQ ID NO: 549813 - RNA, 22 nt, Human
ggagccugugcccaagcccaga

SEQ ID NO: 549814 - RNA, 22 nt, Human
uuccugugccucaggucucagc

SEQ ID NO: 549815 - RNA, 19 nt, Human
gcagccaggugcucuaccu

SEQ ID NO: 549816 - RNA, 22 nt, Human
aaggcagucugguuucaaagca

SEQ ID NO: 549817 - RNA, 22 nt, Human
acuuugcagagccagaagagaa

SEQ ID NO: 549818 - RNA, 22 nt, Human
agggcuggaggguacuaguuua

SEQ ID NO: 549819 - RNA, 20 nt, Human
gcugggcuuugacugacaca

SEQ ID NO: 549820 - RNA, 22 nt, Human
gccugggauuguguaagugaau

SEQ ID NO: 549821 - RNA, 22 nt, Human
aaggccagaguacuagaggcug

SEQ ID NO: 549822 - RNA, 22 nt, Human
uccaggcaugguguaauuuugc

SEQ ID NO: 549823 - RNA, 23 nt, Human
ugggaguguugggaucucugcuc

SEQ ID NO: 549824 - RNA, 22 nt, Human
ccugucuguccucucaugagcc

SEQ ID NO: 549825 - RNA, 22 nt, Human
cagccagccucucaaccaugca

SEQ ID NO: 549826 - RNA, 22 nt, Human
cagcagcugcgugcccaggccg

SEQ ID NO: 549827 - RNA, 19 nt, Human
auauccuugagaaagggaa

SEQ ID NO: 549828 - RNA, 22 nt, Human
uccagggagauggcagaggcug

SEQ ID NO: 549829 - RNA, 22 nt, Human
gcucucugccauaugaggauac

SEQ ID NO: 549830 - RNA, 19 nt, Human
agggaaggauucugucauu

SEQ ID NO: 549831 - RNA, 22 nt, Human
uaacugaacagccuaauucuuu

SEQ ID NO: 549832 - RNA, 17 nt, Human
cucuccuuccucugagg

SEQ ID NO: 549833 - RNA, 22 nt, Human
uaauguuugagauguuggauuu

SEQ ID NO: 549834 - RNA, 22 nt, Human
guaucuuuugguggaaaaauaa

SEQ ID NO: 549835 - RNA, 22 nt, Human
agggacacugaugagaaauucu

SEQ ID NO: 549836 - RNA, 22 nt, Human
gccaggcauuauuccgaucccu

SEQ ID NO: 549837 - RNA, 22 nt, Human
acagagaugcaaguguguauuu

SEQ ID NO: 549838 - RNA, 22 nt, Human
acugggcugccugguucuucua

SEQ ID NO: 549839 - RNA, 22 nt, Human
gaugcacaugugaguauagaag

SEQ ID NO: 549840 - RNA, 20 nt, Human
gucuuuauguuuuaugaccu

SEQ ID NO: 549841 - RNA, 22 nt, Human
ggggaccugggcuucaaggguu

SEQ ID NO: 549842 - RNA, 22 nt, Human
ugcagggacaggcucuggggau

SEQ ID NO: 549843 - RNA, 22 nt, Human
aaggcccuggccccagcuucuu

SEQ ID NO: 549844 - RNA, 22 nt, Human
uggaggcauugugacugcugaa

SEQ ID NO: 549845 - RNA, 22 nt, Human
uuaaagcauguugcuuaacagg

SEQ ID NO: 549846 - RNA, 22 nt, Human
acaugcuaugagagauuacuuc

SEQ ID NO: 549847 - RNA, 22 nt, Human
cuggcuccauccuugagcucug

SEQ ID NO: 549848 - RNA, 22 nt, Human
ugcaaagauuuaucuuucucca

SEQ ID NO: 549849 - RNA, 22 nt, Human
acaaaaauuagcugggcauggu

SEQ ID NO: 549850 - RNA, 20 nt, Human
agagaauucccuuuggagau

SEQ ID NO: 549851 - RNA, 22 nt, Human
uggaaagagauguuguuucuga

SEQ ID NO: 549852 - RNA, 22 nt, Human
uuguuuuuagagaagcccugaa

SEQ ID NO: 549853 - RNA, 22 nt, Human
ugaaguuuucugguugauuaag

SEQ ID NO: 549854 - RNA, 22 nt, Human
ucugccugccagucugguccuc

SEQ ID NO: 549855 - RNA, 22 nt, Human
cacucacuuauuucuaacagaa

SEQ ID NO: 549856 - RNA, 22 nt, Human
uagucaaaccucagaauacccc

SEQ ID NO: 549857 - RNA, 22 nt, Human
agccuucacugggaccuuggau

SEQ ID NO: 549858 - RNA, 22 nt, Human
aaugucuuuugauacaaguuac

SEQ ID NO: 549859 - RNA, 22 nt, Human
uaaggcaccauaauauauuuaa

SEQ ID NO: 549860 - RNA, 22 nt, Human
cccugcagacgucuugaugccu

SEQ ID NO: 549861 - RNA, 22 nt, Human
agcaggguauguuagagcugua

SEQ ID NO: 549862 - RNA, 22 nt, Human
aagaagagaaaugugcugcugg

SEQ ID NO: 549863 - RNA, 22 nt, Human
aauaaauguuaagauugucuca

SEQ ID NO: 549864 - RNA, 18 nt, Human
uccagagcuacuguggug

SEQ ID NO: 549865 - RNA, 22 nt, Human
aggaggugacagccugcaucug

SEQ ID NO: 549866 - RNA, 22 nt, Human
ugaggccuggagggaggaguuu

SEQ ID NO: 549867 - RNA, 22 nt, Human
aacauguaaccagcauucaucu

SEQ ID NO: 549868 - RNA, 20 nt, Human
uaugaagauaugugaacagc

SEQ ID NO: 549869 - RNA, 22 nt, Human
ucagaggauugccucagcgagc

SEQ ID NO: 549870 - RNA, 22 nt, Human
ugggcuggugagggaucauuua

SEQ ID NO: 549871 - RNA, 22 nt, Human
ugucauguguucuuaaauacau

SEQ ID NO: 549872 - RNA, 22 nt, Human
accugggaggcagagguugcag

SEQ ID NO: 549873 - RNA, 22 nt, Human
acaaagucuuuuacaacaguca

SEQ ID NO: 549874 - RNA, 22 nt, Human
uauaagucuggcauauguaugc

SEQ ID NO: 549875 - RNA, 22 nt, Human
acagacuggccugucucgcacc

SEQ ID NO: 549876 - RNA, 22 nt, Human
uuguggcucgugagauguuagg

SEQ ID NO: 549877 - RNA, 23 nt, Human
gacacaggagcacccagcugagc

SEQ ID NO: 549878 - RNA, 22 nt, Human
ccagggcugagcugugaccaug

SEQ ID NO: 549879 - RNA, 22 nt, Human
acaggcuucucacagaaaaggg

SEQ ID NO: 549880 - RNA, 22 nt, Human
gaacaguacuaagagcuuuaca

SEQ ID NO: 549881 - RNA, 22 nt, Human
ucugagccaauuucugugucca

SEQ ID NO: 549882 - RNA, 22 nt, Human
agucagugaaggcauugcucaa

SEQ ID NO: 549883 - RNA, 22 nt, Human
cagcugagcucccaggccauca

SEQ ID NO: 549884 - RNA, 22 nt, Human
agaaagaacgcacuugugcugc

SEQ ID NO: 549885 - RNA, 22 nt, Human
ugcuucuguauuuugggcuuga

SEQ ID NO: 549886 - RNA, 22 nt, Human
acaaaguuugugguauuccaag

SEQ ID NO: 549887 - RNA, 22 nt, Human
gggcacagucuaaaguugggcc

SEQ ID NO: 549888 - RNA, 22 nt, Human
auucaguuaaaaacuguacuuc

SEQ ID NO: 549889 - RNA, 22 nt, Human
uuauacauguuuauaagguuga

SEQ ID NO: 549890 - RNA, 22 nt, Human
uguucauuuugaaguacuucaa

SEQ ID NO: 549891 - RNA, 22 nt, Human
aacaacugcuaagguguguccu

SEQ ID NO: 549892 - RNA, 22 nt, Human
cugcaucaggccaauuaagaau

SEQ ID NO: 549893 - RNA, 22 nt, Human
cagcuggcaaguggagcagggu

SEQ ID NO: 549894 - RNA, 22 nt, Human
uaacagaaauagaaaugagagu

SEQ ID NO: 549895 - RNA, 22 nt, Human
gauuucuuuagguguaauagug

SEQ ID NO: 549896 - RNA, 22 nt, Human
gaggcacaugacucaccaaugg

SEQ ID NO: 549897 - RNA, 22 nt, Human
ccuugaaucucugcucuagaac

SEQ ID NO: 549898 - RNA, 22 nt, Human
cacaucuucuuaacuccaaagu

SEQ ID NO: 549899 - RNA, 22 nt, Human
ucacagcaaaagugugcagagc

SEQ ID NO: 549900 - RNA, 22 nt, Human
gggcugagacgauggggucuuc

SEQ ID NO: 549901 - RNA, 22 nt, Human
ugcugccacaaauucagcugcc

SEQ ID NO: 549902 - RNA, 21 nt, Human
ucugugcuuuuuuggcuccua

SEQ ID NO: 549903 - RNA, 22 nt, Human
guccaagucuuccuucccaaac

SEQ ID NO: 549904 - RNA, 22 nt, Human
aaugaagaaauggacaucuuua

SEQ ID NO: 549905 - RNA, 21 nt, Human
ccaggcuccugaggcugguca

SEQ ID NO: 549906 - RNA, 22 nt, Human
agcugcucccuauccuuuccuu

SEQ ID NO: 549907 - RNA, 22 nt, Human
cagaagucacccucagaauaac

SEQ ID NO: 549908 - RNA, 22 nt, Human
uaacacuugggggcauccuuag

SEQ ID NO: 549909 - RNA, 21 nt, Human
gccaccucgucucggagcagc

SEQ ID NO: 549910 - RNA, 22 nt, Human
uacaaacucuuuauauuucaua

SEQ ID NO: 549911 - RNA, 22 nt, Human
caaaggcaguuacugaaugaag

SEQ ID NO: 549912 - RNA, 22 nt, Human
uaugacuuuggaaaaauuacuu

SEQ ID NO: 549913 - RNA, 22 nt, Human
ugccugucuuaauaucuggaaa

SEQ ID NO: 549914 - RNA, 22 nt, Human
cucugucccagacccaccucuc

SEQ ID NO: 549915 - RNA, 23 nt, Human
aaguaccuacacauuauuucaga

SEQ ID NO: 549916 - RNA, 22 nt, Human
ugcugaguauuuguuugaauaa

SEQ ID NO: 549917 - RNA, 22 nt, Human
aggaaaggccucagcagaaacc

SEQ ID NO: 549918 - RNA, 22 nt, Human
agcagcaugaugacagagucuc

SEQ ID NO: 549919 - RNA, 22 nt, Human
uugucuuagagugaaaacuuua

SEQ ID NO: 549920 - RNA, 22 nt, Human
ugggccugaaauucccauuuua

SEQ ID NO: 549921 - RNA, 22 nt, Human
cuggcucuaucuccaaggcugg

SEQ ID NO: 549922 - RNA, 22 nt, Human
uaaauaaguucuucauuguuug

SEQ ID NO: 549923 - RNA, 19 nt, Human
auggccaguuuagagguuu

SEQ ID NO: 549924 - RNA, 22 nt, Human
ugccucauuaacuguccuuaau

SEQ ID NO: 549925 - RNA, 22 nt, Human
gccuucccacccugcgaggcug

SEQ ID NO: 549926 - RNA, 22 nt, Human
ccaggacuucgaggcuacagug

SEQ ID NO: 549927 - RNA, 22 nt, Human
gggaggcuggcucuggccacag

SEQ ID NO: 549928 - RNA, 22 nt, Human
uaacaagucauuuuaucagcag

SEQ ID NO: 549929 - RNA, 22 nt, Human
auauuccuguuuuuaacacuuu

SEQ ID NO: 549930 - RNA, 22 nt, Human
gacacuucaccuuucccagccu

SEQ ID NO: 549931 - RNA, 20 nt, Human
ugcuuuaugcuauacuuugu

SEQ ID NO: 549932 - RNA, 22 nt, Human
acaggugagggguucuaggcug

SEQ ID NO: 549933 - RNA, 22 nt, Human
cagcuuggaggaggaucuaaga

SEQ ID NO: 549934 - RNA, 22 nt, Human
auugcuuuuagugaaauuauau

SEQ ID NO: 549935 - RNA, 22 nt, Human
gcucucuggguggugggcaaca

SEQ ID NO: 549936 - RNA, 22 nt, Human
ucauggaagaaagguuuguuuc

SEQ ID NO: 549937 - RNA, 22 nt, Human
cuggcugguccucggggacagc

SEQ ID NO: 549938 - RNA, 22 nt, Human
ggcacugauuccauucaugaag

SEQ ID NO: 549939 - RNA, 22 nt, Human
caggaugggauguagugggccc

SEQ ID NO: 549940 - RNA, 22 nt, Human
gucaaacagccuccuguucuaa

SEQ ID NO: 549941 - RNA, 22 nt, Human
uagccggguguugugucaugca

SEQ ID NO: 549942 - RNA, 22 nt, Human
caggguggggaaauagcgcccu

SEQ ID NO: 549943 - RNA, 19 nt, Human
ucauggaagaaaugugaua

SEQ ID NO: 549944 - RNA, 22 nt, Human
cucaagucuauugauaagugca

SEQ ID NO: 549945 - RNA, 22 nt, Human
ggaaggaagugcagacuuuaaa

SEQ ID NO: 549946 - RNA, 23 nt, Human
caucagugagggggaaucacuaa

SEQ ID NO: 549947 - RNA, 22 nt, Human
aaggugaaacuggaagcuggcc

SEQ ID NO: 549948 - RNA, 22 nt, Human
ucugcagaauucgaggaagaaa

SEQ ID NO: 549949 - RNA, 22 nt, Human
uucaguuuccacuuacauuuaa

SEQ ID NO: 549950 - RNA, 22 nt, Human
ugcugccaaaugcgagcucugu

SEQ ID NO: 549951 - RNA, 22 nt, Human
uuucucacccaagaguuauuuu

SEQ ID NO: 549952 - RNA, 22 nt, Human
aagcugcccuguguuagaguuc

SEQ ID NO: 549953 - RNA, 22 nt, Human
cugcaagauguugucauaugcu

SEQ ID NO: 549954 - RNA, 22 nt, Human
ccaggcaggcuagaauguaaau

SEQ ID NO: 549955 - RNA, 22 nt, Human
uguguccucauguggcagagag

SEQ ID NO: 549956 - RNA, 22 nt, Human
uaugaauauaccacaauuuagg

SEQ ID NO: 549957 - RNA, 22 nt, Human
acauuucuccuugcaggaguca

SEQ ID NO: 549958 - RNA, 22 nt, Human
cuggccccaggcagccugcugg

SEQ ID NO: 549959 - RNA, 22 nt, Human
gccugccugcugugugcaaguu

SEQ ID NO: 549960 - RNA, 22 nt, Human
aaggugucaccagauuggcagg

SEQ ID NO: 549961 - RNA, 21 nt, Human
aguguguguggaaugagaaua

SEQ ID NO: 549962 - RNA, 22 nt, Human
gucugucaucugagauggagug

SEQ ID NO: 549963 - RNA, 17 nt, Human
gagauggguggaucacc

SEQ ID NO: 549964 - RNA, 22 nt, Human
uggagccugagucagcggaggc

SEQ ID NO: 549965 - RNA, 22 nt, Human
ggagugggaacaaugacauggu

SEQ ID NO: 549966 - RNA, 22 nt, Human
agcuuuauauaaaagaguacau

SEQ ID NO: 549967 - RNA, 22 nt, Human
uaugagcuuccaguguugcaug

SEQ ID NO: 549968 - RNA, 22 nt, Human
guucuggaggagagccuggugu

SEQ ID NO: 549969 - RNA, 22 nt, Human
ccagaggaaaaauaucucccua

SEQ ID NO: 549970 - RNA, 22 nt, Human
ccaggugucaugcgugugaccc

SEQ ID NO: 549971 - RNA, 22 nt, Human
cuuauucagaccuuggauucuu

SEQ ID NO: 549972 - RNA, 22 nt, Human
gggugcugacuggggccugaaa

SEQ ID NO: 549973 - RNA, 22 nt, Human
uggcucagccagcccuaggaac

SEQ ID NO: 549974 - RNA, 18 nt, Human
uuucacagauucaugacu

SEQ ID NO: 549975 - RNA, 22 nt, Human
cucaggauuuaaaggggcacuc

SEQ ID NO: 549976 - RNA, 22 nt, Human
acauuucagauguaaugugaug

SEQ ID NO: 549977 - RNA, 22 nt, Human
uucuucuucauuucugacgaug

SEQ ID NO: 549978 - RNA, 22 nt, Human
uccaggcaucuguauuuuuuaa

SEQ ID NO: 549979 - RNA, 23 nt, Human
agcuucauugaccuccgcagggg

SEQ ID NO: 549980 - RNA, 22 nt, Human
augaaaacuuuagccucauuag

SEQ ID NO: 549981 - RNA, 22 nt, Human
uugauucaaccacuuaauaauc

SEQ ID NO: 549982 - RNA, 20 nt, Human
uuggcucugaucaguggagc

SEQ ID NO: 549983 - RNA, 22 nt, Human
ugccuuuuagugcucaauaaag

SEQ ID NO: 549984 - RNA, 22 nt, Human
cuggugcuuugcucauuugaua

SEQ ID NO: 549985 - RNA, 19 nt, Human
uuaugaauagcuucaucca

SEQ ID NO: 549986 - RNA, 22 nt, Human
gugaucuuguaauugggcaaug

SEQ ID NO: 549987 - RNA, 22 nt, Human
augugcaaauuauuuugccaga

SEQ ID NO: 549988 - RNA, 22 nt, Human
ucugaaauggcgauggccguug

SEQ ID NO: 549989 - RNA, 21 nt, Human
ugcagagauaucugaagcaga

SEQ ID NO: 549990 - RNA, 19 nt, Human
gcugcuggcucuggcugga

SEQ ID NO: 549991 - RNA, 22 nt, Human
aaucuacaugcaauauuuuuag

SEQ ID NO: 549992 - RNA, 22 nt, Human
ucauccaguucacauggugagu

SEQ ID NO: 549993 - RNA, 22 nt, Human
ucucacucauuuccuaggucuu

SEQ ID NO: 549994 - RNA, 22 nt, Human
ugagaaaaguguggaggucaau

SEQ ID NO: 549995 - RNA, 22 nt, Human
gcaggaugccagggcagcagcg

SEQ ID NO: 549996 - RNA, 22 nt, Human
ccucucuguaagggucccuccc

SEQ ID NO: 549997 - RNA, 22 nt, Human
uuauagaauguuuccaaugccu

SEQ ID NO: 549998 - RNA, 22 nt, Human
guccugggccugcugaggcuga

SEQ ID NO: 549999 - RNA, 22 nt, Human
caugggaggucugcaaggugcu

SEQ ID NO: 550000 - RNA, 19 nt, Human
agcuuccauauucucuagu

SEQ ID NO: 550001 - RNA, 21 nt, Human
ggcuccugcuuugugaggggc

SEQ ID NO: 550002 - RNA, 18 nt, Human
agcuggggccucuggucc

SEQ ID NO: 550003 - RNA, 22 nt, Human
ucucugggaauucacaagcccu

SEQ ID NO: 550004 - RNA, 22 nt, Human
caagaauagcuaccucccauau

SEQ ID NO: 550005 - RNA, 18 nt, Human
aggcaggauccuggccuc

SEQ ID NO: 550006 - RNA, 22 nt, Human
auucauacaggcuuugcucuua

SEQ ID NO: 550007 - RNA, 22 nt, Human
gccuguuggugacuuucuguug

SEQ ID NO: 550008 - RNA, 22 nt, Human
ggccagagaagucagacccuug

SEQ ID NO: 550009 - RNA, 22 nt, Human
cuguaugaacccauauacuuau

SEQ ID NO: 550010 - RNA, 23 nt, Human
uuguuuaccguaggacuuuuaac

SEQ ID NO: 550011 - RNA, 22 nt, Human
uuucuaaucuuuaguuacaaaa

SEQ ID NO: 550012 - RNA, 22 nt, Human
ugugaagcuggauccuggagcu

SEQ ID NO: 550013 - RNA, 22 nt, Human
gcucccaccuuugcuaucagua

SEQ ID NO: 550014 - RNA, 22 nt, Human
ugaccugcagucaagaggggaa

SEQ ID NO: 550015 - RNA, 22 nt, Human
gccugccuucggugcgcagcgg

SEQ ID NO: 550016 - RNA, 21 nt, Human
uuuauguacuucauagaguag

SEQ ID NO: 550017 - RNA, 22 nt, Human
uuucuaaguaaacacagcauac

SEQ ID NO: 550018 - RNA, 22 nt, Human
cuggaaggucuguccccacugc

SEQ ID NO: 550019 - RNA, 18 nt, Human
acagggagggcgcugggg

SEQ ID NO: 550020 - RNA, 22 nt, Human
ggcacagcgacuaccaucgaaa

SEQ ID NO: 550021 - RNA, 22 nt, Human
ugaucagucccaugaucuucca

SEQ ID NO: 550022 - RNA, 22 nt, Human
acagauuugacugguaccuggc

SEQ ID NO: 550023 - RNA, 22 nt, Human
aauaucaacaguguccuucuaa

SEQ ID NO: 550024 - RNA, 22 nt, Human
ccagagagucgaugggggacac

SEQ ID NO: 550025 - RNA, 22 nt, Human
agagacaggauaucugcucaug

SEQ ID NO: 550026 - RNA, 22 nt, Human
gaagaacuuaacauaauaagga

SEQ ID NO: 550027 - RNA, 22 nt, Human
uuucauguuacauuuaaaaugu

SEQ ID NO: 550028 - RNA, 18 nt, Human
gagaagugcauacauuau

SEQ ID NO: 550029 - RNA, 22 nt, Human
gggggcaguaaccucaaagugu

SEQ ID NO: 550030 - RNA, 22 nt, Human
acaguguacuaaauaguaagag

SEQ ID NO: 550031 - RNA, 22 nt, Human
ugccuggguguaaagggccaac

SEQ ID NO: 550032 - RNA, 22 nt, Human
ccuggggauucugacacggagu

SEQ ID NO: 550033 - RNA, 22 nt, Human
gcugcucuacccaugcaucugu

SEQ ID NO: 550034 - RNA, 22 nt, Human
aaaucucuggcagaaauaaacu

SEQ ID NO: 550035 - RNA, 22 nt, Human
aaaauucugucauuaaauugug

SEQ ID NO: 550036 - RNA, 22 nt, Human
uuuguucacugauguaucccaa

SEQ ID NO: 550037 - RNA, 22 nt, Human
gcacuggauuuugaucugcaag

SEQ ID NO: 550038 - RNA, 22 nt, Human
cuucacaguaaauccagaagaa

SEQ ID NO: 550039 - RNA, 22 nt, Human
gggaggugaaaggucaugugug

SEQ ID NO: 550040 - RNA, 22 nt, Human
guuguacaaaauaucagugagg

SEQ ID NO: 550041 - RNA, 22 nt, Human
guaaaauagaauaacguggcua

SEQ ID NO: 550042 - RNA, 22 nt, Human
ugaaaagugaucauggauuagg

SEQ ID NO: 550043 - RNA, 22 nt, Human
uaagaaacuauggagaagaacu

SEQ ID NO: 550044 - RNA, 22 nt, Human
aguaaaaaguucagaaugguug

SEQ ID NO: 550045 - RNA, 22 nt, Human
aaauuguugaucuacaguaagg

SEQ ID NO: 550046 - RNA, 22 nt, Human
cagggcacaguuauggaggugg

SEQ ID NO: 550047 - RNA, 22 nt, Human
acugcagccuugaacucugggc

SEQ ID NO: 550048 - RNA, 22 nt, Human
auagauguuuuaguaauacugu

SEQ ID NO: 550049 - RNA, 19 nt, Human
acaauaacucauugauugc

SEQ ID NO: 550050 - RNA, 22 nt, Human
guguucaaaauguagguagauu

SEQ ID NO: 550051 - RNA, 22 nt, Human
ccugugcauccgguggucauug

SEQ ID NO: 550052 - RNA, 22 nt, Human
cuucacagagucccugauuguu

SEQ ID NO: 550053 - RNA, 22 nt, Human
cugugggagaaguugcuggagu

SEQ ID NO: 550054 - RNA, 21 nt, Human
acacacugaguuuuccacugu

SEQ ID NO: 550055 - RNA, 22 nt, Human
aggcugagccugggcguggugg

SEQ ID NO: 550056 - RNA, 22 nt, Human
agcuccuccugugccaggccag

SEQ ID NO: 550057 - RNA, 22 nt, Human
ugaagcaacuggacaaguuggc

SEQ ID NO: 550058 - RNA, 22 nt, Human
ugaugaaauguugaggcaguga

SEQ ID NO: 550059 - RNA, 22 nt, Human
caggcccucgcccgcagcgacc

SEQ ID NO: 550060 - RNA, 22 nt, Human
uugcugaaaagcuggccuuugu

SEQ ID NO: 550061 - RNA, 22 nt, Human
ccauuucacccacugcuuuagg

SEQ ID NO: 550062 - RNA, 22 nt, Human
gaggcucacuaggcauccuggg

SEQ ID NO: 550063 - RNA, 22 nt, Human
acacaugcugauaagaauauaa

SEQ ID NO: 550064 - RNA, 22 nt, Human
gagcugaguuaccuccagauca

SEQ ID NO: 550065 - RNA, 22 nt, Human
uuagugucuucuucauccucug

SEQ ID NO: 550066 - RNA, 22 nt, Human
gccagcaguauguccuggcagu

SEQ ID NO: 550067 - RNA, 22 nt, Human
aucugcuuagaauucauugucc

SEQ ID NO: 550068 - RNA, 22 nt, Human
agauggugauagagcugggauu

SEQ ID NO: 550069 - RNA, 22 nt, Human
uagcuuuacaaagugcugcacc

SEQ ID NO: 550070 - RNA, 21 nt, Human
ucucuacacuuucacuaggcu

SEQ ID NO: 550071 - RNA, 22 nt, Human
uacaaaguuugagaaugcuuuc

SEQ ID NO: 550072 - RNA, 22 nt, Human
cagcuuuccagagaccugcccc

SEQ ID NO: 550073 - RNA, 22 nt, Human
auaauaacuccuguugaagaac

SEQ ID NO: 550074 - RNA, 22 nt, Human
ugugccagaaaauaugcugagg

SEQ ID NO: 550075 - RNA, 22 nt, Human
ugacagagcuggagaauaauuu

SEQ ID NO: 550076 - RNA, 22 nt, Human
gaggggaaagugugaggcugcg

SEQ ID NO: 550077 - RNA, 22 nt, Human
ugcccugccugagagacaguaa

SEQ ID NO: 550078 - RNA, 22 nt, Human
gcacacaggcaguuuccagcca

SEQ ID NO: 550079 - RNA, 22 nt, Human
acaucacaguaguuaagccaga

SEQ ID NO: 550080 - RNA, 22 nt, Human
gguggcuggaggagcugaugga

SEQ ID NO: 550081 - RNA, 22 nt, Human
cgcgguggcggccuccagcgcc

SEQ ID NO: 550082 - RNA, 22 nt, Human
auuagaaugacagaaaugaggc

SEQ ID NO: 550083 - RNA, 22 nt, Human
uggcccugaggggcugugcccc

SEQ ID NO: 550084 - RNA, 22 nt, Human
aaacuuuaaauuuguaccucug

SEQ ID NO: 550085 - RNA, 22 nt, Human
ccucugaguccucccugguugc

SEQ ID NO: 550086 - RNA, 22 nt, Human
aacucaguuacauauuagaaua

SEQ ID NO: 550087 - RNA, 22 nt, Human
agccaacuaauuaaacaacuuu

SEQ ID NO: 550088 - RNA, 22 nt, Human
gcugggcaaugccagagaggag

SEQ ID NO: 550089 - RNA, 22 nt, Human
agguacagggugaaaguuuaug

SEQ ID NO: 550090 - RNA, 22 nt, Human
gggaggugauggcaagcagcgg

SEQ ID NO: 550091 - RNA, 22 nt, Human
aaugucugaaaaucagacugca

SEQ ID NO: 550092 - RNA, 20 nt, Human
agaagccaagugacauguuu

SEQ ID NO: 550093 - RNA, 22 nt, Human
uucuguauuucaaugucuuuau

SEQ ID NO: 550094 - RNA, 22 nt, Human
uguugaagauaaaguucucauu

SEQ ID NO: 550095 - RNA, 22 nt, Human
aacagacagaaaaaugugaucu

SEQ ID NO: 550096 - RNA, 22 nt, Human
gacaggaaacaagaaggcagga

SEQ ID NO: 550097 - RNA, 22 nt, Human
uguuaggguccugugcaggggc

SEQ ID NO: 550098 - RNA, 22 nt, Human
agcagccaagguaaccugugcu

SEQ ID NO: 550099 - RNA, 22 nt, Human
gccucugcaggugcgguuaucc

SEQ ID NO: 550100 - RNA, 21 nt, Human
uaagccaccaugugaaaccag

SEQ ID NO: 550101 - RNA, 22 nt, Human
caagcuuguuucuccugggggu

SEQ ID NO: 550102 - RNA, 22 nt, Human
agagcuuauaucuuggccaucc

SEQ ID NO: 550103 - RNA, 22 nt, Human
agggcugaaacauaauccuucu

SEQ ID NO: 550104 - RNA, 22 nt, Human
aggcucagucccggcccgcgcc

SEQ ID NO: 550105 - RNA, 22 nt, Human
uaaagucaucuuuaaacaugcc

SEQ ID NO: 550106 - RNA, 22 nt, Human
gacugccagaaugugaggccug

SEQ ID NO: 550107 - RNA, 22 nt, Human
cacauauaugaaaugaggaauu

SEQ ID NO: 550108 - RNA, 22 nt, Human
cuggguggaucgcagccccagg

SEQ ID NO: 550109 - RNA, 22 nt, Human
acauuuauuuuggcacggcaca

SEQ ID NO: 550110 - RNA, 22 nt, Human
cagcugccagcuucucuccauc

SEQ ID NO: 550111 - RNA, 22 nt, Human
gagggggagaugugcacacacu

SEQ ID NO: 550112 - RNA, 22 nt, Human
aaggaggagcggaggcuuguug

SEQ ID NO: 550113 - RNA, 23 nt, Human
acuuaaaugguucuuuaucucag

SEQ ID NO: 550114 - RNA, 21 nt, Human
agcuggccugguuugagcucc

SEQ ID NO: 550115 - RNA, 22 nt, Human
aggaggccgggauucuggagau

SEQ ID NO: 550116 - RNA, 22 nt, Human
uuuuaucagcagggauaacaag

SEQ ID NO: 550117 - RNA, 22 nt, Human
uauuuucauucugugugacugu

SEQ ID NO: 550118 - RNA, 22 nt, Human
ugucaugccauuuaaaauguuu

SEQ ID NO: 550119 - RNA, 22 nt, Human
ucagaacagaagaaggaacacg

SEQ ID NO: 550120 - RNA, 22 nt, Human
aaaugcuaaaugcagcaaguag

SEQ ID NO: 550121 - RNA, 22 nt, Human
ucugcugguuccgaauuaggcc

SEQ ID NO: 550122 - RNA, 22 nt, Human
caucaaaugccauauaugguug

SEQ ID NO: 550123 - RNA, 22 nt, Human
gccagcagguggagagaucaag

SEQ ID NO: 550124 - RNA, 22 nt, Human
aucuggcuuucuuaaugacuua

SEQ ID NO: 550125 - RNA, 22 nt, Human
uucaggauaguggugaguggca

SEQ ID NO: 550126 - RNA, 22 nt, Human
uuggccuucccuaccugggcca

SEQ ID NO: 550127 - RNA, 22 nt, Human
gcugcucuugaggggcucacug

SEQ ID NO: 550128 - RNA, 22 nt, Human
aagcuuuaaggaauuuuaugga

SEQ ID NO: 550129 - RNA, 22 nt, Human
cuucucuguguagagauucaga

SEQ ID NO: 550130 - RNA, 22 nt, Human
auggcuagcaccgcguugcugg

SEQ ID NO: 550131 - RNA, 23 nt, Human
augcucugggcugugggaccugc

SEQ ID NO: 550132 - RNA, 22 nt, Human
uugcauccgaaacaauuucucu

SEQ ID NO: 550133 - RNA, 22 nt, Human
aggaagggcuguuucuccaaga

SEQ ID NO: 550134 - RNA, 22 nt, Human
aggguggagggagucccugagc

SEQ ID NO: 550135 - RNA, 22 nt, Human
auggcagggcagccucucagag

SEQ ID NO: 550136 - RNA, 22 nt, Human
acaaaggcagccaaucaucugc

SEQ ID NO: 550137 - RNA, 22 nt, Human
uucaagauccagcacaacagug

SEQ ID NO: 550138 - RNA, 21 nt, Human
auuauuauaaagaccacaggg

SEQ ID NO: 550139 - RNA, 22 nt, Human
aagccaggaagagagccuucac

SEQ ID NO: 550140 - RNA, 22 nt, Human
cagccugcagggcugccuguug

SEQ ID NO: 550141 - RNA, 22 nt, Human
cugagcaguagagggucucuuu

SEQ ID NO: 550142 - RNA, 22 nt, Human
ugcucagcuggugccagggucc

SEQ ID NO: 550143 - RNA, 22 nt, Human
aucuggcuuaccuagggugccu

SEQ ID NO: 550144 - RNA, 20 nt, Human
cacugaagacuucuugcuca

SEQ ID NO: 550145 - RNA, 22 nt, Human
cucacagguaccagcacccucc

SEQ ID NO: 550146 - RNA, 22 nt, Human
gugauuucagguuuuucauacu

SEQ ID NO: 550147 - RNA, 22 nt, Human
aaauauuugucugaggcgguug

SEQ ID NO: 550148 - RNA, 22 nt, Human
ugaggaaacugaggcacagaug

SEQ ID NO: 550149 - RNA, 22 nt, Human
uggcucaguuaggucagaaaca

SEQ ID NO: 550150 - RNA, 22 nt, Human
ccuacagacaaaccagugacua

SEQ ID NO: 550151 - RNA, 20 nt, Human
gcuguucacauuauuaguag

SEQ ID NO: 550152 - RNA, 22 nt, Human
gagauauaaccuaaaggucacu

SEQ ID NO: 550153 - RNA, 22 nt, Human
caaagauuuuagaauuugcaau

SEQ ID NO: 550154 - RNA, 22 nt, Human
cagcaagauuaagggcagaaaa

SEQ ID NO: 550155 - RNA, 20 nt, Human
aaaauauguauaacucuucu

SEQ ID NO: 550156 - RNA, 23 nt, Human
agcauggaauaggaaagaggcag

SEQ ID NO: 550157 - RNA, 22 nt, Human
ccaggaaggccuggaugccccc

SEQ ID NO: 550158 - RNA, 22 nt, Human
cagugucuuauuuguagcucag

SEQ ID NO: 550159 - RNA, 22 nt, Human
auuaguagcacacagagaucag

SEQ ID NO: 550160 - RNA, 22 nt, Human
uugcauacugaccucuaagcuu

SEQ ID NO: 550161 - RNA, 22 nt, Human
gaaagcaguauuuaguucuguu

SEQ ID NO: 550162 - RNA, 22 nt, Human
aagggcugcaauccaaaacacu

SEQ ID NO: 550163 - RNA, 22 nt, Human
ucaauuaugccauugcaauauu

SEQ ID NO: 550164 - RNA, 21 nt, Human
ugccagggauuuacagagccu

SEQ ID NO: 550165 - RNA, 22 nt, Human
ccagagugacgugaagugugaa

SEQ ID NO: 550166 - RNA, 22 nt, Human
ugcuucugauucaugguuauug

SEQ ID NO: 550167 - RNA, 22 nt, Human
aaugcacaaaaauuguauguaa

SEQ ID NO: 550168 - RNA, 22 nt, Human
augauuucuauauaaacuuaaa

SEQ ID NO: 550169 - RNA, 22 nt, Human
ucagcccugggacccagggaug

SEQ ID NO: 550170 - RNA, 22 nt, Human
cucaggagacaguguccacaug

SEQ ID NO: 550171 - RNA, 22 nt, Human
ggccucaguuucuucaacugua

SEQ ID NO: 550172 - RNA, 22 nt, Human
cuggccacuggagguggcaccc

SEQ ID NO: 550173 - RNA, 22 nt, Human
cacacacuguuaauguaggagu

SEQ ID NO: 550174 - RNA, 22 nt, Human
uggaauuuaguuaauuccauuu

SEQ ID NO: 550175 - RNA, 22 nt, Human
ugagagagccugaaucucuuac

SEQ ID NO: 550176 - RNA, 22 nt, Human
cagcuguugugauuuccaggag

SEQ ID NO: 550177 - RNA, 22 nt, Human
aggcagcaaugaaugaaaugga

SEQ ID NO: 550178 - RNA, 20 nt, Human
cagggccacgcuccaaggca

SEQ ID NO: 550179 - RNA, 22 nt, Human
uguggcgagaacauuggaccau

SEQ ID NO: 550180 - RNA, 22 nt, Human
aaagugcacucucagugcugcu

SEQ ID NO: 550181 - RNA, 22 nt, Human
uggaguucucaggugagggcuu

SEQ ID NO: 550182 - RNA, 18 nt, Human
cccagcccaccauuucuc

SEQ ID NO: 550183 - RNA, 23 nt, Human
aggaggaaaaguuaucugcugag

SEQ ID NO: 550184 - RNA, 22 nt, Human
aaacagcuggucucaaauguuc

SEQ ID NO: 550185 - RNA, 22 nt, Human
gcuaagugguuuucuucuccuc

SEQ ID NO: 550186 - RNA, 22 nt, Human
cagagcaguccuugucaaucag

SEQ ID NO: 550187 - RNA, 22 nt, Human
ugaacacugccauauuuaagaa

SEQ ID NO: 550188 - RNA, 19 nt, Human
accaggccucagaggcccu

SEQ ID NO: 550189 - RNA, 22 nt, Human
ucccagaggaaauggcagcuga

SEQ ID NO: 550190 - RNA, 22 nt, Human
acuuuugaagaauuaugcaaaa

SEQ ID NO: 550191 - RNA, 22 nt, Human
cagcaggaagguuuccccugca

SEQ ID NO: 550192 - RNA, 22 nt, Human
gcugugcacuaccuauacaucc

SEQ ID NO: 550193 - RNA, 22 nt, Human
cugccuugguucccagccagca

SEQ ID NO: 550194 - RNA, 22 nt, Human
acacaguaugcaucuagaaauu

SEQ ID NO: 550195 - RNA, 22 nt, Human
acagagcuuaauucaggagcuu

SEQ ID NO: 550196 - RNA, 22 nt, Human
uggcucagauuuuuguaggcuu

SEQ ID NO: 550197 - RNA, 22 nt, Human
ucagagugguagccuauuuucu

SEQ ID NO: 550198 - RNA, 19 nt, Human
aggcagcauucuggggcuu

SEQ ID NO: 550199 - RNA, 22 nt, Human
gauguguauuuggaagacaaaa

SEQ ID NO: 550200 - RNA, 22 nt, Human
acauucuauucugcaggacaag

SEQ ID NO: 550201 - RNA, 22 nt, Human
ugcccaggauugugaggucagg

SEQ ID NO: 550202 - RNA, 22 nt, Human
acaguggaauuuguagaugugu

SEQ ID NO: 550203 - RNA, 22 nt, Human
agcagacagguaggaggauaaa

SEQ ID NO: 550204 - RNA, 23 nt, Human
ugguccugccaacggugccccuc

SEQ ID NO: 550205 - RNA, 20 nt, Human
aaagauacuuuuuguaaugg

SEQ ID NO: 550206 - RNA, 22 nt, Human
ccacagaccuuggcuuccaccu

SEQ ID NO: 550207 - RNA, 22 nt, Human
aauaaagaauggaugagaucgu

SEQ ID NO: 550208 - RNA, 22 nt, Human
uucuuaggagcauuaguaauuu

SEQ ID NO: 550209 - RNA, 19 nt, Human
gcugggcuuggguuuguag

SEQ ID NO: 550210 - RNA, 22 nt, Human
cugcaggaauucaaagugagcu

SEQ ID NO: 550211 - RNA, 22 nt, Human
ggcuggcagaagugugcuggcu

SEQ ID NO: 550212 - RNA, 22 nt, Human
acugggaagacuggaauugcuc

SEQ ID NO: 550213 - RNA, 22 nt, Human
gaaauuaaccaccuuuggcuuu

SEQ ID NO: 550214 - RNA, 22 nt, Human
ggugaggggagagugaaagaaa

SEQ ID NO: 550215 - RNA, 22 nt, Human
agggcugguauguccaugaaag

SEQ ID NO: 550216 - RNA, 23 nt, Human
uuuaaaaguuguaauguaggcuu

SEQ ID NO: 550217 - RNA, 22 nt, Human
cuuauuagaaagaaaagacaug

SEQ ID NO: 550218 - RNA, 22 nt, Human
aagcagcagcaggauuaaagag

SEQ ID NO: 550219 - RNA, 22 nt, Human
gguuuauuaaugugaacuguau

SEQ ID NO: 550220 - RNA, 22 nt, Human
uuuuuuaguuaggucagaaugu

SEQ ID NO: 550221 - RNA, 22 nt, Human
uggagccuguguuucugcccag

SEQ ID NO: 550222 - RNA, 22 nt, Human
ugacacagaaauuaagcuguca

SEQ ID NO: 550223 - RNA, 22 nt, Human
uucaugaauggaaucaaugcuc

SEQ ID NO: 550224 - RNA, 22 nt, Human
aaaggcuccuucucccaugacc

SEQ ID NO: 550225 - RNA, 22 nt, Human
uagcugcccaucuuuccuuuag

SEQ ID NO: 550226 - RNA, 22 nt, Human
agcccagcuuugaaccauauca

SEQ ID NO: 550227 - RNA, 22 nt, Human
gcccugccggguauuuugugcu

SEQ ID NO: 550228 - RNA, 22 nt, Human
ccaggccagccuggagcauggc

SEQ ID NO: 550229 - RNA, 22 nt, Human
acuugaaaagcucagcaguagu

SEQ ID NO: 550230 - RNA, 22 nt, Human
uggagcauauucuggagcuugg

SEQ ID NO: 550231 - RNA, 22 nt, Human
ucugcccugcagggagcaguaa

SEQ ID NO: 550232 - RNA, 22 nt, Human
gcugccugcccugggucaucug

SEQ ID NO: 550233 - RNA, 22 nt, Human
ugcccugcuaaauauagguagc

SEQ ID NO: 550234 - RNA, 22 nt, Human
gcauucuugguggagugcuaaa

SEQ ID NO: 550235 - RNA, 22 nt, Human
cuagaguccuccuggaaaaggu

SEQ ID NO: 550236 - RNA, 22 nt, Human
ugcugcuguaucaugccuucau

SEQ ID NO: 550237 - RNA, 22 nt, Human
uuuucucuacaaaauaaccagc

SEQ ID NO: 550238 - RNA, 22 nt, Human
uugaagaggacuuugcagcugu

SEQ ID NO: 550239 - RNA, 22 nt, Human
uucacagugguaaggguuguga

SEQ ID NO: 550240 - RNA, 22 nt, Human
acaauuucuaauauagaucuua

SEQ ID NO: 550241 - RNA, 22 nt, Human
cuacagaagaaacuaucacuau

SEQ ID NO: 550242 - RNA, 22 nt, Human
caggcagcgcucguggccuggc

SEQ ID NO: 550243 - RNA, 22 nt, Human
cccuggggcugagggauggccg

SEQ ID NO: 550244 - RNA, 22 nt, Human
ccuggcugccgagugugcagcg

SEQ ID NO: 550245 - RNA, 19 nt, Human
ccaaaagcaauuccaagua

SEQ ID NO: 550246 - RNA, 22 nt, Human
agacauuuggaagauacacaua

SEQ ID NO: 550247 - RNA, 22 nt, Human
ugaguggagaacagaggcucuc

SEQ ID NO: 550248 - RNA, 22 nt, Human
ucugggcuuggauuggcucugc

SEQ ID NO: 550249 - RNA, 22 nt, Human
uugaaaauaucacaggagcagc

SEQ ID NO: 550250 - RNA, 22 nt, Human
gcacggcuaauuuuuguauuuu

SEQ ID NO: 550251 - RNA, 20 nt, Human
uucuauggaccaguauauuu

SEQ ID NO: 550252 - RNA, 22 nt, Human
gggagggaaggaggcgccgugu

SEQ ID NO: 550253 - RNA, 22 nt, Human
cuccagugcgcaggacagcccc

SEQ ID NO: 550254 - RNA, 22 nt, Human
ucaggguugcugugaucagucc

SEQ ID NO: 550255 - RNA, 23 nt, Human
ccuggcugaccugaagguguagu

SEQ ID NO: 550256 - RNA, 22 nt, Human
uggcucaggccacuucuuuuau

SEQ ID NO: 550257 - RNA, 22 nt, Human
aagggcuggccacauucugggu

SEQ ID NO: 550258 - RNA, 22 nt, Human
uggcagcacuugaacuugagcc

SEQ ID NO: 550259 - RNA, 22 nt, Human
gugugccaacaaaagacagugc

SEQ ID NO: 550260 - RNA, 22 nt, Human
acaucuuugcucuuauagagcu

SEQ ID NO: 550261 - RNA, 22 nt, Human
caagcccaggauuccccaguua

SEQ ID NO: 550262 - RNA, 22 nt, Human
aaggcagauauaaagacuagag

SEQ ID NO: 550263 - RNA, 22 nt, Human
cauuuacagugagaguuuuuac

SEQ ID NO: 550264 - RNA, 22 nt, Human
aaacaucuuucuauugcaaguu

SEQ ID NO: 550265 - RNA, 22 nt, Human
acauacuuaacauuaaagucau

SEQ ID NO: 550266 - RNA, 19 nt, Human
gcugugccucucuccugcu

SEQ ID NO: 550267 - RNA, 22 nt, Human
guggccagaagacugcaaugcu

SEQ ID NO: 550268 - RNA, 22 nt, Human
agauuuagacugccuuaaucau

SEQ ID NO: 550269 - RNA, 22 nt, Human
acagagagaggcccgaggcugc

SEQ ID NO: 550270 - RNA, 22 nt, Human
ccuggcagucaggggaguccuu

SEQ ID NO: 550271 - RNA, 22 nt, Human
cugggugaguugaugaaggaga

SEQ ID NO: 550272 - RNA, 22 nt, Human
uuuuuuauaucaacugaagucu

SEQ ID NO: 550273 - RNA, 22 nt, Human
aguuauuucaguaacauaauag

SEQ ID NO: 550274 - RNA, 22 nt, Human
uuagcaagauaacaguaauuuu

SEQ ID NO: 550275 - RNA, 22 nt, Human
agcagcugagaugguaagauuc

SEQ ID NO: 550276 - RNA, 19 nt, Human
ggcucagggcgcugccgcc

SEQ ID NO: 550277 - RNA, 22 nt, Human
acaaaauuuuuagacaaggcuu

SEQ ID NO: 550278 - RNA, 22 nt, Human
ccagacagcaguuaaaggacau

SEQ ID NO: 550279 - RNA, 22 nt, Human
aaggcagugguugugauacugu

SEQ ID NO: 550280 - RNA, 22 nt, Human
ggcucugccugcccagcagcac

SEQ ID NO: 550281 - RNA, 22 nt, Human
aggaccugccaggugcaaagca

SEQ ID NO: 550282 - RNA, 22 nt, Human
uguguugugacauucuuggaug

SEQ ID NO: 550283 - RNA, 22 nt, Human
cggcugagacggccauagacac

SEQ ID NO: 550284 - RNA, 22 nt, Human
cccugggacccgcugcagaggc

SEQ ID NO: 550285 - RNA, 22 nt, Human
gauuaauagacacaaccaagcu

SEQ ID NO: 550286 - RNA, 22 nt, Human
gaggcaguguuuacugcccugu

SEQ ID NO: 550287 - RNA, 22 nt, Human
uggagaaggggcagggucucca

SEQ ID NO: 550288 - RNA, 22 nt, Human
acagcaagccagcuugucacug

SEQ ID NO: 550289 - RNA, 22 nt, Human
uagcuagaaaguuucagcugug

SEQ ID NO: 550290 - RNA, 22 nt, Human
cagucuuugaugcauccuagcc

SEQ ID NO: 550291 - RNA, 22 nt, Human
acucugccuuucagcagaugaa

SEQ ID NO: 550292 - RNA, 22 nt, Human
gccucugcucucagguagccuc

SEQ ID NO: 550293 - RNA, 22 nt, Human
cccugccuucuuggccuuuaaa

SEQ ID NO: 550294 - RNA, 22 nt, Human
acuucacagauauuuauuuggu

SEQ ID NO: 550295 - RNA, 22 nt, Human
auucuuaauuccaaagacugag

SEQ ID NO: 550296 - RNA, 22 nt, Human
aagaagugguccuuuucuuucu

SEQ ID NO: 550297 - RNA, 22 nt, Human
cagaggaaggcucugggaaugu

SEQ ID NO: 550298 - RNA, 22 nt, Human
uuuggcauuuaauaggugauca

SEQ ID NO: 550299 - RNA, 22 nt, Human
uagggcagagcuuguacacgau

SEQ ID NO: 550300 - RNA, 22 nt, Human
aguggcuggaauugcaggugcg

SEQ ID NO: 550301 - RNA, 22 nt, Human
uguaaucauuacaguacaugga

SEQ ID NO: 550302 - RNA, 22 nt, Human
ucucaugguuugugauucaaau

SEQ ID NO: 550303 - RNA, 22 nt, Human
agaugguugguccauaggccua

SEQ ID NO: 550304 - RNA, 22 nt, Human
augaagcguucgagauagguag

SEQ ID NO: 550305 - RNA, 22 nt, Human
cucuugaagcaggggccaguuc

SEQ ID NO: 550306 - RNA, 22 nt, Human
cauuacaaaguuauaaacaguu

SEQ ID NO: 550307 - RNA, 22 nt, Human
uagaauauacacuacagcuuaa

SEQ ID NO: 550308 - RNA, 22 nt, Human
aggccucagugaucaucaucag

SEQ ID NO: 550309 - RNA, 22 nt, Human
uucuucuucaagugcugcauuc

SEQ ID NO: 550310 - RNA, 22 nt, Human
caucagcaggcaacacucuugg

SEQ ID NO: 550311 - RNA, 22 nt, Human
uguaugcaaauuuauuagcaca

SEQ ID NO: 550312 - RNA, 22 nt, Human
agagaggcgaguuaccugugcu

SEQ ID NO: 550313 - RNA, 22 nt, Human
guagaagugaugucauguuaua

SEQ ID NO: 550314 - RNA, 19 nt, Human
auagaaaggguuaaagaca

SEQ ID NO: 550315 - RNA, 22 nt, Human
cugcccuguggcucugagucau

SEQ ID NO: 550316 - RNA, 22 nt, Human
auucucauuugcuggcuauaug

SEQ ID NO: 550317 - RNA, 20 nt, Human
ggccuuggccucuuugcagc

SEQ ID NO: 550318 - RNA, 22 nt, Human
cagaguguaucuguguaagcau

SEQ ID NO: 550319 - RNA, 22 nt, Human
guggcagcugugggacacuggu

SEQ ID NO: 550320 - RNA, 22 nt, Human
uaugcacaguuacaagaauauc

SEQ ID NO: 550321 - RNA, 22 nt, Human
aggagaggguggcauuaaguuu

SEQ ID NO: 550322 - RNA, 22 nt, Human
acucaucagccucuaggaaaga

SEQ ID NO: 550323 - RNA, 20 nt, Human
cucaggauugucuagccccu

SEQ ID NO: 550324 - RNA, 22 nt, Human
gucccuuggcucacaaacagcu

SEQ ID NO: 550325 - RNA, 22 nt, Human
aggagcugacuuguaaagcauu

SEQ ID NO: 550326 - RNA, 20 nt, Human
cuuugccuauucucugccug

SEQ ID NO: 550327 - RNA, 22 nt, Human
uuucacagcauauagguguacu

SEQ ID NO: 550328 - RNA, 22 nt, Human
aauagaauguaaucuaauacau

SEQ ID NO: 550329 - RNA, 22 nt, Human
aagcccagcaucccugcaccag

SEQ ID NO: 550330 - RNA, 20 nt, Human
caggccagagguuugauggc

SEQ ID NO: 550331 - RNA, 20 nt, Human
gaggccucagccucagcucc

SEQ ID NO: 550332 - RNA, 22 nt, Human
uuucacagguaagcaauacagg

SEQ ID NO: 550333 - RNA, 22 nt, Human
ugaugaaacugagguuccaaga

SEQ ID NO: 550334 - RNA, 22 nt, Human
ccagcuuuuggggugacaauuu

SEQ ID NO: 550335 - RNA, 22 nt, Human
gcagggugaaggucacauagaa

SEQ ID NO: 550336 - RNA, 22 nt, Human
ucucccaguccucugugcuuac

SEQ ID NO: 550337 - RNA, 22 nt, Human
cugguucauauaggcaaguuua

SEQ ID NO: 550338 - RNA, 22 nt, Human
uugugaauggugccgcaauaaa

SEQ ID NO: 550339 - RNA, 22 nt, Human
caguggccugagccaggcuucc

SEQ ID NO: 550340 - RNA, 22 nt, Human
gaagccacaacuuuuucuuagc

SEQ ID NO: 550341 - RNA, 22 nt, Human
ugaggugguccaaagacuguuu

SEQ ID NO: 550342 - RNA, 22 nt, Human
cccucuacagggaagcgcuuuc

SEQ ID NO: 550343 - RNA, 22 nt, Human
uaugugaauacagcaguggaug

SEQ ID NO: 550344 - RNA, 22 nt, Human
uguauuagagcaguagaauuau

SEQ ID NO: 550345 - RNA, 22 nt, Human
gaacaguuucccuguagaaaau

SEQ ID NO: 550346 - RNA, 22 nt, Human
aaagagaaaaugaucuguacau

SEQ ID NO: 550347 - RNA, 22 nt, Human
uucacagacuuuccauagauug

SEQ ID NO: 550348 - RNA, 22 nt, Human
aagaugguggccagaguggaaa

SEQ ID NO: 550349 - RNA, 22 nt, Human
ggaagggaaaauucauucggcu

SEQ ID NO: 550350 - RNA, 22 nt, Human
caggggcagucugugugcgugg

SEQ ID NO: 550351 - RNA, 22 nt, Human
cacauguaguaagcaggcaaug

SEQ ID NO: 550352 - RNA, 22 nt, Human
gagggcugcuggaaaaaugcag

SEQ ID NO: 550353 - RNA, 22 nt, Human
uuaaugcagaaaucaaacugac

SEQ ID NO: 550354 - RNA, 22 nt, Human
aggcugcaggucugggucaugu

SEQ ID NO: 550355 - RNA, 22 nt, Human
ggcacagcucaggucccagcuc

SEQ ID NO: 550356 - RNA, 22 nt, Human
uucuccgcuaaguucucugcag

SEQ ID NO: 550357 - RNA, 22 nt, Human
ugucucagaauggcucauaaua

SEQ ID NO: 550358 - RNA, 22 nt, Human
uccagccaugacucggacagug

SEQ ID NO: 550359 - RNA, 22 nt, Human
cugcuguguaucauuuuagaug

SEQ ID NO: 550360 - RNA, 22 nt, Human
gggccuggcaugcagccccguu

SEQ ID NO: 550361 - RNA, 21 nt, Human
ugauuucugccaaguucacua

SEQ ID NO: 550362 - RNA, 22 nt, Human
uccagggauguccuguagcacu

SEQ ID NO: 550363 - RNA, 22 nt, Human
aacagcaugcuggguaacauug

SEQ ID NO: 550364 - RNA, 22 nt, Human
uuuuuugucuugaagaaauggu

SEQ ID NO: 550365 - RNA, 22 nt, Human
ugcaggugugugcaagggaggg

SEQ ID NO: 550366 - RNA, 22 nt, Human
gcccaggauucuuucuuccuua

SEQ ID NO: 550367 - RNA, 18 nt, Human
cagcugccagcucaugga

SEQ ID NO: 550368 - RNA, 22 nt, Human
cagcuuuagagaaaacauauuu

SEQ ID NO: 550369 - RNA, 22 nt, Human
gcagcugcagagaccggguggg

SEQ ID NO: 550370 - RNA, 22 nt, Human
gcaggaugagugaguacauuua

SEQ ID NO: 550371 - RNA, 22 nt, Human
ggaaggaggggcaaagcaguuc

SEQ ID NO: 550372 - RNA, 22 nt, Human
ccauggaguuccucuggucuau

SEQ ID NO: 550373 - RNA, 22 nt, Human
auucuuggcaaggagauuuaaa

SEQ ID NO: 550374 - RNA, 22 nt, Human
gcagggcugcagagggcacugu

SEQ ID NO: 550375 - RNA, 22 nt, Human
aucuggcuauuucuggucgggg

SEQ ID NO: 550376 - RNA, 22 nt, Human
ggcuagaauaauugacuucauu

SEQ ID NO: 550377 - RNA, 22 nt, Human
acccaggaggcagagguugcag

SEQ ID NO: 550378 - RNA, 22 nt, Human
uccaggcauuggagagauaaug

SEQ ID NO: 550379 - RNA, 22 nt, Human
ggagggcugccagguggagcgg

SEQ ID NO: 550380 - RNA, 22 nt, Human
gcauuucauguaagucagacca

SEQ ID NO: 550381 - RNA, 22 nt, Human
agcagcucuuaacaaagcaugg

SEQ ID NO: 550382 - RNA, 22 nt, Human
cugucuguuuuaccuucuccag

SEQ ID NO: 550383 - RNA, 22 nt, Human
ugagcuucuuuauuuggccaga

SEQ ID NO: 550384 - RNA, 22 nt, Human
aauaucagaauguaaugguccu

SEQ ID NO: 550385 - RNA, 22 nt, Human
aauaagaauugccagauuugaa

SEQ ID NO: 550386 - RNA, 21 nt, Human
ugguaucaaacuauacaauau

SEQ ID NO: 550387 - RNA, 22 nt, Human
ucagaaaagagaaaaucuuaua

SEQ ID NO: 550388 - RNA, 22 nt, Human
aagauucuuugaggauuuuacu

SEQ ID NO: 550389 - RNA, 22 nt, Human
uccauuauacuucugauucaaa

SEQ ID NO: 550390 - RNA, 22 nt, Human
agguacaguagacagacaguua

SEQ ID NO: 550391 - RNA, 22 nt, Human
uacaucuuugucuaugaccagc

SEQ ID NO: 550392 - RNA, 22 nt, Human
acaguaaaucaacagaauaucu

SEQ ID NO: 550393 - RNA, 22 nt, Human
acauagcauaaagaaugacucu

SEQ ID NO: 550394 - RNA, 17 nt, Human
ugcuucuguauugcugg

SEQ ID NO: 550395 - RNA, 22 nt, Human
ucauauuuugcaaggucagcua

SEQ ID NO: 550396 - RNA, 22 nt, Human
cugggcuguaauguggcacuga

SEQ ID NO: 550397 - RNA, 22 nt, Human
uccaaagaauagaggugacauu

SEQ ID NO: 550398 - RNA, 22 nt, Human
acagggcaaccucugggagacu

SEQ ID NO: 550399 - RNA, 22 nt, Human
uuauuuauaucucugcaguuua

SEQ ID NO: 550400 - RNA, 22 nt, Human
cagagcuguccaaacccugaca

SEQ ID NO: 550401 - RNA, 22 nt, Human
uuuguaaggcuaaauaauauuc

SEQ ID NO: 550402 - RNA, 22 nt, Human
gagggggcgaacagaagcaagg

SEQ ID NO: 550403 - RNA, 22 nt, Human
uugccuuugacggugcagcagu

SEQ ID NO: 550404 - RNA, 22 nt, Human
acuuugcaaugggcagaaccca

SEQ ID NO: 550405 - RNA, 19 nt, Human
accaaacaguggacggagc

SEQ ID NO: 550406 - RNA, 22 nt, Human
cuggccccaucuggagucugag

SEQ ID NO: 550407 - RNA, 22 nt, Human
cugaggcaugaaugugggcuuu

SEQ ID NO: 550408 - RNA, 22 nt, Human
uauagaagagacaugugcauag

SEQ ID NO: 550409 - RNA, 22 nt, Human
gcaaguacaaacgcaucggcug

SEQ ID NO: 550410 - RNA, 22 nt, Human
cgugacacauucuggacauggu

SEQ ID NO: 550411 - RNA, 22 nt, Human
ccuggcagcuaagugcuuugag

SEQ ID NO: 550412 - RNA, 22 nt, Human
aaugggaagccagaagacaagg

SEQ ID NO: 550413 - RNA, 22 nt, Human
uagcagagugauuggccaugag

SEQ ID NO: 550414 - RNA, 22 nt, Human
ggagaaaggauaggaaugugcu

SEQ ID NO: 550415 - RNA, 22 nt, Human
gcugugcuauaucucugagugu

SEQ ID NO: 550416 - RNA, 22 nt, Human
cagaagaauggugucugagcuc

SEQ ID NO: 550417 - RNA, 17 nt, Human
aggaggaucagagagua

SEQ ID NO: 550418 - RNA, 22 nt, Human
uggcccugaaucaaggccagca

SEQ ID NO: 550419 - RNA, 22 nt, Human
gagcuuccugaugccgaccagu

SEQ ID NO: 550420 - RNA, 22 nt, Human
uguggcccagaugagugugcua

SEQ ID NO: 550421 - RNA, 23 nt, Human
auugaugacuugauuacacuuuu

SEQ ID NO: 550422 - RNA, 22 nt, Human
uauaauccugcuucacauugaa

SEQ ID NO: 550423 - RNA, 22 nt, Human
cacugugucaguuugguuagac

SEQ ID NO: 550424 - RNA, 22 nt, Human
aagaaagcauuagacaggcauu

SEQ ID NO: 550425 - RNA, 23 nt, Human
acagucguagguauccuuuuccu

SEQ ID NO: 550426 - RNA, 22 nt, Human
ggcaggugagagcucuuugaaa

SEQ ID NO: 550427 - RNA, 22 nt, Human
gcucucugucguuaugcuucau

SEQ ID NO: 550428 - RNA, 22 nt, Human
uguggccuccuguuccugggua

SEQ ID NO: 550429 - RNA, 22 nt, Human
uuccaaagaaguucacauuuac

SEQ ID NO: 550430 - RNA, 16 nt, Human
gggagugaaggagggu

SEQ ID NO: 550431 - RNA, 19 nt, Human
ggcagucucaagcagcaca

SEQ ID NO: 550432 - RNA, 22 nt, Human
ggccuguguccuccuugcccug

SEQ ID NO: 550433 - RNA, 22 nt, Human
cucaggauauugggcuggagca

SEQ ID NO: 550434 - RNA, 22 nt, Human
cuguggagaugcagaccaggcc

SEQ ID NO: 550435 - RNA, 22 nt, Human
ucugaaauuccuuccagacuuu

SEQ ID NO: 550436 - RNA, 22 nt, Human
agcagggguaacagaaggaaag

SEQ ID NO: 550437 - RNA, 22 nt, Human
acugaaggaagcgggcaggggu

SEQ ID NO: 550438 - RNA, 22 nt, Human
gggcagggguagcauuccaagu

SEQ ID NO: 550439 - RNA, 22 nt, Human
augcuuuauacaaaacacuuaa

SEQ ID NO: 550440 - RNA, 22 nt, Human
uuucauugugaugcuuuuauca

SEQ ID NO: 550441 - RNA, 22 nt, Human
ucccugccaguccuggucugaa

SEQ ID NO: 550442 - RNA, 22 nt, Human
uagggcaguuucauguuaucuu

SEQ ID NO: 550443 - RNA, 22 nt, Human
uuagaaagcuuuccauagucaa

SEQ ID NO: 550444 - RNA, 22 nt, Human
cuggcuggucaucagcaguacg

SEQ ID NO: 550445 - RNA, 22 nt, Human
ggcuucccuuuccgagaggaga

SEQ ID NO: 550446 - RNA, 22 nt, Human
uaagaauuaucucauggauaau

SEQ ID NO: 550447 - RNA, 22 nt, Human
ucaauuaagaggcuaaguuacu

SEQ ID NO: 550448 - RNA, 19 nt, Human
auaaggcaauuggauuugg

SEQ ID NO: 550449 - RNA, 22 nt, Human
ugaggcaggaauggggaaaagu

SEQ ID NO: 550450 - RNA, 22 nt, Human
acagaauugauggaaaucucag

SEQ ID NO: 550451 - RNA, 22 nt, Human
uggagcuggcuuguggaaguug

SEQ ID NO: 550452 - RNA, 22 nt, Human
uacuauuuggaauuuuaaauug

SEQ ID NO: 550453 - RNA, 22 nt, Human
acacaucucaggggacacucuc

SEQ ID NO: 550454 - RNA, 22 nt, Human
gguaaaaugcagauucuuagcc

SEQ ID NO: 550455 - RNA, 22 nt, Human
aaagacuuucaccuagcaaaga

SEQ ID NO: 550456 - RNA, 22 nt, Human
caggccuggguucaaaucccuu

SEQ ID NO: 550457 - RNA, 22 nt, Human
cuuagaaaucgaacucagguua

SEQ ID NO: 550458 - RNA, 22 nt, Human
gaagcacugcauuucaagauca

SEQ ID NO: 550459 - RNA, 22 nt, Human
agggcucugagcuggaccaccu

SEQ ID NO: 550460 - RNA, 22 nt, Human
caaaauaccacgacuuguuuua

SEQ ID NO: 550461 - RNA, 23 nt, Human
uggggcugauggagacggaccag

SEQ ID NO: 550462 - RNA, 22 nt, Human
ucccaggguuacagccagggca

SEQ ID NO: 550463 - RNA, 22 nt, Human
gaaggccucacucugcagcaua

SEQ ID NO: 550464 - RNA, 22 nt, Human
aggccuccugcagggaugagug

SEQ ID NO: 550465 - RNA, 22 nt, Human
uuucaaaguggagaauuagaca

SEQ ID NO: 550466 - RNA, 20 nt, Human
acacaaagcaauggaguaca

SEQ ID NO: 550467 - RNA, 22 nt, Human
cagugcauaaucuaaauggggg

SEQ ID NO: 550468 - RNA, 22 nt, Human
acaaaugcuuaguucaccaaaa

SEQ ID NO: 550469 - RNA, 22 nt, Human
ccaaagugcugagauuacaggu

SEQ ID NO: 550470 - RNA, 23 nt, Human
agcugaggcugugggugucagag

SEQ ID NO: 550471 - RNA, 22 nt, Human
aacccuggggcagcugcuaggg

SEQ ID NO: 550472 - RNA, 20 nt, Human
guguuucaugugauacaaug

SEQ ID NO: 550473 - RNA, 22 nt, Human
ggcagcuccucaaaaaauuaaa

SEQ ID NO: 550474 - RNA, 22 nt, Human
gggcugagcuguucugaguuua

SEQ ID NO: 550475 - RNA, 19 nt, Human
aggcugcaagguggugggc

SEQ ID NO: 550476 - RNA, 22 nt, Human
augcacuacuagaugcaaaagu

SEQ ID NO: 550477 - RNA, 22 nt, Human
augcaagaucacaccaaacacg

SEQ ID NO: 550478 - RNA, 21 nt, Human
agcagccauggaugguaugua

SEQ ID NO: 550479 - RNA, 22 nt, Human
aaggcacuuaacgugggaggau

SEQ ID NO: 550480 - RNA, 22 nt, Human
gcugccugguuucucagcugca

SEQ ID NO: 550481 - RNA, 22 nt, Human
uaauguuuuucucaacauugcu

SEQ ID NO: 550482 - RNA, 22 nt, Human
gauuucuugauaauucaaaucc

SEQ ID NO: 550483 - RNA, 22 nt, Human
uauuuaguuaucuuucauaaaa

SEQ ID NO: 550484 - RNA, 22 nt, Human
ccugugucuuccccacuggugu

SEQ ID NO: 550485 - RNA, 22 nt, Human
uuugugugggggaaacaaggua

SEQ ID NO: 550486 - RNA, 22 nt, Human
cagagcuggguuugggaaaccu

SEQ ID NO: 550487 - RNA, 22 nt, Human
gagaaacuuggaguuauucugg

SEQ ID NO: 550488 - RNA, 18 nt, Human
cugaaggauccaggugua

SEQ ID NO: 550489 - RNA, 22 nt, Human
agcccagaggcugggcgugcau

SEQ ID NO: 550490 - RNA, 22 nt, Human
uagcaguggaaucuuuugucca

SEQ ID NO: 550491 - RNA, 22 nt, Human
aaacugaaguagauucugaaau

SEQ ID NO: 550492 - RNA, 22 nt, Human
aaggagaaaugguagaugugca

SEQ ID NO: 550493 - RNA, 22 nt, Human
gcagcuuucugggacagaaagg

SEQ ID NO: 550494 - RNA, 22 nt, Human
ucagagagaaauaguuuuugac

SEQ ID NO: 550495 - RNA, 22 nt, Human
aggccuggugaaugaaguaucu

SEQ ID NO: 550496 - RNA, 22 nt, Human
cucuggagcauuucaccuacau

SEQ ID NO: 550497 - RNA, 22 nt, Human
auuccagugugcaugguacaca

SEQ ID NO: 550498 - RNA, 22 nt, Human
ccuggcuggauggagccccugg

SEQ ID NO: 550499 - RNA, 22 nt, Human
cuggaguuuuggaaaaaugcuu

SEQ ID NO: 550500 - RNA, 22 nt, Human
uguggccaccagagcugcuauu

SEQ ID NO: 550501 - RNA, 22 nt, Human
gcucuguaccugcggagaugag

SEQ ID NO: 550502 - RNA, 22 nt, Human
acagaacauggauuuuugaagu

SEQ ID NO: 550503 - RNA, 23 nt, Human
agugagcagcuguagggcaagga

SEQ ID NO: 550504 - RNA, 22 nt, Human
uccuccaggucuaggguggcuu

SEQ ID NO: 550505 - RNA, 22 nt, Human
guccugaaugccuucauagucc

SEQ ID NO: 550506 - RNA, 22 nt, Human
augacacaauuuuagagcugaa

SEQ ID NO: 550507 - RNA, 22 nt, Human
cauguucuaacaaugagaaacc

SEQ ID NO: 550508 - RNA, 22 nt, Human
caggcccugcugcugagaccuu

SEQ ID NO: 550509 - RNA, 20 nt, Human
ucaaagaagauucagcucaa

SEQ ID NO: 550510 - RNA, 22 nt, Human
uacauucccccaauuaccaaug

SEQ ID NO: 550511 - RNA, 22 nt, Human
uguccuuuuggcugucuauggu

SEQ ID NO: 550512 - RNA, 22 nt, Human
agcagccaaccuuacauucauc

SEQ ID NO: 550513 - RNA, 22 nt, Human
ucaucacaauuuuaugacccuc

SEQ ID NO: 550514 - RNA, 22 nt, Human
agggagaggagggucuuguuga

SEQ ID NO: 550515 - RNA, 22 nt, Human
cauggccucaaaggacugcaga

SEQ ID NO: 550516 - RNA, 22 nt, Human
gaggcacauauauacagagccc

SEQ ID NO: 550517 - RNA, 20 nt, Human
ccugucugcaauggagguca

SEQ ID NO: 550518 - RNA, 22 nt, Human
ggcaagaguugaagcuccagga

SEQ ID NO: 550519 - RNA, 22 nt, Human
uuuaauguauucuuuggaacca

SEQ ID NO: 550520 - RNA, 22 nt, Human
uauucacauguacauaugcuca

SEQ ID NO: 550521 - RNA, 22 nt, Human
gcaccugggacccagaggcacc

SEQ ID NO: 550522 - RNA, 22 nt, Human
gggaccugggccagaggacagu

SEQ ID NO: 550523 - RNA, 22 nt, Human
cagggccacuguagaugaggag

SEQ ID NO: 550524 - RNA, 22 nt, Human
agacauuuauugaacaccuagc

SEQ ID NO: 550525 - RNA, 22 nt, Human
ucagauggcacacagagccugc

SEQ ID NO: 550526 - RNA, 22 nt, Human
cgcaggugggcccuucauugau

SEQ ID NO: 550527 - RNA, 22 nt, Human
uuggaagacagugaaacagcac

SEQ ID NO: 550528 - RNA, 22 nt, Human
ggccugugucugugccuguccu

SEQ ID NO: 550529 - RNA, 22 nt, Human
cuucauuaaugucuauaaguuu

SEQ ID NO: 550530 - RNA, 22 nt, Human
uuacgaauguuagauugcaucu

SEQ ID NO: 550531 - RNA, 21 nt, Human
ucugucucuccacugcccugc

SEQ ID NO: 550532 - RNA, 22 nt, Human
ccagcagcccacaggcgucccu

SEQ ID NO: 550533 - RNA, 22 nt, Human
agaaaauuagauuuuacugugu

SEQ ID NO: 550534 - RNA, 18 nt, Human
ggagagugagaucaaaca

SEQ ID NO: 550535 - RNA, 22 nt, Human
gaggcacagagcccuaggagcu

SEQ ID NO: 550536 - RNA, 22 nt, Human
accauuaacaugauuuugggga

SEQ ID NO: 550537 - RNA, 22 nt, Human
cugccaucugagccaaaagugc

SEQ ID NO: 550538 - RNA, 17 nt, Human
uggcaagaauggaaaug

SEQ ID NO: 550539 - RNA, 22 nt, Human
gcaggagcugcucuccugacga

SEQ ID NO: 550540 - RNA, 22 nt, Human
agaaaugugaauuucauuuccu

SEQ ID NO: 550541 - RNA, 22 nt, Human
ucuucacaccgggcagcaggaa

SEQ ID NO: 550542 - RNA, 22 nt, Human
ucauuacagagauauaaucuac

SEQ ID NO: 550543 - RNA, 22 nt, Human
ccugccuggagcugagugugga

SEQ ID NO: 550544 - RNA, 18 nt, Human
gcccagaggucugggccc

SEQ ID NO: 550545 - RNA, 22 nt, Human
cagggacauugguggccagguu

SEQ ID NO: 550546 - RNA, 22 nt, Human
aggagucaggaccaaauggaaa

SEQ ID NO: 550547 - RNA, 22 nt, Human
cagaaaugugauguacacacac

SEQ ID NO: 550548 - RNA, 22 nt, Human
ugcuuuauuggaaccucauccu

SEQ ID NO: 550549 - RNA, 22 nt, Human
ccacagagacagagcccagggu

SEQ ID NO: 550550 - RNA, 19 nt, Human
ccaguagagacagcugcag

SEQ ID NO: 550551 - RNA, 22 nt, Human
accccagaggcggaggcugcag

SEQ ID NO: 550552 - RNA, 22 nt, Human
gcagggcucaacaggacacccc

SEQ ID NO: 550553 - RNA, 22 nt, Human
acaguguacuagguacauguuc

SEQ ID NO: 550554 - RNA, 22 nt, Human
cagugauuuucucagaacuuga

SEQ ID NO: 550555 - RNA, 22 nt, Human
gcuaggaguggugggucaagga

SEQ ID NO: 550556 - RNA, 22 nt, Human
gugaagcacaugggcguugggu

SEQ ID NO: 550557 - RNA, 22 nt, Human
uguaugaaagaacaagggcuua

SEQ ID NO: 550558 - RNA, 22 nt, Human
uuaacacuugaacucuacaugu

SEQ ID NO: 550559 - RNA, 22 nt, Human
ucaaaguauuuuaacuguaucc

SEQ ID NO: 550560 - RNA, 22 nt, Human
ucuuugaugggagaucugagag

SEQ ID NO: 550561 - RNA, 22 nt, Human
uaugaagaagacaaaugacacu

SEQ ID NO: 550562 - RNA, 22 nt, Human
caguuacagagccaguuagaga

SEQ ID NO: 550563 - RNA, 22 nt, Human
accauguguuuuacacauggua

SEQ ID NO: 550564 - RNA, 22 nt, Human
gcccugugccagucacgcugug

SEQ ID NO: 550565 - RNA, 23 nt, Human
agcagccauagggaagcaauaca

SEQ ID NO: 550566 - RNA, 23 nt, Human
cuggggcuuucaaaucugggcag

SEQ ID NO: 550567 - RNA, 17 nt, Human
agcagcuggcacaggag

SEQ ID NO: 550568 - RNA, 22 nt, Human
ugugggaaugacgaggaagagg

SEQ ID NO: 550569 - RNA, 22 nt, Human
uuucaaaguugggaauuguaau

SEQ ID NO: 550570 - RNA, 17 nt, Human
aguggcaggcagauggg

SEQ ID NO: 550571 - RNA, 22 nt, Human
cuggcucaccuccgcuccagca

SEQ ID NO: 550572 - RNA, 18 nt, Human
acaaaggucugcaagacc

SEQ ID NO: 550573 - RNA, 22 nt, Human
guggaggacaaaagaagccuuu

SEQ ID NO: 550574 - RNA, 23 nt, Human
agaguggccuacucacacucauu

SEQ ID NO: 550575 - RNA, 22 nt, Human
cauccacuagaaugacagaguu

SEQ ID NO: 550576 - RNA, 22 nt, Human
accugccucuaagcagcaggug

SEQ ID NO: 550577 - RNA, 22 nt, Human
ugggcucagccuucauguggcc

SEQ ID NO: 550578 - RNA, 22 nt, Human
cacagggcuaaaugaaggguug

SEQ ID NO: 550579 - RNA, 22 nt, Human
aaucacaucucauucaacagcc

SEQ ID NO: 550580 - RNA, 22 nt, Human
caaaugaagaaccuucucaccu

SEQ ID NO: 550581 - RNA, 22 nt, Human
aggagcucauugaaguggauga

SEQ ID NO: 550582 - RNA, 22 nt, Human
gcagcugccgugagcucacgcc

SEQ ID NO: 550583 - RNA, 22 nt, Human
gggaagagaccguacccuggcc

SEQ ID NO: 550584 - RNA, 23 nt, Human
ugcuguccaacagacuggccaug

SEQ ID NO: 550585 - RNA, 22 nt, Human
auguucuuccaaaucuguaaca

SEQ ID NO: 550586 - RNA, 22 nt, Human
agguccagcuguugcagccucc

SEQ ID NO: 550587 - RNA, 21 nt, Human
ggcagcccgcccucuccuggc

SEQ ID NO: 550588 - RNA, 22 nt, Human
gucuucauucaacaaauauuca

SEQ ID NO: 550589 - RNA, 22 nt, Human
aauaaaaugaacugguagaguu

SEQ ID NO: 550590 - RNA, 22 nt, Human
cagagcagugggguuggucaga

SEQ ID NO: 550591 - RNA, 20 nt, Human
ucuucagaugcuuuuggagu

SEQ ID NO: 550592 - RNA, 22 nt, Human
ugggcagaguagcucagaagaa

SEQ ID NO: 550593 - RNA, 22 nt, Human
acagauuuguucuuuugggcua

SEQ ID NO: 550594 - RNA, 22 nt, Human
agguggagugaaggaaaggcag

SEQ ID NO: 550595 - RNA, 22 nt, Human
auucuggauuaucaguccacca

SEQ ID NO: 550596 - RNA, 22 nt, Human
uguccagguggccucugcugcu

SEQ ID NO: 550597 - RNA, 22 nt, Human
cacuauuuccuggauuuugacg

SEQ ID NO: 550598 - RNA, 22 nt, Human
acuguguggaaauuugugaggg

SEQ ID NO: 550599 - RNA, 22 nt, Human
gcagcuggggaggucgugggga

SEQ ID NO: 550600 - RNA, 22 nt, Human
acagcagcuggguucccaccau

SEQ ID NO: 550601 - RNA, 22 nt, Human
ccagucuggcaggagggggaac

SEQ ID NO: 550602 - RNA, 22 nt, Human
ugcaagcacucaaugcaaacag

SEQ ID NO: 550603 - RNA, 22 nt, Human
aaauuauuaguuaaguugggca

SEQ ID NO: 550604 - RNA, 22 nt, Human
ccugcuggccaguggagggcug

SEQ ID NO: 550605 - RNA, 22 nt, Human
cuaugcaucugaacaauagaga

SEQ ID NO: 550606 - RNA, 22 nt, Human
ugaaggcauugaugaaggaauc

SEQ ID NO: 550607 - RNA, 17 nt, Human
aggcugcugggccaggg

SEQ ID NO: 550608 - RNA, 22 nt, Human
aaugcuuugagggaagaugaaa

SEQ ID NO: 550609 - RNA, 22 nt, Human
ggugccaggcucccagcucagg

SEQ ID NO: 550610 - RNA, 22 nt, Human
cccuggagugccggaaucaaga

SEQ ID NO: 550611 - RNA, 22 nt, Human
uguguucagcaggcaccuucuu

SEQ ID NO: 550612 - RNA, 22 nt, Human
uccaggcacagaguuggucagu

SEQ ID NO: 550613 - RNA, 22 nt, Human
ucacugcugcugccaugaugga

SEQ ID NO: 550614 - RNA, 22 nt, Human
ggggcucucaggucuccccaaa

SEQ ID NO: 550615 - RNA, 18 nt, Human
aaugcacacauuuacucc

SEQ ID NO: 550616 - RNA, 20 nt, Human
ccugcugagccagugugagg

SEQ ID NO: 550617 - RNA, 22 nt, Human
aauaugcauuaacuguguacau

SEQ ID NO: 550618 - RNA, 22 nt, Human
caucuuuaauuugugacaacua

SEQ ID NO: 550619 - RNA, 22 nt, Human
accaaagggcagaacaugagca

SEQ ID NO: 550620 - RNA, 18 nt, Human
uccauuguucuacuguga

SEQ ID NO: 550621 - RNA, 19 nt, Human
uguguaaagucugugguca

SEQ ID NO: 550622 - RNA, 22 nt, Human
caggaaaaggagacuuuagcac

SEQ ID NO: 550623 - RNA, 22 nt, Human
uuuacagaaugucaauuucuau

SEQ ID NO: 550624 - RNA, 18 nt, Human
cucucuggucuggauccc

SEQ ID NO: 550625 - RNA, 22 nt, Human
ucaggccucagcagcccacagg

SEQ ID NO: 550626 - RNA, 22 nt, Human
cccaguccuaaagcagacgcca

SEQ ID NO: 550627 - RNA, 22 nt, Human
cacaauuuguauuuugcaucca

SEQ ID NO: 550628 - RNA, 22 nt, Human
agacaguaugauauaugaauac

SEQ ID NO: 550629 - RNA, 22 nt, Human
cagcugcuguucaguuuuguuu

SEQ ID NO: 550630 - RNA, 22 nt, Human
cucucugaggcaggccuguggg

SEQ ID NO: 550631 - RNA, 22 nt, Human
uccagagagaaaaacaagcuuu

SEQ ID NO: 550632 - RNA, 22 nt, Human
cuguccagucuuuagcaagcug

SEQ ID NO: 550633 - RNA, 22 nt, Human
uaguaacagauuuauacagucu

SEQ ID NO: 550634 - RNA, 22 nt, Human
uucuggaguauuccuggcaccu

SEQ ID NO: 550635 - RNA, 22 nt, Human
gggcugagaaguugaucccaag

SEQ ID NO: 550636 - RNA, 22 nt, Human
caggggacauuaaagcuccaua

SEQ ID NO: 550637 - RNA, 22 nt, Human
cucccaagcugugcugaacugu

SEQ ID NO: 550638 - RNA, 22 nt, Human
aggugccagcucucaggcagga

SEQ ID NO: 550639 - RNA, 22 nt, Human
agggcccucuggcaggccaggc

SEQ ID NO: 550640 - RNA, 22 nt, Human
uccagcuugacaaaugauuuua

SEQ ID NO: 550641 - RNA, 23 nt, Human
aguggggaaucaacagauucuuu

SEQ ID NO: 550642 - RNA, 22 nt, Human
caggcuugggagcagagccacu

SEQ ID NO: 550643 - RNA, 22 nt, Human
cagggagaggcaucauagggaa

SEQ ID NO: 550644 - RNA, 19 nt, Human
uccugcagguggcuugcag

SEQ ID NO: 550645 - RNA, 22 nt, Human
gugcgccagcucaaggggaggc

SEQ ID NO: 550646 - RNA, 22 nt, Human
aauucauugccagaaucuauga

SEQ ID NO: 550647 - RNA, 22 nt, Human
uggagcaggaagucuauggcug

SEQ ID NO: 550648 - RNA, 22 nt, Human
ugaaaggugacauuucuuggau

SEQ ID NO: 550649 - RNA, 17 nt, Human
acaggcagaucaccuga

SEQ ID NO: 550650 - RNA, 22 nt, Human
cucacacugugccaaauccuuu

SEQ ID NO: 550651 - RNA, 22 nt, Human
uguuuaaucuauaaaauggaga

SEQ ID NO: 550652 - RNA, 22 nt, Human
uggcccgaccucugcucaugca

SEQ ID NO: 550653 - RNA, 22 nt, Human
uugcaacucuugaaaagcauug

SEQ ID NO: 550654 - RNA, 22 nt, Human
acccagcaaagauaaacuuaug

SEQ ID NO: 550655 - RNA, 22 nt, Human
cacacuagucuauccauuagcu

SEQ ID NO: 550656 - RNA, 22 nt, Human
caguggaggcucaagugugcuu

SEQ ID NO: 550657 - RNA, 22 nt, Human
agcagccacagcagaucugagu

SEQ ID NO: 550658 - RNA, 22 nt, Human
uuucacagaaagaagcuaguuu

SEQ ID NO: 550659 - RNA, 22 nt, Human
ggcagggcaggaaagucaggaa

SEQ ID NO: 550660 - RNA, 22 nt, Human
ggcacacagauggagcacuagc

SEQ ID NO: 550661 - RNA, 22 nt, Human
aguuugaaggaguugaaucacc

SEQ ID NO: 550662 - RNA, 22 nt, Human
ugaggcaggaugcuugcacagg

SEQ ID NO: 550663 - RNA, 22 nt, Human
uuaggaauauuuucugaguagu

SEQ ID NO: 550664 - RNA, 22 nt, Human
uuuuuguagucauuagaagagg

SEQ ID NO: 550665 - RNA, 22 nt, Human
ugaguccauugauggauaguga

SEQ ID NO: 550666 - RNA, 22 nt, Human
aagucauuccugcuuguugccc

SEQ ID NO: 550667 - RNA, 20 nt, Human
uucaggauucuagaccacac

SEQ ID NO: 550668 - RNA, 22 nt, Human
gaaaggcaguacagcugagccu

SEQ ID NO: 550669 - RNA, 22 nt, Human
ccugggcucaagugaugguccc

SEQ ID NO: 550670 - RNA, 22 nt, Human
aagauucuacaguagguacauu

SEQ ID NO: 550671 - RNA, 21 nt, Human
gccuggcucucacuggccugg

SEQ ID NO: 550672 - RNA, 22 nt, Human
uggggcugaggagccucacucu

SEQ ID NO: 550673 - RNA, 22 nt, Human
uguauaaacuuaagcaggaacc

SEQ ID NO: 550674 - RNA, 21 nt, Human
gcaggggauagaaauggucug

SEQ ID NO: 550675 - RNA, 17 nt, Human
agagagagcaugccacc

SEQ ID NO: 550676 - RNA, 23 nt, Human
aguacauucgaaaaauucuguga

SEQ ID NO: 550677 - RNA, 22 nt, Human
caccugggcuaaacuaugcagg

SEQ ID NO: 550678 - RNA, 22 nt, Human
cacccaggcuggagugcagggg

SEQ ID NO: 550679 - RNA, 22 nt, Human
cagaaacaggcaacgugugcac

SEQ ID NO: 550680 - RNA, 21 nt, Human
acaugcauagagagauuucug

SEQ ID NO: 550681 - RNA, 19 nt, Human
uuaagcuaagauacuagua

SEQ ID NO: 550682 - RNA, 22 nt, Human
caggccugugaguugaggcccc

SEQ ID NO: 550683 - RNA, 22 nt, Human
aucugguuuggggauccuugug

SEQ ID NO: 550684 - RNA, 22 nt, Human
aggugcuguuugucagcaguuu

SEQ ID NO: 550685 - RNA, 22 nt, Human
accugugcaaagacuggucagg

SEQ ID NO: 550686 - RNA, 22 nt, Human
acucaggaaauugagauaaugg

SEQ ID NO: 550687 - RNA, 22 nt, Human
uuauucacuucuuggucccuca

SEQ ID NO: 550688 - RNA, 22 nt, Human
uaugucaugucuuagagaauga

SEQ ID NO: 550689 - RNA, 22 nt, Human
auguuuuauauuuugcagcagu

SEQ ID NO: 550690 - RNA, 22 nt, Human
auucaguaggucuagaauaaga

SEQ ID NO: 550691 - RNA, 23 nt, Human
gaaaucuagucauuuuuagucug

SEQ ID NO: 550692 - RNA, 20 nt, Human
auaaaauaacugccacaaga

SEQ ID NO: 550693 - RNA, 22 nt, Human
gaacagacuuggaggagugauc

SEQ ID NO: 550694 - RNA, 22 nt, Human
gcagagucccagcagguggugg

SEQ ID NO: 550695 - RNA, 22 nt, Human
aguauuucuucauaugauuacu

SEQ ID NO: 550696 - RNA, 21 nt, Human
ugauuuccagaaaauuggccc

SEQ ID NO: 550697 - RNA, 22 nt, Human
agaggcugugcagagggagugc

SEQ ID NO: 550698 - RNA, 22 nt, Human
aggcuuuaauuaucuacaggag

SEQ ID NO: 550699 - RNA, 22 nt, Human
gcccucugcuggccucaccucg

SEQ ID NO: 550700 - RNA, 22 nt, Human
agugcuccuauggaucaguugu

SEQ ID NO: 550701 - RNA, 17 nt, Human
aagauuucauuagcuga

SEQ ID NO: 550702 - RNA, 22 nt, Human
uacaaagccugguagauaucug

SEQ ID NO: 550703 - RNA, 22 nt, Human
uagggcucugagaguucagccu

SEQ ID NO: 550704 - RNA, 22 nt, Human
uguuccugacggccaaagaggu

SEQ ID NO: 550705 - RNA, 21 nt, Human
ucaggcaggcgcagagggaag

SEQ ID NO: 550706 - RNA, 22 nt, Human
uggcugccuagugucugagcag

SEQ ID NO: 550707 - RNA, 22 nt, Human
acccuggacaucuugucauagc

SEQ ID NO: 550708 - RNA, 22 nt, Human
aaaagcaguaaauguaugaccu

SEQ ID NO: 550709 - RNA, 22 nt, Human
ccuagagcucugcuuuaucuaa

SEQ ID NO: 550710 - RNA, 22 nt, Human
ccagguggacaaggcuuucaca

SEQ ID NO: 550711 - RNA, 22 nt, Human
ccagcuuuuccucucauugcuu

SEQ ID NO: 550712 - RNA, 22 nt, Human
caagcagacaguaggccuagaa

SEQ ID NO: 550713 - RNA, 22 nt, Human
agagugaaguuuuugaaaguga

SEQ ID NO: 550714 - RNA, 21 nt, Human
cuuauucacuguuauuuauca

SEQ ID NO: 550715 - RNA, 17 nt, Human
acaggccugcuugcacu

SEQ ID NO: 550716 - RNA, 21 nt, Human
aaauguguuccauaaugcuuu

SEQ ID NO: 550717 - RNA, 22 nt, Human
aaguuuuaacaaguacuuacua

SEQ ID NO: 550718 - RNA, 23 nt, Human
uuguuuuuagagguggcaugaga

SEQ ID NO: 550719 - RNA, 22 nt, Human
acagagagggagugauaaaucc

SEQ ID NO: 550720 - RNA, 22 nt, Human
uucaaagcaauagaaagaguga

SEQ ID NO: 550721 - RNA, 22 nt, Human
gucauucuccaagaacccgcug

SEQ ID NO: 550722 - RNA, 17 nt, Human
guuugcaugguguuaac

SEQ ID NO: 550723 - RNA, 22 nt, Human
agugucuuugucaaauuacagg

SEQ ID NO: 550724 - RNA, 22 nt, Human
uaaaaaacauuacucuguccug

SEQ ID NO: 550725 - RNA, 22 nt, Human
cugacucagcagcugaugaucc

SEQ ID NO: 550726 - RNA, 22 nt, Human
aaaaucucauuaucaggaaggg

SEQ ID NO: 550727 - RNA, 22 nt, Human
guucuguacuccaagcucuucc

SEQ ID NO: 550728 - RNA, 22 nt, Human
guuuccugacccuggcccagca

SEQ ID NO: 550729 - RNA, 21 nt, Human
agagaagaggacuuucucaca

SEQ ID NO: 550730 - RNA, 23 nt, Human
agcuccagcugacgugggcagcc

SEQ ID NO: 550731 - RNA, 22 nt, Human
cuucugggauuuuugaagacuc

SEQ ID NO: 550732 - RNA, 22 nt, Human
ucuuccaaaugaauaugguuuu

SEQ ID NO: 550733 - RNA, 22 nt, Human
ucagggacauuuagacacugau

SEQ ID NO: 550734 - RNA, 22 nt, Human
caacuacuggugcucaggaaau

SEQ ID NO: 550735 - RNA, 22 nt, Human
aaagaauagccuuuguccaaau

SEQ ID NO: 550736 - RNA, 22 nt, Human
guucacagcaaaccuaugaacu

SEQ ID NO: 550737 - RNA, 22 nt, Human
augucuuucucacagccaguuc

SEQ ID NO: 550738 - RNA, 22 nt, Human
uaagacauuugaaaugugaucc

SEQ ID NO: 550739 - RNA, 22 nt, Human
acagugaucaguuacugucugu

SEQ ID NO: 550740 - RNA, 22 nt, Human
ccagggccugccacuuagcaag

SEQ ID NO: 550741 - RNA, 22 nt, Human
acacauuuauuacaugcaugug

SEQ ID NO: 550742 - RNA, 20 nt, Human
uccaggagaacugggagccg

SEQ ID NO: 550743 - RNA, 22 nt, Human
ugcagggcccuugggguugaac

SEQ ID NO: 550744 - RNA, 18 nt, Human
uuugggcugauguugggc

SEQ ID NO: 550745 - RNA, 22 nt, Human
ucucugaaggggagcuguuuaa

SEQ ID NO: 550746 - RNA, 22 nt, Human
cagggcccaggccacuggguug

SEQ ID NO: 550747 - RNA, 22 nt, Human
ucauccaaggauuuuauugcau

SEQ ID NO: 550748 - RNA, 22 nt, Human
cugcucugcaaggcacagugau

SEQ ID NO: 550749 - RNA, 22 nt, Human
gcagccacccucaaggcugaau

SEQ ID NO: 550750 - RNA, 22 nt, Human
agcagggggccacagucacagc

SEQ ID NO: 550751 - RNA, 22 nt, Human
aucuguggcuggugagaggcag

SEQ ID NO: 550752 - RNA, 22 nt, Human
aggccuggcaugagaccugaga

SEQ ID NO: 550753 - RNA, 17 nt, Human
uucaaugauuaaugcau

SEQ ID NO: 550754 - RNA, 22 nt, Human
ugcuuuauguggcugauacuca

SEQ ID NO: 550755 - RNA, 22 nt, Human
ggaggaagggcccaggcuuuau

SEQ ID NO: 550756 - RNA, 22 nt, Human
gagggaccccaggcuggcccuu

SEQ ID NO: 550757 - RNA, 22 nt, Human
ggucugugcucuggagccucug

SEQ ID NO: 550758 - RNA, 22 nt, Human
gccugcagccucagagaauuuu

SEQ ID NO: 550759 - RNA, 22 nt, Human
caagagcauuuaguuagcuggu

SEQ ID NO: 550760 - RNA, 22 nt, Human
acuucauguuguuuacaacuua

SEQ ID NO: 550761 - RNA, 22 nt, Human
cagcugggugaucuugggcagg

SEQ ID NO: 550762 - RNA, 22 nt, Human
ugaaauauuuagagaguaaguu

SEQ ID NO: 550763 - RNA, 22 nt, Human
gagcucccuggagguucagaua

SEQ ID NO: 550764 - RNA, 22 nt, Human
acaaaguuauucuuucagagga

SEQ ID NO: 550765 - RNA, 22 nt, Human
ggacacagguaaauaccacuga

SEQ ID NO: 550766 - RNA, 22 nt, Human
gagcccaggaaguggaggcuga

SEQ ID NO: 550767 - RNA, 22 nt, Human
ugauacauaaaccaucauuuug

SEQ ID NO: 550768 - RNA, 22 nt, Human
ugcaauuuggcuuccauuuucu

SEQ ID NO: 550769 - RNA, 22 nt, Human
aagcuuuaugaucucucagcua

SEQ ID NO: 550770 - RNA, 22 nt, Human
ugagccugcaauaagcacagcc

SEQ ID NO: 550771 - RNA, 22 nt, Human
auuacagagggucggucguuuu

SEQ ID NO: 550772 - RNA, 22 nt, Human
aggaauuaacaauauauuuagg

SEQ ID NO: 550773 - RNA, 22 nt, Human
acccaggguagaaccucagagc

SEQ ID NO: 550774 - RNA, 22 nt, Human
acauuugugcacaugugcaugg

SEQ ID NO: 550775 - RNA, 22 nt, Human
aggccugggucucgugccuacc

SEQ ID NO: 550776 - RNA, 22 nt, Human
uuaaacagacaguaaaugaaac

SEQ ID NO: 550777 - RNA, 20 nt, Human
cagcuuggaugagaggcuga

SEQ ID NO: 550778 - RNA, 21 nt, Human
gcagccacagccaccaagcua

SEQ ID NO: 550779 - RNA, 21 nt, Human
agggaaauccagucacuuuuc

SEQ ID NO: 550780 - RNA, 22 nt, Human
augaaaauugacagcggaagua

SEQ ID NO: 550781 - RNA, 20 nt, Human
aaaagcagccagagauggua

SEQ ID NO: 550782 - RNA, 22 nt, Human
gggcuggaggugagcaggacag

SEQ ID NO: 550783 - RNA, 22 nt, Human
cagggccugccugguuccugga

SEQ ID NO: 550784 - RNA, 21 nt, Human
ggacaccagucacacuggauu

SEQ ID NO: 550785 - RNA, 22 nt, Human
cugauucuuucuucuugccagg

SEQ ID NO: 550786 - RNA, 22 nt, Human
aaaaucaguacacuuuauuuug

SEQ ID NO: 550787 - RNA, 22 nt, Human
uguaacauauguaaaagcaccu

SEQ ID NO: 550788 - RNA, 20 nt, Human
uccagccacuuccgcugguc

SEQ ID NO: 550789 - RNA, 22 nt, Human
augcagaagacugaaaagcuga

SEQ ID NO: 550790 - RNA, 22 nt, Human
cugccucuguugggcauggucu

SEQ ID NO: 550791 - RNA, 22 nt, Human
gcagcagagaccccaggaagga

SEQ ID NO: 550792 - RNA, 22 nt, Human
caggcaggagccagggauucca

SEQ ID NO: 550793 - RNA, 22 nt, Human
cccagggauuauaaaggugaaa

SEQ ID NO: 550794 - RNA, 21 nt, Human
cauucacagucuggcucuuga

SEQ ID NO: 550795 - RNA, 22 nt, Human
guuauucuacagucauugaagu

SEQ ID NO: 550796 - RNA, 22 nt, Human
uacagauauauagugugugccu

SEQ ID NO: 550797 - RNA, 22 nt, Human
cugaagccaugugcucacuggu

SEQ ID NO: 550798 - RNA, 22 nt, Human
uuaaagcaaccucagcccucuu

SEQ ID NO: 550799 - RNA, 22 nt, Human
ugcuggaggcaguggaggugcc

SEQ ID NO: 550800 - RNA, 23 nt, Human
ucaggauauugugugccaaggug

SEQ ID NO: 550801 - RNA, 22 nt, Human
cugcugauguaagccaugcucu

SEQ ID NO: 550802 - RNA, 22 nt, Human
gaaggaagacugguuuaaaugu

SEQ ID NO: 550803 - RNA, 22 nt, Human
cccuggcuuggcacucuccacu

SEQ ID NO: 550804 - RNA, 22 nt, Human
aauucugugcaggcagagcuau

SEQ ID NO: 550805 - RNA, 22 nt, Human
uauuccagaugaaaucauucag

SEQ ID NO: 550806 - RNA, 20 nt, Human
gcaauuaauuuuugguuaca

SEQ ID NO: 550807 - RNA, 22 nt, Human
ugagacaguucugcagcugggu

SEQ ID NO: 550808 - RNA, 22 nt, Human
gaggccuggugugucucccgcu

SEQ ID NO: 550809 - RNA, 22 nt, Human
uggaucuucacaagagagggcg

SEQ ID NO: 550810 - RNA, 22 nt, Human
uccaggcauagaaggcacgcac

SEQ ID NO: 550811 - RNA, 22 nt, Human
auauacaugggaauauguggag

SEQ ID NO: 550812 - RNA, 22 nt, Human
uuucaaaugcaugucuuuccuc

SEQ ID NO: 550813 - RNA, 22 nt, Human
aucuccagcaauggggagcucu

SEQ ID NO: 550814 - RNA, 22 nt, Human
ccuggccacucagguguggggc

SEQ ID NO: 550815 - RNA, 22 nt, Human
acauguuuggcucuaugcuaua

SEQ ID NO: 550816 - RNA, 22 nt, Human
gugcagagcaagggcugagggc

SEQ ID NO: 550817 - RNA, 19 nt, Human
ugggaaaguaacauacaaa

SEQ ID NO: 550818 - RNA, 22 nt, Human
uagaugaccuuguguuaggcaa

SEQ ID NO: 550819 - RNA, 22 nt, Human
aaaugguauaaugucauguauu

SEQ ID NO: 550820 - RNA, 22 nt, Human
agggccugggauguccuccuag

SEQ ID NO: 550821 - RNA, 22 nt, Human
guuacauuacuugugcaguugu

SEQ ID NO: 550822 - RNA, 22 nt, Human
uagcauuagagauagaaauagu

SEQ ID NO: 550823 - RNA, 22 nt, Human
ccagaggacuugggggcugaau

SEQ ID NO: 550824 - RNA, 22 nt, Human
cucccagggccaucgagucacu

SEQ ID NO: 550825 - RNA, 22 nt, Human
aaguucaauggaaaagcuuuag

SEQ ID NO: 550826 - RNA, 22 nt, Human
ucuguggccuguguccaagugc

SEQ ID NO: 550827 - RNA, 17 nt, Human
uggcucugaggcugaau

SEQ ID NO: 550828 - RNA, 22 nt, Human
caauguuucuuguaaccaguga

SEQ ID NO: 550829 - RNA, 22 nt, Human
caggcugggaacgccacccgcu

SEQ ID NO: 550830 - RNA, 22 nt, Human
ucaggcugccuaucagacugug

SEQ ID NO: 550831 - RNA, 22 nt, Human
ccaggguggcguagaugcuggg

SEQ ID NO: 550832 - RNA, 22 nt, Human
ucucaguguuaucuaucugccu

SEQ ID NO: 550833 - RNA, 22 nt, Human
gucucuuuuauggugaguugau

SEQ ID NO: 550834 - RNA, 22 nt, Human
ugcuugagacacauaugaauuu

SEQ ID NO: 550835 - RNA, 22 nt, Human
cagcuugcaguacuuguuuuug

SEQ ID NO: 550836 - RNA, 22 nt, Human
ggagccaguauuuaguggucuu

SEQ ID NO: 550837 - RNA, 22 nt, Human
agcaggcuaaauaauaauacau

SEQ ID NO: 550838 - RNA, 19 nt, Human
caucuggaugauucuccug

SEQ ID NO: 550839 - RNA, 22 nt, Human
ucugccugaaauucacauguaa

SEQ ID NO: 550840 - RNA, 22 nt, Human
cugccguccaucuacgucucag

SEQ ID NO: 550841 - RNA, 22 nt, Human
ggccuuuuguguccuugcccgu

SEQ ID NO: 550842 - RNA, 22 nt, Human
aggcaucugaguuugcaagcuu

SEQ ID NO: 550843 - RNA, 22 nt, Human
uucaacauuuaucaguuuauca

SEQ ID NO: 550844 - RNA, 22 nt, Human
gaggcugacggcaccaucuucu

SEQ ID NO: 550845 - RNA, 22 nt, Human
gccaggggugcccacccaagga

SEQ ID NO: 550846 - RNA, 22 nt, Human
agcuuuaugggagcuuagauaa

SEQ ID NO: 550847 - RNA, 22 nt, Human
aacagaacccgagugugaaucu

SEQ ID NO: 550848 - RNA, 22 nt, Human
ucuuuagaaacuuuucuucaug

SEQ ID NO: 550849 - RNA, 22 nt, Human
uccagagugcugacgcagaccc

SEQ ID NO: 550850 - RNA, 22 nt, Human
acagauauccucagucuccaac

SEQ ID NO: 550851 - RNA, 22 nt, Human
uggcacauagaaaaggaucaau

SEQ ID NO: 550852 - RNA, 22 nt, Human
aaaugugcuugugaucagcugu

SEQ ID NO: 550853 - RNA, 22 nt, Human
uuuacacugugaaacagguauc

SEQ ID NO: 550854 - RNA, 22 nt, Human
gguggaguaauucgcagagguu

SEQ ID NO: 550855 - RNA, 22 nt, Human
augugacuccaggcaguuuugu

SEQ ID NO: 550856 - RNA, 18 nt, Human
gacccagcagaugggcuu

SEQ ID NO: 550857 - RNA, 22 nt, Human
ucuucuuccuccacagggccca

SEQ ID NO: 550858 - RNA, 22 nt, Human
uaccugagcccagugcagcaua

SEQ ID NO: 550859 - RNA, 22 nt, Human
cccugccuacaggguuuucuuu

SEQ ID NO: 550860 - RNA, 22 nt, Human
ucugcaggaaaaaagugccugg

SEQ ID NO: 550861 - RNA, 22 nt, Human
gcaaagcaagcugucagccuca

SEQ ID NO: 550862 - RNA, 22 nt, Human
ugagauaauacuucuuagcugg

SEQ ID NO: 550863 - RNA, 22 nt, Human
accauguuggccaagcuggucu

SEQ ID NO: 550864 - RNA, 22 nt, Human
cacauacugagaaucacaccca

SEQ ID NO: 550865 - RNA, 22 nt, Human
uaauuuuuccacguacacuggg

SEQ ID NO: 550866 - RNA, 22 nt, Human
aaggugucacugggacaggaaa

SEQ ID NO: 550867 - RNA, 22 nt, Human
ccuuucagaugggcauggaccg

SEQ ID NO: 550868 - RNA, 22 nt, Human
ugccucugugugcaggugagca

SEQ ID NO: 550869 - RNA, 22 nt, Human
cugaggucucuuuccauaguga

SEQ ID NO: 550870 - RNA, 22 nt, Human
uuccagcuaacucacaucccuu

SEQ ID NO: 550871 - RNA, 23 nt, Human
ggagccuggcauaugagacgcau

SEQ ID NO: 550872 - RNA, 22 nt, Human
cuggagcuaauaauccaucuga

SEQ ID NO: 550873 - RNA, 22 nt, Human
cuggccugaucucaugcugucc

SEQ ID NO: 550874 - RNA, 22 nt, Human
ugagauuuuccuaaauauaaug

SEQ ID NO: 550875 - RNA, 22 nt, Human
ggucccuggggaacuaggcugu

SEQ ID NO: 550876 - RNA, 22 nt, Human
guucuuaagaccacaauaaaaa

SEQ ID NO: 550877 - RNA, 22 nt, Human
acaguggaugacauccuuuugc

SEQ ID NO: 550878 - RNA, 22 nt, Human
aagucauugguagcuugauagg

SEQ ID NO: 550879 - RNA, 22 nt, Human
uccaagcuguauguuccuagag

SEQ ID NO: 550880 - RNA, 23 nt, Human
ugcauggggcuauacugcuguuc

SEQ ID NO: 550881 - RNA, 22 nt, Human
gccagccugugggggcucugug

SEQ ID NO: 550882 - RNA, 22 nt, Human
agcaccuguggcucaugcucgu

SEQ ID NO: 550883 - RNA, 22 nt, Human
agagccugaggaugucccagcu

SEQ ID NO: 550884 - RNA, 22 nt, Human
guuucuuagacauaugccauga

SEQ ID NO: 550885 - RNA, 22 nt, Human
acaaagauucauuugcauuauu

SEQ ID NO: 550886 - RNA, 22 nt, Human
caaggcaguuccccagagggcu

SEQ ID NO: 550887 - RNA, 22 nt, Human
uguaugaaucucauuuguuuaa

SEQ ID NO: 550888 - RNA, 21 nt, Human
cagcagaguaaugcauucgua

SEQ ID NO: 550889 - RNA, 22 nt, Human
ucaaauuuuaacaugcauuaga

SEQ ID NO: 550890 - RNA, 22 nt, Human
uauuucugaggcccaggaagug

SEQ ID NO: 550891 - RNA, 22 nt, Human
aaaugugucaguuucauucucu

SEQ ID NO: 550892 - RNA, 22 nt, Human
aagcagaguccccuucccaugg

SEQ ID NO: 550893 - RNA, 22 nt, Human
cagucacuggaauagcugagga

SEQ ID NO: 550894 - RNA, 22 nt, Human
ggggaaggauugaguugaccca

SEQ ID NO: 550895 - RNA, 22 nt, Human
auagcaaaggacaauagucagu

SEQ ID NO: 550896 - RNA, 22 nt, Human
agaagagaaauagugccacugu

SEQ ID NO: 550897 - RNA, 22 nt, Human
ccagcugcugugcagggaggcu

SEQ ID NO: 550898 - RNA, 22 nt, Human
guggccuggcuggcaccaccuc

SEQ ID NO: 550899 - RNA, 22 nt, Human
gaagcacugccauaauucagac

SEQ ID NO: 550900 - RNA, 22 nt, Human
auuucauguuucaucuaccuaa

SEQ ID NO: 550901 - RNA, 22 nt, Human
ccagggugagaaaaggcuggau

SEQ ID NO: 550902 - RNA, 22 nt, Human
uggcagagcaaaaagauagaau

SEQ ID NO: 550903 - RNA, 19 nt, Human
aggccugggguuuugcacu

SEQ ID NO: 550904 - RNA, 22 nt, Human
cuuauguauaauguuccacaua

SEQ ID NO: 550905 - RNA, 22 nt, Human
cauaucccauuggccaggacau

SEQ ID NO: 550906 - RNA, 22 nt, Human
cagggcuccccagagagccucu

SEQ ID NO: 550907 - RNA, 22 nt, Human
gggccugacugagagcuccuca

SEQ ID NO: 550908 - RNA, 22 nt, Human
uucaaaagcgguccaggaagau

SEQ ID NO: 550909 - RNA, 22 nt, Human
uucuuucuuggggaacacacuc

SEQ ID NO: 550910 - RNA, 22 nt, Human
uguggcaguauaagagcuagaa

SEQ ID NO: 550911 - RNA, 22 nt, Human
ccugagaggcccucucacuguc

SEQ ID NO: 550912 - RNA, 22 nt, Human
cuauuuauguccaaguguuuua

SEQ ID NO: 550913 - RNA, 22 nt, Human
gaggaagagcauggccaguuuc

SEQ ID NO: 550914 - RNA, 22 nt, Human
ugauuuccugugcgcccuuagg

SEQ ID NO: 550915 - RNA, 23 nt, Human
agaguccacaagauuuuccagug

SEQ ID NO: 550916 - RNA, 22 nt, Human
caggaaaugaaagcuagcuaau

SEQ ID NO: 550917 - RNA, 22 nt, Human
aauuuuauuaacuggauguagc

SEQ ID NO: 550918 - RNA, 19 nt, Human
auuuacugccuaaaaucuc

SEQ ID NO: 550919 - RNA, 20 nt, Human
ccuuuagaaacucauaugua

SEQ ID NO: 550920 - RNA, 22 nt, Human
ccugagagcagcuuccugcuua

SEQ ID NO: 550921 - RNA, 22 nt, Human
ucauccaguuguggagagggaa

SEQ ID NO: 550922 - RNA, 22 nt, Human
cagcaucuaaucuucaugccgg

SEQ ID NO: 550923 - RNA, 21 nt, Human
uuucuaagugcuugguuuggg

SEQ ID NO: 550924 - RNA, 19 nt, Human
ucaaaggcaaggaggaacu

SEQ ID NO: 550925 - RNA, 22 nt, Human
gcuauuuagugagucacauccu

SEQ ID NO: 550926 - RNA, 18 nt, Human
ggccugaggauuucagca

SEQ ID NO: 550927 - RNA, 22 nt, Human
acagugauauuuuuacucaaau

SEQ ID NO: 550928 - RNA, 22 nt, Human
gguggccuccagggcauaggug

SEQ ID NO: 550929 - RNA, 21 nt, Human
gggcucugcccuccuggagcu

SEQ ID NO: 550930 - RNA, 22 nt, Human
agaaaauuuauucauguuaguu

SEQ ID NO: 550931 - RNA, 22 nt, Human
agggccaguaccaggugggugg

SEQ ID NO: 550932 - RNA, 19 nt, Human
agcagguggguaagaaaau

SEQ ID NO: 550933 - RNA, 22 nt, Human
uccugugugcuuucuuuagguu

SEQ ID NO: 550934 - RNA, 22 nt, Human
uuggcaguagucucggcuaccc

SEQ ID NO: 550935 - RNA, 22 nt, Human
ugcuucaaguugaaauauucuu

SEQ ID NO: 550936 - RNA, 22 nt, Human
cuggcagguuuggugucuggug

SEQ ID NO: 550937 - RNA, 22 nt, Human
caaugacauggauaaucauauu

SEQ ID NO: 550938 - RNA, 22 nt, Human
caguuucuucaucaguuaagca

SEQ ID NO: 550939 - RNA, 22 nt, Human
acagaaauugcuaauagcucau

SEQ ID NO: 550940 - RNA, 22 nt, Human
agagccugcuguguaagucaca

SEQ ID NO: 550941 - RNA, 22 nt, Human
caugacacccaggcauagcacc

SEQ ID NO: 550942 - RNA, 19 nt, Human
ccagcagacacagcugccc

SEQ ID NO: 550943 - RNA, 22 nt, Human
cagacaugauguaagcagaggc

SEQ ID NO: 550944 - RNA, 22 nt, Human
cuggagccacugggucuuguau

SEQ ID NO: 550945 - RNA, 22 nt, Human
aacaagaacaccuacaguucua

SEQ ID NO: 550946 - RNA, 22 nt, Human
cagacagcaaaucugcuugcau

SEQ ID NO: 550947 - RNA, 22 nt, Human
guuuggggucugcagagcggcg

SEQ ID NO: 550948 - RNA, 22 nt, Human
ugaggcagggagaguggauaug

SEQ ID NO: 550949 - RNA, 22 nt, Human
ugcaugcagcuggugauaagaa

SEQ ID NO: 550950 - RNA, 22 nt, Human
ccucugagucucacuguaaccu

SEQ ID NO: 550951 - RNA, 22 nt, Human
caggagcuacucagguuggguu

SEQ ID NO: 550952 - RNA, 22 nt, Human
auucugucuuuuuaaaauaaua

SEQ ID NO: 550953 - RNA, 22 nt, Human
uuauaucagaaggugagauuga

SEQ ID NO: 550954 - RNA, 22 nt, Human
aggaggccccuccuggguugcu

SEQ ID NO: 550955 - RNA, 22 nt, Human
uuggaauuucauguaagugacu

SEQ ID NO: 550956 - RNA, 22 nt, Human
ucagaagguggagguugcagug

SEQ ID NO: 550957 - RNA, 22 nt, Human
cacagguggcuccaaguuagag

SEQ ID NO: 550958 - RNA, 17 nt, Human
acaagcaguggccaugg

SEQ ID NO: 550959 - RNA, 22 nt, Human
agcaaagaagacacaggcuuca

SEQ ID NO: 550960 - RNA, 22 nt, Human
aacaagugauauauaauggaag

SEQ ID NO: 550961 - RNA, 22 nt, Human
gagcaguggucacagggaggga

SEQ ID NO: 550962 - RNA, 22 nt, Human
gggggacuggaccguccugggu

SEQ ID NO: 550963 - RNA, 22 nt, Human
cacuggugucugagcaggguga

SEQ ID NO: 550964 - RNA, 22 nt, Human
aguuacaaccaugacacaagca

SEQ ID NO: 550965 - RNA, 22 nt, Human
aguuuccuuggauucaauuugg

SEQ ID NO: 550966 - RNA, 23 nt, Human
gcaggugguucgaacagaaguuu

SEQ ID NO: 550967 - RNA, 22 nt, Human
aagggcucgguagcaguccuga

SEQ ID NO: 550968 - RNA, 22 nt, Human
ucaagagauugaauaauaacug

SEQ ID NO: 550969 - RNA, 20 nt, Human
ugggcagcacugcuggcugg

SEQ ID NO: 550970 - RNA, 22 nt, Human
aggccucuggagguggcagugu

SEQ ID NO: 550971 - RNA, 22 nt, Human
gaacaaauucucaucaacuugu

SEQ ID NO: 550972 - RNA, 22 nt, Human
caaggauagguacuauguaaua

SEQ ID NO: 550973 - RNA, 22 nt, Human
aggcugcuggcaggcguggacg

SEQ ID NO: 550974 - RNA, 22 nt, Human
auguuuaaaggguugagaaaua

SEQ ID NO: 550975 - RNA, 22 nt, Human
uccaaauucuagggccuugguu

SEQ ID NO: 550976 - RNA, 22 nt, Human
ucccagagcucuggagguugga

SEQ ID NO: 550977 - RNA, 22 nt, Human
ucucugaguucuccuccagccc

SEQ ID NO: 550978 - RNA, 22 nt, Human
gggguggauuccuacaggucca

SEQ ID NO: 550979 - RNA, 22 nt, Human
cuccagcucgcgagcucugcuc

SEQ ID NO: 550980 - RNA, 22 nt, Human
auuuuacuacuccaauuaauga

SEQ ID NO: 550981 - RNA, 22 nt, Human
cuacaaauauaaaacacagaua

SEQ ID NO: 550982 - RNA, 22 nt, Human
gcucagaaaagugaggcucagu

SEQ ID NO: 550983 - RNA, 22 nt, Human
caaaugugguuucucagcauuc

SEQ ID NO: 550984 - RNA, 22 nt, Human
ucccugcacagccgagccaugc

SEQ ID NO: 550985 - RNA, 22 nt, Human
gcaaaugaguuguaacauaaaa

SEQ ID NO: 550986 - RNA, 22 nt, Human
acuggcagcuguaggaugcaug

SEQ ID NO: 550987 - RNA, 22 nt, Human
agagaugaaaaguggagacugg

SEQ ID NO: 550988 - RNA, 22 nt, Human
uacaggaagcacucaagaaaug

SEQ ID NO: 550989 - RNA, 22 nt, Human
uggccuggggaccugugagacc

SEQ ID NO: 550990 - RNA, 22 nt, Human
gcaggccugcccagcaggaugg

SEQ ID NO: 550991 - RNA, 22 nt, Human
ugugggguagcaguuuccgugu

SEQ ID NO: 550992 - RNA, 22 nt, Human
ggcaggugcaccugagccaucu

SEQ ID NO: 550993 - RNA, 22 nt, Human
gcuggcagagacaagaagacua

SEQ ID NO: 550994 - RNA, 22 nt, Human
cuucugugaccaccagcagccc

SEQ ID NO: 550995 - RNA, 22 nt, Human
acacacagaguuuauacaggca

SEQ ID NO: 550996 - RNA, 20 nt, Human
agugccagggcaggugagag

SEQ ID NO: 550997 - RNA, 22 nt, Human
ggcuggcuggcugguagacaag

SEQ ID NO: 550998 - RNA, 22 nt, Human
acacauaugccauuacagcaaa

SEQ ID NO: 550999 - RNA, 22 nt, Human
ucaauucuaguggagagaguuu

SEQ ID NO: 551000 - RNA, 22 nt, Human
uucuuucccagaagauauguuu

SEQ ID NO: 551001 - RNA, 22 nt, Human
uacaagaaauuucugcauauau

SEQ ID NO: 551002 - RNA, 16 nt, Human
cuuuuucuccccucuu

SEQ ID NO: 551003 - RNA, 22 nt, Human
auacauucaaaggaaggauaga

SEQ ID NO: 551004 - RNA, 22 nt, Human
ucacaauuuggauacagcuaug

SEQ ID NO: 551005 - RNA, 22 nt, Human
acauguuugauaaauauuuggg

SEQ ID NO: 551006 - RNA, 22 nt, Human
ucacacagcuccuuuccuuagu

SEQ ID NO: 551007 - RNA, 22 nt, Human
ugucuguacaaauuuucugugu

SEQ ID NO: 551008 - RNA, 22 nt, Human
uucuguguggguagcuccuguu

SEQ ID NO: 551009 - RNA, 22 nt, Human
auguccuuccauuuugaucugu

SEQ ID NO: 551010 - RNA, 22 nt, Human
auuagaauuaugcuugcuaaug

SEQ ID NO: 551011 - RNA, 21 nt, Human
gugguuauuuucauuagcauc

SEQ ID NO: 551012 - RNA, 22 nt, Human
aucauacagaaccugagcacuu

SEQ ID NO: 551013 - RNA, 22 nt, Human
uuccucagccaaggcugggauc

SEQ ID NO: 551014 - RNA, 20 nt, Human
ggucccugcccucugucauc

SEQ ID NO: 551015 - RNA, 22 nt, Human
acagcuaggucuucagcacuuu

SEQ ID NO: 551016 - RNA, 22 nt, Human
aaugaagccagcugggaugcga

SEQ ID NO: 551017 - RNA, 22 nt, Human
aguggagaagaggauggucucc

SEQ ID NO: 551018 - RNA, 18 nt, Human
gccaggcaggguggggaa

SEQ ID NO: 551019 - RNA, 22 nt, Human
auucugcauugcucacaaagau

SEQ ID NO: 551020 - RNA, 22 nt, Human
acccaggggcagccuugcugug

SEQ ID NO: 551021 - RNA, 22 nt, Human
auguccagaguaaagcacauuc

SEQ ID NO: 551022 - RNA, 22 nt, Human
aaucaggaugacugucauuuca

SEQ ID NO: 551023 - RNA, 22 nt, Human
aggccacaguacuuugcagacc

SEQ ID NO: 551024 - RNA, 22 nt, Human
ggcuuuauuaagcaggguaagu

SEQ ID NO: 551025 - RNA, 22 nt, Human
ucuuuccauggccacacagucu

SEQ ID NO: 551026 - RNA, 22 nt, Human
augagaauaugauuuacuauug

SEQ ID NO: 551027 - RNA, 23 nt, Human
gggaccagcuagggcugugaccu

SEQ ID NO: 551028 - RNA, 20 nt, Human
accccacagaguccauugca

SEQ ID NO: 551029 - RNA, 22 nt, Human
auauucuuccaaaacaucauuu

SEQ ID NO: 551030 - RNA, 22 nt, Human
guuuaagaggguuucauuccca

SEQ ID NO: 551031 - RNA, 22 nt, Human
uuagugauaggacuuuaaagcc

SEQ ID NO: 551032 - RNA, 22 nt, Human
gcagaggucuagcaccaagaau

SEQ ID NO: 551033 - RNA, 22 nt, Human
ugauuuccuggcuuuggaguuc

SEQ ID NO: 551034 - RNA, 22 nt, Human
gcuguggcuugcagcuggggcu

SEQ ID NO: 551035 - RNA, 22 nt, Human
ucaaaugcaccucucauuuguu

SEQ ID NO: 551036 - RNA, 22 nt, Human
aagaugauaggacuugcuuaag

SEQ ID NO: 551037 - RNA, 23 nt, Human
uuguuucuuuguauugucucuau

SEQ ID NO: 551038 - RNA, 22 nt, Human
agcagggcuguguagguaauga

SEQ ID NO: 551039 - RNA, 16 nt, Human
gagcagagcgguucca

SEQ ID NO: 551040 - RNA, 22 nt, Human
augauuuuucagcagaggaucu

SEQ ID NO: 551041 - RNA, 22 nt, Human
uaagacuuccaggaaaaggugg

SEQ ID NO: 551042 - RNA, 20 nt, Human
gcauugaguauagacagaug

SEQ ID NO: 551043 - RNA, 22 nt, Human
uuuacauggaauauugucuugu

SEQ ID NO: 551044 - RNA, 22 nt, Human
ugcaggcucugugugugccugg

SEQ ID NO: 551045 - RNA, 22 nt, Human
ugaagagauuaaguugguuuug

SEQ ID NO: 551046 - RNA, 22 nt, Human
caggaagaggacaggcuucccc

SEQ ID NO: 551047 - RNA, 22 nt, Human
agcaggaaguagucuguaagca

SEQ ID NO: 551048 - RNA, 22 nt, Human
aagcagacaucccauacuuuug

SEQ ID NO: 551049 - RNA, 22 nt, Human
cugugggcugaaagugcucccg

SEQ ID NO: 551050 - RNA, 22 nt, Human
caauauucaguggaaaagccau

SEQ ID NO: 551051 - RNA, 22 nt, Human
gggacagaaggaagugagcaca

SEQ ID NO: 551052 - RNA, 22 nt, Human
uacuuccuguuuccaugucugu

SEQ ID NO: 551053 - RNA, 22 nt, Human
ucuggcugcugcgugagugcuu

SEQ ID NO: 551054 - RNA, 22 nt, Human
uuguaacucugaauacauccua

SEQ ID NO: 551055 - RNA, 22 nt, Human
aagcagaugcguuggagcaguu

SEQ ID NO: 551056 - RNA, 22 nt, Human
ugagagugguucagcucagaag

SEQ ID NO: 551057 - RNA, 22 nt, Human
agaacuauacauuacucauuga

SEQ ID NO: 551058 - RNA, 22 nt, Human
acccacaccuccguauaucacu

SEQ ID NO: 551059 - RNA, 22 nt, Human
aagacaggaaaagcuccaggcc

SEQ ID NO: 551060 - RNA, 22 nt, Human
aagacagagacucugcaacagg

SEQ ID NO: 551061 - RNA, 22 nt, Human
gagcaggccagcaauggaaggg

SEQ ID NO: 551062 - RNA, 22 nt, Human
acaaaugcagcauaaagugaac

SEQ ID NO: 551063 - RNA, 22 nt, Human
ccaggcagaugggccggcuuca

SEQ ID NO: 551064 - RNA, 22 nt, Human
agaaaaggauugauggaucaga

SEQ ID NO: 551065 - RNA, 22 nt, Human
aguauuugaucagaugauagua

SEQ ID NO: 551066 - RNA, 22 nt, Human
uagaaaugcccagauucugcua

SEQ ID NO: 551067 - RNA, 22 nt, Human
caguguuuaaucauugugaauu

SEQ ID NO: 551068 - RNA, 22 nt, Human
agcaguccaacugagguggcau

SEQ ID NO: 551069 - RNA, 21 nt, Human
agcuuacauuaccauuguugc

SEQ ID NO: 551070 - RNA, 22 nt, Human
agccucugcuuaugcaaaggua

SEQ ID NO: 551071 - RNA, 19 nt, Human
caggagagcaugcacuuug

SEQ ID NO: 551072 - RNA, 22 nt, Human
agccacagugcaagagagaaaa

SEQ ID NO: 551073 - RNA, 22 nt, Human
gagaggcugacuggcuguccug

SEQ ID NO: 551074 - RNA, 22 nt, Human
ucagacagcuugcagggaggug

SEQ ID NO: 551075 - RNA, 22 nt, Human
aaggaaauacuucugcagagca

SEQ ID NO: 551076 - RNA, 22 nt, Human
acuugguugaugucauaagguu

SEQ ID NO: 551077 - RNA, 22 nt, Human
cuauuauuaauguggggcuuug

SEQ ID NO: 551078 - RNA, 22 nt, Human
gcaguggggcgcugggaguugg

SEQ ID NO: 551079 - RNA, 22 nt, Human
cagggccacccucugcugggug

SEQ ID NO: 551080 - RNA, 19 nt, Human
ccugugagaggacaggugu

SEQ ID NO: 551081 - RNA, 22 nt, Human
uaagauaaguggguugagaugg

SEQ ID NO: 551082 - RNA, 22 nt, Human
gcagagaaaguuuuguccucag

SEQ ID NO: 551083 - RNA, 20 nt, Human
ucccugccuuuuacugcugg

SEQ ID NO: 551084 - RNA, 22 nt, Human
cgcauacauagaaacacacaga

SEQ ID NO: 551085 - RNA, 22 nt, Human
augggguggaguccgggcagcg

SEQ ID NO: 551086 - RNA, 20 nt, Human
cagauaaacgggaaagaagc

SEQ ID NO: 551087 - RNA, 22 nt, Human
ccugcagagccacgugccagcg

SEQ ID NO: 551088 - RNA, 22 nt, Human
gccauaaauugcuggucaaaau

SEQ ID NO: 551089 - RNA, 22 nt, Human
aggcagguguuaacccucugag

SEQ ID NO: 551090 - RNA, 22 nt, Human
gaggcucacuuucauccucuuc

SEQ ID NO: 551091 - RNA, 22 nt, Human
aguuuauguagaauuggcaaua

SEQ ID NO: 551092 - RNA, 22 nt, Human
gagaaucucuuugacaagcaga

SEQ ID NO: 551093 - RNA, 22 nt, Human
uacauuuucuaggggaccaaga

SEQ ID NO: 551094 - RNA, 19 nt, Human
uuucuuuuccccucagcac

SEQ ID NO: 551095 - RNA, 22 nt, Human
uuucuucaguaacacaaaccau

SEQ ID NO: 551096 - RNA, 22 nt, Human
cuuugcuaauguugcauuuuca

SEQ ID NO: 551097 - RNA, 18 nt, Human
cauuccccaucucugagc

SEQ ID NO: 551098 - RNA, 22 nt, Human
gaggcugccccuuccucagcug

SEQ ID NO: 551099 - RNA, 22 nt, Human
ucucucagaggaagaggcagug

SEQ ID NO: 551100 - RNA, 22 nt, Human
augcuguguuugagaaccuagg

SEQ ID NO: 551101 - RNA, 17 nt, Human
gcaguggagggguaguu

SEQ ID NO: 551102 - RNA, 21 nt, Human
gcugcugccccuagugaggcc

SEQ ID NO: 551103 - RNA, 22 nt, Human
ugcagaagcagagaguugccaa

SEQ ID NO: 551104 - RNA, 22 nt, Human
auugaaagauaggcuacugugg

SEQ ID NO: 551105 - RNA, 22 nt, Human
uggcccugugugcaggcugcac

SEQ ID NO: 551106 - RNA, 22 nt, Human
acagagcuuaggaugacuccca

SEQ ID NO: 551107 - RNA, 22 nt, Human
auauuauuuucccuggaguugu

SEQ ID NO: 551108 - RNA, 22 nt, Human
aucagcugaaaaacaggcagca

SEQ ID NO: 551109 - RNA, 22 nt, Human
guccucagcaccagaacuaggg

SEQ ID NO: 551110 - RNA, 22 nt, Human
cccagggagguagcaggagaaa

SEQ ID NO: 551111 - RNA, 22 nt, Human
agggacagaugaaugacugagu

SEQ ID NO: 551112 - RNA, 21 nt, Human
ugcucaugcaaugcaugucca

SEQ ID NO: 551113 - RNA, 22 nt, Human
ccagaaaaggagcugcaggaug

SEQ ID NO: 551114 - RNA, 22 nt, Human
gcuggcagcauuagacccuggg

SEQ ID NO: 551115 - RNA, 22 nt, Human
caaggaagacccacgcagauau

SEQ ID NO: 551116 - RNA, 22 nt, Human
cuucucucccuggcacucagac

SEQ ID NO: 551117 - RNA, 21 nt, Human
agcuggugucagagcucuggg

SEQ ID NO: 551118 - RNA, 23 nt, Human
acagugugguggacaaggagcag

SEQ ID NO: 551119 - RNA, 22 nt, Human
gccugggagcacaucggggucc

SEQ ID NO: 551120 - RNA, 19 nt, Human
caguggccuggaggucucu

SEQ ID NO: 551121 - RNA, 22 nt, Human
auaauuuaauuuucacaguggu

SEQ ID NO: 551122 - RNA, 22 nt, Human
ugaaagcucugucaucauuccu

SEQ ID NO: 551123 - RNA, 22 nt, Human
ugggccaggauuucaagacccu

SEQ ID NO: 551124 - RNA, 22 nt, Human
uauuucugauugcucaugaggc

SEQ ID NO: 551125 - RNA, 22 nt, Human
cuuccugcaggacagccaucug

SEQ ID NO: 551126 - RNA, 22 nt, Human
ccagucccagcucugccaugcu

SEQ ID NO: 551127 - RNA, 22 nt, Human
ucuguggaaauuuccugaggca

SEQ ID NO: 551128 - RNA, 22 nt, Human
uugaagagucuuucuuuccccc

SEQ ID NO: 551129 - RNA, 22 nt, Human
cugggccuugcaucccagagcc

SEQ ID NO: 551130 - RNA, 22 nt, Human
gaaaggccagcucacagaugag

SEQ ID NO: 551131 - RNA, 19 nt, Human
gccaggagggcucuggcug

SEQ ID NO: 551132 - RNA, 21 nt, Human
uuagaguagagaacaugaucc

SEQ ID NO: 551133 - RNA, 21 nt, Human
uccugcagggcagcagagugg

SEQ ID NO: 551134 - RNA, 22 nt, Human
agagauucauguuuacuguagg

SEQ ID NO: 551135 - RNA, 22 nt, Human
gagagcugucagcguagcaccg

SEQ ID NO: 551136 - RNA, 22 nt, Human
uguaaagguaggugcaaaauga

SEQ ID NO: 551137 - RNA, 19 nt, Human
caagugaagccugggaugg

SEQ ID NO: 551138 - RNA, 22 nt, Human
cacaagacuuauuuguguagaa

SEQ ID NO: 551139 - RNA, 22 nt, Human
agcuggcuccagaaggagucgu

SEQ ID NO: 551140 - RNA, 22 nt, Human
augcugaauugaugcgagggag

SEQ ID NO: 551141 - RNA, 22 nt, Human
cagcagaagcaacauucaggcu

SEQ ID NO: 551142 - RNA, 22 nt, Human
cagcuacacaccagaacuauua

SEQ ID NO: 551143 - RNA, 22 nt, Human
cuuucugaucccugcaacccuc

SEQ ID NO: 551144 - RNA, 22 nt, Human
agagagaggggcgagcaaacac

SEQ ID NO: 551145 - RNA, 22 nt, Human
gaagaauauggcucucagcaau

SEQ ID NO: 551146 - RNA, 22 nt, Human
agagaacaaauuaaaggugguu

SEQ ID NO: 551147 - RNA, 22 nt, Human
ucuggggaugagugaugucgua

SEQ ID NO: 551148 - RNA, 22 nt, Human
aagccacuuggggaaagaugga

SEQ ID NO: 551149 - RNA, 22 nt, Human
gggacuggaacuacuggugcag

SEQ ID NO: 551150 - RNA, 17 nt, Human
agcuuguuuuugaaagc

SEQ ID NO: 551151 - RNA, 22 nt, Human
ccagcuggcccagcugugcucc

SEQ ID NO: 551152 - RNA, 22 nt, Human
cuagcaucagaugagaagcugu

SEQ ID NO: 551153 - RNA, 23 nt, Human
ugcaggcuaggaagagagccuuc

SEQ ID NO: 551154 - RNA, 19 nt, Human
acucuuuuccuuuugaauc

SEQ ID NO: 551155 - RNA, 22 nt, Human
uucuuuuacauuaagauuucag

SEQ ID NO: 551156 - RNA, 22 nt, Human
cuucuggguguggagugaggac

SEQ ID NO: 551157 - RNA, 22 nt, Human
aaccuuuauuugguacuauucu

SEQ ID NO: 551158 - RNA, 22 nt, Human
uugaccuauguuucuucaucug

SEQ ID NO: 551159 - RNA, 22 nt, Human
uggcagcaauuugugauguuga

SEQ ID NO: 551160 - RNA, 22 nt, Human
gucccuaguggaaagacaugau

SEQ ID NO: 551161 - RNA, 22 nt, Human
agaaaguucacugguauauuuu

SEQ ID NO: 551162 - RNA, 22 nt, Human
ugauucuauggaaggcauaagg

SEQ ID NO: 551163 - RNA, 22 nt, Human
gugaaguucaagcuugccaucu

SEQ ID NO: 551164 - RNA, 22 nt, Human
uguacuuccccaaugacagcac

SEQ ID NO: 551165 - RNA, 21 nt, Human
ugggcacugagggugcugcuc

SEQ ID NO: 551166 - RNA, 23 nt, Human
aaagcaaggaauuggcaacagag

SEQ ID NO: 551167 - RNA, 22 nt, Human
aaagccagggacagugugcaug

SEQ ID NO: 551168 - RNA, 22 nt, Human
cuuucuggcacagccgcgggau

SEQ ID NO: 551169 - RNA, 22 nt, Human
cuggggaaggcggugacugcgc

SEQ ID NO: 551170 - RNA, 17 nt, Human
uccuggauccauggugg

SEQ ID NO: 551171 - RNA, 22 nt, Human
augcaaauugccauaaaguggg

SEQ ID NO: 551172 - RNA, 22 nt, Human
ugcaaauggagcauguauaaga

SEQ ID NO: 551173 - RNA, 22 nt, Human
aucagcaagauguaauuucuau

SEQ ID NO: 551174 - RNA, 22 nt, Human
agaaauuccuaagguacacaag

SEQ ID NO: 551175 - RNA, 22 nt, Human
cuucccuucugugcagggcaga

SEQ ID NO: 551176 - RNA, 22 nt, Human
ugcaauaaagugcuauaaaucc

SEQ ID NO: 551177 - RNA, 22 nt, Human
cuuuuucaagucaaagagggua

SEQ ID NO: 551178 - RNA, 22 nt, Human
gagcccuggcagucugggaugg

SEQ ID NO: 551179 - RNA, 22 nt, Human
aacaucuuuuuguuugcugaaa

SEQ ID NO: 551180 - RNA, 22 nt, Human
auaaggcauauagucacuuuuu

SEQ ID NO: 551181 - RNA, 22 nt, Human
auugaaaaaugacuauugcuua

SEQ ID NO: 551182 - RNA, 22 nt, Human
guauuugauacaugaaauggug

SEQ ID NO: 551183 - RNA, 22 nt, Human
gccuugcuuugcuucuggacag

SEQ ID NO: 551184 - RNA, 22 nt, Human
ucuggggagucaaagagaccug

SEQ ID NO: 551185 - RNA, 22 nt, Human
agacaaagaaaccguagaagca

SEQ ID NO: 551186 - RNA, 22 nt, Human
caguuacaugcucaugucauca

SEQ ID NO: 551187 - RNA, 22 nt, Human
gacccauauaggacccuccaaa

SEQ ID NO: 551188 - RNA, 22 nt, Human
guaagcaucugucucuucugca

SEQ ID NO: 551189 - RNA, 22 nt, Human
gggacaggccccucgcuagcuu

SEQ ID NO: 551190 - RNA, 22 nt, Human
ccagaggugcugggagaggucu

SEQ ID NO: 551191 - RNA, 19 nt, Human
augucccaccgccccugag

SEQ ID NO: 551192 - RNA, 22 nt, Human
ugggcuuccuggagccugugcu

SEQ ID NO: 551193 - RNA, 22 nt, Human
ggaagggcaaaagagaugaacu

SEQ ID NO: 551194 - RNA, 17 nt, Human
gaacagcagaggggaca

SEQ ID NO: 551195 - RNA, 23 nt, Human
uucuggauguucuagucugagag

SEQ ID NO: 551196 - RNA, 22 nt, Human
uggagcagccaugaugacagag

SEQ ID NO: 551197 - RNA, 22 nt, Human
ugcacuacugugauacacagcc

SEQ ID NO: 551198 - RNA, 22 nt, Human
aaacuucaguaggagccaaccu

SEQ ID NO: 551199 - RNA, 22 nt, Human
agggagaagguuuagcugugag

SEQ ID NO: 551200 - RNA, 22 nt, Human
gggaaggagguggcuugaagug

SEQ ID NO: 551201 - RNA, 22 nt, Human
aaagacuaagaagaguauuauu

SEQ ID NO: 551202 - RNA, 22 nt, Human
ucaggaagugcugaggcugcuu

SEQ ID NO: 551203 - RNA, 22 nt, Human
uuagccauuaaauuacaaggug

SEQ ID NO: 551204 - RNA, 22 nt, Human
uaauacugaaagggaaaugucc

SEQ ID NO: 551205 - RNA, 22 nt, Human
ccucagaguuggccacgagagc

SEQ ID NO: 551206 - RNA, 22 nt, Human
cagcagguccugggcguggccu

SEQ ID NO: 551207 - RNA, 22 nt, Human
ucacaagagcuggacugucuuu

SEQ ID NO: 551208 - RNA, 22 nt, Human
ugggccucaguuuccuuaggau

SEQ ID NO: 551209 - RNA, 21 nt, Human
ccuggcacuggccugcugagc

SEQ ID NO: 551210 - RNA, 17 nt, Human
gagaguguauuggaugc

SEQ ID NO: 551211 - RNA, 22 nt, Human
cccugaggggaguggugaggug

SEQ ID NO: 551212 - RNA, 22 nt, Human
ugcaagagcccaaacuauauac

SEQ ID NO: 551213 - RNA, 22 nt, Human
uguguuccuucgucuucccuuc

SEQ ID NO: 551214 - RNA, 22 nt, Human
agaggagugggaagcagugcaa

SEQ ID NO: 551215 - RNA, 22 nt, Human
uacauuugcuuugauuuucagc

SEQ ID NO: 551216 - RNA, 22 nt, Human
caucagaacgugagcuccuugu

SEQ ID NO: 551217 - RNA, 22 nt, Human
cuggccuggcagggagggcaug

SEQ ID NO: 551218 - RNA, 19 nt, Human
ucaaaugccaaugucacag

SEQ ID NO: 551219 - RNA, 19 nt, Human
uuucuaagcuaaaugcuuc

SEQ ID NO: 551220 - RNA, 22 nt, Human
agcccagcaaagggagguucag

SEQ ID NO: 551221 - RNA, 22 nt, Human
acagcugggugcugcucagagc

SEQ ID NO: 551222 - RNA, 22 nt, Human
agauuucucuuucccuggcuga

SEQ ID NO: 551223 - RNA, 22 nt, Human
cagcccagcacuaaguagauuu

SEQ ID NO: 551224 - RNA, 22 nt, Human
gccuuggcugaugugcgaauga

SEQ ID NO: 551225 - RNA, 22 nt, Human
gugcuguauaugcaagaggaag

SEQ ID NO: 551226 - RNA, 22 nt, Human
gcugagccccccugcguggguc

SEQ ID NO: 551227 - RNA, 22 nt, Human
aucaagaauguucauucuucua

SEQ ID NO: 551228 - RNA, 22 nt, Human
uaagcucuccaggugaucauga

SEQ ID NO: 551229 - RNA, 22 nt, Human
cagguucccagguccagggcuu

SEQ ID NO: 551230 - RNA, 22 nt, Human
gugaagagcuguugcagagauu

SEQ ID NO: 551231 - RNA, 22 nt, Human
ucagagcagacuuugaaggagg

SEQ ID NO: 551232 - RNA, 20 nt, Human
acacauauagcagcauaaac

SEQ ID NO: 551233 - RNA, 22 nt, Human
ugcagugguguccagguguacu

SEQ ID NO: 551234 - RNA, 22 nt, Human
uacugccuggagcauuggugcu

SEQ ID NO: 551235 - RNA, 22 nt, Human
caggcagcauuuacucugauga

SEQ ID NO: 551236 - RNA, 22 nt, Human
augauuuucugauaaagaacug

SEQ ID NO: 551237 - RNA, 22 nt, Human
acuugaauuauauuucuagaga

SEQ ID NO: 551238 - RNA, 22 nt, Human
agccucucuuuauucccagcua

SEQ ID NO: 551239 - RNA, 22 nt, Human
ucacacagguuugcaaugauuu

SEQ ID NO: 551240 - RNA, 22 nt, Human
gcucaggaaacagcagggcuug

SEQ ID NO: 551241 - RNA, 22 nt, Human
uagacagagugaagacaagugg

SEQ ID NO: 551242 - RNA, 22 nt, Human
uuuuacaccuguuaacucuaag

SEQ ID NO: 551243 - RNA, 22 nt, Human
cuguuuauuacacuggauagca

SEQ ID NO: 551244 - RNA, 22 nt, Human
uagcagagcagggaucagagcc

SEQ ID NO: 551245 - RNA, 22 nt, Human
ugaagcaaacgcuucuguuccu

SEQ ID NO: 551246 - RNA, 22 nt, Human
gauauuuuugcagacaccuggg

SEQ ID NO: 551247 - RNA, 22 nt, Human
gaguucaguaguuauagucuag

SEQ ID NO: 551248 - RNA, 22 nt, Human
auaguuuucuaugcacuguuau

SEQ ID NO: 551249 - RNA, 22 nt, Human
uaaggcagaaauaugagcaggg

SEQ ID NO: 551250 - RNA, 22 nt, Human
cucagcaacagcgacuuaaggg

SEQ ID NO: 551251 - RNA, 22 nt, Human
uuucaaguguccugauuaaugg

SEQ ID NO: 551252 - RNA, 22 nt, Human
gcacagggaggcuggccuggcc

SEQ ID NO: 551253 - RNA, 22 nt, Human
cuggcucauccagguguugcuc

SEQ ID NO: 551254 - RNA, 23 nt, Human
aguuccagaaaaaugcucaagca

SEQ ID NO: 551255 - RNA, 22 nt, Human
ggcccaaacggguccagugaaa

SEQ ID NO: 551256 - RNA, 22 nt, Human
aaacuugagcagucagaugaag

SEQ ID NO: 551257 - RNA, 22 nt, Human
gccagguggagguugcagugag

SEQ ID NO: 551258 - RNA, 18 nt, Human
agaguguucucagugaaa

SEQ ID NO: 551259 - RNA, 22 nt, Human
cagccugggcuccagagucccu

SEQ ID NO: 551260 - RNA, 22 nt, Human
uucuuaagcguaugauaaugaa

SEQ ID NO: 551261 - RNA, 22 nt, Human
cagagacuggagugcaguggcg

SEQ ID NO: 551262 - RNA, 22 nt, Human
ucccagccuuccagucugguuu

SEQ ID NO: 551263 - RNA, 22 nt, Human
gugggcuuuugacagugccugg

SEQ ID NO: 551264 - RNA, 22 nt, Human
ccccucuugugggcucagguca

SEQ ID NO: 551265 - RNA, 22 nt, Human
gcuggccucuggagaagggcuu

SEQ ID NO: 551266 - RNA, 22 nt, Human
aacaggcaggagaauucugccu

SEQ ID NO: 551267 - RNA, 18 nt, Human
gggaucaggcugccuagg

SEQ ID NO: 551268 - RNA, 22 nt, Human
auuaaaagcuucccaagaguua

SEQ ID NO: 551269 - RNA, 22 nt, Human
uggcagaguuauggguauuuau

SEQ ID NO: 551270 - RNA, 22 nt, Human
uuucuaaaggguagauuuggcc

SEQ ID NO: 551271 - RNA, 22 nt, Human
auguacaggauggugcucaucu

SEQ ID NO: 551272 - RNA, 22 nt, Human
agcuggcuucucugcagacauu

SEQ ID NO: 551273 - RNA, 22 nt, Human
gcugggcuggaaggccaaggca

SEQ ID NO: 551274 - RNA, 23 nt, Human
agcuuugugaaagcagacauggg

SEQ ID NO: 551275 - RNA, 22 nt, Human
uuuccuaaucccaaugacauuu

SEQ ID NO: 551276 - RNA, 17 nt, Human
ucagggaaugagguugu

SEQ ID NO: 551277 - RNA, 22 nt, Human
ugaaggaaaugacggcagaaga

SEQ ID NO: 551278 - RNA, 22 nt, Human
aauuucaagucuugaagaagua

SEQ ID NO: 551279 - RNA, 21 nt, Human
aucugcuuagguuuguucaga

SEQ ID NO: 551280 - RNA, 22 nt, Human
auacaagugauauaauuguuuc

SEQ ID NO: 551281 - RNA, 22 nt, Human
aaauauacuagaugaugaccca

SEQ ID NO: 551282 - RNA, 23 nt, Human
ucaucaaacagcugcucaagaaa

SEQ ID NO: 551283 - RNA, 22 nt, Human
agauacaacuguuuaaacauua

SEQ ID NO: 551284 - RNA, 22 nt, Human
gcaggagagccagcaggcuucc

SEQ ID NO: 551285 - RNA, 22 nt, Human
aaugugaacuuugucauguaac

SEQ ID NO: 551286 - RNA, 22 nt, Human
uauuuaaaauaagccccagugg

SEQ ID NO: 551287 - RNA, 22 nt, Human
gcaauacaguugaagagauuga

SEQ ID NO: 551288 - RNA, 22 nt, Human
aagacaauguuucugauagaua

SEQ ID NO: 551289 - RNA, 22 nt, Human
ucuucaaaaaauauccaucagu

SEQ ID NO: 551290 - RNA, 22 nt, Human
augggaagugaagucagggagg

SEQ ID NO: 551291 - RNA, 22 nt, Human
ccacagaaaguugucuagagua

SEQ ID NO: 551292 - RNA, 22 nt, Human
aggccuguuggcgugggcucua

SEQ ID NO: 551293 - RNA, 19 nt, Human
ugagaaggcaguggggagc

SEQ ID NO: 551294 - RNA, 22 nt, Human
cacagggcuucucauggggugc

SEQ ID NO: 551295 - RNA, 22 nt, Human
gcagggcuguucaggagggugg

SEQ ID NO: 551296 - RNA, 22 nt, Human
agcucaggucucaggagguguc

SEQ ID NO: 551297 - RNA, 22 nt, Human
acgaauaagagauaaagcaagg

SEQ ID NO: 551298 - RNA, 22 nt, Human
accaguccgcggagcuccgggg

SEQ ID NO: 551299 - RNA, 22 nt, Human
caacagcuggaggcuuggcccg

SEQ ID NO: 551300 - RNA, 22 nt, Human
uuacacagugguuaagucuggg

SEQ ID NO: 551301 - RNA, 22 nt, Human
aacacagcuaauuucugucaau

SEQ ID NO: 551302 - RNA, 22 nt, Human
cccaggaguuugaguucagcau

SEQ ID NO: 551303 - RNA, 22 nt, Human
ccagcugauucgguggugguug

SEQ ID NO: 551304 - RNA, 22 nt, Human
cagggccagcgucucgggcuau

SEQ ID NO: 551305 - RNA, 22 nt, Human
uucaacuuuaugcauauguauu

SEQ ID NO: 551306 - RNA, 22 nt, Human
uacaagaaggaaaacuagcaau

SEQ ID NO: 551307 - RNA, 22 nt, Human
gggggcaguaaggauauggaaa

SEQ ID NO: 551308 - RNA, 22 nt, Human
gcacagggccuggcacauaaga

SEQ ID NO: 551309 - RNA, 22 nt, Human
aggggcuguggaaaccaacucu

SEQ ID NO: 551310 - RNA, 22 nt, Human
gauauugccagauguccccgga

SEQ ID NO: 551311 - RNA, 22 nt, Human
gugagcagcucaggguggucuc

SEQ ID NO: 551312 - RNA, 22 nt, Human
auguauguuaguguauuaucua

SEQ ID NO: 551313 - RNA, 22 nt, Human
cugagauggaguuucgcucuuc

SEQ ID NO: 551314 - RNA, 22 nt, Human
uguaaauaaugcauguaaauca

SEQ ID NO: 551315 - RNA, 22 nt, Human
uuagagaaauucugguaaugua

SEQ ID NO: 551316 - RNA, 22 nt, Human
ucuggcagguucccauguuaug

SEQ ID NO: 551317 - RNA, 18 nt, Human
uggcuucugcuagcugga

SEQ ID NO: 551318 - RNA, 22 nt, Human
caggauggccccggggcugugc

SEQ ID NO: 551319 - RNA, 22 nt, Human
gaggcuggaauauuagaaaugu

SEQ ID NO: 551320 - RNA, 22 nt, Human
caguggaagcuggcugugaaga

SEQ ID NO: 551321 - RNA, 21 nt, Human
aaagugguaaggauuauuuug

SEQ ID NO: 551322 - RNA, 22 nt, Human
ccuggcuuccuucaugaccugg

SEQ ID NO: 551323 - RNA, 22 nt, Human
gcagagaggaaugaagccaucc

SEQ ID NO: 551324 - RNA, 22 nt, Human
uuagauaauguuauuguaauuu

SEQ ID NO: 551325 - RNA, 22 nt, Human
cccaggacucuucacugcagcc

SEQ ID NO: 551326 - RNA, 22 nt, Human
gacacaaaguuugucagaaauu

SEQ ID NO: 551327 - RNA, 22 nt, Human
gauccucuuuuccuaggaaggu

SEQ ID NO: 551328 - RNA, 22 nt, Human
cacauaauacauguuccacuua

SEQ ID NO: 551329 - RNA, 22 nt, Human
agggagcucaguuggaagcggu

SEQ ID NO: 551330 - RNA, 22 nt, Human
caggguugcaugcaucuguggg

SEQ ID NO: 551331 - RNA, 22 nt, Human
cuggccugaggccgccuucaga

SEQ ID NO: 551332 - RNA, 22 nt, Human
aaacucaaggauuuagacgaag

SEQ ID NO: 551333 - RNA, 22 nt, Human
ucucagagggaaacaugaguga

SEQ ID NO: 551334 - RNA, 22 nt, Human
cucaggguaaugaaagacgaau

SEQ ID NO: 551335 - RNA, 22 nt, Human
gcagguggauauugcuacuuga

SEQ ID NO: 551336 - RNA, 22 nt, Human
gacagcagacagaacuaccugc

SEQ ID NO: 551337 - RNA, 22 nt, Human
aauauaguucugguauuguuaa

SEQ ID NO: 551338 - RNA, 22 nt, Human
cagggcuagugacaccccaguc

SEQ ID NO: 551339 - RNA, 22 nt, Human
auggcagagaaagcgagccaca

SEQ ID NO: 551340 - RNA, 22 nt, Human
caccagguggaaaugucacagc

SEQ ID NO: 551341 - RNA, 22 nt, Human
auacauacguacauacguaugu

SEQ ID NO: 551342 - RNA, 22 nt, Human
cugggcuacguguugacagcau

SEQ ID NO: 551343 - RNA, 20 nt, Human
auaauuuacccugcaccacu

SEQ ID NO: 551344 - RNA, 21 nt, Human
acucaagugggcaugcgcaga

SEQ ID NO: 551345 - RNA, 22 nt, Human
guggugcauccuugaguaagcu

SEQ ID NO: 551346 - RNA, 21 nt, Human
gaacauuuggguuguuucuac

SEQ ID NO: 551347 - RNA, 20 nt, Human
cuuggccuacuuagcuuugu

SEQ ID NO: 551348 - RNA, 22 nt, Human
cuuacacuucaucucauccagg

SEQ ID NO: 551349 - RNA, 22 nt, Human
gcucccugcagcugagaguucc

SEQ ID NO: 551350 - RNA, 22 nt, Human
gcacugugcuagguaucaggga

SEQ ID NO: 551351 - RNA, 22 nt, Human
uaaugcacagaauugacauggg

SEQ ID NO: 551352 - RNA, 22 nt, Human
uuacaucugcacuccaggacag

SEQ ID NO: 551353 - RNA, 22 nt, Human
uuacaauugagucuauuguaug

SEQ ID NO: 551354 - RNA, 22 nt, Human
ugugaagauuuggcaugcagaa

SEQ ID NO: 551355 - RNA, 22 nt, Human
caagggugguauugggagcaua

SEQ ID NO: 551356 - RNA, 22 nt, Human
gcuuggcauuugcugggagcug

SEQ ID NO: 551357 - RNA, 22 nt, Human
aaccugcauguuucuaaaagca

SEQ ID NO: 551358 - RNA, 22 nt, Human
uagaggcagaagaaauugacaa

SEQ ID NO: 551359 - RNA, 22 nt, Human
ccagguguagcacugcucacag

SEQ ID NO: 551360 - RNA, 22 nt, Human
uugcaucagcaggcauaauugg

SEQ ID NO: 551361 - RNA, 22 nt, Human
caugugggaagaggccagcugg

SEQ ID NO: 551362 - RNA, 22 nt, Human
ugcagaaggccugacauugcac

SEQ ID NO: 551363 - RNA, 19 nt, Human
cugaagucuuuucagcugg

SEQ ID NO: 551364 - RNA, 22 nt, Human
uuagcugucaagguggcugcag

SEQ ID NO: 551365 - RNA, 22 nt, Human
uagaggggaaucugccuccucu

SEQ ID NO: 551366 - RNA, 22 nt, Human
ucaaagcaucagucaauuuagg

SEQ ID NO: 551367 - RNA, 22 nt, Human
aucuggcugacuuugugggaca

SEQ ID NO: 551368 - RNA, 22 nt, Human
acuaaacugaagcaugaaaagg

SEQ ID NO: 551369 - RNA, 22 nt, Human
agauacacagagcaucuucaga

SEQ ID NO: 551370 - RNA, 22 nt, Human
uuuauaagaagcaaugucugag

SEQ ID NO: 551371 - RNA, 22 nt, Human
agggcugcugaggaagccuugc

SEQ ID NO: 551372 - RNA, 22 nt, Human
uggcucuguucgccaucaggag

SEQ ID NO: 551373 - RNA, 17 nt, Human
ucaggcugggugcagug

SEQ ID NO: 551374 - RNA, 22 nt, Human
uacccaggagaaacagcagggc

SEQ ID NO: 551375 - RNA, 22 nt, Human
gccugggauucccagaggggca

SEQ ID NO: 551376 - RNA, 22 nt, Human
ucgugaggcucugcaucgcaca

SEQ ID NO: 551377 - RNA, 22 nt, Human
ugcuggcugggcugcuggagac

SEQ ID NO: 551378 - RNA, 19 nt, Human
agcuggcagcuuccacuuc

SEQ ID NO: 551379 - RNA, 21 nt, Human
gcauuaaaagcaguuguuggu

SEQ ID NO: 551380 - RNA, 22 nt, Human
cugggcucugcggugucgcucu

SEQ ID NO: 551381 - RNA, 21 nt, Human
acauggacugugaauggggac

SEQ ID NO: 551382 - RNA, 22 nt, Human
ggaaaagaaagggacugauugg

SEQ ID NO: 551383 - RNA, 22 nt, Human
acucuaaaaugcuaugagaucu

SEQ ID NO: 551384 - RNA, 22 nt, Human
ucagacagggcuucucaaacuu

SEQ ID NO: 551385 - RNA, 19 nt, Human
gcuggcagauguggccgug

SEQ ID NO: 551386 - RNA, 22 nt, Human
aaagucauugcuguuaucaaug

SEQ ID NO: 551387 - RNA, 22 nt, Human
ggaaccacagcccccagcaggc

SEQ ID NO: 551388 - RNA, 22 nt, Human
aggcaggcuagucgcuugagcc

SEQ ID NO: 551389 - RNA, 23 nt, Human
uggaaacauucugaauguccauc

SEQ ID NO: 551390 - RNA, 22 nt, Human
ucacuugccuagcccaguucag

SEQ ID NO: 551391 - RNA, 22 nt, Human
aggcugaggugugcugugaucg

SEQ ID NO: 551392 - RNA, 22 nt, Human
uuccuucucagcccucgaggau

SEQ ID NO: 551393 - RNA, 22 nt, Human
acagccauagaugcuuauguaa

SEQ ID NO: 551394 - RNA, 22 nt, Human
cacaggaggaggccagagcgua

SEQ ID NO: 551395 - RNA, 18 nt, Human
agugugugcccuuucagg

SEQ ID NO: 551396 - RNA, 18 nt, Human
cacaggcaggugauaggu

SEQ ID NO: 551397 - RNA, 23 nt, Human
uccagcagccaagaaggguagaa

SEQ ID NO: 551398 - RNA, 22 nt, Human
aaaauuaagugucugggaagcc

SEQ ID NO: 551399 - RNA, 22 nt, Human
gcugaaaugcagaucccucacu

SEQ ID NO: 551400 - RNA, 18 nt, Human
ccagguggugacagagau

SEQ ID NO: 551401 - RNA, 22 nt, Human
ggaggaaggguagcauaaugua

SEQ ID NO: 551402 - RNA, 22 nt, Human
uggcagaaguucacuaguagcu

SEQ ID NO: 551403 - RNA, 22 nt, Human
acaacugucaguaaagaauauu

SEQ ID NO: 551404 - RNA, 21 nt, Human
uuugcauuuuacaugugggga

SEQ ID NO: 551405 - RNA, 22 nt, Human
agucaggguuguaggcucaccc

SEQ ID NO: 551406 - RNA, 22 nt, Human
guggcagguggagccuccugca

SEQ ID NO: 551407 - RNA, 22 nt, Human
cuugggaggagaacaaagcucc

SEQ ID NO: 551408 - RNA, 22 nt, Human
uauuuguauguguguacauaua

SEQ ID NO: 551409 - RNA, 22 nt, Human
uggcuaggaauccaugacucuc

SEQ ID NO: 551410 - RNA, 22 nt, Human
agagacaggguuuugccauguu

SEQ ID NO: 551411 - RNA, 22 nt, Human
acugccugugucccuucagugc

SEQ ID NO: 551412 - RNA, 21 nt, Human
caguuacacaaguguuaccag

SEQ ID NO: 551413 - RNA, 21 nt, Human
uaucuacuggugucuuucaga

SEQ ID NO: 551414 - RNA, 22 nt, Human
gugcuuccccaagccacagccu

SEQ ID NO: 551415 - RNA, 22 nt, Human
gaggcuguguuucagugaggcc

SEQ ID NO: 551416 - RNA, 22 nt, Human
uucaaaacagcuagauauugga

SEQ ID NO: 551417 - RNA, 22 nt, Human
cuugggcucugugggccuuagu

SEQ ID NO: 551418 - RNA, 22 nt, Human
ggugggcagcucuuggcaggca

SEQ ID NO: 551419 - RNA, 22 nt, Human
aguggcaguagaugagcugguu

SEQ ID NO: 551420 - RNA, 16 nt, Human
cauauugcugaaagag

SEQ ID NO: 551421 - RNA, 22 nt, Human
uccaauuuucugauuucacuug

SEQ ID NO: 551422 - RNA, 22 nt, Human
aaugaugguuaaacacuggagg

SEQ ID NO: 551423 - RNA, 22 nt, Human
cccaggcacacugaagugacau

SEQ ID NO: 551424 - RNA, 22 nt, Human
uccugcagcucugagaagcauc

SEQ ID NO: 551425 - RNA, 22 nt, Human
uuauggaaaacuccagagagua

SEQ ID NO: 551426 - RNA, 22 nt, Human
augcugagaaaccugucuggca

SEQ ID NO: 551427 - RNA, 22 nt, Human
ugucauuuauuuugcugucugu

SEQ ID NO: 551428 - RNA, 22 nt, Human
cagauuuugaugaauguggaaa

SEQ ID NO: 551429 - RNA, 22 nt, Human
agcaggcuccuuccuucucugg

SEQ ID NO: 551430 - RNA, 22 nt, Human
auucacaugugcuucuuaucac

SEQ ID NO: 551431 - RNA, 22 nt, Human
cacagaauaaauugguaucaga

SEQ ID NO: 551432 - RNA, 22 nt, Human
gggcucugugguugugcuuugu

SEQ ID NO: 551433 - RNA, 22 nt, Human
ccagggcauguccaagacuuag

SEQ ID NO: 551434 - RNA, 22 nt, Human
caggggcugugggcggagccuc

SEQ ID NO: 551435 - RNA, 22 nt, Human
caacagcucagacacgggaccu

SEQ ID NO: 551436 - RNA, 19 nt, Human
uccuucagucagaucuggg

SEQ ID NO: 551437 - RNA, 22 nt, Human
aaguucaaggaagccuccaguu

SEQ ID NO: 551438 - RNA, 22 nt, Human
uucaaagauuagcauacgcaau

SEQ ID NO: 551439 - RNA, 22 nt, Human
cccacagguccccaugaacucg

SEQ ID NO: 551440 - RNA, 22 nt, Human
aguugaauaauuagacauaucu

SEQ ID NO: 551441 - RNA, 22 nt, Human
agccugguuuaagcauuuuaua

SEQ ID NO: 551442 - RNA, 22 nt, Human
acuucaugcuuuagagagauga

SEQ ID NO: 551443 - RNA, 22 nt, Human
aauccagguggcggagguugug

SEQ ID NO: 551444 - RNA, 19 nt, Human
ucugugcugggaggcagca

SEQ ID NO: 551445 - RNA, 22 nt, Human
cacuguuuuauuccaacauagg

SEQ ID NO: 551446 - RNA, 19 nt, Human
aaaggcaguggguggcgug

SEQ ID NO: 551447 - RNA, 22 nt, Human
uaucacaggugugauuuacauu

SEQ ID NO: 551448 - RNA, 22 nt, Human
uuuaucacagaauaagaaguca

SEQ ID NO: 551449 - RNA, 22 nt, Human
cauaauaucuccgauuacuugc

SEQ ID NO: 551450 - RNA, 22 nt, Human
uguguauuaccauuuuacagcu

SEQ ID NO: 551451 - RNA, 22 nt, Human
gaacagcugcuagagaucugug

SEQ ID NO: 551452 - RNA, 19 nt, Human
cgcaggagccgaggugacc

SEQ ID NO: 551453 - RNA, 22 nt, Human
caguuuugguccuuucuaggua

SEQ ID NO: 551454 - RNA, 22 nt, Human
ucaguguccggagccugagugc

SEQ ID NO: 551455 - RNA, 22 nt, Human
uuauuuucagcuaggaaagcca

SEQ ID NO: 551456 - RNA, 22 nt, Human
guugaaaguggagaaccugguu

SEQ ID NO: 551457 - RNA, 22 nt, Human
gugccuggcaugcgccggugcu

SEQ ID NO: 551458 - RNA, 22 nt, Human
cacauacaaugguguuauuugg

SEQ ID NO: 551459 - RNA, 22 nt, Human
aagaaguuaauaauggugagaa

SEQ ID NO: 551460 - RNA, 22 nt, Human
cauuugaaaccuggaaucuacc

SEQ ID NO: 551461 - RNA, 22 nt, Human
uuucuggacccuucugugagug

SEQ ID NO: 551462 - RNA, 22 nt, Human
uucacaaaacacuauuuucugg

SEQ ID NO: 551463 - RNA, 22 nt, Human
guggcaggagacuggaagaugg

SEQ ID NO: 551464 - RNA, 22 nt, Human
ggaaggaggaugcucuggccuu

SEQ ID NO: 551465 - RNA, 17 nt, Human
aggcuggcucacaggga

SEQ ID NO: 551466 - RNA, 22 nt, Human
cugagccagagggagucggguc

SEQ ID NO: 551467 - RNA, 22 nt, Human
caaucaugguauaauuccuuuu

SEQ ID NO: 551468 - RNA, 22 nt, Human
augcccugggagugcuguacca

SEQ ID NO: 551469 - RNA, 22 nt, Human
uccuugagccucccagacucag

SEQ ID NO: 551470 - RNA, 22 nt, Human
uugugugugagccuucaccaca

SEQ ID NO: 551471 - RNA, 22 nt, Human
uugcugaaaacaguggguauug

SEQ ID NO: 551472 - RNA, 22 nt, Human
uuaugacauaugaguacaagua

SEQ ID NO: 551473 - RNA, 22 nt, Human
agggugggcuagacucuucccc

SEQ ID NO: 551474 - RNA, 22 nt, Human
ugccugucuuuccucccucgua

SEQ ID NO: 551475 - RNA, 22 nt, Human
agugcaaagaaaucagcuuugu

SEQ ID NO: 551476 - RNA, 22 nt, Human
cuuucucaaugccggaaggcac

SEQ ID NO: 551477 - RNA, 22 nt, Human
auauacacauguguauacauuu

SEQ ID NO: 551478 - RNA, 22 nt, Human
gcagcuuggugaaaggugaugg

SEQ ID NO: 551479 - RNA, 22 nt, Human
ugugaaggcagagccagugaaa

SEQ ID NO: 551480 - RNA, 22 nt, Human
cugggcagugguggcaucuuug

SEQ ID NO: 551481 - RNA, 22 nt, Human
guuucuuauuucaacuggaaca

SEQ ID NO: 551482 - RNA, 22 nt, Human
agugaaaaccuaaucaugcagu

SEQ ID NO: 551483 - RNA, 22 nt, Human
cuggggucucaauucuagcggg

SEQ ID NO: 551484 - RNA, 22 nt, Human
acuuucuuaggcuguauaaaug

SEQ ID NO: 551485 - RNA, 22 nt, Human
uuugaaagcaggugugggaggg

SEQ ID NO: 551486 - RNA, 22 nt, Human
cagaagaggacuggguagcuca

SEQ ID NO: 551487 - RNA, 22 nt, Human
cacauacauacguauguauaca

SEQ ID NO: 551488 - RNA, 21 nt, Human
caaagccaggcaacucucucc

SEQ ID NO: 551489 - RNA, 22 nt, Human
acauaucuuucccucuccugaa

SEQ ID NO: 551490 - RNA, 22 nt, Human
gucccacugggcaacuagaaaa

SEQ ID NO: 551491 - RNA, 17 nt, Human
ugaaggaaggaugaugu

SEQ ID NO: 551492 - RNA, 22 nt, Human
auuaagacuauugauauuuaca

SEQ ID NO: 551493 - RNA, 22 nt, Human
ucacuguauuugcugaugcaua

SEQ ID NO: 551494 - RNA, 22 nt, Human
gagcuggcuaauacugacuuau

SEQ ID NO: 551495 - RNA, 22 nt, Human
cuucugcaauaaguuuuggucc

SEQ ID NO: 551496 - RNA, 22 nt, Human
cagcagcuguuuacggaacacc

SEQ ID NO: 551497 - RNA, 22 nt, Human
aggcaggaaaaucgcuugaacc

SEQ ID NO: 551498 - RNA, 22 nt, Human
ugaggaagcaaaggcuugugug

SEQ ID NO: 551499 - RNA, 22 nt, Human
aaagcugcugccaaucaggcuu

SEQ ID NO: 551500 - RNA, 22 nt, Human
acauuugauaauuauaaagaca

SEQ ID NO: 551501 - RNA, 20 nt, Human
gcuggcagaugucuugagau

SEQ ID NO: 551502 - RNA, 22 nt, Human
cccagaguggacgguggccccu

SEQ ID NO: 551503 - RNA, 22 nt, Human
gagaggugaaggcugcccuggg

SEQ ID NO: 551504 - RNA, 22 nt, Human
ugaggccugaagccuggagccu

SEQ ID NO: 551505 - RNA, 19 nt, Human
gcugccugucuuagccagu

SEQ ID NO: 551506 - RNA, 22 nt, Human
auagacauauggcuuuguuucu

SEQ ID NO: 551507 - RNA, 22 nt, Human
gccagaggaacgcugcgcgccc

SEQ ID NO: 551508 - RNA, 22 nt, Human
uggccagucuguggaagccagg

SEQ ID NO: 551509 - RNA, 22 nt, Human
aggaagagguagcugucaaggg

SEQ ID NO: 551510 - RNA, 22 nt, Human
ucuggagcgaggucccugucug

SEQ ID NO: 551511 - RNA, 22 nt, Human
acuucaaacaauuaacagagaa

SEQ ID NO: 551512 - RNA, 22 nt, Human
ucccaagacuauguucugugug

SEQ ID NO: 551513 - RNA, 22 nt, Human
uucaagaaagaguggcuauucc

SEQ ID NO: 551514 - RNA, 22 nt, Human
cuucugggagagcuuuugcuuc

SEQ ID NO: 551515 - RNA, 22 nt, Human
aagugauuuuccuacuugcuaa

SEQ ID NO: 551516 - RNA, 22 nt, Human
uggcugagaaaaugguuuuagg

SEQ ID NO: 551517 - RNA, 22 nt, Human
agaaaauauucauugagaggcu

SEQ ID NO: 551518 - RNA, 22 nt, Human
cuucuuaaauuggauugcuauu

SEQ ID NO: 551519 - RNA, 22 nt, Human
auuaauuuccaggcacugugcu

SEQ ID NO: 551520 - RNA, 22 nt, Human
augggcaguguauuggaaggaa

SEQ ID NO: 551521 - RNA, 22 nt, Human
caguaugucuacuggacaaagu

SEQ ID NO: 551522 - RNA, 22 nt, Human
caauguuuucaacugacaagua

SEQ ID NO: 551523 - RNA, 22 nt, Human
uacauacaagcauucaauuuua

SEQ ID NO: 551524 - RNA, 22 nt, Human
ucaauuucauucuauuaguuaa

SEQ ID NO: 551525 - RNA, 22 nt, Human
uggcccugugacugaguucuag

SEQ ID NO: 551526 - RNA, 22 nt, Human
cucaggaggugguagaggcccu

SEQ ID NO: 551527 - RNA, 22 nt, Human
uauugcaaguggcauaaaauuu

SEQ ID NO: 551528 - RNA, 22 nt, Human
aauuauuuaacuccuuuggaga

SEQ ID NO: 551529 - RNA, 22 nt, Human
ccagagucuuuauauuccugaa

SEQ ID NO: 551530 - RNA, 22 nt, Human
guuuucaugucuauugggcaua

SEQ ID NO: 551531 - RNA, 22 nt, Human
agcagcucaaagccugcaagga

SEQ ID NO: 551532 - RNA, 22 nt, Human
cggagccugcuuguugcagcug

SEQ ID NO: 551533 - RNA, 22 nt, Human
gaaaguauuagccuagaaguca

SEQ ID NO: 551534 - RNA, 22 nt, Human
ucugucacuauuggccagaaca

SEQ ID NO: 551535 - RNA, 22 nt, Human
uaacaguguggacuugagaucu

SEQ ID NO: 551536 - RNA, 22 nt, Human
cuguuguuccgggagcugcagc

SEQ ID NO: 551537 - RNA, 22 nt, Human
gccauggcccauaccaggugca

SEQ ID NO: 551538 - RNA, 22 nt, Human
gggauggcuuuguggcugacuc

SEQ ID NO: 551539 - RNA, 17 nt, Human
ugcccugugccuggugu

SEQ ID NO: 551540 - RNA, 20 nt, Human
ugccuuuuauaccuuuaaac

SEQ ID NO: 551541 - RNA, 22 nt, Human
uaacaugucccugauucuuugu

SEQ ID NO: 551542 - RNA, 22 nt, Human
aacauacauauuucagugucca

SEQ ID NO: 551543 - RNA, 22 nt, Human
caaaugcuaugauuuugaguuu

SEQ ID NO: 551544 - RNA, 22 nt, Human
cagaugaggcaaccucauugcu

SEQ ID NO: 551545 - RNA, 22 nt, Human
uucaacaaauauuuauugagcu

SEQ ID NO: 551546 - RNA, 22 nt, Human
uugcuuugguagcagcuauaga

SEQ ID NO: 551547 - RNA, 22 nt, Human
ucaggagcagcaugggugagag

SEQ ID NO: 551548 - RNA, 22 nt, Human
gcugcagcccggcgcgccugag

SEQ ID NO: 551549 - RNA, 22 nt, Human
ggcugccucugaugugcagacg

SEQ ID NO: 551550 - RNA, 22 nt, Human
ugggugcaugugagcacgugca

SEQ ID NO: 551551 - RNA, 22 nt, Human
ggcugagcacuuuaggcaggag

SEQ ID NO: 551552 - RNA, 22 nt, Human
aauaagauccugaagauauguu

SEQ ID NO: 551553 - RNA, 22 nt, Human
acacauuucuaaauuuuuaccg

SEQ ID NO: 551554 - RNA, 22 nt, Human
ggcucugaccucccaggcaguu

SEQ ID NO: 551555 - RNA, 22 nt, Human
uggagagguuuaaacaaaaguu

SEQ ID NO: 551556 - RNA, 22 nt, Human
gggcugcuuuuuucuuagcaga

SEQ ID NO: 551557 - RNA, 22 nt, Human
cugggccugucagggcuuuuug

SEQ ID NO: 551558 - RNA, 22 nt, Human
gccagcaguccugcugugugcc

SEQ ID NO: 551559 - RNA, 22 nt, Human
uccuggcuaguuuugcugaaau

SEQ ID NO: 551560 - RNA, 22 nt, Human
cagccagagaaagggcacugcc

SEQ ID NO: 551561 - RNA, 22 nt, Human
augcaagacccagaaaucauua

SEQ ID NO: 551562 - RNA, 22 nt, Human
ucucagguuucaagacaggaaa

SEQ ID NO: 551563 - RNA, 17 nt, Human
aggccucccuccaggcc

SEQ ID NO: 551564 - RNA, 23 nt, Human
uccagcagagccuuccaggaggg

SEQ ID NO: 551565 - RNA, 22 nt, Human
uguuauauaacuuacaaccugu

SEQ ID NO: 551566 - RNA, 22 nt, Human
uguggccucaaggcugcccuca

SEQ ID NO: 551567 - RNA, 22 nt, Human
auuugcauuuagaaagaucacu

SEQ ID NO: 551568 - RNA, 22 nt, Human
auacagauguuaaagcaauuuc

SEQ ID NO: 551569 - RNA, 18 nt, Human
gggcaucauucacaaagu

SEQ ID NO: 551570 - RNA, 22 nt, Human
uugcuuccucgaggccagcgug

SEQ ID NO: 551571 - RNA, 22 nt, Human
aaagauuucagaagccugugcc

SEQ ID NO: 551572 - RNA, 21 nt, Human
gaguuaauuugaccccugccu

SEQ ID NO: 551573 - RNA, 22 nt, Human
ucuugcacuucaugaauauguu

SEQ ID NO: 551574 - RNA, 22 nt, Human
ggccuggccuccagaugugggc

SEQ ID NO: 551575 - RNA, 22 nt, Human
cugaguggaacauaggaugaua

SEQ ID NO: 551576 - RNA, 22 nt, Human
cacugccuccccaggcuccaca

SEQ ID NO: 551577 - RNA, 20 nt, Human
uuucagauuuacagaaaugu

SEQ ID NO: 551578 - RNA, 21 nt, Human
gacaaagugaagcaggcagga

SEQ ID NO: 551579 - RNA, 22 nt, Human
augcugaggacaaagagaucaa

SEQ ID NO: 551580 - RNA, 22 nt, Human
auaugugugaugcauggacuaa

SEQ ID NO: 551581 - RNA, 22 nt, Human
uaaauguauaggcacuaaaccu

SEQ ID NO: 551582 - RNA, 22 nt, Human
aggagcaaaugaugagacagca

SEQ ID NO: 551583 - RNA, 22 nt, Human
uuuaauuuucugggcccagcag

SEQ ID NO: 551584 - RNA, 22 nt, Human
uuccauauuagacuaugugggg

SEQ ID NO: 551585 - RNA, 22 nt, Human
accagggcccgggagagcucuc

SEQ ID NO: 551586 - RNA, 22 nt, Human
ggcuuccccacaaagcacacaa

SEQ ID NO: 551587 - RNA, 22 nt, Human
agaugcagaaaaacuaagugau

SEQ ID NO: 551588 - RNA, 22 nt, Human
gcuguauuccugcacuguauag

SEQ ID NO: 551589 - RNA, 22 nt, Human
uaacauuccucaaaguuuucag

SEQ ID NO: 551590 - RNA, 22 nt, Human
agggugcagucacaggaaaugu

SEQ ID NO: 551591 - RNA, 22 nt, Human
cagcauuuuccauagaaagaag

SEQ ID NO: 551592 - RNA, 17 nt, Human
aaacagugaguguuaug

SEQ ID NO: 551593 - RNA, 22 nt, Human
ccuggcagacagcacugaagcu

SEQ ID NO: 551594 - RNA, 22 nt, Human
cagagguauugcaaaagccuag

SEQ ID NO: 551595 - RNA, 22 nt, Human
auauuaggaguuaaauguauua

SEQ ID NO: 551596 - RNA, 22 nt, Human
aguguuauuuauuguuucauaa

SEQ ID NO: 551597 - RNA, 22 nt, Human
acaguguucuugauauuacagu

SEQ ID NO: 551598 - RNA, 22 nt, Human
uggacucagugcugccauuccc

SEQ ID NO: 551599 - RNA, 22 nt, Human
uuugcauuuuagauuuaggccu

SEQ ID NO: 551600 - RNA, 18 nt, Human
agagaugggaguuggaaa

SEQ ID NO: 551601 - RNA, 22 nt, Human
uaggaaaaauacagaauuauau

SEQ ID NO: 551602 - RNA, 22 nt, Human
caggauccccaggucgccgucc

SEQ ID NO: 551603 - RNA, 22 nt, Human
aguuuuaugcaguguucugaua

SEQ ID NO: 551604 - RNA, 19 nt, Human
cugagcagcggcagcacuu

SEQ ID NO: 551605 - RNA, 22 nt, Human
ugggccugauucuugaauccug

SEQ ID NO: 551606 - RNA, 22 nt, Human
gugcauuuggugacucucaccc

SEQ ID NO: 551607 - RNA, 22 nt, Human
ugagcaggauucgccucuugca

SEQ ID NO: 551608 - RNA, 22 nt, Human
ugucccaguucccaggguugcu

SEQ ID NO: 551609 - RNA, 22 nt, Human
uccaguggugguuugaagggca

SEQ ID NO: 551610 - RNA, 22 nt, Human
ucaaaggaauuugauuuugaug

SEQ ID NO: 551611 - RNA, 22 nt, Human
cucagacuuucaggguaggcca

SEQ ID NO: 551612 - RNA, 22 nt, Human
gaacauuuauauuagauagcua

SEQ ID NO: 551613 - RNA, 22 nt, Human
agccuggauccuaggcucagcu

SEQ ID NO: 551614 - RNA, 22 nt, Human
agcuggaggauaacucacuucu

SEQ ID NO: 551615 - RNA, 22 nt, Human
auggcaggcccagguguucauu

SEQ ID NO: 551616 - RNA, 22 nt, Human
uucauuaguucugaagaugucu

SEQ ID NO: 551617 - RNA, 20 nt, Human
augcaaacucacaaaauacc

SEQ ID NO: 551618 - RNA, 22 nt, Human
ugaagcaggaucguuugcuuca

SEQ ID NO: 551619 - RNA, 22 nt, Human
uuucacagcuagugagcuucua

SEQ ID NO: 551620 - RNA, 22 nt, Human
uaguccauuuucacacugcuga

SEQ ID NO: 551621 - RNA, 22 nt, Human
agucuuuagagucuuaguguuu

SEQ ID NO: 551622 - RNA, 22 nt, Human
agaaucuaaguacacagacaga

SEQ ID NO: 551623 - RNA, 22 nt, Human
cagcugccacaggacuuucuga

SEQ ID NO: 551624 - RNA, 22 nt, Human
guggaggguuugcaaugugcag

SEQ ID NO: 551625 - RNA, 22 nt, Human
aauguucagaggacaauauaaa

SEQ ID NO: 551626 - RNA, 22 nt, Human
aggcucagccccugggaggaga

SEQ ID NO: 551627 - RNA, 22 nt, Human
aaagcaaacagaaccccaagcu

SEQ ID NO: 551628 - RNA, 22 nt, Human
guccucugucccuggggcacgg

SEQ ID NO: 551629 - RNA, 22 nt, Human
acuuugaaggggaacauuuuaa

SEQ ID NO: 551630 - RNA, 22 nt, Human
uaccucaugcuguacagcacgu

SEQ ID NO: 551631 - RNA, 22 nt, Human
aacugaaacggugaucuuuuaa

SEQ ID NO: 551632 - RNA, 22 nt, Human
agggcagcagcggcccaggccu

SEQ ID NO: 551633 - RNA, 18 nt, Human
ggaaaccacaggguucug

SEQ ID NO: 551634 - RNA, 22 nt, Human
cuccuuccugccccagugauaa

SEQ ID NO: 551635 - RNA, 22 nt, Human
ccugcucagccccagcucaccc

SEQ ID NO: 551636 - RNA, 22 nt, Human
uugcagcuucgagucuaucugu

SEQ ID NO: 551637 - RNA, 22 nt, Human
gaauucuaaccauuaagccaag

SEQ ID NO: 551638 - RNA, 21 nt, Human
caagccagaccaauagcagcc

SEQ ID NO: 551639 - RNA, 22 nt, Human
gacccaggguauccagagcugc

SEQ ID NO: 551640 - RNA, 22 nt, Human
aggccugaaggaagaugagcug

SEQ ID NO: 551641 - RNA, 20 nt, Human
gagauuuccaaucaugccca

SEQ ID NO: 551642 - RNA, 23 nt, Human
cccuuuaagauuugaauagucag

SEQ ID NO: 551643 - RNA, 22 nt, Human
ucuuugaaguaucuuaaauggu

SEQ ID NO: 551644 - RNA, 21 nt, Human
uggcagggguaguaguacagc

SEQ ID NO: 551645 - RNA, 22 nt, Human
acaggcugcugggcuccgugcu

SEQ ID NO: 551646 - RNA, 22 nt, Human
cuugaaagucacaugcagcccu

SEQ ID NO: 551647 - RNA, 22 nt, Human
uauuucuguuuauuuguacauc

SEQ ID NO: 551648 - RNA, 22 nt, Human
cugccugcacugccuggcucca

SEQ ID NO: 551649 - RNA, 22 nt, Human
aggcagcaaagaaaugaugcug

SEQ ID NO: 551650 - RNA, 22 nt, Human
gcacagccacguaaugugguca

SEQ ID NO: 551651 - RNA, 22 nt, Human
gaggguggaaaggguguaccug

SEQ ID NO: 551652 - RNA, 22 nt, Human
augggcuggccuuucccgcucu

SEQ ID NO: 551653 - RNA, 22 nt, Human
cagagccaacgccaccugccca

SEQ ID NO: 551654 - RNA, 22 nt, Human
aacugcuuuuugaucucaggag

SEQ ID NO: 551655 - RNA, 20 nt, Human
caucagugccugacaggucc

SEQ ID NO: 551656 - RNA, 22 nt, Human
caagagcugcaaauagcgugac

SEQ ID NO: 551657 - RNA, 22 nt, Human
cagagcacacaugcauagagug

SEQ ID NO: 551658 - RNA, 22 nt, Human
uccaaacgggagccaaaugagc

SEQ ID NO: 551659 - RNA, 22 nt, Human
caguggagugggacuggucuga

SEQ ID NO: 551660 - RNA, 22 nt, Human
gggcucugggauucagagcaag

SEQ ID NO: 551661 - RNA, 22 nt, Human
uucuugauuucaugcaguuaag

SEQ ID NO: 551662 - RNA, 22 nt, Human
uggcauuuuguucaguauaugg

SEQ ID NO: 551663 - RNA, 22 nt, Human
aggaagcuccaugaaggcagag

SEQ ID NO: 551664 - RNA, 22 nt, Human
acuauaaccuguuagaauagau

SEQ ID NO: 551665 - RNA, 22 nt, Human
ccucuuugugccugcaggcugc

SEQ ID NO: 551666 - RNA, 22 nt, Human
ucaaucacguguuccauguucu

SEQ ID NO: 551667 - RNA, 22 nt, Human
gaaaauuuagaacugaacuucu

SEQ ID NO: 551668 - RNA, 22 nt, Human
auccugggcagugugucacucu

SEQ ID NO: 551669 - RNA, 22 nt, Human
ccaggccucuggcugcuuaguc

SEQ ID NO: 551670 - RNA, 22 nt, Human
acacucugcucugagcuucagg

SEQ ID NO: 551671 - RNA, 23 nt, Human
gcccaugcuguugggcccgagca

SEQ ID NO: 551672 - RNA, 22 nt, Human
aaggcacugcuuugcugcgccc

SEQ ID NO: 551673 - RNA, 22 nt, Human
guugugaauagugccgcaauaa

SEQ ID NO: 551674 - RNA, 22 nt, Human
ucaaaguuacuugugguuuucu

SEQ ID NO: 551675 - RNA, 22 nt, Human
gccagagcugagacacgagucc

SEQ ID NO: 551676 - RNA, 20 nt, Human
uauuucacucuccagauggc

SEQ ID NO: 551677 - RNA, 22 nt, Human
accagggcuuacagcaguagcu

SEQ ID NO: 551678 - RNA, 22 nt, Human
ggaugcccacuaucugcuggcu

SEQ ID NO: 551679 - RNA, 22 nt, Human
ugcagguguagaguugggcucc

SEQ ID NO: 551680 - RNA, 22 nt, Human
guuuauaauccaacucugcucc

SEQ ID NO: 551681 - RNA, 20 nt, Human
aggcucugccugcaggccca

SEQ ID NO: 551682 - RNA, 22 nt, Human
uauuugucacugcacuugaaau

SEQ ID NO: 551683 - RNA, 22 nt, Human
aaaaccuucuagacuuuauauu

SEQ ID NO: 551684 - RNA, 22 nt, Human
uugaucaucuaagaguaauagu

SEQ ID NO: 551685 - RNA, 22 nt, Human
gagaaugggaaugaaaguagca

SEQ ID NO: 551686 - RNA, 19 nt, Human
gccugccuggguuucugag

SEQ ID NO: 551687 - RNA, 22 nt, Human
agggcagacuaggauggaagug

SEQ ID NO: 551688 - RNA, 22 nt, Human
ugaggcucagaagugccaagug

SEQ ID NO: 551689 - RNA, 22 nt, Human
guugugcagaagugccucagua

SEQ ID NO: 551690 - RNA, 22 nt, Human
uuguuacagcacuuaaccuuuu

SEQ ID NO: 551691 - RNA, 22 nt, Human
auuucucacucacaguccaugu

SEQ ID NO: 551692 - RNA, 22 nt, Human
uaggaaccuacugugguuuuaa

SEQ ID NO: 551693 - RNA, 18 nt, Human
agcagguggauuuauugg

SEQ ID NO: 551694 - RNA, 22 nt, Human
uguucauuauucuucaucugcc

SEQ ID NO: 551695 - RNA, 22 nt, Human
agggcucauaauuccugacuuc

SEQ ID NO: 551696 - RNA, 19 nt, Human
gcacacauacacccuuugg

SEQ ID NO: 551697 - RNA, 22 nt, Human
acaaagauguuuaaagcauuua

SEQ ID NO: 551698 - RNA, 22 nt, Human
cccccuggcaggcuggccucuc

SEQ ID NO: 551699 - RNA, 22 nt, Human
agcgggugcugugucagcccuc

SEQ ID NO: 551700 - RNA, 22 nt, Human
cucuguuucucagccuauuucc

SEQ ID NO: 551701 - RNA, 22 nt, Human
ccugggcucaagugauccuccu

SEQ ID NO: 551702 - RNA, 22 nt, Human
aacaguuacccuuaagaucuuu

SEQ ID NO: 551703 - RNA, 22 nt, Human
ucuggcuccugaguccaugcuc

SEQ ID NO: 551704 - RNA, 22 nt, Human
agggcucuguccccagaggccc

SEQ ID NO: 551705 - RNA, 22 nt, Human
agcugucagugcugugccugua

SEQ ID NO: 551706 - RNA, 22 nt, Human
gagauuucuuuugaugccuguc

SEQ ID NO: 551707 - RNA, 22 nt, Human
uguaggccuauguccagcaauu

SEQ ID NO: 551708 - RNA, 22 nt, Human
agcuggcccucgagagccaauu

SEQ ID NO: 551709 - RNA, 22 nt, Human
ugguuuaccccuguccuauauc

SEQ ID NO: 551710 - RNA, 22 nt, Human
ggucccagaauugguuagcaca

SEQ ID NO: 551711 - RNA, 22 nt, Human
ugccuggcaacuguggugggcu

SEQ ID NO: 551712 - RNA, 22 nt, Human
caaaugcauagaaagaugaaac

SEQ ID NO: 551713 - RNA, 22 nt, Human
ccugcaggggagagacuucuag

SEQ ID NO: 551714 - RNA, 22 nt, Human
agcugaggcucugagagggaag

SEQ ID NO: 551715 - RNA, 22 nt, Human
gaaggcacugaacuccuucugg

SEQ ID NO: 551716 - RNA, 21 nt, Human
agugaaauugcaucagaggga

SEQ ID NO: 551717 - RNA, 22 nt, Human
gccugcagcaugcuaggucuug

SEQ ID NO: 551718 - RNA, 22 nt, Human
uccgagaagcauaaagcaggaa

SEQ ID NO: 551719 - RNA, 22 nt, Human
ggcucaggaccugggauugcca

SEQ ID NO: 551720 - RNA, 22 nt, Human
cccuucccuucugggagaucca

SEQ ID NO: 551721 - RNA, 22 nt, Human
ugggcuccuugggagcaaguga

SEQ ID NO: 551722 - RNA, 22 nt, Human
ugcauaaacagauacuucaugu

SEQ ID NO: 551723 - RNA, 22 nt, Human
ugggcucugugccagguuggug

SEQ ID NO: 551724 - RNA, 22 nt, Human
ucagagguaguagcagaguuga

SEQ ID NO: 551725 - RNA, 22 nt, Human
ggcaagaaggcuucagguagcu

SEQ ID NO: 551726 - RNA, 22 nt, Human
agggcaugcuggaggagagaca

SEQ ID NO: 551727 - RNA, 22 nt, Human
gggagcugaauggcaauggaga

SEQ ID NO: 551728 - RNA, 22 nt, Human
agauggggcugaaaguuccaau

SEQ ID NO: 551729 - RNA, 22 nt, Human
ggaguggccucuccugugcagg

SEQ ID NO: 551730 - RNA, 22 nt, Human
auuauuaaagcuuaggucuuau

SEQ ID NO: 551731 - RNA, 22 nt, Human
uggcuuggcuaagaucuaagcu

SEQ ID NO: 551732 - RNA, 21 nt, Human
aaguggagaagaaaagcugga

SEQ ID NO: 551733 - RNA, 22 nt, Human
aagauacacguuguauugaaua

SEQ ID NO: 551734 - RNA, 22 nt, Human
cucugagaugcuugaagaggau

SEQ ID NO: 551735 - RNA, 22 nt, Human
guccucuuagccacuuaauuau

SEQ ID NO: 551736 - RNA, 22 nt, Human
gucauuccuuauguugauucag

SEQ ID NO: 551737 - RNA, 22 nt, Human
ccuggcaggcuggggacagugc

SEQ ID NO: 551738 - RNA, 22 nt, Human
gcugccuguugaagggucugug

SEQ ID NO: 551739 - RNA, 22 nt, Human
gagggcugcaaugagacagaga

SEQ ID NO: 551740 - RNA, 22 nt, Human
ugcccauggcaggauuucugaa

SEQ ID NO: 551741 - RNA, 22 nt, Human
uucuucuugucugcccucacau

SEQ ID NO: 551742 - RNA, 22 nt, Human
ccucuggggguccucagagucu

SEQ ID NO: 551743 - RNA, 22 nt, Human
ucauacaucuguccuggagcuc

SEQ ID NO: 551744 - RNA, 22 nt, Human
cuuucuucaaccucauucugca

SEQ ID NO: 551745 - RNA, 22 nt, Human
agcacugugauuuauaacauuu

SEQ ID NO: 551746 - RNA, 22 nt, Human
ucucuuaauucagaggcaguua

SEQ ID NO: 551747 - RNA, 22 nt, Human
uuuacauugcauuagguauuau

SEQ ID NO: 551748 - RNA, 22 nt, Human
gggccuguguguucaggagccu

SEQ ID NO: 551749 - RNA, 22 nt, Human
uacauguaauuuucauaguaag

SEQ ID NO: 551750 - RNA, 22 nt, Human
ggaguucacugugcaggcucug

SEQ ID NO: 551751 - RNA, 22 nt, Human
ucaggaucggccuuuuuuuaag

SEQ ID NO: 551752 - RNA, 22 nt, Human
ucagagaugcagugccaccuac

SEQ ID NO: 551753 - RNA, 22 nt, Human
ucucccaggugggugccuggag

SEQ ID NO: 551754 - RNA, 22 nt, Human
auuuccaguccuaaugaucugg

SEQ ID NO: 551755 - RNA, 22 nt, Human
uccaggagagguguggggacug

SEQ ID NO: 551756 - RNA, 22 nt, Human
auuuaugauuagccuauuguug

SEQ ID NO: 551757 - RNA, 22 nt, Human
ucaaguaugacaucaaguuucu

SEQ ID NO: 551758 - RNA, 19 nt, Human
ccuuccccuucagccucug

SEQ ID NO: 551759 - RNA, 22 nt, Human
auuucacagcugucaguguuac

SEQ ID NO: 551760 - RNA, 22 nt, Human
ucccaagagggguuauuaugcc

SEQ ID NO: 551761 - RNA, 22 nt, Human
uauuacagcuuugauuaucugg

SEQ ID NO: 551762 - RNA, 22 nt, Human
gccuggagaagauggaacuagc

SEQ ID NO: 551763 - RNA, 22 nt, Human
ggcagagacaccgaaugacucu

SEQ ID NO: 551764 - RNA, 22 nt, Human
cugggcugucaguuuuguuuua

SEQ ID NO: 551765 - RNA, 22 nt, Human
augaccccuaaaauuuacuguc

SEQ ID NO: 551766 - RNA, 22 nt, Human
uuucaagucaguagcuaaucau

SEQ ID NO: 551767 - RNA, 22 nt, Human
guguccucuuauugcucuuggc

SEQ ID NO: 551768 - RNA, 18 nt, Human
ugucucugaauuccagug

SEQ ID NO: 551769 - RNA, 22 nt, Human
ggcuccugaaagacuaugggaa

SEQ ID NO: 551770 - RNA, 22 nt, Human
caguuucuacgaaggucaaccc

SEQ ID NO: 551771 - RNA, 22 nt, Human
ucagguguuagaagaaauuuca

SEQ ID NO: 551772 - RNA, 22 nt, Human
guccaggaaucaaaagauggaa

SEQ ID NO: 551773 - RNA, 22 nt, Human
uguggcagcugcugcaggagcu

SEQ ID NO: 551774 - RNA, 22 nt, Human
agccaagcaccacuggcacucg

SEQ ID NO: 551775 - RNA, 22 nt, Human
cagcaaucgggugauaugcaau

SEQ ID NO: 551776 - RNA, 22 nt, Human
gccaaaguaccuagcccucugc

SEQ ID NO: 551777 - RNA, 22 nt, Human
aggcaguguguagcuggaagag

SEQ ID NO: 551778 - RNA, 22 nt, Human
uuuaucaucuuguuuuuaaagc

SEQ ID NO: 551779 - RNA, 22 nt, Human
uucuuuugggaauuacguaugc

SEQ ID NO: 551780 - RNA, 22 nt, Human
acugccuggccuggccucacug

SEQ ID NO: 551781 - RNA, 22 nt, Human
acuucaugaacauguggccugu

SEQ ID NO: 551782 - RNA, 22 nt, Human
uaaacaucugucauguguuuau

SEQ ID NO: 551783 - RNA, 23 nt, Human
uucaacauuuauugagcguccgu

SEQ ID NO: 551784 - RNA, 22 nt, Human
cuagaaauacaggcacgugcca

SEQ ID NO: 551785 - RNA, 22 nt, Human
cucugugagggucuguacagaa

SEQ ID NO: 551786 - RNA, 18 nt, Human
gagcccugagucugcaca

SEQ ID NO: 551787 - RNA, 22 nt, Human
ucugggcuggugcucaugaauu

SEQ ID NO: 551788 - RNA, 22 nt, Human
uagcagagcgggugcgaggcgg

SEQ ID NO: 551789 - RNA, 22 nt, Human
aggacccugaggucuccuguga

SEQ ID NO: 551790 - RNA, 22 nt, Human
uuuguuagagugugggaggcug

SEQ ID NO: 551791 - RNA, 22 nt, Human
ucagcuuucuauguugcuaaac

SEQ ID NO: 551792 - RNA, 22 nt, Human
acuuggcaaguaucuauaaagu

SEQ ID NO: 551793 - RNA, 22 nt, Human
auuuuuccaauuaggauaaaga

SEQ ID NO: 551794 - RNA, 22 nt, Human
cccuccagagcuugaccugcug

SEQ ID NO: 551795 - RNA, 22 nt, Human
uggagaagauuggucaccauuc

SEQ ID NO: 551796 - RNA, 22 nt, Human
gcaacaaguguaaacaugcauu

SEQ ID NO: 551797 - RNA, 22 nt, Human
agccugcaggaugggcagcacc

SEQ ID NO: 551798 - RNA, 22 nt, Human
ccugggcucugucagaauuggg

SEQ ID NO: 551799 - RNA, 22 nt, Human
aagagucagcuucuguaugggu

SEQ ID NO: 551800 - RNA, 22 nt, Human
uacacaucucugucaguaguga

SEQ ID NO: 551801 - RNA, 22 nt, Human
ccagaggaugcuggucagccuc

SEQ ID NO: 551802 - RNA, 22 nt, Human
ucacauuuucuacuacuguacg

SEQ ID NO: 551803 - RNA, 18 nt, Human
aguuuuuaggaagaaaug

SEQ ID NO: 551804 - RNA, 19 nt, Human
aggcaggugcagagguccc

SEQ ID NO: 551805 - RNA, 22 nt, Human
cagguccuggcaucaggcaggu

SEQ ID NO: 551806 - RNA, 22 nt, Human
ugcugggcuaggguggagcucu

SEQ ID NO: 551807 - RNA, 21 nt, Human
ucacaugcccauuacuggagc

SEQ ID NO: 551808 - RNA, 22 nt, Human
cagcuguggagauggggugcau

SEQ ID NO: 551809 - RNA, 22 nt, Human
agugcacagcgugauguauugg

SEQ ID NO: 551810 - RNA, 22 nt, Human
guaugaaggcgagagcccacua

SEQ ID NO: 551811 - RNA, 22 nt, Human
uauguacacauacacuuguaau

SEQ ID NO: 551812 - RNA, 22 nt, Human
caaagacacgggaaacaacguu

SEQ ID NO: 551813 - RNA, 22 nt, Human
gaagcagaacccacuccccaac

SEQ ID NO: 551814 - RNA, 20 nt, Human
gugccuggagaagaggcugu

SEQ ID NO: 551815 - RNA, 22 nt, Human
uggggccagguggcugcagguc

SEQ ID NO: 551816 - RNA, 17 nt, Human
ucuucgggcgcuaggua

SEQ ID NO: 551817 - RNA, 22 nt, Human
aguuaaagucugaaauagagaa

SEQ ID NO: 551818 - RNA, 22 nt, Human
uucccaguauuaccuucaggaa

SEQ ID NO: 551819 - RNA, 22 nt, Human
auuucucuuagcaagacauuac

SEQ ID NO: 551820 - RNA, 22 nt, Human
cuggccuguccugacccagccu

SEQ ID NO: 551821 - RNA, 22 nt, Human
uggaaggagacugggaagugug

SEQ ID NO: 551822 - RNA, 22 nt, Human
ugggccugggucuuugcugcca

SEQ ID NO: 551823 - RNA, 18 nt, Human
uggugaaggguggaggag

SEQ ID NO: 551824 - RNA, 22 nt, Human
auguuacacauaggcauaaaug

SEQ ID NO: 551825 - RNA, 22 nt, Human
cuggccagacuacacaugugug

SEQ ID NO: 551826 - RNA, 22 nt, Human
ugugagacguguuagaacagug

SEQ ID NO: 551827 - RNA, 22 nt, Human
uccugcagcugcagaccugggg

SEQ ID NO: 551828 - RNA, 22 nt, Human
cagcuuugugcaaugcagucuc

SEQ ID NO: 551829 - RNA, 22 nt, Human
ggcugcagaggcgaucugaggu

SEQ ID NO: 551830 - RNA, 22 nt, Human
uucacagucacccuucuccaug

SEQ ID NO: 551831 - RNA, 22 nt, Human
ucuggccuauuucugucagauc

SEQ ID NO: 551832 - RNA, 22 nt, Human
uaugaagaaaccuauccucuag

SEQ ID NO: 551833 - RNA, 22 nt, Human
ggcaagcauaaccuguacagcc

SEQ ID NO: 551834 - RNA, 22 nt, Human
ucauuuuuagcgcgcaaaaguu

SEQ ID NO: 551835 - RNA, 22 nt, Human
uacagaguggugagaucuuuug

SEQ ID NO: 551836 - RNA, 22 nt, Human
ccuggaaggugaugguacagca

SEQ ID NO: 551837 - RNA, 22 nt, Human
ccugaccuaccugaagucuaca

SEQ ID NO: 551838 - RNA, 22 nt, Human
ucugcgcugccuugauccuugg

SEQ ID NO: 551839 - RNA, 22 nt, Human
ucacagaauagcacuguaagcg

SEQ ID NO: 551840 - RNA, 22 nt, Human
gggcugacaccacccaggcgca

SEQ ID NO: 551841 - RNA, 22 nt, Human
uaguuucauaugcaaaauagua

SEQ ID NO: 551842 - RNA, 22 nt, Human
uacaaguuucaaagagaucaug

SEQ ID NO: 551843 - RNA, 22 nt, Human
gcacugggaaugugagcagcug

SEQ ID NO: 551844 - RNA, 22 nt, Human
aucagaauacuaucaacaguga

SEQ ID NO: 551845 - RNA, 22 nt, Human
guugaaaguagaugcuauuugg

SEQ ID NO: 551846 - RNA, 22 nt, Human
caaaggagguaaugggugugag

SEQ ID NO: 551847 - RNA, 22 nt, Human
cacauugcagcuucuuuuggcu

SEQ ID NO: 551848 - RNA, 22 nt, Human
ucccaggaaaacacucgaggac

SEQ ID NO: 551849 - RNA, 20 nt, Human
cuuccacacaagaagcacag

SEQ ID NO: 551850 - RNA, 23 nt, Human
aguaugaauucauuguuuuaguu

SEQ ID NO: 551851 - RNA, 22 nt, Human
gcuggccugaccagccacaggc

SEQ ID NO: 551852 - RNA, 22 nt, Human
gcaccuggacagugacccuagc

SEQ ID NO: 551853 - RNA, 22 nt, Human
cuugcuuuaucugguuucucau

SEQ ID NO: 551854 - RNA, 22 nt, Human
agcacauucuugccuuaaccuc

SEQ ID NO: 551855 - RNA, 22 nt, Human
agaaugcuccagagcugaaaga

SEQ ID NO: 551856 - RNA, 23 nt, Human
uaugugcauauguguaagaauac

SEQ ID NO: 551857 - RNA, 22 nt, Human
ugggcugcccaagguggccaug

SEQ ID NO: 551858 - RNA, 22 nt, Human
uaaaguucuggugagagguaag

SEQ ID NO: 551859 - RNA, 22 nt, Human
uaacacuaagaaucuaaauuua

SEQ ID NO: 551860 - RNA, 22 nt, Human
ggaggggaugguuugacccugg

SEQ ID NO: 551861 - RNA, 22 nt, Human
acacaagugaauauuuuaagga

SEQ ID NO: 551862 - RNA, 22 nt, Human
cuuucuucaucaagugccacgu

SEQ ID NO: 551863 - RNA, 22 nt, Human
ccuagagucucucugcaggagu

SEQ ID NO: 551864 - RNA, 22 nt, Human
acauuucugcuagaauagguga

SEQ ID NO: 551865 - RNA, 22 nt, Human
uuucuucucgacaccuuauccc

SEQ ID NO: 551866 - RNA, 22 nt, Human
gaagagaagcaucaauagguaa

SEQ ID NO: 551867 - RNA, 22 nt, Human
acugagaggugauagugacauu

SEQ ID NO: 551868 - RNA, 22 nt, Human
uaugcaguguacgauguuuagu

SEQ ID NO: 551869 - RNA, 22 nt, Human
ggagacucucauugucaagcuu

SEQ ID NO: 551870 - RNA, 22 nt, Human
gaagucuggcugacgagaguua

SEQ ID NO: 551871 - RNA, 22 nt, Human
ggaaguauuuguuuuugcaucc

SEQ ID NO: 551872 - RNA, 22 nt, Human
aggcccugggcaguucuguagc

SEQ ID NO: 551873 - RNA, 22 nt, Human
ugcagaggaccauuguccugga

SEQ ID NO: 551874 - RNA, 22 nt, Human
accugaggccuccccagcagac

SEQ ID NO: 551875 - RNA, 22 nt, Human
cuggagagggagcccuggcagu

SEQ ID NO: 551876 - RNA, 22 nt, Human
agccugagccccauccagcuga

SEQ ID NO: 551877 - RNA, 22 nt, Human
uugacagcuauuuugcuuugau

SEQ ID NO: 551878 - RNA, 22 nt, Human
aauuaggcaaauuaauuucucu

SEQ ID NO: 551879 - RNA, 22 nt, Human
aaagcuggccucucaggcuuua

SEQ ID NO: 551880 - RNA, 22 nt, Human
uuaaguccuugguaauuuucuu

SEQ ID NO: 551881 - RNA, 21 nt, Human
uuauuucacauggacuuccag

SEQ ID NO: 551882 - RNA, 22 nt, Human
cagggacaugacuggucucugu

SEQ ID NO: 551883 - RNA, 20 nt, Human
gcugaggucauuaugccuca

SEQ ID NO: 551884 - RNA, 22 nt, Human
cuggccugggagcugcuagcgu

SEQ ID NO: 551885 - RNA, 22 nt, Human
agaguuaagacguacaugagug

SEQ ID NO: 551886 - RNA, 20 nt, Human
aagggcagagggaacagacu

SEQ ID NO: 551887 - RNA, 22 nt, Human
cugggagaggaaccucgagggu

SEQ ID NO: 551888 - RNA, 22 nt, Human
aggggcuggcuuaucugagagu

SEQ ID NO: 551889 - RNA, 22 nt, Human
uuccaggaauucagcucucagu

SEQ ID NO: 551890 - RNA, 20 nt, Human
uagauguuuccugucauaaa

SEQ ID NO: 551891 - RNA, 22 nt, Human
ccagggcaggagaaagacucac

SEQ ID NO: 551892 - RNA, 22 nt, Human
uauuucuguaacucagggucug

SEQ ID NO: 551893 - RNA, 22 nt, Human
cagucccaugagcccagaacau

SEQ ID NO: 551894 - RNA, 22 nt, Human
gaggaguguauuccacaccacu

SEQ ID NO: 551895 - RNA, 22 nt, Human
uggcuagcccuuguggggagag

SEQ ID NO: 551896 - RNA, 22 nt, Human
cugauuccaaagccaaagcuau

SEQ ID NO: 551897 - RNA, 22 nt, Human
ugucagagagcaggcaguagaa

SEQ ID NO: 551898 - RNA, 22 nt, Human
ggguggaggagaacaggcccca

SEQ ID NO: 551899 - RNA, 21 nt, Human
agcuccaggcuccugggguuc

SEQ ID NO: 551900 - RNA, 22 nt, Human
uccauugucuuugguccuagcc

SEQ ID NO: 551901 - RNA, 19 nt, Human
gggagcaggaaagcugugg

SEQ ID NO: 551902 - RNA, 23 nt, Human
acuuuucaauuagcuaugcuuaa

SEQ ID NO: 551903 - RNA, 22 nt, Human
aguguuugucccguuagaaaug

SEQ ID NO: 551904 - RNA, 18 nt, Human
aaaaugcaggcgacaugg

SEQ ID NO: 551905 - RNA, 22 nt, Human
caaaaugugagucccaccucaa

SEQ ID NO: 551906 - RNA, 22 nt, Human
gcagagucagguccaaggacug

SEQ ID NO: 551907 - RNA, 22 nt, Human
uugacaagaaucguugccuugg

SEQ ID NO: 551908 - RNA, 20 nt, Human
uccuuuggccuuagagcugu

SEQ ID NO: 551909 - RNA, 22 nt, Human
uaaaggcuuuuacaggagugca

SEQ ID NO: 551910 - RNA, 22 nt, Human
aucugggaauggaagccuucug

SEQ ID NO: 551911 - RNA, 22 nt, Human
gcucuggaagcaucugagagga

SEQ ID NO: 551912 - RNA, 18 nt, Human
uauauuucacacauauuc

SEQ ID NO: 551913 - RNA, 22 nt, Human
auccuugagccaaugacugauu

SEQ ID NO: 551914 - RNA, 22 nt, Human
aggugcagcugguggagucugg

SEQ ID NO: 551915 - RNA, 22 nt, Human
caaggaaaaagcgagcucgggg

SEQ ID NO: 551916 - RNA, 22 nt, Human
uaacauuuaaauuuuucacaua

SEQ ID NO: 551917 - RNA, 22 nt, Human
acuuagaacaggcagaauucca

SEQ ID NO: 551918 - RNA, 22 nt, Human
ugagagcacacagaaauauuuu

SEQ ID NO: 551919 - RNA, 19 nt, Human
agagucugugcucuuccua

SEQ ID NO: 551920 - RNA, 22 nt, Human
ccaucccuccuccaccagcuag

SEQ ID NO: 551921 - RNA, 22 nt, Human
uaagauaauaaguaugucuaug

SEQ ID NO: 551922 - RNA, 22 nt, Human
augagcuguaagguggcuuccu

SEQ ID NO: 551923 - RNA, 22 nt, Human
aagagcuggagcugcuacagga

SEQ ID NO: 551924 - RNA, 22 nt, Human
cuucuugcaauuuucaucuuau

SEQ ID NO: 551925 - RNA, 22 nt, Human
aagcugcccaagacugaagcau

SEQ ID NO: 551926 - RNA, 22 nt, Human
cagcuccccaugguuccugaag

SEQ ID NO: 551927 - RNA, 22 nt, Human
ugcccugugccagacuuccugg

SEQ ID NO: 551928 - RNA, 22 nt, Human
agguucccaggaucugucuggg

SEQ ID NO: 551929 - RNA, 22 nt, Human
aggcugcuucagcugcagggag

SEQ ID NO: 551930 - RNA, 16 nt, Human
aaagaaacaggugucc

SEQ ID NO: 551931 - RNA, 21 nt, Human
cacuggaauuuucugugacau

SEQ ID NO: 551932 - RNA, 18 nt, Human
gguggcaggucagaugcc

SEQ ID NO: 551933 - RNA, 22 nt, Human
ugaaucaaagcugaaguuuuca

SEQ ID NO: 551934 - RNA, 22 nt, Human
uuuaugaaccacucuacaccuu

SEQ ID NO: 551935 - RNA, 22 nt, Human
ccuccugggacaggcuggcaca

SEQ ID NO: 551936 - RNA, 22 nt, Human
ucugcccacagccuccugucca

SEQ ID NO: 551937 - RNA, 22 nt, Human
ugcuuuauucagucucugccau

SEQ ID NO: 551938 - RNA, 22 nt, Human
ugcaggaguccaaucaggagac

SEQ ID NO: 551939 - RNA, 22 nt, Human
ucuucaaaauugauuggagaag

SEQ ID NO: 551940 - RNA, 22 nt, Human
aaggcccuaauagagcacauau

SEQ ID NO: 551941 - RNA, 21 nt, Human
ggagcugcaggagccgaaggc

SEQ ID NO: 551942 - RNA, 22 nt, Human
gguguagcucugugucccacug

SEQ ID NO: 551943 - RNA, 22 nt, Human
acauucuguuuccccaaagaga

SEQ ID NO: 551944 - RNA, 22 nt, Human
uuguaacaaagacacuccaaaa

SEQ ID NO: 551945 - RNA, 22 nt, Human
gaagcccagcaaacugugauca

SEQ ID NO: 551946 - RNA, 22 nt, Human
gagugugguaugcucugaggcu

SEQ ID NO: 551947 - RNA, 19 nt, Human
ugagcaugcgagcugagaa

SEQ ID NO: 551948 - RNA, 22 nt, Human
cccccaggcucugacacaggag

SEQ ID NO: 551949 - RNA, 22 nt, Human
gcagcugcaggcaggcuugcug

SEQ ID NO: 551950 - RNA, 22 nt, Human
cagagcagaagcgguccucaca

SEQ ID NO: 551951 - RNA, 22 nt, Human
aaugcaaagaguugcuuaucaa

SEQ ID NO: 551952 - RNA, 22 nt, Human
uccagccaugcaugacaaucac

SEQ ID NO: 551953 - RNA, 20 nt, Human
acaguggaaauugaugucug

SEQ ID NO: 551954 - RNA, 19 nt, Human
uacauuuguguacacuugu

SEQ ID NO: 551955 - RNA, 22 nt, Human
auacagaauucacuacaguuuc

SEQ ID NO: 551956 - RNA, 22 nt, Human
ccaagauaagagacaagauuua

SEQ ID NO: 551957 - RNA, 20 nt, Human
ugaggcucagagagguugag

SEQ ID NO: 551958 - RNA, 22 nt, Human
uugcaggggaaggagcagagcu

SEQ ID NO: 551959 - RNA, 22 nt, Human
ugcagggaacuuggacagcuag

SEQ ID NO: 551960 - RNA, 22 nt, Human
ugugugugacaaccuaguucag

SEQ ID NO: 551961 - RNA, 22 nt, Human
cccucagucuggcugggaagac

SEQ ID NO: 551962 - RNA, 22 nt, Human
cacacacuggagcaaggagaug

SEQ ID NO: 551963 - RNA, 22 nt, Human
ucagaggcuucuggccagucug

SEQ ID NO: 551964 - RNA, 22 nt, Human
agcucccagucuccucuccaug

SEQ ID NO: 551965 - RNA, 22 nt, Human
gguuucaacuucaaccucucca

SEQ ID NO: 551966 - RNA, 22 nt, Human
ccacugucagaggggcugugcc

SEQ ID NO: 551967 - RNA, 22 nt, Human
augaaggcuguguggagccccc

SEQ ID NO: 551968 - RNA, 22 nt, Human
ugcuucuguuucauugaucuua

SEQ ID NO: 551969 - RNA, 22 nt, Human
gccuggcacucaaucaucugcu

SEQ ID NO: 551970 - RNA, 22 nt, Human
auuauuagugauguuguuacug

SEQ ID NO: 551971 - RNA, 22 nt, Human
cagauggcagggcagcucugca

SEQ ID NO: 551972 - RNA, 22 nt, Human
cuguguccugucuccuaaggug

SEQ ID NO: 551973 - RNA, 22 nt, Human
cauuucaaugccuucaacauag

SEQ ID NO: 551974 - RNA, 22 nt, Human
aggccucucuccuuggcuugua

SEQ ID NO: 551975 - RNA, 22 nt, Human
cugcuguguuccuccugcaucu

SEQ ID NO: 551976 - RNA, 22 nt, Human
auuaaauuggaucugcauaguu

SEQ ID NO: 551977 - RNA, 22 nt, Human
ucaaugauaguacaaucagccu

SEQ ID NO: 551978 - RNA, 22 nt, Human
ucuggcuuucauuuguuuaaag

SEQ ID NO: 551979 - RNA, 22 nt, Human
accuggccauccagcuggcauc

SEQ ID NO: 551980 - RNA, 22 nt, Human
gccaccagccccaugcgcugug

SEQ ID NO: 551981 - RNA, 22 nt, Human
uucuucaauuauuggaaagaaa

SEQ ID NO: 551982 - RNA, 22 nt, Human
agccaacuuagaagaaauuuga

SEQ ID NO: 551983 - RNA, 22 nt, Human
aacuauuuuuggagcuaacucu

SEQ ID NO: 551984 - RNA, 22 nt, Human
uuagcauucucauuugcauaaa

SEQ ID NO: 551985 - RNA, 22 nt, Human
gggcuagaaauucugcagugga

SEQ ID NO: 551986 - RNA, 22 nt, Human
ugccaggccaauucuauuugac

SEQ ID NO: 551987 - RNA, 22 nt, Human
ugggaccucucuugagagagca

SEQ ID NO: 551988 - RNA, 22 nt, Human
uccaggccacauggauggcgau

SEQ ID NO: 551989 - RNA, 22 nt, Human
uggcugaguucuccaggaguag

SEQ ID NO: 551990 - RNA, 22 nt, Human
cugucccucaucaccucugggu

SEQ ID NO: 551991 - RNA, 22 nt, Human
ugcagaagaccuuccagggcug

SEQ ID NO: 551992 - RNA, 22 nt, Human
acauguuagaaaugcagaaucu

SEQ ID NO: 551993 - RNA, 22 nt, Human
uuaacaauagaguuucuucagg

SEQ ID NO: 551994 - RNA, 22 nt, Human
uaaaaguuuuaguuguacauaa

SEQ ID NO: 551995 - RNA, 20 nt, Human
ucaggcuccgcauuaacuua

SEQ ID NO: 551996 - RNA, 22 nt, Human
ccuggcacaugcaguacucaag

SEQ ID NO: 551997 - RNA, 22 nt, Human
uguaaggacaacaggagaaaaa

SEQ ID NO: 551998 - RNA, 22 nt, Human
cccaaggccucuccuuggcuug

SEQ ID NO: 551999 - RNA, 22 nt, Human
auguguuuguaccuuuaaauau

SEQ ID NO: 552000 - RNA, 22 nt, Human
gagagaggccuccauguacuga

SEQ ID NO: 552001 - RNA, 23 nt, Human
cauaugaauuuuagaggcaguuu

SEQ ID NO: 552002 - RNA, 22 nt, Human
ugggcacauaguuuuaugguca

SEQ ID NO: 552003 - RNA, 22 nt, Human
gucauaaaaggaccaccuauug

SEQ ID NO: 552004 - RNA, 22 nt, Human
caaugugugcuuacaggccagu

SEQ ID NO: 552005 - RNA, 22 nt, Human
acacucuucucacagucaguuu

SEQ ID NO: 552006 - RNA, 22 nt, Human
cuguccuguggaccugaggacg

SEQ ID NO: 552007 - RNA, 22 nt, Human
aguagaaaguugcaggaggaau

SEQ ID NO: 552008 - RNA, 22 nt, Human
ccuggggagccgccugagcccc

SEQ ID NO: 552009 - RNA, 22 nt, Human
agcagagaagacacaggcuuca

SEQ ID NO: 552010 - RNA, 22 nt, Human
aacaaaugauaccaguucucaa

SEQ ID NO: 552011 - RNA, 22 nt, Human
ugagccugaguucaaggcugca

SEQ ID NO: 552012 - RNA, 22 nt, Human
gggaugucguggguggcagcug

SEQ ID NO: 552013 - RNA, 22 nt, Human
aagagcaguguuuuacucagcu

SEQ ID NO: 552014 - RNA, 22 nt, Human
cauuuucaugaguuucuguuca

SEQ ID NO: 552015 - RNA, 22 nt, Human
caggcagagaggagcauuuaau

SEQ ID NO: 552016 - RNA, 22 nt, Human
ucauguuuuaaugccuuuuucu

SEQ ID NO: 552017 - RNA, 22 nt, Human
aauguguguauuucuaggcgag

SEQ ID NO: 552018 - RNA, 22 nt, Human
ccagggccaguaagauuggcau

SEQ ID NO: 552019 - RNA, 22 nt, Human
acauucuugaagugaaguuuau

SEQ ID NO: 552020 - RNA, 20 nt, Human
uuucacaaugaacaugucuc

SEQ ID NO: 552021 - RNA, 22 nt, Human
uuuaaauaggacuccugggggu

SEQ ID NO: 552022 - RNA, 22 nt, Human
aggccucuguuccccauguuuu

SEQ ID NO: 552023 - RNA, 22 nt, Human
ucaggcucugccaccuagauua

SEQ ID NO: 552024 - RNA, 22 nt, Human
ugagcuggcacuuuuccuggga

SEQ ID NO: 552025 - RNA, 22 nt, Human
uuuagaggucuguuucacauca

SEQ ID NO: 552026 - RNA, 22 nt, Human
cugagcgcaugguugcugggga

SEQ ID NO: 552027 - RNA, 20 nt, Human
acagauggcaguuauuacau

SEQ ID NO: 552028 - RNA, 23 nt, Human
aacaccaaggcucagagagauaa

SEQ ID NO: 552029 - RNA, 22 nt, Human
cagggcucugccuugagggaug

SEQ ID NO: 552030 - RNA, 22 nt, Human
ucugaaggugcuagagaaagcu

SEQ ID NO: 552031 - RNA, 22 nt, Human
aagagcaucaaugacucgcagu

SEQ ID NO: 552032 - RNA, 22 nt, Human
uauuuagaugcauuuggauugc

SEQ ID NO: 552033 - RNA, 22 nt, Human
uaugaagcugauaaucacugau

SEQ ID NO: 552034 - RNA, 22 nt, Human
ugaguagcggcuauguguaacu

SEQ ID NO: 552035 - RNA, 22 nt, Human
gaggcucagagacuuuaaguuu

SEQ ID NO: 552036 - RNA, 22 nt, Human
uggaagcagugauucuugucug

SEQ ID NO: 552037 - RNA, 22 nt, Human
ucaccaggauuccuaucaguag

SEQ ID NO: 552038 - RNA, 22 nt, Human
caauacaucaggucaaaaugug

SEQ ID NO: 552039 - RNA, 22 nt, Human
accagaguuggaauaauuuuga

SEQ ID NO: 552040 - RNA, 21 nt, Human
ugauuuccaucuuaaaauaaa

SEQ ID NO: 552041 - RNA, 16 nt, Human
gcacacacaucaauga

SEQ ID NO: 552042 - RNA, 22 nt, Human
uaugacaugugaucucaagagg

SEQ ID NO: 552043 - RNA, 23 nt, Human
gacagagugagaccuugucuuac

SEQ ID NO: 552044 - RNA, 22 nt, Human
aagcuagauuggcauucauuuc

SEQ ID NO: 552045 - RNA, 22 nt, Human
acauguuuaaguuuaaugaaaa

SEQ ID NO: 552046 - RNA, 22 nt, Human
gagguggcugggaguagggaau

SEQ ID NO: 552047 - RNA, 22 nt, Human
ugagcuuccucccugcauccau

SEQ ID NO: 552048 - RNA, 22 nt, Human
agggaguguaaauggugcucag

SEQ ID NO: 552049 - RNA, 22 nt, Human
cuggcagcagcuucuggaucga

SEQ ID NO: 552050 - RNA, 22 nt, Human
uggcuggcgccgggcuagccac

SEQ ID NO: 552051 - RNA, 19 nt, Human
auguaugaggucuucugcu

SEQ ID NO: 552052 - RNA, 18 nt, Human
ugagagaauguucaugcu

SEQ ID NO: 552053 - RNA, 22 nt, Human
gcaacagcccagguucugugug

SEQ ID NO: 552054 - RNA, 22 nt, Human
cuuuacauuaauuucuacugau

SEQ ID NO: 552055 - RNA, 22 nt, Human
gcuuuguguagaaggaggaugg

SEQ ID NO: 552056 - RNA, 22 nt, Human
gcccucagcuccuggacacaug

SEQ ID NO: 552057 - RNA, 22 nt, Human
ggcacagggagccgcaguugca

SEQ ID NO: 552058 - RNA, 22 nt, Human
caugaaaaauuuacuguuaaca

SEQ ID NO: 552059 - RNA, 22 nt, Human
ugucugugcccaaggcucccgg

SEQ ID NO: 552060 - RNA, 22 nt, Human
accugcagguguuuccacacuu

SEQ ID NO: 552061 - RNA, 22 nt, Human
ggcugagcggacuggggucccu

SEQ ID NO: 552062 - RNA, 22 nt, Human
guccaaguacauguguguacau

SEQ ID NO: 552063 - RNA, 22 nt, Human
aggugccuaucuggucucugca

SEQ ID NO: 552064 - RNA, 22 nt, Human
caggaaggggcucacucuggcc

SEQ ID NO: 552065 - RNA, 22 nt, Human
cagcuggggcagccacgugcgg

SEQ ID NO: 552066 - RNA, 19 nt, Human
ggccaccucucuucccagg

SEQ ID NO: 552067 - RNA, 22 nt, Human
accagagcuggcagaguaucaa

SEQ ID NO: 552068 - RNA, 21 nt, Human
agaaggcaccagcaaggacug

SEQ ID NO: 552069 - RNA, 22 nt, Human
ugguggccuugauggcaucugc

SEQ ID NO: 552070 - RNA, 22 nt, Human
gcaccugggguacacagcuaca

SEQ ID NO: 552071 - RNA, 23 nt, Human
gcuucugccauuugcuagcugug

SEQ ID NO: 552072 - RNA, 22 nt, Human
cugcugcauuccucuuuaugag

SEQ ID NO: 552073 - RNA, 22 nt, Human
uucuccagcucaucagggaggg

SEQ ID NO: 552074 - RNA, 19 nt, Human
agauuauugcacauucaug

SEQ ID NO: 552075 - RNA, 22 nt, Human
aggaccaacauagcagcagugg

SEQ ID NO: 552076 - RNA, 20 nt, Human
ucucagcauaagaacccuuc

SEQ ID NO: 552077 - RNA, 22 nt, Human
agauggagaaugacaauuaagg

SEQ ID NO: 552078 - RNA, 23 nt, Human
uuuuaauuuggacauaagaagau

SEQ ID NO: 552079 - RNA, 22 nt, Human
aaucuggcauuugagaguagga

SEQ ID NO: 552080 - RNA, 22 nt, Human
ugggcuucugauguugagugcu

SEQ ID NO: 552081 - RNA, 22 nt, Human
aggguauaaagagcaagcagaa

SEQ ID NO: 552082 - RNA, 22 nt, Human
agagccaggacugugucucacu

SEQ ID NO: 552083 - RNA, 22 nt, Human
uuccauauuguacucuuuggag

SEQ ID NO: 552084 - RNA, 22 nt, Human
gaacccaguccaggugcagccu

SEQ ID NO: 552085 - RNA, 22 nt, Human
aggcugaggcgggaggaucacu

SEQ ID NO: 552086 - RNA, 22 nt, Human
ggggccuuuucugaauguggaa

SEQ ID NO: 552087 - RNA, 22 nt, Human
gagcuuggugaugccuccuggu

SEQ ID NO: 552088 - RNA, 22 nt, Human
acaaggcuguuggucacaaacc

SEQ ID NO: 552089 - RNA, 22 nt, Human
uaagucauaagucaugauguua

SEQ ID NO: 552090 - RNA, 22 nt, Human
uccuucagggcugaccacaggc

SEQ ID NO: 552091 - RNA, 22 nt, Human
accuucauauucucugauaccu

SEQ ID NO: 552092 - RNA, 22 nt, Human
agaaguuuguuauguaaacaaa

SEQ ID NO: 552093 - RNA, 22 nt, Human
ggccagggggcuucagacucca

SEQ ID NO: 552094 - RNA, 22 nt, Human
cugccugggccggccacccucu

SEQ ID NO: 552095 - RNA, 21 nt, Human
gagccuucccucugcccuuuc

SEQ ID NO: 552096 - RNA, 22 nt, Human
ucucacaggugcacguggcugu

SEQ ID NO: 552097 - RNA, 22 nt, Human
ucucugaggacuugggguugcc

SEQ ID NO: 552098 - RNA, 22 nt, Human
gagucgagcagaaagccgucgg

SEQ ID NO: 552099 - RNA, 22 nt, Human
gcacccagagggcagggucucc

SEQ ID NO: 552100 - RNA, 22 nt, Human
ccaagcagucugcuaggaguuu

SEQ ID NO: 552101 - RNA, 22 nt, Human
ucuguucauuugccucggcucu

SEQ ID NO: 552102 - RNA, 22 nt, Human
uugcaccauuucacuuccauua

SEQ ID NO: 552103 - RNA, 22 nt, Human
ggcaaaaaguucccaucagugu

SEQ ID NO: 552104 - RNA, 22 nt, Human
auuaaucauuucugcauuaucu

SEQ ID NO: 552105 - RNA, 22 nt, Human
guuuacauugcuguuugugucu

SEQ ID NO: 552106 - RNA, 22 nt, Human
acacuuaaucuuacugaggauc

SEQ ID NO: 552107 - RNA, 22 nt, Human
ucaggagauggucuuuauaggc

SEQ ID NO: 552108 - RNA, 22 nt, Human
uggaaagacauucagccgcugg

SEQ ID NO: 552109 - RNA, 22 nt, Human
ucucuggcugauauuccucugc

SEQ ID NO: 552110 - RNA, 22 nt, Human
ccagcuuucauaucaugaggua

SEQ ID NO: 552111 - RNA, 22 nt, Human
gcagguggaagcagcagacuca

SEQ ID NO: 552112 - RNA, 21 nt, Human
uacagcaacggagguuuucua

SEQ ID NO: 552113 - RNA, 22 nt, Human
agggacugagcuaggaucuagu

SEQ ID NO: 552114 - RNA, 22 nt, Human
ucacagcuaagcuuggucacug

SEQ ID NO: 552115 - RNA, 18 nt, Human
cuucaguggcugcucugc

SEQ ID NO: 552116 - RNA, 22 nt, Human
agacaauggaccaagcaccuuc

SEQ ID NO: 552117 - RNA, 22 nt, Human
ccagcuuucugggugguuucug

SEQ ID NO: 552118 - RNA, 22 nt, Human
aagaaagauaagguuugcuugg

SEQ ID NO: 552119 - RNA, 22 nt, Human
augcugaauaguucacucuucu

SEQ ID NO: 552120 - RNA, 22 nt, Human
aaugugagccaaugcccguggg

SEQ ID NO: 552121 - RNA, 22 nt, Human
aaguaaauguuggagcucaaau

SEQ ID NO: 552122 - RNA, 22 nt, Human
ugagccagauaagggcucacgc

SEQ ID NO: 552123 - RNA, 22 nt, Human
augggcugaggaagcuccugag

SEQ ID NO: 552124 - RNA, 22 nt, Human
ccagggucucugcugccugaga

SEQ ID NO: 552125 - RNA, 22 nt, Human
aggaggcccuagagcucuagag

SEQ ID NO: 552126 - RNA, 22 nt, Human
aggcucagagagcuguguccau

SEQ ID NO: 552127 - RNA, 22 nt, Human
gccugggagggcagcagugugg

SEQ ID NO: 552128 - RNA, 22 nt, Human
agugugcugcuuaaacaguugu

SEQ ID NO: 552129 - RNA, 22 nt, Human
acagguggagugguuagcaggc

SEQ ID NO: 552130 - RNA, 22 nt, Human
cagcucugugggagcguaugug

SEQ ID NO: 552131 - RNA, 22 nt, Human
gcuuuuucaaaugaaagcuggu

SEQ ID NO: 552132 - RNA, 18 nt, Human
acaggccucaguccugca

SEQ ID NO: 552133 - RNA, 21 nt, Human
guggccugauuaugaaugggu

SEQ ID NO: 552134 - RNA, 22 nt, Human
aggcugucaucuuugcaggcag

SEQ ID NO: 552135 - RNA, 22 nt, Human
acagaacugggaaaugcacaua

SEQ ID NO: 552136 - RNA, 22 nt, Human
agaguccagaaaacagugugcu

SEQ ID NO: 552137 - RNA, 22 nt, Human
auagaaauggcagcuggugcua

SEQ ID NO: 552138 - RNA, 22 nt, Human
caagggcagcagccucaagcgg

SEQ ID NO: 552139 - RNA, 22 nt, Human
gaggagcacaugaggcugaggg

SEQ ID NO: 552140 - RNA, 22 nt, Human
guuuuucugugagcgguaaagg

SEQ ID NO: 552141 - RNA, 22 nt, Human
auugaauagaugcauuauacua

SEQ ID NO: 552142 - RNA, 22 nt, Human
aggagucauugagagggguccu

SEQ ID NO: 552143 - RNA, 22 nt, Human
guacauucagcuuagcacuucu

SEQ ID NO: 552144 - RNA, 22 nt, Human
aagguacagaaauuaacaagga

SEQ ID NO: 552145 - RNA, 22 nt, Human
ccaggcugcucacaagcugccc

SEQ ID NO: 552146 - RNA, 22 nt, Human
ccuggcacgaagggcugagguu

SEQ ID NO: 552147 - RNA, 22 nt, Human
caagaugggcaccccagcaccu

SEQ ID NO: 552148 - RNA, 23 nt, Human
uucaaagaucuucugaaaucugu

SEQ ID NO: 552149 - RNA, 21 nt, Human
ugaaugaggaggauggcauuu

SEQ ID NO: 552150 - RNA, 22 nt, Human
aggccucaggaagguaaagaag

SEQ ID NO: 552151 - RNA, 22 nt, Human
caugagcugcugggagccuguc

SEQ ID NO: 552152 - RNA, 22 nt, Human
gggaugucacugugccuggcac

SEQ ID NO: 552153 - RNA, 22 nt, Human
cagccagguaugggcgugcggg

SEQ ID NO: 552154 - RNA, 22 nt, Human
agggaggcaggaaaguugucug

SEQ ID NO: 552155 - RNA, 22 nt, Human
uguuuuauuucuccaagaggga

SEQ ID NO: 552156 - RNA, 18 nt, Human
uuguuuuaagacucuguc

SEQ ID NO: 552157 - RNA, 20 nt, Human
uuucagugguuugugccuag

SEQ ID NO: 552158 - RNA, 22 nt, Human
ucuucaugaaugaaucuuugac

SEQ ID NO: 552159 - RNA, 22 nt, Human
ucuuaacaagcuccucagugcu

SEQ ID NO: 552160 - RNA, 22 nt, Human
ccaggacccugcaaacccuguu

SEQ ID NO: 552161 - RNA, 22 nt, Human
ucagaggacuaccuucuccagu

SEQ ID NO: 552162 - RNA, 22 nt, Human
uagcagaaccagcagucaauuu

SEQ ID NO: 552163 - RNA, 22 nt, Human
uguauuuucuucuggaagcuua

SEQ ID NO: 552164 - RNA, 22 nt, Human
auauuucuggggguguguuucu

SEQ ID NO: 552165 - RNA, 22 nt, Human
aggagggugauccgggcugguc

SEQ ID NO: 552166 - RNA, 20 nt, Human
ugcccagcaagagugcaguu

SEQ ID NO: 552167 - RNA, 22 nt, Human
aggcagcauuugaauccagguc

SEQ ID NO: 552168 - RNA, 22 nt, Human
uuaaaggcgauaaggcaguguu

SEQ ID NO: 552169 - RNA, 22 nt, Human
ggugcccaccugucuuccugga

SEQ ID NO: 552170 - RNA, 22 nt, Human
aacagaaugcaggggaugcugc

SEQ ID NO: 552171 - RNA, 20 nt, Human
uggagcugugguaaggagca

SEQ ID NO: 552172 - RNA, 22 nt, Human
cauaggaaaagcauucuucuug

SEQ ID NO: 552173 - RNA, 22 nt, Human
gaacacagcagggauaaccacu

SEQ ID NO: 552174 - RNA, 22 nt, Human
gcaggugguccccguggagugg

SEQ ID NO: 552175 - RNA, 21 nt, Human
uggcugcuggcccucucucca

SEQ ID NO: 552176 - RNA, 22 nt, Human
ccugccugcagaaaguaucucc

SEQ ID NO: 552177 - RNA, 22 nt, Human
ggccuuggugccauggccaguu

SEQ ID NO: 552178 - RNA, 22 nt, Human
caugaaugcuggguucauguaa

SEQ ID NO: 552179 - RNA, 22 nt, Human
ugcagggaaagggcacugggcu

SEQ ID NO: 552180 - RNA, 22 nt, Human
aucuguuguuuguuugcuaaag

SEQ ID NO: 552181 - RNA, 22 nt, Human
ucugggcacugcugagccugua

SEQ ID NO: 552182 - RNA, 22 nt, Human
uggcaagaauauuggaccagaa

SEQ ID NO: 552183 - RNA, 17 nt, Human
ccagagaguaguuagga

SEQ ID NO: 552184 - RNA, 22 nt, Human
uguaaacaugcugaggcuggag

SEQ ID NO: 552185 - RNA, 22 nt, Human
aagcuuuagagaugaguuccuu

SEQ ID NO: 552186 - RNA, 19 nt, Human
acuguucuaacuugcagcu

SEQ ID NO: 552187 - RNA, 22 nt, Human
acagucuugcuguauggucagg

SEQ ID NO: 552188 - RNA, 19 nt, Human
auuuuucuuccucugugca

SEQ ID NO: 552189 - RNA, 19 nt, Human
ucaguggaugaacauguuu

SEQ ID NO: 552190 - RNA, 22 nt, Human
aauguguuuucacugaagauuc

SEQ ID NO: 552191 - RNA, 22 nt, Human
auauuuguugaguucuuaugau

SEQ ID NO: 552192 - RNA, 22 nt, Human
agcccuucaaccugccuacucc

SEQ ID NO: 552193 - RNA, 22 nt, Human
cuguucuuaucgucuuaauauc

SEQ ID NO: 552194 - RNA, 22 nt, Human
uaacuguaauauaaauaugagu

SEQ ID NO: 552195 - RNA, 22 nt, Human
ccaaaucaggggccacaagcau

SEQ ID NO: 552196 - RNA, 22 nt, Human
gccucugcaacuccgccuuggu

SEQ ID NO: 552197 - RNA, 21 nt, Human
ccagcagcucaaggaucucuu

SEQ ID NO: 552198 - RNA, 22 nt, Human
ucugagagucucugaggcagau

SEQ ID NO: 552199 - RNA, 22 nt, Human
cuuccuguugucacagucugcg

SEQ ID NO: 552200 - RNA, 22 nt, Human
uaaauguggagacucaggaguc

SEQ ID NO: 552201 - RNA, 22 nt, Human
gcagcccaauggacugagacag

SEQ ID NO: 552202 - RNA, 22 nt, Human
cagcuggcccuuugguagccuu

SEQ ID NO: 552203 - RNA, 22 nt, Human
gcagggccagggcucaggcugu

SEQ ID NO: 552204 - RNA, 22 nt, Human
aagacauuuauuugaaucaauu

SEQ ID NO: 552205 - RNA, 22 nt, Human
ucuuugcaaauguuauuaucuu

SEQ ID NO: 552206 - RNA, 22 nt, Human
caaaugugacuuuugggcuucu

SEQ ID NO: 552207 - RNA, 20 nt, Human
uuggcucaugcaacaccuac

SEQ ID NO: 552208 - RNA, 22 nt, Human
ugaaagaugcucaaugaauggu

SEQ ID NO: 552209 - RNA, 22 nt, Human
ugcuggcccuggcucagggaac

SEQ ID NO: 552210 - RNA, 22 nt, Human
gccucccuguagaggccagccu

SEQ ID NO: 552211 - RNA, 22 nt, Human
cgcagguguguuuucaggacua

SEQ ID NO: 552212 - RNA, 22 nt, Human
aagccucuggggccucaucugu

SEQ ID NO: 552213 - RNA, 22 nt, Human
acuucacauuagcuaaaaggga

SEQ ID NO: 552214 - RNA, 22 nt, Human
agcagccagaaauccagaggug

SEQ ID NO: 552215 - RNA, 22 nt, Human
uuccaagugcccauauuucauc

SEQ ID NO: 552216 - RNA, 22 nt, Human
cccauuuaucccaagguuacuc

SEQ ID NO: 552217 - RNA, 22 nt, Human
aacaguaaagacagaauuuauc

SEQ ID NO: 552218 - RNA, 22 nt, Human
uagcugccaaaagggugggcua

SEQ ID NO: 552219 - RNA, 22 nt, Human
cauguuauuuauccauuaaaca

SEQ ID NO: 552220 - RNA, 22 nt, Human
cggcuggggcuguccccaugac

SEQ ID NO: 552221 - RNA, 22 nt, Human
ggcagcugugaagugccucaca

SEQ ID NO: 552222 - RNA, 21 nt, Human
uuagcuuucuagaaucuuugu

SEQ ID NO: 552223 - RNA, 20 nt, Human
gggaguggugguagccugug

SEQ ID NO: 552224 - RNA, 22 nt, Human
cuuuucauuguuuguacaugca

SEQ ID NO: 552225 - RNA, 22 nt, Human
uauuguacugaggaauaaagcu

SEQ ID NO: 552226 - RNA, 22 nt, Human
ugggcagacugagcccuguccc

SEQ ID NO: 552227 - RNA, 22 nt, Human
ggcagcaaauauugucagcugu

SEQ ID NO: 552228 - RNA, 22 nt, Human
auaugucgcuacaucauuagau

SEQ ID NO: 552229 - RNA, 22 nt, Human
gucacuguuuccuauuauauuu

SEQ ID NO: 552230 - RNA, 22 nt, Human
uugcaaaugugaguuuagacug

SEQ ID NO: 552231 - RNA, 22 nt, Human
cauccugcggggagcagagggc

SEQ ID NO: 552232 - RNA, 22 nt, Human
ucuauauuccagauacagauua

SEQ ID NO: 552233 - RNA, 22 nt, Human
gaaagagaggggcugagaugca

SEQ ID NO: 552234 - RNA, 22 nt, Human
ucugagugggaacucucaugac

SEQ ID NO: 552235 - RNA, 22 nt, Human
gggagccuugggagugccagcc

SEQ ID NO: 552236 - RNA, 22 nt, Human
uucaagaagguacauuuacauc

SEQ ID NO: 552237 - RNA, 22 nt, Human
uacacagauaugugaucaauca

SEQ ID NO: 552238 - RNA, 22 nt, Human
ugggaaaguguugaggugucuu

SEQ ID NO: 552239 - RNA, 22 nt, Human
guuuuauaugucucugcugaca

SEQ ID NO: 552240 - RNA, 22 nt, Human
ccuguguguaggccaggggagu

SEQ ID NO: 552241 - RNA, 22 nt, Human
gcauucaucuuccuccaugcag

SEQ ID NO: 552242 - RNA, 22 nt, Human
uacuguucaugccuucauaaag

SEQ ID NO: 552243 - RNA, 22 nt, Human
gcagggcaguaagagcuagagu

SEQ ID NO: 552244 - RNA, 22 nt, Human
ucacugaauacuugucucaucc

SEQ ID NO: 552245 - RNA, 19 nt, Human
cagcaauaaugccagaugg

SEQ ID NO: 552246 - RNA, 22 nt, Human
uuugaaaguguuuacuugggaa

SEQ ID NO: 552247 - RNA, 22 nt, Human
ggaaagagcuaaaagggugaga

SEQ ID NO: 552248 - RNA, 22 nt, Human
gaaacuuuuaaaccucaugagu

SEQ ID NO: 552249 - RNA, 22 nt, Human
ucaaaugcuucuacuccuaaga

SEQ ID NO: 552250 - RNA, 21 nt, Human
cauuagggcagaagcaggaag

SEQ ID NO: 552251 - RNA, 22 nt, Human
aauguugccccaggacaaagga

SEQ ID NO: 552252 - RNA, 22 nt, Human
cucucccccacagcagccuucu

SEQ ID NO: 552253 - RNA, 22 nt, Human
ccuuuucuggccaccaagcgcu

SEQ ID NO: 552254 - RNA, 22 nt, Human
caguacuuguccucagguguua

SEQ ID NO: 552255 - RNA, 22 nt, Human
acagauggccauauuacuauau

SEQ ID NO: 552256 - RNA, 22 nt, Human
agcagggcuucugugccugugc

SEQ ID NO: 552257 - RNA, 23 nt, Human
ugagcagcuaaaggugaugcggg

SEQ ID NO: 552258 - RNA, 22 nt, Human
cuugaaagucagcagaguggau

SEQ ID NO: 552259 - RNA, 22 nt, Human
ugggcccaagagagucuccaac

SEQ ID NO: 552260 - RNA, 22 nt, Human
cccagggaaugacucuggccuu

SEQ ID NO: 552261 - RNA, 22 nt, Human
cacugcuuucacaguuuguucc

SEQ ID NO: 552262 - RNA, 22 nt, Human
ccaggcugcagucaaggggcau

SEQ ID NO: 552263 - RNA, 22 nt, Human
aaugggagguaguaugggaggu

SEQ ID NO: 552264 - RNA, 21 nt, Human
ucuggagcccuaagcugagaa

SEQ ID NO: 552265 - RNA, 22 nt, Human
uccaggcuaauuuugcauuguu

SEQ ID NO: 552266 - RNA, 22 nt, Human
uucauacaugagacuagaugca

SEQ ID NO: 552267 - RNA, 22 nt, Human
acaaagaucuugcuuuccuacu

SEQ ID NO: 552268 - RNA, 22 nt, Human
agcuggaggggccagcaggugu

SEQ ID NO: 552269 - RNA, 22 nt, Human
ugcacagcgggugucugucagg

SEQ ID NO: 552270 - RNA, 22 nt, Human
agggcagcuggaagguggcuuc

SEQ ID NO: 552271 - RNA, 22 nt, Human
uuuuccuacugauaaacaguua

SEQ ID NO: 552272 - RNA, 22 nt, Human
cagagcagugaggaguugugua

SEQ ID NO: 552273 - RNA, 22 nt, Human
agagacugcgugucagcgcugg

SEQ ID NO: 552274 - RNA, 22 nt, Human
uuccucuuucucugugcuaugu

SEQ ID NO: 552275 - RNA, 22 nt, Human
ugggccacaagccaugggacca

SEQ ID NO: 552276 - RNA, 22 nt, Human
aagagagaacucccuucgccag

SEQ ID NO: 552277 - RNA, 22 nt, Human
uuacaaagaguguucuuuucca

SEQ ID NO: 552278 - RNA, 22 nt, Human
acacugugagcugaagggcugc

SEQ ID NO: 552279 - RNA, 22 nt, Human
uguggggcagcuagccggccug

SEQ ID NO: 552280 - RNA, 22 nt, Human
uguaugcuuguguauaauauaa

SEQ ID NO: 552281 - RNA, 22 nt, Human
agaggaggcucugggaucgucc

SEQ ID NO: 552282 - RNA, 22 nt, Human
accucugcucaagaccccuccg

SEQ ID NO: 552283 - RNA, 18 nt, Human
aagcugggaaggagacag

SEQ ID NO: 552284 - RNA, 22 nt, Human
aaccccgcucaggcugggugag

SEQ ID NO: 552285 - RNA, 22 nt, Human
gcuggccuugugucugaggaag

SEQ ID NO: 552286 - RNA, 22 nt, Human
agauacaugucaagagacuuau

SEQ ID NO: 552287 - RNA, 22 nt, Human
cuggggggcuacugacagagga

SEQ ID NO: 552288 - RNA, 22 nt, Human
cccaguuguugccggcucugga

SEQ ID NO: 552289 - RNA, 19 nt, Human
uuacaucugcaacacuggu

SEQ ID NO: 552290 - RNA, 22 nt, Human
aauuucacagcuggucuauggg

SEQ ID NO: 552291 - RNA, 16 nt, Human
caggaaccugucuggc

SEQ ID NO: 552292 - RNA, 22 nt, Human
uucagcuauaacauugagacuu

SEQ ID NO: 552293 - RNA, 22 nt, Human
cuggagcauuuucugcuucugc

SEQ ID NO: 552294 - RNA, 22 nt, Human
gccagggagucugggccacaga

SEQ ID NO: 552295 - RNA, 22 nt, Human
acagggcauuuccucuaugugu

SEQ ID NO: 552296 - RNA, 22 nt, Human
aagugugggaaguagguggcga

SEQ ID NO: 552297 - RNA, 18 nt, Human
gguggccuugacuucucu

SEQ ID NO: 552298 - RNA, 21 nt, Human
gagcucucaggcaagaagcag

SEQ ID NO: 552299 - RNA, 22 nt, Human
agcaggagacauggggguggug

SEQ ID NO: 552300 - RNA, 22 nt, Human
ucagaaauuuucucaguaguuc

SEQ ID NO: 552301 - RNA, 18 nt, Human
ucaagacaucaugaaaua

SEQ ID NO: 552302 - RNA, 22 nt, Human
acuuucucaaaucagacuuuaa

SEQ ID NO: 552303 - RNA, 22 nt, Human
agagcaggcauaaagcuuugaa

SEQ ID NO: 552304 - RNA, 22 nt, Human
ggagaguggauuccagcuguau

SEQ ID NO: 552305 - RNA, 22 nt, Human
cuucacuguuugguucacagca

SEQ ID NO: 552306 - RNA, 22 nt, Human
uucacaguggcugugccauuug

SEQ ID NO: 552307 - RNA, 22 nt, Human
uuucaaacauagaucugaauau

SEQ ID NO: 552308 - RNA, 22 nt, Human
ugcuucugcauucaauguugga

SEQ ID NO: 552309 - RNA, 22 nt, Human
uccaagggcagccauagaacuu

SEQ ID NO: 552310 - RNA, 22 nt, Human
agcuguucccucacugcaguca

SEQ ID NO: 552311 - RNA, 22 nt, Human
aaagacuuggcuuaugauuugc

SEQ ID NO: 552312 - RNA, 22 nt, Human
gggcugaccccaccccucacuc

SEQ ID NO: 552313 - RNA, 22 nt, Human
cuucuucagcacaauauugaug

SEQ ID NO: 552314 - RNA, 22 nt, Human
acauaauggacaauaaugcauc

SEQ ID NO: 552315 - RNA, 22 nt, Human
agugcagcaacaaacugcccuc

SEQ ID NO: 552316 - RNA, 22 nt, Human
uggccugggccugccggugcaa

SEQ ID NO: 552317 - RNA, 22 nt, Human
gggccuccggggugagcugugg

SEQ ID NO: 552318 - RNA, 22 nt, Human
ucagagugcagcgggaggcugg

SEQ ID NO: 552319 - RNA, 22 nt, Human
caucaaacaaaugcuuuuagau

SEQ ID NO: 552320 - RNA, 22 nt, Human
cagggcuguggcuuugugcugu

SEQ ID NO: 552321 - RNA, 20 nt, Human
caccacagaauuggggacag

SEQ ID NO: 552322 - RNA, 22 nt, Human
gagugaugucuguagugaagaa

SEQ ID NO: 552323 - RNA, 22 nt, Human
gaguucuucuauauaguaugag

SEQ ID NO: 552324 - RNA, 22 nt, Human
aguagcaauguuugagaagcac

SEQ ID NO: 552325 - RNA, 19 nt, Human
aggaaggaaccugagucug

SEQ ID NO: 552326 - RNA, 22 nt, Human
ggaucauuaacacauccaucac

SEQ ID NO: 552327 - RNA, 22 nt, Human
cuguucaauuuguuucaguuau

SEQ ID NO: 552328 - RNA, 22 nt, Human
acagcuugcaauggcuuucaac

SEQ ID NO: 552329 - RNA, 22 nt, Human
gccuggagccucagcaaggagg

SEQ ID NO: 552330 - RNA, 22 nt, Human
ccucccugcgcuccugcggcgg

SEQ ID NO: 552331 - RNA, 22 nt, Human
ucuuuacauaguguggacuacu

SEQ ID NO: 552332 - RNA, 22 nt, Human
uguaacauauagcauguucuug

SEQ ID NO: 552333 - RNA, 22 nt, Human
aaucucuuuggcucaaggaucc

SEQ ID NO: 552334 - RNA, 17 nt, Human
uuccucucacauuuuuu

SEQ ID NO: 552335 - RNA, 22 nt, Human
acuguuuucuaaagaacagaug

SEQ ID NO: 552336 - RNA, 22 nt, Human
uuuccucacacagaagaucuug

SEQ ID NO: 552337 - RNA, 22 nt, Human
acagcuuuguguuaaugggaag

SEQ ID NO: 552338 - RNA, 20 nt, Human
ucucccaggcucagggaaga

SEQ ID NO: 552339 - RNA, 22 nt, Human
cccagcuugcaaauggguugcu

SEQ ID NO: 552340 - RNA, 22 nt, Human
gcagugaaucuggcaagaauuu

SEQ ID NO: 552341 - RNA, 22 nt, Human
cugucccagauguucucagcac

SEQ ID NO: 552342 - RNA, 22 nt, Human
cggcagagcggcgagccccucc

SEQ ID NO: 552343 - RNA, 22 nt, Human
uggugaagucagcggagcccgg

SEQ ID NO: 552344 - RNA, 22 nt, Human
aagcugccagauucagucugcu

SEQ ID NO: 552345 - RNA, 22 nt, Human
uucuuugaguuaguacagucca

SEQ ID NO: 552346 - RNA, 22 nt, Human
cuuauuuugcugaugacccagg

SEQ ID NO: 552347 - RNA, 22 nt, Human
uuggagagcaguaaaccacacu

SEQ ID NO: 552348 - RNA, 22 nt, Human
uccugcagcugaagcucaugug

SEQ ID NO: 552349 - RNA, 22 nt, Human
agcugccagcaucccggaaggg

SEQ ID NO: 552350 - RNA, 22 nt, Human
uuccauaauaggcuuaagugaa

SEQ ID NO: 552351 - RNA, 22 nt, Human
ucagggcaucaucaugaauaua

SEQ ID NO: 552352 - RNA, 22 nt, Human
cacauggggcgcugcauuggcc

SEQ ID NO: 552353 - RNA, 22 nt, Human
cgaaaucagcaucuugaggcaa

SEQ ID NO: 552354 - RNA, 19 nt, Human
cuggcagccugucuguguc

SEQ ID NO: 552355 - RNA, 22 nt, Human
aaguguuucaauaauuuggacc

SEQ ID NO: 552356 - RNA, 23 nt, Human
acugggcuuaugaggaggcuugu

SEQ ID NO: 552357 - RNA, 22 nt, Human
ucagauggguuuugaaggaugu

SEQ ID NO: 552358 - RNA, 22 nt, Human
ugcugggcacugucuagguacu

SEQ ID NO: 552359 - RNA, 22 nt, Human
uucaagaucuuccaaaggauac

SEQ ID NO: 552360 - RNA, 22 nt, Human
cugaaacuggaguccuuauauc

SEQ ID NO: 552361 - RNA, 22 nt, Human
augcagguugggcaaguguggg

SEQ ID NO: 552362 - RNA, 22 nt, Human
aaugugguuaacccauuuaaga

SEQ ID NO: 552363 - RNA, 22 nt, Human
cuggcccuucucuugcuuccug

SEQ ID NO: 552364 - RNA, 22 nt, Human
ggccugcucuggcuguggucag

SEQ ID NO: 552365 - RNA, 22 nt, Human
aucaacaugugagagcaccagu

SEQ ID NO: 552366 - RNA, 17 nt, Human
uagagcugguucaggag

SEQ ID NO: 552367 - RNA, 21 nt, Human
agcaauuucauuugguuuaac

SEQ ID NO: 552368 - RNA, 22 nt, Human
uaggcugagcuaagagagcuua

SEQ ID NO: 552369 - RNA, 22 nt, Human
cacagcagagggagccauugaa

SEQ ID NO: 552370 - RNA, 22 nt, Human
aacuagaaaucacuacagguau

SEQ ID NO: 552371 - RNA, 22 nt, Human
ugauuacacagcaguaauuuca

SEQ ID NO: 552372 - RNA, 19 nt, Human
uuuaguaugagcuccaggg

SEQ ID NO: 552373 - RNA, 22 nt, Human
agggagguccaucccugcagag

SEQ ID NO: 552374 - RNA, 22 nt, Human
gccucugcccauccaccaucag

SEQ ID NO: 552375 - RNA, 21 nt, Human
uguauacacacauauauguac

SEQ ID NO: 552376 - RNA, 22 nt, Human
cugggcucagcaggccaaggcc

SEQ ID NO: 552377 - RNA, 22 nt, Human
aagagcaacuuggaaacacuca

SEQ ID NO: 552378 - RNA, 22 nt, Human
acagaagauaacugggaccaga

SEQ ID NO: 552379 - RNA, 22 nt, Human
aaggcugauuagacugauagcu

SEQ ID NO: 552380 - RNA, 22 nt, Human
gaggcagaaguugcagugagca

SEQ ID NO: 552381 - RNA, 22 nt, Human
ugcuucuguucuuucaccuacg

SEQ ID NO: 552382 - RNA, 22 nt, Human
aagaugcacaauguggcaauua

SEQ ID NO: 552383 - RNA, 22 nt, Human
aaucuuuuaggggauccugagg

SEQ ID NO: 552384 - RNA, 22 nt, Human
gcauuacaggaauuuguuacug

SEQ ID NO: 552385 - RNA, 22 nt, Human
caugaagcccucaucagucuga

SEQ ID NO: 552386 - RNA, 22 nt, Human
cauaccuuucucaagcacaugu

SEQ ID NO: 552387 - RNA, 22 nt, Human
ccaggaugacccccacuuuccu

SEQ ID NO: 552388 - RNA, 22 nt, Human
gggccuggggugacguaccccu

SEQ ID NO: 552389 - RNA, 22 nt, Human
gcuggagccuucugcucuguug

SEQ ID NO: 552390 - RNA, 22 nt, Human
auccaaagcccuaaguuaacug

SEQ ID NO: 552391 - RNA, 22 nt, Human
auagauguacguauguaaauca

SEQ ID NO: 552392 - RNA, 22 nt, Human
cccuggaggcggauguugcagu

SEQ ID NO: 552393 - RNA, 22 nt, Human
gcucugaggcugggagcacucu

SEQ ID NO: 552394 - RNA, 22 nt, Human
uggcaggguuggccaccuuacc

SEQ ID NO: 552395 - RNA, 18 nt, Human
caguuacaccuucauuca

SEQ ID NO: 552396 - RNA, 22 nt, Human
caugacaauauguucuuucauu

SEQ ID NO: 552397 - RNA, 22 nt, Human
cugagggucaacuugauuguau

SEQ ID NO: 552398 - RNA, 22 nt, Human
gcaaaacagucgaugccuccca

SEQ ID NO: 552399 - RNA, 22 nt, Human
uggagcaggacugcugcccuca

SEQ ID NO: 552400 - RNA, 22 nt, Human
ugagccuggccugcagagacca

SEQ ID NO: 552401 - RNA, 22 nt, Human
uucuuuuuaucuucccauaaga

SEQ ID NO: 552402 - RNA, 22 nt, Human
gaaaugucucuggauuugcuuu

SEQ ID NO: 552403 - RNA, 22 nt, Human
cauaugaaguucaacagagaug

SEQ ID NO: 552404 - RNA, 22 nt, Human
cucagugaauuggaggauggcc

SEQ ID NO: 552405 - RNA, 22 nt, Human
uggagaagucaaagugaacagg

SEQ ID NO: 552406 - RNA, 17 nt, Human
gcuucuggagcuucugu

SEQ ID NO: 552407 - RNA, 22 nt, Human
augucuuuuaugauuacgggau

SEQ ID NO: 552408 - RNA, 22 nt, Human
ugggacuugccucgagggcugc

SEQ ID NO: 552409 - RNA, 22 nt, Human
ugacaauacagagagagcaaaa

SEQ ID NO: 552410 - RNA, 22 nt, Human
uuaacagacauauauauuugua

SEQ ID NO: 552411 - RNA, 22 nt, Human
aaauguacaacauccauauaua

SEQ ID NO: 552412 - RNA, 22 nt, Human
ucaaaucagcaagcagcuuccc

SEQ ID NO: 552413 - RNA, 22 nt, Human
ggccucgcggcuucugguggcu

SEQ ID NO: 552414 - RNA, 22 nt, Human
uuucuaaguguguuucauagga

SEQ ID NO: 552415 - RNA, 22 nt, Human
ucagaauuguggagaaagggga

SEQ ID NO: 552416 - RNA, 22 nt, Human
ugucccuggaacuauggcucca

SEQ ID NO: 552417 - RNA, 22 nt, Human
ugcaggugaaaauuaugaggau

SEQ ID NO: 552418 - RNA, 20 nt, Human
ggcugugcccuuccguggcc

SEQ ID NO: 552419 - RNA, 22 nt, Human
aaguugagaugucauaggagac

SEQ ID NO: 552420 - RNA, 22 nt, Human
acaaggaggucuggggggcccu

SEQ ID NO: 552421 - RNA, 22 nt, Human
caucaguguggcaguucacugu

SEQ ID NO: 552422 - RNA, 21 nt, Human
gggugcuguggucaugcagga

SEQ ID NO: 552423 - RNA, 22 nt, Human
auuucaguguugguuagcaagc

SEQ ID NO: 552424 - RNA, 22 nt, Human
augcacagcagugaguucagug

SEQ ID NO: 552425 - RNA, 22 nt, Human
cagaggccauauuucuucacuc

SEQ ID NO: 552426 - RNA, 22 nt, Human
aaucaguuagaaggaagagaau

SEQ ID NO: 552427 - RNA, 22 nt, Human
uuaauaaacaggugcagcugaa

SEQ ID NO: 552428 - RNA, 22 nt, Human
cccucugcucaggugcauaggc

SEQ ID NO: 552429 - RNA, 18 nt, Human
agaugaaagcaaaugaca

SEQ ID NO: 552430 - RNA, 22 nt, Human
uguguggcaagcuguaugcuag

SEQ ID NO: 552431 - RNA, 22 nt, Human
gagaaguuucugguuugcauag

SEQ ID NO: 552432 - RNA, 22 nt, Human
cuauuuuucuguacccuaauuu

SEQ ID NO: 552433 - RNA, 22 nt, Human
guaaaauugcaauuacuuuugc

SEQ ID NO: 552434 - RNA, 22 nt, Human
acuuuaaaacugaucaucagag

SEQ ID NO: 552435 - RNA, 22 nt, Human
ugaguccaagagccagugggaa

SEQ ID NO: 552436 - RNA, 22 nt, Human
cuggcucacuagcccugcccug

SEQ ID NO: 552437 - RNA, 22 nt, Human
uuucuucuguuuguaguuacac

SEQ ID NO: 552438 - RNA, 22 nt, Human
augucaaaucaguuuuaucaga

SEQ ID NO: 552439 - RNA, 22 nt, Human
caggugccucaggaugagacaa

SEQ ID NO: 552440 - RNA, 20 nt, Human
uggccuuggggagcucacac

SEQ ID NO: 552441 - RNA, 22 nt, Human
uggcugaaggaagauucuucua

SEQ ID NO: 552442 - RNA, 22 nt, Human
ucucugaagauauuuauuauua

SEQ ID NO: 552443 - RNA, 22 nt, Human
agaggcaccaucuggaacagcc

SEQ ID NO: 552444 - RNA, 22 nt, Human
agaauaaaauagucugaagaug

SEQ ID NO: 552445 - RNA, 22 nt, Human
agacccagaaagcagcugcauu

SEQ ID NO: 552446 - RNA, 22 nt, Human
uaacagaaguuguucauugugg

SEQ ID NO: 552447 - RNA, 22 nt, Human
ugcccugcccaucuacccuguc

SEQ ID NO: 552448 - RNA, 22 nt, Human
caguucuggaguuucauucuuu

SEQ ID NO: 552449 - RNA, 22 nt, Human
gccaagcucuuuaaaggccaaa

SEQ ID NO: 552450 - RNA, 22 nt, Human
gucugggcaagggagauggcgc

SEQ ID NO: 552451 - RNA, 22 nt, Human
gccaggaggcuuaacuggacag

SEQ ID NO: 552452 - RNA, 22 nt, Human
uagggcuauaagagaauaagac

SEQ ID NO: 552453 - RNA, 21 nt, Human
cccuguguuccacagcagaca

SEQ ID NO: 552454 - RNA, 22 nt, Human
augcccaggcccauaccuagau

SEQ ID NO: 552455 - RNA, 22 nt, Human
uaugaaacauucauacaaauaa

SEQ ID NO: 552456 - RNA, 22 nt, Human
gggauggggggaagcguccaug

SEQ ID NO: 552457 - RNA, 22 nt, Human
gcugcuuccuuuccugcugacc

SEQ ID NO: 552458 - RNA, 22 nt, Human
gcuuuucauagauaaaauucua

SEQ ID NO: 552459 - RNA, 22 nt, Human
gagaaagauuguccuucagggg

SEQ ID NO: 552460 - RNA, 22 nt, Human
cacaauaaauguuugcugauga

SEQ ID NO: 552461 - RNA, 22 nt, Human
acaguguguucugggaccucca

SEQ ID NO: 552462 - RNA, 22 nt, Human
ccagcugcccaagaggcauccu

SEQ ID NO: 552463 - RNA, 22 nt, Human
ucauuugugugagugauuugac

SEQ ID NO: 552464 - RNA, 22 nt, Human
ugcagugauuaaaguguuaaau

SEQ ID NO: 552465 - RNA, 22 nt, Human
gggcagcacagacagugaaggc

SEQ ID NO: 552466 - RNA, 22 nt, Human
aggccaaguagcuagcauugaa

SEQ ID NO: 552467 - RNA, 22 nt, Human
caguggugaagagcaggggcuc

SEQ ID NO: 552468 - RNA, 22 nt, Human
gccagcuguucagacauucuuu

SEQ ID NO: 552469 - RNA, 22 nt, Human
gcagggcacacaagaaugauaa

SEQ ID NO: 552470 - RNA, 22 nt, Human
ccugucagaugaaguaauugug

SEQ ID NO: 552471 - RNA, 22 nt, Human
gaaacacaugcagcuccauaga

SEQ ID NO: 552472 - RNA, 22 nt, Human
aagcagaaguugaucuaccaua

SEQ ID NO: 552473 - RNA, 22 nt, Human
uugcccagagcugccuguuaca

SEQ ID NO: 552474 - RNA, 22 nt, Human
ugaagcugugggcaguggagcc

SEQ ID NO: 552475 - RNA, 22 nt, Human
gcccugccugccgguguggguc

SEQ ID NO: 552476 - RNA, 21 nt, Human
auaucuucuucaaaccacuca

SEQ ID NO: 552477 - RNA, 22 nt, Human
ccucugggugggaggccgggcg

SEQ ID NO: 552478 - RNA, 17 nt, Human
acucaggaucugggagu

SEQ ID NO: 552479 - RNA, 22 nt, Human
ucuguucagacacuuuacaugu

SEQ ID NO: 552480 - RNA, 22 nt, Human
uuauaaagguuugugcauauuu

SEQ ID NO: 552481 - RNA, 22 nt, Human
ccuccugcacuugcuuuccuuc

SEQ ID NO: 552482 - RNA, 22 nt, Human
cucugcccccagcuggugcuug

SEQ ID NO: 552483 - RNA, 22 nt, Human
acccuggagcuuuucuggcccu

SEQ ID NO: 552484 - RNA, 22 nt, Human
cagacagagcucacaagucuuu

SEQ ID NO: 552485 - RNA, 21 nt, Human
acaguuuauuagaguaagugc

SEQ ID NO: 552486 - RNA, 22 nt, Human
aaaaaugcuuggacuuaauaaa

SEQ ID NO: 552487 - RNA, 20 nt, Human
ugccaggcacggagugcaug

SEQ ID NO: 552488 - RNA, 22 nt, Human
gaaauacaaaugccuagauccu

SEQ ID NO: 552489 - RNA, 22 nt, Human
uuucacagaggaggaagcugag

SEQ ID NO: 552490 - RNA, 22 nt, Human
guuauguaugggggccuuauga

SEQ ID NO: 552491 - RNA, 22 nt, Human
uuucacaggccuuuuguagccc

SEQ ID NO: 552492 - RNA, 22 nt, Human
gcagagcacccugcagugguau

SEQ ID NO: 552493 - RNA, 22 nt, Human
ggagccuguggcugcuugaagc

SEQ ID NO: 552494 - RNA, 22 nt, Human
gggcugcugccaccagguggau

SEQ ID NO: 552495 - RNA, 22 nt, Human
caggguacagaguuuucuaaac

SEQ ID NO: 552496 - RNA, 17 nt, Human
gcccuggagccaggcua

SEQ ID NO: 552497 - RNA, 22 nt, Human
ggagcugcacgcucugaagccu

SEQ ID NO: 552498 - RNA, 21 nt, Human
ugggggugaggccuaggaauc

SEQ ID NO: 552499 - RNA, 22 nt, Human
cugggccugagcucugaagagu

SEQ ID NO: 552500 - RNA, 22 nt, Human
agccucugcuggcccuggcacu

SEQ ID NO: 552501 - RNA, 21 nt, Human
uuucuaaguaacuggcagcau

SEQ ID NO: 552502 - RNA, 22 nt, Human
ugugacaugugucaucuuuucu

SEQ ID NO: 552503 - RNA, 22 nt, Human
cugaaggauguguggugggagu

SEQ ID NO: 552504 - RNA, 22 nt, Human
ccaggauggggagcagauagaa

SEQ ID NO: 552505 - RNA, 22 nt, Human
uguggcaggcaagauguacaga

SEQ ID NO: 552506 - RNA, 22 nt, Human
cagcugugaauugucuuaucua

SEQ ID NO: 552507 - RNA, 22 nt, Human
cauuuauugguuaggccagcag

SEQ ID NO: 552508 - RNA, 22 nt, Human
uggcccucugcaagauucugga

SEQ ID NO: 552509 - RNA, 22 nt, Human
gcuggcuugacagaggccuggg

SEQ ID NO: 552510 - RNA, 22 nt, Human
ucacagggauggaauagaaaua

SEQ ID NO: 552511 - RNA, 22 nt, Human
cuggaguguaaagagcauagaa

SEQ ID NO: 552512 - RNA, 22 nt, Human
gagaaggcuggucuuaagucga

SEQ ID NO: 552513 - RNA, 22 nt, Human
uuggcacuuugaaugagcucag

SEQ ID NO: 552514 - RNA, 17 nt, Human
aauagcugcucagagag

SEQ ID NO: 552515 - RNA, 22 nt, Human
cugcagcugugagugcuggaug

SEQ ID NO: 552516 - RNA, 22 nt, Human
uugaaauauuugggaguguuug

SEQ ID NO: 552517 - RNA, 22 nt, Human
ucauuuaauagcuuuugucuuu

SEQ ID NO: 552518 - RNA, 20 nt, Human
uaaaugcaucuguucaacug

SEQ ID NO: 552519 - RNA, 22 nt, Human
ucacugcaaccucugccuuccg

SEQ ID NO: 552520 - RNA, 22 nt, Human
gagaagguggaccugaaggagc

SEQ ID NO: 552521 - RNA, 22 nt, Human
aaaggaaugagcuucuguuagg

SEQ ID NO: 552522 - RNA, 22 nt, Human
gggccggagcugggucccgcgc

SEQ ID NO: 552523 - RNA, 22 nt, Human
gccagaagacuggagucagcug

SEQ ID NO: 552524 - RNA, 19 nt, Human
auuugaaagcugugcuugc

SEQ ID NO: 552525 - RNA, 22 nt, Human
aucacaauguacguuaaaaugu

SEQ ID NO: 552526 - RNA, 22 nt, Human
ccacacugaaccucagugucuu

SEQ ID NO: 552527 - RNA, 22 nt, Human
ucuggggaugaggaccuagaug

SEQ ID NO: 552528 - RNA, 22 nt, Human
uuuccuguugccaucaagaaug

SEQ ID NO: 552529 - RNA, 22 nt, Human
aagcagagccaccagcuuugga

SEQ ID NO: 552530 - RNA, 22 nt, Human
aaaugucagaagcuuuacuucu

SEQ ID NO: 552531 - RNA, 23 nt, Human
auggaaauagcaugugucauuua

SEQ ID NO: 552532 - RNA, 22 nt, Human
acaacaguagccuuuacaaggc

SEQ ID NO: 552533 - RNA, 22 nt, Human
ggcagcagcaagguuggagcug

SEQ ID NO: 552534 - RNA, 22 nt, Human
ccugucugcaugaucccugcca

SEQ ID NO: 552535 - RNA, 22 nt, Human
ucaauguucaaguaugacaaug

SEQ ID NO: 552536 - RNA, 22 nt, Human
aacaugaugugaagcaugaacu

SEQ ID NO: 552537 - RNA, 22 nt, Human
agcaugcugguguucauggcag

SEQ ID NO: 552538 - RNA, 22 nt, Human
agagacaccgcgcaucauggcu

SEQ ID NO: 552539 - RNA, 22 nt, Human
caaagugcuaggauuacaggcc

SEQ ID NO: 552540 - RNA, 22 nt, Human
gccuggugcuaugagggccagc

SEQ ID NO: 552541 - RNA, 18 nt, Human
agcagggcauuuugccau

SEQ ID NO: 552542 - RNA, 22 nt, Human
aggguggcaguuacuggagcaa

SEQ ID NO: 552543 - RNA, 22 nt, Human
aggugaggauagguggccaagg

SEQ ID NO: 552544 - RNA, 22 nt, Human
auauuugugguaaagguaagaa

SEQ ID NO: 552545 - RNA, 22 nt, Human
uuccaggaggcacugacagagg

SEQ ID NO: 552546 - RNA, 22 nt, Human
ccugggagagucuguggucucc

SEQ ID NO: 552547 - RNA, 22 nt, Human
ggucauuguucuuuucugugau

SEQ ID NO: 552548 - RNA, 22 nt, Human
ucuggaugacagaauggucaua

SEQ ID NO: 552549 - RNA, 22 nt, Human
augcccugugacucuccuggac

SEQ ID NO: 552550 - RNA, 22 nt, Human
cacugcagcaccaugcagggcu

SEQ ID NO: 552551 - RNA, 22 nt, Human
uugcccugaagaacgucccaga

SEQ ID NO: 552552 - RNA, 22 nt, Human
uuaagacauucagauauuucua

SEQ ID NO: 552553 - RNA, 22 nt, Human
gaaauauuucucuugagccccu

SEQ ID NO: 552554 - RNA, 22 nt, Human
ccauccuaucugaccuacuugu

SEQ ID NO: 552555 - RNA, 18 nt, Human
aggaaagacgaagagggc

SEQ ID NO: 552556 - RNA, 22 nt, Human
gcuguguccucacacagccuuu

SEQ ID NO: 552557 - RNA, 22 nt, Human
ugggagcaggugugcuagggaa

SEQ ID NO: 552558 - RNA, 22 nt, Human
aguugacauccauaacaggaag

SEQ ID NO: 552559 - RNA, 22 nt, Human
uaagaacauaaauucauacggg

SEQ ID NO: 552560 - RNA, 22 nt, Human
gcuauuuauuaaaauagugaag

SEQ ID NO: 552561 - RNA, 22 nt, Human
aggcugucucaccucaggaggg

SEQ ID NO: 552562 - RNA, 21 nt, Human
uggcugagccaggugugugga

SEQ ID NO: 552563 - RNA, 22 nt, Human
gcugggagugggcaagaugaga

SEQ ID NO: 552564 - RNA, 22 nt, Human
aaaaaaucagaucuuugguuaa

SEQ ID NO: 552565 - RNA, 22 nt, Human
aguggaccagaagacugaagcu

SEQ ID NO: 552566 - RNA, 22 nt, Human
gugucuggaacgggugguacuc

SEQ ID NO: 552567 - RNA, 22 nt, Human
ugcccugccaagacugaguggu

SEQ ID NO: 552568 - RNA, 22 nt, Human
cacauuucugugagucaauauu

SEQ ID NO: 552569 - RNA, 22 nt, Human
cuucugggccauggccuuccuc

SEQ ID NO: 552570 - RNA, 22 nt, Human
ugaacacauaaggcuuuccugu

SEQ ID NO: 552571 - RNA, 20 nt, Human
uggcuccucuuggcuguggc

SEQ ID NO: 552572 - RNA, 22 nt, Human
ucauaaaaugcuccugauauug

SEQ ID NO: 552573 - RNA, 22 nt, Human
aaaggcuggauucagagaggug

SEQ ID NO: 552574 - RNA, 22 nt, Human
ugcaggugguccuuccucugcu

SEQ ID NO: 552575 - RNA, 22 nt, Human
gaauucuaccagggcaagaggg

SEQ ID NO: 552576 - RNA, 22 nt, Human
cuacauuuuaauaagcugcuua

SEQ ID NO: 552577 - RNA, 22 nt, Human
ggagggcucaauugacuccuga

SEQ ID NO: 552578 - RNA, 22 nt, Human
cuucaaacccagauuaaaugca

SEQ ID NO: 552579 - RNA, 22 nt, Human
gggaguguugagcgcccugcca

SEQ ID NO: 552580 - RNA, 22 nt, Human
uuaagcuagugaagucccucaa

SEQ ID NO: 552581 - RNA, 22 nt, Human
ugaaaucaugaacaagguaggu

SEQ ID NO: 552582 - RNA, 22 nt, Human
aaaggaggaauggagagaugcu

SEQ ID NO: 552583 - RNA, 22 nt, Human
cagaggcugccagccaugugca

SEQ ID NO: 552584 - RNA, 22 nt, Human
gcagggacaacugugcaccuga

SEQ ID NO: 552585 - RNA, 22 nt, Human
gcaguaggagaagaggaugcuu

SEQ ID NO: 552586 - RNA, 22 nt, Human
gccaggcuggaaagaacagaca

SEQ ID NO: 552587 - RNA, 22 nt, Human
cucuuccuacagucugcuaugc

SEQ ID NO: 552588 - RNA, 22 nt, Human
cuggccugugggcugucuccgg

SEQ ID NO: 552589 - RNA, 22 nt, Human
uuaaauucauuccaacuuuuga

SEQ ID NO: 552590 - RNA, 22 nt, Human
agaacuuacauuauagagcugu

SEQ ID NO: 552591 - RNA, 22 nt, Human
ugaauacaggaaaauauacuga

SEQ ID NO: 552592 - RNA, 22 nt, Human
gcaggaguuaggcgucguggau

SEQ ID NO: 552593 - RNA, 22 nt, Human
ucagaaagcugauucuugauac

SEQ ID NO: 552594 - RNA, 22 nt, Human
ggaaggaagugaccaggauauc

SEQ ID NO: 552595 - RNA, 22 nt, Human
ugcagcagggcccaggcacaga

SEQ ID NO: 552596 - RNA, 22 nt, Human
agcucuggcuaagcugauaaau

SEQ ID NO: 552597 - RNA, 18 nt, Human
uaggcugggggcuguagu

SEQ ID NO: 552598 - RNA, 22 nt, Human
cugagagaugauauagcuuaau

SEQ ID NO: 552599 - RNA, 22 nt, Human
uggccucaagucugagggccuu

SEQ ID NO: 552600 - RNA, 23 nt, Human
uguugaaguaacuguuacauaga

SEQ ID NO: 552601 - RNA, 22 nt, Human
cccauuuagauaacaguucaaa

SEQ ID NO: 552602 - RNA, 21 nt, Human
agucccaggggugagugaugu

SEQ ID NO: 552603 - RNA, 20 nt, Human
gcugccuguuucuguaagua

SEQ ID NO: 552604 - RNA, 22 nt, Human
ggcagaggugaaguucacaagg

SEQ ID NO: 552605 - RNA, 22 nt, Human
gggaccuggggacuccuuguuc

SEQ ID NO: 552606 - RNA, 22 nt, Human
aucaaaguccaucagaagguag

SEQ ID NO: 552607 - RNA, 22 nt, Human
uugaagcauuguggcuuguauu

SEQ ID NO: 552608 - RNA, 22 nt, Human
acccagcuguuucccgugucau

SEQ ID NO: 552609 - RNA, 22 nt, Human
uauugcaagcaauuccaaaagg

SEQ ID NO: 552610 - RNA, 22 nt, Human
guccucugaaguugugcaaugc

SEQ ID NO: 552611 - RNA, 22 nt, Human
ugaaauuauucuuaccaaggug

SEQ ID NO: 552612 - RNA, 22 nt, Human
aaacacauuuuaggaaaaucua

SEQ ID NO: 552613 - RNA, 22 nt, Human
cagaggcaaaagagguggaggu

SEQ ID NO: 552614 - RNA, 22 nt, Human
ugcuccaggcaagcugagaguu

SEQ ID NO: 552615 - RNA, 22 nt, Human
uucagcuacccuuggcuuaaua

SEQ ID NO: 552616 - RNA, 22 nt, Human
uaagcauucaaugcuuagcacu

SEQ ID NO: 552617 - RNA, 22 nt, Human
uggacaacauagugagaccuca

SEQ ID NO: 552618 - RNA, 22 nt, Human
gcucccugacucaguuccugag

SEQ ID NO: 552619 - RNA, 22 nt, Human
ggcaugggccgaggugccuccu

SEQ ID NO: 552620 - RNA, 22 nt, Human
aaggcagcccuggcucagccug

SEQ ID NO: 552621 - RNA, 22 nt, Human
gcacacagcuagauuaccauuc

SEQ ID NO: 552622 - RNA, 22 nt, Human
agucaaacaaauguuuauugag

SEQ ID NO: 552623 - RNA, 22 nt, Human
gcugggccuuccgauucucaag

SEQ ID NO: 552624 - RNA, 22 nt, Human
cagcaggcccaggugcugguga

SEQ ID NO: 552625 - RNA, 22 nt, Human
uuugacaggacuaacauauggc

SEQ ID NO: 552626 - RNA, 22 nt, Human
agggccugugaauucucccugc

SEQ ID NO: 552627 - RNA, 22 nt, Human
cuucagagugcagaagauuggg

SEQ ID NO: 552628 - RNA, 22 nt, Human
cagacagaaggcuccuugaggu

SEQ ID NO: 552629 - RNA, 22 nt, Human
aauguauucucuuuauaagaua

SEQ ID NO: 552630 - RNA, 22 nt, Human
gcugugcccauauucugcugac

SEQ ID NO: 552631 - RNA, 22 nt, Human
gagaggcuaugagguucugugu

SEQ ID NO: 552632 - RNA, 22 nt, Human
ggaagguuuuucuccugguggg

SEQ ID NO: 552633 - RNA, 22 nt, Human
gccaugccugugucuccaggcc

SEQ ID NO: 552634 - RNA, 22 nt, Human
aaugaagcaguuuucaucaagu

SEQ ID NO: 552635 - RNA, 22 nt, Human
gcaggagcagucaggggcagcu

SEQ ID NO: 552636 - RNA, 22 nt, Human
augggcagcugcagcaguggug

SEQ ID NO: 552637 - RNA, 22 nt, Human
gccagagccacuuuugggugau

SEQ ID NO: 552638 - RNA, 22 nt, Human
ggaaaucaucugauuggcuuuc

SEQ ID NO: 552639 - RNA, 19 nt, Human
agaggcugucaccuguagc

SEQ ID NO: 552640 - RNA, 22 nt, Human
agcuuguuuuguugaauacuua

SEQ ID NO: 552641 - RNA, 23 nt, Human
ccucagagaggcagagccacaug

SEQ ID NO: 552642 - RNA, 22 nt, Human
ggcugcaguugugugaaggccg

SEQ ID NO: 552643 - RNA, 19 nt, Human
ucuaauaucuacuucccug

SEQ ID NO: 552644 - RNA, 22 nt, Human
ucucuggagcugcagauccagg

SEQ ID NO: 552645 - RNA, 22 nt, Human
ugaggcaggagaauggcgggaa

SEQ ID NO: 552646 - RNA, 22 nt, Human
agcagcugguaggaguggccac

SEQ ID NO: 552647 - RNA, 22 nt, Human
ggucccaggaagugcggcggcg

SEQ ID NO: 552648 - RNA, 22 nt, Human
aggucacacaacugucagaggc

SEQ ID NO: 552649 - RNA, 22 nt, Human
augggaugcauggcuguggcca

SEQ ID NO: 552650 - RNA, 22 nt, Human
guggcaugacagugaaugggca

SEQ ID NO: 552651 - RNA, 20 nt, Human
ccaauguuuacagauuacuu

SEQ ID NO: 552652 - RNA, 22 nt, Human
gacagcagaugaagccugcaga

SEQ ID NO: 552653 - RNA, 20 nt, Human
cuucaggacccauccucccc

SEQ ID NO: 552654 - RNA, 22 nt, Human
ucaguguuuuuaaagcaauaua

SEQ ID NO: 552655 - RNA, 22 nt, Human
uguaaacauauguauguaugua

SEQ ID NO: 552656 - RNA, 16 nt, Human
gcuggucaagcagcag

SEQ ID NO: 552657 - RNA, 22 nt, Human
gaggaaacauuguagaagcagu

SEQ ID NO: 552658 - RNA, 22 nt, Human
aagauuaaaggggagacaagcu

SEQ ID NO: 552659 - RNA, 22 nt, Human
aggcugugcaauuaggguaaga

SEQ ID NO: 552660 - RNA, 22 nt, Human
ccaggagcauuaagagaacaua

SEQ ID NO: 552661 - RNA, 22 nt, Human
uuccaaagaaauugaccaagac

SEQ ID NO: 552662 - RNA, 23 nt, Human
gccauggcugccccacaggccuc

SEQ ID NO: 552663 - RNA, 18 nt, Human
ucagacaaguuagacagg

SEQ ID NO: 552664 - RNA, 20 nt, Human
aaagucuguuuaucucugga

SEQ ID NO: 552665 - RNA, 22 nt, Human
gaggucaggcuugcagcagggu

SEQ ID NO: 552666 - RNA, 22 nt, Human
agcagaugaaucccagauaaag

SEQ ID NO: 552667 - RNA, 22 nt, Human
ucucccacagccgugcuucaag

SEQ ID NO: 552668 - RNA, 22 nt, Human
auauuuauaagcaagcaggacu

SEQ ID NO: 552669 - RNA, 22 nt, Human
gacauaaaccuugagauauuaa

SEQ ID NO: 552670 - RNA, 22 nt, Human
gcacacagauuaggaaacagaa

SEQ ID NO: 552671 - RNA, 20 nt, Human
ucuuuguuaauuuuaucucc

SEQ ID NO: 552672 - RNA, 22 nt, Human
ucagaggacaagcucccuggug

SEQ ID NO: 552673 - RNA, 22 nt, Human
uacauuuacagagccuucucug

SEQ ID NO: 552674 - RNA, 22 nt, Human
ucugccuggccuggagggcaca

SEQ ID NO: 552675 - RNA, 22 nt, Human
ccuguucaugaaacugcuuucc

SEQ ID NO: 552676 - RNA, 20 nt, Human
aaaugccagugauucugcuu

SEQ ID NO: 552677 - RNA, 22 nt, Human
agcugccucccugugcuugucc

SEQ ID NO: 552678 - RNA, 22 nt, Human
gaggacaggagacucacuguuu

SEQ ID NO: 552679 - RNA, 18 nt, Human
caggaugagugaugggga

SEQ ID NO: 552680 - RNA, 20 nt, Human
gcucccagccugcagucccc

SEQ ID NO: 552681 - RNA, 22 nt, Human
uguggcucucagauccuccaau

SEQ ID NO: 552682 - RNA, 22 nt, Human
ggcccagaagccagaagccucc

SEQ ID NO: 552683 - RNA, 22 nt, Human
uuaaaucaggcaucauuucagu

SEQ ID NO: 552684 - RNA, 22 nt, Human
uaaggccaaguucauauacaac

SEQ ID NO: 552685 - RNA, 22 nt, Human
uguucuuuggcuuccuuuccgu

SEQ ID NO: 552686 - RNA, 22 nt, Human
gaaguuaguaccugguauacuu

SEQ ID NO: 552687 - RNA, 22 nt, Human
cucuuacaagcucccgauauaa

SEQ ID NO: 552688 - RNA, 22 nt, Human
auaaauuuauaauuguuuccug

SEQ ID NO: 552689 - RNA, 22 nt, Human
ugcagggaaugcuugcagcaug

SEQ ID NO: 552690 - RNA, 22 nt, Human
cugagcagaccauggcagaggu

SEQ ID NO: 552691 - RNA, 22 nt, Human
uugucccauugcgaaugugagu

SEQ ID NO: 552692 - RNA, 22 nt, Human
ucccaagauacgcuguaagaag

SEQ ID NO: 552693 - RNA, 22 nt, Human
ugacauuuuaucaauaucacag

SEQ ID NO: 552694 - RNA, 22 nt, Human
aguaugaaccuggguucuggau

SEQ ID NO: 552695 - RNA, 22 nt, Human
guucauucaaucuauuugcuuc

SEQ ID NO: 552696 - RNA, 22 nt, Human
ccaggugucuguggccagcccu

SEQ ID NO: 552697 - RNA, 22 nt, Human
gggcuucuagaccagcagugag

SEQ ID NO: 552698 - RNA, 22 nt, Human
cuggggcugcgguggaggagcc

SEQ ID NO: 552699 - RNA, 22 nt, Human
guuguauucuucaauaucagag

SEQ ID NO: 552700 - RNA, 22 nt, Human
agguuuucacaggaaguauguu

SEQ ID NO: 552701 - RNA, 22 nt, Human
aggugaguuacaggaggagguc

SEQ ID NO: 552702 - RNA, 22 nt, Human
aagcacagaccagaucuccagg

SEQ ID NO: 552703 - RNA, 22 nt, Human
augcacccagugucuggacuau

SEQ ID NO: 552704 - RNA, 22 nt, Human
cguggggcggguggacacuugc

SEQ ID NO: 552705 - RNA, 22 nt, Human
ugcagccaauucauucauucuu

SEQ ID NO: 552706 - RNA, 22 nt, Human
agaaaucaugucuuauuucuau

SEQ ID NO: 552707 - RNA, 22 nt, Human
ccagggcaggggcuggaguuca

SEQ ID NO: 552708 - RNA, 22 nt, Human
uccaaguucuaggaacugcugc

SEQ ID NO: 552709 - RNA, 22 nt, Human
cagcaggguagguuguaucagu

SEQ ID NO: 552710 - RNA, 20 nt, Human
aucaggauucuugcuuuguu

SEQ ID NO: 552711 - RNA, 22 nt, Human
gucucagggacugcuucugggg

SEQ ID NO: 552712 - RNA, 22 nt, Human
uccuuccuggggucucugcugc

SEQ ID NO: 552713 - RNA, 22 nt, Human
cagcagaagugcauuugugauu

SEQ ID NO: 552714 - RNA, 22 nt, Human
gggcuggaggccugccugguua

SEQ ID NO: 552715 - RNA, 22 nt, Human
ugaaauguggagaugguaagua

SEQ ID NO: 552716 - RNA, 22 nt, Human
guggcugcaucggggugaccag

SEQ ID NO: 552717 - RNA, 22 nt, Human
uagaaacauucaguugcagucc

SEQ ID NO: 552718 - RNA, 22 nt, Human
agaggguugaaccuauaaacua

SEQ ID NO: 552719 - RNA, 22 nt, Human
agcuggccuuagugagcaccug

SEQ ID NO: 552720 - RNA, 22 nt, Human
cacccagcagcacuuaagacua

SEQ ID NO: 552721 - RNA, 22 nt, Human
ccuggagguggagguugcagug

SEQ ID NO: 552722 - RNA, 22 nt, Human
uucccugcaaccuuucccuggg

SEQ ID NO: 552723 - RNA, 22 nt, Human
cucccagguuacaucugagccu

SEQ ID NO: 552724 - RNA, 22 nt, Human
cagaacugggcucgcucugguu

SEQ ID NO: 552725 - RNA, 22 nt, Human
uuuaugcaucucuaggaagggc

SEQ ID NO: 552726 - RNA, 22 nt, Human
gugcauacuuuauuuuaauacu

SEQ ID NO: 552727 - RNA, 22 nt, Human
aauauauuugaaucaggaacaa

SEQ ID NO: 552728 - RNA, 22 nt, Human
uguacaguguagucaugagguu

SEQ ID NO: 552729 - RNA, 22 nt, Human
uuuauguuauggguaggaucaa

SEQ ID NO: 552730 - RNA, 22 nt, Human
uugcaaggcuagguucacccac

SEQ ID NO: 552731 - RNA, 22 nt, Human
gggccuggggacaccaccauga

SEQ ID NO: 552732 - RNA, 22 nt, Human
acacacuuuaaauuaaaccucu

SEQ ID NO: 552733 - RNA, 22 nt, Human
gggccuugccauggagccugag

SEQ ID NO: 552734 - RNA, 22 nt, Human
guggcagggcuuugcuguucuu

SEQ ID NO: 552735 - RNA, 22 nt, Human
aaugucugagucucuguauccc

SEQ ID NO: 552736 - RNA, 22 nt, Human
agcugguucauucauucauggu

SEQ ID NO: 552737 - RNA, 22 nt, Human
uagcuuaucccacagugcccag

SEQ ID NO: 552738 - RNA, 21 nt, Human
acagccugucaucucaugguc

SEQ ID NO: 552739 - RNA, 22 nt, Human
augcaacagagaaaauauugag

SEQ ID NO: 552740 - RNA, 22 nt, Human
uccugccugagcguggaggagg

SEQ ID NO: 552741 - RNA, 22 nt, Human
ggcugggcaggucugcacaggg

SEQ ID NO: 552742 - RNA, 22 nt, Human
auuuaccauauguacugaguau

SEQ ID NO: 552743 - RNA, 22 nt, Human
uccagaaaguacaugggauuca

SEQ ID NO: 552744 - RNA, 22 nt, Human
uccacgugagcuucgugugcag

SEQ ID NO: 552745 - RNA, 22 nt, Human
acuuuagauauuccucuguaca

SEQ ID NO: 552746 - RNA, 22 nt, Human
ucugggagagcugcugucagag

SEQ ID NO: 552747 - RNA, 22 nt, Human
gcaccaggaggcccuucucauc

SEQ ID NO: 552748 - RNA, 22 nt, Human
ucacaggaaccaucagagaaau

SEQ ID NO: 552749 - RNA, 22 nt, Human
cacuguguaagaagaugggcuu

SEQ ID NO: 552750 - RNA, 22 nt, Human
cacuggaauauggcguugaacc

SEQ ID NO: 552751 - RNA, 22 nt, Human
aaauaucauucuggugcacaga

SEQ ID NO: 552752 - RNA, 22 nt, Human
cugggcacagcguugggcucuu

SEQ ID NO: 552753 - RNA, 22 nt, Human
uccccacacuuucacuccuggc

SEQ ID NO: 552754 - RNA, 22 nt, Human
cauuuccacuucugaaaacugg

SEQ ID NO: 552755 - RNA, 22 nt, Human
ggcucaagcagucugccugccu

SEQ ID NO: 552756 - RNA, 17 nt, Human
gcuuccugugcugggga

SEQ ID NO: 552757 - RNA, 22 nt, Human
gcuccuggagagauugagaaag

SEQ ID NO: 552758 - RNA, 22 nt, Human
ggauccuuaacuaucacaguga

SEQ ID NO: 552759 - RNA, 22 nt, Human
auacaacagaaaaugauuauuc

SEQ ID NO: 552760 - RNA, 22 nt, Human
gcaccaugauggagccucauua

SEQ ID NO: 552761 - RNA, 22 nt, Human
ugaaaucuuauacuuugguagu

SEQ ID NO: 552762 - RNA, 22 nt, Human
caugccuguauuucugaucuau

SEQ ID NO: 552763 - RNA, 22 nt, Human
gugcauauaugcacauaugugu

SEQ ID NO: 552764 - RNA, 22 nt, Human
uuauuccaauuucuccuacaaa

SEQ ID NO: 552765 - RNA, 22 nt, Human
aucacaaaggcugcuucaugau

SEQ ID NO: 552766 - RNA, 22 nt, Human
ccuggcagcuccguggccuucc

SEQ ID NO: 552767 - RNA, 22 nt, Human
gcagaggccaggccaccagcaa

SEQ ID NO: 552768 - RNA, 22 nt, Human
caggacaguuugcuuugcccug

SEQ ID NO: 552769 - RNA, 22 nt, Human
caucuuuaacaauuuacaaugu

SEQ ID NO: 552770 - RNA, 21 nt, Human
ugacugaggcuucuucacaca

SEQ ID NO: 552771 - RNA, 22 nt, Human
uuaaacaguauaucugagcaag

SEQ ID NO: 552772 - RNA, 22 nt, Human
cugcuccacaccuccauuuccu

SEQ ID NO: 552773 - RNA, 22 nt, Human
gugcuugggggaaguaacagac

SEQ ID NO: 552774 - RNA, 22 nt, Human
ucuguucagaagaggugaaagu

SEQ ID NO: 552775 - RNA, 23 nt, Human
ugcagcugccucuggcgggccgg

SEQ ID NO: 552776 - RNA, 22 nt, Human
agggucuguggaugcaucuggg

SEQ ID NO: 552777 - RNA, 22 nt, Human
gagcugcuucugugugccgggu

SEQ ID NO: 552778 - RNA, 22 nt, Human
cacagggcagugcugcccacuc

SEQ ID NO: 552779 - RNA, 22 nt, Human
ugugaaggagaugaagggagug

SEQ ID NO: 552780 - RNA, 20 nt, Human
cccugagacgacugagcucc

SEQ ID NO: 552781 - RNA, 23 nt, Human
gcagagucaaguagucaugagug

SEQ ID NO: 552782 - RNA, 22 nt, Human
ucaaaggcaccaaggucacugc

SEQ ID NO: 552783 - RNA, 22 nt, Human
auuguucuaaggguuuaauuaa

SEQ ID NO: 552784 - RNA, 22 nt, Human
gggcuccaccuagggacacugg

SEQ ID NO: 552785 - RNA, 19 nt, Human
cugcagggaugugcagagu

SEQ ID NO: 552786 - RNA, 22 nt, Human
uccuugaagcuuguaucuaaua

SEQ ID NO: 552787 - RNA, 18 nt, Human
cccacggugcuguagggc

SEQ ID NO: 552788 - RNA, 22 nt, Human
aaaugcaaggccaugugaagga

SEQ ID NO: 552789 - RNA, 19 nt, Human
ccaggccuggcgucuccgc

SEQ ID NO: 552790 - RNA, 22 nt, Human
acugagagaacgggcugcuccc

SEQ ID NO: 552791 - RNA, 22 nt, Human
uaauuuacuugcaaauaacaau

SEQ ID NO: 552792 - RNA, 22 nt, Human
augaggcucucaggggagcugu

SEQ ID NO: 552793 - RNA, 22 nt, Human
gauuucaaggauguuagaggug

SEQ ID NO: 552794 - RNA, 22 nt, Human
uuucagagccuuuaucucucua

SEQ ID NO: 552795 - RNA, 22 nt, Human
cagaaguaagauuacugugaga

SEQ ID NO: 552796 - RNA, 22 nt, Human
gggcacaguacuccaaucaacu

SEQ ID NO: 552797 - RNA, 22 nt, Human
guuuguaauuacugcagcaugg

SEQ ID NO: 552798 - RNA, 22 nt, Human
ggcccugcugaguggaguggag

SEQ ID NO: 552799 - RNA, 22 nt, Human
aucacuaugggcauuauauuua

SEQ ID NO: 552800 - RNA, 23 nt, Human
ugggaccuguuugcccacagaug

SEQ ID NO: 552801 - RNA, 22 nt, Human
gagggagcuugauggauguuug

SEQ ID NO: 552802 - RNA, 22 nt, Human
cugagggccuuggcuccugccc

SEQ ID NO: 552803 - RNA, 21 nt, Human
ugcaugcuauguuuuuauuuc

SEQ ID NO: 552804 - RNA, 22 nt, Human
auauaauaguuucauaaaggcu

SEQ ID NO: 552805 - RNA, 22 nt, Human
ugccugaguuuaacccucagag

SEQ ID NO: 552806 - RNA, 22 nt, Human
ucagauggaggcaauguuaccu

SEQ ID NO: 552807 - RNA, 22 nt, Human
uccaugucuucaugugucuaac

SEQ ID NO: 552808 - RNA, 22 nt, Human
caguguuucugaguuccagcuc

SEQ ID NO: 552809 - RNA, 22 nt, Human
cccucugaccuccugccacagu

SEQ ID NO: 552810 - RNA, 22 nt, Human
ggaggucaaauggagggcuggg

SEQ ID NO: 552811 - RNA, 22 nt, Human
gugauuccuauuaguacaugca

SEQ ID NO: 552812 - RNA, 22 nt, Human
acaacauucuuaaauacacuga

SEQ ID NO: 552813 - RNA, 22 nt, Human
ugaggccugggcacauaaccuc

SEQ ID NO: 552814 - RNA, 22 nt, Human
auuaaaagagauaauguguguu

SEQ ID NO: 552815 - RNA, 22 nt, Human
auuuucagugaucauagcacac

SEQ ID NO: 552816 - RNA, 22 nt, Human
aucagcaaaaaugccuucagaa

SEQ ID NO: 552817 - RNA, 22 nt, Human
ucuaaacauaacuuugugugau

SEQ ID NO: 552818 - RNA, 22 nt, Human
gaauuuuucuggaagcaauuau

SEQ ID NO: 552819 - RNA, 20 nt, Human
uugggccugucagcacuccc

SEQ ID NO: 552820 - RNA, 22 nt, Human
cucuucaacugccaggcagucu

SEQ ID NO: 552821 - RNA, 22 nt, Human
ucugaagccaccucugcuuguc

SEQ ID NO: 552822 - RNA, 22 nt, Human
accugcaguggccacuccuaau

SEQ ID NO: 552823 - RNA, 22 nt, Human
aacaguaauggcauugccauga

SEQ ID NO: 552824 - RNA, 22 nt, Human
gggcccugggauucagagcaag

SEQ ID NO: 552825 - RNA, 22 nt, Human
cagcuuguuuuauuuggggacc

SEQ ID NO: 552826 - RNA, 22 nt, Human
gugagcaggauaggggcucccu

SEQ ID NO: 552827 - RNA, 22 nt, Human
uccuguggucuggaaggaaugg

SEQ ID NO: 552828 - RNA, 22 nt, Human
uuuauuccaugugucuaugacc

SEQ ID NO: 552829 - RNA, 19 nt, Human
uagaaugcccacuuaaaaa

SEQ ID NO: 552830 - RNA, 22 nt, Human
ggccucucuggcauggcugccc

SEQ ID NO: 552831 - RNA, 22 nt, Human
auuguaucuugucauuaugcau

SEQ ID NO: 552832 - RNA, 22 nt, Human
aggagucagauuguuugaaugu

SEQ ID NO: 552833 - RNA, 22 nt, Human
gaauuagguaauagaacuagua

SEQ ID NO: 552834 - RNA, 22 nt, Human
cuucaguguucccaucuguaaa

SEQ ID NO: 552835 - RNA, 22 nt, Human
uagcauuaaagguaagacauua

SEQ ID NO: 552836 - RNA, 22 nt, Human
uggggagaaaugucuuuguucc

SEQ ID NO: 552837 - RNA, 22 nt, Human
ccaguccagugccaugcauggc

SEQ ID NO: 552838 - RNA, 20 nt, Human
acucuaccagggcagcagca

SEQ ID NO: 552839 - RNA, 22 nt, Human
agcugggagcagagccacagcc

SEQ ID NO: 552840 - RNA, 22 nt, Human
auccuugacacacuccaguacu

SEQ ID NO: 552841 - RNA, 22 nt, Human
auguauaugaagcuaguauuuu

SEQ ID NO: 552842 - RNA, 22 nt, Human
agccaggcagggcucucgcucu

SEQ ID NO: 552843 - RNA, 22 nt, Human
ccaccaggacagcccugagggg

SEQ ID NO: 552844 - RNA, 22 nt, Human
ugcccaagauucuuacaucaug

SEQ ID NO: 552845 - RNA, 22 nt, Human
agccagcaugaagacagaggcc

SEQ ID NO: 552846 - RNA, 22 nt, Human
ugcagaguccucuggagggacu

SEQ ID NO: 552847 - RNA, 22 nt, Human
gagggaagauuccccauauggg

SEQ ID NO: 552848 - RNA, 22 nt, Human
agcucuggaccugacaucuggu

SEQ ID NO: 552849 - RNA, 22 nt, Human
uggcugaguuacgaacagagca

SEQ ID NO: 552850 - RNA, 22 nt, Human
caaauucucuuacuguuugaca

SEQ ID NO: 552851 - RNA, 22 nt, Human
aggcuggagggcaauggcaaga

SEQ ID NO: 552852 - RNA, 22 nt, Human
cagagccuuccuagcagacucu

SEQ ID NO: 552853 - RNA, 22 nt, Human
guauuucuagaaccaaaagcca

SEQ ID NO: 552854 - RNA, 22 nt, Human
gggagcuguaagggacagguag

SEQ ID NO: 552855 - RNA, 22 nt, Human
aggcuggcuuugguagcauggu

SEQ ID NO: 552856 - RNA, 22 nt, Human
ccugcugucccucugggcucca

SEQ ID NO: 552857 - RNA, 22 nt, Human
ugggcacagaauagauggccca

SEQ ID NO: 552858 - RNA, 22 nt, Human
gcacagaagagcuuuggaauga

SEQ ID NO: 552859 - RNA, 22 nt, Human
gcaaauauuucuaauuccugaa

SEQ ID NO: 552860 - RNA, 22 nt, Human
acaauauacacauccuaauggg

SEQ ID NO: 552861 - RNA, 22 nt, Human
ugaauaaauugagagcgaaugu

SEQ ID NO: 552862 - RNA, 22 nt, Human
agggaccugucaaugacaguua

SEQ ID NO: 552863 - RNA, 22 nt, Human
gcggggacagaaggcgguucuc

SEQ ID NO: 552864 - RNA, 22 nt, Human
uacuguuuuaaaagguacuugu

SEQ ID NO: 552865 - RNA, 22 nt, Human
ucacaucaggugucuccccaag

SEQ ID NO: 552866 - RNA, 22 nt, Human
auuuuuaggcucuacccucaga

SEQ ID NO: 552867 - RNA, 22 nt, Human
accuggcuuccaaucuaggagc

SEQ ID NO: 552868 - RNA, 22 nt, Human
gaaaaguacacagcccaaacau

SEQ ID NO: 552869 - RNA, 22 nt, Human
caguuaaagugcuuaucacaga

SEQ ID NO: 552870 - RNA, 22 nt, Human
aguguuuuauuucagcacuuug

SEQ ID NO: 552871 - RNA, 22 nt, Human
cggcugugucuucacaggagcc

SEQ ID NO: 552872 - RNA, 22 nt, Human
agaguaaaguacuuggaauacc

SEQ ID NO: 552873 - RNA, 22 nt, Human
aauuuugugugggaucaaagga

SEQ ID NO: 552874 - RNA, 22 nt, Human
ucuucaauauguguuuaauauu

SEQ ID NO: 552875 - RNA, 22 nt, Human
aagaaguuggaaaugauugaga

SEQ ID NO: 552876 - RNA, 22 nt, Human
gagugugucggucagcguggcg

SEQ ID NO: 552877 - RNA, 22 nt, Human
ucugugacuugcgggaggagaa

SEQ ID NO: 552878 - RNA, 22 nt, Human
agucagagcaaacuggacagac

SEQ ID NO: 552879 - RNA, 22 nt, Human
acagaaaugauguuuggcaaua

SEQ ID NO: 552880 - RNA, 22 nt, Human
cugucaccuguucacugcagca

SEQ ID NO: 552881 - RNA, 22 nt, Human
ccacagagacaggguccuugcu

SEQ ID NO: 552882 - RNA, 22 nt, Human
gccucaggacuggcauacucau

SEQ ID NO: 552883 - RNA, 20 nt, Human
acaauuuccucacuauaugc

SEQ ID NO: 552884 - RNA, 22 nt, Human
ggcugggcugcugggucagagc

SEQ ID NO: 552885 - RNA, 22 nt, Human
ccugucugaaggcagggggaug

SEQ ID NO: 552886 - RNA, 22 nt, Human
ucaauucagacugagaaaugau

SEQ ID NO: 552887 - RNA, 22 nt, Human
ucccagacaaucauuggccacc

SEQ ID NO: 552888 - RNA, 22 nt, Human
gaguucugugauuauuugggac

SEQ ID NO: 552889 - RNA, 22 nt, Human
acccugagucagacagccugac

SEQ ID NO: 552890 - RNA, 22 nt, Human
uguucuguuuuaugguagggaa

SEQ ID NO: 552891 - RNA, 22 nt, Human
uaguggagaaguggagucugug

SEQ ID NO: 552892 - RNA, 22 nt, Human
agcagcagauucagcaggaaug

SEQ ID NO: 552893 - RNA, 22 nt, Human
ucacauuucugauuauaccaaa

SEQ ID NO: 552894 - RNA, 22 nt, Human
gacaugcaugaaugcaggucuc

SEQ ID NO: 552895 - RNA, 22 nt, Human
gaggguggcuccucccugggcc

SEQ ID NO: 552896 - RNA, 22 nt, Human
uucaaacaacucauuuaugcaa

SEQ ID NO: 552897 - RNA, 22 nt, Human
agaggucagaacaggaaagugu

SEQ ID NO: 552898 - RNA, 22 nt, Human
uauagcaagcaggacagucuca

SEQ ID NO: 552899 - RNA, 22 nt, Human
guuuucuuccugcaauuggcau

SEQ ID NO: 552900 - RNA, 22 nt, Human
gcccauggaaaaccuguccucu

SEQ ID NO: 552901 - RNA, 22 nt, Human
uacaugaauguuucaauauugu

SEQ ID NO: 552902 - RNA, 22 nt, Human
uggaggaugccauccaggauac

SEQ ID NO: 552903 - RNA, 23 nt, Human
aggggcagcaaguuuugguguua

SEQ ID NO: 552904 - RNA, 21 nt, Human
gccagggaagagaguuggcug

SEQ ID NO: 552905 - RNA, 22 nt, Human
agcagagcggggccuccggaag

SEQ ID NO: 552906 - RNA, 22 nt, Human
agggaggaaggauguuccaaag

SEQ ID NO: 552907 - RNA, 22 nt, Human
ucacacaugaguaaauacaggg

SEQ ID NO: 552908 - RNA, 22 nt, Human
gcuucuggcagugcagccacca

SEQ ID NO: 552909 - RNA, 22 nt, Human
ccuggacucaggcugugggcac

SEQ ID NO: 552910 - RNA, 22 nt, Human
cagcagagggagccauugaaau

SEQ ID NO: 552911 - RNA, 22 nt, Human
uggcuucuugggaugggucauu

SEQ ID NO: 552912 - RNA, 22 nt, Human
ugcucuggaauaguccuaggca

SEQ ID NO: 552913 - RNA, 22 nt, Human
gaaggaagauucuguuggaauc

SEQ ID NO: 552914 - RNA, 22 nt, Human
cagguucccuugcagcuaagug

SEQ ID NO: 552915 - RNA, 22 nt, Human
ucugccuugagguccucagcuc

SEQ ID NO: 552916 - RNA, 22 nt, Human
uuugugcacuucuguagcugcc

SEQ ID NO: 552917 - RNA, 22 nt, Human
agcuggguucagaggcacaugg

SEQ ID NO: 552918 - RNA, 22 nt, Human
ccugccuggaucagccauccug

SEQ ID NO: 552919 - RNA, 22 nt, Human
agcucugguuuagaaggggaaa

SEQ ID NO: 552920 - RNA, 22 nt, Human
acuggcagccacaacuggcagg

SEQ ID NO: 552921 - RNA, 22 nt, Human
aaguuacuggcaagggcugcag

SEQ ID NO: 552922 - RNA, 22 nt, Human
acacaucagccucagcuuuggg

SEQ ID NO: 552923 - RNA, 22 nt, Human
cucaguagaaaauacauggacu

SEQ ID NO: 552924 - RNA, 22 nt, Human
ggugggcacauucagucucugu

SEQ ID NO: 552925 - RNA, 21 nt, Human
acuguucaucuguucagaagc

SEQ ID NO: 552926 - RNA, 22 nt, Human
uucuuuccaaccagauauuggu

SEQ ID NO: 552927 - RNA, 22 nt, Human
agggcugaaguuauggcugagc

SEQ ID NO: 552928 - RNA, 22 nt, Human
ccugugcuggcuuuauucucag

SEQ ID NO: 552929 - RNA, 22 nt, Human
gccugcagggugaugggcugcc

SEQ ID NO: 552930 - RNA, 22 nt, Human
gccuuugccugcgacguggcug

SEQ ID NO: 552931 - RNA, 22 nt, Human
uggcucugggaaucuguugcuu

SEQ ID NO: 552932 - RNA, 22 nt, Human
gccaagcuuggaaggaucaugg

SEQ ID NO: 552933 - RNA, 22 nt, Human
gaaggagacccugaagaugcug

SEQ ID NO: 552934 - RNA, 22 nt, Human
aggcucugugacaaucaagcug

SEQ ID NO: 552935 - RNA, 22 nt, Human
uagaugcuugucaguuucuguc

SEQ ID NO: 552936 - RNA, 22 nt, Human
agacacagugaguuucuuuccc

SEQ ID NO: 552937 - RNA, 22 nt, Human
ugaauggucacugagcaucugu

SEQ ID NO: 552938 - RNA, 20 nt, Human
ccacaggaguccagucgacc

SEQ ID NO: 552939 - RNA, 22 nt, Human
ucaggcugcaucuguaagggug

SEQ ID NO: 552940 - RNA, 22 nt, Human
cagagcaguaaaucuggggcac

SEQ ID NO: 552941 - RNA, 22 nt, Human
agauaacauguugcagauucug

SEQ ID NO: 552942 - RNA, 22 nt, Human
ucccagccuccugacaguuuug

SEQ ID NO: 552943 - RNA, 22 nt, Human
cugagcugcggcaggcaccugg

SEQ ID NO: 552944 - RNA, 19 nt, Human
guagggacagugguucuga

SEQ ID NO: 552945 - RNA, 18 nt, Human
uccagagguguuggagcc

SEQ ID NO: 552946 - RNA, 22 nt, Human
uuuuuccuuagggguuacucac

SEQ ID NO: 552947 - RNA, 22 nt, Human
ucugaaauaaaugcacuguuag

SEQ ID NO: 552948 - RNA, 16 nt, Human
gcagguggggcgcgca

SEQ ID NO: 552949 - RNA, 23 nt, Human
agucagagagugugagacaacug

SEQ ID NO: 552950 - RNA, 22 nt, Human
uggcucagagccuugagagcug

SEQ ID NO: 552951 - RNA, 22 nt, Human
aaguuacauaaauguccucuag

SEQ ID NO: 552952 - RNA, 22 nt, Human
ccaugcccuugucaucuccagg

SEQ ID NO: 552953 - RNA, 20 nt, Human
ugcagguguuggagaaggua

SEQ ID NO: 552954 - RNA, 20 nt, Human
uggcagaguugucccaccca

SEQ ID NO: 552955 - RNA, 22 nt, Human
uacaguauauacuguguguaga

SEQ ID NO: 552956 - RNA, 22 nt, Human
uaugaucuuuauaaccuaucuu

SEQ ID NO: 552957 - RNA, 22 nt, Human
cccugcagagaccacugaccuu

SEQ ID NO: 552958 - RNA, 23 nt, Human
cagaagacagucucaagacaagg

SEQ ID NO: 552959 - RNA, 22 nt, Human
agucccagcuacucaagaggcu

SEQ ID NO: 552960 - RNA, 22 nt, Human
agccuggcuaaauucucccaug

SEQ ID NO: 552961 - RNA, 22 nt, Human
aaguccagacuccuuugcgugg

SEQ ID NO: 552962 - RNA, 22 nt, Human
gcuucugaguucuugcuuaaua

SEQ ID NO: 552963 - RNA, 22 nt, Human
ccagggugaggaggcucccacg

SEQ ID NO: 552964 - RNA, 22 nt, Human
caagaauuaagaauuuugaugu

SEQ ID NO: 552965 - RNA, 22 nt, Human
uggcacugaagcuggaaagccu

SEQ ID NO: 552966 - RNA, 19 nt, Human
ggccuugaugaguggggag

SEQ ID NO: 552967 - RNA, 22 nt, Human
gaugaagcuaaaucuaagguuu

SEQ ID NO: 552968 - RNA, 22 nt, Human
aacauuuuuaagaccaagugcu

SEQ ID NO: 552969 - RNA, 22 nt, Human
uaacaucugggcugcguccuga

SEQ ID NO: 552970 - RNA, 22 nt, Human
ucagaagcauguggggagccug

SEQ ID NO: 552971 - RNA, 22 nt, Human
cauacuuugggauaagagugga

SEQ ID NO: 552972 - RNA, 22 nt, Human
ucugccugugguggaggaaguu

SEQ ID NO: 552973 - RNA, 22 nt, Human
cugaggcucccucgggucugcu

SEQ ID NO: 552974 - RNA, 22 nt, Human
gucuggaguggggccugagaau

SEQ ID NO: 552975 - RNA, 22 nt, Human
caagccucagaaucuucuccau

SEQ ID NO: 552976 - RNA, 23 nt, Human
ugaaacagaugccaaugaucaag

SEQ ID NO: 552977 - RNA, 22 nt, Human
ucucaauauuauaugucauaaa

SEQ ID NO: 552978 - RNA, 22 nt, Human
gugucccagccccacaggccug

SEQ ID NO: 552979 - RNA, 22 nt, Human
uacauaguuccauuuacaggaa

SEQ ID NO: 552980 - RNA, 19 nt, Human
uccugcagaccagaccugu

SEQ ID NO: 552981 - RNA, 22 nt, Human
augcuguguccuagugaaagaa

SEQ ID NO: 552982 - RNA, 21 nt, Human
ucuggcagcaguuuguugagu

SEQ ID NO: 552983 - RNA, 20 nt, Human
uccugagccuccaccauguc

SEQ ID NO: 552984 - RNA, 22 nt, Human
ucaaagauggguuuuguuugau

SEQ ID NO: 552985 - RNA, 22 nt, Human
guauccuccccgcuggccuuca

SEQ ID NO: 552986 - RNA, 22 nt, Human
ugggcucauguuucuuugagga

SEQ ID NO: 552987 - RNA, 22 nt, Human
gacacaugaccauaaaugcuaa

SEQ ID NO: 552988 - RNA, 23 nt, Human
ugccaaaguuuaccuaacacugg

SEQ ID NO: 552989 - RNA, 22 nt, Human
ggcacugggagaggugagacgg

SEQ ID NO: 552990 - RNA, 22 nt, Human
uugguuuagagagugugguuac

SEQ ID NO: 552991 - RNA, 22 nt, Human
ucagauuuuccagccuuucucu

SEQ ID NO: 552992 - RNA, 22 nt, Human
ucugagcuuuuauuaucaaccu

SEQ ID NO: 552993 - RNA, 22 nt, Human
aacccaggagacagguugcagu

SEQ ID NO: 552994 - RNA, 22 nt, Human
ugucuuuagagucacaaaacca

SEQ ID NO: 552995 - RNA, 20 nt, Human
acaauagauuugagcaaagu

SEQ ID NO: 552996 - RNA, 22 nt, Human
uaaagcaaggcaaauuguuggu

SEQ ID NO: 552997 - RNA, 22 nt, Human
uggggcuggcuauugucucccu

SEQ ID NO: 552998 - RNA, 21 nt, Human
ggcaggugggucucuguugcu

SEQ ID NO: 552999 - RNA, 20 nt, Human
cccaggugucugaagcucug

SEQ ID NO: 553000 - RNA, 22 nt, Human
cuguuauuuagaacauggaauc

SEQ ID NO: 553001 - RNA, 22 nt, Human
aaaaaauuccauucugugccuu

SEQ ID NO: 553002 - RNA, 22 nt, Human
augcccuggggcuaccucugag

SEQ ID NO: 553003 - RNA, 22 nt, Human
cuucaggauuuaggaagaugaa

SEQ ID NO: 553004 - RNA, 19 nt, Human
acacagggaucagaggguu

SEQ ID NO: 553005 - RNA, 22 nt, Human
cucucccucauuggguuccauu

SEQ ID NO: 553006 - RNA, 23 nt, Human
ccagccucugggucuucauccag

SEQ ID NO: 553007 - RNA, 22 nt, Human
ucugucugcucauuuaccucag

SEQ ID NO: 553008 - RNA, 22 nt, Human
cagggcagccaggccccguggg

SEQ ID NO: 553009 - RNA, 18 nt, Human
cccagcuuagcgccccuc

SEQ ID NO: 553010 - RNA, 22 nt, Human
caugcacagugauaucugaaga

SEQ ID NO: 553011 - RNA, 22 nt, Human
uugcacuccagcccgagcaaca

SEQ ID NO: 553012 - RNA, 22 nt, Human
auccuugagccuuaucuuuugu

SEQ ID NO: 553013 - RNA, 22 nt, Human
gccagcuggagacuggcagggg

SEQ ID NO: 553014 - RNA, 22 nt, Human
ccugcagguccccggaugcgca

SEQ ID NO: 553015 - RNA, 22 nt, Human
ucuuugcaugugcuucuuggcc

SEQ ID NO: 553016 - RNA, 22 nt, Human
gggccaugagagguucaucaac

SEQ ID NO: 553017 - RNA, 22 nt, Human
ccuguucauuuuuugacucugc

SEQ ID NO: 553018 - RNA, 22 nt, Human
uccuucaacuuuuuacuugccc

SEQ ID NO: 553019 - RNA, 22 nt, Human
cugggcgugucuuccagcuggc

SEQ ID NO: 553020 - RNA, 22 nt, Human
gccuggagaaaggaagguggga

SEQ ID NO: 553021 - RNA, 22 nt, Human
gucuggggaagucagggcauca

SEQ ID NO: 553022 - RNA, 20 nt, Human
cacuacuuguuuuugucaau

SEQ ID NO: 553023 - RNA, 22 nt, Human
guccucagaugcugcugaaaug

SEQ ID NO: 553024 - RNA, 22 nt, Human
gacauaauccuccucaccuacu

SEQ ID NO: 553025 - RNA, 22 nt, Human
agcuuuauauguuguuucucca

SEQ ID NO: 553026 - RNA, 22 nt, Human
aacaaauguguuuuguaauuaa

SEQ ID NO: 553027 - RNA, 20 nt, Human
cugcugugauucccuccucc

SEQ ID NO: 553028 - RNA, 22 nt, Human
gcacacccucucaccagcacug

SEQ ID NO: 553029 - RNA, 22 nt, Human
ucuguaucuaauuuuacaguag

SEQ ID NO: 553030 - RNA, 22 nt, Human
gaagauuuucuccuuuaaauga

SEQ ID NO: 553031 - RNA, 22 nt, Human
aguucagcuucccaggucacug

SEQ ID NO: 553032 - RNA, 23 nt, Human
ucuggcucuaugugacagcucuc

SEQ ID NO: 553033 - RNA, 22 nt, Human
gcucugagacaguagagauggc

SEQ ID NO: 553034 - RNA, 22 nt, Human
uugcaucuaccauaucaaagau

SEQ ID NO: 553035 - RNA, 19 nt, Human
aggcugugagggaggacuc

SEQ ID NO: 553036 - RNA, 22 nt, Human
ccagaagaggacacagugugga

SEQ ID NO: 553037 - RNA, 22 nt, Human
gggcugcacagaucuucaaggg

SEQ ID NO: 553038 - RNA, 21 nt, Human
uccuccuguagaggguccugg

SEQ ID NO: 553039 - RNA, 22 nt, Human
uauacacauuuuuaccuauagu

SEQ ID NO: 553040 - RNA, 20 nt, Human
ggccucaguguccuuguuug

SEQ ID NO: 553041 - RNA, 22 nt, Human
ucaaaauuagugaccaaaggca

SEQ ID NO: 553042 - RNA, 22 nt, Human
acacacagguaaaggagccugg

SEQ ID NO: 553043 - RNA, 22 nt, Human
ucugaaauuuuaguuauagaaa

SEQ ID NO: 553044 - RNA, 22 nt, Human
gaccuggaagaacugaggccuu

SEQ ID NO: 553045 - RNA, 22 nt, Human
ugguccuggggugcaggcugac

SEQ ID NO: 553046 - RNA, 22 nt, Human
aacauuucugagaauaucaguu

SEQ ID NO: 553047 - RNA, 22 nt, Human
acuuucuccagaaaaccaagga

SEQ ID NO: 553048 - RNA, 22 nt, Human
ugcaagaggguguucaguuugu

SEQ ID NO: 553049 - RNA, 22 nt, Human
gacugaaagcuuggaauguucc

SEQ ID NO: 553050 - RNA, 22 nt, Human
caugggcaccuuaaaaugaggc

SEQ ID NO: 553051 - RNA, 22 nt, Human
ucuuugauuuuguuacuaagac

SEQ ID NO: 553052 - RNA, 22 nt, Human
uggccuggaagagaggucgagg

SEQ ID NO: 553053 - RNA, 22 nt, Human
aacuauacauauuuacauagac

SEQ ID NO: 553054 - RNA, 23 nt, Human
ucacacagcuggucagguacaga

SEQ ID NO: 553055 - RNA, 22 nt, Human
aagagggaggugcgggugcaga

SEQ ID NO: 553056 - RNA, 22 nt, Human
acaguguauaaaaucuuaaaga

SEQ ID NO: 553057 - RNA, 22 nt, Human
uccuggguccauggcagccgaa

SEQ ID NO: 553058 - RNA, 22 nt, Human
acaguggaagaagcacugaacu

SEQ ID NO: 553059 - RNA, 20 nt, Human
uugcauuggaugugcaggug

SEQ ID NO: 553060 - RNA, 22 nt, Human
ugagauuuggguuguuuaacau

SEQ ID NO: 553061 - RNA, 22 nt, Human
aguggcugccaagagcaaugcu

SEQ ID NO: 553062 - RNA, 22 nt, Human
cagcagagcugggaauaaaauu

SEQ ID NO: 553063 - RNA, 22 nt, Human
agccuggaggaggaguugagca

SEQ ID NO: 553064 - RNA, 22 nt, Human
ucagauggucauucacuagggu

SEQ ID NO: 553065 - RNA, 19 nt, Human
ccuggaggugaagguucuc

SEQ ID NO: 553066 - RNA, 23 nt, Human
uggcccugaaucuguccuggagg

SEQ ID NO: 553067 - RNA, 22 nt, Human
acaaugaguuugauguaguuug

SEQ ID NO: 553068 - RNA, 22 nt, Human
uaguuaggaauagcagcgacuc

SEQ ID NO: 553069 - RNA, 21 nt, Human
guuuucaugauagagucugua

SEQ ID NO: 553070 - RNA, 22 nt, Human
gggcucugguacuuccuggcuc

SEQ ID NO: 553071 - RNA, 22 nt, Human
ugaagccagucaauguuaaguu

SEQ ID NO: 553072 - RNA, 22 nt, Human
gcugggaggaucucucccuguc

SEQ ID NO: 553073 - RNA, 20 nt, Human
ggcuuucugugauccucagu

SEQ ID NO: 553074 - RNA, 22 nt, Human
auuuggaaaugcaucucuugag

SEQ ID NO: 553075 - RNA, 22 nt, Human
ggccugagcucuggggaggcaa

SEQ ID NO: 553076 - RNA, 22 nt, Human
augggcugugagguccggcagg

SEQ ID NO: 553077 - RNA, 22 nt, Human
cccagagcuccgguccugccca

SEQ ID NO: 553078 - RNA, 22 nt, Human
auuuagcaagaguacaaaauaa

SEQ ID NO: 553079 - RNA, 22 nt, Human
cccuggaggcggagcuugcagu

SEQ ID NO: 553080 - RNA, 22 nt, Human
ugguuuugcuccaguauaaaua

SEQ ID NO: 553081 - RNA, 22 nt, Human
uguguuuuccagaaugguguuu

SEQ ID NO: 553082 - RNA, 22 nt, Human
uggcaggagguuuucuccagga

SEQ ID NO: 553083 - RNA, 20 nt, Human
acuuucucgguuucucaccu

SEQ ID NO: 553084 - RNA, 22 nt, Human
gccacguugccacccgggugac

SEQ ID NO: 553085 - RNA, 22 nt, Human
gcucugggcugcccucuggaca

SEQ ID NO: 553086 - RNA, 22 nt, Human
gcucccugcacucugcagcccu

SEQ ID NO: 553087 - RNA, 22 nt, Human
cagcacagugaccagacccacu

SEQ ID NO: 553088 - RNA, 20 nt, Human
agggaggugcugggccugag

SEQ ID NO: 553089 - RNA, 22 nt, Human
caaguccaggugggcaaauaaa

SEQ ID NO: 553090 - RNA, 22 nt, Human
uccuagucacaggaaaauuuca

SEQ ID NO: 553091 - RNA, 22 nt, Human
uccuugaauugugccacuuacc

SEQ ID NO: 553092 - RNA, 22 nt, Human
uugaggagucaggggcacggaa

SEQ ID NO: 553093 - RNA, 22 nt, Human
ccuggccuccuggccuucucau

SEQ ID NO: 553094 - RNA, 22 nt, Human
aaugaacauggacaaguuaaua

SEQ ID NO: 553095 - RNA, 22 nt, Human
agccagccaguucacuaggaaa

SEQ ID NO: 553096 - RNA, 22 nt, Human
gagaugcuuuguguauagacaa

SEQ ID NO: 553097 - RNA, 22 nt, Human
cagggagaucuuggcuccuggu

SEQ ID NO: 553098 - RNA, 19 nt, Human
aggacucuggaggcaugag

SEQ ID NO: 553099 - RNA, 22 nt, Human
gaggguccccaugcagagcuca

SEQ ID NO: 553100 - RNA, 22 nt, Human
uguguucauguauguauacaua

SEQ ID NO: 553101 - RNA, 22 nt, Human
agccccugggaguagcugcugc

SEQ ID NO: 553102 - RNA, 22 nt, Human
cccagcucucugcucuuagccu

SEQ ID NO: 553103 - RNA, 18 nt, Human
gcucugcccaggcugccc

SEQ ID NO: 553104 - RNA, 20 nt, Human
acaaaauagguacuggguag

SEQ ID NO: 553105 - RNA, 22 nt, Human
ucacuguaauagguuugaagau

SEQ ID NO: 553106 - RNA, 22 nt, Human
ucuggcucugaauucacuucug

SEQ ID NO: 553107 - RNA, 22 nt, Human
uuccuaaucacgaacauuauuu

SEQ ID NO: 553108 - RNA, 22 nt, Human
auguccuuugcuucucuggucc

SEQ ID NO: 553109 - RNA, 23 nt, Human
aaaugacauaugguuucugaagg

SEQ ID NO: 553110 - RNA, 22 nt, Human
uucagugugugauaccugcugu

SEQ ID NO: 553111 - RNA, 22 nt, Human
agcaccuucacaggcucucagg

SEQ ID NO: 553112 - RNA, 22 nt, Human
aggugaaguugaggaggcagaa

SEQ ID NO: 553113 - RNA, 22 nt, Human
uuggugggagaagacucugguu

SEQ ID NO: 553114 - RNA, 22 nt, Human
aagcagcauagcucccuuaguu

SEQ ID NO: 553115 - RNA, 22 nt, Human
uugagaguagagauggcagggc

SEQ ID NO: 553116 - RNA, 22 nt, Human
uuucacaaaugucuuuaacuug

SEQ ID NO: 553117 - RNA, 22 nt, Human
aaauuagaucaguggauuuucu

SEQ ID NO: 553118 - RNA, 18 nt, Human
ucuuuguuuccuucuugc

SEQ ID NO: 553119 - RNA, 22 nt, Human
ucugagcugggcacagaaggcg

SEQ ID NO: 553120 - RNA, 22 nt, Human
caaauaucuuuggcaaagagaa

SEQ ID NO: 553121 - RNA, 20 nt, Human
ugcugcaguuucaugggacu

SEQ ID NO: 553122 - RNA, 22 nt, Human
aagauuuaccacuuuauucaag

SEQ ID NO: 553123 - RNA, 23 nt, Human
uuugaacauuucuagauuacaua

SEQ ID NO: 553124 - RNA, 22 nt, Human
caggcuccucacucaugcuccc

SEQ ID NO: 553125 - RNA, 22 nt, Human
cugggccaggaccaggguugaa

SEQ ID NO: 553126 - RNA, 22 nt, Human
acugcuuacaaaaggaaagaau

SEQ ID NO: 553127 - RNA, 22 nt, Human
ggggcugagaauucagucucgg

SEQ ID NO: 553128 - RNA, 22 nt, Human
acccaggacucucuuccaguag

SEQ ID NO: 553129 - RNA, 22 nt, Human
ucuuaaaugacugauaagagga

SEQ ID NO: 553130 - RNA, 22 nt, Human
aguuacauaaucugugaauuuu

SEQ ID NO: 553131 - RNA, 22 nt, Human
uggagccaggagccugggaguc

SEQ ID NO: 553132 - RNA, 22 nt, Human
uugcaggacaaugauggucccu

SEQ ID NO: 553133 - RNA, 17 nt, Human
cagugaggccuuuccuc

SEQ ID NO: 553134 - RNA, 22 nt, Human
ucauuucuccgaccugcugucc

SEQ ID NO: 553135 - RNA, 22 nt, Human
uucuccagagguggcuagaguu

SEQ ID NO: 553136 - RNA, 22 nt, Human
ucagagaguuuucacuagggug

SEQ ID NO: 553137 - RNA, 22 nt, Human
accugagcaugccaggagagug

SEQ ID NO: 553138 - RNA, 22 nt, Human
cucuccucugaaguggugaccc

SEQ ID NO: 553139 - RNA, 22 nt, Human
gagauggggaauaggagcaagc

SEQ ID NO: 553140 - RNA, 22 nt, Human
aaacagcaggaacaucuugcca

SEQ ID NO: 553141 - RNA, 22 nt, Human
cagagagaggccacugcuauua

SEQ ID NO: 553142 - RNA, 22 nt, Human
aauuucuguaugaauagagaaa

SEQ ID NO: 553143 - RNA, 22 nt, Human
cacaucagggcugcuugggggu

SEQ ID NO: 553144 - RNA, 22 nt, Human
gguuuuggaaguauaaagaugu

SEQ ID NO: 553145 - RNA, 22 nt, Human
uggaacacuguggaugagaaga

SEQ ID NO: 553146 - RNA, 22 nt, Human
agaaagaggaugcagaucucau

SEQ ID NO: 553147 - RNA, 22 nt, Human
ccacugccagcuuuguccuccc

SEQ ID NO: 553148 - RNA, 22 nt, Human
uuuucaucucugcuuuguaccu

SEQ ID NO: 553149 - RNA, 22 nt, Human
aggcugccaaagcuucugucuc

SEQ ID NO: 553150 - RNA, 20 nt, Human
ugagugauggaggcggguca

SEQ ID NO: 553151 - RNA, 22 nt, Human
cugccuguauugucugcuuggg

SEQ ID NO: 553152 - RNA, 22 nt, Human
aggggcaggugcugcacuuaga

SEQ ID NO: 553153 - RNA, 22 nt, Human
ugccaucacugaacuucugaaa

SEQ ID NO: 553154 - RNA, 22 nt, Human
cagaggccucacuuccagccag

SEQ ID NO: 553155 - RNA, 22 nt, Human
cuggccuucagacucggacuga

SEQ ID NO: 553156 - RNA, 22 nt, Human
ugcugcacucaccaacagauaa

SEQ ID NO: 553157 - RNA, 22 nt, Human
ccugggcucuauccugacccag

SEQ ID NO: 553158 - RNA, 22 nt, Human
aacuuucuaaagucaaauuggu

SEQ ID NO: 553159 - RNA, 22 nt, Human
ucuugaagucacacagaaagug

SEQ ID NO: 553160 - RNA, 22 nt, Human
uuucauaauacuguacaugaaa

SEQ ID NO: 553161 - RNA, 22 nt, Human
ucagaaaugaucguuauucauu

SEQ ID NO: 553162 - RNA, 22 nt, Human
cauugucacccaaagcucauag

SEQ ID NO: 553163 - RNA, 22 nt, Human
gcugccugugcacuuucucgua

SEQ ID NO: 553164 - RNA, 22 nt, Human
gaggaggguuggccuuagguag

SEQ ID NO: 553165 - RNA, 22 nt, Human
gcuguucccauguggggcucag

SEQ ID NO: 553166 - RNA, 22 nt, Human
agcucccauuaucuucugaaac

SEQ ID NO: 553167 - RNA, 22 nt, Human
caggggcucuaaugcaugauca

SEQ ID NO: 553168 - RNA, 22 nt, Human
ccaggagcaggagcuggacaga

SEQ ID NO: 553169 - RNA, 22 nt, Human
gcugucugggaggccuccacuu

SEQ ID NO: 553170 - RNA, 22 nt, Human
ucccaggcugggggccugaagu

SEQ ID NO: 553171 - RNA, 22 nt, Human
uugaggagcaggaugggaggcu

SEQ ID NO: 553172 - RNA, 22 nt, Human
gcagaagcccggucagcgcacg

SEQ ID NO: 553173 - RNA, 22 nt, Human
uugaaacugcuuauugaauuug

SEQ ID NO: 553174 - RNA, 22 nt, Human
gcuguucuagcuucaguuucgc

SEQ ID NO: 553175 - RNA, 22 nt, Human
ucuccuuuaagauuuccucagg

SEQ ID NO: 553176 - RNA, 22 nt, Human
uuggaagaccagaggccuuguc

SEQ ID NO: 553177 - RNA, 22 nt, Human
auuauucaauguuauuucagug

SEQ ID NO: 553178 - RNA, 22 nt, Human
gaggcucagagggacuuucaag

SEQ ID NO: 553179 - RNA, 22 nt, Human
gcagacagacugcagugauuuu

SEQ ID NO: 553180 - RNA, 19 nt, Human
gcaggcacagcccugggug

SEQ ID NO: 553181 - RNA, 22 nt, Human
caaauucacaugauugcuucug

SEQ ID NO: 553182 - RNA, 22 nt, Human
accaaucuccuauuuuguuuca

SEQ ID NO: 553183 - RNA, 22 nt, Human
auggccugggcccgcuucagau

SEQ ID NO: 553184 - RNA, 22 nt, Human
ugccucugugggccuuccuggc

SEQ ID NO: 553185 - RNA, 22 nt, Human
aaauacagaguuauggaccuca

SEQ ID NO: 553186 - RNA, 22 nt, Human
agcugccacauggugucacugu

SEQ ID NO: 553187 - RNA, 22 nt, Human
cacaucuauagggacagcaaca

SEQ ID NO: 553188 - RNA, 23 nt, Human
uggcucagcuaguuuuccauuuc

SEQ ID NO: 553189 - RNA, 22 nt, Human
auguggcugguaguugacaacu

SEQ ID NO: 553190 - RNA, 22 nt, Human
ccacugcccaccccgacgucua

SEQ ID NO: 553191 - RNA, 22 nt, Human
ugacaggcagugcugggcaugu

SEQ ID NO: 553192 - RNA, 22 nt, Human
gcaguggggaaugcuggggaga

SEQ ID NO: 553193 - RNA, 22 nt, Human
gaggguggggaauagacugcua

SEQ ID NO: 553194 - RNA, 22 nt, Human
ucagaaagguugagucaugugc

SEQ ID NO: 553195 - RNA, 22 nt, Human
cgugggcugcgcccaguucuuc

SEQ ID NO: 553196 - RNA, 22 nt, Human
agcaggcuuguuaugucugaga

SEQ ID NO: 553197 - RNA, 22 nt, Human
aggauuucugugccuggaaaau

SEQ ID NO: 553198 - RNA, 22 nt, Human
auuauacauuuuguguagagau

SEQ ID NO: 553199 - RNA, 22 nt, Human
uuaauuuauacauaaucacagg

SEQ ID NO: 553200 - RNA, 22 nt, Human
uugcagcuucuaccacuguuuc

SEQ ID NO: 553201 - RNA, 22 nt, Human
aggcagugugggccaagcuucc

SEQ ID NO: 553202 - RNA, 22 nt, Human
acccuuucuuacucacacgcuc

SEQ ID NO: 553203 - RNA, 22 nt, Human
uagucagugaucaguggaguug

SEQ ID NO: 553204 - RNA, 22 nt, Human
uggcccugcuaugauccugcaa

SEQ ID NO: 553205 - RNA, 22 nt, Human
ccagucugugugccagccugcg

SEQ ID NO: 553206 - RNA, 19 nt, Human
ucucucaauugcuucaauu

SEQ ID NO: 553207 - RNA, 22 nt, Human
uggaaggcaacggagugagcug

SEQ ID NO: 553208 - RNA, 22 nt, Human
uuucacagcugucuuccgucuc

SEQ ID NO: 553209 - RNA, 22 nt, Human
aacagcuguauacuguagcugu

SEQ ID NO: 553210 - RNA, 22 nt, Human
aaggaagauauaucaagcuuaa

SEQ ID NO: 553211 - RNA, 22 nt, Human
aaacaugcauucaagaaaaucu

SEQ ID NO: 553212 - RNA, 22 nt, Human
cccaggcagagagcuggugagc

SEQ ID NO: 553213 - RNA, 22 nt, Human
uaguuaauucuuuaagaacaag

SEQ ID NO: 553214 - RNA, 22 nt, Human
uuaaggcacagagagguuaagu

SEQ ID NO: 553215 - RNA, 22 nt, Human
caaagguauucucauuuuggaa

SEQ ID NO: 553216 - RNA, 17 nt, Human
cccugccaccaggaagc

SEQ ID NO: 553217 - RNA, 22 nt, Human
cacaugggcguaauguccaugg

SEQ ID NO: 553218 - RNA, 22 nt, Human
uggcuucaucugcagcacugcc

SEQ ID NO: 553219 - RNA, 22 nt, Human
uauacacauccuccaaagauag

SEQ ID NO: 553220 - RNA, 22 nt, Human
uaaaaugacuuccuccaacauc

SEQ ID NO: 553221 - RNA, 22 nt, Human
uacauacauauucauacaggug

SEQ ID NO: 553222 - RNA, 22 nt, Human
uuacaaagagaaguuguagaau

SEQ ID NO: 553223 - RNA, 22 nt, Human
ucugagagccucuagccuaagu

SEQ ID NO: 553224 - RNA, 22 nt, Human
acauacacaugaauauauuuuu

SEQ ID NO: 553225 - RNA, 22 nt, Human
guuacaaaggaagcuucacugc

SEQ ID NO: 553226 - RNA, 22 nt, Human
cgcuggggcuuuuugcuugaga

SEQ ID NO: 553227 - RNA, 17 nt, Human
ugagacagggcaggccc

SEQ ID NO: 553228 - RNA, 22 nt, Human
auuguguaauuuucagcucaua

SEQ ID NO: 553229 - RNA, 22 nt, Human
gccugccccuuccugggcaggg

SEQ ID NO: 553230 - RNA, 22 nt, Human
uggaagcuguggcauaacugag

SEQ ID NO: 553231 - RNA, 22 nt, Human
agcauggggcuccgcaaugaac

SEQ ID NO: 553232 - RNA, 22 nt, Human
uuuccucuaaacgcauuugcuu

SEQ ID NO: 553233 - RNA, 22 nt, Human
uacaaaugaguuguaugaacca

SEQ ID NO: 553234 - RNA, 22 nt, Human
ugcagggccaugguggcggcug

SEQ ID NO: 553235 - RNA, 22 nt, Human
ugggacuuguguggcaguauuu

SEQ ID NO: 553236 - RNA, 22 nt, Human
auguuucaagagaaaaagagac

SEQ ID NO: 553237 - RNA, 22 nt, Human
auauuugugguuuuuggcuccu

SEQ ID NO: 553238 - RNA, 22 nt, Human
uucuaguguccuuggacuugcu

SEQ ID NO: 553239 - RNA, 22 nt, Human
aaauaugagauguucucuuucg

SEQ ID NO: 553240 - RNA, 21 nt, Human
ggguccugggaugggauccag

SEQ ID NO: 553241 - RNA, 22 nt, Human
ucuucagacuguuguucuuuug

SEQ ID NO: 553242 - RNA, 22 nt, Human
uguccucuuccagugcuccuuc

SEQ ID NO: 553243 - RNA, 22 nt, Human
aggcagccuauggggagcucag

SEQ ID NO: 553244 - RNA, 22 nt, Human
aauagcaccugagguaguuugu

SEQ ID NO: 553245 - RNA, 22 nt, Human
ccauggccaggaaagccaaggu

SEQ ID NO: 553246 - RNA, 22 nt, Human
ugaagcacaggcauacacaacc

SEQ ID NO: 553247 - RNA, 22 nt, Human
gugaggacuaguggguuugugc

SEQ ID NO: 553248 - RNA, 22 nt, Human
agaaaagaggcuuucuaagcau

SEQ ID NO: 553249 - RNA, 22 nt, Human
ucaaaucucauugccuaaaacu

SEQ ID NO: 553250 - RNA, 22 nt, Human
uuuaauuuguauuucuagaggg

SEQ ID NO: 553251 - RNA, 22 nt, Human
auaauacaugguuaaccucuuu

SEQ ID NO: 553252 - RNA, 23 nt, Human
gggugggccaaauuagguagccu

SEQ ID NO: 553253 - RNA, 22 nt, Human
uccaggcauaaugcccaguggu

SEQ ID NO: 553254 - RNA, 21 nt, Human
uuugaaagugggugauucuuu

SEQ ID NO: 553255 - RNA, 22 nt, Human
cucagggagguccugugcugaa

SEQ ID NO: 553256 - RNA, 15 nt, Human
gcagguggaucacuu

SEQ ID NO: 553257 - RNA, 19 nt, Human
acugccugaggcucacagg

SEQ ID NO: 553258 - RNA, 22 nt, Human
guauacaugugguaaaaugcac

SEQ ID NO: 553259 - RNA, 22 nt, Human
aggagcugaagucucugcacuc

SEQ ID NO: 553260 - RNA, 22 nt, Human
uggcagagaacacggcugaucu

SEQ ID NO: 553261 - RNA, 22 nt, Human
gagguggcugcuugcugggaaa

SEQ ID NO: 553262 - RNA, 22 nt, Human
cucagagagggcaccagggcca

SEQ ID NO: 553263 - RNA, 22 nt, Human
auucaacuagugauuguguuau

SEQ ID NO: 553264 - RNA, 18 nt, Human
ugaacuggcaucagaauc

SEQ ID NO: 553265 - RNA, 22 nt, Human
uccaggcaucccccaggacaga

SEQ ID NO: 553266 - RNA, 22 nt, Human
ucccagagccucugccacucug

SEQ ID NO: 553267 - RNA, 22 nt, Human
agccucucuuucugguggcuaa

SEQ ID NO: 553268 - RNA, 22 nt, Human
uggucgaccaguuggaaaguaa

SEQ ID NO: 553269 - RNA, 22 nt, Human
gcccagaaagacugccuaacag

SEQ ID NO: 553270 - RNA, 21 nt, Human
ucccagggccaggugccauca

SEQ ID NO: 553271 - RNA, 23 nt, Human
aagcugccagucugaagccuggg

SEQ ID NO: 553272 - RNA, 22 nt, Human
ucagcuuugaucucaggcaauc

SEQ ID NO: 553273 - RNA, 22 nt, Human
agcuggcagucggccuugaugc

SEQ ID NO: 553274 - RNA, 22 nt, Human
uaggcucagggcugggugacgg

SEQ ID NO: 553275 - RNA, 22 nt, Human
uagauuuccucuuccucauucc

SEQ ID NO: 553276 - RNA, 22 nt, Human
ugcugagugggauuccugugcu

SEQ ID NO: 553277 - RNA, 22 nt, Human
augacagaggagugcaggugau

SEQ ID NO: 553278 - RNA, 22 nt, Human
ucuuugcagaauuuaacuuugc

SEQ ID NO: 553279 - RNA, 19 nt, Human
ucugaaguccagggcauac

SEQ ID NO: 553280 - RNA, 22 nt, Human
uagcuuuaaaaaucaucaaagc

SEQ ID NO: 553281 - RNA, 22 nt, Human
aguucuggcccaggguuucuug

SEQ ID NO: 553282 - RNA, 22 nt, Human
ccuguguggccaggcuggaguc

SEQ ID NO: 553283 - RNA, 22 nt, Human
gaaguggaagccaucggcaguc

SEQ ID NO: 553284 - RNA, 22 nt, Human
aguaugaacggaaggccuggga

SEQ ID NO: 553285 - RNA, 22 nt, Human
uuucaaguuguuuauauccaga

SEQ ID NO: 553286 - RNA, 22 nt, Human
uuucaaagaccauuaacuauca

SEQ ID NO: 553287 - RNA, 22 nt, Human
ccaaugauggugcccacgauga

SEQ ID NO: 553288 - RNA, 22 nt, Human
cgcagcagccccgugguaggug

SEQ ID NO: 553289 - RNA, 22 nt, Human
aaugcacauauauguguauaca

SEQ ID NO: 553290 - RNA, 22 nt, Human
ugcaggugacaccacucuuccu

SEQ ID NO: 553291 - RNA, 22 nt, Human
gagaggagucccuaucacaguu

SEQ ID NO: 553292 - RNA, 22 nt, Human
uaaagguaacaugaacugcuuu

SEQ ID NO: 553293 - RNA, 23 nt, Human
uggccucuccccaccuggcagaa

SEQ ID NO: 553294 - RNA, 22 nt, Human
ugucaaauuuuuauugcaguau

SEQ ID NO: 553295 - RNA, 23 nt, Human
gcagcuugugguuuaguagaggg

SEQ ID NO: 553296 - RNA, 22 nt, Human
ugcaauuuuaauacauuagagg

SEQ ID NO: 553297 - RNA, 22 nt, Human
uaaagacaaaugacauuacggc

SEQ ID NO: 553298 - RNA, 22 nt, Human
uguuuauaccuugguauaacca

SEQ ID NO: 553299 - RNA, 22 nt, Human
cagcaauaacucaaagccauuu

SEQ ID NO: 553300 - RNA, 22 nt, Human
aacaguaugugagauuuacaca

SEQ ID NO: 553301 - RNA, 22 nt, Human
cacuuugauuugugaugugaga

SEQ ID NO: 553302 - RNA, 22 nt, Human
ucuggcucauacaagccugcaa

SEQ ID NO: 553303 - RNA, 22 nt, Human
caggaaauaucuccuggcagag

SEQ ID NO: 553304 - RNA, 22 nt, Human
ucaaugauuagaguuuagugug

SEQ ID NO: 553305 - RNA, 22 nt, Human
uuaggaagagcuuucaaucacu

SEQ ID NO: 553306 - RNA, 22 nt, Human
caggacagagcccagacugugu

SEQ ID NO: 553307 - RNA, 22 nt, Human
agcucucaagauaagaaagaac

SEQ ID NO: 553308 - RNA, 18 nt, Human
uggcagagugucuguucu

SEQ ID NO: 553309 - RNA, 22 nt, Human
aggucaggguauucacgucugu

SEQ ID NO: 553310 - RNA, 22 nt, Human
uccuucagcucucuauuuagau

SEQ ID NO: 553311 - RNA, 19 nt, Human
ugagacagggauucaggug

SEQ ID NO: 553312 - RNA, 22 nt, Human
gaggccaaucaauagggcaaua

SEQ ID NO: 553313 - RNA, 22 nt, Human
ucaggcugaggucaucugcauc

SEQ ID NO: 553314 - RNA, 22 nt, Human
gagagggcucuguguggguacu

SEQ ID NO: 553315 - RNA, 22 nt, Human
ccagcccuucccaacuggccag

SEQ ID NO: 553316 - RNA, 22 nt, Human
ucccaguguggcaggccaugga

SEQ ID NO: 553317 - RNA, 20 nt, Human
aaggagaaugacacggcugc

SEQ ID NO: 553318 - RNA, 22 nt, Human
aggcaggcugcuauggaguaga

SEQ ID NO: 553319 - RNA, 22 nt, Human
gacccagcuaaccaggugggga

SEQ ID NO: 553320 - RNA, 22 nt, Human
ugcuggcuggccuggccuggac

SEQ ID NO: 553321 - RNA, 22 nt, Human
cauauacacuuccaccucugug

SEQ ID NO: 553322 - RNA, 22 nt, Human
uaauacagggcacuuugaguga

SEQ ID NO: 553323 - RNA, 22 nt, Human
uaaauaagucacugaccauuua

SEQ ID NO: 553324 - RNA, 19 nt, Human
cuucauucuucagcuuuug

SEQ ID NO: 553325 - RNA, 19 nt, Human
agcauuuggaauucuacac

SEQ ID NO: 553326 - RNA, 22 nt, Human
aggaaauguaguccucaucucc

SEQ ID NO: 553327 - RNA, 22 nt, Human
acuuugcaauacuuaauacaaa

SEQ ID NO: 553328 - RNA, 22 nt, Human
guccacauaggaacccagcuuc

SEQ ID NO: 553329 - RNA, 22 nt, Human
gugacaggcauggggucaugca

SEQ ID NO: 553330 - RNA, 22 nt, Human
aaaagcagagacucuggagcua

SEQ ID NO: 553331 - RNA, 20 nt, Human
ggguggaguugcggucugug

SEQ ID NO: 553332 - RNA, 23 nt, Human
uuccugugguauauuuuauaggg

SEQ ID NO: 553333 - RNA, 22 nt, Human
agcugguaugaacaggauagga

SEQ ID NO: 553334 - RNA, 22 nt, Human
gcugagcuagcuaucucagucu

SEQ ID NO: 553335 - RNA, 21 nt, Human
ccagccucagaucagggagcu

SEQ ID NO: 553336 - RNA, 21 nt, Human
uggcaggcagcuggaagcuug

SEQ ID NO: 553337 - RNA, 22 nt, Human
aagacagcucaggacagauuca

SEQ ID NO: 553338 - RNA, 22 nt, Human
aggauccuuuuucugcuguuug

SEQ ID NO: 553339 - RNA, 22 nt, Human
uauaaaguuucgaaagauguau

SEQ ID NO: 553340 - RNA, 22 nt, Human
gcucagagcuugaaguuccacu

SEQ ID NO: 553341 - RNA, 22 nt, Human
caucuugccugcuauucuguug

SEQ ID NO: 553342 - RNA, 22 nt, Human
ccugcagcuccggauuucuggg

SEQ ID NO: 553343 - RNA, 22 nt, Human
cgucccaguuccagccgcgcug

SEQ ID NO: 553344 - RNA, 22 nt, Human
cuuggcugucuauaggaaagag

SEQ ID NO: 553345 - RNA, 22 nt, Human
cugcugggccuggucucugagg

SEQ ID NO: 553346 - RNA, 19 nt, Human
cugagagaugcuucacaca

SEQ ID NO: 553347 - RNA, 22 nt, Human
cccagccagccucuucccauau

SEQ ID NO: 553348 - RNA, 22 nt, Human
agcagguggaaaauucuuauca

SEQ ID NO: 553349 - RNA, 22 nt, Human
auuuccaaucucugcauauggg

SEQ ID NO: 553350 - RNA, 22 nt, Human
ggauacaacuagaagauggcag

SEQ ID NO: 553351 - RNA, 22 nt, Human
uucaccacuuugcaccaggccu

SEQ ID NO: 553352 - RNA, 22 nt, Human
ugccagccagguucugaggcua

SEQ ID NO: 553353 - RNA, 22 nt, Human
gauuauauaauggaagcucuug

SEQ ID NO: 553354 - RNA, 22 nt, Human
ggcugcugguagggguaggaag

SEQ ID NO: 553355 - RNA, 22 nt, Human
ccuuuucuguguggguaauuua

SEQ ID NO: 553356 - RNA, 22 nt, Human
uuuuguguccuucacaucaugu

SEQ ID NO: 553357 - RNA, 23 nt, Human
agggcacugaagcuggaauuggg

SEQ ID NO: 553358 - RNA, 22 nt, Human
ucuauuuaggagacccugguuc

SEQ ID NO: 553359 - RNA, 22 nt, Human
uucaagugaggcugucuuuaga

SEQ ID NO: 553360 - RNA, 22 nt, Human
agcugccagcaaguuucaaaca

SEQ ID NO: 553361 - RNA, 22 nt, Human
cugccacuagcuuucacaucuu

SEQ ID NO: 553362 - RNA, 18 nt, Human
aaguaacagaagagcaca

SEQ ID NO: 553363 - RNA, 22 nt, Human
agggagagguugaaaccucagu

SEQ ID NO: 553364 - RNA, 22 nt, Human
agugcuggcccauagcugcugg

SEQ ID NO: 553365 - RNA, 22 nt, Human
ucauggcacuuagcacaguccu

SEQ ID NO: 553366 - RNA, 22 nt, Human
ucaaaggcccauugucccguug

SEQ ID NO: 553367 - RNA, 22 nt, Human
cagccaggagcucccccugcuc

SEQ ID NO: 553368 - RNA, 22 nt, Human
gcugccaguaguuggagcucca

SEQ ID NO: 553369 - RNA, 22 nt, Human
gcccuggccuggcgcguuguca

SEQ ID NO: 553370 - RNA, 22 nt, Human
gggaagaguaacuagcccaugu

SEQ ID NO: 553371 - RNA, 22 nt, Human
ggcucuggguucugcaaugcgu

SEQ ID NO: 553372 - RNA, 22 nt, Human
cugcccuggucccauggcugau

SEQ ID NO: 553373 - RNA, 22 nt, Human
ccucacagcuuuucaaagugga

SEQ ID NO: 553374 - RNA, 22 nt, Human
aggccagggucccacacucgca

SEQ ID NO: 553375 - RNA, 22 nt, Human
caaaagcaguucuaucugaguu

SEQ ID NO: 553376 - RNA, 22 nt, Human
aguaaucaaauuaagcuaauug

SEQ ID NO: 553377 - RNA, 21 nt, Human
ugugaaauagcuaugcuacau

SEQ ID NO: 553378 - RNA, 22 nt, Human
acagaaauauagaagguaggaa

SEQ ID NO: 553379 - RNA, 22 nt, Human
uuuaaugugagucccuuucaag

SEQ ID NO: 553380 - RNA, 22 nt, Human
cagagccuaaaacgacuccacu

SEQ ID NO: 553381 - RNA, 22 nt, Human
ucuauuuacagaaagcagaauu

SEQ ID NO: 553382 - RNA, 22 nt, Human
cuuaacagagagaaguguugcu

SEQ ID NO: 553383 - RNA, 22 nt, Human
aggcacaggaaugucauccagu

SEQ ID NO: 553384 - RNA, 22 nt, Human
cccagccucagcuuuacuucca

SEQ ID NO: 553385 - RNA, 22 nt, Human
ugcuggcuacugauggcaggcc

SEQ ID NO: 553386 - RNA, 22 nt, Human
gcacagggcugccaggcggcuu

SEQ ID NO: 553387 - RNA, 22 nt, Human
ugcuggggcucugaccacucca

SEQ ID NO: 553388 - RNA, 22 nt, Human
uuuuucuugugcuggaucuaau

SEQ ID NO: 553389 - RNA, 22 nt, Human
uuuuucaagacaaccugcaugu

SEQ ID NO: 553390 - RNA, 22 nt, Human
gaggggcuggcacgauggcugc

SEQ ID NO: 553391 - RNA, 22 nt, Human
guucugggaagguggaccuguu

SEQ ID NO: 553392 - RNA, 21 nt, Human
cagaggcugagagggcaaucu

SEQ ID NO: 553393 - RNA, 22 nt, Human
aguaacagagcauggguucaga

SEQ ID NO: 553394 - RNA, 22 nt, Human
uuuacagcuacuguccuauuuc

SEQ ID NO: 553395 - RNA, 22 nt, Human
agugucugcuuugagucaggug

SEQ ID NO: 553396 - RNA, 22 nt, Human
ucagacagucaucagagcuugu

SEQ ID NO: 553397 - RNA, 22 nt, Human
uuucuggcagcgggacaggggu

SEQ ID NO: 553398 - RNA, 22 nt, Human
auguuguagcauaugaaauaua

SEQ ID NO: 553399 - RNA, 22 nt, Human
aucuacaggcugaggugggagg

SEQ ID NO: 553400 - RNA, 22 nt, Human
acugggcugcuugagugccuuc

SEQ ID NO: 553401 - RNA, 22 nt, Human
agaaagcuuaugaaugggcaag

SEQ ID NO: 553402 - RNA, 22 nt, Human
uuccagagcaguuuucagauca

SEQ ID NO: 553403 - RNA, 22 nt, Human
augaaaaguucgaucuagaagg

SEQ ID NO: 553404 - RNA, 22 nt, Human
agccagcuggagaccacuguuu

SEQ ID NO: 553405 - RNA, 22 nt, Human
aauucacaaaaguuagauccau

SEQ ID NO: 553406 - RNA, 22 nt, Human
gguucacauauugagaguauuc

SEQ ID NO: 553407 - RNA, 22 nt, Human
ggagaaagcuguaguggaaugu

SEQ ID NO: 553408 - RNA, 22 nt, Human
aaaaggcuagcuaguaacagaa

SEQ ID NO: 553409 - RNA, 22 nt, Human
uuccucagcuguguccuggcga

SEQ ID NO: 553410 - RNA, 18 nt, Human
uauaaccuguuuugaugg

SEQ ID NO: 553411 - RNA, 16 nt, Human
gcagaggaaaggggag

SEQ ID NO: 553412 - RNA, 22 nt, Human
caggcugggcuccggagauaaa

SEQ ID NO: 553413 - RNA, 22 nt, Human
aagaguuucuuuauuaaccuuu

SEQ ID NO: 553414 - RNA, 22 nt, Human
ucugccugaaucucuuagaaca

SEQ ID NO: 553415 - RNA, 22 nt, Human
gaaucauuggaaccacauccaa

SEQ ID NO: 553416 - RNA, 22 nt, Human
acaaggcuguggggagaacuga

SEQ ID NO: 553417 - RNA, 23 nt, Human
cccagagcacagccuccagaugc

SEQ ID NO: 553418 - RNA, 22 nt, Human
augcugaagagagaacuacuca

SEQ ID NO: 553419 - RNA, 22 nt, Human
guccucugggagccuugagccu

SEQ ID NO: 553420 - RNA, 19 nt, Human
uggggucaagagaggcuuc

SEQ ID NO: 553421 - RNA, 22 nt, Human
uggcucagaacuacuucuaguu

SEQ ID NO: 553422 - RNA, 22 nt, Human
gggcuggucuggcuuagucagg

SEQ ID NO: 553423 - RNA, 22 nt, Human
uuaaacauuuauggaggcagca

SEQ ID NO: 553424 - RNA, 22 nt, Human
uugcuugaacccaggaagugga

SEQ ID NO: 553425 - RNA, 20 nt, Human
cagagaccaggccagguguc

SEQ ID NO: 553426 - RNA, 22 nt, Human
ggccucugccccagccacaccu

SEQ ID NO: 553427 - RNA, 22 nt, Human
uggguggaauaaaucaguucug

SEQ ID NO: 553428 - RNA, 22 nt, Human
caaggagaaaacggcuucugaa

SEQ ID NO: 553429 - RNA, 22 nt, Human
uaucuuuaaugcuuggagguua

SEQ ID NO: 553430 - RNA, 22 nt, Human
ugcagcauucuuggccacuacu

SEQ ID NO: 553431 - RNA, 22 nt, Human
cauuuauucagcucagucgguu

SEQ ID NO: 553432 - RNA, 23 nt, Human
uuguaaaacagugugacgguucc

SEQ ID NO: 553433 - RNA, 22 nt, Human
guggagcccugccuugcucaug

SEQ ID NO: 553434 - RNA, 22 nt, Human
aucuucccaggcuggggagagg

SEQ ID NO: 553435 - RNA, 22 nt, Human
cagcugugagcagccaguugcc

SEQ ID NO: 553436 - RNA, 20 nt, Human
cuggcaggagcgagucuacc

SEQ ID NO: 553437 - RNA, 22 nt, Human
ugcaggagcugugcggugaggg

SEQ ID NO: 553438 - RNA, 22 nt, Human
aggccugagcagaggaguggac

SEQ ID NO: 553439 - RNA, 22 nt, Human
aucuguuguuuucucauauguu

SEQ ID NO: 553440 - RNA, 22 nt, Human
agggcagaaaccaccuugaugg

SEQ ID NO: 553441 - RNA, 22 nt, Human
uagaugcauagagcacagcaca

SEQ ID NO: 553442 - RNA, 22 nt, Human
caacuuuugacacgugugcuaa

SEQ ID NO: 553443 - RNA, 22 nt, Human
caaagcaggcuugucaaauugc

SEQ ID NO: 553444 - RNA, 22 nt, Human
agggcugagcccaggcauguag

SEQ ID NO: 553445 - RNA, 22 nt, Human
gcugauccuuuuaugucuagcu

SEQ ID NO: 553446 - RNA, 22 nt, Human
cugaaauucugccucugcacaa

SEQ ID NO: 553447 - RNA, 22 nt, Human
agggauggaagcucgucugcaa

SEQ ID NO: 553448 - RNA, 22 nt, Human
ccuggggaaaagcaggcauuua

SEQ ID NO: 553449 - RNA, 21 nt, Human
ucuggcccuagguugggccuc

SEQ ID NO: 553450 - RNA, 22 nt, Human
aauguuugaccaaaaaacugca

SEQ ID NO: 553451 - RNA, 17 nt, Human
aaacaaugcagacaagc

SEQ ID NO: 553452 - RNA, 22 nt, Human
ugcugccauggucgcugguguc

SEQ ID NO: 553453 - RNA, 22 nt, Human
gcagcagaaguagaaguacagg

SEQ ID NO: 553454 - RNA, 22 nt, Human
ugggaccuguuacauugaguua

SEQ ID NO: 553455 - RNA, 22 nt, Human
agaaaguucugugaguuguuca

SEQ ID NO: 553456 - RNA, 22 nt, Human
uaugaagugucuguuguaucug

SEQ ID NO: 553457 - RNA, 20 nt, Human
cagcagagacccauggggag

SEQ ID NO: 553458 - RNA, 22 nt, Human
acauguguauagccuguauaga

SEQ ID NO: 553459 - RNA, 22 nt, Human
ggccuugggaggagggucagaa

SEQ ID NO: 553460 - RNA, 22 nt, Human
gagaaaugagugauucacuuuu

SEQ ID NO: 553461 - RNA, 22 nt, Human
cagaauaaagguacaauugagu

SEQ ID NO: 553462 - RNA, 22 nt, Human
caggccagugugcuucccaggc

SEQ ID NO: 553463 - RNA, 22 nt, Human
uucugggccuccuaggacaggc

SEQ ID NO: 553464 - RNA, 22 nt, Human
aagaacuagucuuacagccuca

SEQ ID NO: 553465 - RNA, 22 nt, Human
gcugucugggaugucacugcug

SEQ ID NO: 553466 - RNA, 21 nt, Human
aagaugguuaugugcuaaaga

SEQ ID NO: 553467 - RNA, 19 nt, Human
uucacauuggaagaaguag

SEQ ID NO: 553468 - RNA, 22 nt, Human
cagugcagucaaggaagaacca

SEQ ID NO: 553469 - RNA, 22 nt, Human
ugcagagagaccccugggccag

SEQ ID NO: 553470 - RNA, 22 nt, Human
aacccagccguguagcugccgc

SEQ ID NO: 553471 - RNA, 22 nt, Human
gggccucagcucugcucugcaa

SEQ ID NO: 553472 - RNA, 22 nt, Human
aauucaaauuacaauaguuguu

SEQ ID NO: 553473 - RNA, 22 nt, Human
gggcuggaggagauccagaggc

SEQ ID NO: 553474 - RNA, 23 nt, Human
uccuccugacacagccugaguga

SEQ ID NO: 553475 - RNA, 22 nt, Human
acagagaucagaggcauaagca

SEQ ID NO: 553476 - RNA, 22 nt, Human
caaaggcuuccacugcauccuu

SEQ ID NO: 553477 - RNA, 22 nt, Human
aggcaguccccagggguguugc

SEQ ID NO: 553478 - RNA, 20 nt, Human
cugggcucaagugagccucc

SEQ ID NO: 553479 - RNA, 23 nt, Human
ugcucugggaggcccuggagagc

SEQ ID NO: 553480 - RNA, 22 nt, Human
aagggcaggagaagacggauau

SEQ ID NO: 553481 - RNA, 22 nt, Human
agagcaucuaacacauaagccu

SEQ ID NO: 553482 - RNA, 22 nt, Human
cagauuuagaguggggcuugga

SEQ ID NO: 553483 - RNA, 22 nt, Human
guaacagaaagucaugcucauu

SEQ ID NO: 553484 - RNA, 19 nt, Human
ccaggccaucccaguuccc

SEQ ID NO: 553485 - RNA, 17 nt, Human
uuugaaaggaugucagu

SEQ ID NO: 553486 - RNA, 22 nt, Human
cagguccucgggggaggccggc

SEQ ID NO: 553487 - RNA, 22 nt, Human
augcaagagcaauaugguaugc

SEQ ID NO: 553488 - RNA, 22 nt, Human
uugccauuaucauuuaugauac

SEQ ID NO: 553489 - RNA, 22 nt, Human
caggcagccugcggucugcaca

SEQ ID NO: 553490 - RNA, 19 nt, Human
ccugugugggguagagauc

SEQ ID NO: 553491 - RNA, 22 nt, Human
ccugggcagggcuggacucuca

SEQ ID NO: 553492 - RNA, 22 nt, Human
ggagucagccugucagagugua

SEQ ID NO: 553493 - RNA, 22 nt, Human
caggguggggcuggcuaucaaa

SEQ ID NO: 553494 - RNA, 22 nt, Human
acauuucucuugaugucucuau

SEQ ID NO: 553495 - RNA, 22 nt, Human
acacugugacaaaggcuguucu

SEQ ID NO: 553496 - RNA, 22 nt, Human
aggcugaugcuggcugaggcug

SEQ ID NO: 553497 - RNA, 21 nt, Human
acaggcuuuagaaaaugacuc

SEQ ID NO: 553498 - RNA, 22 nt, Human
uaaaucacaaauuuucucauuu

SEQ ID NO: 553499 - RNA, 22 nt, Human
gcagagucugggcagccuccau

SEQ ID NO: 553500 - RNA, 22 nt, Human
ccugagagcauuccacacugaa

SEQ ID NO: 553501 - RNA, 22 nt, Human
ugaggccugaagccugaaguga

SEQ ID NO: 553502 - RNA, 22 nt, Human
caggaaagagcugccaggcagg

SEQ ID NO: 553503 - RNA, 22 nt, Human
gcuaggaaucggacccaggaag

SEQ ID NO: 553504 - RNA, 22 nt, Human
ccucuggcuguaccacuggcac

SEQ ID NO: 553505 - RNA, 22 nt, Human
cuggccuuuagccccagugucu

SEQ ID NO: 553506 - RNA, 22 nt, Human
gugggggacccaggugcugucc

SEQ ID NO: 553507 - RNA, 22 nt, Human
uugauacaggccuucuagauga

SEQ ID NO: 553508 - RNA, 22 nt, Human
aaaguuugaaugauauauuagu

SEQ ID NO: 553509 - RNA, 18 nt, Human
uggaggcagaguucuggc

SEQ ID NO: 553510 - RNA, 22 nt, Human
cuggugcuggagccuagucccu

SEQ ID NO: 553511 - RNA, 22 nt, Human
auauaacucuuguucuuauagu

SEQ ID NO: 553512 - RNA, 22 nt, Human
acaaaggcagagaauucaacau

SEQ ID NO: 553513 - RNA, 22 nt, Human
agaugaaaauacgugacuuuaa

SEQ ID NO: 553514 - RNA, 22 nt, Human
gugggccaggacccgcuguccg

SEQ ID NO: 553515 - RNA, 22 nt, Human
caguuucuuaucuucaaaauug

SEQ ID NO: 553516 - RNA, 22 nt, Human
gugcucacugugagacguccug

SEQ ID NO: 553517 - RNA, 22 nt, Human
uggcugagaaugggaugaugcc

SEQ ID NO: 553518 - RNA, 22 nt, Human
uucaagaucgaguuuaaaguga

SEQ ID NO: 553519 - RNA, 22 nt, Human
acugccugcucauaacauugcu

SEQ ID NO: 553520 - RNA, 20 nt, Human
ugaggcaggagaauggcaug

SEQ ID NO: 553521 - RNA, 22 nt, Human
cagcuuauucaguaagcacaua

SEQ ID NO: 553522 - RNA, 22 nt, Human
guuuuucuuugugugaagacaa

SEQ ID NO: 553523 - RNA, 22 nt, Human
augaaagaugauuuaaaguacu

SEQ ID NO: 553524 - RNA, 22 nt, Human
agcucccagggcugggcaaguu

SEQ ID NO: 553525 - RNA, 22 nt, Human
uaagucaucccauaacagugcu

SEQ ID NO: 553526 - RNA, 22 nt, Human
cagagcagacguugagauuaag

SEQ ID NO: 553527 - RNA, 22 nt, Human
aggugcugccccgagaaggaug

SEQ ID NO: 553528 - RNA, 22 nt, Human
caagaauaaaauacauguugau

SEQ ID NO: 553529 - RNA, 22 nt, Human
ugucucaguucccuucucugga

SEQ ID NO: 553530 - RNA, 22 nt, Human
cuagggaaugagagacuggauc

SEQ ID NO: 553531 - RNA, 22 nt, Human
ucaaagauugaaacuaaggaga

SEQ ID NO: 553532 - RNA, 22 nt, Human
uuaugcuaguauaguccuuaga

SEQ ID NO: 553533 - RNA, 22 nt, Human
uaggaacaguccuagaaaucug

SEQ ID NO: 553534 - RNA, 18 nt, Human
auggucucauacugggag

SEQ ID NO: 553535 - RNA, 20 nt, Human
cagagcuguuauggaugaug

SEQ ID NO: 553536 - RNA, 22 nt, Human
cugcagagaauuguggggcuuc

SEQ ID NO: 553537 - RNA, 22 nt, Human
acugugcacaauucuaaguccu

SEQ ID NO: 553538 - RNA, 22 nt, Human
uggaaacaucucugccuuuauu

SEQ ID NO: 553539 - RNA, 22 nt, Human
gaggggcugggcagucccugga

SEQ ID NO: 553540 - RNA, 22 nt, Human
caguccagagcccaccagagga

SEQ ID NO: 553541 - RNA, 22 nt, Human
gagcagagaauccagcuaagug

SEQ ID NO: 553542 - RNA, 21 nt, Human
agaagccuggguggagguggg

SEQ ID NO: 553543 - RNA, 22 nt, Human
cccaggcagggacgugcucugg

SEQ ID NO: 553544 - RNA, 22 nt, Human
auccccagaaaauaggugccua

SEQ ID NO: 553545 - RNA, 21 nt, Human
ugaaacuaccuacaagcuacc

SEQ ID NO: 553546 - RNA, 20 nt, Human
ugcuuccuggccacugcggg

SEQ ID NO: 553547 - RNA, 22 nt, Human
uucacaaagcugguuccuucug

SEQ ID NO: 553548 - RNA, 22 nt, Human
ugcagggaagcaaggguggcuc

SEQ ID NO: 553549 - RNA, 22 nt, Human
uuacaaagcgcuuuaccucuga

SEQ ID NO: 553550 - RNA, 22 nt, Human
gccaagcucaccuucugaugga

SEQ ID NO: 553551 - RNA, 22 nt, Human
aagaacaacugcuuuaaaagca

SEQ ID NO: 553552 - RNA, 22 nt, Human
ccuguucauuuguauuugucuu

SEQ ID NO: 553553 - RNA, 22 nt, Human
gagcgggaggaacggcucgggc

SEQ ID NO: 553554 - RNA, 22 nt, Human
agaucacagucaauugcaaguu

SEQ ID NO: 553555 - RNA, 22 nt, Human
uauucugugugauauguaaaug

SEQ ID NO: 553556 - RNA, 22 nt, Human
agggcagagauuaauuaagaca

SEQ ID NO: 553557 - RNA, 22 nt, Human
agaagccagucgcucucccgca

SEQ ID NO: 553558 - RNA, 22 nt, Human
caaauacaaauacgggcagcuu

SEQ ID NO: 553559 - RNA, 22 nt, Human
ccuaggaacccccaggcuucug

SEQ ID NO: 553560 - RNA, 22 nt, Human
ucuggcugauucccugggacug

SEQ ID NO: 553561 - RNA, 22 nt, Human
aaaggccacacugcucuuucuc

SEQ ID NO: 553562 - RNA, 22 nt, Human
aucagcaagcauuuauugagug

SEQ ID NO: 553563 - RNA, 22 nt, Human
aauuccagucucugcucuauuu

SEQ ID NO: 553564 - RNA, 22 nt, Human
ugggaagccuagcagacagcug

SEQ ID NO: 553565 - RNA, 22 nt, Human
uccaauuugaaaugguauaugu

SEQ ID NO: 553566 - RNA, 22 nt, Human
gggaaacuggggacugaaucug

SEQ ID NO: 553567 - RNA, 19 nt, Human
ucaggacugacuugaaguc

SEQ ID NO: 553568 - RNA, 22 nt, Human
uacaaagugauuuuggaauuga

SEQ ID NO: 553569 - RNA, 20 nt, Human
ccagcuuucccugcagcauc

SEQ ID NO: 553570 - RNA, 22 nt, Human
gcaggggcugagcaccagcggg

SEQ ID NO: 553571 - RNA, 22 nt, Human
cugagagguaagcagcgcagug

SEQ ID NO: 553572 - RNA, 19 nt, Human
gagggcucauuugaacaau

SEQ ID NO: 553573 - RNA, 22 nt, Human
cuucugggauuaauuuuuccug

SEQ ID NO: 553574 - RNA, 22 nt, Human
auaucuuucaaagccaaaagua

SEQ ID NO: 553575 - RNA, 22 nt, Human
aauauaacacagauggccuguu

SEQ ID NO: 553576 - RNA, 22 nt, Human
aaacagcaauuacuuuugcacc

SEQ ID NO: 553577 - RNA, 22 nt, Human
ugcccugguuacacuggagucc

SEQ ID NO: 553578 - RNA, 23 nt, Human
ucuggcuuugcuggaaguuuuga

SEQ ID NO: 553579 - RNA, 23 nt, Human
ugugggaauguuggagaggaaac

SEQ ID NO: 553580 - RNA, 18 nt, Human
aucuuuccauagcauguu

SEQ ID NO: 553581 - RNA, 23 nt, Human
ccugugugcccuuaauucacagc

SEQ ID NO: 553582 - RNA, 22 nt, Human
gcuuccuggagggagagagcug

SEQ ID NO: 553583 - RNA, 22 nt, Human
ucaaaauuaaaccaacguccag

SEQ ID NO: 553584 - RNA, 20 nt, Human
uucuuuguuccuuacauuug

SEQ ID NO: 553585 - RNA, 22 nt, Human
uggccuggcucacagugagauu

SEQ ID NO: 553586 - RNA, 22 nt, Human
ugagcuggucacuccuucugaa

SEQ ID NO: 553587 - RNA, 22 nt, Human
uguagaaauuaguaagaucaac

SEQ ID NO: 553588 - RNA, 22 nt, Human
guggcccucugauagggucagg

SEQ ID NO: 553589 - RNA, 22 nt, Human
uggaagauaugcugauucucug

SEQ ID NO: 553590 - RNA, 22 nt, Human
caggaaaaaugccaggagucag

SEQ ID NO: 553591 - RNA, 22 nt, Human
ugcagcugcuugauucaucuug

SEQ ID NO: 553592 - RNA, 22 nt, Human
cccaaccagaaauugacagaca

SEQ ID NO: 553593 - RNA, 22 nt, Human
aaacacugcgugguggcaacuc

SEQ ID NO: 553594 - RNA, 20 nt, Human
guuaaaagaguaauuugagg

SEQ ID NO: 553595 - RNA, 22 nt, Human
uccaagcuacugaagguuuggg

SEQ ID NO: 553596 - RNA, 22 nt, Human
gaagagcuuaguuguccuagaa

SEQ ID NO: 553597 - RNA, 22 nt, Human
ccagaccacccuggccaugcac

SEQ ID NO: 553598 - RNA, 22 nt, Human
aaagacauuagauuaacguaca

SEQ ID NO: 553599 - RNA, 22 nt, Human
aguaugaauacagauuuucucu

SEQ ID NO: 553600 - RNA, 22 nt, Human
uuucacagauauaagauuucac

SEQ ID NO: 553601 - RNA, 22 nt, Human
uuuagaaauugcagagugggug

SEQ ID NO: 553602 - RNA, 22 nt, Human
cucucccagucaggcucaggau

SEQ ID NO: 553603 - RNA, 22 nt, Human
ugugcaggugcaggaagggggc

SEQ ID NO: 553604 - RNA, 22 nt, Human
aaagucacauagcaucacuucu

SEQ ID NO: 553605 - RNA, 22 nt, Human
ugagguggcacacacuuccugc

SEQ ID NO: 553606 - RNA, 22 nt, Human
gcugccuuugugagccaagggg

SEQ ID NO: 553607 - RNA, 22 nt, Human
gccugagagucuccagaccuug

SEQ ID NO: 553608 - RNA, 22 nt, Human
cuuucaaaacgcucuguaugca

SEQ ID NO: 553609 - RNA, 22 nt, Human
aggcuuaaaugcucauaucagu

SEQ ID NO: 553610 - RNA, 22 nt, Human
gccacuguuccaccaucuugau

SEQ ID NO: 553611 - RNA, 22 nt, Human
gaggagagaugguagauugggu

SEQ ID NO: 553612 - RNA, 22 nt, Human
ucugccugagcagagggaggcc

SEQ ID NO: 553613 - RNA, 22 nt, Human
acugcacuucacccugggugac

SEQ ID NO: 553614 - RNA, 22 nt, Human
agcuuuauuaacucuccaggug

SEQ ID NO: 553615 - RNA, 22 nt, Human
agagccugcaucaggcuugggg

SEQ ID NO: 553616 - RNA, 23 nt, Human
gccucagagaaacagcugcacac

SEQ ID NO: 553617 - RNA, 20 nt, Human
uucuggaggcuacaagucug

SEQ ID NO: 553618 - RNA, 22 nt, Human
aucaggaaugaauacuuuugga

SEQ ID NO: 553619 - RNA, 20 nt, Human
ggaagccagcauccuugagg

SEQ ID NO: 553620 - RNA, 23 nt, Human
uggggcucuggcaggccugaggu

SEQ ID NO: 553621 - RNA, 22 nt, Human
ggucaggggcugcucuacagag

SEQ ID NO: 553622 - RNA, 22 nt, Human
ugccuuuuccaguuucuagggg

SEQ ID NO: 553623 - RNA, 22 nt, Human
cugggccuaacccacagcguuu

SEQ ID NO: 553624 - RNA, 21 nt, Human
cagcuucuucugugaccuggu

SEQ ID NO: 553625 - RNA, 22 nt, Human
ccuggcugcccauggacccucu

SEQ ID NO: 553626 - RNA, 22 nt, Human
acacuuuaucaauauucaaaaa

SEQ ID NO: 553627 - RNA, 22 nt, Human
agggugccuggaagccacucac

SEQ ID NO: 553628 - RNA, 22 nt, Human
ccuggcaguucaucaaauggca

SEQ ID NO: 553629 - RNA, 22 nt, Human
cacagggccuugugugacugca

SEQ ID NO: 553630 - RNA, 22 nt, Human
acagaccaaaaaaggauauugg

SEQ ID NO: 553631 - RNA, 22 nt, Human
guauuagggccaaaggcaggaa

SEQ ID NO: 553632 - RNA, 22 nt, Human
cugcaggggcuggaguuggcuu

SEQ ID NO: 553633 - RNA, 22 nt, Human
uaacacauuuuccucauacgga

SEQ ID NO: 553634 - RNA, 22 nt, Human
gaugccugcauuucaggagagu

SEQ ID NO: 553635 - RNA, 22 nt, Human
uacaguuuuuauucaugacaag

SEQ ID NO: 553636 - RNA, 22 nt, Human
acagcuuuaguguggguggugc

SEQ ID NO: 553637 - RNA, 22 nt, Human
uacaaagucaccagcuucuugc

SEQ ID NO: 553638 - RNA, 22 nt, Human
uauuuguccagguaaauuucag

SEQ ID NO: 553639 - RNA, 22 nt, Human
aggcgugggaggaucugaggcc

SEQ ID NO: 553640 - RNA, 23 nt, Human
auuccugaggcuccuuaugcacc

SEQ ID NO: 553641 - RNA, 22 nt, Human
caggccugguugagcccugaga

SEQ ID NO: 553642 - RNA, 22 nt, Human
aacauacagugagcaguggacu

SEQ ID NO: 553643 - RNA, 22 nt, Human
gaauguuuaaaaggugcaguuu

SEQ ID NO: 553644 - RNA, 22 nt, Human
ccaggccuggccaggggaugcc

SEQ ID NO: 553645 - RNA, 22 nt, Human
ugaaagaaggguggaaaaugua

SEQ ID NO: 553646 - RNA, 22 nt, Human
aguacaaacuguuucaaaguag

SEQ ID NO: 553647 - RNA, 22 nt, Human
ucccaaggauaagagagucuga

SEQ ID NO: 553648 - RNA, 22 nt, Human
aaaugcacagaaaggaugugga

SEQ ID NO: 553649 - RNA, 22 nt, Human
gucacccugcuguuuguccauu

SEQ ID NO: 553650 - RNA, 22 nt, Human
aaagaugucacaagaugugaug

SEQ ID NO: 553651 - RNA, 22 nt, Human
auuuguucagcauugaauuugg

SEQ ID NO: 553652 - RNA, 22 nt, Human
ucaaauacauggucaaucaacu

SEQ ID NO: 553653 - RNA, 22 nt, Human
aaguuuaucccucucacaguua

SEQ ID NO: 553654 - RNA, 21 nt, Human
ugggagagcguugcuguccuc

SEQ ID NO: 553655 - RNA, 22 nt, Human
ucugauuagcuccauuugcuaa

SEQ ID NO: 553656 - RNA, 22 nt, Human
uagcuaucuguguccagaucca

SEQ ID NO: 553657 - RNA, 22 nt, Human
agaggcugugcccaccaggcaa

SEQ ID NO: 553658 - RNA, 22 nt, Human
aagauaauauucauuaacuaga

SEQ ID NO: 553659 - RNA, 22 nt, Human
ugcugugguucccagaguggau

SEQ ID NO: 553660 - RNA, 22 nt, Human
ggugugccuggggcuuagcugc

SEQ ID NO: 553661 - RNA, 22 nt, Human
ugggcugaguggcagccagagu

SEQ ID NO: 553662 - RNA, 22 nt, Human
ggccagaaguuggaaaagagcc

SEQ ID NO: 553663 - RNA, 22 nt, Human
ccagcucucuuugaagcauaaa

SEQ ID NO: 553664 - RNA, 19 nt, Human
agcagccaucgaccaugga

SEQ ID NO: 553665 - RNA, 22 nt, Human
agugcccuuuacaacuucuuga

SEQ ID NO: 553666 - RNA, 22 nt, Human
agggccagcccauaaugccaaa

SEQ ID NO: 553667 - RNA, 22 nt, Human
gaauguuuuucauuggugacuc

SEQ ID NO: 553668 - RNA, 22 nt, Human
cugaggaggggccugagugaga

SEQ ID NO: 553669 - RNA, 22 nt, Human
caggugucaaaauacuaagugg

SEQ ID NO: 553670 - RNA, 22 nt, Human
uggugcaggaguuggcagggac

SEQ ID NO: 553671 - RNA, 22 nt, Human
ccaggaggcucugacuggaccc

SEQ ID NO: 553672 - RNA, 22 nt, Human
aagccucaccuuuuagaagcua

SEQ ID NO: 553673 - RNA, 22 nt, Human
gcucaggacccaggugugaccu

SEQ ID NO: 553674 - RNA, 22 nt, Human
gcagguguggaguggggugagc

SEQ ID NO: 553675 - RNA, 22 nt, Human
caugauuauguguuagaguuug

SEQ ID NO: 553676 - RNA, 22 nt, Human
uccagaauauuugggaaagaug

SEQ ID NO: 553677 - RNA, 22 nt, Human
guguacaugagaaaucaacuuu

SEQ ID NO: 553678 - RNA, 22 nt, Human
aaaagggacuacucucagcucc

SEQ ID NO: 553679 - RNA, 22 nt, Human
ucuuuucugccacagccugagc

SEQ ID NO: 553680 - RNA, 22 nt, Human
cuggcagcgugagcagcaucca

SEQ ID NO: 553681 - RNA, 22 nt, Human
gcacagcaugaagagaggaagc

SEQ ID NO: 553682 - RNA, 22 nt, Human
gcuccuggcucucugagggcug

SEQ ID NO: 553683 - RNA, 22 nt, Human
ugcauugauagaaaaacaugga

SEQ ID NO: 553684 - RNA, 22 nt, Human
acccacacaucucuaauucagu

SEQ ID NO: 553685 - RNA, 21 nt, Human
aacauuaguaauuugacuuuu

SEQ ID NO: 553686 - RNA, 22 nt, Human
augaaacaguguguauagcaaa

SEQ ID NO: 553687 - RNA, 22 nt, Human
ugggcugcugucugcacaugcu

SEQ ID NO: 553688 - RNA, 22 nt, Human
uuuccucugcugccauugcccc

SEQ ID NO: 553689 - RNA, 22 nt, Human
gccuggaguacuccuugaagug

SEQ ID NO: 553690 - RNA, 22 nt, Human
gagucugagaacugggcucagu

SEQ ID NO: 553691 - RNA, 22 nt, Human
auagacacauguuauuauacuu

SEQ ID NO: 553692 - RNA, 17 nt, Human
acacagacaggcagaca

SEQ ID NO: 553693 - RNA, 18 nt, Human
cuuuaugugcagagcuuu

SEQ ID NO: 553694 - RNA, 22 nt, Human
cucacauuccacuugugccaac

SEQ ID NO: 553695 - RNA, 22 nt, Human
auuucucucauuguuagcuagg

SEQ ID NO: 553696 - RNA, 22 nt, Human
uggugagagcugaccgugcgag

SEQ ID NO: 553697 - RNA, 22 nt, Human
cucuggggaagcagccagcugg

SEQ ID NO: 553698 - RNA, 22 nt, Human
aagaacaguugggaggugagcc

SEQ ID NO: 553699 - RNA, 22 nt, Human
gcacacaguagggauucaauga

SEQ ID NO: 553700 - RNA, 22 nt, Human
guauuaggagguggagccuuug

SEQ ID NO: 553701 - RNA, 22 nt, Human
agggccuugcugucugaagcug

SEQ ID NO: 553702 - RNA, 22 nt, Human
cccaggcuggagugcaauggca

SEQ ID NO: 553703 - RNA, 22 nt, Human
gaauguuugugcagagucaucu

SEQ ID NO: 553704 - RNA, 22 nt, Human
agcugucuaccugcagaguccu

SEQ ID NO: 553705 - RNA, 22 nt, Human
cagaccagcucuaugaacccaa

SEQ ID NO: 553706 - RNA, 22 nt, Human
uugaguguaaggaauguggggc

SEQ ID NO: 553707 - RNA, 22 nt, Human
uuaaagcaaccaucaauuugga

SEQ ID NO: 553708 - RNA, 22 nt, Human
aggcccuguuaugagccacugu

SEQ ID NO: 553709 - RNA, 17 nt, Human
ugggggcccuguguaga

SEQ ID NO: 553710 - RNA, 22 nt, Human
gcccaucaucacuguggaggcu

SEQ ID NO: 553711 - RNA, 19 nt, Human
gccucugcuggggacaggc

SEQ ID NO: 553712 - RNA, 22 nt, Human
gcaagcugcuuaagcucauugu

SEQ ID NO: 553713 - RNA, 22 nt, Human
aaacuacuggauuaguaacuua

SEQ ID NO: 553714 - RNA, 22 nt, Human
augacagaaggccucccugaca

SEQ ID NO: 553715 - RNA, 22 nt, Human
ugggcugaggggccuugaugac

SEQ ID NO: 553716 - RNA, 22 nt, Human
ugaacacauuugggaaaaucuu

SEQ ID NO: 553717 - RNA, 22 nt, Human
gcccucucuucugcagccucca

SEQ ID NO: 553718 - RNA, 22 nt, Human
ugcugcucuucaccauggccuc

SEQ ID NO: 553719 - RNA, 22 nt, Human
agggcacaggcuggcaggaucu

SEQ ID NO: 553720 - RNA, 22 nt, Human
accaucagucauugucaguggg

SEQ ID NO: 553721 - RNA, 22 nt, Human
gagcucaggagcaucagaagaa

SEQ ID NO: 553722 - RNA, 22 nt, Human
ggucucagcuggaguccuuggu

SEQ ID NO: 553723 - RNA, 22 nt, Human
gugcugggugcugcagacaggu

SEQ ID NO: 553724 - RNA, 22 nt, Human
ucauugcaccccagucccagcu

SEQ ID NO: 553725 - RNA, 22 nt, Human
cugcccugucugcagccuggcu

SEQ ID NO: 553726 - RNA, 22 nt, Human
ugccugcagcgucuccagcagg

SEQ ID NO: 553727 - RNA, 22 nt, Human
uguggccagagguacuauuuua

SEQ ID NO: 553728 - RNA, 22 nt, Human
uaguuaaagagauccacauucc

SEQ ID NO: 553729 - RNA, 22 nt, Human
gacauuuaaggcagucacuuaa

SEQ ID NO: 553730 - RNA, 22 nt, Human
caguggguaggaaaggcucuuc

SEQ ID NO: 553731 - RNA, 18 nt, Human
cuguccaguagacucugc

SEQ ID NO: 553732 - RNA, 23 nt, Human
uccaggcacgcauuucuucuagc

SEQ ID NO: 553733 - RNA, 22 nt, Human
ggcagugaaucugagagccugg

SEQ ID NO: 553734 - RNA, 22 nt, Human
cagcucucuaaggucuugcuuu

SEQ ID NO: 553735 - RNA, 22 nt, Human
uuucuggaaagcaagauacauu

SEQ ID NO: 553736 - RNA, 22 nt, Human
cuugccuuugucuucaaaggcu

SEQ ID NO: 553737 - RNA, 22 nt, Human
gugcaugugucuuuauaguaga

SEQ ID NO: 553738 - RNA, 22 nt, Human
caguuacuguaugucaaagacu

SEQ ID NO: 553739 - RNA, 22 nt, Human
cagcagaaacccagcaaagcca

SEQ ID NO: 553740 - RNA, 22 nt, Human
cugggccugguagggcuugaaa

SEQ ID NO: 553741 - RNA, 22 nt, Human
cuggagccauguauagccuaug

SEQ ID NO: 553742 - RNA, 22 nt, Human
agcaggaggagagccuggcggu

SEQ ID NO: 553743 - RNA, 22 nt, Human
cauuccuacaugauaagaauua

SEQ ID NO: 553744 - RNA, 22 nt, Human
acguguucaauuuccaucugac

SEQ ID NO: 553745 - RNA, 22 nt, Human
gcaggaguucaauugcccauga

SEQ ID NO: 553746 - RNA, 22 nt, Human
gacaggguacgggcuaggcaca

SEQ ID NO: 553747 - RNA, 22 nt, Human
gagcuguccuaccaggaguccu

SEQ ID NO: 553748 - RNA, 22 nt, Human
ggcugcagggcagcuggugugg

SEQ ID NO: 553749 - RNA, 22 nt, Human
uuuggaaauuucaucaauagcc

SEQ ID NO: 553750 - RNA, 22 nt, Human
cugaaggagaaggccacuguuc

SEQ ID NO: 553751 - RNA, 22 nt, Human
cuccagggagcuguggagguuu

SEQ ID NO: 553752 - RNA, 22 nt, Human
cacauguuuggcaugucaccaa

SEQ ID NO: 553753 - RNA, 22 nt, Human
uagcuuuccuuguugccugugc

SEQ ID NO: 553754 - RNA, 17 nt, Human
gcagaaaagucaaggga

SEQ ID NO: 553755 - RNA, 22 nt, Human
auacaaguuaaugagaaugaca

SEQ ID NO: 553756 - RNA, 22 nt, Human
ccagugcaggugagcaccaggu

SEQ ID NO: 553757 - RNA, 22 nt, Human
ggagagugggagcaacuguugc

SEQ ID NO: 553758 - RNA, 22 nt, Human
gccugccuguuggcugaggugc

SEQ ID NO: 553759 - RNA, 22 nt, Human
gccaggcagcuagcaaccccug

SEQ ID NO: 553760 - RNA, 22 nt, Human
uagugcauaacauuuaaagguc

SEQ ID NO: 553761 - RNA, 20 nt, Human
aagauucugauuuguagcgu

SEQ ID NO: 553762 - RNA, 22 nt, Human
ggagugaaguggcgcgaucucg

SEQ ID NO: 553763 - RNA, 22 nt, Human
ugaagcagcaaaugaugggaga

SEQ ID NO: 553764 - RNA, 22 nt, Human
gcagugcuuuagucuguccuuu

SEQ ID NO: 553765 - RNA, 22 nt, Human
uuuaggaaauacuguccuauga

SEQ ID NO: 553766 - RNA, 17 nt, Human
agccgggcauggaccag

SEQ ID NO: 553767 - RNA, 22 nt, Human
uugauuuucaauucauugacaa

SEQ ID NO: 553768 - RNA, 22 nt, Human
uugagucaguaauuccauuucu

SEQ ID NO: 553769 - RNA, 22 nt, Human
ccucugagagaaggccuucagc

SEQ ID NO: 553770 - RNA, 22 nt, Human
uagagaaauaagcuuugccuug

SEQ ID NO: 553771 - RNA, 22 nt, Human
caucuguaaaguaggaauauug

SEQ ID NO: 553772 - RNA, 22 nt, Human
gaccauuugcuaguaaauugca

SEQ ID NO: 553773 - RNA, 22 nt, Human
ccauuucacucuuccugaagga

SEQ ID NO: 553774 - RNA, 22 nt, Human
caggggccaggcugucugcugu

SEQ ID NO: 553775 - RNA, 22 nt, Human
ugucucuggcccaugagcagag

SEQ ID NO: 553776 - RNA, 22 nt, Human
gcugccaugccacagcacucac

SEQ ID NO: 553777 - RNA, 22 nt, Human
gggccugugcacaguucuguua

SEQ ID NO: 553778 - RNA, 21 nt, Human
aguuugaugcaauuucugaga

SEQ ID NO: 553779 - RNA, 22 nt, Human
ggugaaggaggaagcugaugga

SEQ ID NO: 553780 - RNA, 21 nt, Human
ucagaagagcugccucuuggu

SEQ ID NO: 553781 - RNA, 22 nt, Human
auucuaggcuugaaacaugaag

SEQ ID NO: 553782 - RNA, 22 nt, Human
aucaggccagcaaucccugggc

SEQ ID NO: 553783 - RNA, 22 nt, Human
gcagugauggggaucucacugg

SEQ ID NO: 553784 - RNA, 22 nt, Human
ucaggagcuugguagugugauu

SEQ ID NO: 553785 - RNA, 22 nt, Human
uagcuuuagaaauauucucaga

SEQ ID NO: 553786 - RNA, 22 nt, Human
ucucaggggccuggaguccugg

SEQ ID NO: 553787 - RNA, 22 nt, Human
auugguggugaggacaugccag

SEQ ID NO: 553788 - RNA, 22 nt, Human
auugcauaugcagcacaucagg

SEQ ID NO: 553789 - RNA, 22 nt, Human
cuauuuaugugcuauuuuguau

SEQ ID NO: 553790 - RNA, 18 nt, Human
uuuuacucauagcaggcc

SEQ ID NO: 553791 - RNA, 22 nt, Human
gcucuguguccacagcuggaaa

SEQ ID NO: 553792 - RNA, 22 nt, Human
uguuugaauaacuuggauauau

SEQ ID NO: 553793 - RNA, 22 nt, Human
ucuacuguagugaugcugcagu

SEQ ID NO: 553794 - RNA, 22 nt, Human
aagugaguggccuggagaggug

SEQ ID NO: 553795 - RNA, 22 nt, Human
aaacaguaaguucuaguauuau

SEQ ID NO: 553796 - RNA, 22 nt, Human
ugcccugcuucucuugggacag

SEQ ID NO: 553797 - RNA, 22 nt, Human
aguguacaucagaacauaucaa

SEQ ID NO: 553798 - RNA, 22 nt, Human
gcagugggcaacaagagcugga

SEQ ID NO: 553799 - RNA, 22 nt, Human
gcaggagcuggaaagugauguu

SEQ ID NO: 553800 - RNA, 22 nt, Human
agcugccagggacugggcaugg

SEQ ID NO: 553801 - RNA, 22 nt, Human
uuaaauuauugagggauuguca

SEQ ID NO: 553802 - RNA, 22 nt, Human
ccaggaguuggagguugcagug

SEQ ID NO: 553803 - RNA, 21 nt, Human
ggcaggauggcaguggacccc

SEQ ID NO: 553804 - RNA, 22 nt, Human
aaaguucagugccuucuauaca

SEQ ID NO: 553805 - RNA, 22 nt, Human
caggccucccggugcacacuga

SEQ ID NO: 553806 - RNA, 22 nt, Human
uuacaguagauacaaugaguaa

SEQ ID NO: 553807 - RNA, 22 nt, Human
uauugacagagggucagaagag

SEQ ID NO: 553808 - RNA, 22 nt, Human
acauacuaugaauacauguguc

SEQ ID NO: 553809 - RNA, 22 nt, Human
gggaaggacauucugggcucag

SEQ ID NO: 553810 - RNA, 19 nt, Human
ggaaggugacaguggugaa

SEQ ID NO: 553811 - RNA, 22 nt, Human
cucaggccugaguggcaguccc

SEQ ID NO: 553812 - RNA, 20 nt, Human
uuucuggguacucucccucu

SEQ ID NO: 553813 - RNA, 22 nt, Human
cugccuccugccgugcagcuuc

SEQ ID NO: 553814 - RNA, 22 nt, Human
ucaggagaaucagggcuguccu

SEQ ID NO: 553815 - RNA, 22 nt, Human
agaagccauaguaucucagggu

SEQ ID NO: 553816 - RNA, 22 nt, Human
aaagcagguugcaauuacagug

SEQ ID NO: 553817 - RNA, 22 nt, Human
gucaccaggucugaugcagcca

SEQ ID NO: 553818 - RNA, 22 nt, Human
gacagccaacuggggagggcau

SEQ ID NO: 553819 - RNA, 22 nt, Human
ggagccagagucugcaguguaa

SEQ ID NO: 553820 - RNA, 22 nt, Human
agccacagggggugagggacaa

SEQ ID NO: 553821 - RNA, 19 nt, Human
uguagcaguuuaaaacaac

SEQ ID NO: 553822 - RNA, 21 nt, Human
aauaaaacaguuggugucaau

SEQ ID NO: 553823 - RNA, 22 nt, Human
aggccucacauugggcuucaag

SEQ ID NO: 553824 - RNA, 22 nt, Human
acuuuucuaagcaauggucuug

SEQ ID NO: 553825 - RNA, 22 nt, Human
agggagcaugggugaagcaggc

SEQ ID NO: 553826 - RNA, 22 nt, Human
ccaguggccaugcacgagcagc

SEQ ID NO: 553827 - RNA, 22 nt, Human
uauggaaagcucuuuuugauug

SEQ ID NO: 553828 - RNA, 22 nt, Human
gcacaugguaggcauuugaugu

SEQ ID NO: 553829 - RNA, 22 nt, Human
auuauuucucacucacauaaua

SEQ ID NO: 553830 - RNA, 22 nt, Human
acaucuuuuuucucuaauugug

SEQ ID NO: 553831 - RNA, 22 nt, Human
cugggagucuggccucuggucc

SEQ ID NO: 553832 - RNA, 22 nt, Human
ccugggugucaugggcagcugg

SEQ ID NO: 553833 - RNA, 22 nt, Human
uggcccugguggcacagccugc

SEQ ID NO: 553834 - RNA, 22 nt, Human
ucagcagggcugugguguggcu

SEQ ID NO: 553835 - RNA, 22 nt, Human
caaagcagagaacugucucauu

SEQ ID NO: 553836 - RNA, 22 nt, Human
agagacaagggaccucuggaga

SEQ ID NO: 553837 - RNA, 22 nt, Human
caggcuggagugcaauggugcu

SEQ ID NO: 553838 - RNA, 23 nt, Human
ccacagagcugccaauuccugug

SEQ ID NO: 553839 - RNA, 22 nt, Human
gcuguucuuucagcccagggcu

SEQ ID NO: 553840 - RNA, 22 nt, Human
ggaacugaaugucucgguauaa

SEQ ID NO: 553841 - RNA, 22 nt, Human
gugcucugaucugucugacauc

SEQ ID NO: 553842 - RNA, 22 nt, Human
ugguuaaguccagaaaggaagc

SEQ ID NO: 553843 - RNA, 22 nt, Human
uguccaggucagcagcagggac

SEQ ID NO: 553844 - RNA, 22 nt, Human
aggggagcaacauagucacucu

SEQ ID NO: 553845 - RNA, 19 nt, Human
ucccagagucuagagguug

SEQ ID NO: 553846 - RNA, 22 nt, Human
uagcuuuaaugaguugguaaga

SEQ ID NO: 553847 - RNA, 22 nt, Human
ucccugugaaucagaagcaggu

SEQ ID NO: 553848 - RNA, 22 nt, Human
agugucugccagcugccaggug

SEQ ID NO: 553849 - RNA, 22 nt, Human
ucaggcugugggcacuggccau

SEQ ID NO: 553850 - RNA, 22 nt, Human
ugcuccagaaccugaccaugcu

SEQ ID NO: 553851 - RNA, 20 nt, Human
cuguagggugcagcaggcuc

SEQ ID NO: 553852 - RNA, 21 nt, Human
uggagcugaauuuuuggcauc

SEQ ID NO: 553853 - RNA, 22 nt, Human
augaaacaaaccucuauggagu

SEQ ID NO: 553854 - RNA, 22 nt, Human
auuaaauuagcaaacugugaaa

SEQ ID NO: 553855 - RNA, 22 nt, Human
gcagauaggguauuaggaguaa

SEQ ID NO: 553856 - RNA, 22 nt, Human
gcccucuggggcacacagagga

SEQ ID NO: 553857 - RNA, 19 nt, Human
ucaaagucugagucacuuu

SEQ ID NO: 553858 - RNA, 22 nt, Human
agacaucaaugaucagagguag

SEQ ID NO: 553859 - RNA, 22 nt, Human
ucagcuuugcaaguuagaaaau

SEQ ID NO: 553860 - RNA, 22 nt, Human
uuucacacuagucagaauacca

SEQ ID NO: 553861 - RNA, 22 nt, Human
gcagguggucacucauccccag

SEQ ID NO: 553862 - RNA, 22 nt, Human
gccuccugagaagccacaggcu

SEQ ID NO: 553863 - RNA, 22 nt, Human
agguaggguuaauggagauaua

SEQ ID NO: 553864 - RNA, 22 nt, Human
gaaaauguuuccuguuauuugc

SEQ ID NO: 553865 - RNA, 22 nt, Human
cucccacuccuggcucaccaca

SEQ ID NO: 553866 - RNA, 22 nt, Human
ggccagagucuauaugcagaca

SEQ ID NO: 553867 - RNA, 22 nt, Human
cagaaacagacaugacgcagua

SEQ ID NO: 553868 - RNA, 22 nt, Human
agcuuuauauuuaaugaauucu

SEQ ID NO: 553869 - RNA, 22 nt, Human
uucaguaugacagacgcauugg

SEQ ID NO: 553870 - RNA, 22 nt, Human
ugauuuccaaaaggcuucuaag

SEQ ID NO: 553871 - RNA, 22 nt, Human
auguccaggaucuauccccaga

SEQ ID NO: 553872 - RNA, 22 nt, Human
uuggucuuuucuauuaaauaua

SEQ ID NO: 553873 - RNA, 21 nt, Human
gcugccaccgcgugcuccagg

SEQ ID NO: 553874 - RNA, 22 nt, Human
gggcacugaacacccucuucgc

SEQ ID NO: 553875 - RNA, 22 nt, Human
aucaaagugaaaagugcugaug

SEQ ID NO: 553876 - RNA, 22 nt, Human
uuacaguagauuuugaaugugg

SEQ ID NO: 553877 - RNA, 22 nt, Human
caggacagaaauaaggaauaua

SEQ ID NO: 553878 - RNA, 22 nt, Human
ccauuguaaagaguauacuuug

SEQ ID NO: 553879 - RNA, 22 nt, Human
uacacaacugacaaccauucug

SEQ ID NO: 553880 - RNA, 17 nt, Human
uuuaaacuacuacaagg

SEQ ID NO: 553881 - RNA, 22 nt, Human
aguugaaauuagaguccuggcu

SEQ ID NO: 553882 - RNA, 22 nt, Human
caguuaaugugggccaaguucu

SEQ ID NO: 553883 - RNA, 22 nt, Human
gcuuucuugguucugcaggggc

SEQ ID NO: 553884 - RNA, 20 nt, Human
gucuuauuuaacacaugacu

SEQ ID NO: 553885 - RNA, 22 nt, Human
cugaggcuuugugugcaugccu

SEQ ID NO: 553886 - RNA, 22 nt, Human
gcaggugagggugucugaauag

SEQ ID NO: 553887 - RNA, 23 nt, Human
acaugggagggacauggaggcug

SEQ ID NO: 553888 - RNA, 17 nt, Human
cucacggaggaugaauc

SEQ ID NO: 553889 - RNA, 22 nt, Human
uucuucaaccaucuacauaaac

SEQ ID NO: 553890 - RNA, 22 nt, Human
uuacagauguaggaacugaagu

SEQ ID NO: 553891 - RNA, 22 nt, Human
uguggagacuauagccauaaca

SEQ ID NO: 553892 - RNA, 19 nt, Human
cucuggagcagacacugga

SEQ ID NO: 553893 - RNA, 22 nt, Human
aaacaugaauagauauuaaaca

SEQ ID NO: 553894 - RNA, 22 nt, Human
aacuuuacuugaaagaacaugu

SEQ ID NO: 553895 - RNA, 19 nt, Human
uugguggugguuuugguuc

SEQ ID NO: 553896 - RNA, 22 nt, Human
cugcagugcaagcccagaugga

SEQ ID NO: 553897 - RNA, 22 nt, Human
uggaagaauaggauagaagaac

SEQ ID NO: 553898 - RNA, 22 nt, Human
uucaaugaggauagaacuggau

SEQ ID NO: 553899 - RNA, 22 nt, Human
cauuaagauuuuuuucuacugg

SEQ ID NO: 553900 - RNA, 22 nt, Human
acagcuguggucuccuuagugu

SEQ ID NO: 553901 - RNA, 22 nt, Human
acaguggaugugauguccaggu

SEQ ID NO: 553902 - RNA, 22 nt, Human
ugaacauauucaccucuaaaua

SEQ ID NO: 553903 - RNA, 22 nt, Human
ugcugucccccgugucugggcu

SEQ ID NO: 553904 - RNA, 23 nt, Human
guccucuggagagaaaggcagua

SEQ ID NO: 553905 - RNA, 22 nt, Human
gcuaggagauugagcucugaag

SEQ ID NO: 553906 - RNA, 19 nt, Human
cucagagaggggcagugcc

SEQ ID NO: 553907 - RNA, 22 nt, Human
cccucugccugggaccaagucc

SEQ ID NO: 553908 - RNA, 22 nt, Human
aguucacauuccgagguacugg

SEQ ID NO: 553909 - RNA, 20 nt, Human
ccucugccuuucuagucuga

SEQ ID NO: 553910 - RNA, 22 nt, Human
aggggcuggaguucgagguuac

SEQ ID NO: 553911 - RNA, 22 nt, Human
uguguacuugaaagggcagguc

SEQ ID NO: 553912 - RNA, 22 nt, Human
ccuggcugaaccaaugaagugg

SEQ ID NO: 553913 - RNA, 22 nt, Human
acucagagaauaucuagaagga

SEQ ID NO: 553914 - RNA, 22 nt, Human
aauuucaguugcuaauaaguuc

SEQ ID NO: 553915 - RNA, 22 nt, Human
uagcuuuaagacauggugaaug

SEQ ID NO: 553916 - RNA, 22 nt, Human
cacaggagaacccacagauucu

SEQ ID NO: 553917 - RNA, 22 nt, Human
agaaaugugagccccuuaucaa

SEQ ID NO: 553918 - RNA, 22 nt, Human
agguggcaugccugagacauaa

SEQ ID NO: 553919 - RNA, 22 nt, Human
gaggggucacaugggcuggcuu

SEQ ID NO: 553920 - RNA, 22 nt, Human
aaggcuuuuaacuacuguuuua

SEQ ID NO: 553921 - RNA, 22 nt, Human
cuggcucauuuuagcaucaggu

SEQ ID NO: 553922 - RNA, 22 nt, Human
agcacuuugggagauaaagcug

SEQ ID NO: 553923 - RNA, 22 nt, Human
gugcugccggcauagcagugaa

SEQ ID NO: 553924 - RNA, 22 nt, Human
cugcaggggccucgagcacagg

SEQ ID NO: 553925 - RNA, 22 nt, Human
agaugguugucgcaaaugaaug

SEQ ID NO: 553926 - RNA, 22 nt, Human
agcaggcuaagggaccuguuua

SEQ ID NO: 553927 - RNA, 22 nt, Human
cauucacucagcgaugccagua

SEQ ID NO: 553928 - RNA, 22 nt, Human
agcucccagaagccagagucgg

SEQ ID NO: 553929 - RNA, 22 nt, Human
gcagaggagugauuaugccgug

SEQ ID NO: 553930 - RNA, 22 nt, Human
ggaggggauuuaguagaugcua

SEQ ID NO: 553931 - RNA, 22 nt, Human
gagagcugggggacuguggaug

SEQ ID NO: 553932 - RNA, 22 nt, Human
ggcuguggcauuaggugaggcc

SEQ ID NO: 553933 - RNA, 22 nt, Human
ggcagucuuucccuugagcucu

SEQ ID NO: 553934 - RNA, 22 nt, Human
uucccaguuagucauuuuuaca

SEQ ID NO: 553935 - RNA, 22 nt, Human
gaaacuuuggcuaaaagccaga

SEQ ID NO: 553936 - RNA, 22 nt, Human
uuugucauaucacacaauuuug

SEQ ID NO: 553937 - RNA, 22 nt, Human
uagguaagauguuaacagcuga

SEQ ID NO: 553938 - RNA, 20 nt, Human
cagagccaagagcagcaucu

SEQ ID NO: 553939 - RNA, 22 nt, Human
agcagguguaucggucaccuac

SEQ ID NO: 553940 - RNA, 22 nt, Human
uuuccucuccggggccuccagg

SEQ ID NO: 553941 - RNA, 22 nt, Human
gaaguuaguuggggcccaagaa

SEQ ID NO: 553942 - RNA, 22 nt, Human
ugcuggcuuccugugcacagca

SEQ ID NO: 553943 - RNA, 22 nt, Human
ccccagcucagugcagggacau

SEQ ID NO: 553944 - RNA, 22 nt, Human
ugggcugcagagcccggccuuc

SEQ ID NO: 553945 - RNA, 22 nt, Human
uacauggugguggcacuugacu

SEQ ID NO: 553946 - RNA, 22 nt, Human
ccagcugcagguguuccagaug

SEQ ID NO: 553947 - RNA, 22 nt, Human
uuuauucuugagagugagaaga

SEQ ID NO: 553948 - RNA, 22 nt, Human
gcugggcagccccuacagagag

SEQ ID NO: 553949 - RNA, 22 nt, Human
gugaggcagcaggagccucugu

SEQ ID NO: 553950 - RNA, 22 nt, Human
aggagcugugaaugggaggggu

SEQ ID NO: 553951 - RNA, 22 nt, Human
ucccagagccaagcuauggaug

SEQ ID NO: 553952 - RNA, 22 nt, Human
ucaaugaaagagcaugcauuuu

SEQ ID NO: 553953 - RNA, 22 nt, Human
guaggcagauaggagugcagcc

SEQ ID NO: 553954 - RNA, 22 nt, Human
uuuccaaaaugaaucuaaugca

SEQ ID NO: 553955 - RNA, 22 nt, Human
uuucccaucuuagcagauuaaa

SEQ ID NO: 553956 - RNA, 17 nt, Human
aaucuguuuacagucag

SEQ ID NO: 553957 - RNA, 22 nt, Human
gcuguggucugugagcuccaaa

SEQ ID NO: 553958 - RNA, 22 nt, Human
gggcaguugauggaggucugga

SEQ ID NO: 553959 - RNA, 22 nt, Human
gggggcucugacucccucagcu

SEQ ID NO: 553960 - RNA, 22 nt, Human
ccagcccugccucucagggccc

SEQ ID NO: 553961 - RNA, 22 nt, Human
ucuguuuucauuugucuugaga

SEQ ID NO: 553962 - RNA, 22 nt, Human
caccagguuccgggcagagcug

SEQ ID NO: 553963 - RNA, 22 nt, Human
uccaggcacuauauauacuuuu

SEQ ID NO: 553964 - RNA, 22 nt, Human
ccaggaguuugaggcugcagug

SEQ ID NO: 553965 - RNA, 22 nt, Human
ucugccuuggcaaccacagcuu

SEQ ID NO: 553966 - RNA, 22 nt, Human
agcugcucugggaaacagaagu

SEQ ID NO: 553967 - RNA, 22 nt, Human
uccaguggcaccuuggcccuca

SEQ ID NO: 553968 - RNA, 22 nt, Human
agacuuugagcucuuagagaag

SEQ ID NO: 553969 - RNA, 22 nt, Human
cagaaggagcgcuaagguccca

SEQ ID NO: 553970 - RNA, 22 nt, Human
uuguaauuuguucccaagcaga

SEQ ID NO: 553971 - RNA, 22 nt, Human
cucuggaguucucaugaggaac

SEQ ID NO: 553972 - RNA, 19 nt, Human
cucuuaaauugucucuugc

SEQ ID NO: 553973 - RNA, 22 nt, Human
ucaucgccucgugcaucuuggc

SEQ ID NO: 553974 - RNA, 22 nt, Human
aaaggauucucuugauuucagu

SEQ ID NO: 553975 - RNA, 22 nt, Human
acaaacuaccuacagauguuca

SEQ ID NO: 553976 - RNA, 18 nt, Human
gggaagccgggaagccgg

SEQ ID NO: 553977 - RNA, 22 nt, Human
ugucauuuucuaaucuguuguc

SEQ ID NO: 553978 - RNA, 22 nt, Human
cagggccaagccccuuuggcug

SEQ ID NO: 553979 - RNA, 22 nt, Human
uggcucagagcagggacucugg

SEQ ID NO: 553980 - RNA, 22 nt, Human
ugagagugauugguucgaaugu

SEQ ID NO: 553981 - RNA, 22 nt, Human
ggaguugauuuuggauauauua

SEQ ID NO: 553982 - RNA, 22 nt, Human
aaaucaguucacguucugaggu

SEQ ID NO: 553983 - RNA, 22 nt, Human
aacauuucagcaccugauuccu

SEQ ID NO: 553984 - RNA, 22 nt, Human
ggcaaaaacagcaaugacuuuu

SEQ ID NO: 553985 - RNA, 22 nt, Human
cccaaggccuucaagccagcuc

SEQ ID NO: 553986 - RNA, 22 nt, Human
uuugcuauaaaagggucacacg

SEQ ID NO: 553987 - RNA, 22 nt, Human
uuuuccacuuuagugcaauaac

SEQ ID NO: 553988 - RNA, 22 nt, Human
aauguuguguuucaguucaaga

SEQ ID NO: 553989 - RNA, 17 nt, Human
agguggcugcugcgccu

SEQ ID NO: 553990 - RNA, 22 nt, Human
cacauuuagagguuagcauggu

SEQ ID NO: 553991 - RNA, 22 nt, Human
uccaggaggguuuucugccuuc

SEQ ID NO: 553992 - RNA, 22 nt, Human
gcugucagugaggugagacaug

SEQ ID NO: 553993 - RNA, 22 nt, Human
uccagcuugccuggucuuuugg

SEQ ID NO: 553994 - RNA, 22 nt, Human
caucagcacuaugauuaaagua

SEQ ID NO: 553995 - RNA, 22 nt, Human
ggugucuguugccuccugguua

SEQ ID NO: 553996 - RNA, 22 nt, Human
ugcacacagaugguacaugcau

SEQ ID NO: 553997 - RNA, 22 nt, Human
aaacaugcuggauuuagaauau

SEQ ID NO: 553998 - RNA, 22 nt, Human
uuauguauggauggcugaaagu

SEQ ID NO: 553999 - RNA, 22 nt, Human
auuucuguugcuuauaaauuac

SEQ ID NO: 554000 - RNA, 22 nt, Human
aagauauagauaaaacuaugca

SEQ ID NO: 554001 - RNA, 22 nt, Human
uuucaaagacagccauauuugu

SEQ ID NO: 554002 - RNA, 23 nt, Human
ucagaggaucaucaaacguuuuc

SEQ ID NO: 554003 - RNA, 22 nt, Human
gcaccuggcugcccagguggag

SEQ ID NO: 554004 - RNA, 22 nt, Human
acuuuguuuggcuauuagaguc

SEQ ID NO: 554005 - RNA, 22 nt, Human
uuuuuggguccaggcuguaucu

SEQ ID NO: 554006 - RNA, 22 nt, Human
ugcaggugguacuucuuuuucu

SEQ ID NO: 554007 - RNA, 22 nt, Human
ugggagugaggcagagucuauc

SEQ ID NO: 554008 - RNA, 22 nt, Human
ugcucuggguccugggccuccu

SEQ ID NO: 554009 - RNA, 22 nt, Human
aaagcuauagggucaagcauuu

SEQ ID NO: 554010 - RNA, 22 nt, Human
agcugaaggcuagaacagcugg

SEQ ID NO: 554011 - RNA, 20 nt, Human
ugucaugcauuagaugaaga

SEQ ID NO: 554012 - RNA, 21 nt, Human
uaaauaauaaguugcugagau

SEQ ID NO: 554013 - RNA, 22 nt, Human
gcuaggagccgcugcacuaggu

SEQ ID NO: 554014 - RNA, 22 nt, Human
caaaagcagcaaguuuauaugu

SEQ ID NO: 554015 - RNA, 22 nt, Human
cagcauggagacaaagugggca

SEQ ID NO: 554016 - RNA, 22 nt, Human
caguuacacaccauugugaaca

SEQ ID NO: 554017 - RNA, 22 nt, Human
aagagacagagccauguuucua

SEQ ID NO: 554018 - RNA, 22 nt, Human
auuuauuaccucggaguuucug

SEQ ID NO: 554019 - RNA, 23 nt, Human
ccagcucccaggucugaggacug

SEQ ID NO: 554020 - RNA, 22 nt, Human
agcagguguuagggauccaaug

SEQ ID NO: 554021 - RNA, 22 nt, Human
acagaagcucaagagagcagug

SEQ ID NO: 554022 - RNA, 20 nt, Human
ggggggcuucagggccugug

SEQ ID NO: 554023 - RNA, 23 nt, Human
gagugcagaauagacaugcagug

SEQ ID NO: 554024 - RNA, 22 nt, Human
acaaaguaggcagugggcugga

SEQ ID NO: 554025 - RNA, 21 nt, Human
uaacaaagacuucuggucagg

SEQ ID NO: 554026 - RNA, 22 nt, Human
gacccuguuucuacaaauaauu

SEQ ID NO: 554027 - RNA, 22 nt, Human
gaaggcuguggcuggucucagu

SEQ ID NO: 554028 - RNA, 22 nt, Human
cagagccucagaauccugugga

SEQ ID NO: 554029 - RNA, 22 nt, Human
uuuaauuguuguggguacauag

SEQ ID NO: 554030 - RNA, 22 nt, Human
cccuguacagucucuguggcac

SEQ ID NO: 554031 - RNA, 22 nt, Human
ccugccugauuccaggauggcu

SEQ ID NO: 554032 - RNA, 19 nt, Human
ggaugagggucaggcauag

SEQ ID NO: 554033 - RNA, 22 nt, Human
gcagcugagcgugaggaagagu

SEQ ID NO: 554034 - RNA, 20 nt, Human
aauuauauaacuccaacauu

SEQ ID NO: 554035 - RNA, 22 nt, Human
cuuuugcagccauuauugcugc

SEQ ID NO: 554036 - RNA, 22 nt, Human
cccuggcauaaaacuucuccag

SEQ ID NO: 554037 - RNA, 19 nt, Human
gcaggguguugacuguccc

SEQ ID NO: 554038 - RNA, 21 nt, Human
gcccagaagacuggcucugcc

SEQ ID NO: 554039 - RNA, 22 nt, Human
ccccugccagcuaucccugaac

SEQ ID NO: 554040 - RNA, 22 nt, Human
caaagcagagccagagcuuguc

SEQ ID NO: 554041 - RNA, 21 nt, Human
ugaggcuguuguaccagggag

SEQ ID NO: 554042 - RNA, 22 nt, Human
ugugcagggaagggcaugcuau

SEQ ID NO: 554043 - RNA, 22 nt, Human
ugcagggagcucuggggugcag

SEQ ID NO: 554044 - RNA, 22 nt, Human
ccagcucuagccccauguggcu

SEQ ID NO: 554045 - RNA, 19 nt, Human
gaucuuugccaauuuaagc

SEQ ID NO: 554046 - RNA, 22 nt, Human
caggagcucucaucgucagggc

SEQ ID NO: 554047 - RNA, 22 nt, Human
uugaaaggaauacagaggccua

SEQ ID NO: 554048 - RNA, 22 nt, Human
auccugugcaaugacugcaucu

SEQ ID NO: 554049 - RNA, 22 nt, Human
agcuucuggaagccuggcagca

SEQ ID NO: 554050 - RNA, 18 nt, Human
uuauuuguuacagcacau

SEQ ID NO: 554051 - RNA, 22 nt, Human
cugucucugucuuaacucccag

SEQ ID NO: 554052 - RNA, 22 nt, Human
cuguggcugcagccuugguccu

SEQ ID NO: 554053 - RNA, 22 nt, Human
ggaaggaauuccaagacuaaag

SEQ ID NO: 554054 - RNA, 22 nt, Human
ggcacugagaacaggcugacuu

SEQ ID NO: 554055 - RNA, 16 nt, Human
agccaggcugccucgg

SEQ ID NO: 554056 - RNA, 22 nt, Human
aggaaggguucuuucuguuuau

SEQ ID NO: 554057 - RNA, 17 nt, Human
ccagagcuacugagacu

SEQ ID NO: 554058 - RNA, 22 nt, Human
cugggaggacaacuuggagcuc

SEQ ID NO: 554059 - RNA, 22 nt, Human
uuucuucagccacuccaaacug

SEQ ID NO: 554060 - RNA, 22 nt, Human
ugguuccucaagcgcuggcggc

SEQ ID NO: 554061 - RNA, 22 nt, Human
ugggaagcacgcucagcagaaa

SEQ ID NO: 554062 - RNA, 22 nt, Human
guggcuugaccaucccugcuac

SEQ ID NO: 554063 - RNA, 22 nt, Human
ucaggaugagcucauaacuaug

SEQ ID NO: 554064 - RNA, 22 nt, Human
uuuaaauuuagaagaaacacug

SEQ ID NO: 554065 - RNA, 22 nt, Human
gucaagucaugacucaaaggaa

SEQ ID NO: 554066 - RNA, 22 nt, Human
uuuccuuaaaucuguuucuagu

SEQ ID NO: 554067 - RNA, 22 nt, Human
gccuggaggggacagucucugg

SEQ ID NO: 554068 - RNA, 22 nt, Human
uagcugugagcacccaggcugu

SEQ ID NO: 554069 - RNA, 22 nt, Human
uuucaaauagaaucuuuccaaa

SEQ ID NO: 554070 - RNA, 22 nt, Human
gugcugugcgcuuuuucuguau

SEQ ID NO: 554071 - RNA, 22 nt, Human
uggguaggaccagaaaugcacu

SEQ ID NO: 554072 - RNA, 22 nt, Human
aaaguguaaggaauuuaaguaa

SEQ ID NO: 554073 - RNA, 21 nt, Human
cacacagugaucuauccacau

SEQ ID NO: 554074 - RNA, 22 nt, Human
ucucuuaauuuuggaauagugu

SEQ ID NO: 554075 - RNA, 22 nt, Human
ccagggcuggugggagaugcug

SEQ ID NO: 554076 - RNA, 22 nt, Human
ggggaagggaguccaaguguua

SEQ ID NO: 554077 - RNA, 22 nt, Human
aggcuaauauggcacaugaaca

SEQ ID NO: 554078 - RNA, 22 nt, Human
uccuggcccggccgggccugcu

SEQ ID NO: 554079 - RNA, 22 nt, Human
ggagacagugacuuagagacug

SEQ ID NO: 554080 - RNA, 22 nt, Human
caaggcaggaagccugucuuau

SEQ ID NO: 554081 - RNA, 17 nt, Human
gcugccugcaacugacu

SEQ ID NO: 554082 - RNA, 22 nt, Human
auuuauuaugggauuuggcuca

SEQ ID NO: 554083 - RNA, 22 nt, Human
ucucucagggggaaggcugaag

SEQ ID NO: 554084 - RNA, 22 nt, Human
aucuguucuucaaaauauuaca

SEQ ID NO: 554085 - RNA, 22 nt, Human
caagaugccccugguagggauc

SEQ ID NO: 554086 - RNA, 22 nt, Human
ugggagagugcucaaugugcaa

SEQ ID NO: 554087 - RNA, 22 nt, Human
gccaagcuuugcaggaguguug

SEQ ID NO: 554088 - RNA, 22 nt, Human
cacugaagaugcgacuagugcu

SEQ ID NO: 554089 - RNA, 22 nt, Human
cugugcuuucgagaugugaucu

SEQ ID NO: 554090 - RNA, 22 nt, Human
uaacaauuugcuucauuuguuu

SEQ ID NO: 554091 - RNA, 22 nt, Human
aggcugaggggcgagggacccu

SEQ ID NO: 554092 - RNA, 20 nt, Human
uuuauucacagagaagaguu

SEQ ID NO: 554093 - RNA, 22 nt, Human
uccugcagucugcacucugccu

SEQ ID NO: 554094 - RNA, 22 nt, Human
acauacuuuuuaaaagauugcu

SEQ ID NO: 554095 - RNA, 18 nt, Human
ugaggaaggggaaguauu

SEQ ID NO: 554096 - RNA, 22 nt, Human
acacuaauuaagcugcuuuacu

SEQ ID NO: 554097 - RNA, 22 nt, Human
uccagcuuauagguagauuuaa

SEQ ID NO: 554098 - RNA, 22 nt, Human
auuuaaugucgagcuauuguag

SEQ ID NO: 554099 - RNA, 22 nt, Human
ucuucaguagguccucagaauc

SEQ ID NO: 554100 - RNA, 22 nt, Human
ccugagcugaacuaagcaguuu

SEQ ID NO: 554101 - RNA, 22 nt, Human
gccuggccugaacuaggaggug

SEQ ID NO: 554102 - RNA, 22 nt, Human
ugcucuggaguggcuugugcac

SEQ ID NO: 554103 - RNA, 22 nt, Human
agucucugcaugccugcugugc

SEQ ID NO: 554104 - RNA, 22 nt, Human
gagcuuaggccagggacaggga

SEQ ID NO: 554105 - RNA, 22 nt, Human
uugcauaaagauuuuauugcau

SEQ ID NO: 554106 - RNA, 22 nt, Human
cuuucuuucgaagacgugauua

SEQ ID NO: 554107 - RNA, 22 nt, Human
ggcuucugcucagccugcacgc

SEQ ID NO: 554108 - RNA, 22 nt, Human
ugguggcaucacucagccuccc

SEQ ID NO: 554109 - RNA, 22 nt, Human
guuagaauaaaaggucagagag

SEQ ID NO: 554110 - RNA, 22 nt, Human
uuuaauauccaguggauacaaa

SEQ ID NO: 554111 - RNA, 22 nt, Human
aaggccugaacaugaggagaug

SEQ ID NO: 554112 - RNA, 22 nt, Human
gaucauuuacuuguucuggacu

SEQ ID NO: 554113 - RNA, 22 nt, Human
gcugggaaugauuuuggagagg

SEQ ID NO: 554114 - RNA, 22 nt, Human
agcucccaggcagucaugagga

SEQ ID NO: 554115 - RNA, 22 nt, Human
cugaggcaugggaaguugggug

SEQ ID NO: 554116 - RNA, 21 nt, Human
uggcacugcuuagcagguucc

SEQ ID NO: 554117 - RNA, 22 nt, Human
ccagggcagcgccccuccacgc

SEQ ID NO: 554118 - RNA, 23 nt, Human
uccuucagagccucccuccaagc

SEQ ID NO: 554119 - RNA, 22 nt, Human
gacagcagacaaaccauguuuu

SEQ ID NO: 554120 - RNA, 22 nt, Human
cgcagagggcaggcagugcugg

SEQ ID NO: 554121 - RNA, 22 nt, Human
agugcagccgagaucaggugcu

SEQ ID NO: 554122 - RNA, 22 nt, Human
acaaagucugaaaccugaggca

SEQ ID NO: 554123 - RNA, 22 nt, Human
auuuagaaauuccaaaaguauu

SEQ ID NO: 554124 - RNA, 22 nt, Human
aaggcagcagugcacgacugau

SEQ ID NO: 554125 - RNA, 22 nt, Human
aaucuaacuucauagcugauuu

SEQ ID NO: 554126 - RNA, 22 nt, Human
accaggcagcaccaaagccggu

SEQ ID NO: 554127 - RNA, 22 nt, Human
gcugaaauucagauuccuaggc

SEQ ID NO: 554128 - RNA, 22 nt, Human
gggagagaugcugauugccaau

SEQ ID NO: 554129 - RNA, 22 nt, Human
uacuugccaucagaguuuauua

SEQ ID NO: 554130 - RNA, 22 nt, Human
cagccaggggcuggcguguuga

SEQ ID NO: 554131 - RNA, 22 nt, Human
ggagccugacagugcccagcau

SEQ ID NO: 554132 - RNA, 22 nt, Human
ggggcccagcaccccuccucgc

SEQ ID NO: 554133 - RNA, 22 nt, Human
cccagagcugagucugauauau

SEQ ID NO: 554134 - RNA, 22 nt, Human
augauucagcccaauuuuucua

SEQ ID NO: 554135 - RNA, 22 nt, Human
gagaaaugcuagcuuaggaauc

SEQ ID NO: 554136 - RNA, 22 nt, Human
agggugcagaaggagccuagga

SEQ ID NO: 554137 - RNA, 22 nt, Human
uaaggcagugagaagaaacagg

SEQ ID NO: 554138 - RNA, 22 nt, Human
ucugggcagagggucuuaguca

SEQ ID NO: 554139 - RNA, 22 nt, Human
augauguaacauaaagaugucu

SEQ ID NO: 554140 - RNA, 22 nt, Human
auuucuagaggcagcuucuagg

SEQ ID NO: 554141 - RNA, 23 nt, Human
agggcugaaugcagagaagcaga

SEQ ID NO: 554142 - RNA, 22 nt, Human
uugucuguccaggcaccccaag

SEQ ID NO: 554143 - RNA, 23 nt, Human
auucuucauuaucuucuagaaaa

SEQ ID NO: 554144 - RNA, 22 nt, Human
ccugggaaucggugcguugagg

SEQ ID NO: 554145 - RNA, 22 nt, Human
cagcugugggccugacguggca

SEQ ID NO: 554146 - RNA, 22 nt, Human
ucaaaugcuguauuguaguaau

SEQ ID NO: 554147 - RNA, 22 nt, Human
ucaaagaagugcaaaccucauc

SEQ ID NO: 554148 - RNA, 22 nt, Human
auaauuuacuaagcucuaccuu

SEQ ID NO: 554149 - RNA, 22 nt, Human
cuuuuuuccuaaggcaacauga

SEQ ID NO: 554150 - RNA, 22 nt, Human
cagagccugcugccuucugaag

SEQ ID NO: 554151 - RNA, 22 nt, Human
gcaauaaauaacauggaagaca

SEQ ID NO: 554152 - RNA, 22 nt, Human
ggagaaagggacugaucugcuc

SEQ ID NO: 554153 - RNA, 22 nt, Human
aaagcagagaucauggcuugua

SEQ ID NO: 554154 - RNA, 22 nt, Human
cccagggcuuuucucacuagac

SEQ ID NO: 554155 - RNA, 22 nt, Human
uuagccauuuuauacaagugua

SEQ ID NO: 554156 - RNA, 22 nt, Human
ccacagaguuacaaaacaguca

SEQ ID NO: 554157 - RNA, 22 nt, Human
uauuuguuucuaguggcagcaa

SEQ ID NO: 554158 - RNA, 22 nt, Human
cacaggcucuucucacuugauu

SEQ ID NO: 554159 - RNA, 22 nt, Human
gcugugaguggaggaggcugag

SEQ ID NO: 554160 - RNA, 22 nt, Human
uguuccaauaaggaguugaaau

SEQ ID NO: 554161 - RNA, 22 nt, Human
uuucaaagguggaagagugaau

SEQ ID NO: 554162 - RNA, 22 nt, Human
ugucacauaauuuaucuguagg

SEQ ID NO: 554163 - RNA, 22 nt, Human
caggaacccccacucucagcuc

SEQ ID NO: 554164 - RNA, 22 nt, Human
uguuacaguggcuuuuuaaaca

SEQ ID NO: 554165 - RNA, 22 nt, Human
ccucccaccguaucucaguggc

SEQ ID NO: 554166 - RNA, 22 nt, Human
ugggccuggacaucuguauuuu

SEQ ID NO: 554167 - RNA, 19 nt, Human
gggcaaagugaucguccug

SEQ ID NO: 554168 - RNA, 22 nt, Human
augaagucuagcaagcauugaa

SEQ ID NO: 554169 - RNA, 22 nt, Human
gggugagagucaggcagagauu

SEQ ID NO: 554170 - RNA, 22 nt, Human
auacagaaguuuuccacuuauu

SEQ ID NO: 554171 - RNA, 22 nt, Human
gaaggccauugcguccugggau

SEQ ID NO: 554172 - RNA, 22 nt, Human
ccacacugucuaacaaggcaua

SEQ ID NO: 554173 - RNA, 22 nt, Human
gcaggggaguggaugauggauu

SEQ ID NO: 554174 - RNA, 22 nt, Human
aagccacuauggugauucucaa

SEQ ID NO: 554175 - RNA, 20 nt, Human
ccugucuggagacaaagaga

SEQ ID NO: 554176 - RNA, 22 nt, Human
aagaugauagaucugucaaugu

SEQ ID NO: 554177 - RNA, 22 nt, Human
caacuuuaugauugguuuguca

SEQ ID NO: 554178 - RNA, 22 nt, Human
cccugcagagccagcccugacc

SEQ ID NO: 554179 - RNA, 22 nt, Human
aaaguauuugugauuuuuacca

SEQ ID NO: 554180 - RNA, 22 nt, Human
aguggucuagucugaggauuau

SEQ ID NO: 554181 - RNA, 22 nt, Human
uucuuguucugguucuguuagc

SEQ ID NO: 554182 - RNA, 22 nt, Human
auuucucaucaagugccaacuc

SEQ ID NO: 554183 - RNA, 22 nt, Human
gcuggaguccagugguaugauc

SEQ ID NO: 554184 - RNA, 23 nt, Human
gggagaauaugaggaugauggug

SEQ ID NO: 554185 - RNA, 22 nt, Human
guccaggcuaagucccuucugc

SEQ ID NO: 554186 - RNA, 22 nt, Human
cagguggagcugacugagggca

SEQ ID NO: 554187 - RNA, 22 nt, Human
uuagaaaggaaucuucauuuca

SEQ ID NO: 554188 - RNA, 23 nt, Human
cagcuuucagggcuuuagggaag

SEQ ID NO: 554189 - RNA, 22 nt, Human
acauaccauacauggugagaug

SEQ ID NO: 554190 - RNA, 22 nt, Human
uauuauuauaguuauugggaag

SEQ ID NO: 554191 - RNA, 17 nt, Human
auguauauuaacucuga

SEQ ID NO: 554192 - RNA, 22 nt, Human
auacaaaaauuagccgggagua

SEQ ID NO: 554193 - RNA, 22 nt, Human
ugcccugggaggcuuuccuguu

SEQ ID NO: 554194 - RNA, 22 nt, Human
uugcauugcuuggucuucaaga

SEQ ID NO: 554195 - RNA, 22 nt, Human
uucuaaacuucaauucuaaauu

SEQ ID NO: 554196 - RNA, 22 nt, Human
aggaccagaggccagagucagc

SEQ ID NO: 554197 - RNA, 22 nt, Human
agugucugccugggaggagcau

SEQ ID NO: 554198 - RNA, 22 nt, Human
agcugccaucagccuuuggaug

SEQ ID NO: 554199 - RNA, 22 nt, Human
caggauuucauacaucuuuacu

SEQ ID NO: 554200 - RNA, 22 nt, Human
uggaugaaaaaugagaauuuuc

SEQ ID NO: 554201 - RNA, 22 nt, Human
cagcuggcauaccugggcccgg

SEQ ID NO: 554202 - RNA, 22 nt, Human
cugagaguaauuuucuacuuga

SEQ ID NO: 554203 - RNA, 22 nt, Human
uuagggacaaauuugcagaacc

SEQ ID NO: 554204 - RNA, 20 nt, Human
ucucugagcuucucuugggg

SEQ ID NO: 554205 - RNA, 22 nt, Human
uguccucacaggaaugaacuuu

SEQ ID NO: 554206 - RNA, 22 nt, Human
cuggugccauucuguggccuag

SEQ ID NO: 554207 - RNA, 22 nt, Human
aagcacauuauagcuaucuagg

SEQ ID NO: 554208 - RNA, 22 nt, Human
uugcagggcaggaccauggaca

SEQ ID NO: 554209 - RNA, 22 nt, Human
cugcugugcuuguggccacccg

SEQ ID NO: 554210 - RNA, 22 nt, Human
acacagggucuagaguuaggcc

SEQ ID NO: 554211 - RNA, 22 nt, Human
uuucacaauuuuaaggagcaaa

SEQ ID NO: 554212 - RNA, 22 nt, Human
uaggaaccagagcacucugggc

SEQ ID NO: 554213 - RNA, 21 nt, Human
cucaggaucuuauauauuagu

SEQ ID NO: 554214 - RNA, 20 nt, Human
ggccauggguugccugaggu

SEQ ID NO: 554215 - RNA, 22 nt, Human
auauuuauaaggcaggcaagua

SEQ ID NO: 554216 - RNA, 19 nt, Human
guaacaguggacauuuuag

SEQ ID NO: 554217 - RNA, 22 nt, Human
aguuucuucauccaaaaaaugg

SEQ ID NO: 554218 - RNA, 22 nt, Human
ugcugugagguugagaaggaag

SEQ ID NO: 554219 - RNA, 22 nt, Human
ccuccuggcccugggccuggaa

SEQ ID NO: 554220 - RNA, 22 nt, Human
aaagcuuuguaaauaaacaggu

SEQ ID NO: 554221 - RNA, 22 nt, Human
ggaaagauguaauauuaucuaa

SEQ ID NO: 554222 - RNA, 22 nt, Human
aagagcuggcucuugcagcagc

SEQ ID NO: 554223 - RNA, 22 nt, Human
ggaaaaggccacagggacacau

SEQ ID NO: 554224 - RNA, 22 nt, Human
uaaauguaccuucugccuuacu

SEQ ID NO: 554225 - RNA, 22 nt, Human
auacauuauuguuaaagaacau

SEQ ID NO: 554226 - RNA, 22 nt, Human
aacaaaugaccugauuucuucc

SEQ ID NO: 554227 - RNA, 22 nt, Human
aaguagauagugcuacggaguu

SEQ ID NO: 554228 - RNA, 22 nt, Human
cagggcucgcugccagcuucag

SEQ ID NO: 554229 - RNA, 22 nt, Human
cuauuauuauguuaacuggacu

SEQ ID NO: 554230 - RNA, 22 nt, Human
aagauaaacucuugauuucuga

SEQ ID NO: 554231 - RNA, 22 nt, Human
cucuuucaguucugauagucuc

SEQ ID NO: 554232 - RNA, 22 nt, Human
ucccugcccugccuucaugguu

SEQ ID NO: 554233 - RNA, 22 nt, Human
cagguggggggcuuccgagccu

SEQ ID NO: 554234 - RNA, 22 nt, Human
acacauauucauauguacuuac

SEQ ID NO: 554235 - RNA, 22 nt, Human
uucaaaguugcaugacagcuua

SEQ ID NO: 554236 - RNA, 22 nt, Human
uucaggauaugugauaucugaa

SEQ ID NO: 554237 - RNA, 22 nt, Human
uuuauuuaaagucguguguuaa

SEQ ID NO: 554238 - RNA, 22 nt, Human
gaaaggagggaaacagagcggu

SEQ ID NO: 554239 - RNA, 22 nt, Human
ucacagacaccuuggccacagu

SEQ ID NO: 554240 - RNA, 22 nt, Human
aucuucagcgagguuuccuuuc

SEQ ID NO: 554241 - RNA, 22 nt, Human
guucauuuaugauguaacaugu

SEQ ID NO: 554242 - RNA, 22 nt, Human
acagaagauaaugcugccuugg

SEQ ID NO: 554243 - RNA, 22 nt, Human
cccuggaguccuggcaguugau

SEQ ID NO: 554244 - RNA, 22 nt, Human
uuucuaagacauuugucaucuu

SEQ ID NO: 554245 - RNA, 17 nt, Human
ccuuucucuuucaucuc

SEQ ID NO: 554246 - RNA, 22 nt, Human
ucaggccugcaaaugaauggua

SEQ ID NO: 554247 - RNA, 22 nt, Human
cuccagucuaguagagccugcu

SEQ ID NO: 554248 - RNA, 22 nt, Human
aaacagaaauuuccucaugcuc

SEQ ID NO: 554249 - RNA, 19 nt, Human
uaaaaugucuguggucagu

SEQ ID NO: 554250 - RNA, 22 nt, Human
uguuguagcuugacagcagcca

SEQ ID NO: 554251 - RNA, 22 nt, Human
cugucuggugucccugucuaca

SEQ ID NO: 554252 - RNA, 22 nt, Human
aggcagcagccacaaggccuga

SEQ ID NO: 554253 - RNA, 22 nt, Human
uuuucauuguuccucgagcauu

SEQ ID NO: 554254 - RNA, 20 nt, Human
aaucagaaagugugagcucu

SEQ ID NO: 554255 - RNA, 22 nt, Human
cugcucuguuucuuagcugggu

SEQ ID NO: 554256 - RNA, 22 nt, Human
agaggggagagcuaagcaauuc

SEQ ID NO: 554257 - RNA, 22 nt, Human
aaagucacaguuuaggggauau

SEQ ID NO: 554258 - RNA, 22 nt, Human
uugugcaagaagccagcaccaa

SEQ ID NO: 554259 - RNA, 22 nt, Human
acucugaaugugcauguaaauc

SEQ ID NO: 554260 - RNA, 22 nt, Human
uugaaaucaccacuagcauuug

SEQ ID NO: 554261 - RNA, 22 nt, Human
ugcuggcucaguuugcagacuc

SEQ ID NO: 554262 - RNA, 18 nt, Human
ggcaugugagugcugagg

SEQ ID NO: 554263 - RNA, 22 nt, Human
uucaaagauggagggauagauu

SEQ ID NO: 554264 - RNA, 22 nt, Human
cagaguccuggacacagagaca

SEQ ID NO: 554265 - RNA, 22 nt, Human
agggcagugggaaagccugcuc

SEQ ID NO: 554266 - RNA, 23 nt, Human
uaaauuucuugauucuuauguga

SEQ ID NO: 554267 - RNA, 22 nt, Human
acuuucaagcccucuagagaca

SEQ ID NO: 554268 - RNA, 22 nt, Human
ucagcuuuggucacauugaguu

SEQ ID NO: 554269 - RNA, 21 nt, Human
ccacuguagacucauucugag

SEQ ID NO: 554270 - RNA, 22 nt, Human
caugggcugugaacccaggcug

SEQ ID NO: 554271 - RNA, 22 nt, Human
ucacaggacccugaggguggcg

SEQ ID NO: 554272 - RNA, 22 nt, Human
aagagcaaguggguagugaagc

SEQ ID NO: 554273 - RNA, 22 nt, Human
caagcaacgacuuucaagcugu

SEQ ID NO: 554274 - RNA, 22 nt, Human
uucaacaucuuggagcuggaac

SEQ ID NO: 554275 - RNA, 22 nt, Human
ugaaagcuguccacuaggcugu

SEQ ID NO: 554276 - RNA, 22 nt, Human
aaugaaugaaccacauauaaca

SEQ ID NO: 554277 - RNA, 22 nt, Human
uaguggagaggauguggagaaa

SEQ ID NO: 554278 - RNA, 22 nt, Human
ggagugaguacuggaguagcug

SEQ ID NO: 554279 - RNA, 22 nt, Human
ucagcuggcaguucagaggcug

SEQ ID NO: 554280 - RNA, 22 nt, Human
guggccucaugucuauaaagag

SEQ ID NO: 554281 - RNA, 22 nt, Human
acaguucugcaagauauuuuuu

SEQ ID NO: 554282 - RNA, 22 nt, Human
caagagcuagacuuugucagga

SEQ ID NO: 554283 - RNA, 22 nt, Human
aaaugugugcacaaagacagcu

SEQ ID NO: 554284 - RNA, 22 nt, Human
ccugagagugcgugccuccuua

SEQ ID NO: 554285 - RNA, 22 nt, Human
gugucaugggguuuguuauaca

SEQ ID NO: 554286 - RNA, 22 nt, Human
gccugcuucacggacaggccuc

SEQ ID NO: 554287 - RNA, 22 nt, Human
ugugggccugggaaggugacac

SEQ ID NO: 554288 - RNA, 22 nt, Human
caugaguucaucugcuucucuu

SEQ ID NO: 554289 - RNA, 22 nt, Human
gccugcuuugccuacaagcaga

SEQ ID NO: 554290 - RNA, 22 nt, Human
aucaacauagccacuccuuaga

SEQ ID NO: 554291 - RNA, 22 nt, Human
aaacagcugggagguagaggcg

SEQ ID NO: 554292 - RNA, 22 nt, Human
ggcuguggacacugagcucaga

SEQ ID NO: 554293 - RNA, 22 nt, Human
cugccccuggcuggugaagcag

SEQ ID NO: 554294 - RNA, 22 nt, Human
ccuggccagggucugggcugcu

SEQ ID NO: 554295 - RNA, 20 nt, Human
uaugaguauuacuuucagga

SEQ ID NO: 554296 - RNA, 22 nt, Human
guuggaagaagacuguaaauua

SEQ ID NO: 554297 - RNA, 22 nt, Human
ggucccaggagaauaggugcaa

SEQ ID NO: 554298 - RNA, 22 nt, Human
cuguggcucauucuugguggca

SEQ ID NO: 554299 - RNA, 22 nt, Human
cccagggacagcuagguggggc

SEQ ID NO: 554300 - RNA, 22 nt, Human
ugaaaucauguaguuauugcaa

SEQ ID NO: 554301 - RNA, 22 nt, Human
cucagucaugacgcucaggacc

SEQ ID NO: 554302 - RNA, 18 nt, Human
aagccagagaccacugcc

SEQ ID NO: 554303 - RNA, 22 nt, Human
cuagaaauauuuuacagucaag

SEQ ID NO: 554304 - RNA, 23 nt, Human
uggcucucucagugcugcagagg

SEQ ID NO: 554305 - RNA, 22 nt, Human
auguacaaaaugccacugaauu

SEQ ID NO: 554306 - RNA, 22 nt, Human
ucaccaggcuccuguuaagaug

SEQ ID NO: 554307 - RNA, 22 nt, Human
uuuccuuccaaaugcccgggag

SEQ ID NO: 554308 - RNA, 22 nt, Human
aggggagaaaaaugccuucugu

SEQ ID NO: 554309 - RNA, 22 nt, Human
cuauaucaucauuaccugcacc

SEQ ID NO: 554310 - RNA, 22 nt, Human
agccccacacucucucugagaa

SEQ ID NO: 554311 - RNA, 22 nt, Human
uugcugaagaaaaaauauguua

SEQ ID NO: 554312 - RNA, 23 nt, Human
ccuggaguacuaaggggauggaa

SEQ ID NO: 554313 - RNA, 21 nt, Human
ugaggcucaucuuauguggcu

SEQ ID NO: 554314 - RNA, 22 nt, Human
gcccaagacuguacaguuaaag

SEQ ID NO: 554315 - RNA, 22 nt, Human
agcuggugaaccugaggcacag

SEQ ID NO: 554316 - RNA, 22 nt, Human
gagcugccugugugccaugaug

SEQ ID NO: 554317 - RNA, 22 nt, Human
uaucacacuguuuuaauuacuu

SEQ ID NO: 554318 - RNA, 22 nt, Human
aaaugaguuugccucuagauag

SEQ ID NO: 554319 - RNA, 22 nt, Human
gaauaacauuuuuuccuuuaca

SEQ ID NO: 554320 - RNA, 22 nt, Human
gggggcuguccugugcauugua

SEQ ID NO: 554321 - RNA, 22 nt, Human
aauguuucauucuugcccauug

SEQ ID NO: 554322 - RNA, 22 nt, Human
gugcagauccugauugcaguuc

SEQ ID NO: 554323 - RNA, 22 nt, Human
aggaguggaauuacuggguucu

SEQ ID NO: 554324 - RNA, 22 nt, Human
uuaacauuugugaagcauuuag

SEQ ID NO: 554325 - RNA, 22 nt, Human
uguacaaagaguauagcuuuga

SEQ ID NO: 554326 - RNA, 22 nt, Human
ugaaaucaucugccaauaaguu

SEQ ID NO: 554327 - RNA, 22 nt, Human
guguuuccucuagaagccaugg

SEQ ID NO: 554328 - RNA, 22 nt, Human
aagggcuccaagagguagcugg

SEQ ID NO: 554329 - RNA, 22 nt, Human
gacucugcuacaggccgagguu

SEQ ID NO: 554330 - RNA, 22 nt, Human
ugggaaagcugcagaaauucuc

SEQ ID NO: 554331 - RNA, 22 nt, Human
uccugcuuccuugucuuuagac

SEQ ID NO: 554332 - RNA, 22 nt, Human
gugcaaauguaauugcaguuuu

SEQ ID NO: 554333 - RNA, 23 nt, Human
ccucagggucuagcagagagaag

SEQ ID NO: 554334 - RNA, 20 nt, Human
agagagcacaggcaggaaag

SEQ ID NO: 554335 - RNA, 22 nt, Human
cgacccuacagacagugcugag

SEQ ID NO: 554336 - RNA, 22 nt, Human
ugauuuccacagucaggggugc

SEQ ID NO: 554337 - RNA, 23 nt, Human
ucuccagugucucuucauugagu

SEQ ID NO: 554338 - RNA, 22 nt, Human
caaacugagcaucagaaaguuu

SEQ ID NO: 554339 - RNA, 22 nt, Human
gccagggcugugcagguuuguu

SEQ ID NO: 554340 - RNA, 19 nt, Human
aggcuuggcuagauuuacu

SEQ ID NO: 554341 - RNA, 22 nt, Human
gggcccuggacguggcggcaga

SEQ ID NO: 554342 - RNA, 22 nt, Human
cucuggagagguucccauggga

SEQ ID NO: 554343 - RNA, 22 nt, Human
gccuggagggauagaaugcaag

SEQ ID NO: 554344 - RNA, 22 nt, Human
ugaccuauuagauuuccuugcc

SEQ ID NO: 554345 - RNA, 22 nt, Human
acauuuuuauucaucaaagcag

SEQ ID NO: 554346 - RNA, 22 nt, Human
ucuucacacacaguccucuuuc

SEQ ID NO: 554347 - RNA, 22 nt, Human
gugggagaagauuuggucaucu

SEQ ID NO: 554348 - RNA, 22 nt, Human
uggcucagagagggagugugga

SEQ ID NO: 554349 - RNA, 22 nt, Human
agucucagaguaccugagggac

SEQ ID NO: 554350 - RNA, 22 nt, Human
cuagaacagaaaguacaggaaa

SEQ ID NO: 554351 - RNA, 22 nt, Human
ucugagggugggagaaggagcu

SEQ ID NO: 554352 - RNA, 22 nt, Human
uugugaauagugcugcaauaaa

SEQ ID NO: 554353 - RNA, 22 nt, Human
aggaacaauugauaaacucaca

SEQ ID NO: 554354 - RNA, 22 nt, Human
agugucauaugccacugcaucc

SEQ ID NO: 554355 - RNA, 22 nt, Human
gaggggcagagguagagaacaa

SEQ ID NO: 554356 - RNA, 22 nt, Human
agaaaaacuaagaguggguggu

SEQ ID NO: 554357 - RNA, 22 nt, Human
caugggcugaaaaucugcaaac

SEQ ID NO: 554358 - RNA, 22 nt, Human
ccaguugguuucaaugggacag

SEQ ID NO: 554359 - RNA, 22 nt, Human
caggguggaauggaaugcuggc

SEQ ID NO: 554360 - RNA, 23 nt, Human
gcugucaguuguuuuugucucua

SEQ ID NO: 554361 - RNA, 22 nt, Human
gauuucuuuguacccacaaucc

SEQ ID NO: 554362 - RNA, 22 nt, Human
uugggcucaggaguuugagacc

SEQ ID NO: 554363 - RNA, 22 nt, Human
uucaguaucugcaaaaugggga

SEQ ID NO: 554364 - RNA, 22 nt, Human
uucuucuuuccaauuacauggu

SEQ ID NO: 554365 - RNA, 22 nt, Human
ccuauugacaauucucuucucc

SEQ ID NO: 554366 - RNA, 22 nt, Human
uugaaacuuuucuuggagaaac

SEQ ID NO: 554367 - RNA, 20 nt, Human
guauuagguguuccucuuuc

SEQ ID NO: 554368 - RNA, 22 nt, Human
ucccugugagaaaugaagcagg

SEQ ID NO: 554369 - RNA, 22 nt, Human
ggcagcaggagccaucugguag

SEQ ID NO: 554370 - RNA, 22 nt, Human
aggcaugugacccuggacucag

SEQ ID NO: 554371 - RNA, 22 nt, Human
cucuccccacacccucugcaug

SEQ ID NO: 554372 - RNA, 23 nt, Human
gagguacagcaccagugaauagg

SEQ ID NO: 554373 - RNA, 22 nt, Human
cuggcagcugugugaagaacug

SEQ ID NO: 554374 - RNA, 22 nt, Human
aaaaaguuucaacugccaacuc

SEQ ID NO: 554375 - RNA, 22 nt, Human
auaaacaucuguuucucuucug

SEQ ID NO: 554376 - RNA, 22 nt, Human
ggccucggcccacugcugcggu

SEQ ID NO: 554377 - RNA, 22 nt, Human
acaguuacaugauucuugugag

SEQ ID NO: 554378 - RNA, 22 nt, Human
gccucuguggcucagccuugcu

SEQ ID NO: 554379 - RNA, 22 nt, Human
ggaggcugcugccucacguggg

SEQ ID NO: 554380 - RNA, 22 nt, Human
ccagcuccccucagcagguaau

SEQ ID NO: 554381 - RNA, 22 nt, Human
acaggacagggaauucgaaauu

SEQ ID NO: 554382 - RNA, 22 nt, Human
uuuacagcaacagugcagaggu

SEQ ID NO: 554383 - RNA, 22 nt, Human
cuaaaucaggccuuacagcuuc

SEQ ID NO: 554384 - RNA, 22 nt, Human
cuccuguauguugggcuucaca

SEQ ID NO: 554385 - RNA, 22 nt, Human
gagcuggguauauggcuuuaug

SEQ ID NO: 554386 - RNA, 22 nt, Human
cagccuggauugcagaaugcua

SEQ ID NO: 554387 - RNA, 21 nt, Human
guauaucagcagugaauucaa

SEQ ID NO: 554388 - RNA, 22 nt, Human
uggaaggagcuaaggaccuggg

SEQ ID NO: 554389 - RNA, 22 nt, Human
aguaaaacagagaaaucacuca

SEQ ID NO: 554390 - RNA, 22 nt, Human
agcugccacaugcccaagggca

SEQ ID NO: 554391 - RNA, 22 nt, Human
uaaaguauccaguuauucuucu

SEQ ID NO: 554392 - RNA, 22 nt, Human
uguauuaacauuaauaaaaugg

SEQ ID NO: 554393 - RNA, 22 nt, Human
agaaauuaugcaguaguuuuau

SEQ ID NO: 554394 - RNA, 22 nt, Human
gaaucauuuauuuuugacagca

SEQ ID NO: 554395 - RNA, 22 nt, Human
ucugugaacaucacauugacag

SEQ ID NO: 554396 - RNA, 22 nt, Human
gcugcuaagcguuucuguucca

SEQ ID NO: 554397 - RNA, 22 nt, Human
uagcagaagaacaacaugaucu

SEQ ID NO: 554398 - RNA, 22 nt, Human
gcaaggacucccugggucauuc

SEQ ID NO: 554399 - RNA, 22 nt, Human
gcugagaggcagccagacccuc

SEQ ID NO: 554400 - RNA, 22 nt, Human
cagaggcacagcuucuuuuaau

SEQ ID NO: 554401 - RNA, 22 nt, Human
cagagccugccaccuuucuccc

SEQ ID NO: 554402 - RNA, 22 nt, Human
aauucuuaaucccauaaaguga

SEQ ID NO: 554403 - RNA, 22 nt, Human
cagcagaggcacgucugugaau

SEQ ID NO: 554404 - RNA, 22 nt, Human
aacaaucaaguuucuaaaugac

SEQ ID NO: 554405 - RNA, 18 nt, Human
agcagguggcgucugcag

SEQ ID NO: 554406 - RNA, 22 nt, Human
uaaugcacauagaaguacuuag

SEQ ID NO: 554407 - RNA, 22 nt, Human
aggcagguuggugagaagacug

SEQ ID NO: 554408 - RNA, 23 nt, Human
uccugagaugagacagugcugcc

SEQ ID NO: 554409 - RNA, 22 nt, Human
cauuucaaguaacagauugcuu

SEQ ID NO: 554410 - RNA, 22 nt, Human
ucuggggaauguucauuucuga

SEQ ID NO: 554411 - RNA, 22 nt, Human
cucugagagagcuggugagcac

SEQ ID NO: 554412 - RNA, 22 nt, Human
ggaugcugcuaucaggcuucga

SEQ ID NO: 554413 - RNA, 22 nt, Human
agaaaugggccuugggacacaa

SEQ ID NO: 554414 - RNA, 18 nt, Human
cuacauucauaggaaagg

SEQ ID NO: 554415 - RNA, 22 nt, Human
gcugccugugcgggucgcuagg

SEQ ID NO: 554416 - RNA, 20 nt, Human
acuccagguggcaugaggac

SEQ ID NO: 554417 - RNA, 22 nt, Human
ggagaggcuuggcccagccugg

SEQ ID NO: 554418 - RNA, 22 nt, Human
aaaacuuagcuaggcaaguuuu

SEQ ID NO: 554419 - RNA, 22 nt, Human
ucugccuguugcuagaauguca

SEQ ID NO: 554420 - RNA, 22 nt, Human
ccagcugguaagugauggagcc

SEQ ID NO: 554421 - RNA, 22 nt, Human
uuaaagcaucacacuauuaauu

SEQ ID NO: 554422 - RNA, 22 nt, Human
ggccuucacgugaccuggcgug

SEQ ID NO: 554423 - RNA, 22 nt, Human
gcacuaaaccaacauguaauaa

SEQ ID NO: 554424 - RNA, 22 nt, Human
gugccugugccaggggugugcu

SEQ ID NO: 554425 - RNA, 22 nt, Human
uuucagauggagguuuaggaca

SEQ ID NO: 554426 - RNA, 22 nt, Human
agcuucuggaaggcaaggcuug

SEQ ID NO: 554427 - RNA, 22 nt, Human
caaggccugacugcuugucuaa

SEQ ID NO: 554428 - RNA, 22 nt, Human
ccuuccaggugcaggcaagccu

SEQ ID NO: 554429 - RNA, 22 nt, Human
cauugaaaaacguugacugagu

SEQ ID NO: 554430 - RNA, 22 nt, Human
caugggcuuuggaggcuggagg

SEQ ID NO: 554431 - RNA, 22 nt, Human
ugccaggcccugugcuggaugc

SEQ ID NO: 554432 - RNA, 18 nt, Human
acauuucuaugcuucugg

SEQ ID NO: 554433 - RNA, 22 nt, Human
ccgaggacauugggcuucuguu

SEQ ID NO: 554434 - RNA, 22 nt, Human
caggaaauucuuuuuaacagaa

SEQ ID NO: 554435 - RNA, 22 nt, Human
uagaggugucacuuugggaagu

SEQ ID NO: 554436 - RNA, 22 nt, Human
caccugcaaggagcuuucauuu

SEQ ID NO: 554437 - RNA, 22 nt, Human
gcuuccaaaucuguucaaaaug

SEQ ID NO: 554438 - RNA, 22 nt, Human
caugggagcuaucuccaucacu

SEQ ID NO: 554439 - RNA, 18 nt, Human
cuccuuucccuacaccuc

SEQ ID NO: 554440 - RNA, 22 nt, Human
cugcccugggaguaccuguccu

SEQ ID NO: 554441 - RNA, 22 nt, Human
auagucuuagucuauaguuuug

SEQ ID NO: 554442 - RNA, 22 nt, Human
agugcauacccuucuaaaaagu

SEQ ID NO: 554443 - RNA, 22 nt, Human
ggccuuccuguuguguccaccg

SEQ ID NO: 554444 - RNA, 22 nt, Human
ugcauaaagugccauaguauua

SEQ ID NO: 554445 - RNA, 22 nt, Human
ggcacagcaagaagggaaauga

SEQ ID NO: 554446 - RNA, 21 nt, Human
ucaggaagagccaguucaugc

SEQ ID NO: 554447 - RNA, 22 nt, Human
gcaaagcagucuucugugccua

SEQ ID NO: 554448 - RNA, 22 nt, Human
acauaaugagcucuuuauaaau

SEQ ID NO: 554449 - RNA, 22 nt, Human
ccagcuccagguagaugggcag

SEQ ID NO: 554450 - RNA, 22 nt, Human
acaugcuuugauguauuuugca

SEQ ID NO: 554451 - RNA, 20 nt, Human
ggaaggcuugaaguuuacau

SEQ ID NO: 554452 - RNA, 22 nt, Human
aggcgcaggguuuggacccagg

SEQ ID NO: 554453 - RNA, 19 nt, Human
ugcauauaucuaugaaaga

SEQ ID NO: 554454 - RNA, 22 nt, Human
ucagaggguggcugggagcauc

SEQ ID NO: 554455 - RNA, 22 nt, Human
ugccagagaagacccagucacu

SEQ ID NO: 554456 - RNA, 22 nt, Human
uggugccaucauagcucacugc

SEQ ID NO: 554457 - RNA, 22 nt, Human
uccauucauucauugaugaaca

SEQ ID NO: 554458 - RNA, 22 nt, Human
ucuggaguugaaguucuucccc

SEQ ID NO: 554459 - RNA, 22 nt, Human
acacauauauuugcauauacac

SEQ ID NO: 554460 - RNA, 22 nt, Human
gcagcuggagccagccagacac

SEQ ID NO: 554461 - RNA, 22 nt, Human
ugcauuguugaauauuucauag

SEQ ID NO: 554462 - RNA, 22 nt, Human
uagaacuuauuuggcauuauuu

SEQ ID NO: 554463 - RNA, 22 nt, Human
aaaguucuggagaaaauaauga

SEQ ID NO: 554464 - RNA, 22 nt, Human
ucugccugagaaguggggugcc

SEQ ID NO: 554465 - RNA, 21 nt, Human
uccuuccuugagguccuuucc

SEQ ID NO: 554466 - RNA, 23 nt, Human
acagagaucuugacuuguaugga

SEQ ID NO: 554467 - RNA, 21 nt, Human
acaguauauuagauauuugaa

SEQ ID NO: 554468 - RNA, 22 nt, Human
caucagaccugccagacuaggu

SEQ ID NO: 554469 - RNA, 22 nt, Human
cacagcagaaauaugaaggcag

SEQ ID NO: 554470 - RNA, 22 nt, Human
cagagccauccaggugccuguu

SEQ ID NO: 554471 - RNA, 22 nt, Human
agagccagcaacucuagcccug

SEQ ID NO: 554472 - RNA, 22 nt, Human
gccaagcuggaugaagagguug

SEQ ID NO: 554473 - RNA, 23 nt, Human
cucccuggaguuucuggaagaug

SEQ ID NO: 554474 - RNA, 22 nt, Human
agaaaguuuguuuuuauccaua

SEQ ID NO: 554475 - RNA, 22 nt, Human
caguguaagcucuagacuagaa

SEQ ID NO: 554476 - RNA, 22 nt, Human
acaggucagauaaaggcuggug

SEQ ID NO: 554477 - RNA, 22 nt, Human
ucagggcauggcugcacuuggc

SEQ ID NO: 554478 - RNA, 22 nt, Human
ccagggggcuuggugaggccau

SEQ ID NO: 554479 - RNA, 22 nt, Human
uuugcauugcauuaaguauucu

SEQ ID NO: 554480 - RNA, 21 nt, Human
uaaagaagaugaaugugauca

SEQ ID NO: 554481 - RNA, 22 nt, Human
cucagaauuuagggcucugagg

SEQ ID NO: 554482 - RNA, 22 nt, Human
auauuauaaguuauuucaaguu

SEQ ID NO: 554483 - RNA, 22 nt, Human
cugggcugagccugggcugugu

SEQ ID NO: 554484 - RNA, 22 nt, Human
cucaucugauaaaucacucuua

SEQ ID NO: 554485 - RNA, 22 nt, Human
ugcuucuggcuuaucucgugcc

SEQ ID NO: 554486 - RNA, 22 nt, Human
ugcagcagcagggaggaggcuc

SEQ ID NO: 554487 - RNA, 22 nt, Human
gaaagguugggugaauggugga

SEQ ID NO: 554488 - RNA, 22 nt, Human
aggcagugagaaauagcaagau

SEQ ID NO: 554489 - RNA, 20 nt, Human
ugcagggcucugcuucucuc

SEQ ID NO: 554490 - RNA, 22 nt, Human
gaggcagaggaagguggucucu

SEQ ID NO: 554491 - RNA, 22 nt, Human
augcuauacucaaagaaauuca

SEQ ID NO: 554492 - RNA, 22 nt, Human
cuuccuugcugucugcuccagg

SEQ ID NO: 554493 - RNA, 22 nt, Human
agggggcaggagagaccugcug

SEQ ID NO: 554494 - RNA, 22 nt, Human
augaggcuaugaauggggagau

SEQ ID NO: 554495 - RNA, 22 nt, Human
ucuuccugaaacccuguuccag

SEQ ID NO: 554496 - RNA, 18 nt, Human
uugauaaacaauuucauu

SEQ ID NO: 554497 - RNA, 22 nt, Human
cuccaguggcaaguccgggcgg

SEQ ID NO: 554498 - RNA, 22 nt, Human
ggagcugggguuggcaucuucc

SEQ ID NO: 554499 - RNA, 22 nt, Human
gucauaaagacagaaacauucc

SEQ ID NO: 554500 - RNA, 22 nt, Human
ccuggcaguggugaagaagagg

SEQ ID NO: 554501 - RNA, 22 nt, Human
gguggcagaauaauugaagguc

SEQ ID NO: 554502 - RNA, 22 nt, Human
aguuauuacucuuuaacauauu

SEQ ID NO: 554503 - RNA, 22 nt, Human
ugccuguguggggucugccgcc

SEQ ID NO: 554504 - RNA, 22 nt, Human
cucagagaaccuaagcggagga

SEQ ID NO: 554505 - RNA, 22 nt, Human
ucaggaauccagacagggcaca

SEQ ID NO: 554506 - RNA, 22 nt, Human
ccuggggaauagagucaagggg

SEQ ID NO: 554507 - RNA, 22 nt, Human
ucuggagcuggcagggcccugg

SEQ ID NO: 554508 - RNA, 22 nt, Human
cuggcagcuuagcacucugguu

SEQ ID NO: 554509 - RNA, 22 nt, Human
aggggagaguuaaugugaaugu

SEQ ID NO: 554510 - RNA, 22 nt, Human
gcccugcccuguugaaacuaga

SEQ ID NO: 554511 - RNA, 22 nt, Human
cuaaauacuagccuucagauuu

SEQ ID NO: 554512 - RNA, 22 nt, Human
uggccugguccuugucaaggca

SEQ ID NO: 554513 - RNA, 21 nt, Human
acauuuucuguuuuaggaagu

SEQ ID NO: 554514 - RNA, 22 nt, Human
cacagaacauuuuuagaugcag

SEQ ID NO: 554515 - RNA, 22 nt, Human
ugaaagaacuagcaucuucaag

SEQ ID NO: 554516 - RNA, 22 nt, Human
gagauuggauuuaauggccaaa

SEQ ID NO: 554517 - RNA, 22 nt, Human
gcucuguacgcaggaugagggg

SEQ ID NO: 554518 - RNA, 22 nt, Human
uggcucagcaagacauugaccu

SEQ ID NO: 554519 - RNA, 22 nt, Human
aaucaguuguucacucugaaaa

SEQ ID NO: 554520 - RNA, 22 nt, Human
uacuguauuugauaagugaagu

SEQ ID NO: 554521 - RNA, 20 nt, Human
cagauggcacgucagggcau

SEQ ID NO: 554522 - RNA, 22 nt, Human
gcagggcagggcaagaacuggg

SEQ ID NO: 554523 - RNA, 22 nt, Human
gccuguccacuaaacagccaag

SEQ ID NO: 554524 - RNA, 22 nt, Human
uagaggcacccuggaggagacu

SEQ ID NO: 554525 - RNA, 23 nt, Human
caguacuuaguguagcguuaauu

SEQ ID NO: 554526 - RNA, 22 nt, Human
auuucacaaagaacagaugcag

SEQ ID NO: 554527 - RNA, 22 nt, Human
cugaaaugggcaaaaguagauu

SEQ ID NO: 554528 - RNA, 22 nt, Human
ggcuuucuagaucuagcucugu

SEQ ID NO: 554529 - RNA, 22 nt, Human
ggcagagcucuggacugagaac

SEQ ID NO: 554530 - RNA, 22 nt, Human
aaugaacaaaauaugcuuugca

SEQ ID NO: 554531 - RNA, 22 nt, Human
cuguggugagcaacugacugaa

SEQ ID NO: 554532 - RNA, 22 nt, Human
auacacauauguguguauaugu

SEQ ID NO: 554533 - RNA, 22 nt, Human
ucugcugcugagcacacuccua

SEQ ID NO: 554534 - RNA, 22 nt, Human
uauaauuuuagaagagauggaa

SEQ ID NO: 554535 - RNA, 21 nt, Human
ccaggguccagcugccauggu

SEQ ID NO: 554536 - RNA, 19 nt, Human
uguguguuuauauauguau

SEQ ID NO: 554537 - RNA, 22 nt, Human
ugaaaauggccugaagaagcaa

SEQ ID NO: 554538 - RNA, 20 nt, Human
aucuggcucagauccugcag

SEQ ID NO: 554539 - RNA, 22 nt, Human
uucucuagguuuuagaugaaga

SEQ ID NO: 554540 - RNA, 22 nt, Human
guauuuuucauuccaagugaga

SEQ ID NO: 554541 - RNA, 22 nt, Human
gugggcaggaggcccugcccug

SEQ ID NO: 554542 - RNA, 22 nt, Human
ucugggcuuuaguuuguuaucu

SEQ ID NO: 554543 - RNA, 22 nt, Human
cuguuuaucccuuuggucagca

SEQ ID NO: 554544 - RNA, 22 nt, Human
ucccaagugucuuggaccaggg

SEQ ID NO: 554545 - RNA, 22 nt, Human
uacugaaaguggucaacagugg

SEQ ID NO: 554546 - RNA, 22 nt, Human
gcagcccagagcgcaggacccc

SEQ ID NO: 554547 - RNA, 20 nt, Human
cacaagagaauacacacugg

SEQ ID NO: 554548 - RNA, 22 nt, Human
cucaggauagcugcgcagccug

SEQ ID NO: 554549 - RNA, 22 nt, Human
agagccaaucuucagagcagag

SEQ ID NO: 554550 - RNA, 22 nt, Human
gcaggcuccaacuggaggaguu

SEQ ID NO: 554551 - RNA, 22 nt, Human
uuuacuuucucaaguauauagg

SEQ ID NO: 554552 - RNA, 22 nt, Human
uuucacauuuuauacuuaagcc

SEQ ID NO: 554553 - RNA, 21 nt, Human
ccagggaagaaaugagggcag

SEQ ID NO: 554554 - RNA, 22 nt, Human
auagaauaaggcacagauucuu

SEQ ID NO: 554555 - RNA, 22 nt, Human
ugaaaucaaugucuucugucuc

SEQ ID NO: 554556 - RNA, 22 nt, Human
agucccagugacuuggccagaa

SEQ ID NO: 554557 - RNA, 22 nt, Human
ucccagcagucagagcuaugug

SEQ ID NO: 554558 - RNA, 22 nt, Human
ucccugggcaucacguugcuuc

SEQ ID NO: 554559 - RNA, 22 nt, Human
auauauaaccuggauaaggcuu

SEQ ID NO: 554560 - RNA, 22 nt, Human
aggcuggaaagggaccagagug

SEQ ID NO: 554561 - RNA, 20 nt, Human
uaacacuugcuuuuugacuu

SEQ ID NO: 554562 - RNA, 22 nt, Human
cccagccugucuuucccaauga

SEQ ID NO: 554563 - RNA, 22 nt, Human
uucuggaucagcaucaugagau

SEQ ID NO: 554564 - RNA, 20 nt, Human
agcugguuaucuuaauucuu

SEQ ID NO: 554565 - RNA, 22 nt, Human
aucuacaacggguggaguaggg

SEQ ID NO: 554566 - RNA, 22 nt, Human
ggcugagcaauuuugaugacau

SEQ ID NO: 554567 - RNA, 22 nt, Human
uguaugaauauguauuuucaua

SEQ ID NO: 554568 - RNA, 22 nt, Human
cacugaguucccugacauuuca

SEQ ID NO: 554569 - RNA, 22 nt, Human
cauucauuagaauagauaugua

SEQ ID NO: 554570 - RNA, 22 nt, Human
uauuucuggcuuugagggugau

SEQ ID NO: 554571 - RNA, 22 nt, Human
gaaaucugaacaacagcuguca

SEQ ID NO: 554572 - RNA, 21 nt, Human
ggcagugaugugaagugcauc

SEQ ID NO: 554573 - RNA, 22 nt, Human
uaagucaggaggucuccugaca

SEQ ID NO: 554574 - RNA, 22 nt, Human
acugccugccucugauucugca

SEQ ID NO: 554575 - RNA, 22 nt, Human
guacacacuauuuaaaguguuu

SEQ ID NO: 554576 - RNA, 22 nt, Human
agcagccauuuaaaaugaauug

SEQ ID NO: 554577 - RNA, 18 nt, Human
gacacauccccaggccuc

SEQ ID NO: 554578 - RNA, 22 nt, Human
guauuuuauggccuggggccua

SEQ ID NO: 554579 - RNA, 21 nt, Human
uuagaagcuaaugcagcuggu

SEQ ID NO: 554580 - RNA, 22 nt, Human
cagcaagacaguuuccuaagug

SEQ ID NO: 554581 - RNA, 22 nt, Human
uaaugcuucaauuuccuugauu

SEQ ID NO: 554582 - RNA, 22 nt, Human
auuacacaggcuggcucuuuga

SEQ ID NO: 554583 - RNA, 22 nt, Human
uaaaagcucuucuguugaguua

SEQ ID NO: 554584 - RNA, 22 nt, Human
ugcaggugcuacaagaacucac

SEQ ID NO: 554585 - RNA, 22 nt, Human
aguacagauuuagacacgauag

SEQ ID NO: 554586 - RNA, 22 nt, Human
uccacacacauuucuaugugca

SEQ ID NO: 554587 - RNA, 22 nt, Human
uaggaagauaaacauuuguaug

SEQ ID NO: 554588 - RNA, 22 nt, Human
cugucucagcaggaagucauca

SEQ ID NO: 554589 - RNA, 21 nt, Human
agaauaaugguaucauuugcu

SEQ ID NO: 554590 - RNA, 22 nt, Human
caaggcaggucugaggagguug

SEQ ID NO: 554591 - RNA, 20 nt, Human
aaacacagccucucuuuaca

SEQ ID NO: 554592 - RNA, 22 nt, Human
caguuuuugccauuaagaguaa

SEQ ID NO: 554593 - RNA, 22 nt, Human
ggcuggucacaccacugcaggg

SEQ ID NO: 554594 - RNA, 22 nt, Human
ccuguucuguggcucucaaagg

SEQ ID NO: 554595 - RNA, 22 nt, Human
aguggcaaagucuucagaaguu

SEQ ID NO: 554596 - RNA, 22 nt, Human
aauuucagauauuaaagaauga

SEQ ID NO: 554597 - RNA, 22 nt, Human
cuuuuuaucucuuaaugauguu

SEQ ID NO: 554598 - RNA, 22 nt, Human
cccugccucugaagcugcucag

SEQ ID NO: 554599 - RNA, 22 nt, Human
gcagcuuucuuuuugcaugucu

SEQ ID NO: 554600 - RNA, 22 nt, Human
ccuuccuggagcccaugcagau

SEQ ID NO: 554601 - RNA, 20 nt, Human
cugggcucgguggcccuggc

SEQ ID NO: 554602 - RNA, 22 nt, Human
uuucacaugugcuguugucaau

SEQ ID NO: 554603 - RNA, 22 nt, Human
agaagccagauuguagugggac

SEQ ID NO: 554604 - RNA, 22 nt, Human
ugguuuuauuuauguugaguca

SEQ ID NO: 554605 - RNA, 22 nt, Human
cauccaauguccuauuaagacu

SEQ ID NO: 554606 - RNA, 22 nt, Human
gaggguggguuucuugcacguc

SEQ ID NO: 554607 - RNA, 23 nt, Human
uuucaacaaugcuuagagaaaac

SEQ ID NO: 554608 - RNA, 22 nt, Human
aucuucaaagggauguccaugg

SEQ ID NO: 554609 - RNA, 22 nt, Human
gucuuuggaaagacaaaguuca

SEQ ID NO: 554610 - RNA, 22 nt, Human
ugcaaauuugagcagacuguuc

SEQ ID NO: 554611 - RNA, 22 nt, Human
aggcucaggaggagcugccgga

SEQ ID NO: 554612 - RNA, 22 nt, Human
cuuucagagguuacucaggaaa

SEQ ID NO: 554613 - RNA, 22 nt, Human
ucuucagagugaaagucuguga

SEQ ID NO: 554614 - RNA, 21 nt, Human
aggcucucauccagggaccca

SEQ ID NO: 554615 - RNA, 22 nt, Human
gcucugccucuuugcugcguca

SEQ ID NO: 554616 - RNA, 22 nt, Human
ugcuaccuuuuuuauuaaauga

SEQ ID NO: 554617 - RNA, 22 nt, Human
cacagaacauccuuagcucaug

SEQ ID NO: 554618 - RNA, 22 nt, Human
ugcaggugccaucgcugcucau

SEQ ID NO: 554619 - RNA, 21 nt, Human
ggagucauuagucauuuccuu

SEQ ID NO: 554620 - RNA, 22 nt, Human
aauauuucguugcguggcuaga

SEQ ID NO: 554621 - RNA, 22 nt, Human
uaggcugacuuguuucauaaag

SEQ ID NO: 554622 - RNA, 22 nt, Human
uggugcaagucucugaggaggg

SEQ ID NO: 554623 - RNA, 22 nt, Human
uaagcagaugcugucugcacaa

SEQ ID NO: 554624 - RNA, 22 nt, Human
ucuuuaaugugauuguaauuau

SEQ ID NO: 554625 - RNA, 22 nt, Human
aguuuucuguucuacaauuuga

SEQ ID NO: 554626 - RNA, 22 nt, Human
augucacagucugacucaguga

SEQ ID NO: 554627 - RNA, 22 nt, Human
aucuacagccagucugguuugu

SEQ ID NO: 554628 - RNA, 22 nt, Human
uacauaaugagcuaguuaaguu

SEQ ID NO: 554629 - RNA, 22 nt, Human
gccaguggucacugaggaagaa

SEQ ID NO: 554630 - RNA, 22 nt, Human
gggcagcugccccucucugggc

SEQ ID NO: 554631 - RNA, 22 nt, Human
accugcagcuaaagauguaggg

SEQ ID NO: 554632 - RNA, 21 nt, Human
caccugugagacucucagacc

SEQ ID NO: 554633 - RNA, 22 nt, Human
cauuuuauccucugggaagcua

SEQ ID NO: 554634 - RNA, 22 nt, Human
auucuaauuaguucuacauguu

SEQ ID NO: 554635 - RNA, 22 nt, Human
uucugaaaugagauauaaggua

SEQ ID NO: 554636 - RNA, 22 nt, Human
uuucagugcacguaguuuauuu

SEQ ID NO: 554637 - RNA, 20 nt, Human
gugaccagaagacagugggu

SEQ ID NO: 554638 - RNA, 22 nt, Human
aagugguagacaaagauaauug

SEQ ID NO: 554639 - RNA, 22 nt, Human
gucagugucuuaacagagauua

SEQ ID NO: 554640 - RNA, 19 nt, Human
guggccagggcaggggcug

SEQ ID NO: 554641 - RNA, 20 nt, Human
aacuuuagacauaaucucuu

SEQ ID NO: 554642 - RNA, 22 nt, Human
gaggagguggaauuccaggaau

SEQ ID NO: 554643 - RNA, 18 nt, Human
ucaguauuaccucaggca

SEQ ID NO: 554644 - RNA, 22 nt, Human
ccugggcagguguggcuucccc

SEQ ID NO: 554645 - RNA, 18 nt, Human
ugacagaaccuggagccu

SEQ ID NO: 554646 - RNA, 22 nt, Human
uacacaaaggcacucuguuguu

SEQ ID NO: 554647 - RNA, 20 nt, Human
ugaaaggugggaauuguggg

SEQ ID NO: 554648 - RNA, 22 nt, Human
uacaugcaugucacagaaugaa

SEQ ID NO: 554649 - RNA, 22 nt, Human
uagggacacugcucaugaguuc

SEQ ID NO: 554650 - RNA, 22 nt, Human
cggggccuagucuaccucggca

SEQ ID NO: 554651 - RNA, 22 nt, Human
uagugaaacaguuaucaaucug

SEQ ID NO: 554652 - RNA, 22 nt, Human
uugggccucggccaaggacggg

SEQ ID NO: 554653 - RNA, 19 nt, Human
ugucccagacuccgugucu

SEQ ID NO: 554654 - RNA, 22 nt, Human
ugggggugaaagucuggacagu

SEQ ID NO: 554655 - RNA, 22 nt, Human
cagagguacaagcuaaguuggg

SEQ ID NO: 554656 - RNA, 21 nt, Human
gagauggcccaguagcgggcc

SEQ ID NO: 554657 - RNA, 22 nt, Human
agggcagagaaauguaguugag

SEQ ID NO: 554658 - RNA, 22 nt, Human
uucuggggccccaguguccucg

SEQ ID NO: 554659 - RNA, 22 nt, Human
uggccuggaaaaaugcagaugg

SEQ ID NO: 554660 - RNA, 22 nt, Human
cgcagaagagguugucuagucc

SEQ ID NO: 554661 - RNA, 22 nt, Human
gcuccugucuuggggcacuggc

SEQ ID NO: 554662 - RNA, 22 nt, Human
agccaauaaauuuacaacuaga

SEQ ID NO: 554663 - RNA, 22 nt, Human
gcauguguggaggagaugugcu

SEQ ID NO: 554664 - RNA, 21 nt, Human
uuugagaauuggucagagugc

SEQ ID NO: 554665 - RNA, 22 nt, Human
uccuaagauagaagauagugaa

SEQ ID NO: 554666 - RNA, 22 nt, Human
cagggcuggcuguggcaaucuc

SEQ ID NO: 554667 - RNA, 22 nt, Human
gcccacacagcagauccuuugg

SEQ ID NO: 554668 - RNA, 22 nt, Human
gcuggcuggaggugaggaagaa

SEQ ID NO: 554669 - RNA, 22 nt, Human
cacugaaggcuaggauuagaug

SEQ ID NO: 554670 - RNA, 18 nt, Human
ugugguggagcugccuuc

SEQ ID NO: 554671 - RNA, 22 nt, Human
ggguagcaugugucagaguuug

SEQ ID NO: 554672 - RNA, 22 nt, Human
cccauuuaaacacaagcuuuca

SEQ ID NO: 554673 - RNA, 22 nt, Human
uucauucauuacgugccaggca

SEQ ID NO: 554674 - RNA, 22 nt, Human
gcagaaggucuggcacuucagg

SEQ ID NO: 554675 - RNA, 22 nt, Human
cccaaggcugcagugagcauga

SEQ ID NO: 554676 - RNA, 23 nt, Human
ucauuucacagugagcuuccuag

SEQ ID NO: 554677 - RNA, 22 nt, Human
cugccugugcaugcagucagaa

SEQ ID NO: 554678 - RNA, 22 nt, Human
gaaauaacagcucuggaagagu

SEQ ID NO: 554679 - RNA, 22 nt, Human
aucaggaucaugcuggguggga

SEQ ID NO: 554680 - RNA, 22 nt, Human
caaaggcaacauauacuuguuu

SEQ ID NO: 554681 - RNA, 22 nt, Human
ugagccaguggaagauggcagu

SEQ ID NO: 554682 - RNA, 22 nt, Human
caucagaagauggcucuggaaa

SEQ ID NO: 554683 - RNA, 22 nt, Human
uugaagacuaauuuagauaaug

SEQ ID NO: 554684 - RNA, 22 nt, Human
acacaggggcucggcugggugc

SEQ ID NO: 554685 - RNA, 22 nt, Human
cccuguccuuggcugugaggcu

SEQ ID NO: 554686 - RNA, 22 nt, Human
aaucauaauucaaauaagcuua

SEQ ID NO: 554687 - RNA, 22 nt, Human
uauuauuaaauggcagaauuuu

SEQ ID NO: 554688 - RNA, 22 nt, Human
guuacauuaggauaauuugcug

SEQ ID NO: 554689 - RNA, 22 nt, Human
gcccugcuucuggcaugcagaa

SEQ ID NO: 554690 - RNA, 22 nt, Human
uuucggccgcgugaaguuuucu

SEQ ID NO: 554691 - RNA, 22 nt, Human
cugggcuggcgcauccgacacg

SEQ ID NO: 554692 - RNA, 22 nt, Human
aaggcagccgugugacugcaug

SEQ ID NO: 554693 - RNA, 22 nt, Human
aagcagcugauuucacagcuca

SEQ ID NO: 554694 - RNA, 22 nt, Human
ugcccugguagacacagacugu

SEQ ID NO: 554695 - RNA, 22 nt, Human
gggaaacugcaacucagagagg

SEQ ID NO: 554696 - RNA, 22 nt, Human
ucaggcaguagaauugcuugaa

SEQ ID NO: 554697 - RNA, 22 nt, Human
acagaguuaauggauaggcagg

SEQ ID NO: 554698 - RNA, 22 nt, Human
cugcagcuuucgcuccaucagc

SEQ ID NO: 554699 - RNA, 19 nt, Human
acucaggcuuccucugagg

SEQ ID NO: 554700 - RNA, 22 nt, Human
gcauuguccugcuucugagugu

SEQ ID NO: 554701 - RNA, 22 nt, Human
acacuuuacagcuuccuuugca

SEQ ID NO: 554702 - RNA, 22 nt, Human
uuuccuuuccaaaauucugccu

SEQ ID NO: 554703 - RNA, 22 nt, Human
cuggcagguccagcuggacuca

SEQ ID NO: 554704 - RNA, 18 nt, Human
cagaaguccuucaaggcc

SEQ ID NO: 554705 - RNA, 22 nt, Human
ccaggugggaggaaagcagaga

SEQ ID NO: 554706 - RNA, 21 nt, Human
agaugcugugcuccaggagca

SEQ ID NO: 554707 - RNA, 22 nt, Human
agugugaccuuauuuggaaaca

SEQ ID NO: 554708 - RNA, 22 nt, Human
auuaagaugugggaaaauuuaa

SEQ ID NO: 554709 - RNA, 23 nt, Human
agcacagacuagaaaggucuuuc

SEQ ID NO: 554710 - RNA, 22 nt, Human
gagccugagugcugccuccccu

SEQ ID NO: 554711 - RNA, 22 nt, Human
ugcaagguccaguauaacuuaa

SEQ ID NO: 554712 - RNA, 22 nt, Human
cuucucucugcauaggcauggg

SEQ ID NO: 554713 - RNA, 22 nt, Human
agaccccauaccucagcaggua

SEQ ID NO: 554714 - RNA, 22 nt, Human
ggucaugcugugaaucagugcu

SEQ ID NO: 554715 - RNA, 22 nt, Human
augaaauuugaccaauuauuua

SEQ ID NO: 554716 - RNA, 22 nt, Human
uccugggagagugggacuguau

SEQ ID NO: 554717 - RNA, 22 nt, Human
gcugguuagaaaacagagcuca

SEQ ID NO: 554718 - RNA, 22 nt, Human
gcugccaguguggcaugaugca

SEQ ID NO: 554719 - RNA, 22 nt, Human
gacagugauuaguuacuauaaa

SEQ ID NO: 554720 - RNA, 22 nt, Human
uacuauuuauggagugguuauu

SEQ ID NO: 554721 - RNA, 22 nt, Human
agccugugacucugugaaacca

SEQ ID NO: 554722 - RNA, 22 nt, Human
caagcugggugcgggcaguaua

SEQ ID NO: 554723 - RNA, 22 nt, Human
cugguggagagugggcucugga

SEQ ID NO: 554724 - RNA, 22 nt, Human
ucacaguaguuguucucuguuu

SEQ ID NO: 554725 - RNA, 22 nt, Human
gugcccaguugaggccaggacu

SEQ ID NO: 554726 - RNA, 22 nt, Human
uuggcauuuauucuaaggucaa

SEQ ID NO: 554727 - RNA, 22 nt, Human
guauuauuggguaguaugguaa

SEQ ID NO: 554728 - RNA, 22 nt, Human
acaguuaaucaaauggcauaug

SEQ ID NO: 554729 - RNA, 22 nt, Human
aaaugugucauauucaaaguca

SEQ ID NO: 554730 - RNA, 22 nt, Human
ucaaguauuauuacagauguag

SEQ ID NO: 554731 - RNA, 22 nt, Human
ggcagaggaagcuggaaguggg

SEQ ID NO: 554732 - RNA, 21 nt, Human
aauacagugaagaauuucuuu

SEQ ID NO: 554733 - RNA, 22 nt, Human
ugaagaacgugagauccagaaa

SEQ ID NO: 554734 - RNA, 22 nt, Human
cuguuuaucauguacauuucca

SEQ ID NO: 554735 - RNA, 22 nt, Human
ggcaggugcucugugggccugg

SEQ ID NO: 554736 - RNA, 22 nt, Human
cccaggugcugcgugaagccuc

SEQ ID NO: 554737 - RNA, 22 nt, Human
acugaaaaagacaucuugguaa

SEQ ID NO: 554738 - RNA, 20 nt, Human
cuggguggcaagcaaggggg

SEQ ID NO: 554739 - RNA, 22 nt, Human
ucauagaaugaguuaaugaacu

SEQ ID NO: 554740 - RNA, 22 nt, Human
ugauuuuuaaaauucuccuugc

SEQ ID NO: 554741 - RNA, 22 nt, Human
cugcuguggaugcaggaccuca

SEQ ID NO: 554742 - RNA, 22 nt, Human
aggcacugauucuguuuuccau

SEQ ID NO: 554743 - RNA, 22 nt, Human
caucaucaaaagugacagagaa

SEQ ID NO: 554744 - RNA, 22 nt, Human
gaggaagaauugguuauuggag

SEQ ID NO: 554745 - RNA, 22 nt, Human
caccagggacaaugcuaggggu

SEQ ID NO: 554746 - RNA, 22 nt, Human
cccuggcugcuaccagguagcu

SEQ ID NO: 554747 - RNA, 22 nt, Human
ucagagaguuagugucuuagcu

SEQ ID NO: 554748 - RNA, 22 nt, Human
agugaaauacugucguuuuuag

SEQ ID NO: 554749 - RNA, 22 nt, Human
gagagggccgggggccagcucc

SEQ ID NO: 554750 - RNA, 22 nt, Human
uugugccaugaacuguaugaag

SEQ ID NO: 554751 - RNA, 21 nt, Human
cccaagggaggcaggauaagg

SEQ ID NO: 554752 - RNA, 22 nt, Human
gucccagggaagaaggcagcac

SEQ ID NO: 554753 - RNA, 23 nt, Human
caggcaggaugaggacuacacuc

SEQ ID NO: 554754 - RNA, 22 nt, Human
agauuugcggcuuuacuuugca

SEQ ID NO: 554755 - RNA, 22 nt, Human
gccacaggcacuuaagggcugg

SEQ ID NO: 554756 - RNA, 22 nt, Human
ucugucacccgagcaggcgaga

SEQ ID NO: 554757 - RNA, 22 nt, Human
guccagggaaauagcgacaggg

SEQ ID NO: 554758 - RNA, 22 nt, Human
ccaggccuuucuucuuggucug

SEQ ID NO: 554759 - RNA, 22 nt, Human
acugccuguuuggcauggcccc

SEQ ID NO: 554760 - RNA, 22 nt, Human
agaauaaaugcuaccuaucaca

SEQ ID NO: 554761 - RNA, 22 nt, Human
acuuccugggcaugcagagucc

SEQ ID NO: 554762 - RNA, 22 nt, Human
gcauuucaugcuccuuggaacc

SEQ ID NO: 554763 - RNA, 20 nt, Human
uuuuagcagaaagaaagcuc

SEQ ID NO: 554764 - RNA, 18 nt, Human
aacuucaacuacaaugga

SEQ ID NO: 554765 - RNA, 22 nt, Human
gcuucaaacugagcuucaagug

SEQ ID NO: 554766 - RNA, 22 nt, Human
uagucucugcuuugcccuuggc

SEQ ID NO: 554767 - RNA, 22 nt, Human
cccagccucuggguucugccgg

SEQ ID NO: 554768 - RNA, 22 nt, Human
uucacaaaaaugcugaacaguu

SEQ ID NO: 554769 - RNA, 22 nt, Human
ucucagagcucacaccuccugg

SEQ ID NO: 554770 - RNA, 22 nt, Human
uggccgggccgggcgccuccac

SEQ ID NO: 554771 - RNA, 21 nt, Human
ggacucuacacaggccaucuu

SEQ ID NO: 554772 - RNA, 19 nt, Human
ugaggggaggagaggccug

SEQ ID NO: 554773 - RNA, 22 nt, Human
uaaagguaguuuuaaaggugcu

SEQ ID NO: 554774 - RNA, 22 nt, Human
ggagaggguagggguccugccc

SEQ ID NO: 554775 - RNA, 22 nt, Human
gugaagcaguugcguggguucc

SEQ ID NO: 554776 - RNA, 22 nt, Human
cacacaggagagugcuggaggu

SEQ ID NO: 554777 - RNA, 22 nt, Human
agcuccugcacccagccuugag

SEQ ID NO: 554778 - RNA, 22 nt, Human
ggcuucauggaggaggugaguc

SEQ ID NO: 554779 - RNA, 22 nt, Human
aaauuccaguucuuuuaccugc

SEQ ID NO: 554780 - RNA, 22 nt, Human
agaauaaacugcuuuagggcag

SEQ ID NO: 554781 - RNA, 22 nt, Human
uauugaggaucuccugcuaauu

SEQ ID NO: 554782 - RNA, 22 nt, Human
cagcccuguccagcagagggug

SEQ ID NO: 554783 - RNA, 22 nt, Human
agaagugagugugacucagcag

SEQ ID NO: 554784 - RNA, 22 nt, Human
ggaggugggcuaaggacucucu

SEQ ID NO: 554785 - RNA, 22 nt, Human
ugagccaggaguuugaggcugu

SEQ ID NO: 554786 - RNA, 22 nt, Human
gaauauuuguaauuacuguuga

SEQ ID NO: 554787 - RNA, 19 nt, Human
cugagcaggcagguaggau

SEQ ID NO: 554788 - RNA, 22 nt, Human
uucuaauagcugccuauguauu

SEQ ID NO: 554789 - RNA, 22 nt, Human
uccaucaccacagaggacagag

SEQ ID NO: 554790 - RNA, 22 nt, Human
agcugccagaugacagugcuau

SEQ ID NO: 554791 - RNA, 22 nt, Human
ccagcugacgaugccuggucuc

SEQ ID NO: 554792 - RNA, 22 nt, Human
uucauguguauggaacauuuuu

SEQ ID NO: 554793 - RNA, 22 nt, Human
ugucagggcaugcgguccagcc

SEQ ID NO: 554794 - RNA, 22 nt, Human
accaguuuguaaccuguuuuca

SEQ ID NO: 554795 - RNA, 22 nt, Human
uucuggcucuccccugcugggu

SEQ ID NO: 554796 - RNA, 22 nt, Human
caugaacuccaagcuuccuucc

SEQ ID NO: 554797 - RNA, 22 nt, Human
cagucucucugaaguauuaaga

SEQ ID NO: 554798 - RNA, 22 nt, Human
cagagccucaucauccacucca

SEQ ID NO: 554799 - RNA, 22 nt, Human
aaguuuaacuugaauucuuucu

SEQ ID NO: 554800 - RNA, 22 nt, Human
ucuggcuccacucugugcaugc

SEQ ID NO: 554801 - RNA, 22 nt, Human
ugcagggcuauaacuccauucu

SEQ ID NO: 554802 - RNA, 22 nt, Human
agccagaggccagccugccuca

SEQ ID NO: 554803 - RNA, 22 nt, Human
ugcuucugggcaaaugugugug

SEQ ID NO: 554804 - RNA, 22 nt, Human
guugaaagaugucuugguuccc

SEQ ID NO: 554805 - RNA, 22 nt, Human
gacagggaggaaagagacugcu

SEQ ID NO: 554806 - RNA, 22 nt, Human
uggcacaggaucucagcggcca

SEQ ID NO: 554807 - RNA, 22 nt, Human
ccuaugccugucacucugcgcu

SEQ ID NO: 554808 - RNA, 22 nt, Human
aauuacuuaagagaaacuuuga

SEQ ID NO: 554809 - RNA, 22 nt, Human
ugagaaaauuacuauaauuguc

SEQ ID NO: 554810 - RNA, 22 nt, Human
gucagcuaauaggguguguguc

SEQ ID NO: 554811 - RNA, 22 nt, Human
guucuuaaagauucaucaagca

SEQ ID NO: 554812 - RNA, 20 nt, Human
cuccagggaacagacuggag

SEQ ID NO: 554813 - RNA, 19 nt, Human
agcuguggaugugggauuu

SEQ ID NO: 554814 - RNA, 21 nt, Human
agcagcagaucuggugagggc

SEQ ID NO: 554815 - RNA, 22 nt, Human
cagaaauggaauuuuccaucac

SEQ ID NO: 554816 - RNA, 22 nt, Human
cauuuguaggaugcuucuuguu

SEQ ID NO: 554817 - RNA, 22 nt, Human
uggagcagagaugggagcccaa

SEQ ID NO: 554818 - RNA, 22 nt, Human
uuuuagauugggaaauguaaag

SEQ ID NO: 554819 - RNA, 22 nt, Human
uggcacugccaaccugcuaggu

SEQ ID NO: 554820 - RNA, 22 nt, Human
acagaaugcguagugcauguug

SEQ ID NO: 554821 - RNA, 22 nt, Human
gacagcauggugucuguucagg

SEQ ID NO: 554822 - RNA, 22 nt, Human
auaaggcagucacuggaauguu

SEQ ID NO: 554823 - RNA, 22 nt, Human
auauuaauuauuuacacaugag

SEQ ID NO: 554824 - RNA, 22 nt, Human
agccuuuuggaguuauucuggg

SEQ ID NO: 554825 - RNA, 22 nt, Human
uuauuagguuauucucuguacu

SEQ ID NO: 554826 - RNA, 22 nt, Human
auggggugaccaugagcauuua

SEQ ID NO: 554827 - RNA, 22 nt, Human
gugaaaugaaucuggaaauauu

SEQ ID NO: 554828 - RNA, 22 nt, Human
ccaggcuuucccagccucucca

SEQ ID NO: 554829 - RNA, 22 nt, Human
ugucuucaucuccaugcacaga

SEQ ID NO: 554830 - RNA, 22 nt, Human
acucugaggagugacuagaggu

SEQ ID NO: 554831 - RNA, 22 nt, Human
aacaguguuuuucuucagcacu

SEQ ID NO: 554832 - RNA, 22 nt, Human
ucuaaacauugugauagaccuu

SEQ ID NO: 554833 - RNA, 22 nt, Human
gcuccagguauuugcccuuuua

SEQ ID NO: 554834 - RNA, 22 nt, Human
uggcauggcaacccugcaggga

SEQ ID NO: 554835 - RNA, 22 nt, Human
uauuuuaucugccagaguggag

SEQ ID NO: 554836 - RNA, 22 nt, Human
ucaagauaccaccauuauaugu

SEQ ID NO: 554837 - RNA, 22 nt, Human
ucuuacaccauucaaauauuuu

SEQ ID NO: 554838 - RNA, 22 nt, Human
uacuuucuaagacauacaacuu

SEQ ID NO: 554839 - RNA, 20 nt, Human
auuaaugaauacauuuugau

SEQ ID NO: 554840 - RNA, 17 nt, Human
aggcuggccuucacagu

SEQ ID NO: 554841 - RNA, 22 nt, Human
aguauuuguugauugauaugaa

SEQ ID NO: 554842 - RNA, 22 nt, Human
gaguccaguguuuaccaggggu

SEQ ID NO: 554843 - RNA, 22 nt, Human
agagcagcacguuguccccaca

SEQ ID NO: 554844 - RNA, 22 nt, Human
aggccugcuguguagccuguug

SEQ ID NO: 554845 - RNA, 22 nt, Human
aagggaaaucauauggugcagu

SEQ ID NO: 554846 - RNA, 22 nt, Human
aggcaagaacagacaugggagu

SEQ ID NO: 554847 - RNA, 22 nt, Human
cagcugaguuacucugaggucu

SEQ ID NO: 554848 - RNA, 22 nt, Human
auagaauuugcacuaaaucugc

SEQ ID NO: 554849 - RNA, 22 nt, Human
cagguggggcgcccucaggcag

SEQ ID NO: 554850 - RNA, 22 nt, Human
acugccugcuccuggcuccaca

SEQ ID NO: 554851 - RNA, 22 nt, Human
gggcucucaugaguguguggua

SEQ ID NO: 554852 - RNA, 22 nt, Human
cucaggauugugccuagggaga

SEQ ID NO: 554853 - RNA, 22 nt, Human
aagggcaggcacccacccucac

SEQ ID NO: 554854 - RNA, 22 nt, Human
uuaaggcuguggggauuacugc

SEQ ID NO: 554855 - RNA, 21 nt, Human
cuuaacauuuuaaaugaaagg

SEQ ID NO: 554856 - RNA, 22 nt, Human
aguuauucauuuauucuguaca

SEQ ID NO: 554857 - RNA, 22 nt, Human
uaguaaaaguuuaguugaaagu

SEQ ID NO: 554858 - RNA, 22 nt, Human
ugagcccaggaguuggagaccg

SEQ ID NO: 554859 - RNA, 22 nt, Human
uagucccauuuugagguauuug

SEQ ID NO: 554860 - RNA, 22 nt, Human
aacaguuaucucacauauggaa

SEQ ID NO: 554861 - RNA, 22 nt, Human
uaaagacaauuucgagcuguag

SEQ ID NO: 554862 - RNA, 22 nt, Human
cugcagggaugugaggcccguu

SEQ ID NO: 554863 - RNA, 22 nt, Human
ugagaguuccuccucuuuccac

SEQ ID NO: 554864 - RNA, 22 nt, Human
auugacuuccauagcuaccugg

SEQ ID NO: 554865 - RNA, 18 nt, Human
cucaccauucugcccaau

SEQ ID NO: 554866 - RNA, 22 nt, Human
agaugagggguagaaaggacuu

SEQ ID NO: 554867 - RNA, 22 nt, Human
ggcugcugcccaccccugcaug

SEQ ID NO: 554868 - RNA, 22 nt, Human
ucuuugaugcuucugaaggugu

SEQ ID NO: 554869 - RNA, 22 nt, Human
aggcucagauucacauuugguu

SEQ ID NO: 554870 - RNA, 22 nt, Human
uuugucaucccuuuugaaacug

SEQ ID NO: 554871 - RNA, 22 nt, Human
cagagcaggcccacugcccucc

SEQ ID NO: 554872 - RNA, 22 nt, Human
agggagaguuugauguuuccuc

SEQ ID NO: 554873 - RNA, 22 nt, Human
ugcccaggguggagugcagcgg

SEQ ID NO: 554874 - RNA, 22 nt, Human
ccagggugggaggcugaaggcg

SEQ ID NO: 554875 - RNA, 22 nt, Human
cuggccagcauuuuugcuuuag

SEQ ID NO: 554876 - RNA, 22 nt, Human
ccucucaucauuaucgcuuugu

SEQ ID NO: 554877 - RNA, 22 nt, Human
ugagcaguaacagcucacaggg

SEQ ID NO: 554878 - RNA, 22 nt, Human
auguacauuuagaucauuucug

SEQ ID NO: 554879 - RNA, 22 nt, Human
acugggccugauugggucggag

SEQ ID NO: 554880 - RNA, 22 nt, Human
agaggcaggagguugacuugag

SEQ ID NO: 554881 - RNA, 22 nt, Human
uauucccauuccacuuaucaag

SEQ ID NO: 554882 - RNA, 22 nt, Human
aaguuucaaauauaaaauuaca

SEQ ID NO: 554883 - RNA, 22 nt, Human
ggcccagcgaggccaccuacag

SEQ ID NO: 554884 - RNA, 22 nt, Human
uuuuaaaggcuguaugaccaag

SEQ ID NO: 554885 - RNA, 22 nt, Human
gcugccugcaguguuuucccag

SEQ ID NO: 554886 - RNA, 22 nt, Human
cugccgaguacagccauagaaa

SEQ ID NO: 554887 - RNA, 22 nt, Human
cuucagagaacuugaucgcugc

SEQ ID NO: 554888 - RNA, 22 nt, Human
gaacuacaggugcagcaaguga

SEQ ID NO: 554889 - RNA, 18 nt, Human
ugcaggcugggguuccuc

SEQ ID NO: 554890 - RNA, 22 nt, Human
acugugugaaacaucaaugugu

SEQ ID NO: 554891 - RNA, 22 nt, Human
ggcacacagcuuggcaggagau

SEQ ID NO: 554892 - RNA, 21 nt, Human
ggaagggguccucccaacagu

SEQ ID NO: 554893 - RNA, 22 nt, Human
caugcacaaagguaagaugcgu

SEQ ID NO: 554894 - RNA, 21 nt, Human
ccaggaaggacugagcucccu

SEQ ID NO: 554895 - RNA, 22 nt, Human
cugggcugcaggaguggggcaa

SEQ ID NO: 554896 - RNA, 22 nt, Human
uacagaaaucacaucgcuuuga

SEQ ID NO: 554897 - RNA, 22 nt, Human
uguuuuuaucucuguguacaac

SEQ ID NO: 554898 - RNA, 17 nt, Human
caggcagacauguaagc

SEQ ID NO: 554899 - RNA, 22 nt, Human
cagugcagaggugcaagcaugu

SEQ ID NO: 554900 - RNA, 23 nt, Human
gaagcagaugucugaguaggcag

SEQ ID NO: 554901 - RNA, 22 nt, Human
gcacccagccagcaucucagag

SEQ ID NO: 554902 - RNA, 23 nt, Human
agcuggaggcugucuacucccaa

SEQ ID NO: 554903 - RNA, 22 nt, Human
agcaggggcuccuccacagcca

SEQ ID NO: 554904 - RNA, 22 nt, Human
ugucagaggcucagggucucag

SEQ ID NO: 554905 - RNA, 20 nt, Human
gugggcagaugugugcaugg

SEQ ID NO: 554906 - RNA, 22 nt, Human
gagggaccuuuacacagacauu

SEQ ID NO: 554907 - RNA, 22 nt, Human
aauaguacaaucuacagacaua

SEQ ID NO: 554908 - RNA, 22 nt, Human
acagaauuuaaagcucuagacu

SEQ ID NO: 554909 - RNA, 22 nt, Human
uguucuugagccuuuagaccua

SEQ ID NO: 554910 - RNA, 22 nt, Human
ugugggcccagauucugaggcu

SEQ ID NO: 554911 - RNA, 22 nt, Human
ugugugcauucacaugcaugcc

SEQ ID NO: 554912 - RNA, 22 nt, Human
ucaggaugguguggaggaaaua

SEQ ID NO: 554913 - RNA, 22 nt, Human
ucuagaacuucucuaaaaugaa

SEQ ID NO: 554914 - RNA, 22 nt, Human
acagggcccuugccagcacaag

SEQ ID NO: 554915 - RNA, 22 nt, Human
gaagaaggugcuacacagggca

SEQ ID NO: 554916 - RNA, 22 nt, Human
auuuuguuauagaacucuguga

SEQ ID NO: 554917 - RNA, 22 nt, Human
gcuacugauugaccuuggagag

SEQ ID NO: 554918 - RNA, 22 nt, Human
ucucugggugauggcagggcac

SEQ ID NO: 554919 - RNA, 22 nt, Human
acaugcaaaugugcaugcaugu

SEQ ID NO: 554920 - RNA, 22 nt, Human
cuuauacacgaacacaaggugu

SEQ ID NO: 554921 - RNA, 22 nt, Human
cuagagugaagggucuugaggc

SEQ ID NO: 554922 - RNA, 22 nt, Human
cagaggcauauaauugcugggg

SEQ ID NO: 554923 - RNA, 22 nt, Human
ucugugacugauggaggcuuuu

SEQ ID NO: 554924 - RNA, 22 nt, Human
cccuuccuugugacuggugggg

SEQ ID NO: 554925 - RNA, 20 nt, Human
caugguggaggagcagggcc

SEQ ID NO: 554926 - RNA, 21 nt, Human
uucucuccauaugcccagccc

SEQ ID NO: 554927 - RNA, 22 nt, Human
gugucaugcacacucaguguug

SEQ ID NO: 554928 - RNA, 22 nt, Human
ucugucaccauucagcuugaau

SEQ ID NO: 554929 - RNA, 22 nt, Human
ggggagaguccuuuccaguucc

SEQ ID NO: 554930 - RNA, 22 nt, Human
ggcaggcucuuggccuuaugag

SEQ ID NO: 554931 - RNA, 22 nt, Human
uauuucuuguuauucucguuga

SEQ ID NO: 554932 - RNA, 22 nt, Human
auauaauuaauuuagcugccuc

SEQ ID NO: 554933 - RNA, 22 nt, Human
aggaccugacuggcuccugcuu

SEQ ID NO: 554934 - RNA, 22 nt, Human
agccagugggauuagagccucu

SEQ ID NO: 554935 - RNA, 22 nt, Human
acagccuggccugaguuaaggc

SEQ ID NO: 554936 - RNA, 22 nt, Human
agucugucucugcuaaucacua

SEQ ID NO: 554937 - RNA, 20 nt, Human
ggagaugcagcccaggugcc

SEQ ID NO: 554938 - RNA, 22 nt, Human
agcugugcacacugugaaguag

SEQ ID NO: 554939 - RNA, 19 nt, Human
agagaggcugugugaggga

SEQ ID NO: 554940 - RNA, 22 nt, Human
ugaggcuugucucagauggggg

SEQ ID NO: 554941 - RNA, 22 nt, Human
gaggggagacagggaaaucagu

SEQ ID NO: 554942 - RNA, 16 nt, Human
acaaauacaacugcug

SEQ ID NO: 554943 - RNA, 22 nt, Human
cuuucauccgcagaugagccuc

SEQ ID NO: 554944 - RNA, 22 nt, Human
ucugcagaaggaaucagcugag

SEQ ID NO: 554945 - RNA, 22 nt, Human
ccaaguacucucaccaaagcuu

SEQ ID NO: 554946 - RNA, 22 nt, Human
cugaggcuggggaagggaagug

SEQ ID NO: 554947 - RNA, 22 nt, Human
uuaaagcaccuccuuggaugug

SEQ ID NO: 554948 - RNA, 22 nt, Human
ugggcugcacccucagccucug

SEQ ID NO: 554949 - RNA, 22 nt, Human
agagcccucuucacugccccuu

SEQ ID NO: 554950 - RNA, 22 nt, Human
aaagaaaccuaucagccacaug

SEQ ID NO: 554951 - RNA, 22 nt, Human
ccagaagggcuauugcagugac

SEQ ID NO: 554952 - RNA, 19 nt, Human
acuuugcaugugugucuaa

SEQ ID NO: 554953 - RNA, 22 nt, Human
agucagcugcugcacacagcag

SEQ ID NO: 554954 - RNA, 22 nt, Human
caaacauagugaagcaaugaca

SEQ ID NO: 554955 - RNA, 22 nt, Human
uacauaugaacuuuauaacuug

SEQ ID NO: 554956 - RNA, 22 nt, Human
ugggcagacauugaguuuguuc

SEQ ID NO: 554957 - RNA, 22 nt, Human
gcagcugcagguggucccaugc

SEQ ID NO: 554958 - RNA, 22 nt, Human
agagagcccgggccagggcaca

SEQ ID NO: 554959 - RNA, 22 nt, Human
auaugcuuacagcuuaaaaucc

SEQ ID NO: 554960 - RNA, 22 nt, Human
caggcagcaggagcccugcucg

SEQ ID NO: 554961 - RNA, 22 nt, Human
agucccagcccaguccuguaag

SEQ ID NO: 554962 - RNA, 22 nt, Human
caggaacagcaccaggagcuag

SEQ ID NO: 554963 - RNA, 22 nt, Human
aagagcuggauugugcugcaga

SEQ ID NO: 554964 - RNA, 22 nt, Human
cguagguggcucagcaccuggg

SEQ ID NO: 554965 - RNA, 22 nt, Human
guucacaguucagccuguaaca

SEQ ID NO: 554966 - RNA, 22 nt, Human
gcagguggugggggagccguuc

SEQ ID NO: 554967 - RNA, 22 nt, Human
agugggcuuacugagggagugu

SEQ ID NO: 554968 - RNA, 22 nt, Human
cagaacugggcagggagcagag

SEQ ID NO: 554969 - RNA, 22 nt, Human
cuggcaggaucuaaccagggaa

SEQ ID NO: 554970 - RNA, 22 nt, Human
ucccagaguauuagcaauugcu

SEQ ID NO: 554971 - RNA, 22 nt, Human
uaaggucauggugaauaauaag

SEQ ID NO: 554972 - RNA, 22 nt, Human
uggagcaggacggggaguggua

SEQ ID NO: 554973 - RNA, 23 nt, Human
cacugggcccaggguguggaggc

SEQ ID NO: 554974 - RNA, 23 nt, Human
uggcagcuguguaagagaaagca

SEQ ID NO: 554975 - RNA, 19 nt, Human
aaagcagaggagcaucuga

SEQ ID NO: 554976 - RNA, 22 nt, Human
uucuucaauuuuccauauacug

SEQ ID NO: 554977 - RNA, 22 nt, Human
ugggcugagaguaccuuauaaa

SEQ ID NO: 554978 - RNA, 22 nt, Human
auugcagcuggucaggguaauu

SEQ ID NO: 554979 - RNA, 22 nt, Human
cuggaaguauaggggagaugau

SEQ ID NO: 554980 - RNA, 22 nt, Human
acggcuucuugacuguggguug

SEQ ID NO: 554981 - RNA, 22 nt, Human
cccuuuaaggucugauuuucag

SEQ ID NO: 554982 - RNA, 22 nt, Human
cucagcaagauuaagcagcuug

SEQ ID NO: 554983 - RNA, 22 nt, Human
cugcuuccauggucuggagacu

SEQ ID NO: 554984 - RNA, 22 nt, Human
gaauuaguguugaaaucagggc

SEQ ID NO: 554985 - RNA, 22 nt, Human
aucuauuaugcugagaaacugu

SEQ ID NO: 554986 - RNA, 23 nt, Human
gagcagagcgggcggggguccug

SEQ ID NO: 554987 - RNA, 22 nt, Human
cuaaaugcccuacaaugacugg

SEQ ID NO: 554988 - RNA, 22 nt, Human
ugugcauguauugauuuguacc

SEQ ID NO: 554989 - RNA, 22 nt, Human
ccucagggaaugggaggcuggg

SEQ ID NO: 554990 - RNA, 22 nt, Human
augggcugacaagacaugcaua

SEQ ID NO: 554991 - RNA, 22 nt, Human
cuuuacaaccuaaguugaagcu

SEQ ID NO: 554992 - RNA, 20 nt, Human
gucuccacuggggguuaacc

SEQ ID NO: 554993 - RNA, 21 nt, Human
auacuacauuucucugacuuu

SEQ ID NO: 554994 - RNA, 22 nt, Human
agcagcauagaagcugggagga

SEQ ID NO: 554995 - RNA, 22 nt, Human
uucaacaugcaaacauguuugu

SEQ ID NO: 554996 - RNA, 22 nt, Human
ucucugucugagccuggcagac

SEQ ID NO: 554997 - RNA, 22 nt, Human
uugcuugcuucuauuuuauaca

SEQ ID NO: 554998 - RNA, 22 nt, Human
aggagcugcuuaaaugguuggu

SEQ ID NO: 554999 - RNA, 22 nt, Human
ucuaaggccuucaugucaguau

SEQ ID NO: 555000 - RNA, 22 nt, Human
uucucuucaucucaguaaaugu

SEQ ID NO: 555001 - RNA, 22 nt, Human
uauguacauguuaaagggcaaa

SEQ ID NO: 555002 - RNA, 22 nt, Human
gaucaacauguauuuaagaguu

SEQ ID NO: 555003 - RNA, 22 nt, Human
aucuuaccucuuccucugcauu

SEQ ID NO: 555004 - RNA, 22 nt, Human
cccagcuccagagccagaaaca

SEQ ID NO: 555005 - RNA, 22 nt, Human
auguuucaggcgaacuaacaug

SEQ ID NO: 555006 - RNA, 22 nt, Human
accuggagucauuugaggagua

SEQ ID NO: 555007 - RNA, 22 nt, Human
gcaggggaguccacucuaugca

SEQ ID NO: 555008 - RNA, 22 nt, Human
uggcagcugauuagauggugcc

SEQ ID NO: 555009 - RNA, 22 nt, Human
uccagaaaugcaagccaggugu

SEQ ID NO: 555010 - RNA, 22 nt, Human
uuuccucuucuucccaugucau

SEQ ID NO: 555011 - RNA, 18 nt, Human
gucuuuucucccuuccuc

SEQ ID NO: 555012 - RNA, 18 nt, Human
ccuggcuuuucuacuugc

SEQ ID NO: 555013 - RNA, 22 nt, Human
cuggagagaaaugacaaagcua

SEQ ID NO: 555014 - RNA, 22 nt, Human
cagaggguugucaggcgccuug

SEQ ID NO: 555015 - RNA, 22 nt, Human
ucugccuguagucccacaccuc

SEQ ID NO: 555016 - RNA, 19 nt, Human
cucucacucgccacauccu

SEQ ID NO: 555017 - RNA, 22 nt, Human
aucaguuugagugcugugucaa

SEQ ID NO: 555018 - RNA, 22 nt, Human
uacagaauuagauuauuagaga

SEQ ID NO: 555019 - RNA, 23 nt, Human
agggaaaguaguaauggccuuug

SEQ ID NO: 555020 - RNA, 22 nt, Human
cagucacauggaugauggauag

SEQ ID NO: 555021 - RNA, 22 nt, Human
gagcagcuuaugucaagccaga

SEQ ID NO: 555022 - RNA, 22 nt, Human
cuguggagugcuuggcucagug

SEQ ID NO: 555023 - RNA, 22 nt, Human
ggcagagcugcaugagcacuca

SEQ ID NO: 555024 - RNA, 22 nt, Human
uggcuuccaaaggaaugggccu

SEQ ID NO: 555025 - RNA, 22 nt, Human
caacacagggguuaugccaugg

SEQ ID NO: 555026 - RNA, 22 nt, Human
uuuuuguucccagagaauuugu

SEQ ID NO: 555027 - RNA, 22 nt, Human
caaggaaacaugaaaugcauug

SEQ ID NO: 555028 - RNA, 20 nt, Human
accaggaaucuuuucugagc

SEQ ID NO: 555029 - RNA, 21 nt, Human
gccagccuguuuaccuguggu

SEQ ID NO: 555030 - RNA, 22 nt, Human
ccugcugucaguggggcaggca

SEQ ID NO: 555031 - RNA, 22 nt, Human
aagcugccugggaggaagggcu

SEQ ID NO: 555032 - RNA, 22 nt, Human
ccagcagagucuaggaaggagg

SEQ ID NO: 555033 - RNA, 22 nt, Human
aauauguucaaaauagaucacu

SEQ ID NO: 555034 - RNA, 22 nt, Human
gagggugggcuuuguuccucca

SEQ ID NO: 555035 - RNA, 22 nt, Human
ucaauucugccucuaaauauuu

SEQ ID NO: 555036 - RNA, 22 nt, Human
ccugggcuuuggaacaguacuu

SEQ ID NO: 555037 - RNA, 22 nt, Human
guggucaggggcugaggugccc

SEQ ID NO: 555038 - RNA, 22 nt, Human
ggagcagagcugggcuuggcug

SEQ ID NO: 555039 - RNA, 22 nt, Human
guuuacauaugucugucugcac

SEQ ID NO: 555040 - RNA, 22 nt, Human
uucagcuaaaggaaacucagau

SEQ ID NO: 555041 - RNA, 22 nt, Human
gucccuggagcugagcagugcu

SEQ ID NO: 555042 - RNA, 22 nt, Human
ccucagggucugaggagaccgu

SEQ ID NO: 555043 - RNA, 22 nt, Human
uuuugagauggugucucgcucc

SEQ ID NO: 555044 - RNA, 22 nt, Human
ucuucagcucugaggcucuggc

SEQ ID NO: 555045 - RNA, 22 nt, Human
auccagaacaccuguaucacca

SEQ ID NO: 555046 - RNA, 22 nt, Human
cuggagccaugucuugacugcu

SEQ ID NO: 555047 - RNA, 23 nt, Human
ccaggccucucagagggugugcc

SEQ ID NO: 555048 - RNA, 22 nt, Human
auuauuaugguugcucuuuucc

SEQ ID NO: 555049 - RNA, 22 nt, Human
auuuugcugcuaugccuugcaa

SEQ ID NO: 555050 - RNA, 22 nt, Human
gagaggaagccaggggguguug

SEQ ID NO: 555051 - RNA, 22 nt, Human
ugaguaggugguuaagcaugga

SEQ ID NO: 555052 - RNA, 23 nt, Human
augugcaaagugcuacaguauag

SEQ ID NO: 555053 - RNA, 22 nt, Human
cagggugccuguccucagcaaa

SEQ ID NO: 555054 - RNA, 22 nt, Human
gcauguuuugcaacaagugacc

SEQ ID NO: 555055 - RNA, 22 nt, Human
ccaguguucccucggguucaug

SEQ ID NO: 555056 - RNA, 22 nt, Human
gcugccuuuuaaagccucgcuu

SEQ ID NO: 555057 - RNA, 22 nt, Human
auucuucauggcugugaguccu

SEQ ID NO: 555058 - RNA, 22 nt, Human
acacagauauuguacuugaucc

SEQ ID NO: 555059 - RNA, 22 nt, Human
uaaggcuucagcauucaaaaca

SEQ ID NO: 555060 - RNA, 16 nt, Human
gcagggguggguggag

SEQ ID NO: 555061 - RNA, 22 nt, Human
uuacaguaauguauuauuuaac

SEQ ID NO: 555062 - RNA, 22 nt, Human
ucaaaugcugccuuugugugcc

SEQ ID NO: 555063 - RNA, 20 nt, Human
gggcuggcgcauggggaaag

SEQ ID NO: 555064 - RNA, 22 nt, Human
ucagaggucccuagcaggagug

SEQ ID NO: 555065 - RNA, 22 nt, Human
caaaacauucagagagcucacu

SEQ ID NO: 555066 - RNA, 22 nt, Human
uccuccuucgggacugcuugac

SEQ ID NO: 555067 - RNA, 22 nt, Human
agaagaaaugaggccguucugc

SEQ ID NO: 555068 - RNA, 22 nt, Human
gcacacaugcaugcacaggagu

SEQ ID NO: 555069 - RNA, 22 nt, Human
gucuccugagacugcagucacc

SEQ ID NO: 555070 - RNA, 22 nt, Human
gaggccugaggcugccuggagc

SEQ ID NO: 555071 - RNA, 22 nt, Human
aaguauuucuggccugugaaag

SEQ ID NO: 555072 - RNA, 22 nt, Human
aauaacuucauguaacauuuaa

SEQ ID NO: 555073 - RNA, 22 nt, Human
cagauggcugccuucuugcugu

SEQ ID NO: 555074 - RNA, 22 nt, Human
ccacacagucaguuuccaagaa

SEQ ID NO: 555075 - RNA, 22 nt, Human
caggcagggagcuggaaaggau

SEQ ID NO: 555076 - RNA, 22 nt, Human
uacagagagagggguuaccagg

SEQ ID NO: 555077 - RNA, 22 nt, Human
aagucauuaucucuucuaaucu

SEQ ID NO: 555078 - RNA, 22 nt, Human
ucuugauuuauucuacccagaa

SEQ ID NO: 555079 - RNA, 22 nt, Human
gacaggcuuugagucccagaac

SEQ ID NO: 555080 - RNA, 22 nt, Human
auacaucuuccuuuuaaaaugc

SEQ ID NO: 555081 - RNA, 22 nt, Human
ucaggggcugugcauuucccag

SEQ ID NO: 555082 - RNA, 22 nt, Human
ugcaaagaagccuuugccuucu

SEQ ID NO: 555083 - RNA, 22 nt, Human
caaagagcuguucagugucgcu

SEQ ID NO: 555084 - RNA, 22 nt, Human
aucacugucgucaucugagauu

SEQ ID NO: 555085 - RNA, 22 nt, Human
gcugggcuguaguuugcugacc

SEQ ID NO: 555086 - RNA, 22 nt, Human
uucuccagacccuccugcagac

SEQ ID NO: 555087 - RNA, 22 nt, Human
auauugaacccuacagacugua

SEQ ID NO: 555088 - RNA, 22 nt, Human
uuacaguugcuacaaaggauaa

SEQ ID NO: 555089 - RNA, 22 nt, Human
guuuuauaggcuguugcuauau

SEQ ID NO: 555090 - RNA, 22 nt, Human
aaaguuucaauagaggaagugg

SEQ ID NO: 555091 - RNA, 22 nt, Human
ugggcacaggggaauggaugaa

SEQ ID NO: 555092 - RNA, 22 nt, Human
gcugugcaucuucauucuggac

SEQ ID NO: 555093 - RNA, 22 nt, Human
ucuugauuguuuucugaccuua

SEQ ID NO: 555094 - RNA, 22 nt, Human
gagggcucuacucaccacccug

SEQ ID NO: 555095 - RNA, 22 nt, Human
ugcuccugaacacagcccuaug

SEQ ID NO: 555096 - RNA, 22 nt, Human
aucauaaagugcuaucugauug

SEQ ID NO: 555097 - RNA, 22 nt, Human
aggcaagcauugggaacagggc

SEQ ID NO: 555098 - RNA, 22 nt, Human
uuuaagaugguauuuuauaaag

SEQ ID NO: 555099 - RNA, 22 nt, Human
cucagacuagccuguaccgaca

SEQ ID NO: 555100 - RNA, 22 nt, Human
caggaacacaaugagucucaaa

SEQ ID NO: 555101 - RNA, 22 nt, Human
uggaggagaauuuauggucgaa

SEQ ID NO: 555102 - RNA, 22 nt, Human
gccucccuguucuuccacaaua

SEQ ID NO: 555103 - RNA, 22 nt, Human
aaguggagucccuacaaccagc

SEQ ID NO: 555104 - RNA, 21 nt, Human
caguuacagccaggacaaggc

SEQ ID NO: 555105 - RNA, 22 nt, Human
uuucauaauagugcaguuuguu

SEQ ID NO: 555106 - RNA, 22 nt, Human
uccugaaaauaauuucacaaga

SEQ ID NO: 555107 - RNA, 22 nt, Human
guuuuuccuugcugaggacccg

SEQ ID NO: 555108 - RNA, 22 nt, Human
auccuugaacuuagacacuagg

SEQ ID NO: 555109 - RNA, 22 nt, Human
aaaccagugauagacuagacac

SEQ ID NO: 555110 - RNA, 22 nt, Human
auaaauggcuuucauuccuagg

SEQ ID NO: 555111 - RNA, 22 nt, Human
uaugaacuuuaagcucuguguc

SEQ ID NO: 555112 - RNA, 22 nt, Human
guggcucucgccagccugcggg

SEQ ID NO: 555113 - RNA, 22 nt, Human
ugugggcaggcccgggucugag

SEQ ID NO: 555114 - RNA, 22 nt, Human
uuucacagauguuuuggagucu

SEQ ID NO: 555115 - RNA, 22 nt, Human
cuguggcuguauuuggccagag

SEQ ID NO: 555116 - RNA, 22 nt, Human
aggaccugaaauucuugcuuuu

SEQ ID NO: 555117 - RNA, 22 nt, Human
cuccagaaauuuggaugcagca

SEQ ID NO: 555118 - RNA, 22 nt, Human
caguaggaaggaugcagaaaaa

SEQ ID NO: 555119 - RNA, 22 nt, Human
cuucugaagagguuaucauaga

SEQ ID NO: 555120 - RNA, 22 nt, Human
cagggccagcgcccaggcccag

SEQ ID NO: 555121 - RNA, 22 nt, Human
ggcaugugccugaggucacaca

SEQ ID NO: 555122 - RNA, 22 nt, Human
cagagcauuaaaaccagcucug

SEQ ID NO: 555123 - RNA, 22 nt, Human
auaaggcagaaauagggaaagu

SEQ ID NO: 555124 - RNA, 22 nt, Human
aaaaauagcuucucuugucccu

SEQ ID NO: 555125 - RNA, 22 nt, Human
aauaauguugacgauagucuua

SEQ ID NO: 555126 - RNA, 19 nt, Human
ucucagagcccuagaggcc

SEQ ID NO: 555127 - RNA, 22 nt, Human
uggacaguauugugaagcaggc

SEQ ID NO: 555128 - RNA, 22 nt, Human
caggcacuggggaugcugggau

SEQ ID NO: 555129 - RNA, 22 nt, Human
gccugcuguuaacugcaggaau

SEQ ID NO: 555130 - RNA, 22 nt, Human
ugaacacacaccuauguacaaa

SEQ ID NO: 555131 - RNA, 22 nt, Human
ggcaggagaaaggucucuucuu

SEQ ID NO: 555132 - RNA, 22 nt, Human
aaacacugauggauauuuuucc

SEQ ID NO: 555133 - RNA, 22 nt, Human
gauuuuauuagcccaaacuuug

SEQ ID NO: 555134 - RNA, 22 nt, Human
gagaggucaucucccaucagca

SEQ ID NO: 555135 - RNA, 21 nt, Human
aaggggcaaacccaggacacc

SEQ ID NO: 555136 - RNA, 22 nt, Human
uggcgucucucauaaguaugug

SEQ ID NO: 555137 - RNA, 22 nt, Human
ggcccagccggcgagucucgcg

SEQ ID NO: 555138 - RNA, 22 nt, Human
ucucuggccgagagucccuggg

SEQ ID NO: 555139 - RNA, 22 nt, Human
aggaaaaaagucugugauuaua

SEQ ID NO: 555140 - RNA, 22 nt, Human
agggaggagaauggacuccuuc

SEQ ID NO: 555141 - RNA, 22 nt, Human
gcacagaggaagcacagacucu

SEQ ID NO: 555142 - RNA, 22 nt, Human
cccaggcaucccauuaaggagc

SEQ ID NO: 555143 - RNA, 22 nt, Human
gagcagcucugggugacccagu

SEQ ID NO: 555144 - RNA, 22 nt, Human
ucuagaaaaacaaaguaucuga

SEQ ID NO: 555145 - RNA, 22 nt, Human
cagaggcucaccagccuuucac

SEQ ID NO: 555146 - RNA, 22 nt, Human
agaaaguuaaacagugauaaga

SEQ ID NO: 555147 - RNA, 22 nt, Human
uuucaaaauuuugcagugguaa

SEQ ID NO: 555148 - RNA, 22 nt, Human
cugguucacaucuguuuaucug

SEQ ID NO: 555149 - RNA, 21 nt, Human
ucucuguguucaaggugccag

SEQ ID NO: 555150 - RNA, 19 nt, Human
ucuaaacacagggacaagc

SEQ ID NO: 555151 - RNA, 22 nt, Human
uagggcaggggaggaaucugaa

SEQ ID NO: 555152 - RNA, 22 nt, Human
uagggcuccacucccagagauu

SEQ ID NO: 555153 - RNA, 22 nt, Human
ggcacugagaggcucuuccuaa

SEQ ID NO: 555154 - RNA, 22 nt, Human
ucuuuguuuguacuguuagaau

SEQ ID NO: 555155 - RNA, 22 nt, Human
ggcuccugauaggagaaugcgg

SEQ ID NO: 555156 - RNA, 23 nt, Human
uggacgccgacuuuggaggcgcu

SEQ ID NO: 555157 - RNA, 22 nt, Human
cucugggcuuguugaccugcac

SEQ ID NO: 555158 - RNA, 22 nt, Human
ugcuuaaacccugaucaugugu

SEQ ID NO: 555159 - RNA, 22 nt, Human
ggccuugggcuggcugcaguau

SEQ ID NO: 555160 - RNA, 23 nt, Human
agggcugaugccauugcagcucu

SEQ ID NO: 555161 - RNA, 22 nt, Human
ucaguguagcagacuuguagcc

SEQ ID NO: 555162 - RNA, 22 nt, Human
aaugauugcaaacauugagaac

SEQ ID NO: 555163 - RNA, 19 nt, Human
cucugcuugguccauaugc

SEQ ID NO: 555164 - RNA, 22 nt, Human
gcagauggugggggaggaguac

SEQ ID NO: 555165 - RNA, 22 nt, Human
ccauccugcauugcuauucaga

SEQ ID NO: 555166 - RNA, 22 nt, Human
gucuaaacuuuacagagucaag

SEQ ID NO: 555167 - RNA, 22 nt, Human
acauugaugaaaagguaucauu

SEQ ID NO: 555168 - RNA, 18 nt, Human
gucuggaggucaggagcu

SEQ ID NO: 555169 - RNA, 22 nt, Human
ccucugccugcacaucauccug

SEQ ID NO: 555170 - RNA, 22 nt, Human
agcccuagagcuggaggucagu

SEQ ID NO: 555171 - RNA, 22 nt, Human
uucaaagugcuguucaaaguag

SEQ ID NO: 555172 - RNA, 22 nt, Human
cuggccuggggggacacauccc

SEQ ID NO: 555173 - RNA, 22 nt, Human
auuuucaucgcuagguuggccu

SEQ ID NO: 555174 - RNA, 22 nt, Human
ggcucccaggagggccuggagg

SEQ ID NO: 555175 - RNA, 22 nt, Human
gaugcagaaaguagacaccauc

SEQ ID NO: 555176 - RNA, 22 nt, Human
gcuaucuuucugcaccauaauu

SEQ ID NO: 555177 - RNA, 22 nt, Human
ucauuuacacuucacaaaugga

SEQ ID NO: 555178 - RNA, 22 nt, Human
agccaugcaccuuacucuugcu

SEQ ID NO: 555179 - RNA, 22 nt, Human
cccagagucaagcuuaccauua

SEQ ID NO: 555180 - RNA, 22 nt, Human
caggaggcaucauggagcggac

SEQ ID NO: 555181 - RNA, 22 nt, Human
auacauuagaaucugguacuca

SEQ ID NO: 555182 - RNA, 22 nt, Human
ccagggccaagagaccucgagg

SEQ ID NO: 555183 - RNA, 22 nt, Human
ugaaaaacugaauaguugagua

SEQ ID NO: 555184 - RNA, 22 nt, Human
cuuggaggagguggugcuugau

SEQ ID NO: 555185 - RNA, 22 nt, Human
agcuuuauggugccucacuuga

SEQ ID NO: 555186 - RNA, 22 nt, Human
cauuuguaguaucuguuuauau

SEQ ID NO: 555187 - RNA, 22 nt, Human
uuucuuuaucauagcaucuuug

SEQ ID NO: 555188 - RNA, 22 nt, Human
uauaucuuauaugugcagguac

SEQ ID NO: 555189 - RNA, 22 nt, Human
acacaguaguguggaaaaacau

SEQ ID NO: 555190 - RNA, 22 nt, Human
gcaaagcacacuggagaugucg

SEQ ID NO: 555191 - RNA, 22 nt, Human
acacuugauaggucaaaucagu

SEQ ID NO: 555192 - RNA, 22 nt, Human
ccacugaaggucaacauagagc

SEQ ID NO: 555193 - RNA, 22 nt, Human
auugcuuuagaaagaaaaauau

SEQ ID NO: 555194 - RNA, 22 nt, Human
cacaguggauugggugaugccc

SEQ ID NO: 555195 - RNA, 22 nt, Human
uuucauaugggcauuggcaaua

SEQ ID NO: 555196 - RNA, 19 nt, Human
cgcagguggaaggagccgc

SEQ ID NO: 555197 - RNA, 22 nt, Human
ucaguguaaguuauguagaugu

SEQ ID NO: 555198 - RNA, 22 nt, Human
cuggagccggaccagggacggu

SEQ ID NO: 555199 - RNA, 22 nt, Human
uagcagcuuaaguaauuagaau

SEQ ID NO: 555200 - RNA, 22 nt, Human
ugaggccagugacauauauuaa

SEQ ID NO: 555201 - RNA, 22 nt, Human
accagagcucuucagcacagga

SEQ ID NO: 555202 - RNA, 22 nt, Human
auauucuugaaagauccuggua

SEQ ID NO: 555203 - RNA, 22 nt, Human
agcccugcgcucacguucugca

SEQ ID NO: 555204 - RNA, 22 nt, Human
uauguaagugagaucauggagu

SEQ ID NO: 555205 - RNA, 22 nt, Human
ugaagacacauacaagggaaug

SEQ ID NO: 555206 - RNA, 22 nt, Human
cugugggcgccugucagccuca

SEQ ID NO: 555207 - RNA, 22 nt, Human
augaaugcugggacaaauauau

SEQ ID NO: 555208 - RNA, 22 nt, Human
cauugcacuuuggguccaggac

SEQ ID NO: 555209 - RNA, 22 nt, Human
gaguuaauaggguucuuuguga

SEQ ID NO: 555210 - RNA, 22 nt, Human
gucauuuuaugggaacagauuu

SEQ ID NO: 555211 - RNA, 22 nt, Human
gcugccugucugcugacccagg

SEQ ID NO: 555212 - RNA, 23 nt, Human
auuuccuaaaagauaaucauuac

SEQ ID NO: 555213 - RNA, 22 nt, Human
agagccuggagguucugcugaa

SEQ ID NO: 555214 - RNA, 22 nt, Human
acaggcauauuucuagauuaca

SEQ ID NO: 555215 - RNA, 22 nt, Human
uuucacaggaguuguaccauuu

SEQ ID NO: 555216 - RNA, 22 nt, Human
gaugagugaggacaggguggca

SEQ ID NO: 555217 - RNA, 22 nt, Human
gcagcuggggccacacuuaggc

SEQ ID NO: 555218 - RNA, 22 nt, Human
agaaaugucaaguguucuuguu

SEQ ID NO: 555219 - RNA, 22 nt, Human
gcucagccgaacuucagagcag

SEQ ID NO: 555220 - RNA, 21 nt, Human
aguggggucucuguggaggcc

SEQ ID NO: 555221 - RNA, 23 nt, Human
cugggcugcuugagucccuggcu

SEQ ID NO: 555222 - RNA, 22 nt, Human
gcagagugggagcccagggcug

SEQ ID NO: 555223 - RNA, 22 nt, Human
ugcucccaggcucuguggucug

SEQ ID NO: 555224 - RNA, 22 nt, Human
aaugaagcaguccaucugcucu

SEQ ID NO: 555225 - RNA, 22 nt, Human
cagggcugugcccaucuucccc

SEQ ID NO: 555226 - RNA, 22 nt, Human
uucuccucuguuggccuucccu

SEQ ID NO: 555227 - RNA, 22 nt, Human
aucuuuaggcaaguuacuuaac

SEQ ID NO: 555228 - RNA, 22 nt, Human
cuguccauuuucgugccuccuu

SEQ ID NO: 555229 - RNA, 22 nt, Human
caugcacaacauacucaagagg

SEQ ID NO: 555230 - RNA, 22 nt, Human
ugggcugcccugaugguccuca

SEQ ID NO: 555231 - RNA, 22 nt, Human
gugcaggguagcgacggcagga

SEQ ID NO: 555232 - RNA, 22 nt, Human
uaugaacugugagugugauggg

SEQ ID NO: 555233 - RNA, 22 nt, Human
aucaacaugucauaaagugaaa

SEQ ID NO: 555234 - RNA, 22 nt, Human
cuggucaggggauggggcucag

SEQ ID NO: 555235 - RNA, 22 nt, Human
uucuuucuuuguaguccugaac

SEQ ID NO: 555236 - RNA, 22 nt, Human
cuauucuagauuacaguauaaa

SEQ ID NO: 555237 - RNA, 22 nt, Human
aguggcagccgagcaggagaug

SEQ ID NO: 555238 - RNA, 22 nt, Human
ugcugucugcaacaguacuaca

SEQ ID NO: 555239 - RNA, 22 nt, Human
cuggcucauagagcagcuccaa

SEQ ID NO: 555240 - RNA, 22 nt, Human
guuuuccuucucagccauugcc

SEQ ID NO: 555241 - RNA, 22 nt, Human
ugggccagggcacccaguccag

SEQ ID NO: 555242 - RNA, 22 nt, Human
ugugaaaucugaugaauugacc

SEQ ID NO: 555243 - RNA, 22 nt, Human
gaggcagcucuucugaaugggg

SEQ ID NO: 555244 - RNA, 22 nt, Human
cagacacagauaugcauauggc

SEQ ID NO: 555245 - RNA, 21 nt, Human
ugguuugcggccaaaguuaaa

SEQ ID NO: 555246 - RNA, 22 nt, Human
ccugggucuugguucaugcucu

SEQ ID NO: 555247 - RNA, 22 nt, Human
agaggccuuucuguugagugaa

SEQ ID NO: 555248 - RNA, 22 nt, Human
uguccugcaacugaaggagaag

SEQ ID NO: 555249 - RNA, 22 nt, Human
ccacauuuuugauacucucacu

SEQ ID NO: 555250 - RNA, 22 nt, Human
agugucugaaccaccggggcau

SEQ ID NO: 555251 - RNA, 22 nt, Human
caaggccauauugccuguaugu

SEQ ID NO: 555252 - RNA, 22 nt, Human
cuucuuccaguuauaagagcuu

SEQ ID NO: 555253 - RNA, 22 nt, Human
gaagucuguggguucaaaggca

SEQ ID NO: 555254 - RNA, 22 nt, Human
accuggagaaagccucucccug

SEQ ID NO: 555255 - RNA, 22 nt, Human
uaaaggcuucugcagggacuga

SEQ ID NO: 555256 - RNA, 22 nt, Human
gaaugcacacgugugugcaugc

SEQ ID NO: 555257 - RNA, 22 nt, Human
ggagcugggaauuggaucaucu

SEQ ID NO: 555258 - RNA, 22 nt, Human
gcuuaauucuggcucaguuucc

SEQ ID NO: 555259 - RNA, 22 nt, Human
aaacucaaauuaaacuagcuua

SEQ ID NO: 555260 - RNA, 22 nt, Human
ugucucagauacgccaucaagg

SEQ ID NO: 555261 - RNA, 22 nt, Human
uaagacagggucuauucuuagu

SEQ ID NO: 555262 - RNA, 22 nt, Human
ggccuuggugcucuguguugca

SEQ ID NO: 555263 - RNA, 20 nt, Human
gaggaaaagcugccaggccu

SEQ ID NO: 555264 - RNA, 22 nt, Human
uuuagggaaauugaggguuaag

SEQ ID NO: 555265 - RNA, 22 nt, Human
uuuaggaauauuuucuuucagg

SEQ ID NO: 555266 - RNA, 22 nt, Human
guucaagguuuuacagagugua

SEQ ID NO: 555267 - RNA, 23 nt, Human
acuucauggcacugucuuagagg

SEQ ID NO: 555268 - RNA, 22 nt, Human
cagggacaauggcagagccuga

SEQ ID NO: 555269 - RNA, 22 nt, Human
gggaagccaugcucagagguac

SEQ ID NO: 555270 - RNA, 22 nt, Human
ggccucugguucguggugaccu

SEQ ID NO: 555271 - RNA, 22 nt, Human
ggcaggcaagucugcucuguga

SEQ ID NO: 555272 - RNA, 22 nt, Human
acaggcagagaacucagccaga

SEQ ID NO: 555273 - RNA, 22 nt, Human
ggcccagccucagacaugcccu

SEQ ID NO: 555274 - RNA, 19 nt, Human
gcaggcagcugggguaucc

SEQ ID NO: 555275 - RNA, 22 nt, Human
uucaaugauuuuuagggaucau

SEQ ID NO: 555276 - RNA, 21 nt, Human
cucuugucuuugcucaguagc

SEQ ID NO: 555277 - RNA, 22 nt, Human
uccuguggcguuaucaugugau

SEQ ID NO: 555278 - RNA, 22 nt, Human
ucucugcugagaagggcuggca

SEQ ID NO: 555279 - RNA, 21 nt, Human
gucaggcccauagcagugccu

SEQ ID NO: 555280 - RNA, 23 nt, Human
acucagagaccccgggaagugac

SEQ ID NO: 555281 - RNA, 22 nt, Human
aucugggggagcugcucaugga

SEQ ID NO: 555282 - RNA, 22 nt, Human
ugauuucccuguagccucugaa

SEQ ID NO: 555283 - RNA, 22 nt, Human
uuauggcuuaaauacuacaggg

SEQ ID NO: 555284 - RNA, 22 nt, Human
cuuagggaauugggaggaugcc

SEQ ID NO: 555285 - RNA, 22 nt, Human
ucagguggccaaaugggagcgc

SEQ ID NO: 555286 - RNA, 22 nt, Human
gcuuccugucccucagccauga

SEQ ID NO: 555287 - RNA, 22 nt, Human
caucuuuauuuauauagacagg

SEQ ID NO: 555288 - RNA, 22 nt, Human
ugggccagcugaagugccgccc

SEQ ID NO: 555289 - RNA, 22 nt, Human
uagccgcuuaauuauuugguga

SEQ ID NO: 555290 - RNA, 22 nt, Human
ggucucagaucuuuauuaaggc

SEQ ID NO: 555291 - RNA, 22 nt, Human
gaaaaugugccuuuggguauug

SEQ ID NO: 555292 - RNA, 22 nt, Human
cugcugagcauuugcagggaca

SEQ ID NO: 555293 - RNA, 21 nt, Human
ggagucagggucuggcugggg

SEQ ID NO: 555294 - RNA, 22 nt, Human
ccagggcuggguuugucggugu

SEQ ID NO: 555295 - RNA, 22 nt, Human
agggcagagggugccucaccug

SEQ ID NO: 555296 - RNA, 22 nt, Human
gcaggcucaaaagcugguagga

SEQ ID NO: 555297 - RNA, 22 nt, Human
ccauuuguaccauuucuuugua

SEQ ID NO: 555298 - RNA, 22 nt, Human
ccugaagcaaggguaggcaggu

SEQ ID NO: 555299 - RNA, 23 nt, Human
gucagggcuggggucagagugac

SEQ ID NO: 555300 - RNA, 22 nt, Human
acaauucugaugguuucccagu

SEQ ID NO: 555301 - RNA, 22 nt, Human
agaaggcagaugggacggagca

SEQ ID NO: 555302 - RNA, 21 nt, Human
cuacagaaucgagcauucugg

SEQ ID NO: 555303 - RNA, 22 nt, Human
aacugugaggaugugcaaauuc

SEQ ID NO: 555304 - RNA, 22 nt, Human
uauuucaugugcaccauaauuc

SEQ ID NO: 555305 - RNA, 22 nt, Human
ucuucuccagugcuucugcaca

SEQ ID NO: 555306 - RNA, 17 nt, Human
gguggccugcaguggcu

SEQ ID NO: 555307 - RNA, 22 nt, Human
agucucagggccacccggggaa

SEQ ID NO: 555308 - RNA, 22 nt, Human
auaauuuaaauuaguaugugau

SEQ ID NO: 555309 - RNA, 22 nt, Human
uauagcauauacagauaagcug

SEQ ID NO: 555310 - RNA, 22 nt, Human
aacugagacacgaacuaugauu

SEQ ID NO: 555311 - RNA, 22 nt, Human
gucaggauuuacaaacuucagu

SEQ ID NO: 555312 - RNA, 22 nt, Human
uuugaaagggaaauaaacuccu

SEQ ID NO: 555313 - RNA, 22 nt, Human
guaaaguucuacuagaaucaac

SEQ ID NO: 555314 - RNA, 22 nt, Human
ccugucaguugcugucagggau

SEQ ID NO: 555315 - RNA, 22 nt, Human
gcugugagggcuucugaggcau

SEQ ID NO: 555316 - RNA, 22 nt, Human
auuucaugugaagaagagauaa

SEQ ID NO: 555317 - RNA, 22 nt, Human
gucuuauuuaaggacaagaaga

SEQ ID NO: 555318 - RNA, 22 nt, Human
gagaaacuguuggaauuuuaau

SEQ ID NO: 555319 - RNA, 22 nt, Human
aguuugaagauuaugccagagu

SEQ ID NO: 555320 - RNA, 22 nt, Human
uucuuuguuguacuuuccuaca

SEQ ID NO: 555321 - RNA, 22 nt, Human
gauguaauagauauagauugcu

SEQ ID NO: 555322 - RNA, 22 nt, Human
agggcugaguggugcagucaaa

SEQ ID NO: 555323 - RNA, 18 nt, Human
gcagauggagauucaggg

SEQ ID NO: 555324 - RNA, 22 nt, Human
aagccaacaugauuacuauaau

SEQ ID NO: 555325 - RNA, 22 nt, Human
ugcagggccuugggaugugucc

SEQ ID NO: 555326 - RNA, 21 nt, Human
uagggcucucugugucaggug

SEQ ID NO: 555327 - RNA, 22 nt, Human
uccuuacaugcuuccuuauaca

SEQ ID NO: 555328 - RNA, 22 nt, Human
uugauacacaauggaacaaugu

SEQ ID NO: 555329 - RNA, 22 nt, Human
ggcagccuccagggcacuggug

SEQ ID NO: 555330 - RNA, 22 nt, Human
ugugccaagacuauauugugcu

SEQ ID NO: 555331 - RNA, 22 nt, Human
uuucacaaucaaauggugaaau

SEQ ID NO: 555332 - RNA, 22 nt, Human
gcagccuguuguaccagccugu

SEQ ID NO: 555333 - RNA, 22 nt, Human
ucccugccaaugauuggagcaa

SEQ ID NO: 555334 - RNA, 20 nt, Human
uacagaaacaggacuuuugg

SEQ ID NO: 555335 - RNA, 22 nt, Human
cucuggacagcaggugcugugg

SEQ ID NO: 555336 - RNA, 22 nt, Human
acacaugugauucuaagacagc

SEQ ID NO: 555337 - RNA, 22 nt, Human
uuccuauuuccaugaaacacaa

SEQ ID NO: 555338 - RNA, 22 nt, Human
ugccucuguugagccuuggcug

SEQ ID NO: 555339 - RNA, 22 nt, Human
aaauucuaugucaauguuuauu

SEQ ID NO: 555340 - RNA, 22 nt, Human
cacaguggcagguguggguugu

SEQ ID NO: 555341 - RNA, 22 nt, Human
uguuuucauuugauguaacaaa

SEQ ID NO: 555342 - RNA, 22 nt, Human
cugaauuaagcauuacauacau

SEQ ID NO: 555343 - RNA, 22 nt, Human
aagauuucagaguuugggggaa

SEQ ID NO: 555344 - RNA, 20 nt, Human
agaagucagcucagaaguga

SEQ ID NO: 555345 - RNA, 22 nt, Human
uucagcagucguccaggaaaag

SEQ ID NO: 555346 - RNA, 19 nt, Human
auacagauguauccaugau

SEQ ID NO: 555347 - RNA, 22 nt, Human
ugcuggagaucauuaauguuca

SEQ ID NO: 555348 - RNA, 22 nt, Human
cagucacauagguauacacaua

SEQ ID NO: 555349 - RNA, 18 nt, Human
auauauugacaagaggga

SEQ ID NO: 555350 - RNA, 22 nt, Human
cccagcccaucucaaaggucua

SEQ ID NO: 555351 - RNA, 19 nt, Human
uggcuuccaucucucucau

SEQ ID NO: 555352 - RNA, 22 nt, Human
aaucuugaguaucagaccaaga

SEQ ID NO: 555353 - RNA, 22 nt, Human
aggagcuggaaugguccuuuug

SEQ ID NO: 555354 - RNA, 22 nt, Human
ccuggcagcagcacaugccuuc

SEQ ID NO: 555355 - RNA, 22 nt, Human
gcacaggaaucuucauuuuuua

SEQ ID NO: 555356 - RNA, 21 nt, Human
aaagagacaaauggcauauac

SEQ ID NO: 555357 - RNA, 22 nt, Human
cagggccauaucuugugcacca

SEQ ID NO: 555358 - RNA, 21 nt, Human
cugugcuuuuuaagugugaug

SEQ ID NO: 555359 - RNA, 22 nt, Human
agagccaggugcugcuguuuga

SEQ ID NO: 555360 - RNA, 22 nt, Human
ucucagagauuuuguuucccuu

SEQ ID NO: 555361 - RNA, 22 nt, Human
cacccagcacagagggaggcga

SEQ ID NO: 555362 - RNA, 22 nt, Human
ucccagagugugggcaucaagg

SEQ ID NO: 555363 - RNA, 22 nt, Human
uccucacaagcaagcacaggua

SEQ ID NO: 555364 - RNA, 22 nt, Human
uccucaugccgggucucacgcu

SEQ ID NO: 555365 - RNA, 22 nt, Human
caccuggcuggaagugcuccgg

SEQ ID NO: 555366 - RNA, 22 nt, Human
auuguauuuccagcuugaaugu

SEQ ID NO: 555367 - RNA, 22 nt, Human
auugucuguacuuuaaaaaugu

SEQ ID NO: 555368 - RNA, 22 nt, Human
gaaaugcauggaucuuggcaga

SEQ ID NO: 555369 - RNA, 22 nt, Human
gcagcacauauaaacaaagaga

SEQ ID NO: 555370 - RNA, 22 nt, Human
acagccugcugccugcuucuug

SEQ ID NO: 555371 - RNA, 22 nt, Human
caucagaaugaauguucuggag

SEQ ID NO: 555372 - RNA, 22 nt, Human
ugggaccugcccuggccccauc

SEQ ID NO: 555373 - RNA, 22 nt, Human
uuuccuuccuugcuagccugag

SEQ ID NO: 555374 - RNA, 22 nt, Human
cagugcaguggcugagcuggag

SEQ ID NO: 555375 - RNA, 22 nt, Human
gggcagcagaggaucccuuaau

SEQ ID NO: 555376 - RNA, 22 nt, Human
aucacuguguauguauaugcag

SEQ ID NO: 555377 - RNA, 22 nt, Human
uuucacaaugcaauccuacuuc

SEQ ID NO: 555378 - RNA, 22 nt, Human
ccauggcauuuuaugugucuua

SEQ ID NO: 555379 - RNA, 22 nt, Human
gcugggcugcccaaccucugac

SEQ ID NO: 555380 - RNA, 22 nt, Human
gaggcccaggucaagcagccac

SEQ ID NO: 555381 - RNA, 22 nt, Human
ccucugcaaagaauuugucucc

SEQ ID NO: 555382 - RNA, 19 nt, Human
agucucaguguacagaggc

SEQ ID NO: 555383 - RNA, 22 nt, Human
caguuucuacgacuuaagcaca

SEQ ID NO: 555384 - RNA, 22 nt, Human
aucagaauuagccagugaggcu

SEQ ID NO: 555385 - RNA, 22 nt, Human
aaagucacuuccuucugucagc

SEQ ID NO: 555386 - RNA, 22 nt, Human
cuguugucuucauugucauauc

SEQ ID NO: 555387 - RNA, 23 nt, Human
cugaaauucagaugcuaaagaua

SEQ ID NO: 555388 - RNA, 22 nt, Human
ugcauuaucuuuaauguucuca

SEQ ID NO: 555389 - RNA, 22 nt, Human
ccucugaguuagagaucuagau

SEQ ID NO: 555390 - RNA, 22 nt, Human
ggcagcucaccucugguccagg

SEQ ID NO: 555391 - RNA, 22 nt, Human
gcccaggaguugaaugcagcag

SEQ ID NO: 555392 - RNA, 22 nt, Human
accaugaugcauccuuaaggaa

SEQ ID NO: 555393 - RNA, 22 nt, Human
ggaaagagggacccagcuuggu

SEQ ID NO: 555394 - RNA, 22 nt, Human
uccuuggcagcagggagcauga

SEQ ID NO: 555395 - RNA, 22 nt, Human
accaugaucugcucugguguuu

SEQ ID NO: 555396 - RNA, 22 nt, Human
cacagcuggugacagagcccag

SEQ ID NO: 555397 - RNA, 22 nt, Human
uucauaaugagguccuagaggc

SEQ ID NO: 555398 - RNA, 22 nt, Human
ugaugcccccaaaucuggcuca

SEQ ID NO: 555399 - RNA, 22 nt, Human
ucuaacuugugaguauagauga

SEQ ID NO: 555400 - RNA, 22 nt, Human
cugagguggaacagaggugaag

SEQ ID NO: 555401 - RNA, 22 nt, Human
gggcagugguuacacagcugag

SEQ ID NO: 555402 - RNA, 22 nt, Human
aggaagcccaagucucaucuuc

SEQ ID NO: 555403 - RNA, 22 nt, Human
aggcuuuggggcauucuguguu

SEQ ID NO: 555404 - RNA, 22 nt, Human
gcccaugggcuccagaccuggg

SEQ ID NO: 555405 - RNA, 22 nt, Human
agcuuuauucaugauuucaggg

SEQ ID NO: 555406 - RNA, 22 nt, Human
augaggcaaucaugguccaguu

SEQ ID NO: 555407 - RNA, 22 nt, Human
ccugggaggcugugggucugcu

SEQ ID NO: 555408 - RNA, 22 nt, Human
cagggcaggaugcugugauuau

SEQ ID NO: 555409 - RNA, 22 nt, Human
cagcaacuuggacagcagucuu

SEQ ID NO: 555410 - RNA, 22 nt, Human
uggagggcucuuucaccuggua

SEQ ID NO: 555411 - RNA, 22 nt, Human
acagcucuguguauugucaucu

SEQ ID NO: 555412 - RNA, 22 nt, Human
cccagcucccauguucuccaau

SEQ ID NO: 555413 - RNA, 22 nt, Human
aaaugcauuaagucagaacaau

SEQ ID NO: 555414 - RNA, 22 nt, Human
aaugaaaauuggacccuagaac

SEQ ID NO: 555415 - RNA, 22 nt, Human
ucuguucuauuggucuaugugu

SEQ ID NO: 555416 - RNA, 22 nt, Human
cagcaggguuaagugacucacc

SEQ ID NO: 555417 - RNA, 21 nt, Human
caaaacuuaggugacuuagga

SEQ ID NO: 555418 - RNA, 22 nt, Human
gcaaagucugcaucuggaucag

SEQ ID NO: 555419 - RNA, 22 nt, Human
aauaagaaagagucagcuucag

SEQ ID NO: 555420 - RNA, 22 nt, Human
caucacagaaauaaacauaccu

SEQ ID NO: 555421 - RNA, 19 nt, Human
gccaggccuggaccugcag

SEQ ID NO: 555422 - RNA, 22 nt, Human
ccugccugcaaaaugggacaag

SEQ ID NO: 555423 - RNA, 22 nt, Human
aaggcacaacacaagaggguga

SEQ ID NO: 555424 - RNA, 22 nt, Human
cagugcugagagccuggccagg

SEQ ID NO: 555425 - RNA, 22 nt, Human
ucugcccucauugcugccugga

SEQ ID NO: 555426 - RNA, 22 nt, Human
uugguuuucuaauguauuaagg

SEQ ID NO: 555427 - RNA, 19 nt, Human
uuugugaagaaaaugaugc

SEQ ID NO: 555428 - RNA, 22 nt, Human
auauuccugacuuaauuuuuga

SEQ ID NO: 555429 - RNA, 22 nt, Human
ugcaggcugcagucucaggugg

SEQ ID NO: 555430 - RNA, 14 nt, Human
gcagguggaucacc

SEQ ID NO: 555431 - RNA, 22 nt, Human
gucuucuuuucagucugcuugu

SEQ ID NO: 555432 - RNA, 22 nt, Human
uugaacauuaacuucagucuau

SEQ ID NO: 555433 - RNA, 22 nt, Human
ccagcagacacacaggcguggg

SEQ ID NO: 555434 - RNA, 22 nt, Human
ucucugagcaugccauauugcu

SEQ ID NO: 555435 - RNA, 22 nt, Human
cugugcuucagagucagugcug

SEQ ID NO: 555436 - RNA, 22 nt, Human
aucaauucuuaggaaaauagcu

SEQ ID NO: 555437 - RNA, 22 nt, Human
gcugccugcucggcuccuggga

SEQ ID NO: 555438 - RNA, 22 nt, Human
uggagcugaacuuugaggccag

SEQ ID NO: 555439 - RNA, 22 nt, Human
gaagccccaaacccucgccauc

SEQ ID NO: 555440 - RNA, 22 nt, Human
aggaaggguucuuugugaaaga

SEQ ID NO: 555441 - RNA, 22 nt, Human
guuccaauuccaaauuccaagg

SEQ ID NO: 555442 - RNA, 22 nt, Human
uaaagacagauggaccagccau

SEQ ID NO: 555443 - RNA, 22 nt, Human
cuggagaggcugggaacagguu

SEQ ID NO: 555444 - RNA, 22 nt, Human
ugcugcauuuaucuucucaaac

SEQ ID NO: 555445 - RNA, 22 nt, Human
gacuggaaagccuguccucaga

SEQ ID NO: 555446 - RNA, 22 nt, Human
cuggggugugcucagagcaggg

SEQ ID NO: 555447 - RNA, 22 nt, Human
acucuucaucccuuuaucagga

SEQ ID NO: 555448 - RNA, 22 nt, Human
ccagagccuggcaucugcauaa

SEQ ID NO: 555449 - RNA, 22 nt, Human
cggcagcaaaggaagccagguc

SEQ ID NO: 555450 - RNA, 22 nt, Human
caggcacuggccagucagcaca

SEQ ID NO: 555451 - RNA, 22 nt, Human
aaauguguauaugaaacaugau

SEQ ID NO: 555452 - RNA, 22 nt, Human
gcacugaaaauguuggauucca

SEQ ID NO: 555453 - RNA, 22 nt, Human
agcuuuaccugccuuggggcac

SEQ ID NO: 555454 - RNA, 22 nt, Human
aauuugauuuucuuaaaccaua

SEQ ID NO: 555455 - RNA, 22 nt, Human
cugcagggcccaaggucaacgg

SEQ ID NO: 555456 - RNA, 22 nt, Human
cagucccaguuugagacucugg

SEQ ID NO: 555457 - RNA, 22 nt, Human
guuaaccaaggcaccaagugua

SEQ ID NO: 555458 - RNA, 22 nt, Human
accaggcagcugggggugaugu

SEQ ID NO: 555459 - RNA, 20 nt, Human
ccugcuguuuccauggggcc

SEQ ID NO: 555460 - RNA, 22 nt, Human
ugaggugaccgcagaugggaag

SEQ ID NO: 555461 - RNA, 22 nt, Human
ucugccugaaccacucuuggag

SEQ ID NO: 555462 - RNA, 22 nt, Human
uuguaugaucccauuuagugaa

SEQ ID NO: 555463 - RNA, 22 nt, Human
acuugaaaggaagcucuaaaac

SEQ ID NO: 555464 - RNA, 22 nt, Human
cucaaguaagaaacagaauugg

SEQ ID NO: 555465 - RNA, 22 nt, Human
gaaaacuuggaucucuagaaug

SEQ ID NO: 555466 - RNA, 23 nt, Human
aaucuggcugauguuuuuucucu

SEQ ID NO: 555467 - RNA, 22 nt, Human
ugggcucaugcuggagaugaga

SEQ ID NO: 555468 - RNA, 22 nt, Human
auuaggcauucaugcagcuccu

SEQ ID NO: 555469 - RNA, 22 nt, Human
uuuugcaaaguacauuaucagg

SEQ ID NO: 555470 - RNA, 22 nt, Human
gaagaaggaagaucaugcuuga

SEQ ID NO: 555471 - RNA, 22 nt, Human
guggagccaggaucuccgcaca

SEQ ID NO: 555472 - RNA, 22 nt, Human
ucugaagaacugaguaaacaug

SEQ ID NO: 555473 - RNA, 22 nt, Human
gacacagggggauguguggacg

SEQ ID NO: 555474 - RNA, 22 nt, Human
aaagccagcucugagcugcacc

SEQ ID NO: 555475 - RNA, 22 nt, Human
ucuguuuucucuguauuuugac

SEQ ID NO: 555476 - RNA, 22 nt, Human
cuuugaauuccaguacaauaac

SEQ ID NO: 555477 - RNA, 22 nt, Human
accaggagccacaggaggagcc

SEQ ID NO: 555478 - RNA, 22 nt, Human
gaggaccacagaugagccugca

SEQ ID NO: 555479 - RNA, 22 nt, Human
ugaggcucagugagcccugcag

SEQ ID NO: 555480 - RNA, 19 nt, Human
uccaggcauccuucaggcu

SEQ ID NO: 555481 - RNA, 22 nt, Human
uucuuacuaguauguuucagca

SEQ ID NO: 555482 - RNA, 22 nt, Human
cuuggccucuucucaggguggg

SEQ ID NO: 555483 - RNA, 22 nt, Human
ccagggaaaggagguugacuug

SEQ ID NO: 555484 - RNA, 22 nt, Human
gcuccuggucuggagcuucaag

SEQ ID NO: 555485 - RNA, 22 nt, Human
cugcugugugaccauggacagg

SEQ ID NO: 555486 - RNA, 22 nt, Human
gggacuguccucugugucugug

SEQ ID NO: 555487 - RNA, 22 nt, Human
ucagaguccaugguacuuaauu

SEQ ID NO: 555488 - RNA, 22 nt, Human
cgguccuggcacuugcggcucc

SEQ ID NO: 555489 - RNA, 21 nt, Human
ucucacaauaugaugccagau

SEQ ID NO: 555490 - RNA, 22 nt, Human
uaucuauuccaaauaucagcgu

SEQ ID NO: 555491 - RNA, 19 nt, Human
agacaaguuuccagaagcc

SEQ ID NO: 555492 - RNA, 21 nt, Human
caguguggugaccagggucuc

SEQ ID NO: 555493 - RNA, 22 nt, Human
ggcaggcaacggaccacuaguc

SEQ ID NO: 555494 - RNA, 22 nt, Human
gggcuguggagccgcgagggcu

SEQ ID NO: 555495 - RNA, 22 nt, Human
auguggaggaaaugaguguaca

SEQ ID NO: 555496 - RNA, 22 nt, Human
ggcugccuugacccuggcuccg

SEQ ID NO: 555497 - RNA, 22 nt, Human
guucacagucuacauaguaaag

SEQ ID NO: 555498 - RNA, 22 nt, Human
uggagcugggauuugaacugca

SEQ ID NO: 555499 - RNA, 22 nt, Human
ucaauacuuaagcuuaauucua

SEQ ID NO: 555500 - RNA, 22 nt, Human
ucugcccuggggucagccucca

SEQ ID NO: 555501 - RNA, 22 nt, Human
uuccaggauagcuuucaggaau

SEQ ID NO: 555502 - RNA, 22 nt, Human
cagaggguugaugugaggcuua

SEQ ID NO: 555503 - RNA, 22 nt, Human
cugugucccaguaccuugggua

SEQ ID NO: 555504 - RNA, 18 nt, Human
gcagagugcgucucugug

SEQ ID NO: 555505 - RNA, 22 nt, Human
ucuuuucuagcaaauccaggag

SEQ ID NO: 555506 - RNA, 22 nt, Human
cuggagggggaaauguucauug

SEQ ID NO: 555507 - RNA, 22 nt, Human
aaaugcuugcucuugauuauuu

SEQ ID NO: 555508 - RNA, 22 nt, Human
agauauauuuaagguaauaagu

SEQ ID NO: 555509 - RNA, 22 nt, Human
cagggcucaccacugggauccu

SEQ ID NO: 555510 - RNA, 22 nt, Human
aacaggcaacaguugacucuga

SEQ ID NO: 555511 - RNA, 22 nt, Human
gcugucucggggcuuucuccug

SEQ ID NO: 555512 - RNA, 22 nt, Human
caaggcuguguuagcugcccuc

SEQ ID NO: 555513 - RNA, 22 nt, Human
accuggacaccugcugucaucu

SEQ ID NO: 555514 - RNA, 22 nt, Human
cugggcacugcaggguguugag

SEQ ID NO: 555515 - RNA, 22 nt, Human
auguucuuugaaauauuuuaga

SEQ ID NO: 555516 - RNA, 22 nt, Human
ugagccuggggccugggcagcg

SEQ ID NO: 555517 - RNA, 18 nt, Human
aaauuauucuuccuuuuc

SEQ ID NO: 555518 - RNA, 22 nt, Human
aggcaggcucaggcccaugcuu

SEQ ID NO: 555519 - RNA, 21 nt, Human
uggaccuguccuucucgcugu

SEQ ID NO: 555520 - RNA, 22 nt, Human
cuccugcaagccuccccaagca

SEQ ID NO: 555521 - RNA, 22 nt, Human
cuugccuguggcuaguuggcuc

SEQ ID NO: 555522 - RNA, 22 nt, Human
aucuagauuagguauaagagcu

SEQ ID NO: 555523 - RNA, 23 nt, Human
cagcugaagcagccugggcugga

SEQ ID NO: 555524 - RNA, 21 nt, Human
gcaggaugcaucuuggugucu

SEQ ID NO: 555525 - RNA, 22 nt, Human
uggcagaggaaaaagucacugg

SEQ ID NO: 555526 - RNA, 22 nt, Human
gucccaggcuuauguggagcuu

SEQ ID NO: 555527 - RNA, 22 nt, Human
cuccugggcucaagugauccuc

SEQ ID NO: 555528 - RNA, 19 nt, Human
ccugccugagcugucccuc

SEQ ID NO: 555529 - RNA, 22 nt, Human
gcucaggaccgaggggugggaa

SEQ ID NO: 555530 - RNA, 22 nt, Human
uuugaacaagagcuucacauua

SEQ ID NO: 555531 - RNA, 22 nt, Human
ggccucuggucaagacaagcau

SEQ ID NO: 555532 - RNA, 22 nt, Human
uacaguauuacuguguuguuuu

SEQ ID NO: 555533 - RNA, 22 nt, Human
gcugagagugugagaucagauu

SEQ ID NO: 555534 - RNA, 22 nt, Human
cccaaggcauggcaugguggca

SEQ ID NO: 555535 - RNA, 22 nt, Human
aagauugucaggcuugcuguau

SEQ ID NO: 555536 - RNA, 22 nt, Human
guuuaauaauguugaauuacua

SEQ ID NO: 555537 - RNA, 22 nt, Human
aggaaaaucgagucuggaggca

SEQ ID NO: 555538 - RNA, 22 nt, Human
auauuuacugcuguggugaagg

SEQ ID NO: 555539 - RNA, 22 nt, Human
uuugcuuguucaagauuucugu

SEQ ID NO: 555540 - RNA, 22 nt, Human
gcuucauuacugacagucugug

SEQ ID NO: 555541 - RNA, 22 nt, Human
aaagaauacccugggucauaaa

SEQ ID NO: 555542 - RNA, 22 nt, Human
guccuggguccccgcaggucag

SEQ ID NO: 555543 - RNA, 22 nt, Human
cuucacaaaauauuucauuaua

SEQ ID NO: 555544 - RNA, 22 nt, Human
ggcugccugcucaggugcggcg

SEQ ID NO: 555545 - RNA, 22 nt, Human
cuucccacagaauucaaucagu

SEQ ID NO: 555546 - RNA, 22 nt, Human
uuucaaguaagauacauuucag

SEQ ID NO: 555547 - RNA, 22 nt, Human
uguuccaugucuuuguaggacu

SEQ ID NO: 555548 - RNA, 22 nt, Human
auuucuaaagagggugguuugg

SEQ ID NO: 555549 - RNA, 20 nt, Human
ggggaagaaaaggaugugau

SEQ ID NO: 555550 - RNA, 22 nt, Human
aaggaggcacucgcucucaggg

SEQ ID NO: 555551 - RNA, 22 nt, Human
uucuugcaggucacucacugag

SEQ ID NO: 555552 - RNA, 22 nt, Human
gcacccaggcuugggcagcaac

SEQ ID NO: 555553 - RNA, 22 nt, Human
auauaaguuaguggucauguuu

SEQ ID NO: 555554 - RNA, 22 nt, Human
ggcaggaaguagcagucugagc

SEQ ID NO: 555555 - RNA, 22 nt, Human
aggugcuuggcucgugcacaca

SEQ ID NO: 555556 - RNA, 22 nt, Human
gccaggcaguucaaguacacca

SEQ ID NO: 555557 - RNA, 23 nt, Human
agggccacugggaaggauuacug

SEQ ID NO: 555558 - RNA, 22 nt, Human
uggugcugacaguucugagugc

SEQ ID NO: 555559 - RNA, 22 nt, Human
uuuucuuacugucugugauccu

SEQ ID NO: 555560 - RNA, 22 nt, Human
aguggggacaaugagagcaggu

SEQ ID NO: 555561 - RNA, 22 nt, Human
agucucugucguagaucagcgu

SEQ ID NO: 555562 - RNA, 22 nt, Human
cuggccuagcucucugcuugaa

SEQ ID NO: 555563 - RNA, 22 nt, Human
ggcugcagguugguuggcagcu

SEQ ID NO: 555564 - RNA, 22 nt, Human
ugagaauuacaaaugagucaca

SEQ ID NO: 555565 - RNA, 22 nt, Human
ugcagggcagcuagggagcuuu

SEQ ID NO: 555566 - RNA, 22 nt, Human
uuguuuugcuaaagggucauca

SEQ ID NO: 555567 - RNA, 22 nt, Human
gcugugagaaacagggaguguc

SEQ ID NO: 555568 - RNA, 22 nt, Human
uccaggccacugcagaggcucu

SEQ ID NO: 555569 - RNA, 18 nt, Human
ugaaauugcauccaugag

SEQ ID NO: 555570 - RNA, 22 nt, Human
aguccauaggcaguucauaaca

SEQ ID NO: 555571 - RNA, 22 nt, Human
ugcuucugcugauauuuuguga

SEQ ID NO: 555572 - RNA, 22 nt, Human
aaugggcuuucuuggacaggag

SEQ ID NO: 555573 - RNA, 22 nt, Human
gucuuuuuauuauagaguggag

SEQ ID NO: 555574 - RNA, 22 nt, Human
cccugggagaaguugagggcug

SEQ ID NO: 555575 - RNA, 22 nt, Human
cuuauguaugcuacuuuguggu

SEQ ID NO: 555576 - RNA, 22 nt, Human
ggagcuguaacgagccauugcu

SEQ ID NO: 555577 - RNA, 22 nt, Human
cugcugggaaggucugcucagu

SEQ ID NO: 555578 - RNA, 22 nt, Human
gucagcauaguucacacacagu

SEQ ID NO: 555579 - RNA, 22 nt, Human
acaaaguagucaaaguagauga

SEQ ID NO: 555580 - RNA, 22 nt, Human
guaaacaucgacccaacagggg

SEQ ID NO: 555581 - RNA, 22 nt, Human
ggcuggcacucuguccaguguc

SEQ ID NO: 555582 - RNA, 22 nt, Human
augggugugaaaauggucaucu

SEQ ID NO: 555583 - RNA, 22 nt, Human
aucuuucaggccuaguguuuaa

SEQ ID NO: 555584 - RNA, 22 nt, Human
aaaagauuguuagggagaaugu

SEQ ID NO: 555585 - RNA, 22 nt, Human
aaugggaaagagacuagaugcu

SEQ ID NO: 555586 - RNA, 22 nt, Human
gcagcuggucuggccuagagua

SEQ ID NO: 555587 - RNA, 20 nt, Human
ucacaggagggaaggcaggu

SEQ ID NO: 555588 - RNA, 22 nt, Human
ugaaugaugcaguauaaugaua

SEQ ID NO: 555589 - RNA, 22 nt, Human
aacaugaaguuuucuauaguga

SEQ ID NO: 555590 - RNA, 22 nt, Human
gagguggcauuaagauucuggu

SEQ ID NO: 555591 - RNA, 22 nt, Human
ucuucaaaugcuaguaauauca

SEQ ID NO: 555592 - RNA, 22 nt, Human
uacauugaauuuuuuagcaugu

SEQ ID NO: 555593 - RNA, 22 nt, Human
ucuuuuguugccuacuuauuaa

SEQ ID NO: 555594 - RNA, 22 nt, Human
uggccaaucacugacaaaaugc

SEQ ID NO: 555595 - RNA, 22 nt, Human
gcugggccgaccugggcugcag

SEQ ID NO: 555596 - RNA, 22 nt, Human
uguaacaguaagccugugagcu

SEQ ID NO: 555597 - RNA, 22 nt, Human
ucauacaucuuguauaucuauc

SEQ ID NO: 555598 - RNA, 22 nt, Human
accacugcccauggugaaaacu

SEQ ID NO: 555599 - RNA, 22 nt, Human
acugccugcauccuuaggguag

SEQ ID NO: 555600 - RNA, 22 nt, Human
ugguggcuucugaggauggcga

SEQ ID NO: 555601 - RNA, 22 nt, Human
acuuauuucauggaucauaaug

SEQ ID NO: 555602 - RNA, 22 nt, Human
uuucugaagguuaaggaauuag

SEQ ID NO: 555603 - RNA, 19 nt, Human
ccagagagcuagguacaga

SEQ ID NO: 555604 - RNA, 22 nt, Human
uauguuucuuccuuuucauaca

SEQ ID NO: 555605 - RNA, 17 nt, Human
ucuaggagagcagagcu

SEQ ID NO: 555606 - RNA, 22 nt, Human
ucugucaauuauucacauaggc

SEQ ID NO: 555607 - RNA, 22 nt, Human
cauuugcucugugucaguggca

SEQ ID NO: 555608 - RNA, 22 nt, Human
ugucucugggugauucaguccu

SEQ ID NO: 555609 - RNA, 22 nt, Human
cacagaaguuucauagucucga

SEQ ID NO: 555610 - RNA, 22 nt, Human
gagucacauacuauguaauaga

SEQ ID NO: 555611 - RNA, 21 nt, Human
aaaguucaugcuuuaauauuc

SEQ ID NO: 555612 - RNA, 22 nt, Human
ccacaaguuucagcacccagag

SEQ ID NO: 555613 - RNA, 19 nt, Human
ggccaggcugacugugguc

SEQ ID NO: 555614 - RNA, 22 nt, Human
ugcucacagcccagaacauaau

SEQ ID NO: 555615 - RNA, 22 nt, Human
ucugacauuuugagaaugacau

SEQ ID NO: 555616 - RNA, 18 nt, Human
ccaaggccccugcugggg

SEQ ID NO: 555617 - RNA, 22 nt, Human
ccucaggauacaggagccacag

SEQ ID NO: 555618 - RNA, 22 nt, Human
caaaaccaagaacauucauuuc

SEQ ID NO: 555619 - RNA, 22 nt, Human
ugcuccagugagcuggccaucc

SEQ ID NO: 555620 - RNA, 22 nt, Human
ugcuucugcuuuacuugguuca

SEQ ID NO: 555621 - RNA, 22 nt, Human
aaauccuaagcagaggaauuua

SEQ ID NO: 555622 - RNA, 22 nt, Human
agcuggcucagccggguggucu

SEQ ID NO: 555623 - RNA, 22 nt, Human
ccuuugggugaauuccucucuu

SEQ ID NO: 555624 - RNA, 22 nt, Human
aacauugauugcaucuguucac

SEQ ID NO: 555625 - RNA, 22 nt, Human
gagcugcccugagcuuugcaug

SEQ ID NO: 555626 - RNA, 22 nt, Human
agagaauuuuaaaagccuugaa

SEQ ID NO: 555627 - RNA, 22 nt, Human
gcaagcaguuacccaggauucg

SEQ ID NO: 555628 - RNA, 22 nt, Human
ugguaaagugcucuaacuucau

SEQ ID NO: 555629 - RNA, 22 nt, Human
gcugcugguccucagagcucau

SEQ ID NO: 555630 - RNA, 22 nt, Human
gcagccacuuugcaaccaagag

SEQ ID NO: 555631 - RNA, 22 nt, Human
accauuugacucucuaaggaua

SEQ ID NO: 555632 - RNA, 22 nt, Human
caauuucagaccuuuccuugga

SEQ ID NO: 555633 - RNA, 22 nt, Human
acaaggauuuguuccuaauguu

SEQ ID NO: 555634 - RNA, 22 nt, Human
cagucccagacauaguaaggga

SEQ ID NO: 555635 - RNA, 22 nt, Human
aaauacauaaagguuguaccag

SEQ ID NO: 555636 - RNA, 22 nt, Human
auuucagcccaguaugagcccc

SEQ ID NO: 555637 - RNA, 22 nt, Human
acaggccugagauuuugcauuu

SEQ ID NO: 555638 - RNA, 22 nt, Human
ccaagaugaucuuuacaguguu

SEQ ID NO: 555639 - RNA, 22 nt, Human
ucaguuuucucauuuaugagau

SEQ ID NO: 555640 - RNA, 22 nt, Human
ugggcucugguuuccuggcugg

SEQ ID NO: 555641 - RNA, 22 nt, Human
agcaaagcucaugacauuacag

SEQ ID NO: 555642 - RNA, 22 nt, Human
ccuggaaguuggagguugcagu

SEQ ID NO: 555643 - RNA, 22 nt, Human
ugucacauaggcaaaauguuuu

SEQ ID NO: 555644 - RNA, 22 nt, Human
aaggaagaugcuggccugggga

SEQ ID NO: 555645 - RNA, 22 nt, Human
auucuuuuuuaaggaauagaac

SEQ ID NO: 555646 - RNA, 22 nt, Human
auauacuuggagacuaucauug

SEQ ID NO: 555647 - RNA, 22 nt, Human
cagguuuagguggacgugcagg

SEQ ID NO: 555648 - RNA, 22 nt, Human
gggaccuggcgagggucacaca

SEQ ID NO: 555649 - RNA, 22 nt, Human
aggcuggcccuacuggcugccu

SEQ ID NO: 555650 - RNA, 22 nt, Human
ucgagucauguucucccauuaa

SEQ ID NO: 555651 - RNA, 22 nt, Human
augugguugaagaauuacaucu

SEQ ID NO: 555652 - RNA, 22 nt, Human
uauuucuuguucccuccaaguu

SEQ ID NO: 555653 - RNA, 22 nt, Human
cugagggaguuccugagcccac

SEQ ID NO: 555654 - RNA, 22 nt, Human
ucccagagguugagucacuuau

SEQ ID NO: 555655 - RNA, 22 nt, Human
cuugaaagaagggucuuuuaau

SEQ ID NO: 555656 - RNA, 22 nt, Human
ccacaggacggaggucuggccg

SEQ ID NO: 555657 - RNA, 22 nt, Human
caagaaauguuuacugagcauc

SEQ ID NO: 555658 - RNA, 22 nt, Human
uagaaacagaaaacuguaauag

SEQ ID NO: 555659 - RNA, 22 nt, Human
cuuauaaaguccaucugaacaa

SEQ ID NO: 555660 - RNA, 22 nt, Human
caucaaaauuagacauuguuga

SEQ ID NO: 555661 - RNA, 22 nt, Human
aaaguuacacgacuauuuaugu

SEQ ID NO: 555662 - RNA, 22 nt, Human
uggcccugggcaucuuucguga

SEQ ID NO: 555663 - RNA, 22 nt, Human
caggggcuagcacuuaauguuu

SEQ ID NO: 555664 - RNA, 22 nt, Human
uuucuucucuaaucucaaugau

SEQ ID NO: 555665 - RNA, 22 nt, Human
ucccuguggaagacugccagag

SEQ ID NO: 555666 - RNA, 19 nt, Human
gaaaggcugcugcuaccug

SEQ ID NO: 555667 - RNA, 22 nt, Human
uauuccaguccuauccucuuuu

SEQ ID NO: 555668 - RNA, 22 nt, Human
cugccuagcgccaucugccucu

SEQ ID NO: 555669 - RNA, 22 nt, Human
ggggugugucugacaaugguau

SEQ ID NO: 555670 - RNA, 18 nt, Human
gccugggaggaggaaaug

SEQ ID NO: 555671 - RNA, 22 nt, Human
uuuccuaagggaugcggcucaa

SEQ ID NO: 555672 - RNA, 23 nt, Human
ugaaggccuggaggacgcguugu

SEQ ID NO: 555673 - RNA, 22 nt, Human
agagauguucauucagcauguu

SEQ ID NO: 555674 - RNA, 22 nt, Human
gcugccaccguggagaugagug

SEQ ID NO: 555675 - RNA, 22 nt, Human
aauguuuuagauuacugcuggg

SEQ ID NO: 555676 - RNA, 22 nt, Human
aaaucagugcucauuugaaagg

SEQ ID NO: 555677 - RNA, 22 nt, Human
acugccauuggucaaaugagug

SEQ ID NO: 555678 - RNA, 22 nt, Human
ugcaggcugcuggcaguagcuu

SEQ ID NO: 555679 - RNA, 20 nt, Human
cucagcuaaacaacacugac

SEQ ID NO: 555680 - RNA, 22 nt, Human
cccuuuaaaguuuuaccagcag

SEQ ID NO: 555681 - RNA, 22 nt, Human
gcuggggagaauuggguuaucu

SEQ ID NO: 555682 - RNA, 22 nt, Human
uuggcuucucuuaacccuaaag

SEQ ID NO: 555683 - RNA, 22 nt, Human
cgaggcagaggcugaaacggcu

SEQ ID NO: 555684 - RNA, 22 nt, Human
cagggccuggagcugggccugc

SEQ ID NO: 555685 - RNA, 22 nt, Human
uuucaaagguuuugucaugucu

SEQ ID NO: 555686 - RNA, 22 nt, Human
acacaggagauauguaauggcu

SEQ ID NO: 555687 - RNA, 22 nt, Human
aauguauuugauguauuagccu

SEQ ID NO: 555688 - RNA, 22 nt, Human
uggcuucagacuucugcuacgu

SEQ ID NO: 555689 - RNA, 22 nt, Human
ggucccugcccaccugggagcu

SEQ ID NO: 555690 - RNA, 22 nt, Human
agcacuuaugugauuaggacag

SEQ ID NO: 555691 - RNA, 22 nt, Human
agccauuagucauuuuagaaua

SEQ ID NO: 555692 - RNA, 23 nt, Human
auuuuuugucuuuguaacuagau

SEQ ID NO: 555693 - RNA, 22 nt, Human
uggaaaaugugacuauucuaaa

SEQ ID NO: 555694 - RNA, 22 nt, Human
gaggguggguacaccagcccuc

SEQ ID NO: 555695 - RNA, 22 nt, Human
gccugccuggagcuugagguga

SEQ ID NO: 555696 - RNA, 22 nt, Human
ccaggcucugacauagauggga

SEQ ID NO: 555697 - RNA, 22 nt, Human
ucaauauagcaguguacuugag

SEQ ID NO: 555698 - RNA, 22 nt, Human
ccugggaccucgcgggaagcgg

SEQ ID NO: 555699 - RNA, 21 nt, Human
aaaaugugagcgugaugcuua

SEQ ID NO: 555700 - RNA, 22 nt, Human
uagaaacaaugacaugcuugua

SEQ ID NO: 555701 - RNA, 22 nt, Human
ucagcagggccuccuugugcag

SEQ ID NO: 555702 - RNA, 17 nt, Human
acaacagaaauguauuc

SEQ ID NO: 555703 - RNA, 22 nt, Human
cugugucuucaauguacuggga

SEQ ID NO: 555704 - RNA, 22 nt, Human
uucaaguagaaaguauugauga

SEQ ID NO: 555705 - RNA, 22 nt, Human
ucagaccauccugcuguuagug

SEQ ID NO: 555706 - RNA, 22 nt, Human
agcagggccucuggcacugguc

SEQ ID NO: 555707 - RNA, 22 nt, Human
uagcuagaagguugaaagcagg

SEQ ID NO: 555708 - RNA, 22 nt, Human
aggcccaguagugcugccuuua

SEQ ID NO: 555709 - RNA, 22 nt, Human
cauuucauaguugucacaauaa

SEQ ID NO: 555710 - RNA, 22 nt, Human
aguggcagagcaggugcuggaa

SEQ ID NO: 555711 - RNA, 22 nt, Human
gguacaaggagugaagguuugg

SEQ ID NO: 555712 - RNA, 22 nt, Human
aggucacuugguguuauucagc

SEQ ID NO: 555713 - RNA, 22 nt, Human
aaucagaaagaggucauguugc

SEQ ID NO: 555714 - RNA, 22 nt, Human
agugaaaucagguuuugacugc

SEQ ID NO: 555715 - RNA, 22 nt, Human
uuaaagaugcagcuuuagagaa

SEQ ID NO: 555716 - RNA, 22 nt, Human
cacugcucgcugcagcauggcc

SEQ ID NO: 555717 - RNA, 22 nt, Human
cugggcuucucccccuggcaga

SEQ ID NO: 555718 - RNA, 22 nt, Human
gcucacuggccugaagaggacg

SEQ ID NO: 555719 - RNA, 22 nt, Human
agggagcuguggucagcucagu

SEQ ID NO: 555720 - RNA, 22 nt, Human
uacuacuuucccccacauauuu

SEQ ID NO: 555721 - RNA, 22 nt, Human
auggaauauagucuuauaucuc

SEQ ID NO: 555722 - RNA, 22 nt, Human
cugugagggucacagccaugcc

SEQ ID NO: 555723 - RNA, 22 nt, Human
uccucacagaguggcaggcaau

SEQ ID NO: 555724 - RNA, 22 nt, Human
cucugcccacgucuugcccaga

SEQ ID NO: 555725 - RNA, 22 nt, Human
caaaggcugccacuguggcugu

SEQ ID NO: 555726 - RNA, 22 nt, Human
agccacagcaacaagugcaauu

SEQ ID NO: 555727 - RNA, 22 nt, Human
uaccuugaaccccaagcuuugc

SEQ ID NO: 555728 - RNA, 22 nt, Human
ugaguggacaccugcuucuuua

SEQ ID NO: 555729 - RNA, 22 nt, Human
uuuguaaugauaauguuaaauu

SEQ ID NO: 555730 - RNA, 22 nt, Human
ccccacaacucauguugaaacu

SEQ ID NO: 555731 - RNA, 22 nt, Human
gcccugcugucuucagaguaua

SEQ ID NO: 555732 - RNA, 22 nt, Human
aaacuuuuccugcucuuguccu

SEQ ID NO: 555733 - RNA, 22 nt, Human
uuugauuuacuggauauucuca

SEQ ID NO: 555734 - RNA, 22 nt, Human
acagcagagugugagauagcca

SEQ ID NO: 555735 - RNA, 22 nt, Human
ggcacugaaguggguguugggu

SEQ ID NO: 555736 - RNA, 22 nt, Human
uaguggauguucagagauuuga

SEQ ID NO: 555737 - RNA, 22 nt, Human
caaaagucuguccuuuaacuuc

SEQ ID NO: 555738 - RNA, 22 nt, Human
cacacagugggaaaaccugaag

SEQ ID NO: 555739 - RNA, 22 nt, Human
augauucagcaauuuuauaucu

SEQ ID NO: 555740 - RNA, 22 nt, Human
agagcagauggccagggggccu

SEQ ID NO: 555741 - RNA, 22 nt, Human
caggguggcacucagcgcaucu

SEQ ID NO: 555742 - RNA, 22 nt, Human
caguacuucuuggaaacuggau

SEQ ID NO: 555743 - RNA, 22 nt, Human
acauagaguucaauuuucaguc

SEQ ID NO: 555744 - RNA, 22 nt, Human
augaggcaguacacacaaagcc

SEQ ID NO: 555745 - RNA, 22 nt, Human
caggauggugugagugugagga

SEQ ID NO: 555746 - RNA, 22 nt, Human
augcuuuuccaggagaaauaua

SEQ ID NO: 555747 - RNA, 22 nt, Human
ucugggcuuuuccaugccugug

SEQ ID NO: 555748 - RNA, 22 nt, Human
uaacacauauuugcaguaagca

SEQ ID NO: 555749 - RNA, 22 nt, Human
ugccagggcugcuacuggcuga

SEQ ID NO: 555750 - RNA, 21 nt, Human
gaggccacuaauaggggcaga

SEQ ID NO: 555751 - RNA, 22 nt, Human
ggccuuggggaggauggugucc

SEQ ID NO: 555752 - RNA, 21 nt, Human
gcagacugcccugcugucccc

SEQ ID NO: 555753 - RNA, 18 nt, Human
ucagaggagauaccuaaa

SEQ ID NO: 555754 - RNA, 22 nt, Human
ugcacacacaugcagagggaga

SEQ ID NO: 555755 - RNA, 22 nt, Human
ugaagggggagauauaugugug

SEQ ID NO: 555756 - RNA, 22 nt, Human
gcaaaggcuucuuuuauucucc

SEQ ID NO: 555757 - RNA, 22 nt, Human
ucaucucagggcgacaucaugu

SEQ ID NO: 555758 - RNA, 22 nt, Human
aauauuucaaaaggaaacacag

SEQ ID NO: 555759 - RNA, 22 nt, Human
ugccuagaacuuuauucuuuau

SEQ ID NO: 555760 - RNA, 22 nt, Human
aguuacauucugagcugaguag

SEQ ID NO: 555761 - RNA, 22 nt, Human
uagagaaaagcagggaucagga

SEQ ID NO: 555762 - RNA, 22 nt, Human
gcacugaaugccaaaguguagg

SEQ ID NO: 555763 - RNA, 22 nt, Human
cccagcucucgcacuuacuagc

SEQ ID NO: 555764 - RNA, 22 nt, Human
aguaauaauuuauauuagggag

SEQ ID NO: 555765 - RNA, 22 nt, Human
ucccauauauguuuauauugga

SEQ ID NO: 555766 - RNA, 22 nt, Human
gugaagguagacugggcuuccu

SEQ ID NO: 555767 - RNA, 22 nt, Human
uugaaauauggauugaccuuga

SEQ ID NO: 555768 - RNA, 23 nt, Human
gggggcugguugacucucugcag

SEQ ID NO: 555769 - RNA, 22 nt, Human
gagcucagcacuaaaaucaugu

SEQ ID NO: 555770 - RNA, 22 nt, Human
caaggccaguuucuccuaguca

SEQ ID NO: 555771 - RNA, 18 nt, Human
aggccagcccugcuacug

SEQ ID NO: 555772 - RNA, 22 nt, Human
uggcucagcgcggccuggucuu

SEQ ID NO: 555773 - RNA, 22 nt, Human
cugucaaauggaaacuuauccu

SEQ ID NO: 555774 - RNA, 22 nt, Human
agaggcugggaaggguccccgg

SEQ ID NO: 555775 - RNA, 21 nt, Human
uacagaugaggagaccaaggc

SEQ ID NO: 555776 - RNA, 22 nt, Human
aaggaggaauuucagggugaau

SEQ ID NO: 555777 - RNA, 22 nt, Human
aucagagaaguuucacuggcau

SEQ ID NO: 555778 - RNA, 22 nt, Human
uuauuacuguauuaauccagag

SEQ ID NO: 555779 - RNA, 22 nt, Human
uggagcugauacagcuggcuuu

SEQ ID NO: 555780 - RNA, 22 nt, Human
ugcugccagagagacagggacu

SEQ ID NO: 555781 - RNA, 22 nt, Human
gcugcagcccugcggaucacuu

SEQ ID NO: 555782 - RNA, 18 nt, Human
aguguuaaguaaguagca

SEQ ID NO: 555783 - RNA, 22 nt, Human
ccaccagcagugugcaaggauu

SEQ ID NO: 555784 - RNA, 22 nt, Human
cacuggggugggccugguagag

SEQ ID NO: 555785 - RNA, 22 nt, Human
ucucugagacaguagccucugc

SEQ ID NO: 555786 - RNA, 22 nt, Human
cauuugaaauucuuagaacaaa

SEQ ID NO: 555787 - RNA, 22 nt, Human
uggcaggcaaguucagcuccac

SEQ ID NO: 555788 - RNA, 22 nt, Human
acauaugcucaucugcauuccc

SEQ ID NO: 555789 - RNA, 22 nt, Human
gcugcccaggguggagccggcu

SEQ ID NO: 555790 - RNA, 22 nt, Human
ucagagucuuaacuauucagag

SEQ ID NO: 555791 - RNA, 22 nt, Human
gaauucugggagagaucugaca

SEQ ID NO: 555792 - RNA, 22 nt, Human
gagcagagacaguacaacuggc

SEQ ID NO: 555793 - RNA, 22 nt, Human
caauuuuauugguccaaauaca

SEQ ID NO: 555794 - RNA, 22 nt, Human
aucacccaagcuggagugcagu

SEQ ID NO: 555795 - RNA, 22 nt, Human
gcuggagguuucaccugaguuu

SEQ ID NO: 555796 - RNA, 22 nt, Human
acuucuugggacccuggcaccg

SEQ ID NO: 555797 - RNA, 22 nt, Human
agaagcugacagaugcagcagg

SEQ ID NO: 555798 - RNA, 22 nt, Human
acugagagcguguacaaacuua

SEQ ID NO: 555799 - RNA, 22 nt, Human
acuuccuguguuggucuugcug

SEQ ID NO: 555800 - RNA, 22 nt, Human
gaguagguugucagacuccaaa

SEQ ID NO: 555801 - RNA, 22 nt, Human
uguggcuuaagaaugccuuuaa

SEQ ID NO: 555802 - RNA, 22 nt, Human
ugacacauuaaaugcucacaaa

SEQ ID NO: 555803 - RNA, 22 nt, Human
guuugcauaaaguggaugcagg

SEQ ID NO: 555804 - RNA, 22 nt, Human
agcagcugggcucagagcuggg

SEQ ID NO: 555805 - RNA, 22 nt, Human
aaaguuacuaucacaaugaaau

SEQ ID NO: 555806 - RNA, 22 nt, Human
gacucuuucaaacagaaagcca

SEQ ID NO: 555807 - RNA, 22 nt, Human
uuauuuauggcacuguuggugg

SEQ ID NO: 555808 - RNA, 22 nt, Human
aucaguuuauacuuauaaaucu

SEQ ID NO: 555809 - RNA, 22 nt, Human
uucuuccucagcagggcugccu

SEQ ID NO: 555810 - RNA, 22 nt, Human
cuguagccaguuuggccucacc

SEQ ID NO: 555811 - RNA, 20 nt, Human
gcccaagguccagaaggggg

SEQ ID NO: 555812 - RNA, 22 nt, Human
agccuggccugggcaggcacau

SEQ ID NO: 555813 - RNA, 22 nt, Human
uggggugggcaugcgcuguccu

SEQ ID NO: 555814 - RNA, 22 nt, Human
uuuuuauaugaaggauagugcg

SEQ ID NO: 555815 - RNA, 22 nt, Human
aagaauguucauuaaacuguug

SEQ ID NO: 555816 - RNA, 23 nt, Human
ugcugggguaguuuguggcacag

SEQ ID NO: 555817 - RNA, 22 nt, Human
aagcccagaugagaucccugga

SEQ ID NO: 555818 - RNA, 22 nt, Human
acauucauggguuuuacauuau

SEQ ID NO: 555819 - RNA, 22 nt, Human
cugaggcacagugaacuucucc

SEQ ID NO: 555820 - RNA, 22 nt, Human
guguccuuauaagaagagaugc

SEQ ID NO: 555821 - RNA, 22 nt, Human
cagagcugcacauucuaugaug

SEQ ID NO: 555822 - RNA, 22 nt, Human
aagcuggaacaucuugaggaag

SEQ ID NO: 555823 - RNA, 22 nt, Human
cuguaugaaauugucauuuuua

SEQ ID NO: 555824 - RNA, 17 nt, Human
auccccagcaucuagaa

SEQ ID NO: 555825 - RNA, 22 nt, Human
ucagauggaaugaugccacugc

SEQ ID NO: 555826 - RNA, 21 nt, Human
ucucugggcccuccugugggg

SEQ ID NO: 555827 - RNA, 22 nt, Human
uuguguaagaugcaauauggua

SEQ ID NO: 555828 - RNA, 22 nt, Human
uggggaccagauuagaccaugg

SEQ ID NO: 555829 - RNA, 22 nt, Human
ccaguuaguuaaaggcgcagua

SEQ ID NO: 555830 - RNA, 22 nt, Human
acauuucuucccuuuagcagaa

SEQ ID NO: 555831 - RNA, 19 nt, Human
caaggccaccauuucuccg

SEQ ID NO: 555832 - RNA, 22 nt, Human
uuuaccaaauagauuaugucag

SEQ ID NO: 555833 - RNA, 22 nt, Human
acagugugaugggccugccuga

SEQ ID NO: 555834 - RNA, 22 nt, Human
gcugggcucugucaugccuucc

SEQ ID NO: 555835 - RNA, 22 nt, Human
agucucuugcacauuguauuaa

SEQ ID NO: 555836 - RNA, 22 nt, Human
uauuugaaggcauacauuuuga

SEQ ID NO: 555837 - RNA, 20 nt, Human
gccugagcuauugccaggau

SEQ ID NO: 555838 - RNA, 22 nt, Human
ccccaggcagggccuaacagag

SEQ ID NO: 555839 - RNA, 22 nt, Human
agcugggaggugggcagugaga

SEQ ID NO: 555840 - RNA, 22 nt, Human
aaauuaucaugggggagaaaca

SEQ ID NO: 555841 - RNA, 22 nt, Human
cuuauuuuaagucaguuugggu

SEQ ID NO: 555842 - RNA, 22 nt, Human
cagucucuugcuucauuaguug

SEQ ID NO: 555843 - RNA, 20 nt, Human
agaaucugacccagagagac

SEQ ID NO: 555844 - RNA, 22 nt, Human
ucaguuuuguauguuguaaguc

SEQ ID NO: 555845 - RNA, 22 nt, Human
gcugcucugugacagccuccgg

SEQ ID NO: 555846 - RNA, 22 nt, Human
gaggagcuggcagcgucuccgc

SEQ ID NO: 555847 - RNA, 22 nt, Human
aaggcaguuaauuuggcuagaa

SEQ ID NO: 555848 - RNA, 22 nt, Human
cagacuugacggcagcugcuuu

SEQ ID NO: 555849 - RNA, 22 nt, Human
uuguaagauggauaggaacagc

SEQ ID NO: 555850 - RNA, 22 nt, Human
auuuuuccauucucuguuagua

SEQ ID NO: 555851 - RNA, 22 nt, Human
cuuucacaguccugacugagcg

SEQ ID NO: 555852 - RNA, 22 nt, Human
acagaagugucuuuuucauuca

SEQ ID NO: 555853 - RNA, 22 nt, Human
caaauucucacccuguuugauu

SEQ ID NO: 555854 - RNA, 22 nt, Human
agccagggcugcgagcagacag

SEQ ID NO: 555855 - RNA, 22 nt, Human
guuugaaugcaguaugcauuuu

SEQ ID NO: 555856 - RNA, 22 nt, Human
uuaaagcaguuuguauacaugg

SEQ ID NO: 555857 - RNA, 22 nt, Human
auucaguguaguuauuaucuuu

SEQ ID NO: 555858 - RNA, 22 nt, Human
uacuguuuucuuuauaguacag

SEQ ID NO: 555859 - RNA, 22 nt, Human
acucaguacaucuggaguuggc

SEQ ID NO: 555860 - RNA, 22 nt, Human
aggccucacucucagagcuucu

SEQ ID NO: 555861 - RNA, 22 nt, Human
aggugacugguuuaucuggcag

SEQ ID NO: 555862 - RNA, 22 nt, Human
agggacuuguguccuauguaug

SEQ ID NO: 555863 - RNA, 21 nt, Human
auuugcauuaaaauauuacgc

SEQ ID NO: 555864 - RNA, 22 nt, Human
uccuuucccuuuccauccuggc

SEQ ID NO: 555865 - RNA, 19 nt, Human
ugucacugucauggcccag

SEQ ID NO: 555866 - RNA, 19 nt, Human
gggguggcuggggcuccag

SEQ ID NO: 555867 - RNA, 22 nt, Human
auguccagccaaccacuggauu

SEQ ID NO: 555868 - RNA, 20 nt, Human
gcagggcaagggauaugaaa

SEQ ID NO: 555869 - RNA, 22 nt, Human
aguggcagagguugacugcagu

SEQ ID NO: 555870 - RNA, 22 nt, Human
auuugcuuuaagguauaaaagg

SEQ ID NO: 555871 - RNA, 22 nt, Human
aguuuuucuccccuggcuucau

SEQ ID NO: 555872 - RNA, 22 nt, Human
acuuucaauucacugagauaua

SEQ ID NO: 555873 - RNA, 22 nt, Human
agcaguggugugaggagggcuc

SEQ ID NO: 555874 - RNA, 22 nt, Human
ccagugcauaaucaauacagcc

SEQ ID NO: 555875 - RNA, 22 nt, Human
gaguaagagcuggcuuuggugu

SEQ ID NO: 555876 - RNA, 22 nt, Human
agucucuuuaaucacagugucu

SEQ ID NO: 555877 - RNA, 22 nt, Human
uuaaagcacuaaaugaugaggg

SEQ ID NO: 555878 - RNA, 22 nt, Human
uaccaaaaagugagccccagag

SEQ ID NO: 555879 - RNA, 22 nt, Human
gcaggggcuacucugagcuucc

SEQ ID NO: 555880 - RNA, 22 nt, Human
aggcucaguuugguuuccauug

SEQ ID NO: 555881 - RNA, 22 nt, Human
aaugaacaacuugauuuuugcc

SEQ ID NO: 555882 - RNA, 22 nt, Human
ucuguuuuggucaccuuuauau

SEQ ID NO: 555883 - RNA, 22 nt, Human
gauacaaaauauaaauggagag

SEQ ID NO: 555884 - RNA, 20 nt, Human
aguaccuuuuguauguuacc

SEQ ID NO: 555885 - RNA, 22 nt, Human
cuagagggauguuaggauagca

SEQ ID NO: 555886 - RNA, 22 nt, Human
cagaaacagagaaauauuggcu

SEQ ID NO: 555887 - RNA, 22 nt, Human
uuugagaaaggggauuuaauuc

SEQ ID NO: 555888 - RNA, 22 nt, Human
agccucucagagugcugggauu

SEQ ID NO: 555889 - RNA, 22 nt, Human
ugccuggaugugcuggccucac

SEQ ID NO: 555890 - RNA, 22 nt, Human
acacaguggugagucuggaccu

SEQ ID NO: 555891 - RNA, 22 nt, Human
gagaagcagguuuagcagacaa

SEQ ID NO: 555892 - RNA, 22 nt, Human
uguuucaaaacagugauaauuu

SEQ ID NO: 555893 - RNA, 22 nt, Human
acuugaaaccuuggcaaacaau

SEQ ID NO: 555894 - RNA, 19 nt, Human
aucuuuagcaacuuucaaa

SEQ ID NO: 555895 - RNA, 22 nt, Human
uuacaaagcguugagacaagua

SEQ ID NO: 555896 - RNA, 22 nt, Human
gcuggcugguccagcaggggcu

SEQ ID NO: 555897 - RNA, 22 nt, Human
ugccugcugcuaagcucuuugu

SEQ ID NO: 555898 - RNA, 22 nt, Human
ccugagcuggaagagcuugugc

SEQ ID NO: 555899 - RNA, 22 nt, Human
agccucaguuucaggccuccuc

SEQ ID NO: 555900 - RNA, 22 nt, Human
uaccaaaagcuuguuucauaca

SEQ ID NO: 555901 - RNA, 22 nt, Human
uagcagagauaugggcauagau

SEQ ID NO: 555902 - RNA, 21 nt, Human
ucagggaagugugcagaaggg

SEQ ID NO: 555903 - RNA, 22 nt, Human
gcuggcagguccaagauagagc

SEQ ID NO: 555904 - RNA, 22 nt, Human
uuuaaauuauaguuaaugucug

SEQ ID NO: 555905 - RNA, 22 nt, Human
acacugugucuagcauuuuaca

SEQ ID NO: 555906 - RNA, 22 nt, Human
ggcucugcuggauugaggccag

SEQ ID NO: 555907 - RNA, 17 nt, Human
cagggcugucugccuag

SEQ ID NO: 555908 - RNA, 22 nt, Human
aggcagcaagauuauuuaaucc

SEQ ID NO: 555909 - RNA, 22 nt, Human
cagcucuuugaguauuccauuu

SEQ ID NO: 555910 - RNA, 22 nt, Human
cugcagccacgagucacagccc

SEQ ID NO: 555911 - RNA, 19 nt, Human
acucaagucuaaugaaauc

SEQ ID NO: 555912 - RNA, 22 nt, Human
agugaggucaggaucucaggga

SEQ ID NO: 555913 - RNA, 22 nt, Human
cagcugccuaugaccuagccuc

SEQ ID NO: 555914 - RNA, 22 nt, Human
cccucugccucugaguaggaca

SEQ ID NO: 555915 - RNA, 22 nt, Human
acauuugagaugccuuuuaggu

SEQ ID NO: 555916 - RNA, 22 nt, Human
auuuccaagguaauuuugagua

SEQ ID NO: 555917 - RNA, 19 nt, Human
gcugugggacagcagggug

SEQ ID NO: 555918 - RNA, 22 nt, Human
cccuggaggagcuuagagcuug

SEQ ID NO: 555919 - RNA, 22 nt, Human
ugacauuucgguguaugugaug

SEQ ID NO: 555920 - RNA, 22 nt, Human
uuucagagguaugcugcuuauc

SEQ ID NO: 555921 - RNA, 22 nt, Human
uugugucugggggagugacauc

SEQ ID NO: 555922 - RNA, 22 nt, Human
agggcuguuuuuggcaccuggg

SEQ ID NO: 555923 - RNA, 22 nt, Human
cacuucaauuaacuucagcauu

SEQ ID NO: 555924 - RNA, 22 nt, Human
gagcagggagacaacucuggug

SEQ ID NO: 555925 - RNA, 22 nt, Human
cauguaaagcacuucauaacag

SEQ ID NO: 555926 - RNA, 19 nt, Human
acuugaaagcagagaguuu

SEQ ID NO: 555927 - RNA, 22 nt, Human
acagcagugcacagagaacccu

SEQ ID NO: 555928 - RNA, 20 nt, Human
acauuugaagucgcauuucu

SEQ ID NO: 555929 - RNA, 22 nt, Human
gggagcugagaaacaacauucu

SEQ ID NO: 555930 - RNA, 22 nt, Human
gcaccugcaggaugagccaggg

SEQ ID NO: 555931 - RNA, 22 nt, Human
gcccuggauguacaggcauguu

SEQ ID NO: 555932 - RNA, 22 nt, Human
ccugggcuuacgaccucugacu

SEQ ID NO: 555933 - RNA, 22 nt, Human
ugccuuuuguuagggcugccag

SEQ ID NO: 555934 - RNA, 22 nt, Human
agcagggcuuugucucugugaa

SEQ ID NO: 555935 - RNA, 22 nt, Human
cagggcagaacauauagauagu

SEQ ID NO: 555936 - RNA, 22 nt, Human
uuuccuaaggcucauuuuaaaa

SEQ ID NO: 555937 - RNA, 17 nt, Human
gagaugcuaaucugauc

SEQ ID NO: 555938 - RNA, 22 nt, Human
ugguccaggguguaguacagag

SEQ ID NO: 555939 - RNA, 22 nt, Human
ggccaggcugcccugggagcag

SEQ ID NO: 555940 - RNA, 21 nt, Human
ucucugugucuuuaagcugga

SEQ ID NO: 555941 - RNA, 22 nt, Human
aauaagaauuuacuugucaaga

SEQ ID NO: 555942 - RNA, 18 nt, Human
cugaggcccagagagggc

SEQ ID NO: 555943 - RNA, 22 nt, Human
ucagagagcuggugggcagagg

SEQ ID NO: 555944 - RNA, 22 nt, Human
aguacaaaugcagccagaguag

SEQ ID NO: 555945 - RNA, 22 nt, Human
acagcuguauucaaguugcaag

SEQ ID NO: 555946 - RNA, 19 nt, Human
ugcacacagauaaguaucu

SEQ ID NO: 555947 - RNA, 22 nt, Human
uuucuacagcuggugcaacuuu

SEQ ID NO: 555948 - RNA, 22 nt, Human
aaacaguauuaucaauauauuu

SEQ ID NO: 555949 - RNA, 22 nt, Human
acaaauccagugaacuccagug

SEQ ID NO: 555950 - RNA, 22 nt, Human
cccaggagagaggccaguuggc

SEQ ID NO: 555951 - RNA, 22 nt, Human
aagugugggaaguugcuaaaau

SEQ ID NO: 555952 - RNA, 22 nt, Human
cugcagagguugguucuaagau

SEQ ID NO: 555953 - RNA, 22 nt, Human
cagcugagcaucacuagucugg

SEQ ID NO: 555954 - RNA, 22 nt, Human
gccuucccuggcuaggcaagca

SEQ ID NO: 555955 - RNA, 22 nt, Human
gcugccuucccggaaugucauc

SEQ ID NO: 555956 - RNA, 22 nt, Human
caguuacauuaauaaugcacau

SEQ ID NO: 555957 - RNA, 22 nt, Human
ccacucugcugugcuccaugau

SEQ ID NO: 555958 - RNA, 20 nt, Human
agaaauauugaguucagagg

SEQ ID NO: 555959 - RNA, 22 nt, Human
aacaagaagagagggacguaau

SEQ ID NO: 555960 - RNA, 23 nt, Human
aggcagagccaaggucaaaaccc

SEQ ID NO: 555961 - RNA, 22 nt, Human
agcugcccccagggcugugcuu

SEQ ID NO: 555962 - RNA, 19 nt, Human
ugcagaggguaggaaggcc

SEQ ID NO: 555963 - RNA, 22 nt, Human
acaagaguaucuuugacuuuag

SEQ ID NO: 555964 - RNA, 22 nt, Human
ugcaggcuggcagauaucucau

SEQ ID NO: 555965 - RNA, 22 nt, Human
gccuuggccaacaccuugcaaa

SEQ ID NO: 555966 - RNA, 22 nt, Human
cuauuauuuccucaucuauaaa

SEQ ID NO: 555967 - RNA, 22 nt, Human
caaauauuccagguacaucccu

SEQ ID NO: 555968 - RNA, 18 nt, Human
ugagaggcuauuuuuugc

SEQ ID NO: 555969 - RNA, 22 nt, Human
agggagaacaguugcagcagac

SEQ ID NO: 555970 - RNA, 21 nt, Human
gccugcagaccccaccaggcu

SEQ ID NO: 555971 - RNA, 22 nt, Human
cagcagugugcaggugugcugg

SEQ ID NO: 555972 - RNA, 22 nt, Human
cagcaggcagccauuucacugu

SEQ ID NO: 555973 - RNA, 22 nt, Human
auugacaagugagcugggcugc

SEQ ID NO: 555974 - RNA, 22 nt, Human
aacaucaggaucuuguuacagu

SEQ ID NO: 555975 - RNA, 22 nt, Human
gauuuuuauauaaagugagaaa

SEQ ID NO: 555976 - RNA, 22 nt, Human
ucacugucugaaagaaauggcc

SEQ ID NO: 555977 - RNA, 22 nt, Human
aagucauagucuaacccagcca

SEQ ID NO: 555978 - RNA, 22 nt, Human
gccugggugaauuugauccuaa

SEQ ID NO: 555979 - RNA, 22 nt, Human
ugggcucuggagggccuaggau

SEQ ID NO: 555980 - RNA, 22 nt, Human
ucagcuuucucaaagaagcugg

SEQ ID NO: 555981 - RNA, 22 nt, Human
aaaaagagaaaugcucuagucc

SEQ ID NO: 555982 - RNA, 22 nt, Human
uggcugcucaagggaggaggcu

SEQ ID NO: 555983 - RNA, 23 nt, Human
gccugcugucacagcgggcccag

SEQ ID NO: 555984 - RNA, 21 nt, Human
agcagguguaaaggaggaaau

SEQ ID NO: 555985 - RNA, 22 nt, Human
cagagcagcagagcuuccaugg

SEQ ID NO: 555986 - RNA, 21 nt, Human
uuagcaaagcaaacacaugcu

SEQ ID NO: 555987 - RNA, 22 nt, Human
aaaguaacaauaagguucuauu

SEQ ID NO: 555988 - RNA, 22 nt, Human
acagagcacauagauuggaguu

SEQ ID NO: 555989 - RNA, 22 nt, Human
cagacagcugcuuucuugcugu

SEQ ID NO: 555990 - RNA, 22 nt, Human
ccagggugcucuguggcgucgc

SEQ ID NO: 555991 - RNA, 22 nt, Human
ugcaggugcugugucaagagag

SEQ ID NO: 555992 - RNA, 22 nt, Human
uucuuucccuuccagcagcucc

SEQ ID NO: 555993 - RNA, 17 nt, Human
uuccccugaccaagccu

SEQ ID NO: 555994 - RNA, 22 nt, Human
guggcaguugcuguggcaauaa

SEQ ID NO: 555995 - RNA, 22 nt, Human
ggcagaagugaugggauauaac

SEQ ID NO: 555996 - RNA, 22 nt, Human
acugaaggcuuucccaagguca

SEQ ID NO: 555997 - RNA, 22 nt, Human
ccugccuggguucaaaucccag

SEQ ID NO: 555998 - RNA, 22 nt, Human
gugccugcugcagcugagcagu

SEQ ID NO: 555999 - RNA, 22 nt, Human
ugcuuaauauugugauguaaua

SEQ ID NO: 556000 - RNA, 20 nt, Human
augaaauuccuguuuucuga

SEQ ID NO: 556001 - RNA, 22 nt, Human
uaauccaggguauucuaguuuc

SEQ ID NO: 556002 - RNA, 22 nt, Human
aagcacaucucaaacuucaucu

SEQ ID NO: 556003 - RNA, 22 nt, Human
ugggccaggugcagugcuuuag

SEQ ID NO: 556004 - RNA, 17 nt, Human
ggcaggugcggggccgc

SEQ ID NO: 556005 - RNA, 22 nt, Human
cuggcugcuggccugaggaugc

SEQ ID NO: 556006 - RNA, 20 nt, Human
gaggcugaaguguuuuugcu

SEQ ID NO: 556007 - RNA, 22 nt, Human
auccuuaauuuccugggccuca

SEQ ID NO: 556008 - RNA, 22 nt, Human
cugcucuguuaauuaaacuuug

SEQ ID NO: 556009 - RNA, 22 nt, Human
ugucuguggcaauuguggguaa

SEQ ID NO: 556010 - RNA, 22 nt, Human
gggagcugguuccugcccucca

SEQ ID NO: 556011 - RNA, 22 nt, Human
agcacccucagccuuauccaga

SEQ ID NO: 556012 - RNA, 22 nt, Human
gcuucuggaagcauaugcaaga

SEQ ID NO: 556013 - RNA, 22 nt, Human
aaaggcuaugagauagaagaua

SEQ ID NO: 556014 - RNA, 22 nt, Human
gggcugcuguagagaacauguu

SEQ ID NO: 556015 - RNA, 22 nt, Human
ggccccuggcaccaggcugauu

SEQ ID NO: 556016 - RNA, 22 nt, Human
caggcuggagugaguguagugg

SEQ ID NO: 556017 - RNA, 22 nt, Human
acaaugcaccuauuuuaaaacu

SEQ ID NO: 556018 - RNA, 20 nt, Human
gcacugaagguuccagggga

SEQ ID NO: 556019 - RNA, 22 nt, Human
aaauauaguaaaugcauaguuc

SEQ ID NO: 556020 - RNA, 22 nt, Human
aaugucacauacaauggcaagu

SEQ ID NO: 556021 - RNA, 22 nt, Human
acauaauagguaccugaauaau

SEQ ID NO: 556022 - RNA, 22 nt, Human
gcagggacaaggcagguguucu

SEQ ID NO: 556023 - RNA, 22 nt, Human
cagaguguugaccauaagccca

SEQ ID NO: 556024 - RNA, 23 nt, Human
cagggcccugcucaauuucucca

SEQ ID NO: 556025 - RNA, 22 nt, Human
ucaggaggccaccaggaccugu

SEQ ID NO: 556026 - RNA, 22 nt, Human
gagcugcaugcaacuguuuaaa

SEQ ID NO: 556027 - RNA, 22 nt, Human
aggaggugcuguuuguccugga

SEQ ID NO: 556028 - RNA, 22 nt, Human
uuccaagucuaaguuauaaauc

SEQ ID NO: 556029 - RNA, 22 nt, Human
gagaucgguaaagagcaugcac

SEQ ID NO: 556030 - RNA, 22 nt, Human
gcugggagaggcccugaaguga

SEQ ID NO: 556031 - RNA, 22 nt, Human
gcugccuccugaaagcgcucug

SEQ ID NO: 556032 - RNA, 22 nt, Human
uuucuucuuucccagugauggg

SEQ ID NO: 556033 - RNA, 22 nt, Human
uccuugaaugaauguucucucc

SEQ ID NO: 556034 - RNA, 22 nt, Human
ggaggccaucagggagggcauu

SEQ ID NO: 556035 - RNA, 22 nt, Human
cagcugugcuguauuaagcucu

SEQ ID NO: 556036 - RNA, 22 nt, Human
cagagcauaauugacaugaggu

SEQ ID NO: 556037 - RNA, 22 nt, Human
gcucugagauugagccuuuggu

SEQ ID NO: 556038 - RNA, 22 nt, Human
aucuagaacuuaaagucaguca

SEQ ID NO: 556039 - RNA, 22 nt, Human
ccuggcagcuguuuggcuuggc

SEQ ID NO: 556040 - RNA, 22 nt, Human
cuggaaagagauggcaggguuu

SEQ ID NO: 556041 - RNA, 22 nt, Human
auaacagacuuagaguuacaag

SEQ ID NO: 556042 - RNA, 22 nt, Human
cuuuccaaugcauuuccaaugu

SEQ ID NO: 556043 - RNA, 22 nt, Human
uggcacagggcuuggucgcuca

SEQ ID NO: 556044 - RNA, 22 nt, Human
ugaagaauguugcagugagcau

SEQ ID NO: 556045 - RNA, 22 nt, Human
cuugggcucagacuugaggaca

SEQ ID NO: 556046 - RNA, 22 nt, Human
gugugcagggcugccugugccg

SEQ ID NO: 556047 - RNA, 18 nt, Human
uuuauauggauagagacc

SEQ ID NO: 556048 - RNA, 22 nt, Human
ucuggggagggagccacagguc

SEQ ID NO: 556049 - RNA, 22 nt, Human
uggcucucagcucccagcagcc

SEQ ID NO: 556050 - RNA, 22 nt, Human
guaaaucagugucauuuuagaa

SEQ ID NO: 556051 - RNA, 22 nt, Human
ugauccuauuucaguguauguu

SEQ ID NO: 556052 - RNA, 22 nt, Human
uagagcuauuuagagcauuuua

SEQ ID NO: 556053 - RNA, 21 nt, Human
auaugaguuucagauguugcu

SEQ ID NO: 556054 - RNA, 22 nt, Human
ucccagagacagagccuccucc

SEQ ID NO: 556055 - RNA, 22 nt, Human
uuuuuguucugauuauacuggu

SEQ ID NO: 556056 - RNA, 22 nt, Human
cagggcaguaacgggaacaucu

SEQ ID NO: 556057 - RNA, 22 nt, Human
agaaaucacuuagaggaaguga

SEQ ID NO: 556058 - RNA, 22 nt, Human
cacagugcaugaugggcagaag

SEQ ID NO: 556059 - RNA, 19 nt, Human
ggcuggaguggccaucugu

SEQ ID NO: 556060 - RNA, 22 nt, Human
guaaauuauuucaagaucaucu

SEQ ID NO: 556061 - RNA, 22 nt, Human
ucugggcugguugugcuugcuu

SEQ ID NO: 556062 - RNA, 22 nt, Human
uauuaggguuuugaagguuugu

SEQ ID NO: 556063 - RNA, 22 nt, Human
caggagcccguugcuccggcgg

SEQ ID NO: 556064 - RNA, 22 nt, Human
ccugcuggaccucaacacauuu

SEQ ID NO: 556065 - RNA, 22 nt, Human
acagggcagaaauguugcaucu

SEQ ID NO: 556066 - RNA, 22 nt, Human
cggggcuggcacaggugaccac

SEQ ID NO: 556067 - RNA, 22 nt, Human
agagguagagguugcagugagc

SEQ ID NO: 556068 - RNA, 22 nt, Human
ucugagagucuuucuucaagug

SEQ ID NO: 556069 - RNA, 22 nt, Human
acacucacccucccacugccug

SEQ ID NO: 556070 - RNA, 19 nt, Human
acagaguccagaggaaagg

SEQ ID NO: 556071 - RNA, 22 nt, Human
caguagaauuauuauaaaacau

SEQ ID NO: 556072 - RNA, 18 nt, Human
cugccccuucucugagau

SEQ ID NO: 556073 - RNA, 22 nt, Human
ccagcugucugguuccagagcc

SEQ ID NO: 556074 - RNA, 22 nt, Human
ugcuuaaaaugaugauuauuuu

SEQ ID NO: 556075 - RNA, 22 nt, Human
ugugucagagguagagauggca

SEQ ID NO: 556076 - RNA, 21 nt, Human
aggucagcccagcucuggaag

SEQ ID NO: 556077 - RNA, 22 nt, Human
aacaggaggccuuccaguccag

SEQ ID NO: 556078 - RNA, 22 nt, Human
uccaggcacgaggcccugugca

SEQ ID NO: 556079 - RNA, 22 nt, Human
guucagcuuacaaaauacaccu

SEQ ID NO: 556080 - RNA, 22 nt, Human
agugaaauuccuggucuuuguu

SEQ ID NO: 556081 - RNA, 22 nt, Human
ccagcucugcagggccuggggu

SEQ ID NO: 556082 - RNA, 23 nt, Human
auaaggcauaaagguacauugga

SEQ ID NO: 556083 - RNA, 22 nt, Human
cagccagguucaaguccuuaua

SEQ ID NO: 556084 - RNA, 22 nt, Human
auaugaagaauuccaauuugga

SEQ ID NO: 556085 - RNA, 22 nt, Human
ucagcuuauauuuuuaguguaa

SEQ ID NO: 556086 - RNA, 22 nt, Human
gggaucagaaacauagcccuga

SEQ ID NO: 556087 - RNA, 22 nt, Human
ggacuggguaggagcccagggc

SEQ ID NO: 556088 - RNA, 22 nt, Human
cuggagcagguuuaggaguccc

SEQ ID NO: 556089 - RNA, 20 nt, Human
cugagcugagcuccaugggu

SEQ ID NO: 556090 - RNA, 22 nt, Human
cucauacauaugccauuccugc

SEQ ID NO: 556091 - RNA, 22 nt, Human
gcuccugcccucuugcaauucc

SEQ ID NO: 556092 - RNA, 22 nt, Human
aaguccagguccucauuccauc

SEQ ID NO: 556093 - RNA, 22 nt, Human
uauuggugggggcagagagaga

SEQ ID NO: 556094 - RNA, 22 nt, Human
gcccagcacuccucucugacau

SEQ ID NO: 556095 - RNA, 22 nt, Human
auguuuguugaacaucuacugc

SEQ ID NO: 556096 - RNA, 22 nt, Human
auucccaucgucaacuucacug

SEQ ID NO: 556097 - RNA, 22 nt, Human
aggccagaugucgggcuagaag

SEQ ID NO: 556098 - RNA, 22 nt, Human
ccagagaggggaagggcuugcc

SEQ ID NO: 556099 - RNA, 22 nt, Human
uaggauuucucuuuuugcaacu

SEQ ID NO: 556100 - RNA, 22 nt, Human
gacagcagacagccuggccccu

SEQ ID NO: 556101 - RNA, 22 nt, Human
uaggaaaaagaggcuggcaagg

SEQ ID NO: 556102 - RNA, 22 nt, Human
auacaaaauauauacuggagac

SEQ ID NO: 556103 - RNA, 22 nt, Human
uagaaauguuagauguauugag

SEQ ID NO: 556104 - RNA, 22 nt, Human
uaugugcaaauuaauugcuaga

SEQ ID NO: 556105 - RNA, 22 nt, Human
acaguuuaggaugagagaacac

SEQ ID NO: 556106 - RNA, 22 nt, Human
uccaggcuggaaaugucaaacu

SEQ ID NO: 556107 - RNA, 22 nt, Human
uuuuccucugcagagcaguuag

SEQ ID NO: 556108 - RNA, 22 nt, Human
accucugcaacccuggaauggg

SEQ ID NO: 556109 - RNA, 22 nt, Human
ucaggauccauagacucccaaa

SEQ ID NO: 556110 - RNA, 22 nt, Human
acuguucugcauguaccugagg

SEQ ID NO: 556111 - RNA, 23 nt, Human
gaggccacauuccccugcuugag

SEQ ID NO: 556112 - RNA, 22 nt, Human
gcacauaacugaccacaucuaa

SEQ ID NO: 556113 - RNA, 22 nt, Human
uaauaauuggcaauguugagca

SEQ ID NO: 556114 - RNA, 22 nt, Human
ucagggaaaacaucccgccuaa

SEQ ID NO: 556115 - RNA, 22 nt, Human
agcaagaaaucuucaguguucu

SEQ ID NO: 556116 - RNA, 22 nt, Human
augggaggaucacuugaggcca

SEQ ID NO: 556117 - RNA, 22 nt, Human
ugaguccaauaggggccuggaa

SEQ ID NO: 556118 - RNA, 22 nt, Human
uacuuuuuaugauaagaacuga

SEQ ID NO: 556119 - RNA, 22 nt, Human
cugggcaugaaaaggaugccag

SEQ ID NO: 556120 - RNA, 21 nt, Human
acugccugucuccauagucua

SEQ ID NO: 556121 - RNA, 20 nt, Human
cauauauaccuagaagugga

SEQ ID NO: 556122 - RNA, 22 nt, Human
aggcugagguaggaggaucgcu

SEQ ID NO: 556123 - RNA, 22 nt, Human
cgggcagauugggaagguucau

SEQ ID NO: 556124 - RNA, 22 nt, Human
agagccagcaagugaauaguga

SEQ ID NO: 556125 - RNA, 22 nt, Human
uagaaacccauguuuauucagu

SEQ ID NO: 556126 - RNA, 22 nt, Human
gaggcucagagggagcaugguc

SEQ ID NO: 556127 - RNA, 22 nt, Human
auucaaagcccaguaaacauug

SEQ ID NO: 556128 - RNA, 22 nt, Human
aggaggggcauagaaauguaau

SEQ ID NO: 556129 - RNA, 22 nt, Human
ggggaccuggccacccauccuu

SEQ ID NO: 556130 - RNA, 22 nt, Human
uguagcauguaaauugguuauu

SEQ ID NO: 556131 - RNA, 22 nt, Human
aggcucaggcaggaauggcgga

SEQ ID NO: 556132 - RNA, 22 nt, Human
ugcaggugccucuugagcuugu

SEQ ID NO: 556133 - RNA, 22 nt, Human
aaaauuauucauggcuuuugga

SEQ ID NO: 556134 - RNA, 22 nt, Human
gccugugccucagccugcagcc

SEQ ID NO: 556135 - RNA, 22 nt, Human
gcagcagaguuugggagauggu

SEQ ID NO: 556136 - RNA, 22 nt, Human
ugacauuuaucaaagaaauggu

SEQ ID NO: 556137 - RNA, 23 nt, Human
ugucauugugacuacagaaccag

SEQ ID NO: 556138 - RNA, 20 nt, Human
cuuuggcaaugagaacaggg

SEQ ID NO: 556139 - RNA, 18 nt, Human
gcugucugaggucugagg

SEQ ID NO: 556140 - RNA, 22 nt, Human
cuucaguguccucucuaguaga

SEQ ID NO: 556141 - RNA, 22 nt, Human
ggggcccuuguggcugcaggcc

SEQ ID NO: 556142 - RNA, 20 nt, Human
ccugggguacacuggcaugu

SEQ ID NO: 556143 - RNA, 22 nt, Human
aucauacacucacauaaacaga

SEQ ID NO: 556144 - RNA, 22 nt, Human
ucugaaauaggcuucuuuuggu

SEQ ID NO: 556145 - RNA, 22 nt, Human
aaggcagccucugccagccggg

SEQ ID NO: 556146 - RNA, 22 nt, Human
aucuggcuggauucuuagcguu

SEQ ID NO: 556147 - RNA, 23 nt, Human
cuguaugauguuaaguggaaagc

SEQ ID NO: 556148 - RNA, 22 nt, Human
aagauuauggcagauaacaauu

SEQ ID NO: 556149 - RNA, 22 nt, Human
uuauuccauagaagucaaggaa

SEQ ID NO: 556150 - RNA, 22 nt, Human
gccaggugcuaucccugcgcug

SEQ ID NO: 556151 - RNA, 22 nt, Human
cucuggaggccuaaggaagugg

SEQ ID NO: 556152 - RNA, 22 nt, Human
uaacacaugguuaguacacaau

SEQ ID NO: 556153 - RNA, 22 nt, Human
acuuuguugaagaauauguuag

SEQ ID NO: 556154 - RNA, 22 nt, Human
cccuggagggcagacagaugcc

SEQ ID NO: 556155 - RNA, 22 nt, Human
acagaggccgccucucucacgg

SEQ ID NO: 556156 - RNA, 22 nt, Human
aaucuggcucagaagaagauga

SEQ ID NO: 556157 - RNA, 22 nt, Human
ggcacacauggugguuggugaa

SEQ ID NO: 556158 - RNA, 22 nt, Human
uaccuugagccguugcugauga

SEQ ID NO: 556159 - RNA, 22 nt, Human
gcugccuguccugaggaguccg

SEQ ID NO: 556160 - RNA, 22 nt, Human
agcaucuggugagggccuaguu

SEQ ID NO: 556161 - RNA, 22 nt, Human
agugcaggcucgcuugugaggc

SEQ ID NO: 556162 - RNA, 22 nt, Human
cuauuauuagcaaaagguggau

SEQ ID NO: 556163 - RNA, 22 nt, Human
gccuggugugcgccgcgcagcu

SEQ ID NO: 556164 - RNA, 22 nt, Human
ccauacacacaccaaauuugua

SEQ ID NO: 556165 - RNA, 22 nt, Human
agugggcaugaucuggugucug

SEQ ID NO: 556166 - RNA, 22 nt, Human
cagcuuguuaccgagggagggu

SEQ ID NO: 556167 - RNA, 22 nt, Human
gaggcagcagaacauggaagag

SEQ ID NO: 556168 - RNA, 22 nt, Human
aaaggccacugcaagggaaggu

SEQ ID NO: 556169 - RNA, 22 nt, Human
uuuuuaagcuccuuugauguca

SEQ ID NO: 556170 - RNA, 22 nt, Human
aaucuguuuaguucugcguaug

SEQ ID NO: 556171 - RNA, 20 nt, Human
gcagugaucucaucggucug

SEQ ID NO: 556172 - RNA, 22 nt, Human
aaacuguaaacacagcaguaca

SEQ ID NO: 556173 - RNA, 22 nt, Human
gagcugccugaacaagcagcag

SEQ ID NO: 556174 - RNA, 22 nt, Human
uauuuuugccucucagauaaaa

SEQ ID NO: 556175 - RNA, 22 nt, Human
guccagaaagggcagugauuug

SEQ ID NO: 556176 - RNA, 22 nt, Human
auguuucaaauauauagaguug

SEQ ID NO: 556177 - RNA, 22 nt, Human
uauuuguuccagagauaaaaau

SEQ ID NO: 556178 - RNA, 22 nt, Human
guggcugcagagccagcaagcu

SEQ ID NO: 556179 - RNA, 22 nt, Human
aguggggagguccaggccaccc

SEQ ID NO: 556180 - RNA, 21 nt, Human
auacagaagguggcaaaguac

SEQ ID NO: 556181 - RNA, 22 nt, Human
uaguaacugguugaacaacugu

SEQ ID NO: 556182 - RNA, 22 nt, Human
cuggaaaggguccucauucugu

SEQ ID NO: 556183 - RNA, 22 nt, Human
aagugauucuagucaugauucu

SEQ ID NO: 556184 - RNA, 22 nt, Human
uaggaagagcuauaggucccca

SEQ ID NO: 556185 - RNA, 22 nt, Human
ccaggaggcagagguuacagug

SEQ ID NO: 556186 - RNA, 22 nt, Human
gagaaagcuucuuucccacagg

SEQ ID NO: 556187 - RNA, 23 nt, Human
aagaacuuugguccugcagaguc

SEQ ID NO: 556188 - RNA, 20 nt, Human
ucaggaugugcugagugaag

SEQ ID NO: 556189 - RNA, 23 nt, Human
gccaggaguggguagacuaaugc

SEQ ID NO: 556190 - RNA, 22 nt, Human
aacacuuuuuaguaaagauuga

SEQ ID NO: 556191 - RNA, 22 nt, Human
ucuaaagugagucauuucgacu

SEQ ID NO: 556192 - RNA, 22 nt, Human
cuguuucacguguuuaagccca

SEQ ID NO: 556193 - RNA, 20 nt, Human
cacaggccuugugagcagac

SEQ ID NO: 556194 - RNA, 22 nt, Human
ggcucuggugcccuggcuccca

SEQ ID NO: 556195 - RNA, 22 nt, Human
caggccuuaaggacucggagaa

SEQ ID NO: 556196 - RNA, 20 nt, Human
cugcucugcuuugcaggugg

SEQ ID NO: 556197 - RNA, 22 nt, Human
uccucacagucaacacuuugag

SEQ ID NO: 556198 - RNA, 22 nt, Human
uccugggauucugcauuucuaa

SEQ ID NO: 556199 - RNA, 22 nt, Human
gcccagccuccaagcuccaagg

SEQ ID NO: 556200 - RNA, 22 nt, Human
uggccugcccagagcagcucug

SEQ ID NO: 556201 - RNA, 22 nt, Human
uggacucaaguccaaguucacg

SEQ ID NO: 556202 - RNA, 22 nt, Human
ucucaggcuaccuugcacaagg

SEQ ID NO: 556203 - RNA, 22 nt, Human
uagaaaugcaguguacuguguc

SEQ ID NO: 556204 - RNA, 22 nt, Human
agacagcaggggagucugguuu

SEQ ID NO: 556205 - RNA, 22 nt, Human
accucagagaccucucaggugc

SEQ ID NO: 556206 - RNA, 18 nt, Human
cagaaaucacaccagcac

SEQ ID NO: 556207 - RNA, 22 nt, Human
gaauacauuggaaaucagaaua

SEQ ID NO: 556208 - RNA, 22 nt, Human
aucacaaaggucucagagcaca

SEQ ID NO: 556209 - RNA, 22 nt, Human
uucugggggaauacagcuauga

SEQ ID NO: 556210 - RNA, 20 nt, Human
acauuugaguaucaucuacu

SEQ ID NO: 556211 - RNA, 22 nt, Human
agcugugggauuugggugugcc

SEQ ID NO: 556212 - RNA, 20 nt, Human
acaaaugcauucugugacau

SEQ ID NO: 556213 - RNA, 22 nt, Human
ugcacacacucugcauauacuu

SEQ ID NO: 556214 - RNA, 22 nt, Human
uucuggagagaaaccuuacaaa

SEQ ID NO: 556215 - RNA, 22 nt, Human
ggcagcaguaggagcuaaucuu

SEQ ID NO: 556216 - RNA, 22 nt, Human
uggcugaggcacagcugccgcc

SEQ ID NO: 556217 - RNA, 22 nt, Human
gcuugaaaauucauagguauuu

SEQ ID NO: 556218 - RNA, 22 nt, Human
cuggcagcuucaggacacucgg

SEQ ID NO: 556219 - RNA, 22 nt, Human
uggagugaaguaaagaggacaa

SEQ ID NO: 556220 - RNA, 22 nt, Human
acagguggcacugcuguuacuc

SEQ ID NO: 556221 - RNA, 22 nt, Human
uuuuggucagguuggucucgaa

SEQ ID NO: 556222 - RNA, 22 nt, Human
agucugggagggaugccagugu

SEQ ID NO: 556223 - RNA, 22 nt, Human
uauucacagguucuggggauca

SEQ ID NO: 556224 - RNA, 22 nt, Human
aauuugacccaucuuggaauuu

SEQ ID NO: 556225 - RNA, 17 nt, Human
uggggaugguucaugag

SEQ ID NO: 556226 - RNA, 22 nt, Human
gcugggagucgcgucuguggcc

SEQ ID NO: 556227 - RNA, 22 nt, Human
gacuuucucuccucccaggugu

SEQ ID NO: 556228 - RNA, 22 nt, Human
cauuucaagcauugacuucuau

SEQ ID NO: 556229 - RNA, 22 nt, Human
agcccuuuccaauuugauuuau

SEQ ID NO: 556230 - RNA, 22 nt, Human
uuacagauggcaguuucuugag

SEQ ID NO: 556231 - RNA, 22 nt, Human
uacuuucaugucuauacauauu

SEQ ID NO: 556232 - RNA, 22 nt, Human
cgaggcucagagagggugacuu

SEQ ID NO: 556233 - RNA, 22 nt, Human
uacugugaauacaaaauaaauu

SEQ ID NO: 556234 - RNA, 23 nt, Human
auguuauuauuagcagucuugcc

SEQ ID NO: 556235 - RNA, 22 nt, Human
uccuggcucugcugccuccuag

SEQ ID NO: 556236 - RNA, 22 nt, Human
auguaguauuuggaaauguaaa

SEQ ID NO: 556237 - RNA, 22 nt, Human
cugucaguaggcucccaucauu

SEQ ID NO: 556238 - RNA, 22 nt, Human
aaggaagaggcagguuuugcug

SEQ ID NO: 556239 - RNA, 22 nt, Human
ggcaggugcuugucgaaggccu

SEQ ID NO: 556240 - RNA, 22 nt, Human
gcauuucauguagauugagaac

SEQ ID NO: 556241 - RNA, 20 nt, Human
aggccacugaaugccaauca

SEQ ID NO: 556242 - RNA, 22 nt, Human
ggaggcagaacuucccgucagu

SEQ ID NO: 556243 - RNA, 22 nt, Human
ugcaccauguaaguggccacgu

SEQ ID NO: 556244 - RNA, 22 nt, Human
cuugccuucuguuccuauagaa

SEQ ID NO: 556245 - RNA, 21 nt, Human
guauugcagaguuaugugcuc

SEQ ID NO: 556246 - RNA, 22 nt, Human
cauuguauugaggauacuuaag

SEQ ID NO: 556247 - RNA, 16 nt, Human
agcagggcgggaagga

SEQ ID NO: 556248 - RNA, 22 nt, Human
cuaaaauuaccuaccaguuuag

SEQ ID NO: 556249 - RNA, 22 nt, Human
uauuucagacacugaucuugca

SEQ ID NO: 556250 - RNA, 22 nt, Human
auucuucacuguuucagaauga

SEQ ID NO: 556251 - RNA, 22 nt, Human
gaaugcagauggcugguguaug

SEQ ID NO: 556252 - RNA, 22 nt, Human
gcugucaccaaagcaggcacug

SEQ ID NO: 556253 - RNA, 22 nt, Human
ucugggcuugguuagggcuguu

SEQ ID NO: 556254 - RNA, 22 nt, Human
uugcaaauucgucacuguuaaa

SEQ ID NO: 556255 - RNA, 22 nt, Human
aggcacugguccauuuucugca

SEQ ID NO: 556256 - RNA, 22 nt, Human
ugaaagcacaaguucuaacagg

SEQ ID NO: 556257 - RNA, 22 nt, Human
ucagugucuugaccugggugug

SEQ ID NO: 556258 - RNA, 22 nt, Human
ugccaggcauauggccucuuug

SEQ ID NO: 556259 - RNA, 22 nt, Human
ucuucaugucaugguauauuga

SEQ ID NO: 556260 - RNA, 22 nt, Human
cagaggcugggaccucaggcau

SEQ ID NO: 556261 - RNA, 21 nt, Human
aaugugugcuauuuaucuuuu

SEQ ID NO: 556262 - RNA, 22 nt, Human
agcauuuauuucuuagaaauug

SEQ ID NO: 556263 - RNA, 22 nt, Human
aaagucaucagaaccuuccaga

SEQ ID NO: 556264 - RNA, 22 nt, Human
guagggacaugccauuaucuca

SEQ ID NO: 556265 - RNA, 22 nt, Human
aguaaugucccuuaaauguggu

SEQ ID NO: 556266 - RNA, 22 nt, Human
cagcagagcugggcuuugaauu

SEQ ID NO: 556267 - RNA, 22 nt, Human
ggcugcuugcuguuucuuggau

SEQ ID NO: 556268 - RNA, 22 nt, Human
aaaacucaaacauuuuggcaua

SEQ ID NO: 556269 - RNA, 21 nt, Human
gccugggauaguggccuccgg

SEQ ID NO: 556270 - RNA, 22 nt, Human
auuuguaaagugcuuaaaagua

SEQ ID NO: 556271 - RNA, 22 nt, Human
gccuugcugauuaccuuccuuu

SEQ ID NO: 556272 - RNA, 22 nt, Human
ccaggccugcaucugcugcgca

SEQ ID NO: 556273 - RNA, 22 nt, Human
acuugcauguguaaaucuuccu

SEQ ID NO: 556274 - RNA, 23 nt, Human
uguggcugagaaauugacaacuu

SEQ ID NO: 556275 - RNA, 20 nt, Human
gccagcacagggagcaguuc

SEQ ID NO: 556276 - RNA, 19 nt, Human
ucccgcccacugagcgugc

SEQ ID NO: 556277 - RNA, 22 nt, Human
uaaggcacccauguucauacag

SEQ ID NO: 556278 - RNA, 22 nt, Human
aaggccaucuacuuacggaauu

SEQ ID NO: 556279 - RNA, 22 nt, Human
caguauguuugggagacaugac

SEQ ID NO: 556280 - RNA, 22 nt, Human
ccagcagagcauggggaggaag

SEQ ID NO: 556281 - RNA, 22 nt, Human
ucaucacucauuggacaacaga

SEQ ID NO: 556282 - RNA, 22 nt, Human
gcauuauuaauagcugcaugag

SEQ ID NO: 556283 - RNA, 22 nt, Human
cagggcagagccaggauuucaa

SEQ ID NO: 556284 - RNA, 22 nt, Human
cucugcugcccaggccugcuag

SEQ ID NO: 556285 - RNA, 19 nt, Human
ggaaggagagaaaugcaug

SEQ ID NO: 556286 - RNA, 20 nt, Human
gccuguccugagugucaugg

SEQ ID NO: 556287 - RNA, 22 nt, Human
ucugggagggagccucagaauc

SEQ ID NO: 556288 - RNA, 22 nt, Human
uuccaguugguagaauguaagg

SEQ ID NO: 556289 - RNA, 22 nt, Human
ucacaggguguacaucaccuau

SEQ ID NO: 556290 - RNA, 22 nt, Human
agaaauacaaaguacuaagaua

SEQ ID NO: 556291 - RNA, 22 nt, Human
aggaucaaguugguugagcuuu

SEQ ID NO: 556292 - RNA, 22 nt, Human
ucagaggagggacucagaccca

SEQ ID NO: 556293 - RNA, 22 nt, Human
uuauaauucuggcauaggcugu

SEQ ID NO: 556294 - RNA, 22 nt, Human
ccagguggauaagguuucugga

SEQ ID NO: 556295 - RNA, 22 nt, Human
gggcagugucggggcccaggga

SEQ ID NO: 556296 - RNA, 19 nt, Human
ccugcagggaugagagguu

SEQ ID NO: 556297 - RNA, 22 nt, Human
ccuuucucuuugcugaucaugu

SEQ ID NO: 556298 - RNA, 22 nt, Human
ugccagaagauucucuaucaga

SEQ ID NO: 556299 - RNA, 22 nt, Human
ugucccagauacuggacauaga

SEQ ID NO: 556300 - RNA, 22 nt, Human
aggggugugcauccuggaggau

SEQ ID NO: 556301 - RNA, 20 nt, Human
ucagugauuuugaagaggaa

SEQ ID NO: 556302 - RNA, 22 nt, Human
ggggcucaguucggacagccug

SEQ ID NO: 556303 - RNA, 22 nt, Human
gagaaggggugauguggguaau

SEQ ID NO: 556304 - RNA, 22 nt, Human
gcagcacacgguggugcccugg

SEQ ID NO: 556305 - RNA, 22 nt, Human
uuuaugagcaaugcugagggga

SEQ ID NO: 556306 - RNA, 22 nt, Human
agaagccagaggcaguggguac

SEQ ID NO: 556307 - RNA, 22 nt, Human
uuagaaguaaggucagauuucu

SEQ ID NO: 556308 - RNA, 22 nt, Human
uuaguacauugauucauuaugu

SEQ ID NO: 556309 - RNA, 22 nt, Human
gugggcuggacccuccugcucc

SEQ ID NO: 556310 - RNA, 23 nt, Human
ggagacaagguaccacguuaaca

SEQ ID NO: 556311 - RNA, 21 nt, Human
gagugggcugagauggggcug

SEQ ID NO: 556312 - RNA, 22 nt, Human
ugucaguucagugauuacaaaa

SEQ ID NO: 556313 - RNA, 22 nt, Human
guggcaggucccauuggagcag

SEQ ID NO: 556314 - RNA, 22 nt, Human
ugcugagaggaaggugcacugg

SEQ ID NO: 556315 - RNA, 22 nt, Human
ccugggcauaaaucacuccaag

SEQ ID NO: 556316 - RNA, 22 nt, Human
augugacaauauuuggucuuau

SEQ ID NO: 556317 - RNA, 22 nt, Human
cuuuauguccaccagacugcaa

SEQ ID NO: 556318 - RNA, 18 nt, Human
aaggcacaggagaacauu

SEQ ID NO: 556319 - RNA, 22 nt, Human
ucagcaggcgguuccuuguggg

SEQ ID NO: 556320 - RNA, 22 nt, Human
cacaguuuuaucuuauacugau

SEQ ID NO: 556321 - RNA, 22 nt, Human
aaucuguauugcucauacuuga

SEQ ID NO: 556322 - RNA, 22 nt, Human
cacagguguucuugcagugaaa

SEQ ID NO: 556323 - RNA, 22 nt, Human
auucugaggacagagucuagca

SEQ ID NO: 556324 - RNA, 22 nt, Human
aguggagcaggcggcgcucacu

SEQ ID NO: 556325 - RNA, 23 nt, Human
agugaucuguguuugaagaaugc

SEQ ID NO: 556326 - RNA, 22 nt, Human
agggguggagaguguugccagu

SEQ ID NO: 556327 - RNA, 22 nt, Human
cuuuccuagaaauauauacuua

SEQ ID NO: 556328 - RNA, 22 nt, Human
cacuggaauucaagauacugag

SEQ ID NO: 556329 - RNA, 22 nt, Human
augcaguguuuggaagcuuaag

SEQ ID NO: 556330 - RNA, 22 nt, Human
cccaggucuaugccagcucuga

SEQ ID NO: 556331 - RNA, 22 nt, Human
agcucuguguucacagcacuaa

SEQ ID NO: 556332 - RNA, 20 nt, Human
acugccuugguucaguaggu

SEQ ID NO: 556333 - RNA, 22 nt, Human
uaaguuagcccuauuaaauuaa

SEQ ID NO: 556334 - RNA, 22 nt, Human
uggcugcagacaccuauggcag

SEQ ID NO: 556335 - RNA, 22 nt, Human
guuuaagaaaauucauguuguu

SEQ ID NO: 556336 - RNA, 21 nt, Human
ucauuucagggccuuggcuuc

SEQ ID NO: 556337 - RNA, 22 nt, Human
acagaggucauggagaguucuc

SEQ ID NO: 556338 - RNA, 22 nt, Human
ucugagagcaggaggagcugcu

SEQ ID NO: 556339 - RNA, 20 nt, Human
gacaggagaguuagguaggu

SEQ ID NO: 556340 - RNA, 22 nt, Human
gagcugggaguuauagcauguu

SEQ ID NO: 556341 - RNA, 22 nt, Human
aggagaggucucccuuccccag

SEQ ID NO: 556342 - RNA, 22 nt, Human
ucacaugcuacugagccagacc

SEQ ID NO: 556343 - RNA, 22 nt, Human
aguaugaagauuauaauuuuuc

SEQ ID NO: 556344 - RNA, 22 nt, Human
ggccaggagauggacaccacau

SEQ ID NO: 556345 - RNA, 18 nt, Human
agcagagcccaugcauuc

SEQ ID NO: 556346 - RNA, 22 nt, Human
cuucaaaugugauuuuaauaac

SEQ ID NO: 556347 - RNA, 22 nt, Human
caggggaaggagccuugaaacu

SEQ ID NO: 556348 - RNA, 22 nt, Human
ucagaggauagaaauacuuauu

SEQ ID NO: 556349 - RNA, 22 nt, Human
cacagugucugugcuucagugu

SEQ ID NO: 556350 - RNA, 22 nt, Human
uccaggcccacucagcugaaau

SEQ ID NO: 556351 - RNA, 23 nt, Human
gcugcagcuguggauguucucag

SEQ ID NO: 556352 - RNA, 22 nt, Human
acacaugcauaagccuucccuu

SEQ ID NO: 556353 - RNA, 22 nt, Human
cccagcucuuuuagcggcaucu

SEQ ID NO: 556354 - RNA, 22 nt, Human
gccccacagccugcggucucag

SEQ ID NO: 556355 - RNA, 22 nt, Human
uccuugaaaaucuugguuuaga

SEQ ID NO: 556356 - RNA, 22 nt, Human
uauauaauuuguaaaagcaccu

SEQ ID NO: 556357 - RNA, 22 nt, Human
agggccugcucuaucacucuca

SEQ ID NO: 556358 - RNA, 22 nt, Human
cagggcuccccgcaccgcagcc

SEQ ID NO: 556359 - RNA, 22 nt, Human
aaagugaugaacucugugaccu

SEQ ID NO: 556360 - RNA, 22 nt, Human
auaacuucagggcugugacaga

SEQ ID NO: 556361 - RNA, 22 nt, Human
cuaggaggcgggggcugcagua

SEQ ID NO: 556362 - RNA, 22 nt, Human
ccugggaagagcugacaggagg

SEQ ID NO: 556363 - RNA, 22 nt, Human
gaaggaagcugucuggaugugu

SEQ ID NO: 556364 - RNA, 22 nt, Human
gccuuucaguuccaucaaagga

SEQ ID NO: 556365 - RNA, 22 nt, Human
acuucaugaacuaagggaucgg

SEQ ID NO: 556366 - RNA, 22 nt, Human
cagagcugucauuugccaguga

SEQ ID NO: 556367 - RNA, 22 nt, Human
ccugggagugugccaucucugu

SEQ ID NO: 556368 - RNA, 22 nt, Human
cuuccuaaaagcuucaagagaa

SEQ ID NO: 556369 - RNA, 22 nt, Human
ucauuaaauguuuguugugcca

SEQ ID NO: 556370 - RNA, 22 nt, Human
cucaaauauaagcuaaaugugg

SEQ ID NO: 556371 - RNA, 22 nt, Human
ugaaaauuuccaucaguuauau

SEQ ID NO: 556372 - RNA, 22 nt, Human
auaugcauuuaccuggcauaua

SEQ ID NO: 556373 - RNA, 22 nt, Human
uaacagcaguccucuucucaug

SEQ ID NO: 556374 - RNA, 22 nt, Human
uaauuuuacuuccugagcaccu

SEQ ID NO: 556375 - RNA, 22 nt, Human
ggacaggaugcugaagaugaag

SEQ ID NO: 556376 - RNA, 22 nt, Human
gguggguauugaauacaggugu

SEQ ID NO: 556377 - RNA, 22 nt, Human
gcaggcucagagcagauuagca

SEQ ID NO: 556378 - RNA, 22 nt, Human
acagagguaggacaugagauau

SEQ ID NO: 556379 - RNA, 22 nt, Human
aauagcaaacagacaugcacaa

SEQ ID NO: 556380 - RNA, 22 nt, Human
gaacuuaguagucuacuucuua

SEQ ID NO: 556381 - RNA, 22 nt, Human
acauucuauagcaagcugaucu

SEQ ID NO: 556382 - RNA, 22 nt, Human
uucaguauacauuaucuaauug

SEQ ID NO: 556383 - RNA, 22 nt, Human
agcuguccuggcucaggcugug

SEQ ID NO: 556384 - RNA, 22 nt, Human
ccuggggagaagagcuuccccc

SEQ ID NO: 556385 - RNA, 22 nt, Human
ucuuucuuaaauagguggauug

SEQ ID NO: 556386 - RNA, 23 nt, Human
acaggcucuuaaucagugcuccu

SEQ ID NO: 556387 - RNA, 22 nt, Human
aaaucaguuaagaugaggccau

SEQ ID NO: 556388 - RNA, 22 nt, Human
aaaguuagucagaaccagccau

SEQ ID NO: 556389 - RNA, 22 nt, Human
cugggggcaagcagacagcugu

SEQ ID NO: 556390 - RNA, 22 nt, Human
gccuucccucucauccugcugg

SEQ ID NO: 556391 - RNA, 22 nt, Human
cacugccuggaaggagagacau

SEQ ID NO: 556392 - RNA, 22 nt, Human
ggagccagaggcugcugcugug

SEQ ID NO: 556393 - RNA, 22 nt, Human
cacagaguggaggcuuggccug

SEQ ID NO: 556394 - RNA, 22 nt, Human
uuaauaaaguaugaauuggaaa

SEQ ID NO: 556395 - RNA, 20 nt, Human
guuugaaaugauugguuggu

SEQ ID NO: 556396 - RNA, 22 nt, Human
auucuucaccauggauaauuug

SEQ ID NO: 556397 - RNA, 22 nt, Human
agggccagcugcagaauuagca

SEQ ID NO: 556398 - RNA, 22 nt, Human
acccgggaggcaggagucauag

SEQ ID NO: 556399 - RNA, 22 nt, Human
cuggggcugcagcgaucuucau

SEQ ID NO: 556400 - RNA, 22 nt, Human
uagaaagugaagguuaauuaau

SEQ ID NO: 556401 - RNA, 22 nt, Human
aggcaggagugacccugacagg

SEQ ID NO: 556402 - RNA, 22 nt, Human
gccaggcaaauuaaggaaugca

SEQ ID NO: 556403 - RNA, 22 nt, Human
uggccagguugggcuuugcagc

SEQ ID NO: 556404 - RNA, 22 nt, Human
agaaaguuuauuccuaucuagc

SEQ ID NO: 556405 - RNA, 22 nt, Human
agcacagccucugguuucugac

SEQ ID NO: 556406 - RNA, 19 nt, Human
ggccuugcucuguggcagc

SEQ ID NO: 556407 - RNA, 22 nt, Human
ucuagauuccuccugcauccug

SEQ ID NO: 556408 - RNA, 22 nt, Human
uggcucugccacuaacuuggua

SEQ ID NO: 556409 - RNA, 22 nt, Human
cggggcuguagcacagcugagc

SEQ ID NO: 556410 - RNA, 22 nt, Human
acugugcaaugaguaauaaacu

SEQ ID NO: 556411 - RNA, 22 nt, Human
ugucccauggauaccaggcuau

SEQ ID NO: 556412 - RNA, 22 nt, Human
uaaacauuuguuauucuuguuu

SEQ ID NO: 556413 - RNA, 22 nt, Human
acccucccauuuccauguagca

SEQ ID NO: 556414 - RNA, 22 nt, Human
agaaauguauagugaauuuuuc

SEQ ID NO: 556415 - RNA, 22 nt, Human
gagaaggacuacacaucuggcc

SEQ ID NO: 556416 - RNA, 22 nt, Human
uuacagugagggugacauuuac

SEQ ID NO: 556417 - RNA, 22 nt, Human
ucuggcucucucaucacccaau

SEQ ID NO: 556418 - RNA, 22 nt, Human
uaucaaauugaggcagcugggg

SEQ ID NO: 556419 - RNA, 22 nt, Human
agcccugccucuccaaugccca

SEQ ID NO: 556420 - RNA, 22 nt, Human
ucaggugggcaguggguugagc

SEQ ID NO: 556421 - RNA, 22 nt, Human
auacuuuuaauuccuucugagu

SEQ ID NO: 556422 - RNA, 22 nt, Human
uugaaacucccuuuugucuagu

SEQ ID NO: 556423 - RNA, 22 nt, Human
cagucagucaauacucuuugag

SEQ ID NO: 556424 - RNA, 22 nt, Human
ugaguucucacccauucuucuu

SEQ ID NO: 556425 - RNA, 22 nt, Human
cugccuggagcauucugaaggu

SEQ ID NO: 556426 - RNA, 22 nt, Human
cuggcgagcaggaggcgacggc

SEQ ID NO: 556427 - RNA, 22 nt, Human
gugauucugccuggaagguccu

SEQ ID NO: 556428 - RNA, 22 nt, Human
uucauaguguuuccuuccagug

SEQ ID NO: 556429 - RNA, 22 nt, Human
gucagcaccucuuuggggagcu

SEQ ID NO: 556430 - RNA, 21 nt, Human
cacaccaaacaggaacaggga

SEQ ID NO: 556431 - RNA, 22 nt, Human
gcagcaugagcuauacaaagua

SEQ ID NO: 556432 - RNA, 22 nt, Human
gaaguuagauguggucacugac

SEQ ID NO: 556433 - RNA, 22 nt, Human
ugaaugaguuuggcugcuguuc

SEQ ID NO: 556434 - RNA, 22 nt, Human
accuccuggugcccaaguguuu

SEQ ID NO: 556435 - RNA, 22 nt, Human
agggccugaggcugacggggag

SEQ ID NO: 556436 - RNA, 22 nt, Human
acacagaagcuuuuucuauucc

SEQ ID NO: 556437 - RNA, 22 nt, Human
gagguacaugaggauacacagg

SEQ ID NO: 556438 - RNA, 22 nt, Human
ucaaaugcaggucuggucuugg

SEQ ID NO: 556439 - RNA, 18 nt, Human
gcagggcugcacacgcau

SEQ ID NO: 556440 - RNA, 22 nt, Human
cuacauaaucuggauuugucug

SEQ ID NO: 556441 - RNA, 22 nt, Human
gacagacauuuccugauccaau

SEQ ID NO: 556442 - RNA, 19 nt, Human
ucugaggguccagaugcau

SEQ ID NO: 556443 - RNA, 22 nt, Human
aggcagcagcuugcugguugcc

SEQ ID NO: 556444 - RNA, 22 nt, Human
ugggaaggcguggaaguagaag

SEQ ID NO: 556445 - RNA, 22 nt, Human
ggccagggccaaggcuuuccca

SEQ ID NO: 556446 - RNA, 22 nt, Human
augaagauaagaccaggcugga

SEQ ID NO: 556447 - RNA, 22 nt, Human
aggaaaagugugaaguauggag

SEQ ID NO: 556448 - RNA, 22 nt, Human
uuauguaauuuguuugcucuuc

SEQ ID NO: 556449 - RNA, 22 nt, Human
gauguacuugccuuaucuaucc

SEQ ID NO: 556450 - RNA, 22 nt, Human
gcuuucucuucacugauguuca

SEQ ID NO: 556451 - RNA, 22 nt, Human
uucuagaaacacaugcaaacag

SEQ ID NO: 556452 - RNA, 22 nt, Human
cuacagaaaaucagccacaggc

SEQ ID NO: 556453 - RNA, 22 nt, Human
cagcauggcuugaguguuuccu

SEQ ID NO: 556454 - RNA, 22 nt, Human
uauucacaugaaaacaaauuuu

SEQ ID NO: 556455 - RNA, 22 nt, Human
ggccacugaccuacaucugggg

SEQ ID NO: 556456 - RNA, 22 nt, Human
ucagggaaugugauacaggaag

SEQ ID NO: 556457 - RNA, 22 nt, Human
uuguuaaauggaugcagaauaa

SEQ ID NO: 556458 - RNA, 22 nt, Human
augucagagcuuccacaauagu

SEQ ID NO: 556459 - RNA, 19 nt, Human
uggaagaggaagggaaaua

SEQ ID NO: 556460 - RNA, 22 nt, Human
agagcuggccagggaucacucu

SEQ ID NO: 556461 - RNA, 22 nt, Human
cugccaaguaaugccugggcuc

SEQ ID NO: 556462 - RNA, 22 nt, Human
aaagcagcuuucggcccucggg

SEQ ID NO: 556463 - RNA, 22 nt, Human
ucuuuccacauucucuguuuag

SEQ ID NO: 556464 - RNA, 20 nt, Human
agcaggugacggggccugcu

SEQ ID NO: 556465 - RNA, 22 nt, Human
uucaagucagagcaagccaagu

SEQ ID NO: 556466 - RNA, 22 nt, Human
aaggcuuuuguuccuauuuagu

SEQ ID NO: 556467 - RNA, 22 nt, Human
ccugggaacagcagaguccugg

SEQ ID NO: 556468 - RNA, 22 nt, Human
gaaaugcauaaucuuaguagau

SEQ ID NO: 556469 - RNA, 22 nt, Human
aucaguuuggugcuuucaguga

SEQ ID NO: 556470 - RNA, 22 nt, Human
uauacaauggcugaaucaucca

SEQ ID NO: 556471 - RNA, 22 nt, Human
ucagcaggguuugacuucuaau

SEQ ID NO: 556472 - RNA, 22 nt, Human
caggaaggcccaccuguccugu

SEQ ID NO: 556473 - RNA, 22 nt, Human
ccagcagcuuuauuggcucucc

SEQ ID NO: 556474 - RNA, 22 nt, Human
guuagguagaaguuuacuuuga

SEQ ID NO: 556475 - RNA, 22 nt, Human
ggucccagcugcucaagaggcu

SEQ ID NO: 556476 - RNA, 22 nt, Human
ccucugccaccucccacgaggc

SEQ ID NO: 556477 - RNA, 22 nt, Human
gcagagaacccagcagauuggc

SEQ ID NO: 556478 - RNA, 21 nt, Human
acagugugcuucucucccucc

SEQ ID NO: 556479 - RNA, 22 nt, Human
ucagagugaggcccagcaaucu

SEQ ID NO: 556480 - RNA, 22 nt, Human
ccugcugugaaacuggcauaug

SEQ ID NO: 556481 - RNA, 23 nt, Human
uucaugaguuggacaagacuggg

SEQ ID NO: 556482 - RNA, 22 nt, Human
ucacugggagaugugggaaggg

SEQ ID NO: 556483 - RNA, 22 nt, Human
uucacauaauccuccaguggca

SEQ ID NO: 556484 - RNA, 22 nt, Human
aggaaggggagaaguuaaagcu

SEQ ID NO: 556485 - RNA, 22 nt, Human
ggaggugaggccguagggugug

SEQ ID NO: 556486 - RNA, 22 nt, Human
uggccuggggaagaccaugggc

SEQ ID NO: 556487 - RNA, 22 nt, Human
agguggggugagcugcagacua

SEQ ID NO: 556488 - RNA, 22 nt, Human
ucucaguguguuuucucucaga

SEQ ID NO: 556489 - RNA, 22 nt, Human
uaggaguaggaguggccauccc

SEQ ID NO: 556490 - RNA, 22 nt, Human
auugucuucuggucuuaucuuu

SEQ ID NO: 556491 - RNA, 22 nt, Human
caugacauuuuaaaaagaacau

SEQ ID NO: 556492 - RNA, 22 nt, Human
uugcucugcaguccagacagua

SEQ ID NO: 556493 - RNA, 22 nt, Human
guucauuuuacuguaaauagca

SEQ ID NO: 556494 - RNA, 22 nt, Human
cugaaggagcauagucaguuuu

SEQ ID NO: 556495 - RNA, 22 nt, Human
cauacaagcgugcaugugcuug

SEQ ID NO: 556496 - RNA, 22 nt, Human
aaaugucuguaugagaaagaga

SEQ ID NO: 556497 - RNA, 22 nt, Human
ucaccaauaauaacuugagaau

SEQ ID NO: 556498 - RNA, 22 nt, Human
ucaaagagcucuaucuucaaaa

SEQ ID NO: 556499 - RNA, 22 nt, Human
gccuggcaggccugggccagca

SEQ ID NO: 556500 - RNA, 22 nt, Human
aaagcauguucugggaauagua

SEQ ID NO: 556501 - RNA, 22 nt, Human
acauuugaaaugccaugugagg

SEQ ID NO: 556502 - RNA, 19 nt, Human
cccuggcaggcaagccugg

SEQ ID NO: 556503 - RNA, 22 nt, Human
acauuucagauucaugaaguga

SEQ ID NO: 556504 - RNA, 22 nt, Human
uucauugucucuguuugccuuc

SEQ ID NO: 556505 - RNA, 22 nt, Human
cauugcuguuaauugucucuag

SEQ ID NO: 556506 - RNA, 22 nt, Human
cugggagggguagccaauccua

SEQ ID NO: 556507 - RNA, 22 nt, Human
aggcccugcccagagcuccucg

SEQ ID NO: 556508 - RNA, 22 nt, Human
ggcugcugaguuggccaggaga

SEQ ID NO: 556509 - RNA, 22 nt, Human
ggcucuggaaaguguccuugau

SEQ ID NO: 556510 - RNA, 22 nt, Human
ccaggcucuaucccuccuucuu

SEQ ID NO: 556511 - RNA, 22 nt, Human
agaagccaauccuugucucucu

SEQ ID NO: 556512 - RNA, 21 nt, Human
cucuggagucaagagcuucca

SEQ ID NO: 556513 - RNA, 22 nt, Human
gggcugcaaugcuucaguuguu

SEQ ID NO: 556514 - RNA, 22 nt, Human
aaaagucugcucucauuucaga

SEQ ID NO: 556515 - RNA, 22 nt, Human
gccuggguuccaugaucuccag

SEQ ID NO: 556516 - RNA, 22 nt, Human
agcagcugagccccagcuguga

SEQ ID NO: 556517 - RNA, 22 nt, Human
ugggagcugggguuggacgucu

SEQ ID NO: 556518 - RNA, 22 nt, Human
cugaaccacuaauauuuugauu

SEQ ID NO: 556519 - RNA, 22 nt, Human
gccaggcauuuguuaggugcug

SEQ ID NO: 556520 - RNA, 22 nt, Human
ugaagaauaagauagauggagc

SEQ ID NO: 556521 - RNA, 20 nt, Human
uaacauaguccagagaacga

SEQ ID NO: 556522 - RNA, 19 nt, Human
gaggcaguagucaaagcuu

SEQ ID NO: 556523 - RNA, 22 nt, Human
ucagcucacucugcuuccuggg

SEQ ID NO: 556524 - RNA, 22 nt, Human
caaaugaagggagcugaagucu

SEQ ID NO: 556525 - RNA, 22 nt, Human
uuuauucacuggggucugcccg

SEQ ID NO: 556526 - RNA, 22 nt, Human
caacuacauccacacuuuguua

SEQ ID NO: 556527 - RNA, 22 nt, Human
aggcccuggcacugccugggag

SEQ ID NO: 556528 - RNA, 22 nt, Human
auuucacucucccugccacuua

SEQ ID NO: 556529 - RNA, 21 nt, Human
acacauuaugagcauagacuc

SEQ ID NO: 556530 - RNA, 22 nt, Human
ucaaaguagccggauggaauuu

SEQ ID NO: 556531 - RNA, 22 nt, Human
uccguauuugacuauugcaccg

SEQ ID NO: 556532 - RNA, 22 nt, Human
cccuggaguagcacugggucgc

SEQ ID NO: 556533 - RNA, 22 nt, Human
ucccuggacagccuugccuggg

SEQ ID NO: 556534 - RNA, 22 nt, Human
cagggcaguaccgcccucuggc

SEQ ID NO: 556535 - RNA, 22 nt, Human
ccugagagagugagcccugaca

SEQ ID NO: 556536 - RNA, 22 nt, Human
caccagcuacagacuacugugu

SEQ ID NO: 556537 - RNA, 22 nt, Human
uaucagaaaugccuuaaauugg

SEQ ID NO: 556538 - RNA, 22 nt, Human
uggcagcaguagccaccccagc

SEQ ID NO: 556539 - RNA, 21 nt, Human
uccaaaucccauucuguaguc

SEQ ID NO: 556540 - RNA, 22 nt, Human
ccucagaguaggucucagcugu

SEQ ID NO: 556541 - RNA, 22 nt, Human
ccuugaaauguucucacugggg

SEQ ID NO: 556542 - RNA, 22 nt, Human
caguauuuaggauuaggagaga

SEQ ID NO: 556543 - RNA, 22 nt, Human
agggcacccucucugcaguacc

SEQ ID NO: 556544 - RNA, 22 nt, Human
ucagcucggccuaggcccacgg

SEQ ID NO: 556545 - RNA, 22 nt, Human
uugggcuggcagagguggucuu

SEQ ID NO: 556546 - RNA, 22 nt, Human
ugucaugcuuauguuacauacu

SEQ ID NO: 556547 - RNA, 22 nt, Human
cuugcaggcagggccuccugga

SEQ ID NO: 556548 - RNA, 22 nt, Human
gcagagugauggaaugugggug

SEQ ID NO: 556549 - RNA, 22 nt, Human
ccaaaguccauaguuuacuuua

SEQ ID NO: 556550 - RNA, 22 nt, Human
agcccaugcaacaggccuagcg

SEQ ID NO: 556551 - RNA, 22 nt, Human
gacucugugggaggaggcucag

SEQ ID NO: 556552 - RNA, 17 nt, Human
gcuuccucaugcaguuc

SEQ ID NO: 556553 - RNA, 22 nt, Human
acaucuuuauacuaguccuuga

SEQ ID NO: 556554 - RNA, 22 nt, Human
uccuggccugucuggaguagcu

SEQ ID NO: 556555 - RNA, 22 nt, Human
caugggaggccugcugcuggug

SEQ ID NO: 556556 - RNA, 22 nt, Human
gcucugggguuggaaagugauc

SEQ ID NO: 556557 - RNA, 20 nt, Human
gugcuucagaagccauugcu

SEQ ID NO: 556558 - RNA, 22 nt, Human
auccagagacuggggcugggau

SEQ ID NO: 556559 - RNA, 20 nt, Human
gcugaagauucccaugcaag

SEQ ID NO: 556560 - RNA, 22 nt, Human
uuacacaaacacauuccagaua

SEQ ID NO: 556561 - RNA, 22 nt, Human
accuucaagauugugggucaau

SEQ ID NO: 556562 - RNA, 22 nt, Human
gagcaggauggcacuucuguga

SEQ ID NO: 556563 - RNA, 22 nt, Human
agucaguguagaaagcccaggc

SEQ ID NO: 556564 - RNA, 22 nt, Human
caggcuccuucccagggauggu

SEQ ID NO: 556565 - RNA, 22 nt, Human
gaggagaaauuuggggaccuga

SEQ ID NO: 556566 - RNA, 22 nt, Human
uuucauuacguguuugacuugu

SEQ ID NO: 556567 - RNA, 22 nt, Human
caaacuauuguucacaagacaa

SEQ ID NO: 556568 - RNA, 22 nt, Human
agcucuggaagcccugguaguu

SEQ ID NO: 556569 - RNA, 22 nt, Human
ucagggcaccaaaaaagaugcc

SEQ ID NO: 556570 - RNA, 18 nt, Human
cagcugugcccuguuugg

SEQ ID NO: 556571 - RNA, 20 nt, Human
agagccuugaggaagaugau

SEQ ID NO: 556572 - RNA, 22 nt, Human
ccuggagggcgccgcacagucc

SEQ ID NO: 556573 - RNA, 18 nt, Human
cccagcuccacuucccuc

SEQ ID NO: 556574 - RNA, 22 nt, Human
cucugagcugaaacaugagcau

SEQ ID NO: 556575 - RNA, 22 nt, Human
uguucccauggauaucugcaua

SEQ ID NO: 556576 - RNA, 22 nt, Human
ucauugcaggcauuccccugcc

SEQ ID NO: 556577 - RNA, 22 nt, Human
cccagcacucagcaggcucaua

SEQ ID NO: 556578 - RNA, 22 nt, Human
acagaacauauugcuucucuca

SEQ ID NO: 556579 - RNA, 22 nt, Human
gggugaggagcugccagucaug

SEQ ID NO: 556580 - RNA, 22 nt, Human
ucacgagaggcacagaauagag

SEQ ID NO: 556581 - RNA, 20 nt, Human
ccugucucacguuccgcccc

SEQ ID NO: 556582 - RNA, 19 nt, Human
uuagggacaugaauucuag

SEQ ID NO: 556583 - RNA, 22 nt, Human
ggcugucucugugacugccacc

SEQ ID NO: 556584 - RNA, 22 nt, Human
uacuuucuguccuucuguuaaa

SEQ ID NO: 556585 - RNA, 22 nt, Human
agcuugauuucucugcagugug

SEQ ID NO: 556586 - RNA, 22 nt, Human
auaauguacaacugcuuuuaau

SEQ ID NO: 556587 - RNA, 22 nt, Human
uuggugggcacaggggagaagu

SEQ ID NO: 556588 - RNA, 22 nt, Human
uguguacaggccuugcuagacu

SEQ ID NO: 556589 - RNA, 22 nt, Human
guccuuccccagccagcucugg

SEQ ID NO: 556590 - RNA, 22 nt, Human
uggccagccuugucaucgcuuu

SEQ ID NO: 556591 - RNA, 22 nt, Human
cacagaauuuucucuuuacaau

SEQ ID NO: 556592 - RNA, 22 nt, Human
agcugggccugauuugcagggg

SEQ ID NO: 556593 - RNA, 18 nt, Human
ucagggaaucuuggccuu

SEQ ID NO: 556594 - RNA, 22 nt, Human
cagggccugucacgacgcucau

SEQ ID NO: 556595 - RNA, 17 nt, Human
ucugcagaggcaaaccu

SEQ ID NO: 556596 - RNA, 22 nt, Human
uucuuaagaggguuaagugaag

SEQ ID NO: 556597 - RNA, 22 nt, Human
uggggcucuccacagugucuca

SEQ ID NO: 556598 - RNA, 19 nt, Human
agggccugcagcucaagcu

SEQ ID NO: 556599 - RNA, 22 nt, Human
gaugggcugucugagcgcugug

SEQ ID NO: 556600 - RNA, 22 nt, Human
gugcccugaugcaauugucuca

SEQ ID NO: 556601 - RNA, 23 nt, Human
ugagggacaugguggcuucugag

SEQ ID NO: 556602 - RNA, 22 nt, Human
cuggaaugccucccugucagag

SEQ ID NO: 556603 - RNA, 22 nt, Human
uaaggcacuucaauguuuagaa

SEQ ID NO: 556604 - RNA, 22 nt, Human
gaauguuuuucaaaccuguggc

SEQ ID NO: 556605 - RNA, 22 nt, Human
uggcacugccuggcagggcccc

SEQ ID NO: 556606 - RNA, 22 nt, Human
ccuguguggaaaccgcaugacg

SEQ ID NO: 556607 - RNA, 22 nt, Human
aaaguuuuauucaagcauuagu

SEQ ID NO: 556608 - RNA, 22 nt, Human
agugaguggacccugcaaggaa

SEQ ID NO: 556609 - RNA, 22 nt, Human
uggcugagugaacauguccauu

SEQ ID NO: 556610 - RNA, 22 nt, Human
guauguguaaguaugccaccuu

SEQ ID NO: 556611 - RNA, 22 nt, Human
aggccugaggaccuucuggagg

SEQ ID NO: 556612 - RNA, 22 nt, Human
ucuucaugaccucuguguuuua

SEQ ID NO: 556613 - RNA, 22 nt, Human
ugaaacuuauaagaauaugaau

SEQ ID NO: 556614 - RNA, 22 nt, Human
cagccucuguggcugccacacc

SEQ ID NO: 556615 - RNA, 22 nt, Human
uccagccacucagcagggauug

SEQ ID NO: 556616 - RNA, 22 nt, Human
uguggggcugucaggcaacugg

SEQ ID NO: 556617 - RNA, 22 nt, Human
cugagcugggaguagagacucu

SEQ ID NO: 556618 - RNA, 22 nt, Human
gagguuccccauuguacuggcu

SEQ ID NO: 556619 - RNA, 22 nt, Human
uaaaggguagguuuuacuguaa

SEQ ID NO: 556620 - RNA, 22 nt, Human
ucugggugcccuuugcucuguu

SEQ ID NO: 556621 - RNA, 22 nt, Human
uugugaauagugccgcaauaaa

SEQ ID NO: 556622 - RNA, 22 nt, Human
ccaggcagcaaauuuucugaau

SEQ ID NO: 556623 - RNA, 22 nt, Human
acaaguaccaaaugcucaagua

SEQ ID NO: 556624 - RNA, 18 nt, Human
ccugccagucuggagcag

SEQ ID NO: 556625 - RNA, 22 nt, Human
guauacauagaugaugaacaag

SEQ ID NO: 556626 - RNA, 22 nt, Human
ugcagcaggcacaggacggaag

SEQ ID NO: 556627 - RNA, 22 nt, Human
uggaacacugaucauugccuuu

SEQ ID NO: 556628 - RNA, 22 nt, Human
auuucuuaucugaggucuacau

SEQ ID NO: 556629 - RNA, 22 nt, Human
uggaggaaguugcuggaaguca

SEQ ID NO: 556630 - RNA, 22 nt, Human
cauuuugugcuagacacuaugg

SEQ ID NO: 556631 - RNA, 20 nt, Human
ggcugcaggacucauuggcu

SEQ ID NO: 556632 - RNA, 22 nt, Human
cgcuaggauuaggauuaauccu

SEQ ID NO: 556633 - RNA, 21 nt, Human
ugcugccauagaccugaggga

SEQ ID NO: 556634 - RNA, 22 nt, Human
uagaacagaguuccagugauca

SEQ ID NO: 556635 - RNA, 22 nt, Human
ccugccugaaggucagccaccc

SEQ ID NO: 556636 - RNA, 22 nt, Human
acaugauuggacuccuuccccu

SEQ ID NO: 556637 - RNA, 22 nt, Human
ggccaggcgaugaccccuccac

SEQ ID NO: 556638 - RNA, 22 nt, Human
uuggugggagagaugaggguug

SEQ ID NO: 556639 - RNA, 22 nt, Human
guguccuuauuucugucucuca

SEQ ID NO: 556640 - RNA, 22 nt, Human
ucucuuaaaagauuuuaaugac

SEQ ID NO: 556641 - RNA, 22 nt, Human
agugccaggagcaaggagcucc

SEQ ID NO: 556642 - RNA, 22 nt, Human
cucugggcuccuucagcccuuu

SEQ ID NO: 556643 - RNA, 22 nt, Human
gcugugcccagcuccagcucug

SEQ ID NO: 556644 - RNA, 22 nt, Human
gaacuauucauucucauuagcg

SEQ ID NO: 556645 - RNA, 22 nt, Human
acagaauuaaaguguuugugga

SEQ ID NO: 556646 - RNA, 22 nt, Human
caguacuugggggguucuaagu

SEQ ID NO: 556647 - RNA, 20 nt, Human
gcaaauggaucccacaagcc

SEQ ID NO: 556648 - RNA, 23 nt, Human
gcccugcuacucacaagcugugu

SEQ ID NO: 556649 - RNA, 22 nt, Human
uguuucuuuguagauauucuuu

SEQ ID NO: 556650 - RNA, 22 nt, Human
uucaggaucauuuguuuuaucu

SEQ ID NO: 556651 - RNA, 22 nt, Human
acaggcucucuauugagugcag

SEQ ID NO: 556652 - RNA, 22 nt, Human
uguacauugucacucaucaagu

SEQ ID NO: 556653 - RNA, 19 nt, Human
agaaguuagacauugcaau

SEQ ID NO: 556654 - RNA, 22 nt, Human
gcucccaguucccaaagugacc

SEQ ID NO: 556655 - RNA, 22 nt, Human
ucaggaaguuuugaaucaacug

SEQ ID NO: 556656 - RNA, 22 nt, Human
cuggcagggugggcuuugcuuu

SEQ ID NO: 556657 - RNA, 22 nt, Human
gccugcagcugcuuccacacac

SEQ ID NO: 556658 - RNA, 21 nt, Human
ugggagagggcucagcuaccc

SEQ ID NO: 556659 - RNA, 22 nt, Human
uaauccacaauagagauuaucu

SEQ ID NO: 556660 - RNA, 22 nt, Human
augggaggcaggcucagaaccg

SEQ ID NO: 556661 - RNA, 22 nt, Human
gcuggggucugugaggagggcu

SEQ ID NO: 556662 - RNA, 22 nt, Human
agagccaggaucuguuuugggg

SEQ ID NO: 556663 - RNA, 22 nt, Human
agccaccaccacugaaagguua

SEQ ID NO: 556664 - RNA, 22 nt, Human
ugcccccuuuucuuguuacacu

SEQ ID NO: 556665 - RNA, 22 nt, Human
gcagauggagacgagguuccgc

SEQ ID NO: 556666 - RNA, 22 nt, Human
gagcccaggcagagguugcagu

SEQ ID NO: 556667 - RNA, 22 nt, Human
aacaacuugcguucagagaugu

SEQ ID NO: 556668 - RNA, 22 nt, Human
uaagacaauucuucagucacaa

SEQ ID NO: 556669 - RNA, 21 nt, Human
ugggcgcuugaccucugcacu

SEQ ID NO: 556670 - RNA, 22 nt, Human
gaagacuuuaagccgagauuag

SEQ ID NO: 556671 - RNA, 22 nt, Human
agcugguguccuccuggagcug

SEQ ID NO: 556672 - RNA, 22 nt, Human
aggaagaugugcaaaguuggaa

SEQ ID NO: 556673 - RNA, 22 nt, Human
uuucacauggaagcucucgaga

SEQ ID NO: 556674 - RNA, 22 nt, Human
auacuguuucucuucuacauga

SEQ ID NO: 556675 - RNA, 22 nt, Human
agcagaacauuuucagggcugu

SEQ ID NO: 556676 - RNA, 22 nt, Human
aaagagcuucauuuccauuuau

SEQ ID NO: 556677 - RNA, 22 nt, Human
ccagcuggcacuguggcugccc

SEQ ID NO: 556678 - RNA, 22 nt, Human
acaguguuccuuuguugugacu

SEQ ID NO: 556679 - RNA, 23 nt, Human
ggaaagagaggaguugugcauag

SEQ ID NO: 556680 - RNA, 22 nt, Human
augugaaaaauuucuuauuaca

SEQ ID NO: 556681 - RNA, 22 nt, Human
acauaaauagauuauugggagg

SEQ ID NO: 556682 - RNA, 22 nt, Human
cccugucuguaccgugaugagc

SEQ ID NO: 556683 - RNA, 22 nt, Human
gaggaagccccauugaagccag

SEQ ID NO: 556684 - RNA, 20 nt, Human
agauggugggcuggaacacc

SEQ ID NO: 556685 - RNA, 22 nt, Human
aggcagaaaauagucauccaaa

SEQ ID NO: 556686 - RNA, 22 nt, Human
ugcagaugccugggcugcacca

SEQ ID NO: 556687 - RNA, 22 nt, Human
uacauggguagguuaagucaua

SEQ ID NO: 556688 - RNA, 22 nt, Human
auugucgcuuauuuaggugcuu

SEQ ID NO: 556689 - RNA, 22 nt, Human
cagagccacugucugccaggca

SEQ ID NO: 556690 - RNA, 22 nt, Human
agagcugaggauccagcugagc

SEQ ID NO: 556691 - RNA, 22 nt, Human
gccugcaguucugugcuaggca

SEQ ID NO: 556692 - RNA, 22 nt, Human
ggcagugaacagaaaugcagaa

SEQ ID NO: 556693 - RNA, 22 nt, Human
aauacuggcugucaaagaugga

SEQ ID NO: 556694 - RNA, 22 nt, Human
uggcugaguuccuggcacacgg

SEQ ID NO: 556695 - RNA, 22 nt, Human
uuuaguaaguucacugcaaagc

SEQ ID NO: 556696 - RNA, 22 nt, Human
aguuuuucugggaggcacugcu

SEQ ID NO: 556697 - RNA, 22 nt, Human
caguuauuaugaggucauuagg

SEQ ID NO: 556698 - RNA, 22 nt, Human
uggcucaguuccaucaucugga

SEQ ID NO: 556699 - RNA, 22 nt, Human
uggacuaaagaggaaagaugua

SEQ ID NO: 556700 - RNA, 23 nt, Human
agaggccaacuucuugccccucc

SEQ ID NO: 556701 - RNA, 22 nt, Human
cucugagagugcucagagggua

SEQ ID NO: 556702 - RNA, 22 nt, Human
gccuggcuccuaaggacuggcu

SEQ ID NO: 556703 - RNA, 21 nt, Human
aaaugcuuuguauauaucugu

SEQ ID NO: 556704 - RNA, 22 nt, Human
acuguucuucauuuagcaaaga

SEQ ID NO: 556705 - RNA, 18 nt, Human
aaaggcugaauauagaag

SEQ ID NO: 556706 - RNA, 22 nt, Human
aauagacuuuguauaauuuccc

SEQ ID NO: 556707 - RNA, 22 nt, Human
agaaacuauccugaguagcaaa

SEQ ID NO: 556708 - RNA, 23 nt, Human
ucaguuuuggcuguucaguguug

SEQ ID NO: 556709 - RNA, 22 nt, Human
gccacaugucaugugcucagua

SEQ ID NO: 556710 - RNA, 21 nt, Human
gccucugcugucuuauuguga

SEQ ID NO: 556711 - RNA, 22 nt, Human
ugguccuggaagguccugaggg

SEQ ID NO: 556712 - RNA, 18 nt, Human
gcucaggcccuagucagu

SEQ ID NO: 556713 - RNA, 22 nt, Human
caggauggagaguuguugguug

SEQ ID NO: 556714 - RNA, 22 nt, Human
uguggggacugaguggaggcuu

SEQ ID NO: 556715 - RNA, 22 nt, Human
cuauuagguaugugguugcuau

SEQ ID NO: 556716 - RNA, 22 nt, Human
uaucuuguuuaggugcacaggu

SEQ ID NO: 556717 - RNA, 22 nt, Human
uucaaagugcauguuccucaga

SEQ ID NO: 556718 - RNA, 22 nt, Human
guucauuuuuagaaugcuagua

SEQ ID NO: 556719 - RNA, 22 nt, Human
ugcaugcacuaucuagaugaug

SEQ ID NO: 556720 - RNA, 22 nt, Human
cugagaggggaccaggguguuu

SEQ ID NO: 556721 - RNA, 22 nt, Human
acagacaguaaauaguguggcu

SEQ ID NO: 556722 - RNA, 22 nt, Human
aaagagcuaacauugccgagau

SEQ ID NO: 556723 - RNA, 22 nt, Human
ggaggccaggaaggcucggaga

SEQ ID NO: 556724 - RNA, 22 nt, Human
cacacaugagucuccccauugg

SEQ ID NO: 556725 - RNA, 22 nt, Human
auuaggcagacaacguagccgg

SEQ ID NO: 556726 - RNA, 17 nt, Human
gaaaggaggcaacacug

SEQ ID NO: 556727 - RNA, 22 nt, Human
agcuggggcugcagagaacagg

SEQ ID NO: 556728 - RNA, 19 nt, Human
ccuccugcuagauaugcaa

SEQ ID NO: 556729 - RNA, 22 nt, Human
uccucugcuccaucuuuacugu

SEQ ID NO: 556730 - RNA, 22 nt, Human
ucauuuucaaguuugaacagga

SEQ ID NO: 556731 - RNA, 22 nt, Human
ucagaaaauaacuguuaguuug

SEQ ID NO: 556732 - RNA, 21 nt, Human
gggcgaggccugauguggcuc

SEQ ID NO: 556733 - RNA, 22 nt, Human
gcugagagcaaggacaaagcau

SEQ ID NO: 556734 - RNA, 18 nt, Human
acagacaaaauggaaaug

SEQ ID NO: 556735 - RNA, 22 nt, Human
acugucacuccaacugagucgu

SEQ ID NO: 556736 - RNA, 22 nt, Human
ugggccccagcacgucugggga

SEQ ID NO: 556737 - RNA, 22 nt, Human
uuucuagaaugacucaucugag

SEQ ID NO: 556738 - RNA, 22 nt, Human
auuuccaccggcucaggaaguu

SEQ ID NO: 556739 - RNA, 22 nt, Human
agacuucuuugugagcauuuuc

SEQ ID NO: 556740 - RNA, 20 nt, Human
uaacagaaguagaagugggu

SEQ ID NO: 556741 - RNA, 22 nt, Human
ucaauaaaauuguuuuccuauc

SEQ ID NO: 556742 - RNA, 22 nt, Human
ucagaagccggaagugcuccuc

SEQ ID NO: 556743 - RNA, 22 nt, Human
ccugcaguuuguugugaccccg

SEQ ID NO: 556744 - RNA, 22 nt, Human
agcagggcugcagugugucuuu

SEQ ID NO: 556745 - RNA, 22 nt, Human
uguguucaguaugacauucaca

SEQ ID NO: 556746 - RNA, 22 nt, Human
aucuaauuuucacucauuugcu

SEQ ID NO: 556747 - RNA, 22 nt, Human
cugggcagagcuaacaccugag

SEQ ID NO: 556748 - RNA, 22 nt, Human
ccagagacgucggucagggcgc

SEQ ID NO: 556749 - RNA, 22 nt, Human
guucuucaucauuaacacucug

SEQ ID NO: 556750 - RNA, 22 nt, Human
aacauuucuucugaaacugagu

SEQ ID NO: 556751 - RNA, 22 nt, Human
acugcagccuuugggcucauaa

SEQ ID NO: 556752 - RNA, 22 nt, Human
caggcugcagugcaguggcuau

SEQ ID NO: 556753 - RNA, 22 nt, Human
cauggcccucuucuggagcaau

SEQ ID NO: 556754 - RNA, 22 nt, Human
aacucaguucuuuccacaaugc

SEQ ID NO: 556755 - RNA, 21 nt, Human
ugggccugucccucuuggagg

SEQ ID NO: 556756 - RNA, 22 nt, Human
uuccagaaaaaaauguauaucu

SEQ ID NO: 556757 - RNA, 22 nt, Human
ucugguaaccuuuaucccuccu

SEQ ID NO: 556758 - RNA, 22 nt, Human
gaguuaauguguacacaaaggg

SEQ ID NO: 556759 - RNA, 22 nt, Human
ccugggaggcuguuuccagccu

SEQ ID NO: 556760 - RNA, 22 nt, Human
ugcaggcuggcagugcugaaau

SEQ ID NO: 556761 - RNA, 19 nt, Human
agacagagcucaguggguu

SEQ ID NO: 556762 - RNA, 22 nt, Human
cugagcugggcucucuugaggg

SEQ ID NO: 556763 - RNA, 22 nt, Human
aaggcuuucagcuaacuugauu

SEQ ID NO: 556764 - RNA, 22 nt, Human
aaagacugguguguuacauaua

SEQ ID NO: 556765 - RNA, 22 nt, Human
uuuaguagaaugauacagggca

SEQ ID NO: 556766 - RNA, 22 nt, Human
ggguuggggcccagcagucugc

SEQ ID NO: 556767 - RNA, 22 nt, Human
ccagggcaucacauccaguguu

SEQ ID NO: 556768 - RNA, 22 nt, Human
aauagcucacugauuucucuuu

SEQ ID NO: 556769 - RNA, 22 nt, Human
caggcugacaacugagcauuuu

SEQ ID NO: 556770 - RNA, 22 nt, Human
acuuaaaaacagauccagcagg

SEQ ID NO: 556771 - RNA, 18 nt, Human
uggagcugagugcugugc

SEQ ID NO: 556772 - RNA, 21 nt, Human
aaucaaaugucauauccccag

SEQ ID NO: 556773 - RNA, 22 nt, Human
gcaggggcuaaggacacagaga

SEQ ID NO: 556774 - RNA, 22 nt, Human
caguggaaacuaugcugcugga

SEQ ID NO: 556775 - RNA, 22 nt, Human
ucccagaggucucugcugguuc

SEQ ID NO: 556776 - RNA, 22 nt, Human
cuucuuuuacaggucuuggguu

SEQ ID NO: 556777 - RNA, 22 nt, Human
ugugggcucuaauggcagcaga

SEQ ID NO: 556778 - RNA, 22 nt, Human
cagccuccugggacacucaccg

SEQ ID NO: 556779 - RNA, 22 nt, Human
aaagcagucucagacuuaagca

SEQ ID NO: 556780 - RNA, 17 nt, Human
agaguuuuaagaaauuu

SEQ ID NO: 556781 - RNA, 23 nt, Human
acugggaaguuuggagagacgca

SEQ ID NO: 556782 - RNA, 22 nt, Human
uuuuccucuguauuugaaaugc

SEQ ID NO: 556783 - RNA, 22 nt, Human
ugacauuucuuguugauauaaa

SEQ ID NO: 556784 - RNA, 22 nt, Human
agggcaaggguugaagauaaga

SEQ ID NO: 556785 - RNA, 22 nt, Human
ggagaugcuuuccaguggggau

SEQ ID NO: 556786 - RNA, 22 nt, Human
agagaagggccuguauguaauc

SEQ ID NO: 556787 - RNA, 22 nt, Human
ucuucaaagaauuuuaguaauu

SEQ ID NO: 556788 - RNA, 22 nt, Human
uggcagggugggcuucagcccc

SEQ ID NO: 556789 - RNA, 22 nt, Human
cuggcucugggccucagacacu

SEQ ID NO: 556790 - RNA, 22 nt, Human
acuuuguuuccauauuuguagc

SEQ ID NO: 556791 - RNA, 22 nt, Human
gcagggccuuagcagcggcugc

SEQ ID NO: 556792 - RNA, 20 nt, Human
cagggcacacugcagccucg

SEQ ID NO: 556793 - RNA, 22 nt, Human
ucucagggccccaaaggcuagu

SEQ ID NO: 556794 - RNA, 22 nt, Human
ccagcuucucucugaugcagcu

SEQ ID NO: 556795 - RNA, 22 nt, Human
cuggggcucacuccagcccugg

SEQ ID NO: 556796 - RNA, 22 nt, Human
acauauaagggaucagugacag

SEQ ID NO: 556797 - RNA, 22 nt, Human
caacaguuuauaguguuaucuu

SEQ ID NO: 556798 - RNA, 22 nt, Human
uucuuauuucccccuucaucau

SEQ ID NO: 556799 - RNA, 22 nt, Human
aaaaucacacaaguagaugggg

SEQ ID NO: 556800 - RNA, 22 nt, Human
gccaggcucagcagucaaccug

SEQ ID NO: 556801 - RNA, 22 nt, Human
ccaaaguccacaguuuacauua

SEQ ID NO: 556802 - RNA, 22 nt, Human
agucucaggcagaggaaggcua

SEQ ID NO: 556803 - RNA, 22 nt, Human
aaagguaaaguaucugcccaag

SEQ ID NO: 556804 - RNA, 22 nt, Human
cagcaaagguagaagcacagga

SEQ ID NO: 556805 - RNA, 22 nt, Human
cuggucugagggcucuugaggc

SEQ ID NO: 556806 - RNA, 22 nt, Human
ggcuggcacugaggagagcucu

SEQ ID NO: 556807 - RNA, 22 nt, Human
ggccuuccuucccagccuacug

SEQ ID NO: 556808 - RNA, 22 nt, Human
uuagaaaacauaagugguaaag

SEQ ID NO: 556809 - RNA, 22 nt, Human
caagauggacauaaggagagaa

SEQ ID NO: 556810 - RNA, 22 nt, Human
agggccuggcgcguggccgccg

SEQ ID NO: 556811 - RNA, 22 nt, Human
ucacauuuuccuugguaucugu

SEQ ID NO: 556812 - RNA, 22 nt, Human
agauuucaaugugagcauuagu

SEQ ID NO: 556813 - RNA, 22 nt, Human
acuuuucugcagaugaucucuu

SEQ ID NO: 556814 - RNA, 22 nt, Human
uaacagaagaugaaacuucuuu

SEQ ID NO: 556815 - RNA, 22 nt, Human
uacacauuagugagguauuuug

SEQ ID NO: 556816 - RNA, 18 nt, Human
ccgggcuuuggugacaca

SEQ ID NO: 556817 - RNA, 22 nt, Human
uuuccuaagguagugauaauuu

SEQ ID NO: 556818 - RNA, 20 nt, Human
gagccugggaagucuaaggu

SEQ ID NO: 556819 - RNA, 19 nt, Human
ucuguucacauuguuucgc

SEQ ID NO: 556820 - RNA, 22 nt, Human
caucaaauacuacauggguugg

SEQ ID NO: 556821 - RNA, 22 nt, Human
cugcccugaccugccucagagu

SEQ ID NO: 556822 - RNA, 22 nt, Human
agggccagagucuguguagaua

SEQ ID NO: 556823 - RNA, 22 nt, Human
cagguaggcagccggucucugg

SEQ ID NO: 556824 - RNA, 22 nt, Human
gcacaaacugcaauuacuuuug

SEQ ID NO: 556825 - RNA, 22 nt, Human
aagaucaaguguacuuuaugua

SEQ ID NO: 556826 - RNA, 22 nt, Human
acugccugccuuccagguacug

SEQ ID NO: 556827 - RNA, 22 nt, Human
aacagugauaucaagacagaca

SEQ ID NO: 556828 - RNA, 22 nt, Human
caggaggcuccuagggcucugu

SEQ ID NO: 556829 - RNA, 22 nt, Human
ucagagccaaucauggugcauu

SEQ ID NO: 556830 - RNA, 22 nt, Human
cuggagccacuuuuuauccuuu

SEQ ID NO: 556831 - RNA, 22 nt, Human
uugauuuuuuucuacuaugcgc

SEQ ID NO: 556832 - RNA, 18 nt, Human
aguuccuuaaauuggugu

SEQ ID NO: 556833 - RNA, 23 nt, Human
gccucugcagccuaguuaguguc

SEQ ID NO: 556834 - RNA, 22 nt, Human
auaauauaauccuacuucccau

SEQ ID NO: 556835 - RNA, 22 nt, Human
gugccugugcggacucagggaa

SEQ ID NO: 556836 - RNA, 22 nt, Human
agguggcucugacagcucuggu

SEQ ID NO: 556837 - RNA, 22 nt, Human
cuuuucuuauguggacguaccu

SEQ ID NO: 556838 - RNA, 22 nt, Human
cucuggccugcuuccucaggua

SEQ ID NO: 556839 - RNA, 22 nt, Human
aaugauguauguauaaggcagg

SEQ ID NO: 556840 - RNA, 22 nt, Human
guaaaucccauccuuucucugg

SEQ ID NO: 556841 - RNA, 22 nt, Human
ugauuacaguauuugagaucca

SEQ ID NO: 556842 - RNA, 22 nt, Human
ugcucuguauucuauggcaguu

SEQ ID NO: 556843 - RNA, 22 nt, Human
uuucaguguaagguuuccagga

SEQ ID NO: 556844 - RNA, 22 nt, Human
ugcugaguacucuccuguguag

SEQ ID NO: 556845 - RNA, 22 nt, Human
ucuguuucuccaacauugugag

SEQ ID NO: 556846 - RNA, 22 nt, Human
acagaaguguguguguaggaau

SEQ ID NO: 556847 - RNA, 21 nt, Human
aggguggcucugggucagaac

SEQ ID NO: 556848 - RNA, 22 nt, Human
gcugucuguggugucagcugac

SEQ ID NO: 556849 - RNA, 21 nt, Human
agcagaggcugccuggugacu

SEQ ID NO: 556850 - RNA, 23 nt, Human
ucucaagaggaagcagggcucau

SEQ ID NO: 556851 - RNA, 22 nt, Human
cuaaaugacuuccagugguuau

SEQ ID NO: 556852 - RNA, 22 nt, Human
acagccaggaauucuggagaag

SEQ ID NO: 556853 - RNA, 22 nt, Human
aauguguacaugacagauagaa

SEQ ID NO: 556854 - RNA, 22 nt, Human
gaaaugcagaaccugagaccau

SEQ ID NO: 556855 - RNA, 22 nt, Human
cagaagcauuccagcaaauagu

SEQ ID NO: 556856 - RNA, 22 nt, Human
ccagggcauccucacaucgcag

SEQ ID NO: 556857 - RNA, 22 nt, Human
uugaaagucacaauggcauuaa

SEQ ID NO: 556858 - RNA, 22 nt, Human
caagaaggcuauaugggccagg

SEQ ID NO: 556859 - RNA, 17 nt, Human
accaggcaacacgccca

SEQ ID NO: 556860 - RNA, 22 nt, Human
ggcucagcacagggcuggcauc

SEQ ID NO: 556861 - RNA, 22 nt, Human
uggcucuggggacaguaagucc

SEQ ID NO: 556862 - RNA, 22 nt, Human
aagggcuggaucucucugagca

SEQ ID NO: 556863 - RNA, 22 nt, Human
cugugcuuccaggauggcagcu

SEQ ID NO: 556864 - RNA, 22 nt, Human
cucagggccaaggaugcuguug

SEQ ID NO: 556865 - RNA, 22 nt, Human
ggccugagucccaccuggcugu

SEQ ID NO: 556866 - RNA, 22 nt, Human
cacauuuuuacugccaacuuaa

SEQ ID NO: 556867 - RNA, 22 nt, Human
ucugccugcgcucacggggccg

SEQ ID NO: 556868 - RNA, 22 nt, Human
guccugcuggcuucaggagauu

SEQ ID NO: 556869 - RNA, 22 nt, Human
ggaaaucaaggggacaaauugu

SEQ ID NO: 556870 - RNA, 22 nt, Human
gcagggaagacccggagcagcg

SEQ ID NO: 556871 - RNA, 22 nt, Human
uucuucaaaguccuuauuccuu

SEQ ID NO: 556872 - RNA, 22 nt, Human
aaguacaacgcauacagagaaa

SEQ ID NO: 556873 - RNA, 22 nt, Human
aggcagucagcccugcuagggu

SEQ ID NO: 556874 - RNA, 22 nt, Human
gggcaggggucaguggccccaa

SEQ ID NO: 556875 - RNA, 22 nt, Human
uccccugcagaugagggcagug

SEQ ID NO: 556876 - RNA, 22 nt, Human
gagauggcuugcucucacgugg

SEQ ID NO: 556877 - RNA, 22 nt, Human
gcugggaagagaugcacaugau

SEQ ID NO: 556878 - RNA, 22 nt, Human
cuucagaggggacucaaaguca

SEQ ID NO: 556879 - RNA, 23 nt, Human
cccuggccuuggggcacaggcug

SEQ ID NO: 556880 - RNA, 21 nt, Human
ccagaggccucucuuggccac

SEQ ID NO: 556881 - RNA, 22 nt, Human
uucauugugaacacauucugcc

SEQ ID NO: 556882 - RNA, 22 nt, Human
ccagggguuggagguugcagug

SEQ ID NO: 556883 - RNA, 22 nt, Human
acuaaauaguuuugacagaaca

SEQ ID NO: 556884 - RNA, 22 nt, Human
uccuggaggggacagcaugggc

SEQ ID NO: 556885 - RNA, 22 nt, Human
aaaugucagaaaacauggagug

SEQ ID NO: 556886 - RNA, 23 nt, Human
gcaguggaaugucucuguuugga

SEQ ID NO: 556887 - RNA, 22 nt, Human
gaccagagaaaggcacuggaag

SEQ ID NO: 556888 - RNA, 22 nt, Human
acugccuugaaagauuguugag

SEQ ID NO: 556889 - RNA, 22 nt, Human
gucaaauauuaugcagcuugga

SEQ ID NO: 556890 - RNA, 22 nt, Human
aaagaaggaugggagaaauccu

SEQ ID NO: 556891 - RNA, 22 nt, Human
caaagcuuggagaagcagcugg

SEQ ID NO: 556892 - RNA, 22 nt, Human
acaagagacaagagguucuucu

SEQ ID NO: 556893 - RNA, 22 nt, Human
gucucugccuggggggaucaga

SEQ ID NO: 556894 - RNA, 22 nt, Human
caguggguccuaaguacaguuc

SEQ ID NO: 556895 - RNA, 19 nt, Human
aauguaguguuaugucaac

SEQ ID NO: 556896 - RNA, 22 nt, Human
ccuggagcccaaggcagugaga

SEQ ID NO: 556897 - RNA, 22 nt, Human
cuuggaggaaaggcagggagac

SEQ ID NO: 556898 - RNA, 21 nt, Human
uccuccuggccaggcggcccc

SEQ ID NO: 556899 - RNA, 22 nt, Human
guggagaccuccuaggaugugu

SEQ ID NO: 556900 - RNA, 22 nt, Human
auccaaaucaugucagaagaac

SEQ ID NO: 556901 - RNA, 22 nt, Human
auggagacgcaagggaccuagg

SEQ ID NO: 556902 - RNA, 22 nt, Human
auuuguaauuucuuaucugugu

SEQ ID NO: 556903 - RNA, 22 nt, Human
cucaggaugucggugacuauug

SEQ ID NO: 556904 - RNA, 22 nt, Human
uaaagcagugguucucaaacuu

SEQ ID NO: 556905 - RNA, 22 nt, Human
uuuauaugugaagguuugcaga

SEQ ID NO: 556906 - RNA, 22 nt, Human
aagcacagggacucaggaccgg

SEQ ID NO: 556907 - RNA, 22 nt, Human
acaguaauaaguguuggugagg

SEQ ID NO: 556908 - RNA, 19 nt, Human
ucucaauucuccccacugc

SEQ ID NO: 556909 - RNA, 22 nt, Human
cuugcaggauuuugcugcugua

SEQ ID NO: 556910 - RNA, 22 nt, Human
caggugcccagcuccugcugug

SEQ ID NO: 556911 - RNA, 21 nt, Human
uugcaccaugauaaauucaga

SEQ ID NO: 556912 - RNA, 22 nt, Human
acccagaggugucuagcaagcu

SEQ ID NO: 556913 - RNA, 22 nt, Human
cagcaaaauuugaggauugccu

SEQ ID NO: 556914 - RNA, 22 nt, Human
aaggcagaaauucaacuacugg

SEQ ID NO: 556915 - RNA, 22 nt, Human
gugucaggcagucagcauggag

SEQ ID NO: 556916 - RNA, 22 nt, Human
acacauauguaugcaucaugug

SEQ ID NO: 556917 - RNA, 22 nt, Human
ugagccccggaguuucaggcug

SEQ ID NO: 556918 - RNA, 22 nt, Human
gaaugugugacucuauugagca

SEQ ID NO: 556919 - RNA, 22 nt, Human
ucuuuucuugcauuauugcacu

SEQ ID NO: 556920 - RNA, 22 nt, Human
caaauagaacucacagacaaga

SEQ ID NO: 556921 - RNA, 22 nt, Human
ucuccugcucagaacagccuca

SEQ ID NO: 556922 - RNA, 22 nt, Human
gcaccugggcaaggauucagag

SEQ ID NO: 556923 - RNA, 22 nt, Human
aauauaugaccaggaaguucug

SEQ ID NO: 556924 - RNA, 22 nt, Human
ggcugcaggaugcccagccgug

SEQ ID NO: 556925 - RNA, 22 nt, Human
uguugagacugagggagucagc

SEQ ID NO: 556926 - RNA, 22 nt, Human
gcuggcugcgucaucacagggc

SEQ ID NO: 556927 - RNA, 22 nt, Human
agaguggggaagguguugagaa

SEQ ID NO: 556928 - RNA, 22 nt, Human
gaaauagaggacagcuggauca

SEQ ID NO: 556929 - RNA, 22 nt, Human
gaccucagugaauggucaugua

SEQ ID NO: 556930 - RNA, 22 nt, Human
aagccaagaguuaacuauuugu

SEQ ID NO: 556931 - RNA, 22 nt, Human
caaugugguggcagaugucagu

SEQ ID NO: 556932 - RNA, 22 nt, Human
aagagcuggaguuugcagcccu

SEQ ID NO: 556933 - RNA, 22 nt, Human
gcagcuuuggagguggaacucu

SEQ ID NO: 556934 - RNA, 22 nt, Human
uuccagaaaacgcuuuauuuag

SEQ ID NO: 556935 - RNA, 22 nt, Human
gaugggggccagggccugcuuu

SEQ ID NO: 556936 - RNA, 22 nt, Human
agaaacagaagggaaagcuuuu

SEQ ID NO: 556937 - RNA, 22 nt, Human
ugggcucuggguggccugagca

SEQ ID NO: 556938 - RNA, 22 nt, Human
cauacauuuauacacaucuaug

SEQ ID NO: 556939 - RNA, 22 nt, Human
uaagaagcuucugcuaaugccu

SEQ ID NO: 556940 - RNA, 22 nt, Human
agggcacaggcuccggguccag

SEQ ID NO: 556941 - RNA, 22 nt, Human
auccucuguggauuacaccuag

SEQ ID NO: 556942 - RNA, 22 nt, Human
uggacagguuugggugccuguu

SEQ ID NO: 556943 - RNA, 22 nt, Human
accugggauggggccagguuua

SEQ ID NO: 556944 - RNA, 22 nt, Human
ggggcagagaauaaaaaccuaa

SEQ ID NO: 556945 - RNA, 22 nt, Human
ggcaguagccagggacuggcag

SEQ ID NO: 556946 - RNA, 22 nt, Human
uaagaaguguugccuaaugcaa

SEQ ID NO: 556947 - RNA, 22 nt, Human
cagguuggagaucugucuaugg

SEQ ID NO: 556948 - RNA, 22 nt, Human
auuacacauagacauucguuca

SEQ ID NO: 556949 - RNA, 22 nt, Human
acagaauuuacacaucucuaaa

SEQ ID NO: 556950 - RNA, 22 nt, Human
cugccuguuuucugauagauuu

SEQ ID NO: 556951 - RNA, 18 nt, Human
uguggcaggggugggaga

SEQ ID NO: 556952 - RNA, 22 nt, Human
guggcaggaucacggcucacug

SEQ ID NO: 556953 - RNA, 22 nt, Human
gggcugggcaugguguucccuc

SEQ ID NO: 556954 - RNA, 22 nt, Human
gaaggcuggcuuucugagagca

SEQ ID NO: 556955 - RNA, 22 nt, Human
uuaacaugucuugacuucaucu

SEQ ID NO: 556956 - RNA, 18 nt, Human
uaacauguuuucauuaag

SEQ ID NO: 556957 - RNA, 23 nt, Human
agaggggagcaucugcuggcuga

SEQ ID NO: 556958 - RNA, 22 nt, Human
uaucaaaguuguccugugaagu

SEQ ID NO: 556959 - RNA, 22 nt, Human
uggaccugcuggaugggcaggu

SEQ ID NO: 556960 - RNA, 22 nt, Human
caccugccugguccuuagggcu

SEQ ID NO: 556961 - RNA, 22 nt, Human
uaggcagaaaggaaggcaaguu

SEQ ID NO: 556962 - RNA, 22 nt, Human
cuauacacuuuuugaaaauaga

SEQ ID NO: 556963 - RNA, 22 nt, Human
uuccauuuauucuuguccagau

SEQ ID NO: 556964 - RNA, 22 nt, Human
ucucaguguggugcuuaggaua

SEQ ID NO: 556965 - RNA, 22 nt, Human
ggugggguauuugguacuugua

SEQ ID NO: 556966 - RNA, 22 nt, Human
uguuaaaaauucagcucuagau

SEQ ID NO: 556967 - RNA, 22 nt, Human
cugccuguggacacccuggagg

SEQ ID NO: 556968 - RNA, 22 nt, Human
cauugcacuccacccuaggcaa

SEQ ID NO: 556969 - RNA, 22 nt, Human
gugcauguuaaugguguacaaa

SEQ ID NO: 556970 - RNA, 21 nt, Human
uggagcugccacuugagcugc

SEQ ID NO: 556971 - RNA, 20 nt, Human
uccuugaaagugggguauau

SEQ ID NO: 556972 - RNA, 19 nt, Human
acagggcagcaauaggaua

SEQ ID NO: 556973 - RNA, 22 nt, Human
gcagccccaggagacgcccagg

SEQ ID NO: 556974 - RNA, 22 nt, Human
aucaaaaugcuccagugauggu

SEQ ID NO: 556975 - RNA, 22 nt, Human
aggccuggguguucaccagaag

SEQ ID NO: 556976 - RNA, 22 nt, Human
ugcuggccaacaaggcuccaag

SEQ ID NO: 556977 - RNA, 22 nt, Human
gagggcugauguugccaccuca

SEQ ID NO: 556978 - RNA, 22 nt, Human
uggagcugagagccaggcuggc

SEQ ID NO: 556979 - RNA, 22 nt, Human
cacugaagcuuucauucucuug

SEQ ID NO: 556980 - RNA, 22 nt, Human
agcuucuuaaguuccugcagca

SEQ ID NO: 556981 - RNA, 22 nt, Human
ugcuucuguuacauaccagaac

SEQ ID NO: 556982 - RNA, 22 nt, Human
uugagaagaggcuuuguaggaa

SEQ ID NO: 556983 - RNA, 22 nt, Human
cggcagagugugugcgugcaug

SEQ ID NO: 556984 - RNA, 22 nt, Human
auguagcaugaggcacugugcc

SEQ ID NO: 556985 - RNA, 22 nt, Human
uuugucuuauccaaucucucag

SEQ ID NO: 556986 - RNA, 22 nt, Human
ugauugacuuuagaauagcacu

SEQ ID NO: 556987 - RNA, 22 nt, Human
aaggcaguaaaaucuaccuugc

SEQ ID NO: 556988 - RNA, 22 nt, Human
aguacauuuaguuuaugaacau

SEQ ID NO: 556989 - RNA, 22 nt, Human
uaauacuuaccuugcagagucu

SEQ ID NO: 556990 - RNA, 22 nt, Human
gaagcagcaaaucugcaguauc

SEQ ID NO: 556991 - RNA, 22 nt, Human
ucaccagggcuccagccagccu

SEQ ID NO: 556992 - RNA, 22 nt, Human
aguauuucugcucaugaaagag

SEQ ID NO: 556993 - RNA, 20 nt, Human
ucagaugggagugagccauc

SEQ ID NO: 556994 - RNA, 21 nt, Human
uuucugucucugccacuaguu

SEQ ID NO: 556995 - RNA, 23 nt, Human
ggggaaguggcagugagugaggc

SEQ ID NO: 556996 - RNA, 22 nt, Human
cuuuaagacucugcucuuggug

SEQ ID NO: 556997 - RNA, 22 nt, Human
uacagguaaaauuaucagaaac

SEQ ID NO: 556998 - RNA, 22 nt, Human
agaggcagccguauuucaaagg

SEQ ID NO: 556999 - RNA, 22 nt, Human
gcagagugaggaagagcuucca

SEQ ID NO: 557000 - RNA, 22 nt, Human
aguggggcggacaggaccagga

SEQ ID NO: 557001 - RNA, 22 nt, Human
cccaggagguggagguugcagc

SEQ ID NO: 557002 - RNA, 22 nt, Human
ggcugaaguguaguggcucacu

SEQ ID NO: 557003 - RNA, 22 nt, Human
ugaagccagcuuuggaagacac

SEQ ID NO: 557004 - RNA, 22 nt, Human
ucuucagauugcacugagcaag

SEQ ID NO: 557005 - RNA, 22 nt, Human
cagcugccaugacauguccugc

SEQ ID NO: 557006 - RNA, 22 nt, Human
agucccaggcagccgagccggu

SEQ ID NO: 557007 - RNA, 22 nt, Human
ggaaaucagcagaugcugguga

SEQ ID NO: 557008 - RNA, 22 nt, Human
gcuggcagggugguugagagag

SEQ ID NO: 557009 - RNA, 22 nt, Human
ccagacuguggaguuccuggug

SEQ ID NO: 557010 - RNA, 22 nt, Human
ugcaggcugcucaagacuuagu

SEQ ID NO: 557011 - RNA, 22 nt, Human
ucaggaaggcgccccaucagga

SEQ ID NO: 557012 - RNA, 22 nt, Human
cagaaacuguggauucauuaaa

SEQ ID NO: 557013 - RNA, 22 nt, Human
uucuggcaaggcaagccuggcu

SEQ ID NO: 557014 - RNA, 22 nt, Human
ucaggcucaggaauguguuuau

SEQ ID NO: 557015 - RNA, 22 nt, Human
aucaggaugacuauaaggcugc

SEQ ID NO: 557016 - RNA, 22 nt, Human
ggggacugccuuccacagacac

SEQ ID NO: 557017 - RNA, 22 nt, Human
aggugcagcaugaguccaacgg

SEQ ID NO: 557018 - RNA, 22 nt, Human
caggaagggggauccuuggaag

SEQ ID NO: 557019 - RNA, 21 nt, Human
ccugggagaucagcugccuuc

SEQ ID NO: 557020 - RNA, 22 nt, Human
gcugggagcccuggucugcucc

SEQ ID NO: 557021 - RNA, 22 nt, Human
uagaaaagaauuuuauuugaua

SEQ ID NO: 557022 - RNA, 22 nt, Human
uggaacacaagucauugagggg

SEQ ID NO: 557023 - RNA, 22 nt, Human
aaagacauuagcuuagauguca

SEQ ID NO: 557024 - RNA, 18 nt, Human
ucucugaauauuuuaugu

SEQ ID NO: 557025 - RNA, 22 nt, Human
ggaggcacuucccgucucagcc

SEQ ID NO: 557026 - RNA, 22 nt, Human
uggccaguugaagacaaugcuc

SEQ ID NO: 557027 - RNA, 22 nt, Human
cucacugucuguacuagcugau

SEQ ID NO: 557028 - RNA, 22 nt, Human
gaaaugugggucaugacccauu

SEQ ID NO: 557029 - RNA, 22 nt, Human
uuaaggcauucuccuacuaaua

SEQ ID NO: 557030 - RNA, 22 nt, Human
ucuuucucucuaaucaagcaca

SEQ ID NO: 557031 - RNA, 22 nt, Human
ggcacugacugugcagcgcacc

SEQ ID NO: 557032 - RNA, 22 nt, Human
gugaagcagaguguggaagcaa

SEQ ID NO: 557033 - RNA, 21 nt, Human
gccuggcuagaagcuccuagc

SEQ ID NO: 557034 - RNA, 22 nt, Human
cucuucaggaauaugucaguca

SEQ ID NO: 557035 - RNA, 22 nt, Human
aggcugggaagguaaaguugua

SEQ ID NO: 557036 - RNA, 22 nt, Human
ugugaugguucacugggcauga

SEQ ID NO: 557037 - RNA, 22 nt, Human
gucaggauuaaugggaguaugc

SEQ ID NO: 557038 - RNA, 20 nt, Human
gagauggcuaagugcugaac

SEQ ID NO: 557039 - RNA, 22 nt, Human
agccauugaguuuuaugugcua

SEQ ID NO: 557040 - RNA, 22 nt, Human
uugaagaccuuuagugcuaugu

SEQ ID NO: 557041 - RNA, 22 nt, Human
ucagcaggcccauccuccaggc

SEQ ID NO: 557042 - RNA, 22 nt, Human
gaccauuuuuacagagcauuca

SEQ ID NO: 557043 - RNA, 18 nt, Human
agucucagcggaggagua

SEQ ID NO: 557044 - RNA, 22 nt, Human
ucccuuaaccguaggacagucu

SEQ ID NO: 557045 - RNA, 19 nt, Human
aagauuuggucauugauaa

SEQ ID NO: 557046 - RNA, 19 nt, Human
ugcauaaauuauauacuuu

SEQ ID NO: 557047 - RNA, 22 nt, Human
agggcucagccuccuccucagc

SEQ ID NO: 557048 - RNA, 22 nt, Human
gcugccuggagcucagccugcc

SEQ ID NO: 557049 - RNA, 22 nt, Human
ucaaagcacacuuagugguaga

SEQ ID NO: 557050 - RNA, 22 nt, Human
aaagcaaucagauucagauguc

SEQ ID NO: 557051 - RNA, 22 nt, Human
cugggaggcaccgcgucgugcu

SEQ ID NO: 557052 - RNA, 22 nt, Human
agaaacucuaggucaauugagg

SEQ ID NO: 557053 - RNA, 22 nt, Human
uuacaguaugaucaacuuuuca

SEQ ID NO: 557054 - RNA, 22 nt, Human
ucagguucuggugagggcccuu

SEQ ID NO: 557055 - RNA, 22 nt, Human
ccuggccugugaaucugagagc

SEQ ID NO: 557056 - RNA, 22 nt, Human
auucauucugaccucaagagaa

SEQ ID NO: 557057 - RNA, 22 nt, Human
aaauucagauggcuuucuuuuc

SEQ ID NO: 557058 - RNA, 22 nt, Human
acugggccgcgcugcagagggc

SEQ ID NO: 557059 - RNA, 20 nt, Human
ccugugcuuaucacuugcug

SEQ ID NO: 557060 - RNA, 22 nt, Human
gaggcuggacgugcauuucuac

SEQ ID NO: 557061 - RNA, 22 nt, Human
cuggagugcaguggcaugauca

SEQ ID NO: 557062 - RNA, 22 nt, Human
gaaaaaggauaaauacaguguu

SEQ ID NO: 557063 - RNA, 22 nt, Human
aucugaaacucugacauugucu

SEQ ID NO: 557064 - RNA, 22 nt, Human
agaggccggccgagcccauggg

SEQ ID NO: 557065 - RNA, 22 nt, Human
guuacaaaggacugggggccac

SEQ ID NO: 557066 - RNA, 21 nt, Human
cuuugcaucuauauguucuca

SEQ ID NO: 557067 - RNA, 22 nt, Human
aaggcccuggcaggaagcagga

SEQ ID NO: 557068 - RNA, 22 nt, Human
agcuguggcagcagccguggca

SEQ ID NO: 557069 - RNA, 22 nt, Human
ucucucagucagaugcuaaaga

SEQ ID NO: 557070 - RNA, 22 nt, Human
uaaagcaguaugauggaaggau

SEQ ID NO: 557071 - RNA, 22 nt, Human
ugccuguguggucugcgcauua

SEQ ID NO: 557072 - RNA, 22 nt, Human
acuauacaagauuagggauuug

SEQ ID NO: 557073 - RNA, 22 nt, Human
cucugggcaaguuucuucauga

SEQ ID NO: 557074 - RNA, 22 nt, Human
gaaaugacaaggacauuccugu

SEQ ID NO: 557075 - RNA, 22 nt, Human
acagaaauugggcaaauggaag

SEQ ID NO: 557076 - RNA, 20 nt, Human
ugcagcugguuucacaggga

SEQ ID NO: 557077 - RNA, 22 nt, Human
ccagucagagcagcgcucgcau

SEQ ID NO: 557078 - RNA, 22 nt, Human
ucccuguccugggcaaucccag

SEQ ID NO: 557079 - RNA, 22 nt, Human
uccugugauggcuugcgaugug

SEQ ID NO: 557080 - RNA, 22 nt, Human
cuguggcuaugguguacauacu

SEQ ID NO: 557081 - RNA, 22 nt, Human
ucuuuauugcuacugguuuguc

SEQ ID NO: 557082 - RNA, 22 nt, Human
uuccucagacccucauugugag

SEQ ID NO: 557083 - RNA, 22 nt, Human
acaaaggcauagugaauguuuu

SEQ ID NO: 557084 - RNA, 22 nt, Human
gauuuguuucaaguuagcaucu

SEQ ID NO: 557085 - RNA, 22 nt, Human
ccucccagugccuccagagcag

SEQ ID NO: 557086 - RNA, 22 nt, Human
guccagggcuaaaucagguucc

SEQ ID NO: 557087 - RNA, 22 nt, Human
guuuguguaacaugaugaugau

SEQ ID NO: 557088 - RNA, 22 nt, Human
cugagcagucuagccagguguu

SEQ ID NO: 557089 - RNA, 21 nt, Human
cugguguagcacucaggugcu

SEQ ID NO: 557090 - RNA, 21 nt, Human
aggugccaaggagaagcaggc

SEQ ID NO: 557091 - RNA, 22 nt, Human
gggauuugugggauggccagug

SEQ ID NO: 557092 - RNA, 22 nt, Human
ugaauaguucuacuacuugaca

SEQ ID NO: 557093 - RNA, 19 nt, Human
agagaaggauccuaugguu

SEQ ID NO: 557094 - RNA, 22 nt, Human
acacauuuucuaacagggauca

SEQ ID NO: 557095 - RNA, 22 nt, Human
gccuggcccagggcucuuguug

SEQ ID NO: 557096 - RNA, 22 nt, Human
ugccuggcaaugccagaagcca

SEQ ID NO: 557097 - RNA, 20 nt, Human
gucagaggacccuagagcga

SEQ ID NO: 557098 - RNA, 19 nt, Human
ggccuggauuuagggcucc

SEQ ID NO: 557099 - RNA, 22 nt, Human
uaggccagcccuuaguccuguc

SEQ ID NO: 557100 - RNA, 22 nt, Human
ugaaaucuacccuauucagggu

SEQ ID NO: 557101 - RNA, 22 nt, Human
agggucaaaugggcaggaagag

SEQ ID NO: 557102 - RNA, 22 nt, Human
agggccagaguacaucagggcu

SEQ ID NO: 557103 - RNA, 22 nt, Human
uugagagucauuuaagguguug

SEQ ID NO: 557104 - RNA, 22 nt, Human
uggcacugggaugcuacuguua

SEQ ID NO: 557105 - RNA, 22 nt, Human
uggcagcauguuauguaaggaa

SEQ ID NO: 557106 - RNA, 22 nt, Human
acaaaggcaggauugacuuagu

SEQ ID NO: 557107 - RNA, 22 nt, Human
ugguggcagucuccuggcugug

SEQ ID NO: 557108 - RNA, 22 nt, Human
ggcucuggugaggguaggagau

SEQ ID NO: 557109 - RNA, 22 nt, Human
aucaggauggguuuggcuuagg

SEQ ID NO: 557110 - RNA, 20 nt, Human
auaauuauuuacuuuugugc

SEQ ID NO: 557111 - RNA, 22 nt, Human
caccuggcagcuguuggccacg

SEQ ID NO: 557112 - RNA, 22 nt, Human
gguucuuuggcagucugauuga

SEQ ID NO: 557113 - RNA, 23 nt, Human
cagaggcaucggauucaacauca

SEQ ID NO: 557114 - RNA, 22 nt, Human
uugccuugauucuucucaugug

SEQ ID NO: 557115 - RNA, 17 nt, Human
ggagcagauccaccauu

SEQ ID NO: 557116 - RNA, 22 nt, Human
gcagccaggaaagcuggacccu

SEQ ID NO: 557117 - RNA, 22 nt, Human
ccagagagggcgccaccuggag

SEQ ID NO: 557118 - RNA, 23 nt, Human
cauaugaaaguagacacuuucca

SEQ ID NO: 557119 - RNA, 22 nt, Human
aagccagguguugugguaagag

SEQ ID NO: 557120 - RNA, 18 nt, Human
guccugagcucugcugua

SEQ ID NO: 557121 - RNA, 22 nt, Human
agcugucuccagauacaggauu

SEQ ID NO: 557122 - RNA, 22 nt, Human
gcagggcagccacaggcccccu

SEQ ID NO: 557123 - RNA, 22 nt, Human
uuugcauuuauaaguuggugga

SEQ ID NO: 557124 - RNA, 17 nt, Human
uucagaagcauuuuggc

SEQ ID NO: 557125 - RNA, 22 nt, Human
gcuggcuguuggagguaccugc

SEQ ID NO: 557126 - RNA, 22 nt, Human
gggacugggagauccuccuggc

SEQ ID NO: 557127 - RNA, 22 nt, Human
gcuggccucaucacugacuucu

SEQ ID NO: 557128 - RNA, 22 nt, Human
uacugaaauggcagauauauaa

SEQ ID NO: 557129 - RNA, 22 nt, Human
cccugcugugccugacugccau

SEQ ID NO: 557130 - RNA, 22 nt, Human
agaaaucauuuuaggcuugaug

SEQ ID NO: 557131 - RNA, 19 nt, Human
uguuuuguuaaagcagucc

SEQ ID NO: 557132 - RNA, 22 nt, Human
cauguuaaugaauuuuugcagu

SEQ ID NO: 557133 - RNA, 22 nt, Human
accugcaagcauuacacuucua

SEQ ID NO: 557134 - RNA, 22 nt, Human
cucucugcuguauccuuaggcu

SEQ ID NO: 557135 - RNA, 22 nt, Human
gaaauucaaauaagauauguag

SEQ ID NO: 557136 - RNA, 22 nt, Human
acuuggagagcauugcugggga

SEQ ID NO: 557137 - RNA, 22 nt, Human
ucccuggguccugcuugcucuc

SEQ ID NO: 557138 - RNA, 22 nt, Human
ggcaggugcccagagagcacga

SEQ ID NO: 557139 - RNA, 22 nt, Human
auuauguagguuaggugguugu

SEQ ID NO: 557140 - RNA, 22 nt, Human
gacauuuaauaguauuguggga

SEQ ID NO: 557141 - RNA, 22 nt, Human
uagaacaugcucauguauaaau

SEQ ID NO: 557142 - RNA, 22 nt, Human
cccagccuuccacccuggacua

SEQ ID NO: 557143 - RNA, 21 nt, Human
cugcuuccucucuucauggca

SEQ ID NO: 557144 - RNA, 22 nt, Human
ucacaggagggagagacaccca

SEQ ID NO: 557145 - RNA, 22 nt, Human
uuacacaguauccaagguucuu

SEQ ID NO: 557146 - RNA, 22 nt, Human
ccucagccuuggccccaggcag

SEQ ID NO: 557147 - RNA, 22 nt, Human
ucacauuuguucuugaaucuaa

SEQ ID NO: 557148 - RNA, 22 nt, Human
uuucagaauaucgauucaguga

SEQ ID NO: 557149 - RNA, 22 nt, Human
cugggcucaaauccuggcccug

SEQ ID NO: 557150 - RNA, 22 nt, Human
ucugaaauccuuuaucuuggcu

SEQ ID NO: 557151 - RNA, 22 nt, Human
uaaaugcagcaguuucuguucu

SEQ ID NO: 557152 - RNA, 21 nt, Human
uccaauuuuuaagacuauggc

SEQ ID NO: 557153 - RNA, 22 nt, Human
cacacagaugguaagggaggga

SEQ ID NO: 557154 - RNA, 22 nt, Human
caacagaaggaagcagggucag

SEQ ID NO: 557155 - RNA, 22 nt, Human
ucagaaucugcauuuaacaaaa

SEQ ID NO: 557156 - RNA, 21 nt, Human
gcagagccugagguucuugag

SEQ ID NO: 557157 - RNA, 22 nt, Human
ugcuuugugauaugcugugucu

SEQ ID NO: 557158 - RNA, 22 nt, Human
gaaaucaauuucuugguugaua

SEQ ID NO: 557159 - RNA, 22 nt, Human
ggcaggcaggucuucauggccc

SEQ ID NO: 557160 - RNA, 22 nt, Human
gucauuucuguuucuucagugc

SEQ ID NO: 557161 - RNA, 22 nt, Human
aggccugggacgggagccguga

SEQ ID NO: 557162 - RNA, 22 nt, Human
gggcccuggauuuaagcaugga

SEQ ID NO: 557163 - RNA, 22 nt, Human
uccagggguaccggccaggcag

SEQ ID NO: 557164 - RNA, 21 nt, Human
uuuuuucuugcgugaggccug

SEQ ID NO: 557165 - RNA, 22 nt, Human
uuacagagguauguaugucucu

SEQ ID NO: 557166 - RNA, 21 nt, Human
acauuauaauucauauuccac

SEQ ID NO: 557167 - RNA, 22 nt, Human
cacagggcuuugauggcugagu

SEQ ID NO: 557168 - RNA, 22 nt, Human
guuuauuaacugucaagugauu

SEQ ID NO: 557169 - RNA, 19 nt, Human
ccucccacggauuccuucc

SEQ ID NO: 557170 - RNA, 19 nt, Human
cuugguuaugguaugaugc

SEQ ID NO: 557171 - RNA, 22 nt, Human
acagaacugcagacagugccaa

SEQ ID NO: 557172 - RNA, 22 nt, Human
guccagggccccgagcaccagg

SEQ ID NO: 557173 - RNA, 22 nt, Human
ugcugccucugcugauauggcc

SEQ ID NO: 557174 - RNA, 22 nt, Human
aagugacaaaaggguauccaaa

SEQ ID NO: 557175 - RNA, 21 nt, Human
gcugcucgagauccagugcuu

SEQ ID NO: 557176 - RNA, 22 nt, Human
ucauuuucacacauaaauagca

SEQ ID NO: 557177 - RNA, 22 nt, Human
ccuaagaucugguaugugacag

SEQ ID NO: 557178 - RNA, 22 nt, Human
uuuucaggccagaagauagacc

SEQ ID NO: 557179 - RNA, 22 nt, Human
auagucuuagaucagauaaagu

SEQ ID NO: 557180 - RNA, 22 nt, Human
cuccaggggccagaagccuggc

SEQ ID NO: 557181 - RNA, 22 nt, Human
gagcucauccccaugguccguc

SEQ ID NO: 557182 - RNA, 22 nt, Human
guucccauacaguaucagugcu

SEQ ID NO: 557183 - RNA, 22 nt, Human
cagucucuaaaucaaucugaau

SEQ ID NO: 557184 - RNA, 22 nt, Human
uggcucucaggccugcugcguu

SEQ ID NO: 557185 - RNA, 22 nt, Human
caaacuuucaguuauaacauga

SEQ ID NO: 557186 - RNA, 22 nt, Human
aagggaggggauguaagccugg

SEQ ID NO: 557187 - RNA, 22 nt, Human
acuuuuaaggggccuugauuua

SEQ ID NO: 557188 - RNA, 22 nt, Human
ugguggggcuuuccuucugcuu

SEQ ID NO: 557189 - RNA, 22 nt, Human
ggccugcuucucagugagcuug

SEQ ID NO: 557190 - RNA, 22 nt, Human
acuuucaagaacuucuuuaaug

SEQ ID NO: 557191 - RNA, 22 nt, Human
aacugcauuugcauaaguccau

SEQ ID NO: 557192 - RNA, 22 nt, Human
ucagggacuuacaaaccagaag

SEQ ID NO: 557193 - RNA, 22 nt, Human
auaacagauacucucugugagg

SEQ ID NO: 557194 - RNA, 22 nt, Human
uaaguucaccaguuguaauaag

SEQ ID NO: 557195 - RNA, 22 nt, Human
agaaugcaguuugaaauaaggu

SEQ ID NO: 557196 - RNA, 22 nt, Human
ucucccacuggccuuguaugau

SEQ ID NO: 557197 - RNA, 22 nt, Human
cucuggagggaggcugagcugg

SEQ ID NO: 557198 - RNA, 22 nt, Human
ucaugcaaggcugaaacauggu

SEQ ID NO: 557199 - RNA, 22 nt, Human
agcagcaggagccgugggguga

SEQ ID NO: 557200 - RNA, 22 nt, Human
ugaggcagaaaauagcaguuca

SEQ ID NO: 557201 - RNA, 22 nt, Human
aaagucauuggaauauuaauga

SEQ ID NO: 557202 - RNA, 23 nt, Human
uggcucugugucacauacaggau

SEQ ID NO: 557203 - RNA, 21 nt, Human
auucagaaagggaauaaacuc

SEQ ID NO: 557204 - RNA, 22 nt, Human
agccuggcuguaaccucauggu

SEQ ID NO: 557205 - RNA, 22 nt, Human
uccugagggcgauucagcaggu

SEQ ID NO: 557206 - RNA, 22 nt, Human
aauuaacuaaaauucacuuuau

SEQ ID NO: 557207 - RNA, 22 nt, Human
cauugcacgggcgucugucugu

SEQ ID NO: 557208 - RNA, 22 nt, Human
gcugaaaugccuuguaaauauu

SEQ ID NO: 557209 - RNA, 22 nt, Human
gaggaggaaguucucuguaggc

SEQ ID NO: 557210 - RNA, 22 nt, Human
ggaccugcccuggcucagaugc

SEQ ID NO: 557211 - RNA, 22 nt, Human
aggcacuuaaccuacuaacuga

SEQ ID NO: 557212 - RNA, 22 nt, Human
uggaacacagugauugauagcg

SEQ ID NO: 557213 - RNA, 22 nt, Human
uuugaaaauuuaagugcuacac

SEQ ID NO: 557214 - RNA, 22 nt, Human
agggggcccuugcaggugagcg

SEQ ID NO: 557215 - RNA, 22 nt, Human
ccaggugggcgugucuucaccu

SEQ ID NO: 557216 - RNA, 22 nt, Human
ggagccagagggaugcaguuga

SEQ ID NO: 557217 - RNA, 22 nt, Human
guucacagguucucuuucuaag

SEQ ID NO: 557218 - RNA, 22 nt, Human
agccacgucccugucaggguca

SEQ ID NO: 557219 - RNA, 21 nt, Human
agggaaagaaaaugagcuaau

SEQ ID NO: 557220 - RNA, 22 nt, Human
cauucuaaaguguuuuauaccu

SEQ ID NO: 557221 - RNA, 22 nt, Human
ggagugaaucacuagaugcaga

SEQ ID NO: 557222 - RNA, 22 nt, Human
aacaguaagagauguuuuaucu

SEQ ID NO: 557223 - RNA, 22 nt, Human
acugucaggauggcagcuuguu

SEQ ID NO: 557224 - RNA, 22 nt, Human
ucuccugggaggacaaggaagg

SEQ ID NO: 557225 - RNA, 17 nt, Human
auuuccucagggcugag

SEQ ID NO: 557226 - RNA, 22 nt, Human
cuggcagcgguuugcagccugg

SEQ ID NO: 557227 - RNA, 22 nt, Human
ugcuugggaauguggagucaga

SEQ ID NO: 557228 - RNA, 22 nt, Human
ccugcagaggucaggccagaaa

SEQ ID NO: 557229 - RNA, 22 nt, Human
cugcugggcuccucaugugacu

SEQ ID NO: 557230 - RNA, 22 nt, Human
ugucagcagcugguuugcuguu

SEQ ID NO: 557231 - RNA, 22 nt, Human
gccacuggcaucuaguugguag

SEQ ID NO: 557232 - RNA, 22 nt, Human
caguauuuguucccuaucaaug

SEQ ID NO: 557233 - RNA, 22 nt, Human
aacaucuuugccaaauugcuau

SEQ ID NO: 557234 - RNA, 22 nt, Human
uucacaggaggguggaugcaug

SEQ ID NO: 557235 - RNA, 22 nt, Human
uuaagacaguguauuuguuuuc

SEQ ID NO: 557236 - RNA, 22 nt, Human
acauucaagaugcauucacuua

SEQ ID NO: 557237 - RNA, 22 nt, Human
agaaagggaacuggcaaagcca

SEQ ID NO: 557238 - RNA, 20 nt, Human
cacaacuguccacaugcucc

SEQ ID NO: 557239 - RNA, 22 nt, Human
ugcagguggauaucucaucaga

SEQ ID NO: 557240 - RNA, 22 nt, Human
caagagcugaggcuggagaggu

SEQ ID NO: 557241 - RNA, 22 nt, Human
uuaggaaguguguccagaagcg

SEQ ID NO: 557242 - RNA, 22 nt, Human
aauguucaguagaauaggaaug

SEQ ID NO: 557243 - RNA, 22 nt, Human
aaagaauaguuaaguuuagggc

SEQ ID NO: 557244 - RNA, 22 nt, Human
uuucuuuugcugagaggggcac

SEQ ID NO: 557245 - RNA, 22 nt, Human
augauugaaaaugacauugcca

SEQ ID NO: 557246 - RNA, 22 nt, Human
agguguguauaaacauacauau

SEQ ID NO: 557247 - RNA, 22 nt, Human
cagcacugcugcuguacacaca

SEQ ID NO: 557248 - RNA, 21 nt, Human
cugcuuuacuucagaggaucu

SEQ ID NO: 557249 - RNA, 22 nt, Human
aggcugaggaucccuguguucu

SEQ ID NO: 557250 - RNA, 22 nt, Human
auuuucucucaaaccuuaaaau

SEQ ID NO: 557251 - RNA, 22 nt, Human
ggcuguggggccggguacagug

SEQ ID NO: 557252 - RNA, 22 nt, Human
acuuucuucuuaugcauuaagg

SEQ ID NO: 557253 - RNA, 22 nt, Human
ucacauuuguuccucugcacuu

SEQ ID NO: 557254 - RNA, 22 nt, Human
ggcagugagucccggagaggcc

SEQ ID NO: 557255 - RNA, 22 nt, Human
gaaggccacggaauggagcugg

SEQ ID NO: 557256 - RNA, 22 nt, Human
aauauuucuccuucguuauagc

SEQ ID NO: 557257 - RNA, 22 nt, Human
uucaguauguuggacguuaugu

SEQ ID NO: 557258 - RNA, 22 nt, Human
ggaggccaaggcagguggaucg

SEQ ID NO: 557259 - RNA, 22 nt, Human
agcuguggaguaggggguugga

SEQ ID NO: 557260 - RNA, 20 nt, Human
ucccuggaggugguggcauc

SEQ ID NO: 557261 - RNA, 22 nt, Human
ggugaaggucagagcaggaaaa

SEQ ID NO: 557262 - RNA, 23 nt, Human
ucccagggaaggugagcgaggcu

SEQ ID NO: 557263 - RNA, 22 nt, Human
aguguguguuugggcgguuuau

SEQ ID NO: 557264 - RNA, 22 nt, Human
cagucacacaaguggacuuggg

SEQ ID NO: 557265 - RNA, 22 nt, Human
cagaaacugcuuguggucaucu

SEQ ID NO: 557266 - RNA, 22 nt, Human
auccaguuuaugucauauucuu

SEQ ID NO: 557267 - RNA, 22 nt, Human
auccacagucuuagccaucaaa

SEQ ID NO: 557268 - RNA, 22 nt, Human
ccagagccagagaggugccugc

SEQ ID NO: 557269 - RNA, 18 nt, Human
ucucuuuuccccucauug

SEQ ID NO: 557270 - RNA, 22 nt, Human
uagauacauacauuuuaaaaug

SEQ ID NO: 557271 - RNA, 22 nt, Human
ucccaggauguuggcggcaggu

SEQ ID NO: 557272 - RNA, 22 nt, Human
cggccuugacaagcuuagcagc

SEQ ID NO: 557273 - RNA, 22 nt, Human
uaauuucuucaucucugcagcu

SEQ ID NO: 557274 - RNA, 22 nt, Human
ccaguguuggaggauggcuugc

SEQ ID NO: 557275 - RNA, 22 nt, Human
ccuggaaggcaggcauggauug

SEQ ID NO: 557276 - RNA, 22 nt, Human
uuuggcaagcgaguacuuucug

SEQ ID NO: 557277 - RNA, 22 nt, Human
auaaaaguucaagagaguacag

SEQ ID NO: 557278 - RNA, 17 nt, Human
uuccuggaagucauucc

SEQ ID NO: 557279 - RNA, 22 nt, Human
gcagaggccuagguggaaggcc

SEQ ID NO: 557280 - RNA, 22 nt, Human
uuucccaagaaaaauaauugga

SEQ ID NO: 557281 - RNA, 22 nt, Human
uucacagccucugccccaggca

SEQ ID NO: 557282 - RNA, 22 nt, Human
aagcagaguuagcuugucaccu

SEQ ID NO: 557283 - RNA, 22 nt, Human
ccucagaugucuuaaggcacug

SEQ ID NO: 557284 - RNA, 22 nt, Human
uagcuuuaccauagaagaguau

SEQ ID NO: 557285 - RNA, 22 nt, Human
ggcugccugaggcugaggcccg

SEQ ID NO: 557286 - RNA, 22 nt, Human
ucuaggaguugauaaaagggcu

SEQ ID NO: 557287 - RNA, 16 nt, Human
uuuguucacuccaugg

SEQ ID NO: 557288 - RNA, 22 nt, Human
ggcaguuuuaacagagguagua

SEQ ID NO: 557289 - RNA, 22 nt, Human
guuauuuuaacuucucaguaau

SEQ ID NO: 557290 - RNA, 22 nt, Human
uccucagggaagaugagccuca

SEQ ID NO: 557291 - RNA, 22 nt, Human
aaucuucauguccucucuaauu

SEQ ID NO: 557292 - RNA, 22 nt, Human
caaauguaauaaggaguuuccc

SEQ ID NO: 557293 - RNA, 20 nt, Human
ggggcccaagcccucuugcc

SEQ ID NO: 557294 - RNA, 22 nt, Human
uugcucugaaccacaccaucac

SEQ ID NO: 557295 - RNA, 22 nt, Human
acuggauugggaaaguacuuca

SEQ ID NO: 557296 - RNA, 22 nt, Human
caaauguguuuuuucuucuaca

SEQ ID NO: 557297 - RNA, 20 nt, Human
uuucuguaaggcauuaaucu

SEQ ID NO: 557298 - RNA, 22 nt, Human
aaguguuuccgggagacuuggu

SEQ ID NO: 557299 - RNA, 22 nt, Human
cugggaaguggugagggccuga

SEQ ID NO: 557300 - RNA, 22 nt, Human
gugaaauauuuuguuuauguca

SEQ ID NO: 557301 - RNA, 22 nt, Human
acacaggaagucagcacugaug

SEQ ID NO: 557302 - RNA, 22 nt, Human
aaaacaggugucagcaaacuau

SEQ ID NO: 557303 - RNA, 22 nt, Human
aaagcaagucucuacaaaguac

SEQ ID NO: 557304 - RNA, 22 nt, Human
uggcccagaucucugaccuuga

SEQ ID NO: 557305 - RNA, 22 nt, Human
aacauaauguggccaaagucac

SEQ ID NO: 557306 - RNA, 22 nt, Human
uccauuaaaccuggauggaguu

SEQ ID NO: 557307 - RNA, 22 nt, Human
uggccacagccucugccaguuc

SEQ ID NO: 557308 - RNA, 22 nt, Human
gcugagagugggugcagugcuu

SEQ ID NO: 557309 - RNA, 22 nt, Human
cagagcauuuggaagccacgug

SEQ ID NO: 557310 - RNA, 22 nt, Human
accagagcgcucaagccuuccc

SEQ ID NO: 557311 - RNA, 22 nt, Human
gugaccaucagagaauaacaaa

SEQ ID NO: 557312 - RNA, 23 nt, Human
ucaauaacucggguuaaaauaga

SEQ ID NO: 557313 - RNA, 22 nt, Human
gcagcuuuaaaggaggcucuga

SEQ ID NO: 557314 - RNA, 22 nt, Human
cucuuccucucaugcggucaua

SEQ ID NO: 557315 - RNA, 22 nt, Human
gaaggagaggauugugaggcug

SEQ ID NO: 557316 - RNA, 22 nt, Human
ggugaccucaccuggucccacc

SEQ ID NO: 557317 - RNA, 22 nt, Human
acagaugguacuaaacccauau

SEQ ID NO: 557318 - RNA, 22 nt, Human
gaacuuaacggcaacuauuuaa

SEQ ID NO: 557319 - RNA, 22 nt, Human
aauauaugagggagcuauuuga

SEQ ID NO: 557320 - RNA, 22 nt, Human
uguuccaagcugcuggauaagc

SEQ ID NO: 557321 - RNA, 22 nt, Human
ucuggagccuuggaugggaaag

SEQ ID NO: 557322 - RNA, 22 nt, Human
aaggcaggaugcggacccaucu

SEQ ID NO: 557323 - RNA, 20 nt, Human
gccaggcacuguucucaaua

SEQ ID NO: 557324 - RNA, 22 nt, Human
uuucaaagucaauaucauuacc

SEQ ID NO: 557325 - RNA, 22 nt, Human
ucaaaacaacacucagguguaa

SEQ ID NO: 557326 - RNA, 22 nt, Human
uugugaauagugccgcuauaaa

SEQ ID NO: 557327 - RNA, 22 nt, Human
uccuggaggcaaaugaagacuc

SEQ ID NO: 557328 - RNA, 22 nt, Human
gaggcagccucaguggaccucg

SEQ ID NO: 557329 - RNA, 22 nt, Human
ucagggcaaagggcagaguuug

SEQ ID NO: 557330 - RNA, 22 nt, Human
cuguaaaacacuguaguaucug

SEQ ID NO: 557331 - RNA, 22 nt, Human
cuggagcuccagggucuccucu

SEQ ID NO: 557332 - RNA, 22 nt, Human
cagaggcugaugugggaugggc

SEQ ID NO: 557333 - RNA, 22 nt, Human
uauucacagcugccgcacucag

SEQ ID NO: 557334 - RNA, 22 nt, Human
gccagguggucuggcuccagag

SEQ ID NO: 557335 - RNA, 22 nt, Human
guggcugcuacagagcuggagg

SEQ ID NO: 557336 - RNA, 22 nt, Human
ucccagaagugaaauuucuaga

SEQ ID NO: 557337 - RNA, 20 nt, Human
uggagccaaggugugucugg

SEQ ID NO: 557338 - RNA, 22 nt, Human
uccucaggagagcuccuaugcc

SEQ ID NO: 557339 - RNA, 22 nt, Human
gauauuuucauucggaugcuca

SEQ ID NO: 557340 - RNA, 22 nt, Human
ugcaagaggauuguaucaauaa

SEQ ID NO: 557341 - RNA, 22 nt, Human
uuccaaaggaauggggagcuau

SEQ ID NO: 557342 - RNA, 22 nt, Human
gagagguccauuccccugucag

SEQ ID NO: 557343 - RNA, 22 nt, Human
gcucugggauuaccagccuuag

SEQ ID NO: 557344 - RNA, 20 nt, Human
cccuggagagaagcuccacg

SEQ ID NO: 557345 - RNA, 22 nt, Human
gcagggcuauuggaaggagaug

SEQ ID NO: 557346 - RNA, 22 nt, Human
agaauuuuugcaguuuagccau

SEQ ID NO: 557347 - RNA, 22 nt, Human
caguaacugaugugaucaaacg

SEQ ID NO: 557348 - RNA, 22 nt, Human
gagcagggccacuucuguaccu

SEQ ID NO: 557349 - RNA, 22 nt, Human
gaguaaaaguuggauuacaaag

SEQ ID NO: 557350 - RNA, 22 nt, Human
agcugggcugaugacucauguu

SEQ ID NO: 557351 - RNA, 22 nt, Human
uaacagaauccuguuauugcca

SEQ ID NO: 557352 - RNA, 22 nt, Human
cagcagcaaaucuagaagagga

SEQ ID NO: 557353 - RNA, 22 nt, Human
acaauguucucugaguugugug

SEQ ID NO: 557354 - RNA, 22 nt, Human
auggauauuggccaaacucauu

SEQ ID NO: 557355 - RNA, 22 nt, Human
auagacuugaggauauaaugaa

SEQ ID NO: 557356 - RNA, 22 nt, Human
uuguaaauaguaguaagaugcc

SEQ ID NO: 557357 - RNA, 22 nt, Human
ggcuuugggcccucaagucucc

SEQ ID NO: 557358 - RNA, 22 nt, Human
ugaaauuccaggagaguuaaaa

SEQ ID NO: 557359 - RNA, 22 nt, Human
uugcacagaugagggugaugcu

SEQ ID NO: 557360 - RNA, 18 nt, Human
gcagcugcaguuguagcu

SEQ ID NO: 557361 - RNA, 21 nt, Human
ggccuuccccugcagucuccg

SEQ ID NO: 557362 - RNA, 22 nt, Human
uucuucuugaaacuuuagguug

SEQ ID NO: 557363 - RNA, 23 nt, Human
guguguggaaagugcaugggccu

SEQ ID NO: 557364 - RNA, 22 nt, Human
gagggugcaggcaagagcaaaa

SEQ ID NO: 557365 - RNA, 22 nt, Human
auagugggaauuacgauauacu

SEQ ID NO: 557366 - RNA, 22 nt, Human
uauagagguggaaacugagguu

SEQ ID NO: 557367 - RNA, 22 nt, Human
uuuuccuuucaucaggacaaag

SEQ ID NO: 557368 - RNA, 22 nt, Human
gccagagugccaucagugccau

SEQ ID NO: 557369 - RNA, 22 nt, Human
acagguccucaagucagcuggg

SEQ ID NO: 557370 - RNA, 22 nt, Human
aauucagcacagaggaaccagu

SEQ ID NO: 557371 - RNA, 22 nt, Human
aaggccagacaggaccacaucu

SEQ ID NO: 557372 - RNA, 22 nt, Human
uguaaaagacauuucuaagcaa

SEQ ID NO: 557373 - RNA, 17 nt, Human
aaguccagccugcagcu

SEQ ID NO: 557374 - RNA, 22 nt, Human
agggcugacagugaggagucaa

SEQ ID NO: 557375 - RNA, 22 nt, Human
gggcaggaggcuaauucugcau

SEQ ID NO: 557376 - RNA, 22 nt, Human
aagugguguguuggaagaaauc

SEQ ID NO: 557377 - RNA, 22 nt, Human
agggaaagguagugaggucaca

SEQ ID NO: 557378 - RNA, 17 nt, Human
uccuucagugccucugc

SEQ ID NO: 557379 - RNA, 22 nt, Human
uuucuucuuaauacuggcugcu

SEQ ID NO: 557380 - RNA, 22 nt, Human
uaaacugaagcucaacucaaau

SEQ ID NO: 557381 - RNA, 22 nt, Human
gggcauggaggucugucugcag

SEQ ID NO: 557382 - RNA, 22 nt, Human
ugaguggacgugaggcugagua

SEQ ID NO: 557383 - RNA, 22 nt, Human
uauugucuguccgggucaaagc

SEQ ID NO: 557384 - RNA, 22 nt, Human
cugaagagcucuccuguccccu

SEQ ID NO: 557385 - RNA, 22 nt, Human
cacagcuaauggaaguggaauc

SEQ ID NO: 557386 - RNA, 22 nt, Human
uuucacagcagaauuucugagg

SEQ ID NO: 557387 - RNA, 22 nt, Human
uaugagaaucugcaguaugcuu

SEQ ID NO: 557388 - RNA, 21 nt, Human
aaucaagaguacugguguggc

SEQ ID NO: 557389 - RNA, 22 nt, Human
ugcaggugcguuuucaagccuc

SEQ ID NO: 557390 - RNA, 22 nt, Human
ucugggagguguuuugagaacu

SEQ ID NO: 557391 - RNA, 22 nt, Human
cugcuuuguggaaucacacugg

SEQ ID NO: 557392 - RNA, 22 nt, Human
uuagcuuucuuggagaauuaca

SEQ ID NO: 557393 - RNA, 22 nt, Human
uuacaacagacacauauucuaa

SEQ ID NO: 557394 - RNA, 22 nt, Human
uggaagcaacaacuauggacca

SEQ ID NO: 557395 - RNA, 22 nt, Human
uaauuucaauagcuugcauaau

SEQ ID NO: 557396 - RNA, 23 nt, Human
cagcuucuuugggauucuuuaua

SEQ ID NO: 557397 - RNA, 22 nt, Human
gggcugagagugacuguucugu

SEQ ID NO: 557398 - RNA, 22 nt, Human
uccuggauuaauagggagcugu

SEQ ID NO: 557399 - RNA, 22 nt, Human
uacagcauguccuuagcaaggc

SEQ ID NO: 557400 - RNA, 22 nt, Human
uauacacaggaaucugugaaaa

SEQ ID NO: 557401 - RNA, 22 nt, Human
aacaaauggaacacaaaucuuu

SEQ ID NO: 557402 - RNA, 22 nt, Human
uaagucauuuggagccacugga

SEQ ID NO: 557403 - RNA, 22 nt, Human
auuucaucccaggcucuggaag

SEQ ID NO: 557404 - RNA, 22 nt, Human
gccagaaagaggaggaccuggg

SEQ ID NO: 557405 - RNA, 22 nt, Human
ggggagcuuagggucucugaau

SEQ ID NO: 557406 - RNA, 22 nt, Human
gcuguucagggcacucaugggc

SEQ ID NO: 557407 - RNA, 22 nt, Human
uccuguaguugcuaaguuuguu

SEQ ID NO: 557408 - RNA, 22 nt, Human
acaaaguaggucaucaaagcuc

SEQ ID NO: 557409 - RNA, 22 nt, Human
cacauacaaggcacacuggagg

SEQ ID NO: 557410 - RNA, 22 nt, Human
ggugacaguuccggagguacag

SEQ ID NO: 557411 - RNA, 22 nt, Human
uaugagaaauugcugauauuug

SEQ ID NO: 557412 - RNA, 22 nt, Human
acauuuauauaacucacuagga

SEQ ID NO: 557413 - RNA, 22 nt, Human
ugcuuuaucaaagcuauaguga

SEQ ID NO: 557414 - RNA, 18 nt, Human
uagggcucuagggaguga

SEQ ID NO: 557415 - RNA, 22 nt, Human
uuucagugucaguaaugcagca

SEQ ID NO: 557416 - RNA, 20 nt, Human
uucaugggagcaaagaggcc

SEQ ID NO: 557417 - RNA, 22 nt, Human
gaaugcacuuccaacaucuauu

SEQ ID NO: 557418 - RNA, 21 nt, Human
gagugucuaauccaggcuguc

SEQ ID NO: 557419 - RNA, 22 nt, Human
ccuggccucuccgaguaaccug

SEQ ID NO: 557420 - RNA, 22 nt, Human
uuuccaauguagaugucucugg

SEQ ID NO: 557421 - RNA, 22 nt, Human
uccagggaugguaaugagcagu

SEQ ID NO: 557422 - RNA, 22 nt, Human
acucaggaaaugaagacugguu

SEQ ID NO: 557423 - RNA, 22 nt, Human
cuccaaguccgagggcucucaa

SEQ ID NO: 557424 - RNA, 22 nt, Human
cuuauucagauacagacucuug

SEQ ID NO: 557425 - RNA, 22 nt, Human
ccacagaggacaacugccuggc

SEQ ID NO: 557426 - RNA, 22 nt, Human
aggccagaaaugucagggagug

SEQ ID NO: 557427 - RNA, 22 nt, Human
gcagagcucaagguguucagcu

SEQ ID NO: 557428 - RNA, 22 nt, Human
gccugugugugaggacuggcug

SEQ ID NO: 557429 - RNA, 22 nt, Human
cugagccauaagggaggcuggg

SEQ ID NO: 557430 - RNA, 22 nt, Human
aggacaguccgggguccuccac

SEQ ID NO: 557431 - RNA, 22 nt, Human
aauuuauuuccugccaguacac

SEQ ID NO: 557432 - RNA, 22 nt, Human
cagcuagaaagucuguuaggga

SEQ ID NO: 557433 - RNA, 22 nt, Human
ugacaguugagcauguaagaga

SEQ ID NO: 557434 - RNA, 23 nt, Human
ugggcaucuccucugugccaggc

SEQ ID NO: 557435 - RNA, 22 nt, Human
caggccuuuuuuccugcagugu

SEQ ID NO: 557436 - RNA, 22 nt, Human
acagugauugguuuggggguga

SEQ ID NO: 557437 - RNA, 22 nt, Human
acccaggccugagagacaggag

SEQ ID NO: 557438 - RNA, 22 nt, Human
ucagagagguuaaauaucuugu

SEQ ID NO: 557439 - RNA, 22 nt, Human
acaggcacucucauuaaaauag

SEQ ID NO: 557440 - RNA, 23 nt, Human
guucauuuuauugucugauugcu

SEQ ID NO: 557441 - RNA, 22 nt, Human
cagcagcuucuguugaucagaa

SEQ ID NO: 557442 - RNA, 22 nt, Human
uaguuacagcaggcaggauaua

SEQ ID NO: 557443 - RNA, 22 nt, Human
uacuuagagcgauaauuuauac

SEQ ID NO: 557444 - RNA, 22 nt, Human
auacauuagcucauaugauuaa

SEQ ID NO: 557445 - RNA, 22 nt, Human
aggagaggaaucauuauuacaa

SEQ ID NO: 557446 - RNA, 22 nt, Human
aacuuucagcaaguaauucugg

SEQ ID NO: 557447 - RNA, 22 nt, Human
gguuccuucugaggucccugua

SEQ ID NO: 557448 - RNA, 22 nt, Human
uaaaaguggauaagcuguagga

SEQ ID NO: 557449 - RNA, 22 nt, Human
ggucauugaaaucagaaggguu

SEQ ID NO: 557450 - RNA, 22 nt, Human
agcuuuaugcuuccuacaagcu

SEQ ID NO: 557451 - RNA, 22 nt, Human
ccugcagcuguaggagaaggcg

SEQ ID NO: 557452 - RNA, 22 nt, Human
gggcuggcaucgguugcugaga

SEQ ID NO: 557453 - RNA, 22 nt, Human
ggaagaggcugaggccaugcug

SEQ ID NO: 557454 - RNA, 22 nt, Human
acuguucauauucuuagaaauu

SEQ ID NO: 557455 - RNA, 22 nt, Human
ucagaggaucaugucccuacuc

SEQ ID NO: 557456 - RNA, 22 nt, Human
gcugagggcuggucacauuugu

SEQ ID NO: 557457 - RNA, 22 nt, Human
accagagcuggcucugagcacc

SEQ ID NO: 557458 - RNA, 22 nt, Human
auaaaaguuuccaaucaugccu

SEQ ID NO: 557459 - RNA, 22 nt, Human
aaacacagggauauauauucca

SEQ ID NO: 557460 - RNA, 22 nt, Human
ugacugaagaagccacauugga

SEQ ID NO: 557461 - RNA, 22 nt, Human
uuuauuuggcauccagggagaa

SEQ ID NO: 557462 - RNA, 22 nt, Human
cagacuuucaaggagugaaggc

SEQ ID NO: 557463 - RNA, 22 nt, Human
ucucccagaaguccucaguaca

SEQ ID NO: 557464 - RNA, 18 nt, Human
caugucugcgccacaagg

SEQ ID NO: 557465 - RNA, 22 nt, Human
aagguacaaaguauuauuuaaa

SEQ ID NO: 557466 - RNA, 22 nt, Human
augggcucuaugucuaggagau

SEQ ID NO: 557467 - RNA, 22 nt, Human
uuaugugccacuuuuugaagau

SEQ ID NO: 557468 - RNA, 22 nt, Human
gaggaaagaaccccagucaaua

SEQ ID NO: 557469 - RNA, 22 nt, Human
uggcagggccuaccccaauauc

SEQ ID NO: 557470 - RNA, 22 nt, Human
cugagaguguggcuuccaggcc

SEQ ID NO: 557471 - RNA, 22 nt, Human
cacagaggcaaccuucuggggu

SEQ ID NO: 557472 - RNA, 22 nt, Human
acaaaucuguuuuauagacuuu

SEQ ID NO: 557473 - RNA, 22 nt, Human
agcccagaaaugaaaggaugau

SEQ ID NO: 557474 - RNA, 22 nt, Human
ggccuggcucuugcccagccug

SEQ ID NO: 557475 - RNA, 22 nt, Human
ggcuguggucauuaggagguug

SEQ ID NO: 557476 - RNA, 22 nt, Human
cacauaaguggguuccauugca

SEQ ID NO: 557477 - RNA, 22 nt, Human
augggaggcagcagagcccagc

SEQ ID NO: 557478 - RNA, 22 nt, Human
ucuaaacauugguauggagcag

SEQ ID NO: 557479 - RNA, 22 nt, Human
uucugaaaccuucaguaugaag

SEQ ID NO: 557480 - RNA, 22 nt, Human
uaaguuagcaaggccaagguaa

SEQ ID NO: 557481 - RNA, 21 nt, Human
aacauuucugggagaacucac

SEQ ID NO: 557482 - RNA, 22 nt, Human
uguacagacuuugcagugugca

SEQ ID NO: 557483 - RNA, 22 nt, Human
ugcuggggagugauugaccauc

SEQ ID NO: 557484 - RNA, 22 nt, Human
gcaaagcugggugugaaugcac

SEQ ID NO: 557485 - RNA, 21 nt, Human
uuucaauguguucuuuguagu

SEQ ID NO: 557486 - RNA, 22 nt, Human
cagguacacucccuugugcuga

SEQ ID NO: 557487 - RNA, 22 nt, Human
uaccugcacagccagccaugug

SEQ ID NO: 557488 - RNA, 22 nt, Human
ucaauuuuaugaaacaaaguga

SEQ ID NO: 557489 - RNA, 22 nt, Human
aaacaaauagugcaugggaauu

SEQ ID NO: 557490 - RNA, 22 nt, Human
agggcagagcugucuaaauggc

SEQ ID NO: 557491 - RNA, 22 nt, Human
ucuuuacaguccucugucaauc

SEQ ID NO: 557492 - RNA, 22 nt, Human
aggagccaagcagaacuaagga

SEQ ID NO: 557493 - RNA, 22 nt, Human
ugcagguggauucaauguggga

SEQ ID NO: 557494 - RNA, 22 nt, Human
auuccagaauaccggcaagaug

SEQ ID NO: 557495 - RNA, 22 nt, Human
acacauuaaccuuugaaauucu

SEQ ID NO: 557496 - RNA, 22 nt, Human
cugcccugagucaugccagaug

SEQ ID NO: 557497 - RNA, 22 nt, Human
gcaggcagucaucuuucauauu

SEQ ID NO: 557498 - RNA, 22 nt, Human
auuguaaguagaaauguuaugg

SEQ ID NO: 557499 - RNA, 19 nt, Human
uaguggagugacaaguucu

SEQ ID NO: 557500 - RNA, 20 nt, Human
cucucuggaaggugggagcc

SEQ ID NO: 557501 - RNA, 22 nt, Human
guccucugagggggcugcacgc

SEQ ID NO: 557502 - RNA, 22 nt, Human
cugugcaguggcagcguguggg

SEQ ID NO: 557503 - RNA, 22 nt, Human
aggagaaggaggccccucacac

SEQ ID NO: 557504 - RNA, 22 nt, Human
gccaggagaaugcuagcagagg

SEQ ID NO: 557505 - RNA, 22 nt, Human
uuaccaccuguaucacauuuuu

SEQ ID NO: 557506 - RNA, 22 nt, Human
uguaacaguaguuacuauucuu

SEQ ID NO: 557507 - RNA, 22 nt, Human
ccaggagguggagauugcagug

SEQ ID NO: 557508 - RNA, 22 nt, Human
gggcacuguguucagagugcag

SEQ ID NO: 557509 - RNA, 22 nt, Human
ucuagaaaaaaacugcugugga

SEQ ID NO: 557510 - RNA, 22 nt, Human
uguggccuccccacuucugggg

SEQ ID NO: 557511 - RNA, 22 nt, Human
uaacacuucagaugauuuuguu

SEQ ID NO: 557512 - RNA, 22 nt, Human
auuuuucucuuuccacugagau

SEQ ID NO: 557513 - RNA, 21 nt, Human
ugccaggccugagcugggguc

SEQ ID NO: 557514 - RNA, 22 nt, Human
ucuaggaaccugacaucucuca

SEQ ID NO: 557515 - RNA, 22 nt, Human
gcagagacuccacugucuugug

SEQ ID NO: 557516 - RNA, 22 nt, Human
aaaguacagccacauccaagua

SEQ ID NO: 557517 - RNA, 19 nt, Human
gguggcucucccucaggga

SEQ ID NO: 557518 - RNA, 22 nt, Human
uuaacagagaacauagaaguag

SEQ ID NO: 557519 - RNA, 22 nt, Human
agugugugcaugcauucgugca

SEQ ID NO: 557520 - RNA, 22 nt, Human
agaggcaccgucugcagcgugc

SEQ ID NO: 557521 - RNA, 23 nt, Human
augaaacucaagccagauccaag

SEQ ID NO: 557522 - RNA, 22 nt, Human
agcuccugauacaugcaggaau

SEQ ID NO: 557523 - RNA, 22 nt, Human
aaaugccucauuuucucucacu

SEQ ID NO: 557524 - RNA, 22 nt, Human
ggcagaagauaggacagggaau

SEQ ID NO: 557525 - RNA, 22 nt, Human
gccaggcuggugcaaggauauu

SEQ ID NO: 557526 - RNA, 22 nt, Human
guaacaaaguuucuaggugcug

SEQ ID NO: 557527 - RNA, 22 nt, Human
uggggccucaggccuuuuccua

SEQ ID NO: 557528 - RNA, 22 nt, Human
auagaaacagggaagcaaagca

SEQ ID NO: 557529 - RNA, 22 nt, Human
ccagaagauggcucaaaccaug

SEQ ID NO: 557530 - RNA, 22 nt, Human
gggcagguguugucaaucuaau

SEQ ID NO: 557531 - RNA, 22 nt, Human
ccuuuucuagaaagggaggcaa

SEQ ID NO: 557532 - RNA, 22 nt, Human
uuuaagcacagggauaaaguua

SEQ ID NO: 557533 - RNA, 18 nt, Human
augcccuguugacuucag

SEQ ID NO: 557534 - RNA, 22 nt, Human
aguucucagcuuaguaugcugu

SEQ ID NO: 557535 - RNA, 22 nt, Human
cagcagccuacaaugcacagaa

SEQ ID NO: 557536 - RNA, 23 nt, Human
ucugagaagguuucagccagacu

SEQ ID NO: 557537 - RNA, 22 nt, Human
uucauaaacaaauuaaggccug

SEQ ID NO: 557538 - RNA, 22 nt, Human
gcauggcaagaucaggagacca

SEQ ID NO: 557539 - RNA, 22 nt, Human
auccucagaccucagcaaagcc

SEQ ID NO: 557540 - RNA, 22 nt, Human
cagagcugacccaaggauugaa

SEQ ID NO: 557541 - RNA, 22 nt, Human
aaggcugagagucacaguccua

SEQ ID NO: 557542 - RNA, 22 nt, Human
gccaguggaggacccauggaga

SEQ ID NO: 557543 - RNA, 22 nt, Human
auucacauuuacaaagcacuca

SEQ ID NO: 557544 - RNA, 22 nt, Human
uauuaauaagugacuacuagcu

SEQ ID NO: 557545 - RNA, 22 nt, Human
acacagccgugaaucugcuucu

SEQ ID NO: 557546 - RNA, 22 nt, Human
gcucagaggagcaucauaagga

SEQ ID NO: 557547 - RNA, 22 nt, Human
auugacaaggaaacuauaccag

SEQ ID NO: 557548 - RNA, 22 nt, Human
uccucagaaaccccugugaggu

SEQ ID NO: 557549 - RNA, 22 nt, Human
ccugagcaucagcgccuccuua

SEQ ID NO: 557550 - RNA, 22 nt, Human
gagguggccucaagcagucuuc

SEQ ID NO: 557551 - RNA, 22 nt, Human
ucacagccuggacaguugccug

SEQ ID NO: 557552 - RNA, 22 nt, Human
aucagcaaggcaaucacugcag

SEQ ID NO: 557553 - RNA, 22 nt, Human
ccacugggcguuucuguccaau

SEQ ID NO: 557554 - RNA, 22 nt, Human
ggccugcugacccaaguccugu

SEQ ID NO: 557555 - RNA, 22 nt, Human
uucuuuuuggauagcugaugaa

SEQ ID NO: 557556 - RNA, 22 nt, Human
caugcuuugggucagaaaugcc

SEQ ID NO: 557557 - RNA, 22 nt, Human
ucauccaguaugacuggugucu

SEQ ID NO: 557558 - RNA, 22 nt, Human
aaggcaguacuuuauguccaua

SEQ ID NO: 557559 - RNA, 22 nt, Human
acuaaauacacacauuuguuca

SEQ ID NO: 557560 - RNA, 22 nt, Human
uugucuguaaagacggccacca

SEQ ID NO: 557561 - RNA, 22 nt, Human
uuaacauuucuuuuccacucau

SEQ ID NO: 557562 - RNA, 22 nt, Human
cauuguuaauugguaucuuaca

SEQ ID NO: 557563 - RNA, 22 nt, Human
gaaagcaguaaaugggucccau

SEQ ID NO: 557564 - RNA, 22 nt, Human
uguucuuuagcagaccauguug

SEQ ID NO: 557565 - RNA, 18 nt, Human
gagacacaagggccugga

SEQ ID NO: 557566 - RNA, 22 nt, Human
agcugccuguccuaggccauca

SEQ ID NO: 557567 - RNA, 22 nt, Human
gagcuucccucugcagucccug

SEQ ID NO: 557568 - RNA, 22 nt, Human
gccacagggcagaugcgcagag

SEQ ID NO: 557569 - RNA, 22 nt, Human
auaagguaugaaaaguaaaugg

SEQ ID NO: 557570 - RNA, 22 nt, Human
agguuuauguuuggugcaggag

SEQ ID NO: 557571 - RNA, 22 nt, Human
uagcagggguagauagagugug

SEQ ID NO: 557572 - RNA, 22 nt, Human
ggcagauggaagaggcuggguc

SEQ ID NO: 557573 - RNA, 22 nt, Human
aacagacauauuuuuaauaugc

SEQ ID NO: 557574 - RNA, 22 nt, Human
aaaggucagacuuaggcugggc

SEQ ID NO: 557575 - RNA, 22 nt, Human
ugcguugcgcuccugcagcagg

SEQ ID NO: 557576 - RNA, 22 nt, Human
ugaggggagacagaguggacuc

SEQ ID NO: 557577 - RNA, 22 nt, Human
agaaaccucacagcaauucuga

SEQ ID NO: 557578 - RNA, 22 nt, Human
aauguugauguuuucagugagc

SEQ ID NO: 557579 - RNA, 22 nt, Human
gaaaaugugucaucccuacugu

SEQ ID NO: 557580 - RNA, 22 nt, Human
uguauuucgcuagguacucccu

SEQ ID NO: 557581 - RNA, 22 nt, Human
acuguacuguguauuguagaau

SEQ ID NO: 557582 - RNA, 22 nt, Human
gaaacaacuacuauugauuucu

SEQ ID NO: 557583 - RNA, 22 nt, Human
ccugucauacuaacguaguggg

SEQ ID NO: 557584 - RNA, 22 nt, Human
cauguggcuuuggcaugugccc

SEQ ID NO: 557585 - RNA, 22 nt, Human
acuaaacacaugagauuccugc

SEQ ID NO: 557586 - RNA, 22 nt, Human
cacagcugcccuacuccaugug

SEQ ID NO: 557587 - RNA, 22 nt, Human
gucucaguaagaaaggcuccug

SEQ ID NO: 557588 - RNA, 22 nt, Human
augggcuggcagccugaacagc

SEQ ID NO: 557589 - RNA, 19 nt, Human
gcucucccucucaguugag

SEQ ID NO: 557590 - RNA, 22 nt, Human
gugggaugcaguggugaguggc

SEQ ID NO: 557591 - RNA, 22 nt, Human
uaacacugguauuucauuuagu

SEQ ID NO: 557592 - RNA, 22 nt, Human
cuuccucugcggcgccgggcgc

SEQ ID NO: 557593 - RNA, 22 nt, Human
cagcugaguguuggcauguuca

SEQ ID NO: 557594 - RNA, 22 nt, Human
aagaagugguuggaagaagcau

SEQ ID NO: 557595 - RNA, 22 nt, Human
acucugaaauagaggcuggugg

SEQ ID NO: 557596 - RNA, 22 nt, Human
cagaggggauaacagguguaga

SEQ ID NO: 557597 - RNA, 22 nt, Human
ugaguggaguagugaaugcauu

SEQ ID NO: 557598 - RNA, 22 nt, Human
uuucucucagccuguagaaacu

SEQ ID NO: 557599 - RNA, 22 nt, Human
ucagagaguccuggucauuugc

SEQ ID NO: 557600 - RNA, 20 nt, Human
ucagacagucgcaguucugg

SEQ ID NO: 557601 - RNA, 22 nt, Human
ggucccugaagaugccugagga

SEQ ID NO: 557602 - RNA, 22 nt, Human
cucaggagaugacagaagguau

SEQ ID NO: 557603 - RNA, 17 nt, Human
ggcuggaggggacccgg

SEQ ID NO: 557604 - RNA, 22 nt, Human
ugggcuccucgucacucgcugu

SEQ ID NO: 557605 - RNA, 22 nt, Human
ugaaggccuaacuuccagugcu

SEQ ID NO: 557606 - RNA, 22 nt, Human
uccuucagugucccgcucaggu

SEQ ID NO: 557607 - RNA, 22 nt, Human
caaagcaaggcucaguuugaac

SEQ ID NO: 557608 - RNA, 22 nt, Human
ugccacuggcucaauggugcag

SEQ ID NO: 557609 - RNA, 22 nt, Human
agaugguuaucuaagugaaaaa

SEQ ID NO: 557610 - RNA, 22 nt, Human
uuauuuguggcauaugagacga

SEQ ID NO: 557611 - RNA, 22 nt, Human
gaguccaguuguucacagaggc

SEQ ID NO: 557612 - RNA, 22 nt, Human
uguuuucuguguagagaucaca

SEQ ID NO: 557613 - RNA, 22 nt, Human
cuguacaggugaggagggggcu

SEQ ID NO: 557614 - RNA, 22 nt, Human
acagagauguggaugagggauu

SEQ ID NO: 557615 - RNA, 21 nt, Human
guucuggaggcugcaagucca

SEQ ID NO: 557616 - RNA, 22 nt, Human
uggcacauaguaggugcucaau

SEQ ID NO: 557617 - RNA, 22 nt, Human
uaaguucaagucuuggauauaa

SEQ ID NO: 557618 - RNA, 20 nt, Human
guuuuucuugggcgagcuau

SEQ ID NO: 557619 - RNA, 22 nt, Human
gacugggcuccaagagggagag

SEQ ID NO: 557620 - RNA, 22 nt, Human
aucuggcuugacuuugcgacuu

SEQ ID NO: 557621 - RNA, 22 nt, Human
uucuuuccucccagccuuugga

SEQ ID NO: 557622 - RNA, 21 nt, Human
gccugcuguucacccugccac

SEQ ID NO: 557623 - RNA, 22 nt, Human
augcaaaaguaguugcaguuuu

SEQ ID NO: 557624 - RNA, 22 nt, Human
ggccugcacagagguggcucua

SEQ ID NO: 557625 - RNA, 22 nt, Human
guuugucuuaauuaggcaucga

SEQ ID NO: 557626 - RNA, 22 nt, Human
uccuggagagugggcgagcaca

SEQ ID NO: 557627 - RNA, 22 nt, Human
uggcaggggaggugcuugcuua

SEQ ID NO: 557628 - RNA, 22 nt, Human
uuccagaguugggggagugguu

SEQ ID NO: 557629 - RNA, 22 nt, Human
ggcuggguuauuuauggccaag

SEQ ID NO: 557630 - RNA, 22 nt, Human
gcuaucuucauggaaauacagg

SEQ ID NO: 557631 - RNA, 20 nt, Human
cugaacacagaauaagcaca

SEQ ID NO: 557632 - RNA, 22 nt, Human
gcagauggaucaccugaggucg

SEQ ID NO: 557633 - RNA, 20 nt, Human
uguuaaaggacacuugcuuu

SEQ ID NO: 557634 - RNA, 18 nt, Human
agggucagugucacuggc

SEQ ID NO: 557635 - RNA, 22 nt, Human
ggcuagaacuuuacacuuugca

SEQ ID NO: 557636 - RNA, 22 nt, Human
uguaugaauauguuggggaggu

SEQ ID NO: 557637 - RNA, 22 nt, Human
uccauuuuagagaugaagaaac

SEQ ID NO: 557638 - RNA, 22 nt, Human
caguggcuguuucuggaaggca

SEQ ID NO: 557639 - RNA, 22 nt, Human
uguguacagcaggauuucucaa

SEQ ID NO: 557640 - RNA, 22 nt, Human
cagcauuggguuaccuuuguuu

SEQ ID NO: 557641 - RNA, 22 nt, Human
agccaggccagcugucuugagu

SEQ ID NO: 557642 - RNA, 22 nt, Human
aggcuuuccugucacucaugcu

SEQ ID NO: 557643 - RNA, 22 nt, Human
agcuuaaaguauuuaaauuuca

SEQ ID NO: 557644 - RNA, 22 nt, Human
aguggcagaucucuggucugga

SEQ ID NO: 557645 - RNA, 22 nt, Human
ucauuuaauugguuuugcucgu

SEQ ID NO: 557646 - RNA, 22 nt, Human
ucaggggaaaucucucagcgaa

SEQ ID NO: 557647 - RNA, 22 nt, Human
uuccaaauuaaaauguacaaug

SEQ ID NO: 557648 - RNA, 22 nt, Human
cacaauuagcagcucuuuauuu

SEQ ID NO: 557649 - RNA, 22 nt, Human
uggcuggggagccccgacuccc

SEQ ID NO: 557650 - RNA, 22 nt, Human
acagaguacauucagagacuau

SEQ ID NO: 557651 - RNA, 22 nt, Human
uucaagaugucuucacaauagu

SEQ ID NO: 557652 - RNA, 22 nt, Human
aauggcacuuuauaaauguuaa

SEQ ID NO: 557653 - RNA, 22 nt, Human
ugggcucugaagggucccggau

SEQ ID NO: 557654 - RNA, 22 nt, Human
uggcuggcuuguucacugacug

SEQ ID NO: 557655 - RNA, 23 nt, Human
cggacaaccauuguuuuaguauc

SEQ ID NO: 557656 - RNA, 16 nt, Human
gggcugggggauucug

SEQ ID NO: 557657 - RNA, 21 nt, Human
gauuuuaaagagacugccaca

SEQ ID NO: 557658 - RNA, 22 nt, Human
uggcagagacuccuccugggag

SEQ ID NO: 557659 - RNA, 22 nt, Human
uggcuggcaguaggcuaguggc

SEQ ID NO: 557660 - RNA, 23 nt, Human
gcucugagggcuuaucccuccca

SEQ ID NO: 557661 - RNA, 23 nt, Human
agcaggaaaccgagggugauguu

SEQ ID NO: 557662 - RNA, 19 nt, Human
gccagcagaaugaugaggc

SEQ ID NO: 557663 - RNA, 22 nt, Human
aaaguguugauaugugacaucc

SEQ ID NO: 557664 - RNA, 22 nt, Human
ccuggagccccucuggccagcc

SEQ ID NO: 557665 - RNA, 22 nt, Human
gauuuccuugcauauugguaau

SEQ ID NO: 557666 - RNA, 22 nt, Human
cuguccuugcuggccagguaug

SEQ ID NO: 557667 - RNA, 22 nt, Human
gagcacugauuuauuuuugucu

SEQ ID NO: 557668 - RNA, 22 nt, Human
ugagucagccagagcugccaug

SEQ ID NO: 557669 - RNA, 22 nt, Human
gaacaucagucauaauuuaacg

SEQ ID NO: 557670 - RNA, 22 nt, Human
aggucaagggagcugagggcca

SEQ ID NO: 557671 - RNA, 22 nt, Human
aggagcagaauuuaaugugcag

SEQ ID NO: 557672 - RNA, 22 nt, Human
ggcuucaagucguauauuuggg

SEQ ID NO: 557673 - RNA, 22 nt, Human
acacuucaaaugguuggaaaau

SEQ ID NO: 557674 - RNA, 22 nt, Human
cuggcucagugccuucagaagu

SEQ ID NO: 557675 - RNA, 22 nt, Human
ccugagacaugaaccaggcucc

SEQ ID NO: 557676 - RNA, 22 nt, Human
ccuccaaguuugacucaggaca

SEQ ID NO: 557677 - RNA, 22 nt, Human
aaacauuguuaugauaaauuac

SEQ ID NO: 557678 - RNA, 22 nt, Human
ugaggggagaagcagcagccug

SEQ ID NO: 557679 - RNA, 22 nt, Human
gauuaguauccuuauuaagaga

SEQ ID NO: 557680 - RNA, 19 nt, Human
ucagaggauuuggcuauga

SEQ ID NO: 557681 - RNA, 22 nt, Human
aggcagggcugggauuagacuc

SEQ ID NO: 557682 - RNA, 17 nt, Human
acagagcacaucaagau

SEQ ID NO: 557683 - RNA, 22 nt, Human
cacagggcagugauuguccaca

SEQ ID NO: 557684 - RNA, 22 nt, Human
acauuucugcauguaggguaau

SEQ ID NO: 557685 - RNA, 22 nt, Human
aaaucugguucaguaaguccuc

SEQ ID NO: 557686 - RNA, 22 nt, Human
uggugcaguccaaagggagcag

SEQ ID NO: 557687 - RNA, 22 nt, Human
gaaggcuggaaggcaaguagga

SEQ ID NO: 557688 - RNA, 22 nt, Human
cugaagcacagcauauaaauaa

SEQ ID NO: 557689 - RNA, 22 nt, Human
ggcaccugcucaucuggacuca

SEQ ID NO: 557690 - RNA, 22 nt, Human
acugggcucaagugauuguccu

SEQ ID NO: 557691 - RNA, 22 nt, Human
uacugaaagacugaauauuuag

SEQ ID NO: 557692 - RNA, 22 nt, Human
gagccaccuucaacucaggaau

SEQ ID NO: 557693 - RNA, 22 nt, Human
uacuuucauggguuuucuuuau

SEQ ID NO: 557694 - RNA, 22 nt, Human
cccaaccagaaauugacagaga

SEQ ID NO: 557695 - RNA, 22 nt, Human
gccugcagggccugggccuacc

SEQ ID NO: 557696 - RNA, 22 nt, Human
ucaggaugguccuuuaugagaa

SEQ ID NO: 557697 - RNA, 22 nt, Human
gcacccagcccagggcgugaug

SEQ ID NO: 557698 - RNA, 22 nt, Human
cucaggcugugccaccugugug

SEQ ID NO: 557699 - RNA, 22 nt, Human
agagcugcgucuauucacaauc

SEQ ID NO: 557700 - RNA, 22 nt, Human
uagcacaucuggcgcuuauagg

SEQ ID NO: 557701 - RNA, 22 nt, Human
aggaaacaguugguaaugcaua

SEQ ID NO: 557702 - RNA, 22 nt, Human
agcaggcugagcacccaggggg

SEQ ID NO: 557703 - RNA, 20 nt, Human
gcagagcuguucugugggga

SEQ ID NO: 557704 - RNA, 22 nt, Human
agugggggccaacgagggcagc

SEQ ID NO: 557705 - RNA, 19 nt, Human
ugcuuugcaucugauuguu

SEQ ID NO: 557706 - RNA, 22 nt, Human
agcacuuuauucaggaacucca

SEQ ID NO: 557707 - RNA, 22 nt, Human
gcucacagccggcuggcagggg

SEQ ID NO: 557708 - RNA, 21 nt, Human
gcaggguccuuuccauuccua

SEQ ID NO: 557709 - RNA, 22 nt, Human
uugcuuuguggugguucuucca

SEQ ID NO: 557710 - RNA, 20 nt, Human
gcuuuuucuaauagcagucc

SEQ ID NO: 557711 - RNA, 18 nt, Human
uaugugcauaugugugua

SEQ ID NO: 557712 - RNA, 22 nt, Human
cagcagguggacacacucaccu

SEQ ID NO: 557713 - RNA, 22 nt, Human
gccucuguaggagugagagcau

SEQ ID NO: 557714 - RNA, 22 nt, Human
guuugcauggaagacagugagu

SEQ ID NO: 557715 - RNA, 22 nt, Human
aauuucaaugcacucaugguug

SEQ ID NO: 557716 - RNA, 22 nt, Human
cuccagggggcauccacacagc

SEQ ID NO: 557717 - RNA, 22 nt, Human
agcagccacagucugggacagg

SEQ ID NO: 557718 - RNA, 22 nt, Human
agaccaagugcaggugccacua

SEQ ID NO: 557719 - RNA, 22 nt, Human
cucuuaaauaacaucauugcuu

SEQ ID NO: 557720 - RNA, 23 nt, Human
ugcaggugauuaauccaguuuca

SEQ ID NO: 557721 - RNA, 22 nt, Human
cuucuggaaacuuuuccaauuu

SEQ ID NO: 557722 - RNA, 22 nt, Human
uugugcagagaaaucuuucuug

SEQ ID NO: 557723 - RNA, 22 nt, Human
cuauaauuaugcucaaaaugua

SEQ ID NO: 557724 - RNA, 22 nt, Human
ugaggcucagagcaccugcucc

SEQ ID NO: 557725 - RNA, 22 nt, Human
aaagucacauauaacaagggca

SEQ ID NO: 557726 - RNA, 20 nt, Human
ccuggcuuugcaucugugau

SEQ ID NO: 557727 - RNA, 22 nt, Human
uuugugugaaaauauuuaaguu

SEQ ID NO: 557728 - RNA, 22 nt, Human
agugggcuuuuuuccguuccau

SEQ ID NO: 557729 - RNA, 22 nt, Human
cauuuuguagcaaugacuguug

SEQ ID NO: 557730 - RNA, 22 nt, Human
auucuccaucaccacuggcacu

SEQ ID NO: 557731 - RNA, 22 nt, Human
aaugcaaacagcccagaaucca

SEQ ID NO: 557732 - RNA, 22 nt, Human
ugggggagauuagagcuucuua

SEQ ID NO: 557733 - RNA, 22 nt, Human
gggaagggagggccuccaguca

SEQ ID NO: 557734 - RNA, 22 nt, Human
gcaggauggugcccuuucugcc

SEQ ID NO: 557735 - RNA, 21 nt, Human
uggaaagauucaaagaccagg

SEQ ID NO: 557736 - RNA, 22 nt, Human
ucugggcucuuaguguacccuc

SEQ ID NO: 557737 - RNA, 22 nt, Human
cagggcugcuggccgugcccuc

SEQ ID NO: 557738 - RNA, 22 nt, Human
ccugaggacacacgcugcagga

SEQ ID NO: 557739 - RNA, 22 nt, Human
ccucugggagacugcuacugag

SEQ ID NO: 557740 - RNA, 22 nt, Human
agaggaggcagcuuaacucagu

SEQ ID NO: 557741 - RNA, 21 nt, Human
gaugaagcaaucuuucuguug

SEQ ID NO: 557742 - RNA, 22 nt, Human
ugaaggucaugguaauauuuuu

SEQ ID NO: 557743 - RNA, 22 nt, Human
augugcaauuauuaagaagaga

SEQ ID NO: 557744 - RNA, 22 nt, Human
aagaugguuucuguagguuuau

SEQ ID NO: 557745 - RNA, 22 nt, Human
aggcugcucugcgaagucagcu

SEQ ID NO: 557746 - RNA, 22 nt, Human
cccucucucaggcugacagccu

SEQ ID NO: 557747 - RNA, 22 nt, Human
guuacaaagcacuucaagugaa

SEQ ID NO: 557748 - RNA, 22 nt, Human
gcugagucuugagcacugagca

SEQ ID NO: 557749 - RNA, 22 nt, Human
uaccuuuugcuuauuaugacac

SEQ ID NO: 557750 - RNA, 23 nt, Human
ccugccuguucuaacuccauuuc

SEQ ID NO: 557751 - RNA, 22 nt, Human
cacagaaucugugacuccaaga

SEQ ID NO: 557752 - RNA, 22 nt, Human
uucaacaaggcugucaaaaguu

SEQ ID NO: 557753 - RNA, 22 nt, Human
ccuugaggaguccauaguauca

SEQ ID NO: 557754 - RNA, 22 nt, Human
ugggcagaaugugggauccaga

SEQ ID NO: 557755 - RNA, 22 nt, Human
cuguaauucacuagggucagcg

SEQ ID NO: 557756 - RNA, 22 nt, Human
ggaaacuuggcauaauuuuaag

SEQ ID NO: 557757 - RNA, 22 nt, Human
agcagggcagcuuuuuucagaa

SEQ ID NO: 557758 - RNA, 22 nt, Human
auacaaagcuaaauaugguuuc

SEQ ID NO: 557759 - RNA, 22 nt, Human
uuugaucagcaagauaaauaga

SEQ ID NO: 557760 - RNA, 22 nt, Human
ggagcagagcucuucaucugca

SEQ ID NO: 557761 - RNA, 19 nt, Human
uucagaauugggaggugau

SEQ ID NO: 557762 - RNA, 22 nt, Human
cagaaacacuuguagagaaguu

SEQ ID NO: 557763 - RNA, 22 nt, Human
ugaguccaccuuaguauauggg

SEQ ID NO: 557764 - RNA, 22 nt, Human
agucaaagcuacaggcauuuga

SEQ ID NO: 557765 - RNA, 21 nt, Human
ucagagagucacagugaacug

SEQ ID NO: 557766 - RNA, 22 nt, Human
aaaacaguuuaggcaucacagu

SEQ ID NO: 557767 - RNA, 22 nt, Human
aguuuuaucuguaagcuguuca

SEQ ID NO: 557768 - RNA, 22 nt, Human
ucugccuggagaguucuucucu

SEQ ID NO: 557769 - RNA, 22 nt, Human
caggcccaugagggcagccaca

SEQ ID NO: 557770 - RNA, 22 nt, Human
auucagugugagguuuucaagu

SEQ ID NO: 557771 - RNA, 22 nt, Human
agaugcugugaggaagcuagga

SEQ ID NO: 557772 - RNA, 22 nt, Human
agucaccaacaugguucccagg

SEQ ID NO: 557773 - RNA, 22 nt, Human
ggcucuggagacauguggagag

SEQ ID NO: 557774 - RNA, 22 nt, Human
gaacaguaaauuuaugcagcac

SEQ ID NO: 557775 - RNA, 22 nt, Human
ugaaacaaauuuggaaaaucua

SEQ ID NO: 557776 - RNA, 22 nt, Human
uacaaagucuuggguucuaggc

SEQ ID NO: 557777 - RNA, 22 nt, Human
auuccaaagacagaagcagcug

SEQ ID NO: 557778 - RNA, 22 nt, Human
caaggccagggaauuuuucugg

SEQ ID NO: 557779 - RNA, 22 nt, Human
gggcagguguuuccaaggugag

SEQ ID NO: 557780 - RNA, 22 nt, Human
uucuaagugauucuagcuggac

SEQ ID NO: 557781 - RNA, 22 nt, Human
agagggugggcacgugauggau

SEQ ID NO: 557782 - RNA, 22 nt, Human
acagucaaucagaacagcaugu

SEQ ID NO: 557783 - RNA, 20 nt, Human
aaaggaauauaugaaguaua

SEQ ID NO: 557784 - RNA, 22 nt, Human
gaauguaauagucaguagaaca

SEQ ID NO: 557785 - RNA, 22 nt, Human
gugaauauucuuugugcaguau

SEQ ID NO: 557786 - RNA, 22 nt, Human
cuggcaggcucucuggucgguu

SEQ ID NO: 557787 - RNA, 22 nt, Human
ucuucuuugaaucauagugacc

SEQ ID NO: 557788 - RNA, 22 nt, Human
aaugaagccacugaagacaauc

SEQ ID NO: 557789 - RNA, 22 nt, Human
aagggcagggaguuugugucua

SEQ ID NO: 557790 - RNA, 22 nt, Human
ucaaagaacaucaucugaaaug

SEQ ID NO: 557791 - RNA, 22 nt, Human
uagcaaguggcaccacauuucu

SEQ ID NO: 557792 - RNA, 22 nt, Human
uccuccuguuucucaggccugg

SEQ ID NO: 557793 - RNA, 22 nt, Human
cacugggcgccagcugcugagc

SEQ ID NO: 557794 - RNA, 22 nt, Human
gcagguggauuaucagaagugc

SEQ ID NO: 557795 - RNA, 22 nt, Human
auaugugugccauuucagcagu

SEQ ID NO: 557796 - RNA, 22 nt, Human
ucugagggcuugaggggaagua

SEQ ID NO: 557797 - RNA, 22 nt, Human
ucacagcuuugagcagagacca

SEQ ID NO: 557798 - RNA, 22 nt, Human
gaggagguuccggguggagaag

SEQ ID NO: 557799 - RNA, 22 nt, Human
ggcugugaguuuguccuccaug

SEQ ID NO: 557800 - RNA, 22 nt, Human
ugagguguguccccagggaggu

SEQ ID NO: 557801 - RNA, 22 nt, Human
caggcauggugagaacucagcc

SEQ ID NO: 557802 - RNA, 22 nt, Human
uuuuaaguuaauauaauugagg

SEQ ID NO: 557803 - RNA, 22 nt, Human
augugagaauaacucaaaacaa

SEQ ID NO: 557804 - RNA, 22 nt, Human
uauaacaccauguucuacagau

SEQ ID NO: 557805 - RNA, 22 nt, Human
cagcagagguuggaacaguucu

SEQ ID NO: 557806 - RNA, 22 nt, Human
auggaauaauuguuucacagaa

SEQ ID NO: 557807 - RNA, 22 nt, Human
ucccagggacucucugccuucc

SEQ ID NO: 557808 - RNA, 20 nt, Human
gcuguugccaguacagaugg

SEQ ID NO: 557809 - RNA, 20 nt, Human
ggcugccuccuuccuuuccu

SEQ ID NO: 557810 - RNA, 22 nt, Human
ucuggcucucauacucgccagu

SEQ ID NO: 557811 - RNA, 22 nt, Human
uccagccaagccuugguagcug

SEQ ID NO: 557812 - RNA, 22 nt, Human
ccagagagguagcuuacccucu

SEQ ID NO: 557813 - RNA, 20 nt, Human
ggggcaguggcucaugccug

SEQ ID NO: 557814 - RNA, 22 nt, Human
agcccugcugcuucuuguauuu

SEQ ID NO: 557815 - RNA, 18 nt, Human
ggcaggcucucuggguca

SEQ ID NO: 557816 - RNA, 22 nt, Human
guggagaggaacccagcucugu

SEQ ID NO: 557817 - RNA, 22 nt, Human
ccuggcagaauauuaaagugca

SEQ ID NO: 557818 - RNA, 22 nt, Human
ucuggagcuuguuucagauggu

SEQ ID NO: 557819 - RNA, 22 nt, Human
gcuugcuggugccugcaggcuc

SEQ ID NO: 557820 - RNA, 22 nt, Human
acacauuuuggcuagguggaga

SEQ ID NO: 557821 - RNA, 22 nt, Human
acaugaacauuauaucagcaag

SEQ ID NO: 557822 - RNA, 22 nt, Human
ugucaccagcugcuccucagga

SEQ ID NO: 557823 - RNA, 23 nt, Human
aaaguugauuugcaguuuaagag

SEQ ID NO: 557824 - RNA, 22 nt, Human
cuccuuaaagggagcagcagcu

SEQ ID NO: 557825 - RNA, 22 nt, Human
gcuuggccagcagccgggaugc

SEQ ID NO: 557826 - RNA, 22 nt, Human
agucucagcuacuugggaggcu

SEQ ID NO: 557827 - RNA, 23 nt, Human
ggucccaguggagaggccucacc

SEQ ID NO: 557828 - RNA, 21 nt, Human
gccugggaagagaaagguaag

SEQ ID NO: 557829 - RNA, 22 nt, Human
aauuaggggaggacguaucaua

SEQ ID NO: 557830 - RNA, 22 nt, Human
uaagaacagauaaaguuucccc

SEQ ID NO: 557831 - RNA, 22 nt, Human
caacacauugaagcuaugauga

SEQ ID NO: 557832 - RNA, 22 nt, Human
cuuuauggagugacacaauggg

SEQ ID NO: 557833 - RNA, 22 nt, Human
auuucuuucuggccacgguuuu

SEQ ID NO: 557834 - RNA, 22 nt, Human
aggggaaggccagccuguagag

SEQ ID NO: 557835 - RNA, 22 nt, Human
cucuuuucaaaauuucacugca

SEQ ID NO: 557836 - RNA, 22 nt, Human
auauauaagcugaugagccaca

SEQ ID NO: 557837 - RNA, 22 nt, Human
auggaaagccaguguuccauca

SEQ ID NO: 557838 - RNA, 22 nt, Human
cuggcucaugugaugagggcaa

SEQ ID NO: 557839 - RNA, 22 nt, Human
ggccugcugcuaugacuuccug

SEQ ID NO: 557840 - RNA, 22 nt, Human
gcugcaggcggccgugguggcg

SEQ ID NO: 557841 - RNA, 22 nt, Human
uaguuuuagcagcaaugggaug

SEQ ID NO: 557842 - RNA, 22 nt, Human
ccaggcccugcuccucacacca

SEQ ID NO: 557843 - RNA, 16 nt, Human
aggcgaagguucauuu

SEQ ID NO: 557844 - RNA, 22 nt, Human
gcuggccauggggagugaggag

SEQ ID NO: 557845 - RNA, 22 nt, Human
cauguacaaaaggcaaaugccu

SEQ ID NO: 557846 - RNA, 22 nt, Human
ucccagaacccugccagguccu

SEQ ID NO: 557847 - RNA, 22 nt, Human
ucucagagccuaacuaaccuaa

SEQ ID NO: 557848 - RNA, 22 nt, Human
ucuuugcaacucccauuuccau

SEQ ID NO: 557849 - RNA, 21 nt, Human
cugcugcuggggucugggcag

SEQ ID NO: 557850 - RNA, 22 nt, Human
uggcucaguaaucgagucuccu

SEQ ID NO: 557851 - RNA, 22 nt, Human
aagucagacagcugagcugccu

SEQ ID NO: 557852 - RNA, 22 nt, Human
ccguggaguugugcugaguaug

SEQ ID NO: 557853 - RNA, 22 nt, Human
ugcaagagguuggauuuuaaga

SEQ ID NO: 557854 - RNA, 22 nt, Human
ugggcugcuguuacaggggcug

SEQ ID NO: 557855 - RNA, 22 nt, Human
cucagcagagaccagggaggaa

SEQ ID NO: 557856 - RNA, 22 nt, Human
gcauggcauuugaagguagaag

SEQ ID NO: 557857 - RNA, 22 nt, Human
aggagaaagacuggacagccaa

SEQ ID NO: 557858 - RNA, 22 nt, Human
auucaagagcccauguuuccug

SEQ ID NO: 557859 - RNA, 18 nt, Human
gcuggcugcacuucugcu

SEQ ID NO: 557860 - RNA, 22 nt, Human
uuaggcauauggcacaugauag

SEQ ID NO: 557861 - RNA, 22 nt, Human
uuacaagcagcuacauaucaca

SEQ ID NO: 557862 - RNA, 22 nt, Human
uggccuggcccugaggcccugu

SEQ ID NO: 557863 - RNA, 22 nt, Human
aauucugaugaauaaaucaucc

SEQ ID NO: 557864 - RNA, 22 nt, Human
ucuaggaguaaugagcuagcac

SEQ ID NO: 557865 - RNA, 22 nt, Human
caaugauucugcaacugugugc

SEQ ID NO: 557866 - RNA, 22 nt, Human
gcuuccuucuaccacaucaugc

SEQ ID NO: 557867 - RNA, 22 nt, Human
augaggcaugugaggagaaggg

SEQ ID NO: 557868 - RNA, 22 nt, Human
guccucagggaauguggcgggu

SEQ ID NO: 557869 - RNA, 22 nt, Human
aagcucuuugaccugggccugg

SEQ ID NO: 557870 - RNA, 19 nt, Human
acauggcaucccaggaggu

SEQ ID NO: 557871 - RNA, 22 nt, Human
ucaggauggcuucugcaucaaa

SEQ ID NO: 557872 - RNA, 22 nt, Human
aauaauuuccagccaacuggaa

SEQ ID NO: 557873 - RNA, 22 nt, Human
uggccaggccucuuggugccca

SEQ ID NO: 557874 - RNA, 22 nt, Human
auauuuguaaaauucugugucu

SEQ ID NO: 557875 - RNA, 22 nt, Human
cuugugcauuucauuccucagg

SEQ ID NO: 557876 - RNA, 22 nt, Human
aaaauaucagcaaagggugaca

SEQ ID NO: 557877 - RNA, 22 nt, Human
uuuguucaaauuuuccuaucug

SEQ ID NO: 557878 - RNA, 22 nt, Human
cagcucuguucauagauggugc

SEQ ID NO: 557879 - RNA, 22 nt, Human
gccuggauuacaaacagccaac

SEQ ID NO: 557880 - RNA, 22 nt, Human
uggcugagagaagacggggaag

SEQ ID NO: 557881 - RNA, 22 nt, Human
auguaauuuagaaaugaacaca

SEQ ID NO: 557882 - RNA, 22 nt, Human
ugaaacauuauagaauauuuau

SEQ ID NO: 557883 - RNA, 22 nt, Human
aaguuauuuccucgugacugaa

SEQ ID NO: 557884 - RNA, 22 nt, Human
agaguaugcuacaaagccagcc

SEQ ID NO: 557885 - RNA, 22 nt, Human
uugcagagccaugaggcuggcu

SEQ ID NO: 557886 - RNA, 22 nt, Human
aagugauucugauguguuucuu

SEQ ID NO: 557887 - RNA, 22 nt, Human
agcucugacauugauucucagc

SEQ ID NO: 557888 - RNA, 22 nt, Human
cucugugccucaguuuucuucu

SEQ ID NO: 557889 - RNA, 22 nt, Human
uggcuaggaccucugcggagca

SEQ ID NO: 557890 - RNA, 22 nt, Human
aagcaugcaaucugugauaagg

SEQ ID NO: 557891 - RNA, 22 nt, Human
uuaaugaaacauugacuaugau

SEQ ID NO: 557892 - RNA, 22 nt, Human
cucugagaugauaccuucugga

SEQ ID NO: 557893 - RNA, 22 nt, Human
uuagaaaggggugaaucaaugg

SEQ ID NO: 557894 - RNA, 22 nt, Human
agggacagucuacuguucacug

SEQ ID NO: 557895 - RNA, 22 nt, Human
accuuuuuguucuguucucagc

SEQ ID NO: 557896 - RNA, 22 nt, Human
gagagaagggggauaugagccu

SEQ ID NO: 557897 - RNA, 23 nt, Human
agaccugcaucugauaggcccug

SEQ ID NO: 557898 - RNA, 22 nt, Human
agagauauauauuuguuuacca

SEQ ID NO: 557899 - RNA, 22 nt, Human
uaaaugucaaugugauuuauaa

SEQ ID NO: 557900 - RNA, 22 nt, Human
ucugaggcuauguucaggcuaa

SEQ ID NO: 557901 - RNA, 18 nt, Human
aaacuguauuucuuucua

SEQ ID NO: 557902 - RNA, 22 nt, Human
gggagccacaguuuauagugau

SEQ ID NO: 557903 - RNA, 22 nt, Human
gcacacacaugugaguacaugc

SEQ ID NO: 557904 - RNA, 22 nt, Human
ggcucugcuucagaaggcucau

SEQ ID NO: 557905 - RNA, 22 nt, Human
ucagagucucccccaguuuggg

SEQ ID NO: 557906 - RNA, 22 nt, Human
ugaagaugucagcagggguggu

SEQ ID NO: 557907 - RNA, 22 nt, Human
agccuggaguucccaggagaag

SEQ ID NO: 557908 - RNA, 22 nt, Human
aauauaguucuagaaauauuuu

SEQ ID NO: 557909 - RNA, 22 nt, Human
uugugaaauguuucaaaauagu

SEQ ID NO: 557910 - RNA, 19 nt, Human
uucugcccucucuucuagc

SEQ ID NO: 557911 - RNA, 21 nt, Human
auucagaguaauucaucuuua

SEQ ID NO: 557912 - RNA, 22 nt, Human
caaagucagcugccagucccaa

SEQ ID NO: 557913 - RNA, 22 nt, Human
aaagaccugugguagcucuaaa

SEQ ID NO: 557914 - RNA, 22 nt, Human
acgcagaagggccuggcgugcc

SEQ ID NO: 557915 - RNA, 22 nt, Human
cagcaacucuccugugcucaaa

SEQ ID NO: 557916 - RNA, 22 nt, Human
ccagcugagaaguguaaaguga

SEQ ID NO: 557917 - RNA, 22 nt, Human
aaaaucugcacaggucaguuuu

SEQ ID NO: 557918 - RNA, 22 nt, Human
gucccaggucccagcacaucug

SEQ ID NO: 557919 - RNA, 22 nt, Human
gaagaaggugccagaggcuuac

SEQ ID NO: 557920 - RNA, 22 nt, Human
augaaauggugguuuuccauuu

SEQ ID NO: 557921 - RNA, 17 nt, Human
cauguguaugugggagu

SEQ ID NO: 557922 - RNA, 22 nt, Human
gaaauacuguaaaguuauuauu

SEQ ID NO: 557923 - RNA, 22 nt, Human
aaaggugacugcagcagcuauu

SEQ ID NO: 557924 - RNA, 22 nt, Human
ccauuaaacuuguggacccagu

SEQ ID NO: 557925 - RNA, 20 nt, Human
uauuucugggcaaccauuua

SEQ ID NO: 557926 - RNA, 22 nt, Human
cuggcagcuggaggcuagaggc

SEQ ID NO: 557927 - RNA, 22 nt, Human
caagauggguguugugaugguu

SEQ ID NO: 557928 - RNA, 22 nt, Human
acagccaggagccaugggcagg

SEQ ID NO: 557929 - RNA, 22 nt, Human
cugaggucuagacaccccaggg

SEQ ID NO: 557930 - RNA, 19 nt, Human
acccucucagugccugagg

SEQ ID NO: 557931 - RNA, 22 nt, Human
cuggaagcgucggaggaagggc

SEQ ID NO: 557932 - RNA, 22 nt, Human
ucuaaacauuaugauaguagag

SEQ ID NO: 557933 - RNA, 22 nt, Human
auauucacugagcauaaagcca

SEQ ID NO: 557934 - RNA, 22 nt, Human
ucagcaaugugauacugugcaa

SEQ ID NO: 557935 - RNA, 22 nt, Human
uacagauauguaugcacuuuuu

SEQ ID NO: 557936 - RNA, 22 nt, Human
ugccaggcgugguggugcgcac

SEQ ID NO: 557937 - RNA, 22 nt, Human
acacauguacagauuaguauuu

SEQ ID NO: 557938 - RNA, 22 nt, Human
uuagggaaggcugcugucagcu

SEQ ID NO: 557939 - RNA, 22 nt, Human
ucucccaguggugcagaaagca

SEQ ID NO: 557940 - RNA, 22 nt, Human
auggcagggaccaagcugucau

SEQ ID NO: 557941 - RNA, 22 nt, Human
aaucaacaggaugugcauugua

SEQ ID NO: 557942 - RNA, 22 nt, Human
agcuuuaucagaggagucucua

SEQ ID NO: 557943 - RNA, 20 nt, Human
aggcucagcugagcucuugg

SEQ ID NO: 557944 - RNA, 23 nt, Human
uuucacauuaauguuuagcagga

SEQ ID NO: 557945 - RNA, 22 nt, Human
ggcagcugggucacaccgaucu

SEQ ID NO: 557946 - RNA, 22 nt, Human
ucccugcagacguccugcgggu

SEQ ID NO: 557947 - RNA, 22 nt, Human
auacaaagacaaaucucaaucu

SEQ ID NO: 557948 - RNA, 22 nt, Human
ucaggcugaaaggacuccaguu

SEQ ID NO: 557949 - RNA, 22 nt, Human
ccagcuggucugugcucauguu

SEQ ID NO: 557950 - RNA, 22 nt, Human
aggcagagcuggguuuugaaau

SEQ ID NO: 557951 - RNA, 22 nt, Human
cagcuucuucaguccuggagcu

SEQ ID NO: 557952 - RNA, 22 nt, Human
cagaguuuugugaacaacuugg

SEQ ID NO: 557953 - RNA, 22 nt, Human
ccuguucaccauggucacgugc

SEQ ID NO: 557954 - RNA, 19 nt, Human
uggcaggcccaggauggac

SEQ ID NO: 557955 - RNA, 22 nt, Human
ugcugagagccagggcuggcau

SEQ ID NO: 557956 - RNA, 22 nt, Human
aagcugccauagaacgagaggu

SEQ ID NO: 557957 - RNA, 22 nt, Human
gagggaaagguuaauacaugau

SEQ ID NO: 557958 - RNA, 22 nt, Human
ucagggaagaaaugggacuuua

SEQ ID NO: 557959 - RNA, 22 nt, Human
ugcagagugaggaagaacugca

SEQ ID NO: 557960 - RNA, 22 nt, Human
gcuccugggcccugggcuaacu

SEQ ID NO: 557961 - RNA, 22 nt, Human
ucggagcuguagaugaaacccu

SEQ ID NO: 557962 - RNA, 22 nt, Human
agaaggaguguacaggucaugc

SEQ ID NO: 557963 - RNA, 22 nt, Human
uugcauugugauuacagaggug

SEQ ID NO: 557964 - RNA, 22 nt, Human
uucaagguaugguagcugguca

SEQ ID NO: 557965 - RNA, 22 nt, Human
uaaagcagcguggguggggcag

SEQ ID NO: 557966 - RNA, 22 nt, Human
uugcaacauuguaaguuuauau

SEQ ID NO: 557967 - RNA, 22 nt, Human
acaccaaaguagaauuaaugua

SEQ ID NO: 557968 - RNA, 22 nt, Human
gaagcagacuuuugcuuauuug

SEQ ID NO: 557969 - RNA, 22 nt, Human
cuauuuuaacuugauuaccucu

SEQ ID NO: 557970 - RNA, 22 nt, Human
gccagacacuccccugggcagg

SEQ ID NO: 557971 - RNA, 22 nt, Human
ccucacagggccaggccccuca

SEQ ID NO: 557972 - RNA, 22 nt, Human
ucauuuaauaauuuuugaguag

SEQ ID NO: 557973 - RNA, 22 nt, Human
agucaguagauccaaacuuuug

SEQ ID NO: 557974 - RNA, 23 nt, Human
uccuuuaaugcuggaauggcuag

SEQ ID NO: 557975 - RNA, 22 nt, Human
aauuuuauuagaaggcaagggg

SEQ ID NO: 557976 - RNA, 22 nt, Human
cucugaggcuccaugcaggcuu

SEQ ID NO: 557977 - RNA, 22 nt, Human
gagcacccuuugcacaucaguc

SEQ ID NO: 557978 - RNA, 22 nt, Human
aaaguucuaaaacucuuuguga

SEQ ID NO: 557979 - RNA, 22 nt, Human
cgaggcagacaaaaguuggaag

SEQ ID NO: 557980 - RNA, 22 nt, Human
aucaugcuuggauuauguuugg

SEQ ID NO: 557981 - RNA, 22 nt, Human
gagccaggucgggccgcggcga

SEQ ID NO: 557982 - RNA, 22 nt, Human
aaaguguacuaugucaugaaca

SEQ ID NO: 557983 - RNA, 22 nt, Human
gaacuucagaaucagcauaucu

SEQ ID NO: 557984 - RNA, 22 nt, Human
aaggagcucccggcagaccagg

SEQ ID NO: 557985 - RNA, 22 nt, Human
acaugccagaacuuguaccaau

SEQ ID NO: 557986 - RNA, 19 nt, Human
cccucuugcacaaagcaaa

SEQ ID NO: 557987 - RNA, 22 nt, Human
ucagaguggugguuuugccuuc

SEQ ID NO: 557988 - RNA, 22 nt, Human
aacacaguuuuccaaaauagag

SEQ ID NO: 557989 - RNA, 22 nt, Human
ggggcagagucuggacuguugu

SEQ ID NO: 557990 - RNA, 22 nt, Human
gacagccaugcacuucugcugu

SEQ ID NO: 557991 - RNA, 22 nt, Human
gaagcuggggugcugagggcaa

SEQ ID NO: 557992 - RNA, 22 nt, Human
gcagcguggggcugagucagcu

SEQ ID NO: 557993 - RNA, 22 nt, Human
auacaucaugcuccauauauuu

SEQ ID NO: 557994 - RNA, 22 nt, Human
aaggcacuagcagaauuaguga

SEQ ID NO: 557995 - RNA, 22 nt, Human
augggcugacuaaugguaaacu

SEQ ID NO: 557996 - RNA, 22 nt, Human
acagaauauugguuacuguugc

SEQ ID NO: 557997 - RNA, 22 nt, Human
aagaacauuuuguagaaugaca

SEQ ID NO: 557998 - RNA, 22 nt, Human
ggcagugacuguucagacgucc

SEQ ID NO: 557999 - RNA, 22 nt, Human
cccugcagaaccacagacaaac

SEQ ID NO: 558000 - RNA, 22 nt, Human
aggggcugccuggcuuggcacu

SEQ ID NO: 558001 - RNA, 22 nt, Human
ucaggaagcuacugccagcagc

SEQ ID NO: 558002 - RNA, 22 nt, Human
cugacucuccucaagcauaaau

SEQ ID NO: 558003 - RNA, 22 nt, Human
acagaguaucuaucaggaguau

SEQ ID NO: 558004 - RNA, 22 nt, Human
ucagaggaauaaugcugcauuu

SEQ ID NO: 558005 - RNA, 22 nt, Human
aguuaaaucauuacugacagag

SEQ ID NO: 558006 - RNA, 22 nt, Human
uucuuaagcaccuaaaaagugg

SEQ ID NO: 558007 - RNA, 22 nt, Human
cuccugggagcagggauggaug

SEQ ID NO: 558008 - RNA, 22 nt, Human
uuguacaaguauuaugugaaca

SEQ ID NO: 558009 - RNA, 20 nt, Human
gggagcuggaauugucuuag

SEQ ID NO: 558010 - RNA, 22 nt, Human
agcaccaucacagcuguauguc

SEQ ID NO: 558011 - RNA, 21 nt, Human
acugcaaacagcagagacuga

SEQ ID NO: 558012 - RNA, 22 nt, Human
cagugcugggcagaggagagcg

SEQ ID NO: 558013 - RNA, 22 nt, Human
ucugaggcauacccaggccccc

SEQ ID NO: 558014 - RNA, 22 nt, Human
uggccugaauuauggcagaucu

SEQ ID NO: 558015 - RNA, 22 nt, Human
accaggcugugaagugagacua

SEQ ID NO: 558016 - RNA, 22 nt, Human
gggaccuggacaugugugugcu

SEQ ID NO: 558017 - RNA, 22 nt, Human
ggcaggagaauggcgugaacuc

SEQ ID NO: 558018 - RNA, 22 nt, Human
ccuccaagcugguccucugugu

SEQ ID NO: 558019 - RNA, 22 nt, Human
uuucacauuuaggcgugaauug

SEQ ID NO: 558020 - RNA, 22 nt, Human
ggguccugcgugggcccaggac

SEQ ID NO: 558021 - RNA, 22 nt, Human
gagaggaaagaaccaaugaccc

SEQ ID NO: 558022 - RNA, 22 nt, Human
uaguacuuaucucugucauugu

SEQ ID NO: 558023 - RNA, 22 nt, Human
gacacauaugcguauaguuuag

SEQ ID NO: 558024 - RNA, 22 nt, Human
aggagaggcaucaagaaaaucg

SEQ ID NO: 558025 - RNA, 22 nt, Human
gccccagguugccugucccagg

SEQ ID NO: 558026 - RNA, 22 nt, Human
ggcuucagugagcugagcucac

SEQ ID NO: 558027 - RNA, 23 nt, Human
aaacaugcagcacaugaaugcua

SEQ ID NO: 558028 - RNA, 22 nt, Human
augcacaagaggcuagaaaaga

SEQ ID NO: 558029 - RNA, 22 nt, Human
gcuuagucaauuauaaauaggc

SEQ ID NO: 558030 - RNA, 22 nt, Human
ggcaggguggcccuccagugag

SEQ ID NO: 558031 - RNA, 22 nt, Human
ucucagugagcuuuucuauguu

SEQ ID NO: 558032 - RNA, 22 nt, Human
gagggcugaagauuguggcccc

SEQ ID NO: 558033 - RNA, 22 nt, Human
ugggcagacgcuguuggaaggc

SEQ ID NO: 558034 - RNA, 22 nt, Human
uuugugugcaacgcauggaguc

SEQ ID NO: 558035 - RNA, 22 nt, Human
gugggcaaggucccugccagcu

SEQ ID NO: 558036 - RNA, 22 nt, Human
auguaucaacaaauuguacagu

SEQ ID NO: 558037 - RNA, 22 nt, Human
caggaggcagaggaugcccagu

SEQ ID NO: 558038 - RNA, 22 nt, Human
cuuucugauuuuaagcucuaau

SEQ ID NO: 558039 - RNA, 22 nt, Human
ugucuguuauugguguauaaga

SEQ ID NO: 558040 - RNA, 22 nt, Human
caggccugagacaucugagaua

SEQ ID NO: 558041 - RNA, 22 nt, Human
uuuauuguuguuagucauaagu

SEQ ID NO: 558042 - RNA, 22 nt, Human
cagcucuggcgucagggagcga

SEQ ID NO: 558043 - RNA, 22 nt, Human
cuuuaauuaggaaguauaauga

SEQ ID NO: 558044 - RNA, 22 nt, Human
ucaccuuagcuagaggaagaga

SEQ ID NO: 558045 - RNA, 22 nt, Human
gcuuucuuaguguguuaauugg

SEQ ID NO: 558046 - RNA, 22 nt, Human
agcugcuccuuuccugcaggcg

SEQ ID NO: 558047 - RNA, 22 nt, Human
cuggggcccaucgagggcugag

SEQ ID NO: 558048 - RNA, 22 nt, Human
ugucauuuaaagcuuuccagau

SEQ ID NO: 558049 - RNA, 22 nt, Human
agaauauucaucuguauucuua

SEQ ID NO: 558050 - RNA, 22 nt, Human
uucagcuaaaaaugcccacuug

SEQ ID NO: 558051 - RNA, 22 nt, Human
ggaggaugccaagcugugcaca

SEQ ID NO: 558052 - RNA, 22 nt, Human
uucaacaaacuguucacgaaug

SEQ ID NO: 558053 - RNA, 22 nt, Human
ccaggcucagcuauuaagaaac

SEQ ID NO: 558054 - RNA, 22 nt, Human
ggcugcaggcaggguauccacu

SEQ ID NO: 558055 - RNA, 22 nt, Human
uaauauuucuacccugcugccu

SEQ ID NO: 558056 - RNA, 22 nt, Human
agcccugcgaucgugauuucuu

SEQ ID NO: 558057 - RNA, 22 nt, Human
uagugucugaaugcaccuguuu

SEQ ID NO: 558058 - RNA, 22 nt, Human
aacagcuuugcuucuggagaca

SEQ ID NO: 558059 - RNA, 22 nt, Human
uucuggcucauaugcuaagaag

SEQ ID NO: 558060 - RNA, 22 nt, Human
uggcucugaucagauguccagu

SEQ ID NO: 558061 - RNA, 22 nt, Human
auucuauagacagaaggucaau

SEQ ID NO: 558062 - RNA, 22 nt, Human
ugguaucaaacaauuaauuaga

SEQ ID NO: 558063 - RNA, 22 nt, Human
cagaugcuuuugauucuggggu

SEQ ID NO: 558064 - RNA, 20 nt, Human
aggaagauccuuucuuuuaa

SEQ ID NO: 558065 - RNA, 22 nt, Human
cuggaguuagaguagacacuga

SEQ ID NO: 558066 - RNA, 22 nt, Human
uccucagucguuugagccaaaa

SEQ ID NO: 558067 - RNA, 22 nt, Human
cuugccuucuuuuccuauagaa

SEQ ID NO: 558068 - RNA, 20 nt, Human
cugcccagccacugagggau

SEQ ID NO: 558069 - RNA, 22 nt, Human
aggaagaaccuaagaaagucuc

SEQ ID NO: 558070 - RNA, 22 nt, Human
cauacaaauguguccaggcucu

SEQ ID NO: 558071 - RNA, 21 nt, Human
cagugcucaaucugacagugg

SEQ ID NO: 558072 - RNA, 22 nt, Human
aaguuuaagguggaaguggugg

SEQ ID NO: 558073 - RNA, 22 nt, Human
ucaaggugcugugcugugcuag

SEQ ID NO: 558074 - RNA, 22 nt, Human
cgccaggcuugguagcucaugc

SEQ ID NO: 558075 - RNA, 22 nt, Human
ugcaggagcccuugggcucugg

SEQ ID NO: 558076 - RNA, 22 nt, Human
ugcuuuuuaguacugucuuauu

SEQ ID NO: 558077 - RNA, 22 nt, Human
gggaccuggucuagcacugagc

SEQ ID NO: 558078 - RNA, 22 nt, Human
acauuguauaaugauuaucaca

SEQ ID NO: 558079 - RNA, 21 nt, Human
gcugggcuccagucugccgcu

SEQ ID NO: 558080 - RNA, 22 nt, Human
gagagggguuugccauccuaug

SEQ ID NO: 558081 - RNA, 22 nt, Human
acuguucauccuuuuugaacaa

SEQ ID NO: 558082 - RNA, 22 nt, Human
uucugagaaggcuguggacaca

SEQ ID NO: 558083 - RNA, 22 nt, Human
aggcucagaggugagcaucugc

SEQ ID NO: 558084 - RNA, 22 nt, Human
aaaacaguuauaaacagaguca

SEQ ID NO: 558085 - RNA, 16 nt, Human
cuuccucuucacuggc

SEQ ID NO: 558086 - RNA, 21 nt, Human
ggccagcucggaaggucccau

SEQ ID NO: 558087 - RNA, 22 nt, Human
uguaaaauaauucuccauguuu

SEQ ID NO: 558088 - RNA, 22 nt, Human
ucuucacaugaccuucaugucu

SEQ ID NO: 558089 - RNA, 20 nt, Human
ccaauaaagcucuauaggga

SEQ ID NO: 558090 - RNA, 22 nt, Human
cagcagggcccccgggugcgcc

SEQ ID NO: 558091 - RNA, 22 nt, Human
cugucuguuucugauucaaccu

SEQ ID NO: 558092 - RNA, 22 nt, Human
aggggcugcuggguccgccccu

SEQ ID NO: 558093 - RNA, 22 nt, Human
auacauguaacugcauuguaau

SEQ ID NO: 558094 - RNA, 22 nt, Human
auugucuuuggugcuuccagga

SEQ ID NO: 558095 - RNA, 22 nt, Human
uccaggccgcaggggcagcccc

SEQ ID NO: 558096 - RNA, 22 nt, Human
gcaucuaaauaaacgugggagu

SEQ ID NO: 558097 - RNA, 22 nt, Human
aaguuacagucagagguuaaca

SEQ ID NO: 558098 - RNA, 22 nt, Human
ccagcucaucucagugaaaugc

SEQ ID NO: 558099 - RNA, 22 nt, Human
agcacagauucugaagaguccu

SEQ ID NO: 558100 - RNA, 22 nt, Human
uguuagcugugcuuuagccuuc

SEQ ID NO: 558101 - RNA, 22 nt, Human
aaaucacagggucucuaaguau

SEQ ID NO: 558102 - RNA, 22 nt, Human
gcugagugaggcugucaaaaug

SEQ ID NO: 558103 - RNA, 22 nt, Human
gaaaucugcuucuugcauagua

SEQ ID NO: 558104 - RNA, 22 nt, Human
uaagauuuuuaaaauguccuca

SEQ ID NO: 558105 - RNA, 23 nt, Human
cguuuuuuccucagauguucugg

SEQ ID NO: 558106 - RNA, 22 nt, Human
gagcuggacuuucagauacauc

SEQ ID NO: 558107 - RNA, 22 nt, Human
uacuauuuuugcaacguauaca

SEQ ID NO: 558108 - RNA, 22 nt, Human
guugaaagcuuuucauuuaguu

SEQ ID NO: 558109 - RNA, 22 nt, Human
aagccagggguugguaugcuau

SEQ ID NO: 558110 - RNA, 22 nt, Human
gcagagcucaugccugcaccuc

SEQ ID NO: 558111 - RNA, 22 nt, Human
ccugcuggcgcuugucugggag

SEQ ID NO: 558112 - RNA, 22 nt, Human
cucaguuucugacauuaaaauc

SEQ ID NO: 558113 - RNA, 22 nt, Human
ccaggccuguguuguguggagg

SEQ ID NO: 558114 - RNA, 17 nt, Human
ugguggcuggagucagg

SEQ ID NO: 558115 - RNA, 22 nt, Human
ucugcucagugcuuaucucuaa

SEQ ID NO: 558116 - RNA, 22 nt, Human
cuggggaccagugucuguuugu

SEQ ID NO: 558117 - RNA, 22 nt, Human
aggucacccguuugacuaucca

SEQ ID NO: 558118 - RNA, 22 nt, Human
uuaacacauauuuaucaauugc

SEQ ID NO: 558119 - RNA, 22 nt, Human
uuggugucuuuuuuauacaugu

SEQ ID NO: 558120 - RNA, 22 nt, Human
uaggaauuuuuguaaugguacu

SEQ ID NO: 558121 - RNA, 22 nt, Human
uaggggaacuggcacagggcag

SEQ ID NO: 558122 - RNA, 22 nt, Human
uauuucugagaaccaacuuacc

SEQ ID NO: 558123 - RNA, 22 nt, Human
agaacuuaggaacaacagcuua

SEQ ID NO: 558124 - RNA, 18 nt, Human
ugaggcucagcuccuggu

SEQ ID NO: 558125 - RNA, 22 nt, Human
ggacacagauaaucacacagau

SEQ ID NO: 558126 - RNA, 23 nt, Human
cauggaaaacugaaagcugaccu

SEQ ID NO: 558127 - RNA, 22 nt, Human
gcaugcugcugaggcuggaaua

SEQ ID NO: 558128 - RNA, 22 nt, Human
caugcuuuaccaaagcagugau

SEQ ID NO: 558129 - RNA, 22 nt, Human
aauuauacauugaacaaucuag

SEQ ID NO: 558130 - RNA, 22 nt, Human
aaauguaagucuuuguuucuua

SEQ ID NO: 558131 - RNA, 23 nt, Human
uauuacaauuggucuuauuaaga

SEQ ID NO: 558132 - RNA, 22 nt, Human
cauuuagaaacuguuuuuaaca

SEQ ID NO: 558133 - RNA, 22 nt, Human
uacacagacucuucaauucaga

SEQ ID NO: 558134 - RNA, 22 nt, Human
cagcagggggcagcgcagauca

SEQ ID NO: 558135 - RNA, 22 nt, Human
uugaagcauuugcuauagcauu

SEQ ID NO: 558136 - RNA, 22 nt, Human
aaauguguuugauaggaauauu

SEQ ID NO: 558137 - RNA, 22 nt, Human
aaucaugugggauagucugcuc

SEQ ID NO: 558138 - RNA, 20 nt, Human
agggucaguagcacagagcu

SEQ ID NO: 558139 - RNA, 22 nt, Human
ugacauuuaagccucugauuuc

SEQ ID NO: 558140 - RNA, 22 nt, Human
ggucucuguugccuccaucaag

SEQ ID NO: 558141 - RNA, 22 nt, Human
ccuuuacaaaguucuucauggg

SEQ ID NO: 558142 - RNA, 22 nt, Human
ccucacaguuuggcuaacugug

SEQ ID NO: 558143 - RNA, 22 nt, Human
gcauuuuaauaagauucauagg

SEQ ID NO: 558144 - RNA, 22 nt, Human
ggcugagcccccucugcguagg

SEQ ID NO: 558145 - RNA, 22 nt, Human
ggcuuuauuugcagccauuguu

SEQ ID NO: 558146 - RNA, 22 nt, Human
guuaaugugucugacacaaugg

SEQ ID NO: 558147 - RNA, 22 nt, Human
guaucuuuuacaccaggaaauu

SEQ ID NO: 558148 - RNA, 22 nt, Human
agaguguuauuugcucuguauu

SEQ ID NO: 558149 - RNA, 22 nt, Human
gggaggugaaagguugcugcag

SEQ ID NO: 558150 - RNA, 23 nt, Human
cugcuguguuggucucgauggga

SEQ ID NO: 558151 - RNA, 22 nt, Human
aggcagggugaugauaaugauu

SEQ ID NO: 558152 - RNA, 22 nt, Human
ugagagugaaaugucacauguc

SEQ ID NO: 558153 - RNA, 22 nt, Human
auuguaaaaguauucuaagauu

SEQ ID NO: 558154 - RNA, 22 nt, Human
ucuaaacacuaagucuugaugc

SEQ ID NO: 558155 - RNA, 22 nt, Human
augaguaaaaccacuauuuaca

SEQ ID NO: 558156 - RNA, 20 nt, Human
acagaauaugcugguugugg

SEQ ID NO: 558157 - RNA, 22 nt, Human
cugccuggucucaggcaugggg

SEQ ID NO: 558158 - RNA, 22 nt, Human
gcacuuaacuggaaaagaauuu

SEQ ID NO: 558159 - RNA, 22 nt, Human
aggaggaauacaauccagcagc

SEQ ID NO: 558160 - RNA, 22 nt, Human
caggcccaucugcucccaggcu

SEQ ID NO: 558161 - RNA, 22 nt, Human
ugcagcugccuagggcuggcuu

SEQ ID NO: 558162 - RNA, 20 nt, Human
aagagcugacucacaguggu

SEQ ID NO: 558163 - RNA, 22 nt, Human
gugauuucaaauauagagugag

SEQ ID NO: 558164 - RNA, 22 nt, Human
cagcagaggaaagcaaaucuaa

SEQ ID NO: 558165 - RNA, 22 nt, Human
cuggagugacuuuguuccuuuu

SEQ ID NO: 558166 - RNA, 22 nt, Human
ucuuucagcucuucaggaccca

SEQ ID NO: 558167 - RNA, 22 nt, Human
ucagauuuccuugcaguuugga

SEQ ID NO: 558168 - RNA, 22 nt, Human
uggaaggcaugggaacuguucu

SEQ ID NO: 558169 - RNA, 22 nt, Human
ugcaguggaaucuggagagcag

SEQ ID NO: 558170 - RNA, 20 nt, Human
ugccugggaaggcguggagg

SEQ ID NO: 558171 - RNA, 20 nt, Human
cccucugcacauggcugugg

SEQ ID NO: 558172 - RNA, 22 nt, Human
ucagaaauguaagcugaugacu

SEQ ID NO: 558173 - RNA, 22 nt, Human
gcugagcuagaaaaggaccaca

SEQ ID NO: 558174 - RNA, 22 nt, Human
uugugcauuucucugagugugu

SEQ ID NO: 558175 - RNA, 22 nt, Human
agaaaagggcaggagggauaca

SEQ ID NO: 558176 - RNA, 22 nt, Human
agcagaaccugcagaccugucu

SEQ ID NO: 558177 - RNA, 22 nt, Human
ccugucuggggacucccugggu

SEQ ID NO: 558178 - RNA, 22 nt, Human
uaauuuauuucaacugccaagg

SEQ ID NO: 558179 - RNA, 22 nt, Human
uagcacauaacuuagaauaguu

SEQ ID NO: 558180 - RNA, 22 nt, Human
gaguccaguuagugaggcuggg

SEQ ID NO: 558181 - RNA, 21 nt, Human
uauacaugugugcauacgugu

SEQ ID NO: 558182 - RNA, 22 nt, Human
ccuuuucuauccuucuagguuc

SEQ ID NO: 558183 - RNA, 22 nt, Human
gccaggcuccccggaucccugg

SEQ ID NO: 558184 - RNA, 22 nt, Human
cagcccugagagaaccaucuau

SEQ ID NO: 558185 - RNA, 22 nt, Human
uuuauuauagugguggggacug

SEQ ID NO: 558186 - RNA, 22 nt, Human
aucuucaucaaguucacagugg

SEQ ID NO: 558187 - RNA, 22 nt, Human
ucagguggcugguugcuggcua

SEQ ID NO: 558188 - RNA, 22 nt, Human
uaaaaucaccaaaagcaggugg

SEQ ID NO: 558189 - RNA, 22 nt, Human
agccaaggagugcagguggcuu

SEQ ID NO: 558190 - RNA, 22 nt, Human
uggcugcuagccagagcuucag

SEQ ID NO: 558191 - RNA, 22 nt, Human
cagugaggaguccagggcagag

SEQ ID NO: 558192 - RNA, 22 nt, Human
cagcaugcaaguccagaugugg

SEQ ID NO: 558193 - RNA, 22 nt, Human
cugcugcucgaccagucccagg

SEQ ID NO: 558194 - RNA, 22 nt, Human
cagaaauggucuguucagcuua

SEQ ID NO: 558195 - RNA, 22 nt, Human
uguacacaaugauaaauuauua

SEQ ID NO: 558196 - RNA, 22 nt, Human
aaacaucuucucuugauucuuu

SEQ ID NO: 558197 - RNA, 22 nt, Human
acaacacagcaaaaccccaucu

SEQ ID NO: 558198 - RNA, 22 nt, Human
ucaguguugugcacauacaaaa

SEQ ID NO: 558199 - RNA, 21 nt, Human
agggagcuauuuauaguaagc

SEQ ID NO: 558200 - RNA, 22 nt, Human
ugcucuucggggccacugcuug

SEQ ID NO: 558201 - RNA, 17 nt, Human
gguguauggggagggaa

SEQ ID NO: 558202 - RNA, 22 nt, Human
cagucuuugacaagcccuuuca

SEQ ID NO: 558203 - RNA, 22 nt, Human
aggcaggcaaccaccugggaag

SEQ ID NO: 558204 - RNA, 22 nt, Human
uagaaaguaaaucaguuuuauu

SEQ ID NO: 558205 - RNA, 22 nt, Human
caguucugagcuuucccagaag

SEQ ID NO: 558206 - RNA, 22 nt, Human
ccagaaagaaugaacugaaccc

SEQ ID NO: 558207 - RNA, 22 nt, Human
aaauaacagucagggacaacau

SEQ ID NO: 558208 - RNA, 22 nt, Human
cugucacacuaaaacaagaagu

SEQ ID NO: 558209 - RNA, 22 nt, Human
guauuaggugguggaauuguag

SEQ ID NO: 558210 - RNA, 22 nt, Human
ugcugaaauauuuaugggucaa

SEQ ID NO: 558211 - RNA, 22 nt, Human
ugcugucccuaagucucuucaa

SEQ ID NO: 558212 - RNA, 22 nt, Human
auaguaacuggcauguuuauga

SEQ ID NO: 558213 - RNA, 23 nt, Human
aggaagagagagugccucuuucu

SEQ ID NO: 558214 - RNA, 22 nt, Human
gaccuucaagcaccauauuuau

SEQ ID NO: 558215 - RNA, 22 nt, Human
aaauuagaaauacuuucaaagc

SEQ ID NO: 558216 - RNA, 22 nt, Human
agcugcaggcgccggggccgau

SEQ ID NO: 558217 - RNA, 22 nt, Human
gccugaccucuucugcccuggg

SEQ ID NO: 558218 - RNA, 22 nt, Human
aucauuuugugacaaugccugu

SEQ ID NO: 558219 - RNA, 22 nt, Human
gagccugggacugggggucaug

SEQ ID NO: 558220 - RNA, 22 nt, Human
acagaaguuggaauuagauacu

SEQ ID NO: 558221 - RNA, 23 nt, Human
auauuagggagauuagcccucua

SEQ ID NO: 558222 - RNA, 22 nt, Human
cugggcagguauacaaaaaaug

SEQ ID NO: 558223 - RNA, 22 nt, Human
aacuauaaugggguuaggaaau

SEQ ID NO: 558224 - RNA, 22 nt, Human
aucugcuucagugauaugugaa

SEQ ID NO: 558225 - RNA, 22 nt, Human
gcugccagucuaaugggaaaca

SEQ ID NO: 558226 - RNA, 22 nt, Human
acauucuucagcuuugucaggc

SEQ ID NO: 558227 - RNA, 22 nt, Human
ccaaagucugcauuuuaacaug

SEQ ID NO: 558228 - RNA, 22 nt, Human
ugguggccaauucacagggcuc

SEQ ID NO: 558229 - RNA, 22 nt, Human
aagaaauauugggccuuauaaa

SEQ ID NO: 558230 - RNA, 22 nt, Human
acagagccuccaggagugcugg

SEQ ID NO: 558231 - RNA, 22 nt, Human
ugcuagaaaucugaaacuagca

SEQ ID NO: 558232 - RNA, 22 nt, Human
agaaaaaucuuggcgcuugucu

SEQ ID NO: 558233 - RNA, 22 nt, Human
accugcaggcacaggugugcgc

SEQ ID NO: 558234 - RNA, 22 nt, Human
cauaaaagguagcaguuugaaa

SEQ ID NO: 558235 - RNA, 22 nt, Human
ggaggccuugaggccaggagcu

SEQ ID NO: 558236 - RNA, 22 nt, Human
cuguacaggagacgucugugca

SEQ ID NO: 558237 - RNA, 20 nt, Human
agguuccuuuguggagaauu

SEQ ID NO: 558238 - RNA, 22 nt, Human
gaaaauaguucaucacaaugau

SEQ ID NO: 558239 - RNA, 22 nt, Human
agucaccaucuguggcagccug

SEQ ID NO: 558240 - RNA, 22 nt, Human
gccgugcgugcgcaggugcugu

SEQ ID NO: 558241 - RNA, 18 nt, Human
caguuuuuauaucuggca

SEQ ID NO: 558242 - RNA, 22 nt, Human
uuugaauaugugcuuguuaaau

SEQ ID NO: 558243 - RNA, 22 nt, Human
ggcagcucacugauuagcaauu

SEQ ID NO: 558244 - RNA, 22 nt, Human
gcuggccugucuagagccuuac

SEQ ID NO: 558245 - RNA, 22 nt, Human
agaauguagucuuggagauuua

SEQ ID NO: 558246 - RNA, 22 nt, Human
augggagugacagggccacugg

SEQ ID NO: 558247 - RNA, 22 nt, Human
ggaggggaacuaaucccgugac

SEQ ID NO: 558248 - RNA, 22 nt, Human
ugugccugauggucacguggcc

SEQ ID NO: 558249 - RNA, 22 nt, Human
gcagaggagcaagcuggacacc

SEQ ID NO: 558250 - RNA, 22 nt, Human
aauuucaauuacuuuugcacca

SEQ ID NO: 558251 - RNA, 22 nt, Human
auggcagccugagcagaggaau

SEQ ID NO: 558252 - RNA, 22 nt, Human
aggugucuggauggguguccuu

SEQ ID NO: 558253 - RNA, 22 nt, Human
cugucucuguugccuguaggug

SEQ ID NO: 558254 - RNA, 22 nt, Human
agccucucugaugugacagcua

SEQ ID NO: 558255 - RNA, 22 nt, Human
ucuuuugugauucuucaguuac

SEQ ID NO: 558256 - RNA, 22 nt, Human
accaaggagccacauacaaccu

SEQ ID NO: 558257 - RNA, 22 nt, Human
gaagccacagagauuguggggg

SEQ ID NO: 558258 - RNA, 22 nt, Human
ggcagcuccuccuagucugccc

SEQ ID NO: 558259 - RNA, 22 nt, Human
aauguuugccugacuagagugg

SEQ ID NO: 558260 - RNA, 22 nt, Human
ucugucaccgagggcauccaaa

SEQ ID NO: 558261 - RNA, 22 nt, Human
gaagagaugacaaaggagcaug

SEQ ID NO: 558262 - RNA, 20 nt, Human
cauuugaaucuccauucugc

SEQ ID NO: 558263 - RNA, 22 nt, Human
gcaggcagagguggaggagaca

SEQ ID NO: 558264 - RNA, 22 nt, Human
ucacagaaguugaauuugcaug

SEQ ID NO: 558265 - RNA, 16 nt, Human
gcuaggcaacaggcug

SEQ ID NO: 558266 - RNA, 22 nt, Human
gggcucagacaucccuccugga

SEQ ID NO: 558267 - RNA, 22 nt, Human
uggcugccuuucaccucaucuc

SEQ ID NO: 558268 - RNA, 22 nt, Human
gggcagcagagcccugccgagu

SEQ ID NO: 558269 - RNA, 19 nt, Human
cuggccaggccaggggccc

SEQ ID NO: 558270 - RNA, 22 nt, Human
uucaaacuaugacuucagcuac

SEQ ID NO: 558271 - RNA, 22 nt, Human
uucacauuguuuuaaugugaau

SEQ ID NO: 558272 - RNA, 22 nt, Human
ugggcucucucaccuggaggcu

SEQ ID NO: 558273 - RNA, 22 nt, Human
acagaagugacaauuucuuggg

SEQ ID NO: 558274 - RNA, 22 nt, Human
guaacugaggcagcuuuuaaga

SEQ ID NO: 558275 - RNA, 22 nt, Human
ucugaaauggggcugaagcacu

SEQ ID NO: 558276 - RNA, 20 nt, Human
ccagacagcaccugccuggu

SEQ ID NO: 558277 - RNA, 22 nt, Human
acaguucuuuguuuauagcuug

SEQ ID NO: 558278 - RNA, 22 nt, Human
uccuuaaaugaacucugcauga

SEQ ID NO: 558279 - RNA, 22 nt, Human
aaauaauguuaggccuuugcuc

SEQ ID NO: 558280 - RNA, 22 nt, Human
acagcuguggggacucuugccc

SEQ ID NO: 558281 - RNA, 21 nt, Human
agcugcuuucagcuccuagag

SEQ ID NO: 558282 - RNA, 22 nt, Human
ucaucccuaaggacagcucugc

SEQ ID NO: 558283 - RNA, 22 nt, Human
agggaggaccaaugugugguua

SEQ ID NO: 558284 - RNA, 22 nt, Human
ugccuuuuccagcuuccagagg

SEQ ID NO: 558285 - RNA, 19 nt, Human
ugacaggcuguugccuuga

SEQ ID NO: 558286 - RNA, 22 nt, Human
auguaucaauuaucugucugca

SEQ ID NO: 558287 - RNA, 22 nt, Human
aaaugcuguaacugauauucug

SEQ ID NO: 558288 - RNA, 22 nt, Human
aaagauuauggcauugaaauac

SEQ ID NO: 558289 - RNA, 19 nt, Human
aaaaggaauauucuuuggg

SEQ ID NO: 558290 - RNA, 22 nt, Human
cauugcugugggcauuugcugc

SEQ ID NO: 558291 - RNA, 22 nt, Human
aggcugggcaccguuuugaucc

SEQ ID NO: 558292 - RNA, 22 nt, Human
auuccaguucuccucucuaaag

SEQ ID NO: 558293 - RNA, 20 nt, Human
gccagcccugacacaggagc

SEQ ID NO: 558294 - RNA, 22 nt, Human
uuugcuuugggagguugucugg

SEQ ID NO: 558295 - RNA, 22 nt, Human
ccucugugucuugguuucaaga

SEQ ID NO: 558296 - RNA, 22 nt, Human
ccaaauauuaacaaaguaauuu

SEQ ID NO: 558297 - RNA, 22 nt, Human
aagaaagcugaauauucugugu

SEQ ID NO: 558298 - RNA, 22 nt, Human
ggcugcucuucuuggcgaccuc

SEQ ID NO: 558299 - RNA, 22 nt, Human
cugagggagcugcuggccuugg

SEQ ID NO: 558300 - RNA, 22 nt, Human
uagaaucugaauauucuuauuu

SEQ ID NO: 558301 - RNA, 18 nt, Human
acauuucuaggugaaagc

SEQ ID NO: 558302 - RNA, 22 nt, Human
uguaggacauguacuuguaaca

SEQ ID NO: 558303 - RNA, 22 nt, Human
agccacagucaaccuguccaua

SEQ ID NO: 558304 - RNA, 22 nt, Human
uuacauuuuaguuaaccuguga

SEQ ID NO: 558305 - RNA, 22 nt, Human
agaauccugaugaaaaggagag

SEQ ID NO: 558306 - RNA, 22 nt, Human
gucuuuauauuuacuaaagaau

SEQ ID NO: 558307 - RNA, 23 nt, Human
ccagggccccuacaccacugucc

SEQ ID NO: 558308 - RNA, 22 nt, Human
ccagggaaggcugcuggcugug

SEQ ID NO: 558309 - RNA, 22 nt, Human
ugcauuguugaugaguugaaua

SEQ ID NO: 558310 - RNA, 22 nt, Human
ugagggagucaugauuaaggaa

SEQ ID NO: 558311 - RNA, 22 nt, Human
uucacaaagcuggagcauuucc

SEQ ID NO: 558312 - RNA, 22 nt, Human
caggccaggcugcauuugcccc

SEQ ID NO: 558313 - RNA, 22 nt, Human
uacaaaaaauugauacugacga

SEQ ID NO: 558314 - RNA, 22 nt, Human
gagaaagauguaggcugggagg

SEQ ID NO: 558315 - RNA, 22 nt, Human
aauucacauauacauuauuccu

SEQ ID NO: 558316 - RNA, 22 nt, Human
cccauucauccucgcuuccuuc

SEQ ID NO: 558317 - RNA, 22 nt, Human
auugaaagcacaaagaacaagu

SEQ ID NO: 558318 - RNA, 22 nt, Human
gcagaggcuccauuuuacagau

SEQ ID NO: 558319 - RNA, 22 nt, Human
ugcuguagcccugcacagugca

SEQ ID NO: 558320 - RNA, 22 nt, Human
ucucuucuagcuucuugugguu

SEQ ID NO: 558321 - RNA, 22 nt, Human
ccucagggaggccucuguggcu

SEQ ID NO: 558322 - RNA, 22 nt, Human
aaauauagcaauuaugccuacu

SEQ ID NO: 558323 - RNA, 22 nt, Human
uccugcaggggcugaggaacca

SEQ ID NO: 558324 - RNA, 17 nt, Human
acacagggagagggagc

SEQ ID NO: 558325 - RNA, 22 nt, Human
auuauucaaauucccacuauac

SEQ ID NO: 558326 - RNA, 22 nt, Human
agggcugaccuaagcuccacuu

SEQ ID NO: 558327 - RNA, 22 nt, Human
ucugaaaugcaggcaauuugcu

SEQ ID NO: 558328 - RNA, 22 nt, Human
guguccagggccguguugucuu

SEQ ID NO: 558329 - RNA, 22 nt, Human
gagugagggccaacauccagcu

SEQ ID NO: 558330 - RNA, 22 nt, Human
uuauagaucuaaaugugaaggg

SEQ ID NO: 558331 - RNA, 22 nt, Human
caaagucccagcugcuuagaga

SEQ ID NO: 558332 - RNA, 22 nt, Human
aucagcaaguccuguuaauucu

SEQ ID NO: 558333 - RNA, 22 nt, Human
aggcucagauccuuguguccug

SEQ ID NO: 558334 - RNA, 22 nt, Human
aagacagaccacgugacagggc

SEQ ID NO: 558335 - RNA, 22 nt, Human
cagacagacagccguggccacc

SEQ ID NO: 558336 - RNA, 22 nt, Human
ggauuucuuccuuccucagaag

SEQ ID NO: 558337 - RNA, 22 nt, Human
gauuucaccugaucuugucauc

SEQ ID NO: 558338 - RNA, 21 nt, Human
acuagcuuucuggagaagugu

SEQ ID NO: 558339 - RNA, 21 nt, Human
uccccacauuucuaaacagac

SEQ ID NO: 558340 - RNA, 22 nt, Human
ucaguuuuuaagaguuaugcga

SEQ ID NO: 558341 - RNA, 22 nt, Human
uucaaagaguugggugucuggg

SEQ ID NO: 558342 - RNA, 21 nt, Human
uugaaaguaaauucagcagcu

SEQ ID NO: 558343 - RNA, 22 nt, Human
uguggcagaacugggacucaaa

SEQ ID NO: 558344 - RNA, 22 nt, Human
agggcucccgugaggugacugc

SEQ ID NO: 558345 - RNA, 22 nt, Human
agcugcugugugcucaggcagg

SEQ ID NO: 558346 - RNA, 22 nt, Human
gcuggagccauuggcuuggccu

SEQ ID NO: 558347 - RNA, 22 nt, Human
cugcucuguucccccaucaucu

SEQ ID NO: 558348 - RNA, 22 nt, Human
ggccucugguucacagggagga

SEQ ID NO: 558349 - RNA, 22 nt, Human
acccagggaccccgcugacgcc

SEQ ID NO: 558350 - RNA, 22 nt, Human
cuccuuccugguuagcaccuua

SEQ ID NO: 558351 - RNA, 22 nt, Human
ugaagcaggugaauggaugucg

SEQ ID NO: 558352 - RNA, 22 nt, Human
acucacuuuccauucaagcacc

SEQ ID NO: 558353 - RNA, 22 nt, Human
gagcccucucuguaggcaagua

SEQ ID NO: 558354 - RNA, 22 nt, Human
ucagagaguuggaaagaauuaa

SEQ ID NO: 558355 - RNA, 22 nt, Human
uaugacaagguggaguaugagu

SEQ ID NO: 558356 - RNA, 22 nt, Human
uccugaaaaauuacauguucag

SEQ ID NO: 558357 - RNA, 22 nt, Human
cugaaaucaauuuugauuaucu

SEQ ID NO: 558358 - RNA, 18 nt, Human
ugaccugcgcuucacggu

SEQ ID NO: 558359 - RNA, 22 nt, Human
gccagcucccaagugagccccu

SEQ ID NO: 558360 - RNA, 22 nt, Human
uggcuggggccugaauccugca

SEQ ID NO: 558361 - RNA, 20 nt, Human
uuauaucauaaugugccaau

SEQ ID NO: 558362 - RNA, 22 nt, Human
auuuaagggauuuggagaccaa

SEQ ID NO: 558363 - RNA, 22 nt, Human
cgucuuuauugauuccuucaag

SEQ ID NO: 558364 - RNA, 22 nt, Human
cuaagaaaauagaagcaugcua

SEQ ID NO: 558365 - RNA, 22 nt, Human
cagaagagaugaaauaguauua

SEQ ID NO: 558366 - RNA, 22 nt, Human
agaaaguuguuggaggaaauga

SEQ ID NO: 558367 - RNA, 22 nt, Human
aagagccuggcugcuaggcuca

SEQ ID NO: 558368 - RNA, 22 nt, Human
gacacagaauuuacucccgaua

SEQ ID NO: 558369 - RNA, 22 nt, Human
ucucaagcuuguugguauguuu

SEQ ID NO: 558370 - RNA, 22 nt, Human
auguccaguuucuacacacaua

SEQ ID NO: 558371 - RNA, 22 nt, Human
ccauuuaguaaggaagaacagc

SEQ ID NO: 558372 - RNA, 22 nt, Human
cugccuuggaaaaugugguaau

SEQ ID NO: 558373 - RNA, 22 nt, Human
uaacaagucauuuuaaauuaug

SEQ ID NO: 558374 - RNA, 22 nt, Human
ugcuuuuaagaacaaugcugcu

SEQ ID NO: 558375 - RNA, 22 nt, Human
auaaggcuuaaaccuuguugcc

SEQ ID NO: 558376 - RNA, 21 nt, Human
auucuaaccaggagaggcuga

SEQ ID NO: 558377 - RNA, 18 nt, Human
aggcacagagcauacaua

SEQ ID NO: 558378 - RNA, 22 nt, Human
uccgccaggacugagggcccau

SEQ ID NO: 558379 - RNA, 22 nt, Human
cccagcaucuccaggcauggcc

SEQ ID NO: 558380 - RNA, 22 nt, Human
auuguucuggauauuuacauug

SEQ ID NO: 558381 - RNA, 22 nt, Human
uggcccucagucuugcuccugc

SEQ ID NO: 558382 - RNA, 22 nt, Human
ugcccuguuaucuuggaagagu

SEQ ID NO: 558383 - RNA, 22 nt, Human
aagccagauagaagaacucauu

SEQ ID NO: 558384 - RNA, 22 nt, Human
aaaugcacagagccuuagagau

SEQ ID NO: 558385 - RNA, 22 nt, Human
ucugaaauauauuuugaguguu

SEQ ID NO: 558386 - RNA, 22 nt, Human
agcuggcauacuuugcuaggaa

SEQ ID NO: 558387 - RNA, 22 nt, Human
caggaaccugcuccaagaggca

SEQ ID NO: 558388 - RNA, 22 nt, Human
aaggggucaagcggcagcuaca

SEQ ID NO: 558389 - RNA, 22 nt, Human
acccacgaagaugagcggcaug

SEQ ID NO: 558390 - RNA, 23 nt, Human
acacaauagaguacuauucagcc

SEQ ID NO: 558391 - RNA, 22 nt, Human
ggcaggguuuacaauagcaaua

SEQ ID NO: 558392 - RNA, 22 nt, Human
aguauggggcugugugugcaca

SEQ ID NO: 558393 - RNA, 22 nt, Human
agcugaggaggaaugaugggua

SEQ ID NO: 558394 - RNA, 22 nt, Human
uuucuacagaagauacacugcu

SEQ ID NO: 558395 - RNA, 22 nt, Human
aaguguguugacugaauugggg

SEQ ID NO: 558396 - RNA, 22 nt, Human
gauuucaauccagcuuucuucu

SEQ ID NO: 558397 - RNA, 22 nt, Human
uucaaagauaauguagcauuuu

SEQ ID NO: 558398 - RNA, 23 nt, Human
ugggcagcuucugcaugcccacc

SEQ ID NO: 558399 - RNA, 22 nt, Human
cagcagcucccauccgcugagc

SEQ ID NO: 558400 - RNA, 22 nt, Human
ccagagucccuguucucggccu

SEQ ID NO: 558401 - RNA, 22 nt, Human
gagcugccaagauuacaaucag

SEQ ID NO: 558402 - RNA, 22 nt, Human
uguacauuuagagcucaauaga

SEQ ID NO: 558403 - RNA, 22 nt, Human
agaugguguuuccccaggugga

SEQ ID NO: 558404 - RNA, 22 nt, Human
aauguauaaaguguuaauaacu

SEQ ID NO: 558405 - RNA, 22 nt, Human
gagggcucugucuggaagggaa

SEQ ID NO: 558406 - RNA, 22 nt, Human
acuuucuauuguuuagauucug

SEQ ID NO: 558407 - RNA, 22 nt, Human
gggagcaggagccugccugcca

SEQ ID NO: 558408 - RNA, 22 nt, Human
aguggcaggaaaguggaagaga

SEQ ID NO: 558409 - RNA, 22 nt, Human
aucagaggaaauuaacucucuc

SEQ ID NO: 558410 - RNA, 22 nt, Human
uucuuuuccuguggcucaucca

SEQ ID NO: 558411 - RNA, 22 nt, Human
uccugagagucaagaaugcagg

SEQ ID NO: 558412 - RNA, 21 nt, Human
agaaaauggcguuuuagauuu

SEQ ID NO: 558413 - RNA, 22 nt, Human
acugagcugcuugaagugaacu

SEQ ID NO: 558414 - RNA, 22 nt, Human
agcugcagauucuaucuagaag

SEQ ID NO: 558415 - RNA, 22 nt, Human
ugcugucuuccaggauggugaa

SEQ ID NO: 558416 - RNA, 22 nt, Human
ucacauuucuuuauguagucuu

SEQ ID NO: 558417 - RNA, 22 nt, Human
uaugcacauuaucuaauccauu

SEQ ID NO: 558418 - RNA, 22 nt, Human
aaagcauuguuucaagauuaac

SEQ ID NO: 558419 - RNA, 22 nt, Human
auuuucuucucucccuggcugc

SEQ ID NO: 558420 - RNA, 22 nt, Human
ccaggacuuauuacaguauaac

SEQ ID NO: 558421 - RNA, 22 nt, Human
aaggaguuuggguagucauaca

SEQ ID NO: 558422 - RNA, 22 nt, Human
ugaaaugauaucugauaacaaa

SEQ ID NO: 558423 - RNA, 22 nt, Human
gaauacaaagcagaacucauac

SEQ ID NO: 558424 - RNA, 18 nt, Human
agcagcuuugugcuugau

SEQ ID NO: 558425 - RNA, 22 nt, Human
aggaaauaagggcacuucagau

SEQ ID NO: 558426 - RNA, 22 nt, Human
uauuugcugaaucugauucaga

SEQ ID NO: 558427 - RNA, 22 nt, Human
ggcccugcaugagauuaagguu

SEQ ID NO: 558428 - RNA, 22 nt, Human
ugggccagcaauugcugcucag

SEQ ID NO: 558429 - RNA, 22 nt, Human
auaaacaguagagaaagguggu

SEQ ID NO: 558430 - RNA, 21 nt, Human
agccugggaggcggagguugc

SEQ ID NO: 558431 - RNA, 20 nt, Human
ccugccuggccauuccuugg

SEQ ID NO: 558432 - RNA, 22 nt, Human
aguacauuuauuaaugguaaaa

SEQ ID NO: 558433 - RNA, 22 nt, Human
ucuguaaaacuucuuuguaaau

SEQ ID NO: 558434 - RNA, 22 nt, Human
ucagaagcugguguccuuugaa

SEQ ID NO: 558435 - RNA, 22 nt, Human
acaaauaugguacucggagaaa

SEQ ID NO: 558436 - RNA, 22 nt, Human
guuugcauuucuugaacuauau

SEQ ID NO: 558437 - RNA, 22 nt, Human
gagccugaaauacaggucacug

SEQ ID NO: 558438 - RNA, 22 nt, Human
ccacuuucugagggaacagcag

SEQ ID NO: 558439 - RNA, 22 nt, Human
uccagggacagcgcuggagcua

SEQ ID NO: 558440 - RNA, 22 nt, Human
ucagccagugccuugaucuugc

SEQ ID NO: 558441 - RNA, 21 nt, Human
uuguuuccucccaaaaugcca

SEQ ID NO: 558442 - RNA, 20 nt, Human
ugggauuguuuuuuagcuuc

SEQ ID NO: 558443 - RNA, 22 nt, Human
gucaggcugccagucuuuauug

SEQ ID NO: 558444 - RNA, 22 nt, Human
guggcacagugggagagcccca

SEQ ID NO: 558445 - RNA, 22 nt, Human
guucacaggguuaggaaucacu

SEQ ID NO: 558446 - RNA, 22 nt, Human
gcagagucugguaggugcuggu

SEQ ID NO: 558447 - RNA, 22 nt, Human
ggaccagagcucgggcuucuca

SEQ ID NO: 558448 - RNA, 17 nt, Human
ccucccacaccgcccug

SEQ ID NO: 558449 - RNA, 22 nt, Human
cagccagggucaggcagcuucu

SEQ ID NO: 558450 - RNA, 22 nt, Human
acaucacacgccuuccaggagg

SEQ ID NO: 558451 - RNA, 22 nt, Human
gccuggugaaaggcagagagcg

SEQ ID NO: 558452 - RNA, 22 nt, Human
cagagccagaacuagaccuugu

SEQ ID NO: 558453 - RNA, 22 nt, Human
caaauccagaucccagucguag

SEQ ID NO: 558454 - RNA, 22 nt, Human
uuguuuucuccacugcaucuua

SEQ ID NO: 558455 - RNA, 22 nt, Human
cuccagaauuguccauuggaaa

SEQ ID NO: 558456 - RNA, 22 nt, Human
uagccgggugugguggaacucc

SEQ ID NO: 558457 - RNA, 22 nt, Human
uauucaaaguaccuucauugcc

SEQ ID NO: 558458 - RNA, 22 nt, Human
cucagacugguggguaaaaccu

SEQ ID NO: 558459 - RNA, 22 nt, Human
gugugagcaucaaagccuguca

SEQ ID NO: 558460 - RNA, 22 nt, Human
cuuguaauuauaauguacuguu

SEQ ID NO: 558461 - RNA, 22 nt, Human
ccaguggaauuaaaaauaagug

SEQ ID NO: 558462 - RNA, 22 nt, Human
guuugauucaagaacaaagagu

SEQ ID NO: 558463 - RNA, 22 nt, Human
uagaaacacagaucugguguca

SEQ ID NO: 558464 - RNA, 22 nt, Human
uggcuuccuccagagcaggagg

SEQ ID NO: 558465 - RNA, 22 nt, Human
uuuugccugagagugaaaauaa

SEQ ID NO: 558466 - RNA, 22 nt, Human
gccaguggcccucuggagaagg

SEQ ID NO: 558467 - RNA, 22 nt, Human
acaguuaagcaguaugaucaca

SEQ ID NO: 558468 - RNA, 20 nt, Human
cugagccaacucucuucuug

SEQ ID NO: 558469 - RNA, 22 nt, Human
ugcugcacgauaaauaauuucu

SEQ ID NO: 558470 - RNA, 22 nt, Human
auucacaguuuccucauauucu

SEQ ID NO: 558471 - RNA, 22 nt, Human
auugacaagacaauggcucuua

SEQ ID NO: 558472 - RNA, 22 nt, Human
aagauggcaggaaucauaagcu

SEQ ID NO: 558473 - RNA, 22 nt, Human
acagugucugacacauuguagc

SEQ ID NO: 558474 - RNA, 22 nt, Human
uggcucaguuuagcagcucagu

SEQ ID NO: 558475 - RNA, 22 nt, Human
cgcccagggcaggaggccgcuc

SEQ ID NO: 558476 - RNA, 22 nt, Human
ucacuguagugagcagaauaua

SEQ ID NO: 558477 - RNA, 22 nt, Human
gcccagugguaaaagcaggccu

SEQ ID NO: 558478 - RNA, 22 nt, Human
agguggagaagagaugggcagu

SEQ ID NO: 558479 - RNA, 22 nt, Human
uagaaggaggacuggcaguguu

SEQ ID NO: 558480 - RNA, 23 nt, Human
aggauguaggauguauggcagag

SEQ ID NO: 558481 - RNA, 22 nt, Human
gaacacuugcuguuaauaagug

SEQ ID NO: 558482 - RNA, 22 nt, Human
cuggugcaggaaggagcuggca

SEQ ID NO: 558483 - RNA, 22 nt, Human
uuugaacagacacuuucuacag

SEQ ID NO: 558484 - RNA, 22 nt, Human
ugcaggcucacccuggagcuga

SEQ ID NO: 558485 - RNA, 19 nt, Human
ucucugcuucucuuggcau

SEQ ID NO: 558486 - RNA, 22 nt, Human
aguccagugucaaggugccauu

SEQ ID NO: 558487 - RNA, 22 nt, Human
agauguuuguaaacacacugcu

SEQ ID NO: 558488 - RNA, 22 nt, Human
ugccuggguucccaccccaaag

SEQ ID NO: 558489 - RNA, 22 nt, Human
caggcacuagcagaaugaggcu

SEQ ID NO: 558490 - RNA, 22 nt, Human
agcugccaucugaagaacugca

SEQ ID NO: 558491 - RNA, 23 nt, Human
gagauggcugguuguccucugaa

SEQ ID NO: 558492 - RNA, 18 nt, Human
gccauguucuaugcuuac

SEQ ID NO: 558493 - RNA, 22 nt, Human
uccaggccccacugaagccccu

SEQ ID NO: 558494 - RNA, 22 nt, Human
aaaaguguccagauuaugaaga

SEQ ID NO: 558495 - RNA, 22 nt, Human
uuuuagauaguuuaacugcacu

SEQ ID NO: 558496 - RNA, 22 nt, Human
uccaggcccacucgguggggcu

SEQ ID NO: 558497 - RNA, 18 nt, Human
augugcaauuuuguauuu

SEQ ID NO: 558498 - RNA, 22 nt, Human
aggaagaauguuuacauaucaa

SEQ ID NO: 558499 - RNA, 19 nt, Human
ugguggcaaugucagcuaa

SEQ ID NO: 558500 - RNA, 22 nt, Human
cccagggacagaugggcagcua

SEQ ID NO: 558501 - RNA, 19 nt, Human
uguuucuuccuccaucuga

SEQ ID NO: 558502 - RNA, 22 nt, Human
agggccagggaaacgaucagca

SEQ ID NO: 558503 - RNA, 22 nt, Human
gagaaggagcucaaauauggcu

SEQ ID NO: 558504 - RNA, 22 nt, Human
ugcugccuucuaggcgugcccu

SEQ ID NO: 558505 - RNA, 22 nt, Human
caaauuaaugugucucaaaaua

SEQ ID NO: 558506 - RNA, 22 nt, Human
aaggcuuuaugugaccaaaaga

SEQ ID NO: 558507 - RNA, 22 nt, Human
aaugcacaugccacauguggua

SEQ ID NO: 558508 - RNA, 20 nt, Human
gccugagcuccgccuccugu

SEQ ID NO: 558509 - RNA, 22 nt, Human
uucagcuaaggaguuucacugu

SEQ ID NO: 558510 - RNA, 19 nt, Human
caguuacaggcacuguggg

SEQ ID NO: 558511 - RNA, 18 nt, Human
agcugguggggagacagc

SEQ ID NO: 558512 - RNA, 22 nt, Human
uguggccuuucaaggauggaau

SEQ ID NO: 558513 - RNA, 22 nt, Human
ucuggcucggauuugucuagca

SEQ ID NO: 558514 - RNA, 22 nt, Human
uggggcuucuccuguaggcuca

SEQ ID NO: 558515 - RNA, 22 nt, Human
ugcagaagcagagccgguggcc

SEQ ID NO: 558516 - RNA, 22 nt, Human
gugggggcaggcagugcuagga

SEQ ID NO: 558517 - RNA, 22 nt, Human
gccuggugguauccuggcaaga

SEQ ID NO: 558518 - RNA, 20 nt, Human
gggcucuuagguagcagggg

SEQ ID NO: 558519 - RNA, 22 nt, Human
uugauuuuaaaauagugacacu

SEQ ID NO: 558520 - RNA, 23 nt, Human
gugcucugcggucugcuagucug

SEQ ID NO: 558521 - RNA, 20 nt, Human
caccuucaaauuuccuggca

SEQ ID NO: 558522 - RNA, 20 nt, Human
ucuuggagaggguggacuua

SEQ ID NO: 558523 - RNA, 22 nt, Human
ggcacagagcuuugucccaguu

SEQ ID NO: 558524 - RNA, 22 nt, Human
ggugggcaggucacucugccuc

SEQ ID NO: 558525 - RNA, 22 nt, Human
gugcccugggccuucagggcca

SEQ ID NO: 558526 - RNA, 22 nt, Human
cagcaggcucugaguggcugcc

SEQ ID NO: 558527 - RNA, 20 nt, Human
ugccaugguaacagagugug

SEQ ID NO: 558528 - RNA, 22 nt, Human
gaggaaccuccugaaaaguaua

SEQ ID NO: 558529 - RNA, 22 nt, Human
gcagcuuucugcaaugucaucc

SEQ ID NO: 558530 - RNA, 22 nt, Human
caucuucacauauuuccaauga

SEQ ID NO: 558531 - RNA, 22 nt, Human
aaaaaucuaugacugcuucucc

SEQ ID NO: 558532 - RNA, 22 nt, Human
ucauuucagccauuuuuaaaug

SEQ ID NO: 558533 - RNA, 22 nt, Human
caagagcugugaccucauucac

SEQ ID NO: 558534 - RNA, 22 nt, Human
aagaaaugugaauauugaauag

SEQ ID NO: 558535 - RNA, 22 nt, Human
aguggagacaggacagucgaua

SEQ ID NO: 558536 - RNA, 22 nt, Human
uggugugggcguggcaggcaag

SEQ ID NO: 558537 - RNA, 22 nt, Human
ucagcugagcuccagcucauag

SEQ ID NO: 558538 - RNA, 22 nt, Human
ugaggcagcauucuucaagaca

SEQ ID NO: 558539 - RNA, 22 nt, Human
gcugaaggcccggaggacaggg

SEQ ID NO: 558540 - RNA, 22 nt, Human
ucuagggaacaugggucaagcu

SEQ ID NO: 558541 - RNA, 19 nt, Human
ccuuuuuuaacuucagcaa

SEQ ID NO: 558542 - RNA, 22 nt, Human
ccucugagaccagcucugcacc

SEQ ID NO: 558543 - RNA, 17 nt, Human
ggcuucagggagcuggg

SEQ ID NO: 558544 - RNA, 22 nt, Human
aagaacuaucucuggcuguagg

SEQ ID NO: 558545 - RNA, 22 nt, Human
caaagaaugagugaguacauaa

SEQ ID NO: 558546 - RNA, 22 nt, Human
ccugcccuaugaccagcuucac

SEQ ID NO: 558547 - RNA, 22 nt, Human
caggaugcacuaggaaccaggg

SEQ ID NO: 558548 - RNA, 22 nt, Human
uggcugccuagucccucagccu

SEQ ID NO: 558549 - RNA, 22 nt, Human
aggaagcaaaaggcagggucua

SEQ ID NO: 558550 - RNA, 22 nt, Human
agcagagucuucaagggcaggc

SEQ ID NO: 558551 - RNA, 22 nt, Human
uacaacauaacgggcauucagu

SEQ ID NO: 558552 - RNA, 22 nt, Human
ggcagggagagcaugcugauaa

SEQ ID NO: 558553 - RNA, 19 nt, Human
ugcuucuggggcuucucca

SEQ ID NO: 558554 - RNA, 22 nt, Human
cuggccaggcucucacgugguc

SEQ ID NO: 558555 - RNA, 22 nt, Human
gcugccugucuguuucuuuuau

SEQ ID NO: 558556 - RNA, 23 nt, Human
uagagcagggaaaucugucagag

SEQ ID NO: 558557 - RNA, 22 nt, Human
gagcuggcuccgccaugcugcu

SEQ ID NO: 558558 - RNA, 22 nt, Human
caaugucaugauuuuccauuag

SEQ ID NO: 558559 - RNA, 22 nt, Human
cccaaguuaauuuguagcugaa

SEQ ID NO: 558560 - RNA, 22 nt, Human
aucucagacauguuguccauga

SEQ ID NO: 558561 - RNA, 21 nt, Human
cacagcaggguuccugggcuc

SEQ ID NO: 558562 - RNA, 22 nt, Human
ugggccucaucuucaaugaguc

SEQ ID NO: 558563 - RNA, 22 nt, Human
auucucugaagucaauggaaau

SEQ ID NO: 558564 - RNA, 22 nt, Human
acuucaguaggugauaugugca

SEQ ID NO: 558565 - RNA, 22 nt, Human
aggacuuagaacauuauguacu

SEQ ID NO: 558566 - RNA, 21 nt, Human
uucaggguuucacaauacuaa

SEQ ID NO: 558567 - RNA, 22 nt, Human
uacaauauguggccuuuuguga

SEQ ID NO: 558568 - RNA, 22 nt, Human
guguauaacuaucuaucuagua

SEQ ID NO: 558569 - RNA, 22 nt, Human
acucaggaaaaauguagugaua

SEQ ID NO: 558570 - RNA, 22 nt, Human
aaaaucugguaauuugaaugug

SEQ ID NO: 558571 - RNA, 22 nt, Human
guuuuuccugcugacuuggguc

SEQ ID NO: 558572 - RNA, 15 nt, Human
ccaggcucugcacuc

SEQ ID NO: 558573 - RNA, 22 nt, Human
cugguggaggugccaggauuug

SEQ ID NO: 558574 - RNA, 22 nt, Human
aagcagcuuaaauuagagccug

SEQ ID NO: 558575 - RNA, 22 nt, Human
uagacagauuucuuguuagaca

SEQ ID NO: 558576 - RNA, 22 nt, Human
guugggaagcagauggaugagc

SEQ ID NO: 558577 - RNA, 22 nt, Human
gguucacacuuucaugauuuca

SEQ ID NO: 558578 - RNA, 22 nt, Human
aggccuguuccuuccugggcac

SEQ ID NO: 558579 - RNA, 22 nt, Human
gcuccuggcaggcagugugugu

SEQ ID NO: 558580 - RNA, 22 nt, Human
ugagcuucaaaauaugugaauc

SEQ ID NO: 558581 - RNA, 22 nt, Human
ccaggaagcggugagggcugcc

SEQ ID NO: 558582 - RNA, 22 nt, Human
uuccaaauuccaauccccugaa

SEQ ID NO: 558583 - RNA, 22 nt, Human
gaugauggacaaagcauuggug

SEQ ID NO: 558584 - RNA, 22 nt, Human
agcagcagaagggagacccagg

SEQ ID NO: 558585 - RNA, 22 nt, Human
aaucaacauuguuuuaagucaa

SEQ ID NO: 558586 - RNA, 23 nt, Human
agggguggucaguacccgcagug

SEQ ID NO: 558587 - RNA, 22 nt, Human
auguucuguuuuguaauucaua

SEQ ID NO: 558588 - RNA, 22 nt, Human
agcugagcauuugauccaccuc

SEQ ID NO: 558589 - RNA, 22 nt, Human
auugacaaauggauguugacau

SEQ ID NO: 558590 - RNA, 22 nt, Human
caggcagcugcgacaagagagc

SEQ ID NO: 558591 - RNA, 22 nt, Human
acauuuaaccuuugaggaacug

SEQ ID NO: 558592 - RNA, 22 nt, Human
acauuaaacuugcuuggcugua

SEQ ID NO: 558593 - RNA, 22 nt, Human
augaaaauucuaugcaggccag

SEQ ID NO: 558594 - RNA, 22 nt, Human
gccugcagugagugcagaaggu

SEQ ID NO: 558595 - RNA, 22 nt, Human
auugugaauagugccgcaguaa

SEQ ID NO: 558596 - RNA, 22 nt, Human
gggcugggauugcuugcuguga

SEQ ID NO: 558597 - RNA, 22 nt, Human
gaggcucaguuauuuuagccug

SEQ ID NO: 558598 - RNA, 22 nt, Human
ggaagaggaggagccaggcuuu

SEQ ID NO: 558599 - RNA, 22 nt, Human
agucuucucauuucacaugcuu

SEQ ID NO: 558600 - RNA, 22 nt, Human
gucuagagaggaaggaagugug

SEQ ID NO: 558601 - RNA, 22 nt, Human
auugcacaaacacagucagacu

SEQ ID NO: 558602 - RNA, 22 nt, Human
agcagcuaaguagcgcaguuaa

SEQ ID NO: 558603 - RNA, 22 nt, Human
gggcugccuuucuucugggagc

SEQ ID NO: 558604 - RNA, 22 nt, Human
acagcuuuaucucagggaucag

SEQ ID NO: 558605 - RNA, 22 nt, Human
aaauggaucuguggaauacauu

SEQ ID NO: 558606 - RNA, 22 nt, Human
ucugucugcaccuaagcacagu

SEQ ID NO: 558607 - RNA, 22 nt, Human
agggacccugaugacugaggag

SEQ ID NO: 558608 - RNA, 22 nt, Human
ucccaggugaugcugaggccac

SEQ ID NO: 558609 - RNA, 22 nt, Human
acugagcucuugacugggaguu

SEQ ID NO: 558610 - RNA, 22 nt, Human
ccugggaguggcacucacagca

SEQ ID NO: 558611 - RNA, 22 nt, Human
uuccagccaugguuucccuaug

SEQ ID NO: 558612 - RNA, 22 nt, Human
uaucagaaggcacauggagucu

SEQ ID NO: 558613 - RNA, 22 nt, Human
aacaaguguauuaauggaaaua

SEQ ID NO: 558614 - RNA, 22 nt, Human
agccugucugucuccaaagcug

SEQ ID NO: 558615 - RNA, 22 nt, Human
ugggccucccaugucuuaggga

SEQ ID NO: 558616 - RNA, 22 nt, Human
gaaguauaggagacaaacaaga

SEQ ID NO: 558617 - RNA, 22 nt, Human
caucuacacugauuaggugaac

SEQ ID NO: 558618 - RNA, 21 nt, Human
agcucagccgggcacaguggc

SEQ ID NO: 558619 - RNA, 20 nt, Human
cuucuucaguaguuuguucu

SEQ ID NO: 558620 - RNA, 22 nt, Human
cucuuuccaggguaccccaggu

SEQ ID NO: 558621 - RNA, 22 nt, Human
uugcuaaaucccuauaauauuc

SEQ ID NO: 558622 - RNA, 23 nt, Human
agugcugaauugaaagcuccagg

SEQ ID NO: 558623 - RNA, 22 nt, Human
agaccauagggaccucagguug

SEQ ID NO: 558624 - RNA, 22 nt, Human
augcagaaagagaauguaaugu

SEQ ID NO: 558625 - RNA, 22 nt, Human
gaugcugagagguggagggaac

SEQ ID NO: 558626 - RNA, 22 nt, Human
gagagcacaugaacauggagga

SEQ ID NO: 558627 - RNA, 22 nt, Human
caguggcacccacgggcugggc

SEQ ID NO: 558628 - RNA, 22 nt, Human
aggaggcucucagguccucccc

SEQ ID NO: 558629 - RNA, 22 nt, Human
ucuuuacaucacaauuguaugg

SEQ ID NO: 558630 - RNA, 22 nt, Human
cuucuuuaauguauacaaaaga

SEQ ID NO: 558631 - RNA, 22 nt, Human
aaggcacugaacuuaaauucug

SEQ ID NO: 558632 - RNA, 22 nt, Human
cagugguggaaugaggaauugu

SEQ ID NO: 558633 - RNA, 22 nt, Human
auccccacgauauagccaaagc

SEQ ID NO: 558634 - RNA, 22 nt, Human
auggaaaugauggaacauuaaa

SEQ ID NO: 558635 - RNA, 22 nt, Human
cugggccugucccugauugagg

SEQ ID NO: 558636 - RNA, 22 nt, Human
uugcagagaucagcagguuuga

SEQ ID NO: 558637 - RNA, 22 nt, Human
uaugagaagaacaggugacuuu

SEQ ID NO: 558638 - RNA, 22 nt, Human
uccaggacuagcauuucugaua

SEQ ID NO: 558639 - RNA, 22 nt, Human
ccagagagauugcuucuaaaga

SEQ ID NO: 558640 - RNA, 19 nt, Human
cagcugccuuuucuuugca

SEQ ID NO: 558641 - RNA, 22 nt, Human
aucacagagcucccuuccacug

SEQ ID NO: 558642 - RNA, 22 nt, Human
gcugggcuucaccuccagaguu

SEQ ID NO: 558643 - RNA, 22 nt, Human
augugcucacccuauuuaugga

SEQ ID NO: 558644 - RNA, 22 nt, Human
uucaguuuguuugacuguuaga

SEQ ID NO: 558645 - RNA, 22 nt, Human
aaauaugaaugauaagaguuau

SEQ ID NO: 558646 - RNA, 20 nt, Human
aggcugagggugauuguguc

SEQ ID NO: 558647 - RNA, 22 nt, Human
cauuguuauagcauuacacacc

SEQ ID NO: 558648 - RNA, 22 nt, Human
ugcccaaguguuuggcugaguc

SEQ ID NO: 558649 - RNA, 22 nt, Human
gggcagagacucagaaacagaa

SEQ ID NO: 558650 - RNA, 22 nt, Human
cuguggagcagggcagggucac

SEQ ID NO: 558651 - RNA, 22 nt, Human
uugggcaaaguguuucuggagc

SEQ ID NO: 558652 - RNA, 22 nt, Human
uuggaaagcaagcuggacauac

SEQ ID NO: 558653 - RNA, 22 nt, Human
uuaggaaaaucaugagagauga

SEQ ID NO: 558654 - RNA, 22 nt, Human
cagggccugagggcugcucugc

SEQ ID NO: 558655 - RNA, 22 nt, Human
cuguaaauaugaagaauauaug

SEQ ID NO: 558656 - RNA, 22 nt, Human
cauuucaauuauuugcucuucu

SEQ ID NO: 558657 - RNA, 22 nt, Human
guugcacaguuccucaagcagg

SEQ ID NO: 558658 - RNA, 22 nt, Human
uggcugcaguucacaggagcaa

SEQ ID NO: 558659 - RNA, 22 nt, Human
gauuucuucauucauuagaugg

SEQ ID NO: 558660 - RNA, 22 nt, Human
cagcugguagguagcagauuug

SEQ ID NO: 558661 - RNA, 22 nt, Human
aaauuuaagaagugugugcgug

SEQ ID NO: 558662 - RNA, 22 nt, Human
ccucucuguguggccucuccau

SEQ ID NO: 558663 - RNA, 20 nt, Human
agaggccaguuaggagucua

SEQ ID NO: 558664 - RNA, 22 nt, Human
gaaacuuacuuacucacauuuc

SEQ ID NO: 558665 - RNA, 22 nt, Human
uaauucuagauugacauuuuga

SEQ ID NO: 558666 - RNA, 22 nt, Human
aacaaagcaccacugagucagu

SEQ ID NO: 558667 - RNA, 22 nt, Human
gugagagggcugggcucaugau

SEQ ID NO: 558668 - RNA, 18 nt, Human
aaagaaggauuggagagc

SEQ ID NO: 558669 - RNA, 22 nt, Human
guacauuucucuuguucuuauu

SEQ ID NO: 558670 - RNA, 17 nt, Human
aaguccagaguugagca

SEQ ID NO: 558671 - RNA, 22 nt, Human
ugagaaagugggugccuagcaa

SEQ ID NO: 558672 - RNA, 22 nt, Human
cgcaggcuuuagaaucugcuac

SEQ ID NO: 558673 - RNA, 22 nt, Human
acaguggagaagcaaaugcagu

SEQ ID NO: 558674 - RNA, 22 nt, Human
aggagugcaaauaguccagaga

SEQ ID NO: 558675 - RNA, 22 nt, Human
ugcacuguugcuuuauaugauu

SEQ ID NO: 558676 - RNA, 22 nt, Human
agcaggcugaugggcaugcuug

SEQ ID NO: 558677 - RNA, 22 nt, Human
gacuauuuauaaugcugcagaa

SEQ ID NO: 558678 - RNA, 22 nt, Human
auaucuuuuagagcaagcuugu

SEQ ID NO: 558679 - RNA, 22 nt, Human
ggcagaagaaaggcuaagucuc

SEQ ID NO: 558680 - RNA, 22 nt, Human
agaagugccauacuguggucca

SEQ ID NO: 558681 - RNA, 22 nt, Human
gccagcucagaugcaggaagga

SEQ ID NO: 558682 - RNA, 22 nt, Human
agcagguggugggccagauuug

SEQ ID NO: 558683 - RNA, 22 nt, Human
agauaacuuuuggguauucaug

SEQ ID NO: 558684 - RNA, 22 nt, Human
uucuuaaguaugaucuuaacgg

SEQ ID NO: 558685 - RNA, 22 nt, Human
ugggcugcuuccucagcugaga

SEQ ID NO: 558686 - RNA, 22 nt, Human
ggcccugggcagaggagugggc

SEQ ID NO: 558687 - RNA, 21 nt, Human
ccugagggugguugugaagau

SEQ ID NO: 558688 - RNA, 22 nt, Human
cuggucccuggaccucccugga

SEQ ID NO: 558689 - RNA, 22 nt, Human
cugacucccaaagaggacgcgu

SEQ ID NO: 558690 - RNA, 22 nt, Human
gagcuagacugggcucugaugu

SEQ ID NO: 558691 - RNA, 22 nt, Human
ccacaggggcccacgagccgcu

SEQ ID NO: 558692 - RNA, 22 nt, Human
guggccugucagaagccguggg

SEQ ID NO: 558693 - RNA, 22 nt, Human
ugucucaguacacuccgauguu

SEQ ID NO: 558694 - RNA, 22 nt, Human
aagcugaaucugaaauagaauu

SEQ ID NO: 558695 - RNA, 22 nt, Human
aagcagccuggacuugggcugg

SEQ ID NO: 558696 - RNA, 22 nt, Human
uaaauucugaucaaguuccuuc

SEQ ID NO: 558697 - RNA, 22 nt, Human
agcuguggcaaccuugucagac

SEQ ID NO: 558698 - RNA, 22 nt, Human
ugagucagucugcccuggcuuc

SEQ ID NO: 558699 - RNA, 22 nt, Human
auguauaugugaaagauguuua

SEQ ID NO: 558700 - RNA, 22 nt, Human
ggagagcagggaggcugcucug

SEQ ID NO: 558701 - RNA, 22 nt, Human
ucaggaaggagcuggccugcca

SEQ ID NO: 558702 - RNA, 22 nt, Human
uuuaccaguguuaaacaccagc

SEQ ID NO: 558703 - RNA, 22 nt, Human
uaauagaaagguauuuuuugca

SEQ ID NO: 558704 - RNA, 22 nt, Human
uccucaggugacuagguaucuu

SEQ ID NO: 558705 - RNA, 22 nt, Human
cuuugcaagggauuucaugucu

SEQ ID NO: 558706 - RNA, 22 nt, Human
gugaaggcuacaagagaucaag

SEQ ID NO: 558707 - RNA, 17 nt, Human
gcagcagagagacccuc

SEQ ID NO: 558708 - RNA, 22 nt, Human
ggguggcuccuaugggcauagc

SEQ ID NO: 558709 - RNA, 22 nt, Human
uuucacagaaagacaacagaua

SEQ ID NO: 558710 - RNA, 22 nt, Human
aaacaagguacacaguaauggu

SEQ ID NO: 558711 - RNA, 23 nt, Human
gccuggagaaaagcugcaguuca

SEQ ID NO: 558712 - RNA, 22 nt, Human
gaucaaagccagugaggaguga

SEQ ID NO: 558713 - RNA, 22 nt, Human
ccucccacauugaggacaugcu

SEQ ID NO: 558714 - RNA, 22 nt, Human
uggcugaggagagggcggaagu

SEQ ID NO: 558715 - RNA, 22 nt, Human
cagaggcagacccuccagggcg

SEQ ID NO: 558716 - RNA, 22 nt, Human
cauguguagugaaauaagcagu

SEQ ID NO: 558717 - RNA, 22 nt, Human
ugguaauuaauuugauagguuc

SEQ ID NO: 558718 - RNA, 22 nt, Human
agucuucacucuucacuacuau

SEQ ID NO: 558719 - RNA, 19 nt, Human
uggaccugugcccauggcu

SEQ ID NO: 558720 - RNA, 22 nt, Human
cccagcagaaucugaugagggc

SEQ ID NO: 558721 - RNA, 22 nt, Human
gucggccacgcaggugcgguag

SEQ ID NO: 558722 - RNA, 22 nt, Human
agauguaguagugggucuuuua

SEQ ID NO: 558723 - RNA, 22 nt, Human
agccuccaucucccaucuguga

SEQ ID NO: 558724 - RNA, 22 nt, Human
uuaaaauagccagugccccucu

SEQ ID NO: 558725 - RNA, 22 nt, Human
acacaaaaucaaaguccuaggc

SEQ ID NO: 558726 - RNA, 22 nt, Human
uuacaggggacauuggggacau

SEQ ID NO: 558727 - RNA, 22 nt, Human
acagcagcuaaccccugggcca

SEQ ID NO: 558728 - RNA, 22 nt, Human
uuagccauuaauguccugugca

SEQ ID NO: 558729 - RNA, 22 nt, Human
cccaggcugaguuagagguguc

SEQ ID NO: 558730 - RNA, 22 nt, Human
acagcagcaauagcagugacau

SEQ ID NO: 558731 - RNA, 22 nt, Human
gggcagcagaauuggacagaaa

SEQ ID NO: 558732 - RNA, 22 nt, Human
agugcugaagacuggcuaggga

SEQ ID NO: 558733 - RNA, 21 nt, Human
acauacauaccuuaccaccuu

SEQ ID NO: 558734 - RNA, 22 nt, Human
uaaggcaaaggggaaguuauca

SEQ ID NO: 558735 - RNA, 22 nt, Human
ccagaaggcggagauugcagug

SEQ ID NO: 558736 - RNA, 22 nt, Human
uuagaaaggagcuuauuucuuu

SEQ ID NO: 558737 - RNA, 22 nt, Human
uuuuaguuguacugucaacagu

SEQ ID NO: 558738 - RNA, 22 nt, Human
ccuuuucugaaccacuuaaaua

SEQ ID NO: 558739 - RNA, 22 nt, Human
ugaggcuccagccaggccagca

SEQ ID NO: 558740 - RNA, 22 nt, Human
uccugcagccauuagaggucaa

SEQ ID NO: 558741 - RNA, 22 nt, Human
aauggcugggaguguauuuugg

SEQ ID NO: 558742 - RNA, 22 nt, Human
ggcagaguugguggagucaguu

SEQ ID NO: 558743 - RNA, 22 nt, Human
auugaggcagcauaguucaggg

SEQ ID NO: 558744 - RNA, 22 nt, Human
cagccagcugaauguaccauga

SEQ ID NO: 558745 - RNA, 22 nt, Human
gcagggcagagggagaaucucu

SEQ ID NO: 558746 - RNA, 22 nt, Human
ccugggcucaagcgaucuuguc

SEQ ID NO: 558747 - RNA, 22 nt, Human
augagcugugggauuccagagg

SEQ ID NO: 558748 - RNA, 22 nt, Human
agcugugaauuuuaugcuagug

SEQ ID NO: 558749 - RNA, 22 nt, Human
cugcccugcccaggccuugggc

SEQ ID NO: 558750 - RNA, 22 nt, Human
uuuucuaacaucuaguaauuug

SEQ ID NO: 558751 - RNA, 22 nt, Human
agccagggacgcugcaggcuac

SEQ ID NO: 558752 - RNA, 22 nt, Human
acaacacagcuuuccucaaguu

SEQ ID NO: 558753 - RNA, 22 nt, Human
ugggcagggagcuggaaccaca

SEQ ID NO: 558754 - RNA, 22 nt, Human
aggcuucagaaagaguaauugg

SEQ ID NO: 558755 - RNA, 22 nt, Human
aucuuuuuugucuuggucacug

SEQ ID NO: 558756 - RNA, 18 nt, Human
cuggagucacagugggga

SEQ ID NO: 558757 - RNA, 22 nt, Human
uggucucugacucugaagaccc

SEQ ID NO: 558758 - RNA, 22 nt, Human
acccuggaggucuacagugcag

SEQ ID NO: 558759 - RNA, 22 nt, Human
caguggcaaugggacagagcac

SEQ ID NO: 558760 - RNA, 22 nt, Human
ggaagaaaaugggcaacaggug

SEQ ID NO: 558761 - RNA, 22 nt, Human
aaggaggguucccagguccugg

SEQ ID NO: 558762 - RNA, 22 nt, Human
uuugugaauaagagaaugacag

SEQ ID NO: 558763 - RNA, 22 nt, Human
ugauuuccucuacuagcaauua

SEQ ID NO: 558764 - RNA, 22 nt, Human
cugggccuggacgggcagaucu

SEQ ID NO: 558765 - RNA, 22 nt, Human
cagcagugucuccagcaucaca

SEQ ID NO: 558766 - RNA, 22 nt, Human
gcccuggaaucucuccauggga

SEQ ID NO: 558767 - RNA, 22 nt, Human
agugacugggcagggcagggcc

SEQ ID NO: 558768 - RNA, 22 nt, Human
ccagguucaaauagcuguguga

SEQ ID NO: 558769 - RNA, 22 nt, Human
cuguccagcuuggcuccugggg

SEQ ID NO: 558770 - RNA, 22 nt, Human
aggugccaacaguauuucugcc

SEQ ID NO: 558771 - RNA, 19 nt, Human
cugaaaaacauucucagga

SEQ ID NO: 558772 - RNA, 22 nt, Human
ccagggcagcagaauuggggca

SEQ ID NO: 558773 - RNA, 22 nt, Human
aggcuccuaucgcuuucagcaa

SEQ ID NO: 558774 - RNA, 22 nt, Human
auguacaguuucuagacucaaa

SEQ ID NO: 558775 - RNA, 22 nt, Human
aagagcugcaucuaagccauga

SEQ ID NO: 558776 - RNA, 22 nt, Human
auuugucucugcacuuuacuca

SEQ ID NO: 558777 - RNA, 22 nt, Human
uacccagcuccucagaagacca

SEQ ID NO: 558778 - RNA, 22 nt, Human
uuagccaugcccuagaagagga

SEQ ID NO: 558779 - RNA, 22 nt, Human
guuucuuaaauguagcaggacc

SEQ ID NO: 558780 - RNA, 22 nt, Human
cacccaggcagguggcugagaa

SEQ ID NO: 558781 - RNA, 22 nt, Human
ugucacaaggccaugaaaagaa

SEQ ID NO: 558782 - RNA, 22 nt, Human
uguauauucugccuaaaagcuu

SEQ ID NO: 558783 - RNA, 22 nt, Human
cugucauugagccugucagggc

SEQ ID NO: 558784 - RNA, 22 nt, Human
ugggaaggauaccuuggaacau

SEQ ID NO: 558785 - RNA, 22 nt, Human
aggaagcuccuggagagccagu

SEQ ID NO: 558786 - RNA, 22 nt, Human
gagaggaguaggcugauggugc

SEQ ID NO: 558787 - RNA, 22 nt, Human
ugccaggcuuagagcaggggcu

SEQ ID NO: 558788 - RNA, 20 nt, Human
cucuuauugcauuaguuucu

SEQ ID NO: 558789 - RNA, 22 nt, Human
gccuaggagacaagcgugaaag

SEQ ID NO: 558790 - RNA, 22 nt, Human
ccagcucuuggugcacuuacau

SEQ ID NO: 558791 - RNA, 22 nt, Human
gugcccaggcccaaggcaccac

SEQ ID NO: 558792 - RNA, 22 nt, Human
gccacagcggggccgcuagagc

SEQ ID NO: 558793 - RNA, 22 nt, Human
acugcuggaaacccagaauggu

SEQ ID NO: 558794 - RNA, 20 nt, Human
ccuguucacugcgcaguuuc

SEQ ID NO: 558795 - RNA, 22 nt, Human
uccagcuuugagauuuuaugga

SEQ ID NO: 558796 - RNA, 22 nt, Human
cugauuuacauauacaaaagau

SEQ ID NO: 558797 - RNA, 22 nt, Human
gauucugagcugguguuuuacg

SEQ ID NO: 558798 - RNA, 22 nt, Human
gccuggagcucaugugggcauu

SEQ ID NO: 558799 - RNA, 22 nt, Human
gccucugcucggacuuugccuc

SEQ ID NO: 558800 - RNA, 22 nt, Human
uucaugcugugucuacaacuua

SEQ ID NO: 558801 - RNA, 22 nt, Human
cuuguugcuaacauaugcuucu

SEQ ID NO: 558802 - RNA, 22 nt, Human
guucuugccagcauccucaggu

SEQ ID NO: 558803 - RNA, 22 nt, Human
auaaguucagguaaagaaauca

SEQ ID NO: 558804 - RNA, 20 nt, Human
ugcagggccuaaaaagggaa

SEQ ID NO: 558805 - RNA, 22 nt, Human
cugugucccuugucccagagcc

SEQ ID NO: 558806 - RNA, 22 nt, Human
uuguuuuggagaugagcuaaaa

SEQ ID NO: 558807 - RNA, 22 nt, Human
uuauuuucuccucagaaagugg

SEQ ID NO: 558808 - RNA, 22 nt, Human
gggacaauggaggccucucucc

SEQ ID NO: 558809 - RNA, 22 nt, Human
auucuuuucccaacugcuuuaa

SEQ ID NO: 558810 - RNA, 22 nt, Human
aucaacauggcaaugcccaucu

SEQ ID NO: 558811 - RNA, 18 nt, Human
uggcucugcagccagaug

SEQ ID NO: 558812 - RNA, 22 nt, Human
agagugaagguugacacuucac

SEQ ID NO: 558813 - RNA, 22 nt, Human
ugaggaagggugugacggcacc

SEQ ID NO: 558814 - RNA, 22 nt, Human
uauucuugucuuuuccagaaau

SEQ ID NO: 558815 - RNA, 22 nt, Human
uggcccugaaggccuugagcau

SEQ ID NO: 558816 - RNA, 22 nt, Human
uuccucucucuugccagaaugu

SEQ ID NO: 558817 - RNA, 22 nt, Human
cugagcauggccgguccauggu

SEQ ID NO: 558818 - RNA, 20 nt, Human
uagauuucauacuucucuuu

SEQ ID NO: 558819 - RNA, 22 nt, Human
uuuuuaugccuacgcugaaaag

SEQ ID NO: 558820 - RNA, 22 nt, Human
cugggcugcgggcgccccucca

SEQ ID NO: 558821 - RNA, 22 nt, Human
ucugccugcggcugcagguggc

SEQ ID NO: 558822 - RNA, 22 nt, Human
gcagagccagaauggccaggac

SEQ ID NO: 558823 - RNA, 22 nt, Human
agggugcauguuugcaagagug

SEQ ID NO: 558824 - RNA, 22 nt, Human
aagggcagagggaaucccacau

SEQ ID NO: 558825 - RNA, 22 nt, Human
caucuagaaaaaagaccuguug

SEQ ID NO: 558826 - RNA, 22 nt, Human
cuucugaaaugugagcaaaauc

SEQ ID NO: 558827 - RNA, 22 nt, Human
aaaauucucuugaucuugacag

SEQ ID NO: 558828 - RNA, 22 nt, Human
cuucacagccaacaugggcaca

SEQ ID NO: 558829 - RNA, 22 nt, Human
ccugaguggagggauucugcag

SEQ ID NO: 558830 - RNA, 22 nt, Human
gacauuuagaagucuaauggcc

SEQ ID NO: 558831 - RNA, 22 nt, Human
cauguacacucauguaacuaua

SEQ ID NO: 558832 - RNA, 22 nt, Human
auuaguaaaacauuguauaugu

SEQ ID NO: 558833 - RNA, 22 nt, Human
cagcaauaagccagguuagaca

SEQ ID NO: 558834 - RNA, 18 nt, Human
gcugagguggugucagag

SEQ ID NO: 558835 - RNA, 22 nt, Human
ucagaggauuggacuuuuaugu

SEQ ID NO: 558836 - RNA, 22 nt, Human
ggcaggaggugaguggcgggug

SEQ ID NO: 558837 - RNA, 22 nt, Human
ugauuuccaugaagcugaaggc

SEQ ID NO: 558838 - RNA, 22 nt, Human
caggauggagggagggcuguua

SEQ ID NO: 558839 - RNA, 22 nt, Human
auauaauacaaccugcuaagug

SEQ ID NO: 558840 - RNA, 21 nt, Human
ugcuccuuagcugccccugcc

SEQ ID NO: 558841 - RNA, 22 nt, Human
uugcagaggcaaaaaugaacuc

SEQ ID NO: 558842 - RNA, 20 nt, Human
acauugauuauguuuguaga

SEQ ID NO: 558843 - RNA, 19 nt, Human
gcauuucaggcauguuugc

SEQ ID NO: 558844 - RNA, 22 nt, Human
auuuacauuccauggugguuac

SEQ ID NO: 558845 - RNA, 22 nt, Human
cuucacaaauggccuagaguuc

SEQ ID NO: 558846 - RNA, 22 nt, Human
ugggcagauuaaugcaguggcu

SEQ ID NO: 558847 - RNA, 22 nt, Human
gcccuggccuucaucucagaca

SEQ ID NO: 558848 - RNA, 22 nt, Human
ucuggagcaacagagcaggaca

SEQ ID NO: 558849 - RNA, 23 nt, Human
ucagagaaguuguaggcugggga

SEQ ID NO: 558850 - RNA, 22 nt, Human
gcaggaguguauuugcauguaa

SEQ ID NO: 558851 - RNA, 22 nt, Human
agggucugacuccucuggcaag

SEQ ID NO: 558852 - RNA, 21 nt, Human
ggcagcacuaccugaagcaua

SEQ ID NO: 558853 - RNA, 22 nt, Human
aacacauauuuauauaugcaca

SEQ ID NO: 558854 - RNA, 22 nt, Human
uccacuuuagcaaugauugaau

SEQ ID NO: 558855 - RNA, 22 nt, Human
ugaggaaacuuacaaggcagaa

SEQ ID NO: 558856 - RNA, 22 nt, Human
acauguggucaaucuguguagg

SEQ ID NO: 558857 - RNA, 22 nt, Human
agaaauguuguggguuuuguua

SEQ ID NO: 558858 - RNA, 22 nt, Human
aucaguuuaaaugggcuguugg

SEQ ID NO: 558859 - RNA, 22 nt, Human
ugcugaaggcaggggagguggc

SEQ ID NO: 558860 - RNA, 22 nt, Human
acauuuaggauguuuugagaga

SEQ ID NO: 558861 - RNA, 22 nt, Human
agcuggguggagggcccacggu

SEQ ID NO: 558862 - RNA, 22 nt, Human
cugcccuggguuuuaugggagu

SEQ ID NO: 558863 - RNA, 22 nt, Human
auagccuugguccuugcuccac

SEQ ID NO: 558864 - RNA, 22 nt, Human
uugcaauugcuauggagagcgu

SEQ ID NO: 558865 - RNA, 22 nt, Human
agggcuccuaugaugcucugcc

SEQ ID NO: 558866 - RNA, 19 nt, Human
auuuccaagaauuggagag

SEQ ID NO: 558867 - RNA, 22 nt, Human
uagccuucucaagacaaaguug

SEQ ID NO: 558868 - RNA, 22 nt, Human
ugcucuggggagcuccucugcg

SEQ ID NO: 558869 - RNA, 22 nt, Human
gugcagcuuccuggucucagcc

SEQ ID NO: 558870 - RNA, 20 nt, Human
uguacacaguacuuuacaau

SEQ ID NO: 558871 - RNA, 22 nt, Human
acuucauguugcucuuggcuau

SEQ ID NO: 558872 - RNA, 23 nt, Human
auuugagaaaguauuuuuaagac

SEQ ID NO: 558873 - RNA, 22 nt, Human
uuagaaacccagacucuuaggu

SEQ ID NO: 558874 - RNA, 22 nt, Human
aagcagccagccaucaugcccg

SEQ ID NO: 558875 - RNA, 22 nt, Human
gggcuguaggagcuggaauggg

SEQ ID NO: 558876 - RNA, 22 nt, Human
agcugacaggauggcauuauua

SEQ ID NO: 558877 - RNA, 22 nt, Human
auauaacauacauacagaaaag

SEQ ID NO: 558878 - RNA, 22 nt, Human
aaauguguuucuuugugaaugg

SEQ ID NO: 558879 - RNA, 22 nt, Human
guauuagguuggugcaaaagua

SEQ ID NO: 558880 - RNA, 21 nt, Human
ucuugauuauuggccucacac

SEQ ID NO: 558881 - RNA, 22 nt, Human
ucugggcagccaugugccuggc

SEQ ID NO: 558882 - RNA, 22 nt, Human
ugucuuuuggagcaucuuucuu

SEQ ID NO: 558883 - RNA, 22 nt, Human
agcaggugacagggcuguggug

SEQ ID NO: 558884 - RNA, 22 nt, Human
gccuccuggaagucacauguuu

SEQ ID NO: 558885 - RNA, 22 nt, Human
ucuuugucugaacagggacauu

SEQ ID NO: 558886 - RNA, 21 nt, Human
agcagcugggcaacauggagg

SEQ ID NO: 558887 - RNA, 22 nt, Human
cagaguucaaagccugcuggga

SEQ ID NO: 558888 - RNA, 22 nt, Human
uugcuaaaaauggaauuauagg

SEQ ID NO: 558889 - RNA, 22 nt, Human
gacagggaaacauugaaguguc

SEQ ID NO: 558890 - RNA, 22 nt, Human
uauuugcaaagaacuacacuag

SEQ ID NO: 558891 - RNA, 22 nt, Human
uuuggaacaagacaaaacauua

SEQ ID NO: 558892 - RNA, 22 nt, Human
cagcugaggucaaagaagcagg

SEQ ID NO: 558893 - RNA, 22 nt, Human
agcugggcugggcugagcugag

SEQ ID NO: 558894 - RNA, 22 nt, Human
cuucuaggcuucucagggggca

SEQ ID NO: 558895 - RNA, 22 nt, Human
cugggaagaagugggcuacauu

SEQ ID NO: 558896 - RNA, 22 nt, Human
ccccacaccugccgggcagcag

SEQ ID NO: 558897 - RNA, 22 nt, Human
uuauguacucugcaauguuuga

SEQ ID NO: 558898 - RNA, 22 nt, Human
uucaauucugcucugaucuuag

SEQ ID NO: 558899 - RNA, 22 nt, Human
uuugcaaauauguguuucuauu

SEQ ID NO: 558900 - RNA, 22 nt, Human
gcuguccaugucuggccucagu

SEQ ID NO: 558901 - RNA, 22 nt, Human
cagcagcuggugagacacagcc

SEQ ID NO: 558902 - RNA, 22 nt, Human
uccagcagguuggucaggugca

SEQ ID NO: 558903 - RNA, 22 nt, Human
caauuucacuaauaauauuuac

SEQ ID NO: 558904 - RNA, 22 nt, Human
aagaagcaugagaagauuuuau

SEQ ID NO: 558905 - RNA, 22 nt, Human
gcaggagcccuggcauguucuu

SEQ ID NO: 558906 - RNA, 22 nt, Human
ugggacacccucacgccugcac

SEQ ID NO: 558907 - RNA, 22 nt, Human
uuccagaacuuuuguuaauuuc

SEQ ID NO: 558908 - RNA, 22 nt, Human
ucuucagagacucugagccccu

SEQ ID NO: 558909 - RNA, 22 nt, Human
agcagggggcauccuugcccuu

SEQ ID NO: 558910 - RNA, 22 nt, Human
cagcugugcugauugcucagua

SEQ ID NO: 558911 - RNA, 22 nt, Human
cuacaaaguaccacagacuggg

SEQ ID NO: 558912 - RNA, 21 nt, Human
gucuuuaaaaaaggcugauac

SEQ ID NO: 558913 - RNA, 19 nt, Human
ucgagucaagacacuaggc

SEQ ID NO: 558914 - RNA, 22 nt, Human
aguggcugcuggaguggagaug

SEQ ID NO: 558915 - RNA, 22 nt, Human
aaagucacuuacagcucuuuug

SEQ ID NO: 558916 - RNA, 22 nt, Human
ucucacugauuugagaccaagg

SEQ ID NO: 558917 - RNA, 22 nt, Human
gcaaggcuuugugaauuuuaaa

SEQ ID NO: 558918 - RNA, 22 nt, Human
aguucccaggugaugcugaugu

SEQ ID NO: 558919 - RNA, 22 nt, Human
ucagaacaauugggaaccauua

SEQ ID NO: 558920 - RNA, 22 nt, Human
gggcagaggcucuggcccaucc

SEQ ID NO: 558921 - RNA, 22 nt, Human
uggaagaauauggggguacaga

SEQ ID NO: 558922 - RNA, 22 nt, Human
aaagaacaauguggaaucuccu

SEQ ID NO: 558923 - RNA, 23 nt, Human
cuuuccuuucuuugacacccagc

SEQ ID NO: 558924 - RNA, 22 nt, Human
aagccagggucaggggccuccu

SEQ ID NO: 558925 - RNA, 22 nt, Human
auagcaaaaaugaacaaagcuu

SEQ ID NO: 558926 - RNA, 22 nt, Human
gcucugcugcuuacuagauggu

SEQ ID NO: 558927 - RNA, 22 nt, Human
ucucagagagaugaaacuucca

SEQ ID NO: 558928 - RNA, 22 nt, Human
ugggaccugaagcagguuggca

SEQ ID NO: 558929 - RNA, 22 nt, Human
uagggcagccuuauagcuccca

SEQ ID NO: 558930 - RNA, 22 nt, Human
agggcucaguaaacgguggauu

SEQ ID NO: 558931 - RNA, 22 nt, Human
cucugcagaggcccaaggcuga

SEQ ID NO: 558932 - RNA, 22 nt, Human
gcagacaggcccaguggaggga

SEQ ID NO: 558933 - RNA, 22 nt, Human
uuaggaaauuaugguuucagau

SEQ ID NO: 558934 - RNA, 21 nt, Human
aaggcugagacaacucaggag

SEQ ID NO: 558935 - RNA, 22 nt, Human
cuguguccuccccaucacuucu

SEQ ID NO: 558936 - RNA, 22 nt, Human
agaaauguauucuguauguuuu

SEQ ID NO: 558937 - RNA, 22 nt, Human
gggagggacacaaagaguuccc

SEQ ID NO: 558938 - RNA, 21 nt, Human
guauucuuuaugaagugaaaa

SEQ ID NO: 558939 - RNA, 22 nt, Human
ucagaacauuuaaaaagugguu

SEQ ID NO: 558940 - RNA, 18 nt, Human
ccugcagcccaggaggcc

SEQ ID NO: 558941 - RNA, 22 nt, Human
ugcaagggcuuagggggcugug

SEQ ID NO: 558942 - RNA, 22 nt, Human
aggcuuccuggaggaagaggua

SEQ ID NO: 558943 - RNA, 22 nt, Human
guggcuucuggcugggccucag

SEQ ID NO: 558944 - RNA, 22 nt, Human
agacagaacagaauaauuguug

SEQ ID NO: 558945 - RNA, 22 nt, Human
ccagaagaaaaagcugguauua

SEQ ID NO: 558946 - RNA, 22 nt, Human
cuggaggaccacagaagcuggu

SEQ ID NO: 558947 - RNA, 22 nt, Human
agaggccuaaccaagauguccu

SEQ ID NO: 558948 - RNA, 22 nt, Human
gcuaggaggaagaaugugaauu

SEQ ID NO: 558949 - RNA, 22 nt, Human
ggcauggcuggguucuggugag

SEQ ID NO: 558950 - RNA, 21 nt, Human
acacugugucauaaugcuuaa

SEQ ID NO: 558951 - RNA, 22 nt, Human
ggugagaggcagaggacagcuu

SEQ ID NO: 558952 - RNA, 22 nt, Human
uucugaggcacuggcucuccca

SEQ ID NO: 558953 - RNA, 22 nt, Human
ggugcagcugcagccugggagc

SEQ ID NO: 558954 - RNA, 22 nt, Human
uuuaauguuaaauuuguagaug

SEQ ID NO: 558955 - RNA, 22 nt, Human
ugauugaacugagcuucaagau

SEQ ID NO: 558956 - RNA, 22 nt, Human
gaggaaccaaaucagcuugcac

SEQ ID NO: 558957 - RNA, 22 nt, Human
ucacuguaucauguugcacuua

SEQ ID NO: 558958 - RNA, 22 nt, Human
uacaguguauguauuuguaggu

SEQ ID NO: 558959 - RNA, 22 nt, Human
agugacaggggaggcaggugug

SEQ ID NO: 558960 - RNA, 22 nt, Human
cucacugcaaguuccaccuacc

SEQ ID NO: 558961 - RNA, 22 nt, Human
gugugcagggaugagugcaggu

SEQ ID NO: 558962 - RNA, 22 nt, Human
uuauuagggugguuuauguucu

SEQ ID NO: 558963 - RNA, 21 nt, Human
ugcauucuuguguaagguagu

SEQ ID NO: 558964 - RNA, 22 nt, Human
acagaaauucugggacagaaaa

SEQ ID NO: 558965 - RNA, 22 nt, Human
caagcagaagccucaggggcau

SEQ ID NO: 558966 - RNA, 22 nt, Human
cucugugcgggccauggucagg

SEQ ID NO: 558967 - RNA, 19 nt, Human
ccacagagcaugcugaggc

SEQ ID NO: 558968 - RNA, 22 nt, Human
cucccuggaggcccagaccugg

SEQ ID NO: 558969 - RNA, 22 nt, Human
cugggcugcggugguagguugu

SEQ ID NO: 558970 - RNA, 20 nt, Human
acaguguuagguuuuuccuu

SEQ ID NO: 558971 - RNA, 22 nt, Human
ugagcaucuuuuuacagguuua

SEQ ID NO: 558972 - RNA, 19 nt, Human
ggagaggcuggagggaugc

SEQ ID NO: 558973 - RNA, 23 nt, Human
uugaaggagaaagcuuucuuggu

SEQ ID NO: 558974 - RNA, 22 nt, Human
gggagaagaaugugucaauugu

SEQ ID NO: 558975 - RNA, 22 nt, Human
ggcacugaaccaggacacaagc

SEQ ID NO: 558976 - RNA, 22 nt, Human
caggaaaggugugucaugaugg

SEQ ID NO: 558977 - RNA, 22 nt, Human
ccagcugcuugggaaaaugucu

SEQ ID NO: 558978 - RNA, 22 nt, Human
cgcugccaggucaccaggggua

SEQ ID NO: 558979 - RNA, 22 nt, Human
uuugcuuuguuuaaaaguggua

SEQ ID NO: 558980 - RNA, 22 nt, Human
aaugccucuuggaagaagacuu

SEQ ID NO: 558981 - RNA, 22 nt, Human
uuccacagguuucagacuguuc

SEQ ID NO: 558982 - RNA, 22 nt, Human
aaaauacuguggaguguugaaa

SEQ ID NO: 558983 - RNA, 22 nt, Human
aaacaaccuaaaguuacugauc

SEQ ID NO: 558984 - RNA, 22 nt, Human
uucaggaugcucagaguagucu

SEQ ID NO: 558985 - RNA, 22 nt, Human
ucacauuuuuuacuggacuuaa

SEQ ID NO: 558986 - RNA, 22 nt, Human
cacacagacagcucucugaaga

SEQ ID NO: 558987 - RNA, 22 nt, Human
uuggucuuguggcaucuuucca

SEQ ID NO: 558988 - RNA, 22 nt, Human
ugcuggcugcagugcugucaaa

SEQ ID NO: 558989 - RNA, 22 nt, Human
gcuguggcugaagaugcaggga

SEQ ID NO: 558990 - RNA, 22 nt, Human
augcacgccccacacuggugug

SEQ ID NO: 558991 - RNA, 22 nt, Human
auuuauuauugugguuacuucu

SEQ ID NO: 558992 - RNA, 23 nt, Human
uugcaaauuucaguuaguucaug

SEQ ID NO: 558993 - RNA, 23 nt, Human
uuucugaaguugagauggacuuu

SEQ ID NO: 558994 - RNA, 22 nt, Human
uggccucuggcugaggacuaac

SEQ ID NO: 558995 - RNA, 22 nt, Human
uucauacucacuccaauaacug

SEQ ID NO: 558996 - RNA, 16 nt, Human
uggcugagagaggguu

SEQ ID NO: 558997 - RNA, 22 nt, Human
ggcugagaacaggcccagccuc

SEQ ID NO: 558998 - RNA, 22 nt, Human
cagcagcuccucugcggcuaug

SEQ ID NO: 558999 - RNA, 22 nt, Human
uuuucauuagaaugacugagaa

SEQ ID NO: 559000 - RNA, 20 nt, Human
cagcaguggaugagaguuuu

SEQ ID NO: 559001 - RNA, 22 nt, Human
gcccugccugucugcugggagg

SEQ ID NO: 559002 - RNA, 22 nt, Human
gaagauuuaagcacaauagucu

SEQ ID NO: 559003 - RNA, 23 nt, Human
cacuccuguuucuaagccagcau

SEQ ID NO: 559004 - RNA, 22 nt, Human
caggcagcaucagucugcugua

SEQ ID NO: 559005 - RNA, 22 nt, Human
ucuuuacaaucuaagcauaguu

SEQ ID NO: 559006 - RNA, 19 nt, Human
gcacugaagaguuggucac

SEQ ID NO: 559007 - RNA, 22 nt, Human
cuggcaggcaaauuggugggag

SEQ ID NO: 559008 - RNA, 22 nt, Human
uuuaacaugugaauuuuggaag

SEQ ID NO: 559009 - RNA, 22 nt, Human
aacuuucucuacggcauuuguu

SEQ ID NO: 559010 - RNA, 22 nt, Human
gacuguguccaugugcuggauu

SEQ ID NO: 559011 - RNA, 22 nt, Human
ugcccugcuugguuuauuuuca

SEQ ID NO: 559012 - RNA, 22 nt, Human
ggcugugcuugguguccuugga

SEQ ID NO: 559013 - RNA, 22 nt, Human
uauuuccaagcugaauccaaug

SEQ ID NO: 559014 - RNA, 22 nt, Human
cagcucugagacugaggcuaug

SEQ ID NO: 559015 - RNA, 22 nt, Human
agcuccagcccaucugcucgug

SEQ ID NO: 559016 - RNA, 21 nt, Human
ggcuuuaugcucacccagccu

SEQ ID NO: 559017 - RNA, 22 nt, Human
ccaaaggccaagcucagguaaa

SEQ ID NO: 559018 - RNA, 20 nt, Human
auguacuccccacaagcaac

SEQ ID NO: 559019 - RNA, 22 nt, Human
ggccugucucacccccgggugc

SEQ ID NO: 559020 - RNA, 22 nt, Human
gcugaguggagcagucagcgcu

SEQ ID NO: 559021 - RNA, 18 nt, Human
uccaggccugaagugucc

SEQ ID NO: 559022 - RNA, 22 nt, Human
cuuuacuucucaaaauaaagca

SEQ ID NO: 559023 - RNA, 22 nt, Human
gagaaagacguaggcugggagg

SEQ ID NO: 559024 - RNA, 22 nt, Human
ucacauacugaaaguccaguga

SEQ ID NO: 559025 - RNA, 22 nt, Human
gggcaaaaccugggcaucauga

SEQ ID NO: 559026 - RNA, 22 nt, Human
gagcucccaggccccagcaagg

SEQ ID NO: 559027 - RNA, 22 nt, Human
aaaggagacuucagaucuccuu

SEQ ID NO: 559028 - RNA, 22 nt, Human
ggcucagacucccaggcccucu

SEQ ID NO: 559029 - RNA, 22 nt, Human
caggagugucuccacacagcaa

SEQ ID NO: 559030 - RNA, 22 nt, Human
uaacugauauugaaaaacauca

SEQ ID NO: 559031 - RNA, 22 nt, Human
ucugucugcgcuugcccuggug

SEQ ID NO: 559032 - RNA, 22 nt, Human
gcaggcugggguagccccacuu

SEQ ID NO: 559033 - RNA, 22 nt, Human
agggcagcccuucugggagggc

SEQ ID NO: 559034 - RNA, 22 nt, Human
agggccugguucuguguaggga

SEQ ID NO: 559035 - RNA, 22 nt, Human
agaaaagugcucuagugagagc

SEQ ID NO: 559036 - RNA, 22 nt, Human
ggcugucaauucauaggucaga

SEQ ID NO: 559037 - RNA, 22 nt, Human
caauuucugggccucacacaag

SEQ ID NO: 559038 - RNA, 22 nt, Human
ggcucagagaccugcgaucuga

SEQ ID NO: 559039 - RNA, 22 nt, Human
agcugcucaggagagccagguc

SEQ ID NO: 559040 - RNA, 22 nt, Human
aggcugugagcaagaacaccua

SEQ ID NO: 559041 - RNA, 21 nt, Human
ucuugaaaaguuagauucucu

SEQ ID NO: 559042 - RNA, 22 nt, Human
gucaacauaggccucagugagg

SEQ ID NO: 559043 - RNA, 22 nt, Human
ccauggagcgggugagugagug

SEQ ID NO: 559044 - RNA, 22 nt, Human
uggccagaaccugcaguaggcc

SEQ ID NO: 559045 - RNA, 22 nt, Human
caggggacaguaugguggauga

SEQ ID NO: 559046 - RNA, 22 nt, Human
ucacaggcuugugaacauugca

SEQ ID NO: 559047 - RNA, 22 nt, Human
acaugcuuccaaauuauguugg

SEQ ID NO: 559048 - RNA, 22 nt, Human
gcacugaacuuuaaucauuucu

SEQ ID NO: 559049 - RNA, 22 nt, Human
gaggggccggcaugugccucuc

SEQ ID NO: 559050 - RNA, 22 nt, Human
aauaacagugccaugaaauuga

SEQ ID NO: 559051 - RNA, 22 nt, Human
uagacacaagagaaggguauaa

SEQ ID NO: 559052 - RNA, 22 nt, Human
gggcaggucugggucagccuga

SEQ ID NO: 559053 - RNA, 22 nt, Human
gcacagaacuucucuuaguagg

SEQ ID NO: 559054 - RNA, 22 nt, Human
gggcugaguuccugccucacuc

SEQ ID NO: 559055 - RNA, 22 nt, Human
cugggccuagcaacagaggagu

SEQ ID NO: 559056 - RNA, 22 nt, Human
gggggcagaauguacucuuguc

SEQ ID NO: 559057 - RNA, 22 nt, Human
ccagagaguaggaggcauuauu

SEQ ID NO: 559058 - RNA, 22 nt, Human
cugccuggcauggagaagagaa

SEQ ID NO: 559059 - RNA, 22 nt, Human
ugcaggcugaggcuggcucaac

SEQ ID NO: 559060 - RNA, 22 nt, Human
cuggugggaggcaagguggaag

SEQ ID NO: 559061 - RNA, 22 nt, Human
uugccuauguaacuuuauauuu

SEQ ID NO: 559062 - RNA, 22 nt, Human
aaauugucagaauucagaaagu

SEQ ID NO: 559063 - RNA, 22 nt, Human
cuuuucuuguauuggaugcccc

SEQ ID NO: 559064 - RNA, 22 nt, Human
aagccagggauuccugagggag

SEQ ID NO: 559065 - RNA, 22 nt, Human
ggcugccucuggaagcuggaga

SEQ ID NO: 559066 - RNA, 22 nt, Human
cauggccuugagugacugcacu

SEQ ID NO: 559067 - RNA, 22 nt, Human
uaaguuagagguuaggcacuua

SEQ ID NO: 559068 - RNA, 22 nt, Human
aucaaaguucguaacugauaac

SEQ ID NO: 559069 - RNA, 22 nt, Human
augcucugaugcuguuaaaugu

SEQ ID NO: 559070 - RNA, 22 nt, Human
cuguacaaguccuucaucaggg

SEQ ID NO: 559071 - RNA, 22 nt, Human
aggcagaggaaggguggauuug

SEQ ID NO: 559072 - RNA, 22 nt, Human
uuauacauguguuuugagauga

SEQ ID NO: 559073 - RNA, 22 nt, Human
gucaaauauaugcaaaacuauu

SEQ ID NO: 559074 - RNA, 19 nt, Human
aggagaaguagcagaaauu

SEQ ID NO: 559075 - RNA, 22 nt, Human
aacuacauuuuacagaagauga

SEQ ID NO: 559076 - RNA, 22 nt, Human
gacuauuucccucaucaucuuc

SEQ ID NO: 559077 - RNA, 22 nt, Human
caguguggugugcacagcuuag

SEQ ID NO: 559078 - RNA, 20 nt, Human
caggcaguuugugguuaggg

SEQ ID NO: 559079 - RNA, 22 nt, Human
cugaaggacuuggugauaguug

SEQ ID NO: 559080 - RNA, 22 nt, Human
cacagugaccucuuuaaaaggg

SEQ ID NO: 559081 - RNA, 22 nt, Human
uacauguaggugacauuuuaau

SEQ ID NO: 559082 - RNA, 22 nt, Human
aaggccacacuugcuggccagc

SEQ ID NO: 559083 - RNA, 22 nt, Human
acauucugugagucauguuuua

SEQ ID NO: 559084 - RNA, 22 nt, Human
ucaggcaggcagagggcaaaug

SEQ ID NO: 559085 - RNA, 22 nt, Human
ugugaaauuacuuaaaggaaau

SEQ ID NO: 559086 - RNA, 22 nt, Human
gacauuuagcuguuuugcauuu

SEQ ID NO: 559087 - RNA, 22 nt, Human
ugcccacauucaaaaggugaug

SEQ ID NO: 559088 - RNA, 21 nt, Human
uguaugcacgcacaugcacac

SEQ ID NO: 559089 - RNA, 22 nt, Human
aagucuuucauaagucucuuau

SEQ ID NO: 559090 - RNA, 22 nt, Human
uccugagcaccuaugccauggc

SEQ ID NO: 559091 - RNA, 22 nt, Human
gaagucugacucuuuguaagcu

SEQ ID NO: 559092 - RNA, 22 nt, Human
uuuagacauuugugguuugcaa

SEQ ID NO: 559093 - RNA, 21 nt, Human
aggcuguccuuugccagcccu

SEQ ID NO: 559094 - RNA, 22 nt, Human
cagugguauuugagagaaugga

SEQ ID NO: 559095 - RNA, 22 nt, Human
agccauggcgccacuagaggga

SEQ ID NO: 559096 - RNA, 22 nt, Human
aagcugccagcugagcugaggc

SEQ ID NO: 559097 - RNA, 22 nt, Human
ccugccugccugcuggccggga

SEQ ID NO: 559098 - RNA, 22 nt, Human
gccagcugaauuuccaacuguu

SEQ ID NO: 559099 - RNA, 22 nt, Human
caaggccauaagagauacaaaa

SEQ ID NO: 559100 - RNA, 22 nt, Human
cccaggaggcagagcuugcagu

SEQ ID NO: 559101 - RNA, 22 nt, Human
ucagcuuugggggucucaggag

SEQ ID NO: 559102 - RNA, 22 nt, Human
aagcacugagcacaguggcuga

SEQ ID NO: 559103 - RNA, 22 nt, Human
aaggcugccucugccagaggag

SEQ ID NO: 559104 - RNA, 22 nt, Human
uccugagagguuuauaacgcag

SEQ ID NO: 559105 - RNA, 22 nt, Human
agaaagacgugaugaagaagua

SEQ ID NO: 559106 - RNA, 22 nt, Human
cugugacuagaccugcaggaga

SEQ ID NO: 559107 - RNA, 22 nt, Human
aaauccuaccaagaaauucccu

SEQ ID NO: 559108 - RNA, 22 nt, Human
gccaggcauucuagaaguagug

SEQ ID NO: 559109 - RNA, 22 nt, Human
uccagggagagccgcugcucca

SEQ ID NO: 559110 - RNA, 22 nt, Human
ugcagcagacugaguaugagaa

SEQ ID NO: 559111 - RNA, 22 nt, Human
ccaggugguucaggucaccaua

SEQ ID NO: 559112 - RNA, 19 nt, Human
ccucugcgcuguccugcuc

SEQ ID NO: 559113 - RNA, 19 nt, Human
cuuuuucaccuucuagaag

SEQ ID NO: 559114 - RNA, 22 nt, Human
acagaauuaaugaaaauuacaa

SEQ ID NO: 559115 - RNA, 22 nt, Human
gugcccaggggccagcugccgg

SEQ ID NO: 559116 - RNA, 23 nt, Human
uccaagggcuacaaacacagacc

SEQ ID NO: 559117 - RNA, 22 nt, Human
gccuggagcucuccacuugggg

SEQ ID NO: 559118 - RNA, 22 nt, Human
cccaggcacucuuggucauuuu

SEQ ID NO: 559119 - RNA, 22 nt, Human
gaugccucuuuuggcugaauua

SEQ ID NO: 559120 - RNA, 22 nt, Human
ccugggagguggagguugcagu

SEQ ID NO: 559121 - RNA, 22 nt, Human
gagcucugggaaacaaagugua

SEQ ID NO: 559122 - RNA, 22 nt, Human
caggcagcuagauuuauaacaa

SEQ ID NO: 559123 - RNA, 22 nt, Human
acuuugaaacuaaaauucauua

SEQ ID NO: 559124 - RNA, 22 nt, Human
ccaggcucugagaggaauguga

SEQ ID NO: 559125 - RNA, 22 nt, Human
aggucaccauggcaugcuccac

SEQ ID NO: 559126 - RNA, 22 nt, Human
uggaacacaucuaaggaagcag

SEQ ID NO: 559127 - RNA, 22 nt, Human
auucuggccuuggcucugucac

SEQ ID NO: 559128 - RNA, 22 nt, Human
gaagcagcugccagagaugucu

SEQ ID NO: 559129 - RNA, 22 nt, Human
uguauuuugaguccaaucuccu

SEQ ID NO: 559130 - RNA, 22 nt, Human
caggaacauuuaaccacagggu

SEQ ID NO: 559131 - RNA, 22 nt, Human
gauauuuuuaggugaugcaggc

SEQ ID NO: 559132 - RNA, 22 nt, Human
augaugaaauuuucuaucaugu

SEQ ID NO: 559133 - RNA, 22 nt, Human
aguuacaacuguuugaauguca

SEQ ID NO: 559134 - RNA, 22 nt, Human
cugcccugcuaaugaguuccaa

SEQ ID NO: 559135 - RNA, 22 nt, Human
cugcuuccugcugggauacuga

SEQ ID NO: 559136 - RNA, 22 nt, Human
aauugcuaaagauuauguuuuc

SEQ ID NO: 559137 - RNA, 22 nt, Human
caggaaccuaaagagacauuac

SEQ ID NO: 559138 - RNA, 22 nt, Human
uagaggggaaaaugcguauuaa

SEQ ID NO: 559139 - RNA, 22 nt, Human
auuccauuguguaaggauaucg

SEQ ID NO: 559140 - RNA, 22 nt, Human
aauucuucaagugcuuuggaga

SEQ ID NO: 559141 - RNA, 22 nt, Human
aaugaaaugaagauaugaucag

SEQ ID NO: 559142 - RNA, 22 nt, Human
agaggaggccaggcccacaccu

SEQ ID NO: 559143 - RNA, 22 nt, Human
uaugcacacaucgcagcaggaa

SEQ ID NO: 559144 - RNA, 22 nt, Human
ugccugcauuuuguggcuggcu

SEQ ID NO: 559145 - RNA, 22 nt, Human
cugcugcccagugugcauuggg

SEQ ID NO: 559146 - RNA, 22 nt, Human
agggcaaguugagugugcgugg

SEQ ID NO: 559147 - RNA, 22 nt, Human
gcaggcagaucaccugucagga

SEQ ID NO: 559148 - RNA, 22 nt, Human
acuugaaacccugagaugauaa

SEQ ID NO: 559149 - RNA, 22 nt, Human
ggccucaggguugggcccauua

SEQ ID NO: 559150 - RNA, 22 nt, Human
acacagggauauuucagguggu

SEQ ID NO: 559151 - RNA, 22 nt, Human
auacagaugagaucaggcauaa

SEQ ID NO: 559152 - RNA, 22 nt, Human
auuugugccaaauuauuucuaa

SEQ ID NO: 559153 - RNA, 21 nt, Human
acacaacaggcagucauuuuc

SEQ ID NO: 559154 - RNA, 22 nt, Human
aggagguguagauuuccuguca

SEQ ID NO: 559155 - RNA, 22 nt, Human
aaugugguuaaaauuugguugu

SEQ ID NO: 559156 - RNA, 21 nt, Human
gcaaguacuaucaucauuauc

SEQ ID NO: 559157 - RNA, 22 nt, Human
gccugggauagaggcaaugcau

SEQ ID NO: 559158 - RNA, 22 nt, Human
cuguguggccucaagccagccu

SEQ ID NO: 559159 - RNA, 22 nt, Human
aacugaaacuuaggaaguaauc

SEQ ID NO: 559160 - RNA, 22 nt, Human
guuauguauugggaaauccaag

SEQ ID NO: 559161 - RNA, 22 nt, Human
agaaagggagcguggaucaauu

SEQ ID NO: 559162 - RNA, 22 nt, Human
acagggcagugucuugaaaaau

SEQ ID NO: 559163 - RNA, 22 nt, Human
auucacacacauuuagagcaga

SEQ ID NO: 559164 - RNA, 22 nt, Human
uugaaaggcacaggcaccuggg

SEQ ID NO: 559165 - RNA, 22 nt, Human
guuucuuaccacuuggaccucu

SEQ ID NO: 559166 - RNA, 22 nt, Human
gggcugacagcacgccuucugu

SEQ ID NO: 559167 - RNA, 22 nt, Human
cccagcaguuguuggugcacau

SEQ ID NO: 559168 - RNA, 22 nt, Human
ugaaaucaugagauagugucac

SEQ ID NO: 559169 - RNA, 22 nt, Human
uuguuugcccacaacuauuaag

SEQ ID NO: 559170 - RNA, 22 nt, Human
cccuggcuuaaaaaccucauau

SEQ ID NO: 559171 - RNA, 23 nt, Human
gcucagagguuuuucucuggaug

SEQ ID NO: 559172 - RNA, 22 nt, Human
gcacacauucggauucuuaacc

SEQ ID NO: 559173 - RNA, 22 nt, Human
aaauuauucaaaaagcuguguu

SEQ ID NO: 559174 - RNA, 22 nt, Human
uagcagaggaaauccagaguaa

SEQ ID NO: 559175 - RNA, 22 nt, Human
uggcucaggaucuaagcagaau

SEQ ID NO: 559176 - RNA, 23 nt, Human
acagcuuccuacuuugcugcugc

SEQ ID NO: 559177 - RNA, 22 nt, Human
gcucuugucaaaaauuaguuga

SEQ ID NO: 559178 - RNA, 22 nt, Human
cuuggagauacaagugguaccu

SEQ ID NO: 559179 - RNA, 22 nt, Human
cagugcccuuccaggacugcag

SEQ ID NO: 559180 - RNA, 22 nt, Human
ugggcacagggguaggaaugag

SEQ ID NO: 559181 - RNA, 22 nt, Human
aaacucuggagauguuuaugca

SEQ ID NO: 559182 - RNA, 22 nt, Human
ggauggcaggacaaggacccag

SEQ ID NO: 559183 - RNA, 22 nt, Human
uccugcagaucaaagccuuuga

SEQ ID NO: 559184 - RNA, 22 nt, Human
ccucagaggcagaugguaagaa

SEQ ID NO: 559185 - RNA, 22 nt, Human
uccaguggguugcugagggagg

SEQ ID NO: 559186 - RNA, 22 nt, Human
ugugccuggaucucugugacaa

SEQ ID NO: 559187 - RNA, 22 nt, Human
ugaaggcccagccacagaaugg

SEQ ID NO: 559188 - RNA, 22 nt, Human
agaugggcgcccuggacugagg

SEQ ID NO: 559189 - RNA, 22 nt, Human
gguccccagcaguggcugcuuc

SEQ ID NO: 559190 - RNA, 22 nt, Human
cagagucaguauugaauugaaa

SEQ ID NO: 559191 - RNA, 22 nt, Human
agggcuggcaagggauugaaau

SEQ ID NO: 559192 - RNA, 21 nt, Human
gccaaggggguagcuauuccu

SEQ ID NO: 559193 - RNA, 21 nt, Human
acagcagacaggcuuaggacc

SEQ ID NO: 559194 - RNA, 22 nt, Human
gaggccuggaccagccacagag

SEQ ID NO: 559195 - RNA, 22 nt, Human
gccugggagauuaauuaggaag

SEQ ID NO: 559196 - RNA, 22 nt, Human
cagccucuaagcacagccucuc

SEQ ID NO: 559197 - RNA, 20 nt, Human
uuucacagucccuguuuccu

SEQ ID NO: 559198 - RNA, 22 nt, Human
aagugggaauagaaaugaaggu

SEQ ID NO: 559199 - RNA, 22 nt, Human
auugagaauccauuugagauga

SEQ ID NO: 559200 - RNA, 17 nt, Human
accagaguuuuccaugc

SEQ ID NO: 559201 - RNA, 21 nt, Human
uggcagagugcagucuauaca

SEQ ID NO: 559202 - RNA, 22 nt, Human
aagucaggacuuaugcuaccug

SEQ ID NO: 559203 - RNA, 22 nt, Human
ucagggcugacugcuacucucc

SEQ ID NO: 559204 - RNA, 22 nt, Human
uaaaggaggaguuaaugagacu

SEQ ID NO: 559205 - RNA, 22 nt, Human
ugggggucaggaugaggccuug

SEQ ID NO: 559206 - RNA, 22 nt, Human
uugggcuugacaagcugucaag

SEQ ID NO: 559207 - RNA, 22 nt, Human
ugucuuuaaaauuaaacacauc

SEQ ID NO: 559208 - RNA, 22 nt, Human
aaauuauuaugccccucuauaa

SEQ ID NO: 559209 - RNA, 22 nt, Human
aguuacaugugaauagaaagua

SEQ ID NO: 559210 - RNA, 21 nt, Human
aagggagauaggaaucaggcc

SEQ ID NO: 559211 - RNA, 18 nt, Human
cuccagggaacucaguca

SEQ ID NO: 559212 - RNA, 20 nt, Human
augguucaggccagcugucu

SEQ ID NO: 559213 - RNA, 22 nt, Human
agggcagccaugagccuucagg

SEQ ID NO: 559214 - RNA, 22 nt, Human
ccagcagcccucuuccaagacu

SEQ ID NO: 559215 - RNA, 22 nt, Human
aguuagcaaauaccacaaucug

SEQ ID NO: 559216 - RNA, 18 nt, Human
aggggcagcuugugugga

SEQ ID NO: 559217 - RNA, 22 nt, Human
ucuauacaugugcacacacauc

SEQ ID NO: 559218 - RNA, 22 nt, Human
aaagauuugaguucugcuuaua

SEQ ID NO: 559219 - RNA, 22 nt, Human
ugcaaaagaauauagauauugu

SEQ ID NO: 559220 - RNA, 22 nt, Human
ugggcagauguccucugaagug

SEQ ID NO: 559221 - RNA, 22 nt, Human
augaggcauucacagaaggcac

SEQ ID NO: 559222 - RNA, 22 nt, Human
aggaaggaagagacaccauuug

SEQ ID NO: 559223 - RNA, 22 nt, Human
gcccuuccaacccagagggcaa

SEQ ID NO: 559224 - RNA, 22 nt, Human
uuccuguaugucagugaagagc

SEQ ID NO: 559225 - RNA, 22 nt, Human
ggaccugccagaacucaggcua

SEQ ID NO: 559226 - RNA, 22 nt, Human
uacuuucuagcucuccccaguu

SEQ ID NO: 559227 - RNA, 22 nt, Human
ucucagaguuugaaucuggagu

SEQ ID NO: 559228 - RNA, 22 nt, Human
uccaggccuaggccaagugauu

SEQ ID NO: 559229 - RNA, 22 nt, Human
ggaugcaggggcagcagagccu

SEQ ID NO: 559230 - RNA, 22 nt, Human
auguccagaguguccuggaaag

SEQ ID NO: 559231 - RNA, 22 nt, Human
ugggaagcuacucaugcaggca

SEQ ID NO: 559232 - RNA, 22 nt, Human
aaagaagacagacauuucuuuc

SEQ ID NO: 559233 - RNA, 22 nt, Human
agggcuccuccccggccuccac

SEQ ID NO: 559234 - RNA, 22 nt, Human
guaacauaguuugugcuucauc

SEQ ID NO: 559235 - RNA, 22 nt, Human
agcagggcugcggccccaccac

SEQ ID NO: 559236 - RNA, 22 nt, Human
uucaacaaaauauauuuuucca

SEQ ID NO: 559237 - RNA, 22 nt, Human
ccugucuguauugguuugcuau

SEQ ID NO: 559238 - RNA, 22 nt, Human
uaaacaugugagugugcauaua

SEQ ID NO: 559239 - RNA, 22 nt, Human
uuguuuuuaugaacauccagga

SEQ ID NO: 559240 - RNA, 22 nt, Human
agcugcccugggucuugcugcu

SEQ ID NO: 559241 - RNA, 22 nt, Human
uggggagagguaucauugagau

SEQ ID NO: 559242 - RNA, 22 nt, Human
augggaugaacuugaucugcuu

SEQ ID NO: 559243 - RNA, 18 nt, Human
uaagucauuuugccagca

SEQ ID NO: 559244 - RNA, 22 nt, Human
agaagugccgaaaggaagacag

SEQ ID NO: 559245 - RNA, 22 nt, Human
uaauacuguauacugcaaauuu

SEQ ID NO: 559246 - RNA, 22 nt, Human
cauaaaguguauaagugaagaa

SEQ ID NO: 559247 - RNA, 22 nt, Human
ccaggcaggcagcguucucagg

SEQ ID NO: 559248 - RNA, 22 nt, Human
gaguuaaugaggccaagggcag

SEQ ID NO: 559249 - RNA, 22 nt, Human
ucugggcugcugugcagugacc

SEQ ID NO: 559250 - RNA, 22 nt, Human
cagauggcugccaagaugggcu

SEQ ID NO: 559251 - RNA, 22 nt, Human
gcaaauguuuuugaguguuuac

SEQ ID NO: 559252 - RNA, 22 nt, Human
ccugggcaaaugccagagacaa

SEQ ID NO: 559253 - RNA, 22 nt, Human
gagggcugugaaggagcggguu

SEQ ID NO: 559254 - RNA, 22 nt, Human
ucugagcuacgaugccugucac

SEQ ID NO: 559255 - RNA, 22 nt, Human
agcucagcuuccucuccaugcu

SEQ ID NO: 559256 - RNA, 22 nt, Human
cuguagcagugugcucuuuuuc

SEQ ID NO: 559257 - RNA, 22 nt, Human
aggaagggugucaugagcccuu

SEQ ID NO: 559258 - RNA, 22 nt, Human
ucugccuggguguggagcagag

SEQ ID NO: 559259 - RNA, 22 nt, Human
acacauauaccacuguaaauga

SEQ ID NO: 559260 - RNA, 22 nt, Human
ggaguaggccccgggagagagu

SEQ ID NO: 559261 - RNA, 22 nt, Human
uaagugcaauguuuuacuuaaa

SEQ ID NO: 559262 - RNA, 22 nt, Human
gggagucugggcuagacuccuu

SEQ ID NO: 559263 - RNA, 22 nt, Human
auuacaauaauacaugcucauu

SEQ ID NO: 559264 - RNA, 22 nt, Human
cuuugcuacugugaauagugcc

SEQ ID NO: 559265 - RNA, 22 nt, Human
gccugggagagggauagugcag

SEQ ID NO: 559266 - RNA, 22 nt, Human
gagguuggagggcuggccugca

SEQ ID NO: 559267 - RNA, 22 nt, Human
caggccuccacuccacgcagac

SEQ ID NO: 559268 - RNA, 22 nt, Human
ucagcccugaggacagaggcag

SEQ ID NO: 559269 - RNA, 21 nt, Human
ucacuuauaauguauuugcug

SEQ ID NO: 559270 - RNA, 22 nt, Human
uauguuaagugggauaaucaaa

SEQ ID NO: 559271 - RNA, 22 nt, Human
guggguggaucaccugagguca

SEQ ID NO: 559272 - RNA, 22 nt, Human
agagcccugaagcagagcuaaa

SEQ ID NO: 559273 - RNA, 20 nt, Human
ggcaggcaggagguuuccag

SEQ ID NO: 559274 - RNA, 22 nt, Human
cugauuccugauucaugcucuu

SEQ ID NO: 559275 - RNA, 22 nt, Human
gugcaggagguaacauagcaaa

SEQ ID NO: 559276 - RNA, 22 nt, Human
guauacauacuucuagauuaaa

SEQ ID NO: 559277 - RNA, 22 nt, Human
caguaggagguucugagguucu

SEQ ID NO: 559278 - RNA, 22 nt, Human
agcaggcuaggaaccucacugc

SEQ ID NO: 559279 - RNA, 22 nt, Human
caguggguggcuaaguggcuga

SEQ ID NO: 559280 - RNA, 22 nt, Human
uugaaauuuuaggccuugcaau

SEQ ID NO: 559281 - RNA, 22 nt, Human
ugaagauuuucggguacuugau

SEQ ID NO: 559282 - RNA, 22 nt, Human
ugcuccauucucuagccagugc

SEQ ID NO: 559283 - RNA, 22 nt, Human
uggcgugcccuccagacuuggc

SEQ ID NO: 559284 - RNA, 22 nt, Human
agagcugugaaaaugagguuug

SEQ ID NO: 559285 - RNA, 22 nt, Human
ccuggcacaagagcagcauugg

SEQ ID NO: 559286 - RNA, 22 nt, Human
agcugggcuuggccaggucgcu

SEQ ID NO: 559287 - RNA, 22 nt, Human
ugaggcaggacuugcauaaagu

SEQ ID NO: 559288 - RNA, 22 nt, Human
augcaugauccugagcaaccca

SEQ ID NO: 559289 - RNA, 22 nt, Human
uagauggcuuucugagguauuu

SEQ ID NO: 559290 - RNA, 22 nt, Human
uguggccuggaaggggcugcuc

SEQ ID NO: 559291 - RNA, 22 nt, Human
uggaggcaguuuaagucugaga

SEQ ID NO: 559292 - RNA, 22 nt, Human
uuucugaagggcagcagacucu

SEQ ID NO: 559293 - RNA, 22 nt, Human
ggcuuugguagacacagauuga

SEQ ID NO: 559294 - RNA, 22 nt, Human
ucugggcugucuacagguuggc

SEQ ID NO: 559295 - RNA, 22 nt, Human
ccacaggggucucuguagcuga

SEQ ID NO: 559296 - RNA, 22 nt, Human
aggagcugagucagcccgacag

SEQ ID NO: 559297 - RNA, 22 nt, Human
gacccagcuuaagucacauguu

SEQ ID NO: 559298 - RNA, 22 nt, Human
cugcccugggauggucugugcg

SEQ ID NO: 559299 - RNA, 22 nt, Human
gagggggcgugcaaggcuccgc

SEQ ID NO: 559300 - RNA, 22 nt, Human
acugaaaugaaaucuaucaucu

SEQ ID NO: 559301 - RNA, 22 nt, Human
ggaggaagagguuguucucuca

SEQ ID NO: 559302 - RNA, 22 nt, Human
cacauuuaucucucuccgguga

SEQ ID NO: 559303 - RNA, 21 nt, Human
aggcagccagucaugcucccu

SEQ ID NO: 559304 - RNA, 22 nt, Human
auaaggaaaugaaacucuaaua

SEQ ID NO: 559305 - RNA, 22 nt, Human
uagcuguuuuuugugaggaaau

SEQ ID NO: 559306 - RNA, 22 nt, Human
gguuucaaaguggacaguuagu

SEQ ID NO: 559307 - RNA, 22 nt, Human
acagauuugaucugagaacaaa

SEQ ID NO: 559308 - RNA, 22 nt, Human
agcagugaguaacacagaccag

SEQ ID NO: 559309 - RNA, 21 nt, Human
cccacggaaugaugaggcacu

SEQ ID NO: 559310 - RNA, 22 nt, Human
uaacagaagaaaacauauugga

SEQ ID NO: 559311 - RNA, 22 nt, Human
gcagugauaacuuuacucuuuu

SEQ ID NO: 559312 - RNA, 22 nt, Human
auauuaaauggauuuugggagc

SEQ ID NO: 559313 - RNA, 22 nt, Human
auggagggugucagagagcgaa

SEQ ID NO: 559314 - RNA, 22 nt, Human
cagcuagaaaugggauugguau

SEQ ID NO: 559315 - RNA, 22 nt, Human
agaaguaggcagggcuguauca

SEQ ID NO: 559316 - RNA, 22 nt, Human
guggccagugggaaugggcuca

SEQ ID NO: 559317 - RNA, 22 nt, Human
uuguaugaguaugguguauagg

SEQ ID NO: 559318 - RNA, 22 nt, Human
ucacaacucuuuccauuuaaua

SEQ ID NO: 559319 - RNA, 22 nt, Human
gcagcucuuuucuuaaagagau

SEQ ID NO: 559320 - RNA, 22 nt, Human
aauagcacuuccugaacacauu

SEQ ID NO: 559321 - RNA, 22 nt, Human
agcuucuccaucugcccagaga

SEQ ID NO: 559322 - RNA, 22 nt, Human
uauuucaucuggaacaagguaa

SEQ ID NO: 559323 - RNA, 22 nt, Human
aguuucauauuaccaugucacc

SEQ ID NO: 559324 - RNA, 22 nt, Human
gacccggcuccaggcccagcag

SEQ ID NO: 559325 - RNA, 22 nt, Human
caggugaccuuuguccuaaguu

SEQ ID NO: 559326 - RNA, 22 nt, Human
aaggcucccucuucucgagugu

SEQ ID NO: 559327 - RNA, 22 nt, Human
aguggcaggcggagauguagga

SEQ ID NO: 559328 - RNA, 19 nt, Human
ggcugggucuggcagguuc

SEQ ID NO: 559329 - RNA, 19 nt, Human
ugcucaggccaaggagccc

SEQ ID NO: 559330 - RNA, 22 nt, Human
gcucugcuguguuuguucagca

SEQ ID NO: 559331 - RNA, 22 nt, Human
uuucacauacaguguauaguag

SEQ ID NO: 559332 - RNA, 22 nt, Human
ugucaguagauuauuacaauaa

SEQ ID NO: 559333 - RNA, 22 nt, Human
aggcacuguucccaguuauccu

SEQ ID NO: 559334 - RNA, 22 nt, Human
ucuggggacggggcccagcaau

SEQ ID NO: 559335 - RNA, 22 nt, Human
aaaccauggcucauuggagaug

SEQ ID NO: 559336 - RNA, 22 nt, Human
ucucagucagccuugauguccc

SEQ ID NO: 559337 - RNA, 22 nt, Human
acauuucuuccacaugcugcug

SEQ ID NO: 559338 - RNA, 22 nt, Human
uuuccuaugauauucuaugugu

SEQ ID NO: 559339 - RNA, 22 nt, Human
gacagaagaggaacuuggacag

SEQ ID NO: 559340 - RNA, 22 nt, Human
gcugcugugugggagacaggcg

SEQ ID NO: 559341 - RNA, 22 nt, Human
ugcuggggucauggggcgcccg

SEQ ID NO: 559342 - RNA, 22 nt, Human
gcauccagucuuggcuccugga

SEQ ID NO: 559343 - RNA, 22 nt, Human
gggagccaaggagagaggccuu

SEQ ID NO: 559344 - RNA, 22 nt, Human
caacuucagggaaacaugaagc

SEQ ID NO: 559345 - RNA, 22 nt, Human
ggugcccuucagacagugggca

SEQ ID NO: 559346 - RNA, 22 nt, Human
guuccugggccugcauucacca

SEQ ID NO: 559347 - RNA, 22 nt, Human
agagucugugcuuucaucagga

SEQ ID NO: 559348 - RNA, 22 nt, Human
augcuuuuccuaaaaugaugcc

SEQ ID NO: 559349 - RNA, 22 nt, Human
caagcagagacuagauagcugu

SEQ ID NO: 559350 - RNA, 22 nt, Human
agaaauacuaggaauauucaua

SEQ ID NO: 559351 - RNA, 22 nt, Human
cagccucuuuccacaucaggca

SEQ ID NO: 559352 - RNA, 22 nt, Human
cagcuugggucaggugccugcu

SEQ ID NO: 559353 - RNA, 22 nt, Human
cagcuggguuuaguggggugug

SEQ ID NO: 559354 - RNA, 22 nt, Human
ucccaaagguccgagcgggaau

SEQ ID NO: 559355 - RNA, 20 nt, Human
accaggagauggaggcaggg

SEQ ID NO: 559356 - RNA, 19 nt, Human
uccaggccauucccagagc

SEQ ID NO: 559357 - RNA, 22 nt, Human
agccuggagaggcgccauacac

SEQ ID NO: 559358 - RNA, 22 nt, Human
ugagagucuguuccucuugcag

SEQ ID NO: 559359 - RNA, 22 nt, Human
gucuaaacuuagggaucgaaca

SEQ ID NO: 559360 - RNA, 22 nt, Human
acagaaagaccuuguaacacuu

SEQ ID NO: 559361 - RNA, 22 nt, Human
ggacuggacucucaggcucaca

SEQ ID NO: 559362 - RNA, 22 nt, Human
agggcagagacaugcuuccuga

SEQ ID NO: 559363 - RNA, 22 nt, Human
aaaggcaauuucuucuuccuga

SEQ ID NO: 559364 - RNA, 22 nt, Human
uucacaaaaugguuuguugaug

SEQ ID NO: 559365 - RNA, 20 nt, Human
aagagcauaguacaggaaga

SEQ ID NO: 559366 - RNA, 22 nt, Human
gggcacugugcuaggugcugag

SEQ ID NO: 559367 - RNA, 22 nt, Human
aaucuggcauguaagcuuagag

SEQ ID NO: 559368 - RNA, 22 nt, Human
uagaaagaacuucauguaaaac

SEQ ID NO: 559369 - RNA, 22 nt, Human
aggugggguguuggauguuuau

SEQ ID NO: 559370 - RNA, 22 nt, Human
ucauuucaguucagaggccuuu

SEQ ID NO: 559371 - RNA, 22 nt, Human
cugcucuggcuguguacuucag

SEQ ID NO: 559372 - RNA, 22 nt, Human
cugucagaggcucucuguugcc

SEQ ID NO: 559373 - RNA, 22 nt, Human
aggaagaaaacuaauuagaugg

SEQ ID NO: 559374 - RNA, 22 nt, Human
uuacagcacagugcuuuuacug

SEQ ID NO: 559375 - RNA, 22 nt, Human
aucuccaggauuuucacacuca

SEQ ID NO: 559376 - RNA, 19 nt, Human
cucugccucccuccugggu

SEQ ID NO: 559377 - RNA, 22 nt, Human
uuuauugucuaugaacugcuug

SEQ ID NO: 559378 - RNA, 22 nt, Human
ugacacaguaucaaacaugauu

SEQ ID NO: 559379 - RNA, 18 nt, Human
ccucugccauagccagca

SEQ ID NO: 559380 - RNA, 22 nt, Human
acacauuuacauguuuacguau

SEQ ID NO: 559381 - RNA, 22 nt, Human
gaagcagcucagauugacugaa

SEQ ID NO: 559382 - RNA, 22 nt, Human
cacauuuacauauaaaacuuuc

SEQ ID NO: 559383 - RNA, 22 nt, Human
ggccucucuccuuggcuugcag

SEQ ID NO: 559384 - RNA, 22 nt, Human
cccugggcaagcccuauuuucc

SEQ ID NO: 559385 - RNA, 20 nt, Human
auauuucuuaagaacuuuca

SEQ ID NO: 559386 - RNA, 22 nt, Human
acuggagcugagagcaugggua

SEQ ID NO: 559387 - RNA, 22 nt, Human
caggagugaaaugaggcccagg

SEQ ID NO: 559388 - RNA, 22 nt, Human
accaaugugaugauauuaggag

SEQ ID NO: 559389 - RNA, 22 nt, Human
ucacacagauugguagagcuga

SEQ ID NO: 559390 - RNA, 22 nt, Human
uguuauuugggaaaguuguaca

SEQ ID NO: 559391 - RNA, 22 nt, Human
agcagugggggaguguuaguuu

SEQ ID NO: 559392 - RNA, 22 nt, Human
gauguuucugggaaggaaaagu

SEQ ID NO: 559393 - RNA, 19 nt, Human
ucagaacucagaaugugua

SEQ ID NO: 559394 - RNA, 22 nt, Human
aaacuucaaggauuugcaaauc

SEQ ID NO: 559395 - RNA, 22 nt, Human
cuaaaugccuuuccuaccuaac

SEQ ID NO: 559396 - RNA, 22 nt, Human
acauagcaagugcucaauaaau

SEQ ID NO: 559397 - RNA, 22 nt, Human
acauuuuaauaugcuuagugug

SEQ ID NO: 559398 - RNA, 22 nt, Human
auggcagauggcuggagcaggu

SEQ ID NO: 559399 - RNA, 22 nt, Human
ggcucuugggagcucagaguug

SEQ ID NO: 559400 - RNA, 22 nt, Human
gccaagcuguuuuucagagacg

SEQ ID NO: 559401 - RNA, 22 nt, Human
caucaguguuggcuucucagag

SEQ ID NO: 559402 - RNA, 22 nt, Human
aaauggcaacagaagggaguuc

SEQ ID NO: 559403 - RNA, 19 nt, Human
gucacauuugucucccagg

SEQ ID NO: 559404 - RNA, 22 nt, Human
acacucuugcauuaccugaaua

SEQ ID NO: 559405 - RNA, 20 nt, Human
uccugguggauacugcuuaa

SEQ ID NO: 559406 - RNA, 22 nt, Human
aguacuuugcacuuugcucaga

SEQ ID NO: 559407 - RNA, 22 nt, Human
agucucugagguucagaugccu

SEQ ID NO: 559408 - RNA, 20 nt, Human
uacuugaauguugcagcagu

SEQ ID NO: 559409 - RNA, 22 nt, Human
uauuuccauguuagaacuaagu

SEQ ID NO: 559410 - RNA, 22 nt, Human
agauacaaaagauaagauuuag

SEQ ID NO: 559411 - RNA, 22 nt, Human
acuggaagccaguugacaauca

SEQ ID NO: 559412 - RNA, 22 nt, Human
ggcaguggcuccucucuacucc

SEQ ID NO: 559413 - RNA, 22 nt, Human
uccaucaccauuucugcgagcu

SEQ ID NO: 559414 - RNA, 22 nt, Human
ggcacagcacuguaggccuggg

SEQ ID NO: 559415 - RNA, 22 nt, Human
uccaggcaaaaaccaacuacag

SEQ ID NO: 559416 - RNA, 22 nt, Human
ucucagaguuuagagcugagcc

SEQ ID NO: 559417 - RNA, 23 nt, Human
gagcugggauacaggcuuacugc

SEQ ID NO: 559418 - RNA, 22 nt, Human
aaugaugguuucaucacuugaa

SEQ ID NO: 559419 - RNA, 22 nt, Human
aaaccuguuaauagagcgaugc

SEQ ID NO: 559420 - RNA, 23 nt, Human
ucuguuuugcaacaugugacaag

SEQ ID NO: 559421 - RNA, 22 nt, Human
gagcuccaccaccuucaggcag

SEQ ID NO: 559422 - RNA, 22 nt, Human
gcagaaguuaaucgaaggccau

SEQ ID NO: 559423 - RNA, 22 nt, Human
uuguuuuaaccuaguguuuaug

SEQ ID NO: 559424 - RNA, 22 nt, Human
ggcagguggaaguuggcagagc

SEQ ID NO: 559425 - RNA, 22 nt, Human
aggccuuaccauagcuguagca

SEQ ID NO: 559426 - RNA, 22 nt, Human
uuacaaaguucugaguucaaac

SEQ ID NO: 559427 - RNA, 22 nt, Human
gaggagggagcuggaagcucuu

SEQ ID NO: 559428 - RNA, 22 nt, Human
aucuuguuaaaaugcagaaacu

SEQ ID NO: 559429 - RNA, 22 nt, Human
uucuggggccaauugccacugc

SEQ ID NO: 559430 - RNA, 20 nt, Human
ucccaggcugggcuccagcu

SEQ ID NO: 559431 - RNA, 22 nt, Human
uuuaauuugaaaugaguaaccc

SEQ ID NO: 559432 - RNA, 22 nt, Human
ucuccgaucacagguuuucaau

SEQ ID NO: 559433 - RNA, 22 nt, Human
cucagaaguucagccuagagua

SEQ ID NO: 559434 - RNA, 22 nt, Human
cugcugagagccccagcugaga

SEQ ID NO: 559435 - RNA, 17 nt, Human
cucagagcaggacagaa

SEQ ID NO: 559436 - RNA, 22 nt, Human
agggccugggccagcacccuuu

SEQ ID NO: 559437 - RNA, 22 nt, Human
uaaaauuugucccugaguguug

SEQ ID NO: 559438 - RNA, 22 nt, Human
gcuuuucuccuuagugucccug

SEQ ID NO: 559439 - RNA, 16 nt, Human
ccuuucucugccuucc

SEQ ID NO: 559440 - RNA, 22 nt, Human
acauuaaaaaauguugcaugaa

SEQ ID NO: 559441 - RNA, 22 nt, Human
ucacagggcauuauggcuccag

SEQ ID NO: 559442 - RNA, 22 nt, Human
uagcuagaaagugaagaucaca

SEQ ID NO: 559443 - RNA, 22 nt, Human
cagcaggucccacugagggccc

SEQ ID NO: 559444 - RNA, 22 nt, Human
cauggccugccuccuccuggug

SEQ ID NO: 559445 - RNA, 22 nt, Human
ugccugugcccuucuuggcauu

SEQ ID NO: 559446 - RNA, 22 nt, Human
gccauuuucugucuuguuuauu

SEQ ID NO: 559447 - RNA, 22 nt, Human
cugaagauagugucugaucaug

SEQ ID NO: 559448 - RNA, 22 nt, Human
ucagagugcagggaguagcagc

SEQ ID NO: 559449 - RNA, 22 nt, Human
ucagggcacauucugcaguggc

SEQ ID NO: 559450 - RNA, 22 nt, Human
agcugggcaaaaugugagguug

SEQ ID NO: 559451 - RNA, 22 nt, Human
uuugggaaacuuaggggucaga

SEQ ID NO: 559452 - RNA, 22 nt, Human
aggcagguuucccggcugucaa

SEQ ID NO: 559453 - RNA, 22 nt, Human
cuguacaucucugaggacagua

SEQ ID NO: 559454 - RNA, 22 nt, Human
cccugcagaucuaggguccuuc

SEQ ID NO: 559455 - RNA, 22 nt, Human
ucauacaauucaaucucugauu

SEQ ID NO: 559456 - RNA, 17 nt, Human
ggcaccagacggagagu

SEQ ID NO: 559457 - RNA, 22 nt, Human
ggcacagccacuuuggagaacu

SEQ ID NO: 559458 - RNA, 22 nt, Human
ugaaugaauccuaacaaagaca

SEQ ID NO: 559459 - RNA, 22 nt, Human
gcuucccacagcuggacugggg

SEQ ID NO: 559460 - RNA, 22 nt, Human
ucagaggucacacagcaaguuu

SEQ ID NO: 559461 - RNA, 22 nt, Human
uauguauaugguagaaguaugu

SEQ ID NO: 559462 - RNA, 22 nt, Human
ccucacugcuauguguuugcuc

SEQ ID NO: 559463 - RNA, 18 nt, Human
ggccucagccuggccgga

SEQ ID NO: 559464 - RNA, 22 nt, Human
agugacaaggugguaaugaagc

SEQ ID NO: 559465 - RNA, 22 nt, Human
agagcuuagaauuucagaugau

SEQ ID NO: 559466 - RNA, 22 nt, Human
uauuugcaacauaaaacucuga

SEQ ID NO: 559467 - RNA, 21 nt, Human
ucugagagcaacugcccuuua

SEQ ID NO: 559468 - RNA, 22 nt, Human
cauuuuaaaugauuuaagccaa

SEQ ID NO: 559469 - RNA, 22 nt, Human
uaguggaguagaaaccaaagaa

SEQ ID NO: 559470 - RNA, 22 nt, Human
ggugacugguuuaucuggcagu

SEQ ID NO: 559471 - RNA, 21 nt, Human
aaauccaaacacuaguccaca

SEQ ID NO: 559472 - RNA, 22 nt, Human
uuccauaaugagauucccagcc

SEQ ID NO: 559473 - RNA, 20 nt, Human
uaaauuagccuugaagauua

SEQ ID NO: 559474 - RNA, 22 nt, Human
aacauguaucgcuuuuuaauau

SEQ ID NO: 559475 - RNA, 22 nt, Human
cucagaguccauaguuuacagu

SEQ ID NO: 559476 - RNA, 22 nt, Human
uaauuauuugaagacauuagag

SEQ ID NO: 559477 - RNA, 22 nt, Human
agucaucaucugcccucacugg

SEQ ID NO: 559478 - RNA, 23 nt, Human
auaauaacgucugucuugucucu

SEQ ID NO: 559479 - RNA, 22 nt, Human
ggcaggugcgcauguugcauua

SEQ ID NO: 559480 - RNA, 22 nt, Human
uuagauaaauugcaacuugauu

SEQ ID NO: 559481 - RNA, 22 nt, Human
cuggaagggucuacuuagcaga

SEQ ID NO: 559482 - RNA, 22 nt, Human
accaagcucucuucccggcucu

SEQ ID NO: 559483 - RNA, 22 nt, Human
uacaguaucuucuggcaagcau

SEQ ID NO: 559484 - RNA, 22 nt, Human
ugcuucugacauguucuugguu

SEQ ID NO: 559485 - RNA, 22 nt, Human
uuaaagcugagcccucagaagc

SEQ ID NO: 559486 - RNA, 22 nt, Human
ccucucauagucuguauccuuu

SEQ ID NO: 559487 - RNA, 22 nt, Human
ugggccucugccacgcuccccc

SEQ ID NO: 559488 - RNA, 22 nt, Human
ucccagcagggccgaccagccu

SEQ ID NO: 559489 - RNA, 22 nt, Human
uaggaagcugagcagcauuccu

SEQ ID NO: 559490 - RNA, 22 nt, Human
cugcccagaaucacucacucga

SEQ ID NO: 559491 - RNA, 22 nt, Human
agcuuuauagaaaggaucagug

SEQ ID NO: 559492 - RNA, 22 nt, Human
cugggcucagcccaugcugucc

SEQ ID NO: 559493 - RNA, 22 nt, Human
ucccuggaacagagagacaacg

SEQ ID NO: 559494 - RNA, 22 nt, Human
uuucacagugcucuguaaguau

SEQ ID NO: 559495 - RNA, 22 nt, Human
gcagagcugucuaagucacuuc

SEQ ID NO: 559496 - RNA, 22 nt, Human
gcccagcaggacagagugguuu

SEQ ID NO: 559497 - RNA, 22 nt, Human
aaauguauugcauaggauauuu

SEQ ID NO: 559498 - RNA, 22 nt, Human
gcugcccauuccacuggauggu

SEQ ID NO: 559499 - RNA, 22 nt, Human
uuuuugucaucuauuucuggug

SEQ ID NO: 559500 - RNA, 22 nt, Human
cugauuuucaaaauguguuaaa

SEQ ID NO: 559501 - RNA, 22 nt, Human
uccagacccaugacccugggga

SEQ ID NO: 559502 - RNA, 22 nt, Human
ugcccugugugugcaagcacug

SEQ ID NO: 559503 - RNA, 22 nt, Human
auucaaauuaaguuaauucagc

SEQ ID NO: 559504 - RNA, 22 nt, Human
ugguccugagcaccagccugac

SEQ ID NO: 559505 - RNA, 22 nt, Human
gaggcugggaaguccaagacca

SEQ ID NO: 559506 - RNA, 19 nt, Human
ggccugugcagagcccguc

SEQ ID NO: 559507 - RNA, 22 nt, Human
gcccaugguggcguucggugca

SEQ ID NO: 559508 - RNA, 22 nt, Human
ccaggcaggcgauggugcagug

SEQ ID NO: 559509 - RNA, 22 nt, Human
cagagcugcucaugguggccag

SEQ ID NO: 559510 - RNA, 22 nt, Human
guuucaaaagucaggcuauucu

SEQ ID NO: 559511 - RNA, 21 nt, Human
agagaagggacucuuccaguc

SEQ ID NO: 559512 - RNA, 22 nt, Human
gaaaucugaaucuucuguuggu

SEQ ID NO: 559513 - RNA, 22 nt, Human
uggguacuccuauuaguucagu

SEQ ID NO: 559514 - RNA, 22 nt, Human
gcuguucaagacuaggaaauuu

SEQ ID NO: 559515 - RNA, 22 nt, Human
acugaaggucucagcaaggaug

SEQ ID NO: 559516 - RNA, 22 nt, Human
aguuuguaugccaacagcaaag

SEQ ID NO: 559517 - RNA, 22 nt, Human
uggggggauacuugcuacuggc

SEQ ID NO: 559518 - RNA, 22 nt, Human
cucucagacugaagggccugug

SEQ ID NO: 559519 - RNA, 22 nt, Human
uugugcagaguugccuuuauuu

SEQ ID NO: 559520 - RNA, 22 nt, Human
gaguggcuuuggagaaguaggg

SEQ ID NO: 559521 - RNA, 22 nt, Human
gacccaggguggucaccugaaa

SEQ ID NO: 559522 - RNA, 22 nt, Human
gacuucucccaaccaucagagg

SEQ ID NO: 559523 - RNA, 22 nt, Human
ggcagguguggaguguuauuuu

SEQ ID NO: 559524 - RNA, 22 nt, Human
aaaacugaaccuugagaucuuu

SEQ ID NO: 559525 - RNA, 22 nt, Human
uguuucaugauugcugucauuu

SEQ ID NO: 559526 - RNA, 22 nt, Human
uaaauucagugaguaauuucug

SEQ ID NO: 559527 - RNA, 22 nt, Human
ccuguucaagggaugauugacc

SEQ ID NO: 559528 - RNA, 17 nt, Human
ugcugccaagucccaac

SEQ ID NO: 559529 - RNA, 22 nt, Human
auuugaaaaccugagccucccg

SEQ ID NO: 559530 - RNA, 22 nt, Human
cagcuguuucaguagcguuacu

SEQ ID NO: 559531 - RNA, 22 nt, Human
gagagcugcaagguagggcggg

SEQ ID NO: 559532 - RNA, 22 nt, Human
guucauuuuuacuuugaucuac

SEQ ID NO: 559533 - RNA, 22 nt, Human
caguucuggaggcuccacaucu

SEQ ID NO: 559534 - RNA, 22 nt, Human
cacuggaauggauagagcagag

SEQ ID NO: 559535 - RNA, 22 nt, Human
acaggugggcuuaagagucggc

SEQ ID NO: 559536 - RNA, 22 nt, Human
aggagccuccuucucaugugca

SEQ ID NO: 559537 - RNA, 22 nt, Human
uucacaggcuuggagguggggg

SEQ ID NO: 559538 - RNA, 21 nt, Human
cgacaggagaggcagccagcc

SEQ ID NO: 559539 - RNA, 22 nt, Human
uccuucaguuaucacaguacug

SEQ ID NO: 559540 - RNA, 22 nt, Human
ucugaaaugcaaauuugacuga

SEQ ID NO: 559541 - RNA, 22 nt, Human
ugggcaaguaucggacucugag

SEQ ID NO: 559542 - RNA, 22 nt, Human
cuugggagacacaagaagacau

SEQ ID NO: 559543 - RNA, 22 nt, Human
agggcagauggaacuuccccga

SEQ ID NO: 559544 - RNA, 22 nt, Human
gccaggcagagccccgugcagc

SEQ ID NO: 559545 - RNA, 22 nt, Human
caacugcuuggaggaauacugc

SEQ ID NO: 559546 - RNA, 22 nt, Human
acagggcaccugagguaggaag

SEQ ID NO: 559547 - RNA, 22 nt, Human
uuaucacuuaugagcuuuuugc

SEQ ID NO: 559548 - RNA, 22 nt, Human
uuugaaaggguuaugagacuga

SEQ ID NO: 559549 - RNA, 22 nt, Human
uuaauaaguaguaguuauuguu

SEQ ID NO: 559550 - RNA, 23 nt, Human
ccugggcauuggcugcagcuucu

SEQ ID NO: 559551 - RNA, 22 nt, Human
cugggaggauucauugagguga

SEQ ID NO: 559552 - RNA, 22 nt, Human
ggcaaaaaccgcaauaacuucu

SEQ ID NO: 559553 - RNA, 22 nt, Human
ucccacaugugaauccucaggu

SEQ ID NO: 559554 - RNA, 22 nt, Human
uggcaggcgggagccauagagg

SEQ ID NO: 559555 - RNA, 22 nt, Human
accuccuggcugcucauggaac

SEQ ID NO: 559556 - RNA, 22 nt, Human
ugggcuccggcggccucaggcu

SEQ ID NO: 559557 - RNA, 22 nt, Human
uagaaacagagcagguggccca

SEQ ID NO: 559558 - RNA, 22 nt, Human
augguuauuucauggaaaaauu

SEQ ID NO: 559559 - RNA, 22 nt, Human
accuuucaaaguggcuaucacu

SEQ ID NO: 559560 - RNA, 19 nt, Human
aaaagucuauucaauuaca

SEQ ID NO: 559561 - RNA, 22 nt, Human
gccgaagcugccgucugguccu

SEQ ID NO: 559562 - RNA, 22 nt, Human
ugcagagguuuccaggcaaguu

SEQ ID NO: 559563 - RNA, 18 nt, Human
agaaggagcuaugggcag

SEQ ID NO: 559564 - RNA, 22 nt, Human
cggcccugcugagcuugucugg

SEQ ID NO: 559565 - RNA, 23 nt, Human
cuggcucuguagguggcauccuu

SEQ ID NO: 559566 - RNA, 22 nt, Human
aacuccagcaggaaggugagaa

SEQ ID NO: 559567 - RNA, 22 nt, Human
uacauacaguggaugcuuuagg

SEQ ID NO: 559568 - RNA, 22 nt, Human
augggaggaaggaggcccuuga

SEQ ID NO: 559569 - RNA, 22 nt, Human
ucauucagguugggcaaguguc

SEQ ID NO: 559570 - RNA, 17 nt, Human
gcugagaggcagcacag

SEQ ID NO: 559571 - RNA, 22 nt, Human
agauuuaaauuugcuacaauuc

SEQ ID NO: 559572 - RNA, 22 nt, Human
aaaauaguuaacguucagagua

SEQ ID NO: 559573 - RNA, 22 nt, Human
gguggcagagaggagguaguuu

SEQ ID NO: 559574 - RNA, 22 nt, Human
ggcagggucuggacugaaagcu

SEQ ID NO: 559575 - RNA, 22 nt, Human
ugcagggaugcuagagguaaga

SEQ ID NO: 559576 - RNA, 22 nt, Human
auuacagaaagcaauauugagu

SEQ ID NO: 559577 - RNA, 22 nt, Human
uggagcaagcuggagagaacau

SEQ ID NO: 559578 - RNA, 22 nt, Human
aagacuuucugggguguaaagg

SEQ ID NO: 559579 - RNA, 22 nt, Human
uccugggguuuuggccgcagcu

SEQ ID NO: 559580 - RNA, 23 nt, Human
ucccuggaggcagguccagggcc

SEQ ID NO: 559581 - RNA, 22 nt, Human
uggcucagcuuuccccaucugg

SEQ ID NO: 559582 - RNA, 22 nt, Human
gggcugggauggcuugaagauu

SEQ ID NO: 559583 - RNA, 22 nt, Human
ggaugcugucuaagcugaggac

SEQ ID NO: 559584 - RNA, 22 nt, Human
caggcacuguguuaggcacugu

SEQ ID NO: 559585 - RNA, 22 nt, Human
aauuaaaggucauguuaaaggg

SEQ ID NO: 559586 - RNA, 22 nt, Human
uucuacauauauuuuucucacu

SEQ ID NO: 559587 - RNA, 22 nt, Human
ggcagguggacgugcuaaagcu

SEQ ID NO: 559588 - RNA, 22 nt, Human
uggggcaguuaauaaacauucu

SEQ ID NO: 559589 - RNA, 22 nt, Human
cuguggcuaggaagcuguggga

SEQ ID NO: 559590 - RNA, 22 nt, Human
cuuauacauaaaauggguguag

SEQ ID NO: 559591 - RNA, 22 nt, Human
uugacacagaucaauauucaac

SEQ ID NO: 559592 - RNA, 22 nt, Human
cuggcagguggagguugcagug

SEQ ID NO: 559593 - RNA, 22 nt, Human
agcaggugucacuuucacucca

SEQ ID NO: 559594 - RNA, 22 nt, Human
uucuuguauauaaaaaucauuu

SEQ ID NO: 559595 - RNA, 22 nt, Human
aucaguuuuguucacuacuaua

SEQ ID NO: 559596 - RNA, 22 nt, Human
ucccucuguguugggcaugccu

SEQ ID NO: 559597 - RNA, 22 nt, Human
auuuuuccaugauacuuaucug

SEQ ID NO: 559598 - RNA, 22 nt, Human
ucuacaaagccauucaggaucu

SEQ ID NO: 559599 - RNA, 22 nt, Human
uuugugaacuuaggcaauuagg

SEQ ID NO: 559600 - RNA, 22 nt, Human
acagaaaaguuuacuuuugcuc

SEQ ID NO: 559601 - RNA, 22 nt, Human
uucagaaggauuuuaacacaug

SEQ ID NO: 559602 - RNA, 22 nt, Human
acugaaagauaaaucaguuagc

SEQ ID NO: 559603 - RNA, 22 nt, Human
ucacagaaagcuguguccugac

SEQ ID NO: 559604 - RNA, 22 nt, Human
aauagauacuacuuagauguag

SEQ ID NO: 559605 - RNA, 22 nt, Human
uacaaaguagaaauucaguaaa

SEQ ID NO: 559606 - RNA, 22 nt, Human
cugcugcugcuaucuacccagg

SEQ ID NO: 559607 - RNA, 22 nt, Human
uuugaaucugauauggcagcau

SEQ ID NO: 559608 - RNA, 23 nt, Human
cugcauguccacugguguaaaug

SEQ ID NO: 559609 - RNA, 22 nt, Human
aaaagguaguugccaaauaagg

SEQ ID NO: 559610 - RNA, 22 nt, Human
acaaauguuggauuugucuucc

SEQ ID NO: 559611 - RNA, 22 nt, Human
cugccuguuuccucuugcuccc

SEQ ID NO: 559612 - RNA, 22 nt, Human
uuuauuagauuaucaaagaggu

SEQ ID NO: 559613 - RNA, 22 nt, Human
gaggccugguuugcaugagaau

SEQ ID NO: 559614 - RNA, 22 nt, Human
ggugaaggucuacugugugcca

SEQ ID NO: 559615 - RNA, 22 nt, Human
auauuuuggggugaugugcauc

SEQ ID NO: 559616 - RNA, 22 nt, Human
uaguuauuauuguuacuaucag

SEQ ID NO: 559617 - RNA, 22 nt, Human
cauucugagcuaauaugcuuau

SEQ ID NO: 559618 - RNA, 21 nt, Human
ggccucugucauccugggaag

SEQ ID NO: 559619 - RNA, 22 nt, Human
uuucaguguaucuuccaaaagc

SEQ ID NO: 559620 - RNA, 22 nt, Human
uggaggaugccuggggaggccu

SEQ ID NO: 559621 - RNA, 22 nt, Human
uuucagaaagcaucaucaaagu

SEQ ID NO: 559622 - RNA, 22 nt, Human
acacaucuuagacugaaauaug

SEQ ID NO: 559623 - RNA, 22 nt, Human
ugaugcugucaaggaggugaac

SEQ ID NO: 559624 - RNA, 22 nt, Human
gucagcacuuuuccgaggcaga

SEQ ID NO: 559625 - RNA, 22 nt, Human
uuuacagaugaggaaacugaga

SEQ ID NO: 559626 - RNA, 22 nt, Human
ugaggcucaagaaucugcauuu

SEQ ID NO: 559627 - RNA, 22 nt, Human
auauuuugaaguuaauaaugug

SEQ ID NO: 559628 - RNA, 22 nt, Human
gagcugggaggacugggaacuu

SEQ ID NO: 559629 - RNA, 22 nt, Human
ggaggcugagaaguccaagauc

SEQ ID NO: 559630 - RNA, 22 nt, Human
cagcucccuauggugaggcgac

SEQ ID NO: 559631 - RNA, 22 nt, Human
gaaugaauucagcacauggaau

SEQ ID NO: 559632 - RNA, 17 nt, Human
cacaacuggcugauuga

SEQ ID NO: 559633 - RNA, 22 nt, Human
cucuguccuccaccugcuuuca

SEQ ID NO: 559634 - RNA, 22 nt, Human
uaaaggauaacuuucaagaauu

SEQ ID NO: 559635 - RNA, 22 nt, Human
uggcucagaguucaucuuuuag

SEQ ID NO: 559636 - RNA, 22 nt, Human
cuucacaguauaggucccugag

SEQ ID NO: 559637 - RNA, 22 nt, Human
gugcaauccaguugauuuuuac

SEQ ID NO: 559638 - RNA, 22 nt, Human
gugacagaguuuuagaucucau

SEQ ID NO: 559639 - RNA, 22 nt, Human
uguggggccucgugcuagcugg

SEQ ID NO: 559640 - RNA, 22 nt, Human
agcuccuguggcugaaagagga

SEQ ID NO: 559641 - RNA, 22 nt, Human
cuguucucuggcgguggcuguu

SEQ ID NO: 559642 - RNA, 22 nt, Human
cuuccucuagccuaguaaugcc

SEQ ID NO: 559643 - RNA, 22 nt, Human
aaacuucagggaauaaaagagu

SEQ ID NO: 559644 - RNA, 18 nt, Human
acauuucucucugcguga

SEQ ID NO: 559645 - RNA, 22 nt, Human
augaggcaucugcagucacuag

SEQ ID NO: 559646 - RNA, 22 nt, Human
cugcuuccaugcaauggcaguc

SEQ ID NO: 559647 - RNA, 22 nt, Human
aaucagaaccuugggucauaac

SEQ ID NO: 559648 - RNA, 22 nt, Human
uuagaaaaaacgucuucuagug

SEQ ID NO: 559649 - RNA, 22 nt, Human
ggcacagcccucucuguggaca

SEQ ID NO: 559650 - RNA, 22 nt, Human
ucuggaguguccaguucuacuc

SEQ ID NO: 559651 - RNA, 22 nt, Human
uguggccuugcagccuggaggu

SEQ ID NO: 559652 - RNA, 22 nt, Human
ggaaaucagggguguugcuuuc

SEQ ID NO: 559653 - RNA, 22 nt, Human
ccagccacagcuuccagcuccu

SEQ ID NO: 559654 - RNA, 22 nt, Human
gagggagugccagagggccagc

SEQ ID NO: 559655 - RNA, 22 nt, Human
ugggcucacuggggcagggacc

SEQ ID NO: 559656 - RNA, 22 nt, Human
caugaacauuuguuuacaucug

SEQ ID NO: 559657 - RNA, 17 nt, Human
ucagagggaugagcagg

SEQ ID NO: 559658 - RNA, 22 nt, Human
uuuaccuuuugcuaugguggaa

SEQ ID NO: 559659 - RNA, 22 nt, Human
ggcuuccuggagaaggucugag

SEQ ID NO: 559660 - RNA, 22 nt, Human
cagcacaguacaaggcacggau

SEQ ID NO: 559661 - RNA, 18 nt, Human
gggcuguguucaugccca

SEQ ID NO: 559662 - RNA, 22 nt, Human
cagcucccagaacugaccaugu

SEQ ID NO: 559663 - RNA, 22 nt, Human
ugaaaucaacuaggagacacca

SEQ ID NO: 559664 - RNA, 22 nt, Human
cuucaguguugccagggccuag

SEQ ID NO: 559665 - RNA, 22 nt, Human
cauaaaauggcuuguucuuuaa

SEQ ID NO: 559666 - RNA, 20 nt, Human
agguggcuccugcugggggu

SEQ ID NO: 559667 - RNA, 22 nt, Human
ugcccugcuaaccuugguucca

SEQ ID NO: 559668 - RNA, 22 nt, Human
gagcugcugguugcuggugccu

SEQ ID NO: 559669 - RNA, 23 nt, Human
acaaaugcccauacaucuaguuc

SEQ ID NO: 559670 - RNA, 20 nt, Human
uuuuuccuucucuacaggca

SEQ ID NO: 559671 - RNA, 22 nt, Human
uggcagggccugaaucuuauac

SEQ ID NO: 559672 - RNA, 22 nt, Human
cuggcagcauggagccugugcu

SEQ ID NO: 559673 - RNA, 22 nt, Human
agauguaaacucucaugucauu

SEQ ID NO: 559674 - RNA, 22 nt, Human
agccuggaggccaggagacagu

SEQ ID NO: 559675 - RNA, 22 nt, Human
aagggcuccacuugaaucacac

SEQ ID NO: 559676 - RNA, 22 nt, Human
cugcucuccccaggccagucug

SEQ ID NO: 559677 - RNA, 22 nt, Human
uuccaagugaaaguagcuuugu

SEQ ID NO: 559678 - RNA, 22 nt, Human
ucacugcucuccaauguggagu

SEQ ID NO: 559679 - RNA, 22 nt, Human
uuguaacagcuguuuauauagu

SEQ ID NO: 559680 - RNA, 17 nt, Human
gcagugaaaagagauca

SEQ ID NO: 559681 - RNA, 22 nt, Human
agaauuacauaaauacaugaau

SEQ ID NO: 559682 - RNA, 19 nt, Human
uuaacagucaccaaggaga

SEQ ID NO: 559683 - RNA, 22 nt, Human
caaagcaguuuuaaucaaguag

SEQ ID NO: 559684 - RNA, 22 nt, Human
aagcaaguagguauuugacaaa

SEQ ID NO: 559685 - RNA, 22 nt, Human
aacaaacauuaccuggugcugg

SEQ ID NO: 559686 - RNA, 22 nt, Human
ucugccagugguuuggcccuga

SEQ ID NO: 559687 - RNA, 22 nt, Human
agcagcucaacagugucucuau

SEQ ID NO: 559688 - RNA, 22 nt, Human
gcagcugggacacugaggccag

SEQ ID NO: 559689 - RNA, 22 nt, Human
ccagcgcuucccaucagggagg

SEQ ID NO: 559690 - RNA, 19 nt, Human
ccugccugaccccggcuac

SEQ ID NO: 559691 - RNA, 22 nt, Human
gcugcuggcuuccugcuguuuu

SEQ ID NO: 559692 - RNA, 22 nt, Human
cacuguaucuuuuccaaagucu

SEQ ID NO: 559693 - RNA, 22 nt, Human
ccagucagggcaggagccuggu

SEQ ID NO: 559694 - RNA, 22 nt, Human
uuguuuuggaagaacuuacucu

SEQ ID NO: 559695 - RNA, 22 nt, Human
ugggcagaaggaagagccaccu

SEQ ID NO: 559696 - RNA, 22 nt, Human
auuuaugacuggugaauagaac

SEQ ID NO: 559697 - RNA, 22 nt, Human
aggaaagguagcgugccagcag

SEQ ID NO: 559698 - RNA, 22 nt, Human
gggcagcaguugcccuaaucaa

SEQ ID NO: 559699 - RNA, 22 nt, Human
uggagcuggaagaauguagacg

SEQ ID NO: 559700 - RNA, 23 nt, Human
cuggccuccgacacuggccaaga

SEQ ID NO: 559701 - RNA, 22 nt, Human
acagcaguuuagaggacagcca

SEQ ID NO: 559702 - RNA, 22 nt, Human
agaguccacccuggggucaggc

SEQ ID NO: 559703 - RNA, 22 nt, Human
ugaaagacaagguuuuuucaga

SEQ ID NO: 559704 - RNA, 22 nt, Human
gagggcagagucuaaugaugca

SEQ ID NO: 559705 - RNA, 22 nt, Human
cagcagagcauuugguaggagg

SEQ ID NO: 559706 - RNA, 22 nt, Human
gcacccaggccggcgacugcag

SEQ ID NO: 559707 - RNA, 22 nt, Human
ccagggcaugggaagaacugaa

SEQ ID NO: 559708 - RNA, 22 nt, Human
ucagauggaaagguuacugucc

SEQ ID NO: 559709 - RNA, 22 nt, Human
gcaggaugggagcuucacuuug

SEQ ID NO: 559710 - RNA, 22 nt, Human
cugagaauuacucugaugagua

SEQ ID NO: 559711 - RNA, 22 nt, Human
uucaggcccagcacagcgcgug

SEQ ID NO: 559712 - RNA, 22 nt, Human
agcagaagaaagccacaugacu

SEQ ID NO: 559713 - RNA, 22 nt, Human
cagagagggcggcccuggcuuc

SEQ ID NO: 559714 - RNA, 22 nt, Human
caguguacuuggaauguaacag

SEQ ID NO: 559715 - RNA, 17 nt, Human
ggcuggagcagcucccc

SEQ ID NO: 559716 - RNA, 22 nt, Human
uggcccagugcuuaugcucuga

SEQ ID NO: 559717 - RNA, 22 nt, Human
uuucuccuugugucuccuuuga

SEQ ID NO: 559718 - RNA, 22 nt, Human
ucuaugaaaagucuauucauuc

SEQ ID NO: 559719 - RNA, 22 nt, Human
cauuuauuggcauguaguaggu

SEQ ID NO: 559720 - RNA, 22 nt, Human
ucagcaauaugauaggcuuugu

SEQ ID NO: 559721 - RNA, 22 nt, Human
agugcaaagggcuguugagaag

SEQ ID NO: 559722 - RNA, 23 nt, Human
cuggaacauaguagauggucaga

SEQ ID NO: 559723 - RNA, 23 nt, Human
gggaccugguaggaggugauugg

SEQ ID NO: 559724 - RNA, 19 nt, Human
uggcugggugccaauggcc

SEQ ID NO: 559725 - RNA, 22 nt, Human
uucuaaagugcaaucugacaga

SEQ ID NO: 559726 - RNA, 23 nt, Human
ugaaauauucuuuugcaugagcu

SEQ ID NO: 559727 - RNA, 23 nt, Human
uccaaacucaagacauuaauaag

SEQ ID NO: 559728 - RNA, 22 nt, Human
uuucccuuguuccuuccucuga

SEQ ID NO: 559729 - RNA, 19 nt, Human
gagugauggaucuccuugc

SEQ ID NO: 559730 - RNA, 22 nt, Human
uuucagaaagcugaacauauga

SEQ ID NO: 559731 - RNA, 22 nt, Human
ggcccugcugaagccgggucua

SEQ ID NO: 559732 - RNA, 19 nt, Human
cacagggcaggucucaugu

SEQ ID NO: 559733 - RNA, 22 nt, Human
aggcagacucaauggcuagaua

SEQ ID NO: 559734 - RNA, 22 nt, Human
gcucuuccauuucucuugaacu

SEQ ID NO: 559735 - RNA, 22 nt, Human
aaguucagccugguuuuaaugc

SEQ ID NO: 559736 - RNA, 22 nt, Human
cacauuuaaaaaauccacgauc

SEQ ID NO: 559737 - RNA, 22 nt, Human
ucaucucaaaauuaugcugcac

SEQ ID NO: 559738 - RNA, 22 nt, Human
gggcucaguucugcuucaugcu

SEQ ID NO: 559739 - RNA, 22 nt, Human
gucaggauuugaacucaggucu

SEQ ID NO: 559740 - RNA, 22 nt, Human
ucacauucucagcaucuauaca

SEQ ID NO: 559741 - RNA, 17 nt, Human
gugcagggaugaaggau

SEQ ID NO: 559742 - RNA, 21 nt, Human
gagacagcccagugccagggc

SEQ ID NO: 559743 - RNA, 22 nt, Human
agagccaggaugucuucugggg

SEQ ID NO: 559744 - RNA, 22 nt, Human
gagaggaacucccagugccugg

SEQ ID NO: 559745 - RNA, 22 nt, Human
gcugugcuggaaggggaccugc

SEQ ID NO: 559746 - RNA, 22 nt, Human
cacagcuggugcacuagcucug

SEQ ID NO: 559747 - RNA, 22 nt, Human
uggcagcuguguccagguagaa

SEQ ID NO: 559748 - RNA, 22 nt, Human
uacuauuuugacaugaaauuga

SEQ ID NO: 559749 - RNA, 22 nt, Human
gcccagagagaugcuguagacc

SEQ ID NO: 559750 - RNA, 22 nt, Human
cucaaggaaagucuggagaaga

SEQ ID NO: 559751 - RNA, 22 nt, Human
agaugugggagaugcuucugca

SEQ ID NO: 559752 - RNA, 22 nt, Human
aucuucaaagcacaucguuugu

SEQ ID NO: 559753 - RNA, 22 nt, Human
auuguggugucaguuauaggca

SEQ ID NO: 559754 - RNA, 22 nt, Human
aggugcaggagcugugcaggga

SEQ ID NO: 559755 - RNA, 22 nt, Human
agaaagacaaaaugcaguggcu

SEQ ID NO: 559756 - RNA, 22 nt, Human
gcccagcugucuggcagggaug

SEQ ID NO: 559757 - RNA, 22 nt, Human
cacagugacuggcacauaguaa

SEQ ID NO: 559758 - RNA, 22 nt, Human
aaucaguucuacaucuuaucca

SEQ ID NO: 559759 - RNA, 19 nt, Human
ugggcagcucccucugucc

SEQ ID NO: 559760 - RNA, 22 nt, Human
gccaccagggggcuccagugag

SEQ ID NO: 559761 - RNA, 22 nt, Human
uggcccugagggcucggagcca

SEQ ID NO: 559762 - RNA, 22 nt, Human
gcagggcuugcagcagcuagac

SEQ ID NO: 559763 - RNA, 22 nt, Human
cugcuuuggcucagugacauca

SEQ ID NO: 559764 - RNA, 18 nt, Human
ugaggccucugcugggcc

SEQ ID NO: 559765 - RNA, 22 nt, Human
cugucuccuccacugcauggga

SEQ ID NO: 559766 - RNA, 22 nt, Human
ucugggcucugucagcaccucu

SEQ ID NO: 559767 - RNA, 19 nt, Human
gcuggggccugaccagaca

SEQ ID NO: 559768 - RNA, 22 nt, Human
aggcuggcugagcugcagccug

SEQ ID NO: 559769 - RNA, 22 nt, Human
acugcaucugaaacauggguca

SEQ ID NO: 559770 - RNA, 22 nt, Human
uucacauugugcagauuauggu

SEQ ID NO: 559771 - RNA, 22 nt, Human
ccugggcaacauagugagaccu

SEQ ID NO: 559772 - RNA, 23 nt, Human
uggcucugagcuuccugguggcc

SEQ ID NO: 559773 - RNA, 22 nt, Human
ccuggggagagaaagcccagcc

SEQ ID NO: 559774 - RNA, 22 nt, Human
uugaagcaaggcgaaucuugug

SEQ ID NO: 559775 - RNA, 22 nt, Human
ccauccugcaggaccuccauau

SEQ ID NO: 559776 - RNA, 22 nt, Human
caggaggaggugagguagaacu

SEQ ID NO: 559777 - RNA, 22 nt, Human
ucaggggagguugaaucgucuc

SEQ ID NO: 559778 - RNA, 22 nt, Human
ucacucucuaagcaugacagac

SEQ ID NO: 559779 - RNA, 22 nt, Human
uuuguuaauucuuauguuagag

SEQ ID NO: 559780 - RNA, 22 nt, Human
aaagaacucagagaggauuuua

SEQ ID NO: 559781 - RNA, 22 nt, Human
ucaaaguaaaaguauagaguuu

SEQ ID NO: 559782 - RNA, 22 nt, Human
uauuaaagggaaguuaugcaug

SEQ ID NO: 559783 - RNA, 22 nt, Human
agccaacuuggaaagucagauu

SEQ ID NO: 559784 - RNA, 22 nt, Human
aggaggcugguucaggccauau

SEQ ID NO: 559785 - RNA, 22 nt, Human
uaacaaguucugacagcauugu

SEQ ID NO: 559786 - RNA, 22 nt, Human
uaaggaaaauggacaucaaaca

SEQ ID NO: 559787 - RNA, 22 nt, Human
gugauugcccagcaccauuguu

SEQ ID NO: 559788 - RNA, 23 nt, Human
uggcuucugccccauucucucca

SEQ ID NO: 559789 - RNA, 22 nt, Human
ugccaaggagcuggaucagggc

SEQ ID NO: 559790 - RNA, 22 nt, Human
uccuuuuuaagucguuguggua

SEQ ID NO: 559791 - RNA, 22 nt, Human
agucacuucuauucuauuaagu

SEQ ID NO: 559792 - RNA, 22 nt, Human
cagugcaugaaacaauaugcag

SEQ ID NO: 559793 - RNA, 22 nt, Human
acagcaacuccugcuucugagu

SEQ ID NO: 559794 - RNA, 22 nt, Human
agggccuggugaccuggguccu

SEQ ID NO: 559795 - RNA, 22 nt, Human
ggcugccugaggcagugagaga

SEQ ID NO: 559796 - RNA, 22 nt, Human
cuuuauguccuugaagaguugu

SEQ ID NO: 559797 - RNA, 22 nt, Human
aggucaaaccacagcucuaggc

SEQ ID NO: 559798 - RNA, 22 nt, Human
uauacuuuccugcaacuuugau

SEQ ID NO: 559799 - RNA, 22 nt, Human
cagaguggcagucccaggccca

SEQ ID NO: 559800 - RNA, 22 nt, Human
gcugccuuuugcuccucccacc

SEQ ID NO: 559801 - RNA, 22 nt, Human
caggaagcugagcugcacugca

SEQ ID NO: 559802 - RNA, 19 nt, Human
gcagagugggguggagggu

SEQ ID NO: 559803 - RNA, 22 nt, Human
ugcaaacaggagaguaaguaua

SEQ ID NO: 559804 - RNA, 22 nt, Human
agcuuguuagaaauguagacuc

SEQ ID NO: 559805 - RNA, 22 nt, Human
uucuuugcccuuaaugaaauaa

SEQ ID NO: 559806 - RNA, 20 nt, Human
cugugccuaaaccuccgggu

SEQ ID NO: 559807 - RNA, 22 nt, Human
gcugugagccgcugcugagcau

SEQ ID NO: 559808 - RNA, 22 nt, Human
uccagucaggcugaauucaagg

SEQ ID NO: 559809 - RNA, 22 nt, Human
ucuggggcaguuacuggggccu

SEQ ID NO: 559810 - RNA, 22 nt, Human
agucagucaccauuuaagaaca

SEQ ID NO: 559811 - RNA, 22 nt, Human
aacauucuuaagauuugugucu

SEQ ID NO: 559812 - RNA, 22 nt, Human
aagcacaaugaacaucuuagau

SEQ ID NO: 559813 - RNA, 17 nt, Human
uccuucagggccucaca

SEQ ID NO: 559814 - RNA, 18 nt, Human
cagaugagaugcaaucuc

SEQ ID NO: 559815 - RNA, 22 nt, Human
gaagcagcuaggaucuucauuu

SEQ ID NO: 559816 - RNA, 22 nt, Human
ugcagggauccuagcugaagag

SEQ ID NO: 559817 - RNA, 22 nt, Human
cuuggcaggguggaggaugcag

SEQ ID NO: 559818 - RNA, 22 nt, Human
agagggaacggaucccagcgcg

SEQ ID NO: 559819 - RNA, 22 nt, Human
aauagaauuuguacuguguuuu

SEQ ID NO: 559820 - RNA, 22 nt, Human
auucucaaacaagugguuugau

SEQ ID NO: 559821 - RNA, 21 nt, Human
uucuccccagcgaauccucgg

SEQ ID NO: 559822 - RNA, 22 nt, Human
caggugggaccaugauagggca

SEQ ID NO: 559823 - RNA, 22 nt, Human
ggagcagccacgucucagggca

SEQ ID NO: 559824 - RNA, 22 nt, Human
aaucagaaucaguugacacagc

SEQ ID NO: 559825 - RNA, 22 nt, Human
ccagauggaaaugauguucuca

SEQ ID NO: 559826 - RNA, 22 nt, Human
ucugcccaguuugugcucaggu

SEQ ID NO: 559827 - RNA, 22 nt, Human
aggagcagaccguaguccugca

SEQ ID NO: 559828 - RNA, 22 nt, Human
ugcagaaguauuccaggcccca

SEQ ID NO: 559829 - RNA, 19 nt, Human
agccacagaacuugcagga

SEQ ID NO: 559830 - RNA, 22 nt, Human
gagcuggcaagucuguccuugg

SEQ ID NO: 559831 - RNA, 22 nt, Human
uuauauaucuugauuuguucca

SEQ ID NO: 559832 - RNA, 19 nt, Human
aggucugcagcugcaguuu

SEQ ID NO: 559833 - RNA, 22 nt, Human
cuuccucccccacacacucacu

SEQ ID NO: 559834 - RNA, 22 nt, Human
gcacagagggcagugagccucu

SEQ ID NO: 559835 - RNA, 22 nt, Human
uuuguauuccauaucaugccau

SEQ ID NO: 559836 - RNA, 22 nt, Human
ucccaagaccuggcauccaagu

SEQ ID NO: 559837 - RNA, 22 nt, Human
acuucauguaguccaucagguu

SEQ ID NO: 559838 - RNA, 21 nt, Human
acugggcuagccugacuucug

SEQ ID NO: 559839 - RNA, 20 nt, Human
auguaaaauuauaaggcuga

SEQ ID NO: 559840 - RNA, 22 nt, Human
aaacugaauucccaagggcaug

SEQ ID NO: 559841 - RNA, 22 nt, Human
ucacaucauuaagacuucuccu

SEQ ID NO: 559842 - RNA, 22 nt, Human
uugaaucucuugaaucucuguu

SEQ ID NO: 559843 - RNA, 22 nt, Human
cuucaguucuaaaguagaaugu

SEQ ID NO: 559844 - RNA, 22 nt, Human
acagaacugcaggaggaaaagc

SEQ ID NO: 559845 - RNA, 22 nt, Human
uguucauucgcuauugucuaug

SEQ ID NO: 559846 - RNA, 22 nt, Human
ggaagagggaaccacgacugua

SEQ ID NO: 559847 - RNA, 22 nt, Human
ugaaauguaaauaggacuagaa

SEQ ID NO: 559848 - RNA, 22 nt, Human
caugagugugccagucugauau

SEQ ID NO: 559849 - RNA, 22 nt, Human
cacaugaaggcuggggucguga

SEQ ID NO: 559850 - RNA, 22 nt, Human
augcaaaaguaauugcaauuuu

SEQ ID NO: 559851 - RNA, 22 nt, Human
uuucaaugacacaaaagagaaa

SEQ ID NO: 559852 - RNA, 21 nt, Human
uauugcauaacaaauuacccu

SEQ ID NO: 559853 - RNA, 22 nt, Human
acugccucuuggugcugagaga

SEQ ID NO: 559854 - RNA, 21 nt, Human
uuucccagcugaaaauaaaug

SEQ ID NO: 559855 - RNA, 22 nt, Human
auaguauuuaauaguuagcuca

SEQ ID NO: 559856 - RNA, 22 nt, Human
uggagcagcauucauccagcag

SEQ ID NO: 559857 - RNA, 21 nt, Human
ccagagagagggaaguggguu

SEQ ID NO: 559858 - RNA, 22 nt, Human
cucuuucuggaaggcagagugg

SEQ ID NO: 559859 - RNA, 18 nt, Human
gugcaaugaauagcagag

SEQ ID NO: 559860 - RNA, 22 nt, Human
cagugagggcccccuuccaggu

SEQ ID NO: 559861 - RNA, 22 nt, Human
gcaggagccacuucagggaugc

SEQ ID NO: 559862 - RNA, 22 nt, Human
aaaugcuguguuuuaacauaga

SEQ ID NO: 559863 - RNA, 22 nt, Human
ucucugguuauuaacuaacucc

SEQ ID NO: 559864 - RNA, 22 nt, Human
agauauauuuccugcccaaggc

SEQ ID NO: 559865 - RNA, 22 nt, Human
aaagccuugagauccuauaguu

SEQ ID NO: 559866 - RNA, 22 nt, Human
uuucuucuaugugugauauuuu

SEQ ID NO: 559867 - RNA, 22 nt, Human
uaagcugugggagauuggcaua

SEQ ID NO: 559868 - RNA, 18 nt, Human
gggcaagcggcugucacc

SEQ ID NO: 559869 - RNA, 22 nt, Human
aguucuuugucaucucuggagu

SEQ ID NO: 559870 - RNA, 22 nt, Human
gcauuucagagaaaaucugcuu

SEQ ID NO: 559871 - RNA, 18 nt, Human
auuuuucccagauggaua

SEQ ID NO: 559872 - RNA, 21 nt, Human
ucuuugauuaagcuugacuag

SEQ ID NO: 559873 - RNA, 22 nt, Human
agaggccagguccagaguuugu

SEQ ID NO: 559874 - RNA, 22 nt, Human
aauuuagaauucgcuagcuaau

SEQ ID NO: 559875 - RNA, 22 nt, Human
gugucauguagaaauugaugaa

SEQ ID NO: 559876 - RNA, 22 nt, Human
aguuuccaaagcauguucacac

SEQ ID NO: 559877 - RNA, 20 nt, Human
ugcacacagaaauuugcauu

SEQ ID NO: 559878 - RNA, 22 nt, Human
gcugcucugcuguguaagcagg

SEQ ID NO: 559879 - RNA, 22 nt, Human
gaggcagugucgguggcaggau

SEQ ID NO: 559880 - RNA, 22 nt, Human
gcuuuauguaaguccaaaggca

SEQ ID NO: 559881 - RNA, 22 nt, Human
gcugagcucccagcaguaucug

SEQ ID NO: 559882 - RNA, 22 nt, Human
aagggcuggcccugggaagagu

SEQ ID NO: 559883 - RNA, 22 nt, Human
caacuauuaccauguuauuguc

SEQ ID NO: 559884 - RNA, 22 nt, Human
gagaaggcugauccuuggaguu

SEQ ID NO: 559885 - RNA, 22 nt, Human
uggagcaggccggaaguggcuu

SEQ ID NO: 559886 - RNA, 22 nt, Human
agagaagcugacaggggcgugc

SEQ ID NO: 559887 - RNA, 22 nt, Human
aggagagucuugagucacuggu

SEQ ID NO: 559888 - RNA, 22 nt, Human
ucagggcauucaagaggccugg

SEQ ID NO: 559889 - RNA, 22 nt, Human
aaaagucuugucaagguuccca

SEQ ID NO: 559890 - RNA, 22 nt, Human
caaaguaugaaccaguuucucu

SEQ ID NO: 559891 - RNA, 22 nt, Human
ggccucagaccggagcuggcca

SEQ ID NO: 559892 - RNA, 22 nt, Human
gggcuggugaggcugcccugca

SEQ ID NO: 559893 - RNA, 22 nt, Human
acaggaagugggaagaaacagg

SEQ ID NO: 559894 - RNA, 22 nt, Human
ccugagagugagugccaccuua

SEQ ID NO: 559895 - RNA, 20 nt, Human
ucugcucagcccucaguggc

SEQ ID NO: 559896 - RNA, 22 nt, Human
cugugucccccucagccaggug

SEQ ID NO: 559897 - RNA, 22 nt, Human
caucagcagucacaugaugcug

SEQ ID NO: 559898 - RNA, 18 nt, Human
uuaucucuggcaugugcc

SEQ ID NO: 559899 - RNA, 18 nt, Human
gucauugcaacauacugu

SEQ ID NO: 559900 - RNA, 22 nt, Human
acacacaugguauuguucagaa

SEQ ID NO: 559901 - RNA, 22 nt, Human
ccugcagggugcugccacagau

SEQ ID NO: 559902 - RNA, 22 nt, Human
aguguuaauaucuggcccuagg

SEQ ID NO: 559903 - RNA, 20 nt, Human
ucugcuggccaaaacuucac

SEQ ID NO: 559904 - RNA, 22 nt, Human
cuggcucaauuuguacugcugu

SEQ ID NO: 559905 - RNA, 22 nt, Human
aagagcagauuccuaguggagc

SEQ ID NO: 559906 - RNA, 22 nt, Human
cacaggcagccuuguagaagaa

SEQ ID NO: 559907 - RNA, 22 nt, Human
uaagucaugauucuguguuacu

SEQ ID NO: 559908 - RNA, 22 nt, Human
cagagggagcccuccaggagca

SEQ ID NO: 559909 - RNA, 22 nt, Human
gggcaugguggcaggcaccugu

SEQ ID NO: 559910 - RNA, 22 nt, Human
uguaucaaggguuuauguaagc

SEQ ID NO: 559911 - RNA, 22 nt, Human
ucagagucugugcauucugcua

SEQ ID NO: 559912 - RNA, 22 nt, Human
ugcaauuuuuaucaauucagca

SEQ ID NO: 559913 - RNA, 22 nt, Human
agagagguuaaggagcucuugu

SEQ ID NO: 559914 - RNA, 22 nt, Human
aggaccauccuaagguaggcaa

SEQ ID NO: 559915 - RNA, 22 nt, Human
agggagcugcucugcuuccgug

SEQ ID NO: 559916 - RNA, 22 nt, Human
gaagaccauauucagcaggcau

SEQ ID NO: 559917 - RNA, 22 nt, Human
uuucaagaacagcagcauucca

SEQ ID NO: 559918 - RNA, 22 nt, Human
cacucaggcugugucaggagga

SEQ ID NO: 559919 - RNA, 23 nt, Human
uggcucuguggaucccucaggag

SEQ ID NO: 559920 - RNA, 22 nt, Human
gagcagugaagacagaaguaca

SEQ ID NO: 559921 - RNA, 22 nt, Human
agucccaguucgguucuuccuc

SEQ ID NO: 559922 - RNA, 22 nt, Human
ugcagggaaucuguggcuggac

SEQ ID NO: 559923 - RNA, 22 nt, Human
uagaugaauuagcaauuaucuu

SEQ ID NO: 559924 - RNA, 22 nt, Human
caugaagauccuguauguuuuu

SEQ ID NO: 559925 - RNA, 22 nt, Human
ucaggcuaagggagaggcgcuc

SEQ ID NO: 559926 - RNA, 22 nt, Human
aauguuugucaucacacagaua

SEQ ID NO: 559927 - RNA, 22 nt, Human
ccucacucugcacccugcagca

SEQ ID NO: 559928 - RNA, 22 nt, Human
uuucuacauucaaaaacuacca

SEQ ID NO: 559929 - RNA, 22 nt, Human
aagcagcauaauugcuauuuua

SEQ ID NO: 559930 - RNA, 22 nt, Human
uugccugugaacgcugaguccu

SEQ ID NO: 559931 - RNA, 22 nt, Human
cugcagggcagaagggcauaga

SEQ ID NO: 559932 - RNA, 22 nt, Human
uucuuaaagaggcaaaacacag

SEQ ID NO: 559933 - RNA, 22 nt, Human
aaggcagcaacuaauggaucuc

SEQ ID NO: 559934 - RNA, 22 nt, Human
gauggcagucaaccaggugagg

SEQ ID NO: 559935 - RNA, 23 nt, Human
ugggggugcacgggccacaucuu

SEQ ID NO: 559936 - RNA, 22 nt, Human
ucuguucagaauuguaacacuc

SEQ ID NO: 559937 - RNA, 22 nt, Human
cagggcucgcucgcucgcucgc

SEQ ID NO: 559938 - RNA, 22 nt, Human
ggugcucaagagggcauccucu

SEQ ID NO: 559939 - RNA, 22 nt, Human
ugaauaaucuuggguauuaaua

SEQ ID NO: 559940 - RNA, 22 nt, Human
ccucugagucaugcgcauagga

SEQ ID NO: 559941 - RNA, 22 nt, Human
aagagccauauaugcagcuaga

SEQ ID NO: 559942 - RNA, 22 nt, Human
uuaaaaugcagauucugauuca

SEQ ID NO: 559943 - RNA, 22 nt, Human
agcagcuguggaaaaguaacua

SEQ ID NO: 559944 - RNA, 22 nt, Human
cacaggagagcugggaggugcc

SEQ ID NO: 559945 - RNA, 22 nt, Human
uacaaaggaaacuucuuuuccc

SEQ ID NO: 559946 - RNA, 22 nt, Human
cuggaaagaccugcuugcuuuu

SEQ ID NO: 559947 - RNA, 20 nt, Human
gcagagccucacugcaaggg

SEQ ID NO: 559948 - RNA, 22 nt, Human
ugccugcuaggcccugcugggu

SEQ ID NO: 559949 - RNA, 22 nt, Human
gcagagccaggagcccaggauc

SEQ ID NO: 559950 - RNA, 23 nt, Human
uuucacagaaggauuguagggcc

SEQ ID NO: 559951 - RNA, 22 nt, Human
uuucugaaacauggucuuugua

SEQ ID NO: 559952 - RNA, 22 nt, Human
ugacaguuuaguguaauaguua

SEQ ID NO: 559953 - RNA, 22 nt, Human
aggaaaaugaaacagcaacugu

SEQ ID NO: 559954 - RNA, 22 nt, Human
ucugcuggucaaggcugggucc

SEQ ID NO: 559955 - RNA, 22 nt, Human
uucaaauuaccacauuugcuua

SEQ ID NO: 559956 - RNA, 22 nt, Human
agauauuuguaucuugcuauug

SEQ ID NO: 559957 - RNA, 23 nt, Human
uggagaugccccacucccugucu

SEQ ID NO: 559958 - RNA, 17 nt, Human
gcucccugaggacagcu

SEQ ID NO: 559959 - RNA, 22 nt, Human
acuguccaagcaugccuggcuu

SEQ ID NO: 559960 - RNA, 19 nt, Human
uuuggcacucugaaguguu

SEQ ID NO: 559961 - RNA, 23 nt, Human
gaggaaagaauauagaugcaauc

SEQ ID NO: 559962 - RNA, 22 nt, Human
gaggagguugacggcacuguga

SEQ ID NO: 559963 - RNA, 22 nt, Human
agucccagcucagaaccacuag

SEQ ID NO: 559964 - RNA, 22 nt, Human
guggcugggcuccgagcggcuu

SEQ ID NO: 559965 - RNA, 22 nt, Human
gacgccucuucccugcugcacu

SEQ ID NO: 559966 - RNA, 22 nt, Human
aguaacaguaacaucuuccuag

SEQ ID NO: 559967 - RNA, 22 nt, Human
caguccuugcucugggaugaug

SEQ ID NO: 559968 - RNA, 22 nt, Human
gccuaggaguggggauggcggu

SEQ ID NO: 559969 - RNA, 22 nt, Human
aacaucuuaucugcaugauccc

SEQ ID NO: 559970 - RNA, 22 nt, Human
cagcugcccaagccccagaugu

SEQ ID NO: 559971 - RNA, 22 nt, Human
aaacauucucagcccugcuugc

SEQ ID NO: 559972 - RNA, 22 nt, Human
ucagcuuucucagaggccuaac

SEQ ID NO: 559973 - RNA, 22 nt, Human
caaaggcuucaucucagagcag

SEQ ID NO: 559974 - RNA, 19 nt, Human
uguuggugcggauguggag

SEQ ID NO: 559975 - RNA, 22 nt, Human
gaaccauuguugaaaagaauag

SEQ ID NO: 559976 - RNA, 22 nt, Human
gaaacuguauguaguuuuuggg

SEQ ID NO: 559977 - RNA, 22 nt, Human
cauugcacucuggcuggaacgg

SEQ ID NO: 559978 - RNA, 22 nt, Human
uuuguguuuucccauacuauug

SEQ ID NO: 559979 - RNA, 22 nt, Human
ugcccaggaucuggcgaugcuc

SEQ ID NO: 559980 - RNA, 22 nt, Human
gggcugcuuauacugaugauaa

SEQ ID NO: 559981 - RNA, 22 nt, Human
uugcccuagggucuuauccucc

SEQ ID NO: 559982 - RNA, 22 nt, Human
gaaagagaaccugggccuagau

SEQ ID NO: 559983 - RNA, 22 nt, Human
uccuccagaaacugaggcagaa

SEQ ID NO: 559984 - RNA, 18 nt, Human
aguggucuguuauaucau

SEQ ID NO: 559985 - RNA, 22 nt, Human
ugagccuguccugugcauguga

SEQ ID NO: 559986 - RNA, 19 nt, Human
acaggcagaauugggugug

SEQ ID NO: 559987 - RNA, 19 nt, Human
cagaguccuugaccagucc

SEQ ID NO: 559988 - RNA, 22 nt, Human
uuuaaaauuuagaccucuccac

SEQ ID NO: 559989 - RNA, 23 nt, Human
uauuagggccaggacuggcaaau

SEQ ID NO: 559990 - RNA, 22 nt, Human
gcucugggugaacuuggagcaa

SEQ ID NO: 559991 - RNA, 22 nt, Human
ggcaaggccuugcccagcauuc

SEQ ID NO: 559992 - RNA, 22 nt, Human
ucaggcucuggguacaccugac

SEQ ID NO: 559993 - RNA, 22 nt, Human
aaggaagacacagaugaaguga

SEQ ID NO: 559994 - RNA, 22 nt, Human
cugccuggcccagggaugggcc

SEQ ID NO: 559995 - RNA, 22 nt, Human
gcaggccaggcuaggggcuguc

SEQ ID NO: 559996 - RNA, 22 nt, Human
ggcacuuuccagucuauagagc

SEQ ID NO: 559997 - RNA, 22 nt, Human
cagcuugggaguuugguuuuau

SEQ ID NO: 559998 - RNA, 22 nt, Human
gccugccuuugugaggaagcgg

SEQ ID NO: 559999 - RNA, 22 nt, Human
ucagacagagaaguacaaugag

SEQ ID NO: 560000 - RNA, 22 nt, Human
ugggagcacccugaggagcuuc

SEQ ID NO: 560001 - RNA, 22 nt, Human
cugaggcaggauggccuggcug

SEQ ID NO: 560002 - RNA, 22 nt, Human
auggaauauuugacacauaggg

SEQ ID NO: 560003 - RNA, 22 nt, Human
ccugccuguaagauggguacaa

SEQ ID NO: 560004 - RNA, 22 nt, Human
acucucccacguucgacucuaa

SEQ ID NO: 560005 - RNA, 22 nt, Human
cguuggagacacuugaggacuu

SEQ ID NO: 560006 - RNA, 22 nt, Human
ugucacaaacauacauuauaga

SEQ ID NO: 560007 - RNA, 22 nt, Human
aucaacauuccaaugugguaga

SEQ ID NO: 560008 - RNA, 22 nt, Human
uaagaagguaauacauuuuugc

SEQ ID NO: 560009 - RNA, 22 nt, Human
cccaggcucccaggugggacaa

SEQ ID NO: 560010 - RNA, 22 nt, Human
cagagcugguguuacaagucca

SEQ ID NO: 560011 - RNA, 22 nt, Human
agaccaagaaaggaugaggauc

SEQ ID NO: 560012 - RNA, 22 nt, Human
cagccaucccagccugugguuc

SEQ ID NO: 560013 - RNA, 22 nt, Human
ggaggccaaggcaggcggauca

SEQ ID NO: 560014 - RNA, 22 nt, Human
ccugagccugaguggugcaggg

SEQ ID NO: 560015 - RNA, 18 nt, Human
gugccaggaggcgcagcc

SEQ ID NO: 560016 - RNA, 22 nt, Human
gggcuccugccuccuggcaccu

SEQ ID NO: 560017 - RNA, 22 nt, Human
uacagggguaacaguggggaau

SEQ ID NO: 560018 - RNA, 22 nt, Human
aaagagcaagcugagauuugaa

SEQ ID NO: 560019 - RNA, 22 nt, Human
uaaauuguuuucuagaaguugu

SEQ ID NO: 560020 - RNA, 22 nt, Human
gcacagaacagagaaauagcca

SEQ ID NO: 560021 - RNA, 22 nt, Human
cuggaagugggguuggcuugaa

SEQ ID NO: 560022 - RNA, 22 nt, Human
uauguuaaauguuugauguuua

SEQ ID NO: 560023 - RNA, 22 nt, Human
gugcuggccucagagggucaug

SEQ ID NO: 560024 - RNA, 22 nt, Human
ggccuuugcguccacgccgcuu

SEQ ID NO: 560025 - RNA, 22 nt, Human
uccagaguuugagucuccuucc

SEQ ID NO: 560026 - RNA, 22 nt, Human
uccaaguccauuaugguggucu

SEQ ID NO: 560027 - RNA, 22 nt, Human
caggaagagguggggcuaaagu

SEQ ID NO: 560028 - RNA, 22 nt, Human
cauuacauuucaaaauguuucc

SEQ ID NO: 560029 - RNA, 22 nt, Human
ggcaggcuuucagcaucaaguc

SEQ ID NO: 560030 - RNA, 22 nt, Human
uaguuuuacaucagccauuguu

SEQ ID NO: 560031 - RNA, 22 nt, Human
ucucuccuuaucauuguguuua

SEQ ID NO: 560032 - RNA, 22 nt, Human
aaauuaguacauugcaaagucc

SEQ ID NO: 560033 - RNA, 22 nt, Human
augggcaguuaggaggccagga

SEQ ID NO: 560034 - RNA, 22 nt, Human
ugccacccagccaggaguggga

SEQ ID NO: 560035 - RNA, 22 nt, Human
uuuguccagaugcacagauaau

SEQ ID NO: 560036 - RNA, 22 nt, Human
ggacuucuaagugccagacacu

SEQ ID NO: 560037 - RNA, 22 nt, Human
gggcagcucucacagcagccaa

SEQ ID NO: 560038 - RNA, 22 nt, Human
ccagcuuuugcacuggacuggg

SEQ ID NO: 560039 - RNA, 21 nt, Human
agcuuccugcagugggagguc

SEQ ID NO: 560040 - RNA, 22 nt, Human
uucaaaucucuccuaauccacu

SEQ ID NO: 560041 - RNA, 22 nt, Human
ugaaaugcuguagagacuguau

SEQ ID NO: 560042 - RNA, 22 nt, Human
aggaccuguaccucagcaucua

SEQ ID NO: 560043 - RNA, 22 nt, Human
cccuggcugccagucaccagac

SEQ ID NO: 560044 - RNA, 22 nt, Human
uucuccagaccuugugacuaug

SEQ ID NO: 560045 - RNA, 22 nt, Human
ucaccaggcuggaaugcagugg

SEQ ID NO: 560046 - RNA, 22 nt, Human
gagguuccagacagcuuaggga

SEQ ID NO: 560047 - RNA, 22 nt, Human
acacaguaccccaaggcugggc

SEQ ID NO: 560048 - RNA, 22 nt, Human
ucucucagcuuugagaccugcu

SEQ ID NO: 560049 - RNA, 22 nt, Human
gggcaguggguggcugcagccu

SEQ ID NO: 560050 - RNA, 22 nt, Human
ugggugggagcgcccugucugg

SEQ ID NO: 560051 - RNA, 22 nt, Human
auuuauugaagcuuauuacguu

SEQ ID NO: 560052 - RNA, 22 nt, Human
guggcaggagagacacagccau

SEQ ID NO: 560053 - RNA, 22 nt, Human
ucagcugccuuucccaugcuag

SEQ ID NO: 560054 - RNA, 22 nt, Human
ccugccaggacauugcuugaag

SEQ ID NO: 560055 - RNA, 22 nt, Human
guuaccauugucuaggucauug

SEQ ID NO: 560056 - RNA, 22 nt, Human
aagggccuccuggggagccugg

SEQ ID NO: 560057 - RNA, 22 nt, Human
cugccuugaaaaugaagcuuua

SEQ ID NO: 560058 - RNA, 18 nt, Human
uggguggcuagggaguuu

SEQ ID NO: 560059 - RNA, 22 nt, Human
ugcugccaagcccgugcuccug

SEQ ID NO: 560060 - RNA, 22 nt, Human
cauacagaaaauauauuuugau

SEQ ID NO: 560061 - RNA, 22 nt, Human
cugggagauugcuagagaugca

SEQ ID NO: 560062 - RNA, 22 nt, Human
cagggccaagcugcagcaucug

SEQ ID NO: 560063 - RNA, 22 nt, Human
gacauucacagguaaacauucc

SEQ ID NO: 560064 - RNA, 22 nt, Human
cccaggaaccuaccagcucgag

SEQ ID NO: 560065 - RNA, 22 nt, Human
cuguaugaaauuaaguaaacag

SEQ ID NO: 560066 - RNA, 22 nt, Human
gccagagcugagugagguucuu

SEQ ID NO: 560067 - RNA, 22 nt, Human
ugggaggagcccucugggaagg

SEQ ID NO: 560068 - RNA, 21 nt, Human
ugucagcaacaauacuuucuc

SEQ ID NO: 560069 - RNA, 22 nt, Human
agccacaccuguccugccagcu

SEQ ID NO: 560070 - RNA, 22 nt, Human
ugcauuucagaagaaaauucgg

SEQ ID NO: 560071 - RNA, 22 nt, Human
ccuuuuuucuaugccaacucug

SEQ ID NO: 560072 - RNA, 22 nt, Human
aagggacuuugucagcuuucca

SEQ ID NO: 560073 - RNA, 22 nt, Human
acagcuaggaaauggaagaacu

SEQ ID NO: 560074 - RNA, 22 nt, Human
augcuuugauuugguuucucua

SEQ ID NO: 560075 - RNA, 22 nt, Human
cuucuuaaugacagauuaaaau

SEQ ID NO: 560076 - RNA, 22 nt, Human
aucuccagguugugccugcguc

SEQ ID NO: 560077 - RNA, 22 nt, Human
aaagucugagcagaauuucuca

SEQ ID NO: 560078 - RNA, 22 nt, Human
cccagcuugcgggcggcaggag

SEQ ID NO: 560079 - RNA, 22 nt, Human
agccugccuugggcugcuugag

SEQ ID NO: 560080 - RNA, 22 nt, Human
ucaguggagcuaagcaugagau

SEQ ID NO: 560081 - RNA, 20 nt, Human
uuggaugugcauggccgugc

SEQ ID NO: 560082 - RNA, 22 nt, Human
aaguucaagcucugccuaaaau

SEQ ID NO: 560083 - RNA, 22 nt, Human
aaggagaaggguaaucaacaca

SEQ ID NO: 560084 - RNA, 22 nt, Human
auuccugauuaacgaccuuuca

SEQ ID NO: 560085 - RNA, 19 nt, Human
ugggcucauucaggugguu

SEQ ID NO: 560086 - RNA, 22 nt, Human
cccugcagagagugcuuuugug

SEQ ID NO: 560087 - RNA, 17 nt, Human
uuuguacaacauuuuaa

SEQ ID NO: 560088 - RNA, 20 nt, Human
agccaauacagcaaaauuug

SEQ ID NO: 560089 - RNA, 22 nt, Human
uguggcuguguccaccugcugc

SEQ ID NO: 560090 - RNA, 22 nt, Human
auauuagcagugaucaaaaugg

SEQ ID NO: 560091 - RNA, 22 nt, Human
gcagggcaaacccagguguuca

SEQ ID NO: 560092 - RNA, 22 nt, Human
agcagcaggcuguguggacuga

SEQ ID NO: 560093 - RNA, 22 nt, Human
cuggagcuggcuuccuuccacu

SEQ ID NO: 560094 - RNA, 22 nt, Human
ugguugccucucagagauuccg

SEQ ID NO: 560095 - RNA, 17 nt, Human
ggugaguguccaggugg

SEQ ID NO: 560096 - RNA, 22 nt, Human
aaaugcagauuuugaugcagca

SEQ ID NO: 560097 - RNA, 23 nt, Human
ugucccagagggagggauaggcu

SEQ ID NO: 560098 - RNA, 22 nt, Human
ugaggugguucaagagccuugu

SEQ ID NO: 560099 - RNA, 22 nt, Human
cccagcuugcccaggacugagg

SEQ ID NO: 560100 - RNA, 22 nt, Human
ucuguucagaaauggaagugcc

SEQ ID NO: 560101 - RNA, 22 nt, Human
acaguauuugcgauacugauga

SEQ ID NO: 560102 - RNA, 22 nt, Human
gagagcugggcuuugggugaag

SEQ ID NO: 560103 - RNA, 22 nt, Human
cuguuuauaaauagaggggagu

SEQ ID NO: 560104 - RNA, 22 nt, Human
cagaaugagauaacccagauug

SEQ ID NO: 560105 - RNA, 19 nt, Human
agaggccucagcagcuggc

SEQ ID NO: 560106 - RNA, 20 nt, Human
ucaauuuucuacaacauuug

SEQ ID NO: 560107 - RNA, 22 nt, Human
auauccuuuguguaggcaauuu

SEQ ID NO: 560108 - RNA, 22 nt, Human
aagcacaggaucuugaggagcg

SEQ ID NO: 560109 - RNA, 22 nt, Human
ucuucaugaaauugauugcuua

SEQ ID NO: 560110 - RNA, 22 nt, Human
gaugcccaggcccaaccaugga

SEQ ID NO: 560111 - RNA, 22 nt, Human
gcuggagccaagcugcucuugg

SEQ ID NO: 560112 - RNA, 22 nt, Human
ucugugucugcagaaguucagc

SEQ ID NO: 560113 - RNA, 22 nt, Human
auucauuccaggucagucagac

SEQ ID NO: 560114 - RNA, 22 nt, Human
ggcugggagcuggacaggccgg

SEQ ID NO: 560115 - RNA, 22 nt, Human
uggcagcauuuuuuccagaaca

SEQ ID NO: 560116 - RNA, 22 nt, Human
aggugagggugccagugcaugg

SEQ ID NO: 560117 - RNA, 23 nt, Human
gggaaguggggauuugaagucau

SEQ ID NO: 560118 - RNA, 22 nt, Human
acagggaccugugagcuccaua

SEQ ID NO: 560119 - RNA, 22 nt, Human
gguugccggggcaggacuggaa

SEQ ID NO: 560120 - RNA, 22 nt, Human
uagaacagaggguugcccagau

SEQ ID NO: 560121 - RNA, 22 nt, Human
uaccuuggaaaugcuagaguaa

SEQ ID NO: 560122 - RNA, 22 nt, Human
ccuguggcacaugcagggauuc

SEQ ID NO: 560123 - RNA, 22 nt, Human
guuuuauaauugcuucauaaga

SEQ ID NO: 560124 - RNA, 22 nt, Human
uuugaaauaugaggcauuauga

SEQ ID NO: 560125 - RNA, 22 nt, Human
ucucagugacacucuucauaca

SEQ ID NO: 560126 - RNA, 22 nt, Human
agcagaaccacagcacuguuga

SEQ ID NO: 560127 - RNA, 22 nt, Human
cagugggugaugaguccugggg

SEQ ID NO: 560128 - RNA, 21 nt, Human
ggugucaguuuuggucauuag

SEQ ID NO: 560129 - RNA, 22 nt, Human
caggcagcugaggacuuugcua

SEQ ID NO: 560130 - RNA, 22 nt, Human
gaagcagagccuaaggcagaca

SEQ ID NO: 560131 - RNA, 17 nt, Human
uagcuagaccgagucuc

SEQ ID NO: 560132 - RNA, 22 nt, Human
acuucucucauucagacauagc

SEQ ID NO: 560133 - RNA, 23 nt, Human
uaaagucacauauuagagugagc

SEQ ID NO: 560134 - RNA, 22 nt, Human
ccuggaagauucaccacuacca

SEQ ID NO: 560135 - RNA, 22 nt, Human
acauauguguuguacaugcaug

SEQ ID NO: 560136 - RNA, 21 nt, Human
aauuagggugccucuuauaau

SEQ ID NO: 560137 - RNA, 22 nt, Human
cugggccucauccccagaguuu

SEQ ID NO: 560138 - RNA, 22 nt, Human
gguuucaaugagaagugcuugu

SEQ ID NO: 560139 - RNA, 22 nt, Human
uaaaguguccuagcuaggaggc

SEQ ID NO: 560140 - RNA, 22 nt, Human
aagaucagcucccgagucugag

SEQ ID NO: 560141 - RNA, 22 nt, Human
aucuaagauuuugcuaagauca

SEQ ID NO: 560142 - RNA, 22 nt, Human
aagaggaaaugauugacuauau

SEQ ID NO: 560143 - RNA, 22 nt, Human
gcugcuggccccacaugcucca

SEQ ID NO: 560144 - RNA, 22 nt, Human
ugcugcuccccagcacacagca

SEQ ID NO: 560145 - RNA, 22 nt, Human
agccacagcauguguguaugua

SEQ ID NO: 560146 - RNA, 22 nt, Human
gugggcucaggccucugugggg

SEQ ID NO: 560147 - RNA, 22 nt, Human
aaugcaaugcagcaccuccuug

SEQ ID NO: 560148 - RNA, 22 nt, Human
caggaacacaaguucagggaug

SEQ ID NO: 560149 - RNA, 22 nt, Human
uuccaauugcagaucagauaca

SEQ ID NO: 560150 - RNA, 22 nt, Human
caauuucaucuugugcuucaau

SEQ ID NO: 560151 - RNA, 19 nt, Human
uuaugaaggcuggggggag

SEQ ID NO: 560152 - RNA, 22 nt, Human
caggagaugacagggaagaacc

SEQ ID NO: 560153 - RNA, 22 nt, Human
uucuuaagaaaccaucacauuc

SEQ ID NO: 560154 - RNA, 22 nt, Human
ucaaaucuuuaacaugugcaaa

SEQ ID NO: 560155 - RNA, 22 nt, Human
acagcuguguuuuauaaucagc

SEQ ID NO: 560156 - RNA, 22 nt, Human
ucuaaacucucuuugaauuaug

SEQ ID NO: 560157 - RNA, 22 nt, Human
ucccagaaaaaggaggcuauga

SEQ ID NO: 560158 - RNA, 19 nt, Human
agccuggagggcuggucac

SEQ ID NO: 560159 - RNA, 21 nt, Human
ucacaucuauguuaagcaaac

SEQ ID NO: 560160 - RNA, 22 nt, Human
uucagagagaaaccagugggaa

SEQ ID NO: 560161 - RNA, 22 nt, Human
auauacagggagaaacagcuua

SEQ ID NO: 560162 - RNA, 22 nt, Human
gaagcccauuuguacagcacau

SEQ ID NO: 560163 - RNA, 22 nt, Human
cagaaggcuuuguggaguagac

SEQ ID NO: 560164 - RNA, 22 nt, Human
uauuuuagguaauauccauugu

SEQ ID NO: 560165 - RNA, 22 nt, Human
cuuugaaagcucccaggacuua

SEQ ID NO: 560166 - RNA, 22 nt, Human
acugggccaggugugggugagu

SEQ ID NO: 560167 - RNA, 22 nt, Human
ucacagcaacccugaggcgagu

SEQ ID NO: 560168 - RNA, 22 nt, Human
uaaacaucuguagccuucaguc

SEQ ID NO: 560169 - RNA, 22 nt, Human
uuccaaguguugagauuagagg

SEQ ID NO: 560170 - RNA, 22 nt, Human
gaggcaggguguugauuacaga

SEQ ID NO: 560171 - RNA, 22 nt, Human
ccacagggaacaugacagccuu

SEQ ID NO: 560172 - RNA, 22 nt, Human
ccagguggcuucugcccgaugu

SEQ ID NO: 560173 - RNA, 22 nt, Human
ugcucccagggacucuggcugg

SEQ ID NO: 560174 - RNA, 22 nt, Human
acaauguuuuuguucaaagagu

SEQ ID NO: 560175 - RNA, 22 nt, Human
accaaggaguuugguauuuuag

SEQ ID NO: 560176 - RNA, 22 nt, Human
aacacaugccuuaagaauaagu

SEQ ID NO: 560177 - RNA, 22 nt, Human
aaaaguucccugguuagaaaag

SEQ ID NO: 560178 - RNA, 20 nt, Human
uccaggccuuguucucagau

SEQ ID NO: 560179 - RNA, 22 nt, Human
ugcaugucaaggcacucaggau

SEQ ID NO: 560180 - RNA, 22 nt, Human
uugcauugaaugcacauuuuua

SEQ ID NO: 560181 - RNA, 22 nt, Human
acaggcagguaauuuacauauu

SEQ ID NO: 560182 - RNA, 22 nt, Human
ggcccugcucaggcugcgauga

SEQ ID NO: 560183 - RNA, 22 nt, Human
cagagccaaaugcugugguuau

SEQ ID NO: 560184 - RNA, 22 nt, Human
cugcucugagaggcucuuccua

SEQ ID NO: 560185 - RNA, 22 nt, Human
ucugccugcaguguggcagggc

SEQ ID NO: 560186 - RNA, 22 nt, Human
gugggggagaugcuuagguccg

SEQ ID NO: 560187 - RNA, 22 nt, Human
caucacagguccugaugacauu

SEQ ID NO: 560188 - RNA, 22 nt, Human
caguguucccugaacauauguu

SEQ ID NO: 560189 - RNA, 22 nt, Human
gaaaaaugcuccaaaucugugg

SEQ ID NO: 560190 - RNA, 22 nt, Human
ugcucagggacaauggagaggg

SEQ ID NO: 560191 - RNA, 19 nt, Human
ugaagcaggcagagaagau

SEQ ID NO: 560192 - RNA, 22 nt, Human
aggguccaucaaggacugcaca

SEQ ID NO: 560193 - RNA, 20 nt, Human
acaggggcagcacaauaaug

SEQ ID NO: 560194 - RNA, 22 nt, Human
acacugaagagcacuuucaaag

SEQ ID NO: 560195 - RNA, 22 nt, Human
acagacagauuuugucugaugu

SEQ ID NO: 560196 - RNA, 22 nt, Human
uuucucugaggcuggccucccu

SEQ ID NO: 560197 - RNA, 19 nt, Human
gucucugcuccagggucuc

SEQ ID NO: 560198 - RNA, 22 nt, Human
cagaaguggccucagagggagu

SEQ ID NO: 560199 - RNA, 22 nt, Human
acugagcugcaagucagggagg

SEQ ID NO: 560200 - RNA, 22 nt, Human
uugcaaggucaucaugcauugg

SEQ ID NO: 560201 - RNA, 22 nt, Human
uaguccagccuuggguguagcc

SEQ ID NO: 560202 - RNA, 22 nt, Human
aacaucagcacacaauagcaag

SEQ ID NO: 560203 - RNA, 22 nt, Human
cugauacaaugcuaauaaauuu

SEQ ID NO: 560204 - RNA, 22 nt, Human
agggaagaagcugguaguaggu

SEQ ID NO: 560205 - RNA, 22 nt, Human
aggaaccagagguugagcaacu

SEQ ID NO: 560206 - RNA, 19 nt, Human
gccuaugucuucaaaucau

SEQ ID NO: 560207 - RNA, 22 nt, Human
augguggaagagcaucagaaag

SEQ ID NO: 560208 - RNA, 22 nt, Human
uuugcauuguuucaaaagugaa

SEQ ID NO: 560209 - RNA, 22 nt, Human
cccagcccugaccuauuggaaa

SEQ ID NO: 560210 - RNA, 22 nt, Human
uagggcugcugcagaugacagg

SEQ ID NO: 560211 - RNA, 22 nt, Human
caaugauuuuuccauugcagga

SEQ ID NO: 560212 - RNA, 22 nt, Human
auucagcaaugagcuuggauuu

SEQ ID NO: 560213 - RNA, 22 nt, Human
ccuccacaggagcugcagugcu

SEQ ID NO: 560214 - RNA, 19 nt, Human
gugggacagacauuacaua

SEQ ID NO: 560215 - RNA, 22 nt, Human
uugaaaggugcugugugcugau

SEQ ID NO: 560216 - RNA, 22 nt, Human
uggaagugcucuucugaccaac

SEQ ID NO: 560217 - RNA, 22 nt, Human
uggcugagggggcaguucagga

SEQ ID NO: 560218 - RNA, 21 nt, Human
acagagccgggcacaaagcug

SEQ ID NO: 560219 - RNA, 22 nt, Human
guggcagggugcucaucaugca

SEQ ID NO: 560220 - RNA, 22 nt, Human
ucccuccuggugagcaggggcu

SEQ ID NO: 560221 - RNA, 22 nt, Human
gcuguccugggaacaggcacua

SEQ ID NO: 560222 - RNA, 18 nt, Human
ugguuccuugaaggggca

SEQ ID NO: 560223 - RNA, 22 nt, Human
aucauguuccagaaacagugau

SEQ ID NO: 560224 - RNA, 19 nt, Human
ccuuccuccccagggccau

SEQ ID NO: 560225 - RNA, 22 nt, Human
gcaguguucuaaauugggugug

SEQ ID NO: 560226 - RNA, 22 nt, Human
caggcacugugcugagcucugc

SEQ ID NO: 560227 - RNA, 22 nt, Human
ugcacagagggaggcauaaaau

SEQ ID NO: 560228 - RNA, 22 nt, Human
uagggcugugucuccaggacca

SEQ ID NO: 560229 - RNA, 22 nt, Human
aacaacaacggagaaaggguug

SEQ ID NO: 560230 - RNA, 22 nt, Human
augcuguagaucuuagccucua

SEQ ID NO: 560231 - RNA, 16 nt, Human
ccugggcucuguugga

SEQ ID NO: 560232 - RNA, 22 nt, Human
aaauacaauuucaggcuguaau

SEQ ID NO: 560233 - RNA, 22 nt, Human
caggugcugcguggcggagcug

SEQ ID NO: 560234 - RNA, 22 nt, Human
cccucugcaggcuggaccugcc

SEQ ID NO: 560235 - RNA, 22 nt, Human
cugcucugaagccaggauucug

SEQ ID NO: 560236 - RNA, 22 nt, Human
auacagaucccacagcauguga

SEQ ID NO: 560237 - RNA, 19 nt, Human
gcagguggauguggucagc

SEQ ID NO: 560238 - RNA, 22 nt, Human
cucuccaggacuuuggcccaau

SEQ ID NO: 560239 - RNA, 22 nt, Human
ugaagcaggcauugacugauga

SEQ ID NO: 560240 - RNA, 22 nt, Human
cuuggcagauccaaaaaugaca

SEQ ID NO: 560241 - RNA, 22 nt, Human
gcugaguguaaugauggcagag

SEQ ID NO: 560242 - RNA, 22 nt, Human
gcagagccuugcgucaugugcc

SEQ ID NO: 560243 - RNA, 20 nt, Human
uccaggcagcucagaguguc

SEQ ID NO: 560244 - RNA, 18 nt, Human
uggagccauugccaccau

SEQ ID NO: 560245 - RNA, 22 nt, Human
uuucccaagaccauagauggaa

SEQ ID NO: 560246 - RNA, 22 nt, Human
auuucuuacauaacaaauuguu

SEQ ID NO: 560247 - RNA, 22 nt, Human
ugcagaggagcuggaaggcugg

SEQ ID NO: 560248 - RNA, 21 nt, Human
ugcacagccauacccuccuug

SEQ ID NO: 560249 - RNA, 22 nt, Human
cucugcauuuuaacagaugauu

SEQ ID NO: 560250 - RNA, 22 nt, Human
uccuggcccgaucccugugaag

SEQ ID NO: 560251 - RNA, 22 nt, Human
ccagagagaguacugggcucug

SEQ ID NO: 560252 - RNA, 22 nt, Human
aaggcagcaugaaucccuguac

SEQ ID NO: 560253 - RNA, 22 nt, Human
guuucaaauagguuucagcaaa

SEQ ID NO: 560254 - RNA, 22 nt, Human
guggaaggugcuagaacaagga

SEQ ID NO: 560255 - RNA, 21 nt, Human
cuugggcuuguagauggugga

SEQ ID NO: 560256 - RNA, 22 nt, Human
caauuucaauacaaaauacauu

SEQ ID NO: 560257 - RNA, 22 nt, Human
aggcugcagugcagguaggauu

SEQ ID NO: 560258 - RNA, 22 nt, Human
ccucagagguuuucauucugua

SEQ ID NO: 560259 - RNA, 22 nt, Human
aggcccagacucagcggggcgg

SEQ ID NO: 560260 - RNA, 20 nt, Human
aguagcagugugacauugac

SEQ ID NO: 560261 - RNA, 22 nt, Human
gugcugcucacaucuggaggua

SEQ ID NO: 560262 - RNA, 22 nt, Human
gucugcccuuggcucagccaua

SEQ ID NO: 560263 - RNA, 22 nt, Human
caguuucuguuuuaaauagcag

SEQ ID NO: 560264 - RNA, 22 nt, Human
aguuuuuccugauuuuacagaa

SEQ ID NO: 560265 - RNA, 22 nt, Human
caggaaccaugaagacauauac

SEQ ID NO: 560266 - RNA, 22 nt, Human
ucugggcuuuacacugugcuua

SEQ ID NO: 560267 - RNA, 21 nt, Human
ugaaacacucuuuccaugaga

SEQ ID NO: 560268 - RNA, 22 nt, Human
cuggcccucggaguccagcugc

SEQ ID NO: 560269 - RNA, 22 nt, Human
gucacaggccuggaugaggggc

SEQ ID NO: 560270 - RNA, 22 nt, Human
aaguucaagucugcaucuuuuu

SEQ ID NO: 560271 - RNA, 22 nt, Human
uuucccaagugaagugaagcca

SEQ ID NO: 560272 - RNA, 22 nt, Human
uaggccaggacagagcuuccag

SEQ ID NO: 560273 - RNA, 22 nt, Human
cugccuuggcccuaguucaugg

SEQ ID NO: 560274 - RNA, 22 nt, Human
ggccccugcggacugccuagag

SEQ ID NO: 560275 - RNA, 22 nt, Human
ugcugccaugcagagcaacaga

SEQ ID NO: 560276 - RNA, 22 nt, Human
gccuggcugagguggggaggca

SEQ ID NO: 560277 - RNA, 22 nt, Human
auagaauagcauagaaaauuga

SEQ ID NO: 560278 - RNA, 22 nt, Human
ucacagcuauucucauguauuu

SEQ ID NO: 560279 - RNA, 22 nt, Human
augggcuguccuaguccagccc

SEQ ID NO: 560280 - RNA, 22 nt, Human
gcacugugacccagagcaggug

SEQ ID NO: 560281 - RNA, 22 nt, Human
gcacugggaaugcugaugggcu

SEQ ID NO: 560282 - RNA, 22 nt, Human
gaaggcugaugacagauucugc

SEQ ID NO: 560283 - RNA, 22 nt, Human
augcaguacauacaaacacuga

SEQ ID NO: 560284 - RNA, 22 nt, Human
agcuaugguaaucauccaccaa

SEQ ID NO: 560285 - RNA, 22 nt, Human
gggcucagagcauuuggguugg

SEQ ID NO: 560286 - RNA, 22 nt, Human
ugggaguagaugaggagugggc

SEQ ID NO: 560287 - RNA, 22 nt, Human
uggagguggaguuggaaacuga

SEQ ID NO: 560288 - RNA, 22 nt, Human
ugccuuccuaauggugggguuu

SEQ ID NO: 560289 - RNA, 22 nt, Human
ccagacaguuccuugagguuca

SEQ ID NO: 560290 - RNA, 22 nt, Human
aagcagagugauauaaacaugg

SEQ ID NO: 560291 - RNA, 22 nt, Human
ccagaaaacucuacaugcuugu

SEQ ID NO: 560292 - RNA, 22 nt, Human
uaguggaggggaugcaaagcuu

SEQ ID NO: 560293 - RNA, 22 nt, Human
uuccagugaugggcaauuuggu

SEQ ID NO: 560294 - RNA, 21 nt, Human
ggucagggggugccuccaggu

SEQ ID NO: 560295 - RNA, 19 nt, Human
auuucaagagguuuauugg

SEQ ID NO: 560296 - RNA, 22 nt, Human
ucucagagggaggauuacugcc

SEQ ID NO: 560297 - RNA, 22 nt, Human
ucaggccacggcucacugagac

SEQ ID NO: 560298 - RNA, 22 nt, Human
ugaggcagggaguuuaauuguc

SEQ ID NO: 560299 - RNA, 20 nt, Human
uguucacaguaguugcugcu

SEQ ID NO: 560300 - RNA, 22 nt, Human
aggccuggccuuuauguucaag

SEQ ID NO: 560301 - RNA, 22 nt, Human
auuauccaacacccaguuacau

SEQ ID NO: 560302 - RNA, 22 nt, Human
cugggaagaagggacaacagcg

SEQ ID NO: 560303 - RNA, 22 nt, Human
cugggccaucuccuuugugugg

SEQ ID NO: 560304 - RNA, 22 nt, Human
uggagguggggcucaggaaucu

SEQ ID NO: 560305 - RNA, 22 nt, Human
uuauuaggaaaaggucagaugu

SEQ ID NO: 560306 - RNA, 20 nt, Human
ucucacaggggcuuuucucu

SEQ ID NO: 560307 - RNA, 22 nt, Human
uggcugaggucuggggcuucug

SEQ ID NO: 560308 - RNA, 22 nt, Human
ggcacacaaaggcagcauuuga

SEQ ID NO: 560309 - RNA, 22 nt, Human
uuagauaaauuaagacuuuaca

SEQ ID NO: 560310 - RNA, 22 nt, Human
auuauucauugguaggcaagcu

SEQ ID NO: 560311 - RNA, 22 nt, Human
ccagggaagucacauugucuag

SEQ ID NO: 560312 - RNA, 22 nt, Human
ggcuuuauuaacucauccguaa

SEQ ID NO: 560313 - RNA, 22 nt, Human
acaaagucucuaauaaucuucu

SEQ ID NO: 560314 - RNA, 22 nt, Human
uguaaggaggaaaauuaguggu

SEQ ID NO: 560315 - RNA, 22 nt, Human
ggcuggaaaagacaaagcuauu

SEQ ID NO: 560316 - RNA, 23 nt, Human
cauguacagaguuugauaaagug

SEQ ID NO: 560317 - RNA, 22 nt, Human
gcuuuacagagaaaguuugccu

SEQ ID NO: 560318 - RNA, 21 nt, Human
uaagaacauuaucuucuuccu

SEQ ID NO: 560319 - RNA, 22 nt, Human
gcagggacugugaucucacaga

SEQ ID NO: 560320 - RNA, 22 nt, Human
uuauguuugaguauaugacuca

SEQ ID NO: 560321 - RNA, 22 nt, Human
aaugugaaaccgcacagaauaa

SEQ ID NO: 560322 - RNA, 22 nt, Human
ucuuccaaugguuucuagauuu

SEQ ID NO: 560323 - RNA, 23 nt, Human
aggcccugccugucccucuuuuu

SEQ ID NO: 560324 - RNA, 22 nt, Human
uggccaggcuggucuggaacgc

SEQ ID NO: 560325 - RNA, 22 nt, Human
aauaagauugacacaaguaccu

SEQ ID NO: 560326 - RNA, 18 nt, Human
cacauuuaccuggcuccc

SEQ ID NO: 560327 - RNA, 22 nt, Human
aaagacuagcauuuauauguac

SEQ ID NO: 560328 - RNA, 22 nt, Human
ucugcuggugaugaccucauaa

SEQ ID NO: 560329 - RNA, 22 nt, Human
aaauuucuugaggcucucuagc

SEQ ID NO: 560330 - RNA, 22 nt, Human
acaggccugacacacagagggc

SEQ ID NO: 560331 - RNA, 22 nt, Human
auuucuacugugagaaacauga

SEQ ID NO: 560332 - RNA, 22 nt, Human
uagaauaugugguaggaucugg

SEQ ID NO: 560333 - RNA, 22 nt, Human
cuggcagcaguuaugaaacaau

SEQ ID NO: 560334 - RNA, 22 nt, Human
uccuggccuugcuccugaugcc

SEQ ID NO: 560335 - RNA, 22 nt, Human
ucugggcugggagcguguggac

SEQ ID NO: 560336 - RNA, 22 nt, Human
gcugcccugcaucugugccuuc

SEQ ID NO: 560337 - RNA, 17 nt, Human
aagucccagcuaacaca

SEQ ID NO: 560338 - RNA, 22 nt, Human
ucuuggagacucuuguauauuu

SEQ ID NO: 560339 - RNA, 22 nt, Human
cuggccaacuugcuuguuggca

SEQ ID NO: 560340 - RNA, 22 nt, Human
ugcugugcuggcggcagaggcc

SEQ ID NO: 560341 - RNA, 22 nt, Human
uaaacuaucuguguuugaaguu

SEQ ID NO: 560342 - RNA, 22 nt, Human
acagauggcaccuuuuugcugu

SEQ ID NO: 560343 - RNA, 22 nt, Human
ccagcuggcaggagagucaggg

SEQ ID NO: 560344 - RNA, 22 nt, Human
acaggcaaggccagugagaaau

SEQ ID NO: 560345 - RNA, 22 nt, Human
ucaaaucuuugaccacuuaugu

SEQ ID NO: 560346 - RNA, 22 nt, Human
aacaguaaaaaucauuuaguug

SEQ ID NO: 560347 - RNA, 22 nt, Human
acauuucugagcagggagcugu

SEQ ID NO: 560348 - RNA, 22 nt, Human
agcugaagggaggauauguaca

SEQ ID NO: 560349 - RNA, 22 nt, Human
cuccugaguaguagcauuguca

SEQ ID NO: 560350 - RNA, 22 nt, Human
agcagccagagucugaacauua

SEQ ID NO: 560351 - RNA, 22 nt, Human
guggccuggaguuugauguagg

SEQ ID NO: 560352 - RNA, 22 nt, Human
uggccugguuauauugcuauca

SEQ ID NO: 560353 - RNA, 22 nt, Human
auaucaaagcuaguggaaauuu

SEQ ID NO: 560354 - RNA, 22 nt, Human
ggcugggcucgcugauuggcug

SEQ ID NO: 560355 - RNA, 22 nt, Human
accaggcuugaugauuugcuua

SEQ ID NO: 560356 - RNA, 22 nt, Human
agaccagggguugaguccuagc

SEQ ID NO: 560357 - RNA, 22 nt, Human
aguacauacuucaaauguacuu

SEQ ID NO: 560358 - RNA, 22 nt, Human
uuuuccucugcaauaaaagcag

SEQ ID NO: 560359 - RNA, 17 nt, Human
gccucugcuugugucau

SEQ ID NO: 560360 - RNA, 22 nt, Human
cuucaucaacucuaacaaaugu

SEQ ID NO: 560361 - RNA, 23 nt, Human
aggaaggagguccuaacaguauc

SEQ ID NO: 560362 - RNA, 22 nt, Human
aagacaugcaguuuguuccauu

SEQ ID NO: 560363 - RNA, 22 nt, Human
cugaggcagagggcagaccaga

SEQ ID NO: 560364 - RNA, 22 nt, Human
ggcucagcuuaucugggcaggc

SEQ ID NO: 560365 - RNA, 21 nt, Human
uggagcugccacuuguccucc

SEQ ID NO: 560366 - RNA, 22 nt, Human
ugggcacuguagcuggugcugg

SEQ ID NO: 560367 - RNA, 22 nt, Human
gccaggcugcuccagggaggcc

SEQ ID NO: 560368 - RNA, 20 nt, Human
agucugucaauuuacagugg

SEQ ID NO: 560369 - RNA, 22 nt, Human
uccugcagagccgcccucaggu

SEQ ID NO: 560370 - RNA, 22 nt, Human
cagguaagagacggauuggccc

SEQ ID NO: 560371 - RNA, 20 nt, Human
gaacauuuggccauacugag

SEQ ID NO: 560372 - RNA, 22 nt, Human
uacauuguguuaaaacagaaga

SEQ ID NO: 560373 - RNA, 22 nt, Human
ucuggaguuacugcuggcuuug

SEQ ID NO: 560374 - RNA, 20 nt, Human
ucacauccucucccaacaug

SEQ ID NO: 560375 - RNA, 22 nt, Human
cuuucucugugugguaaagggc

SEQ ID NO: 560376 - RNA, 22 nt, Human
gaagaagggagugacaaaugca

SEQ ID NO: 560377 - RNA, 22 nt, Human
gaggcugcugagagcccuguuu

SEQ ID NO: 560378 - RNA, 22 nt, Human
uuucucuaaauagggaggcuua

SEQ ID NO: 560379 - RNA, 22 nt, Human
ggagucagaggaaggcuugcuc

SEQ ID NO: 560380 - RNA, 22 nt, Human
aaagccuuuucuguuuaacaca

SEQ ID NO: 560381 - RNA, 22 nt, Human
gcugaggaagucagguggccca

SEQ ID NO: 560382 - RNA, 22 nt, Human
gaagccacuauagauauucuaa

SEQ ID NO: 560383 - RNA, 22 nt, Human
augaagaaacuguucugggugg

SEQ ID NO: 560384 - RNA, 22 nt, Human
cauugaaaccuaacauaggcug

SEQ ID NO: 560385 - RNA, 22 nt, Human
aaauaaagguccacuuuagggc

SEQ ID NO: 560386 - RNA, 23 nt, Human
ugcaauaugucagugcaaagugg

SEQ ID NO: 560387 - RNA, 22 nt, Human
acagagagcugugauugaguua

SEQ ID NO: 560388 - RNA, 22 nt, Human
ugcaagagauucaaaccauaaa

SEQ ID NO: 560389 - RNA, 22 nt, Human
aggcagcaaaugucuggaacag

SEQ ID NO: 560390 - RNA, 22 nt, Human
gaguguggugaacaggagcacc

SEQ ID NO: 560391 - RNA, 22 nt, Human
gauuuccucacuaacauccauc

SEQ ID NO: 560392 - RNA, 22 nt, Human
ugcuggggguagcucugcguag

SEQ ID NO: 560393 - RNA, 17 nt, Human
gcagccagugcagcagg

SEQ ID NO: 560394 - RNA, 22 nt, Human
aggcagccuuuagacagucugc

SEQ ID NO: 560395 - RNA, 22 nt, Human
ucaguuucacagucugugcaga

SEQ ID NO: 560396 - RNA, 16 nt, Human
gaagaaggaaaacuac

SEQ ID NO: 560397 - RNA, 22 nt, Human
uuguguccugauuugacacaau

SEQ ID NO: 560398 - RNA, 22 nt, Human
aaaugguauuuacucuguauua

SEQ ID NO: 560399 - RNA, 20 nt, Human
cccacacccuucccacuugg

SEQ ID NO: 560400 - RNA, 22 nt, Human
gcauuuauuucuuuacugcauc

SEQ ID NO: 560401 - RNA, 22 nt, Human
gggcaugccugcgcagugcaug

SEQ ID NO: 560402 - RNA, 22 nt, Human
cugggagguggagguugcauug

SEQ ID NO: 560403 - RNA, 20 nt, Human
ggccugagcauggcuggcag

SEQ ID NO: 560404 - RNA, 22 nt, Human
gggaccugccaaggccacccag

SEQ ID NO: 560405 - RNA, 22 nt, Human
guuuuucuagacugggaguuug

SEQ ID NO: 560406 - RNA, 22 nt, Human
agugaccauuuucagcuagagg

SEQ ID NO: 560407 - RNA, 22 nt, Human
gucaacauguucugggugaaug

SEQ ID NO: 560408 - RNA, 22 nt, Human
aaagucacaauauuggaaggug

SEQ ID NO: 560409 - RNA, 22 nt, Human
gggcagaggggcgcuucccucu

SEQ ID NO: 560410 - RNA, 22 nt, Human
aucuacagugcacaggacagcc

SEQ ID NO: 560411 - RNA, 22 nt, Human
acccagaggcggagguugcagu

SEQ ID NO: 560412 - RNA, 22 nt, Human
cugggagcugucaggagcgugu

SEQ ID NO: 560413 - RNA, 22 nt, Human
gaagaauauucuugaucuuaga

SEQ ID NO: 560414 - RNA, 22 nt, Human
aaaucgcuugaacccaggaagu

SEQ ID NO: 560415 - RNA, 22 nt, Human
cuuucaaagaccuuggcauggg

SEQ ID NO: 560416 - RNA, 22 nt, Human
caggguggcaggcaccauggcc

SEQ ID NO: 560417 - RNA, 23 nt, Human
caugccaguuugugcaggcagau

SEQ ID NO: 560418 - RNA, 22 nt, Human
ggggaaaggccauggcaagaac

SEQ ID NO: 560419 - RNA, 20 nt, Human
aggcacuggggauagguaag

SEQ ID NO: 560420 - RNA, 22 nt, Human
guauuucaucuugaaaaccagu

SEQ ID NO: 560421 - RNA, 19 nt, Human
gcagaugaugaggcugguc

SEQ ID NO: 560422 - RNA, 22 nt, Human
aggagugagcuuuggggucaga

SEQ ID NO: 560423 - RNA, 22 nt, Human
ugauauuuuaugagcuuucaua

SEQ ID NO: 560424 - RNA, 22 nt, Human
gcugcagcaagcccuccagggg

SEQ ID NO: 560425 - RNA, 22 nt, Human
gccaguggcuugccaggcagga

SEQ ID NO: 560426 - RNA, 20 nt, Human
guuuuucucucuugccacua

SEQ ID NO: 560427 - RNA, 22 nt, Human
ugcuuuauuuauaaaauagcaa

SEQ ID NO: 560428 - RNA, 22 nt, Human
ggccugcucugcagccucuaca

SEQ ID NO: 560429 - RNA, 22 nt, Human
aucaaagagcuugacaauccua

SEQ ID NO: 560430 - RNA, 19 nt, Human
uggcagaggacaaggacuu

SEQ ID NO: 560431 - RNA, 22 nt, Human
aaaguucugggggagaagaacg

SEQ ID NO: 560432 - RNA, 22 nt, Human
gaggaguggaguugcuggguug

SEQ ID NO: 560433 - RNA, 22 nt, Human
ggagccagagcacuggggagcc

SEQ ID NO: 560434 - RNA, 19 nt, Human
uugugugucagucagaguu

SEQ ID NO: 560435 - RNA, 22 nt, Human
agcccagccggauucccaguuc

SEQ ID NO: 560436 - RNA, 22 nt, Human
cagucucuggugaguugacagu

SEQ ID NO: 560437 - RNA, 22 nt, Human
agcugcugcgccucacccuggc

SEQ ID NO: 560438 - RNA, 22 nt, Human
uaggugucugcucuuauuuaac

SEQ ID NO: 560439 - RNA, 21 nt, Human
gagugcagcaagguagagucu

SEQ ID NO: 560440 - RNA, 22 nt, Human
caguauguacucuuaucaugua

SEQ ID NO: 560441 - RNA, 22 nt, Human
ggaagagaaaugagucaagacu

SEQ ID NO: 560442 - RNA, 22 nt, Human
uguacaaagguacuuugauguu

SEQ ID NO: 560443 - RNA, 22 nt, Human
acugucuuguguuaaagaacca

SEQ ID NO: 560444 - RNA, 22 nt, Human
uucaagauggcugcaaauacuu

SEQ ID NO: 560445 - RNA, 22 nt, Human
guucacagaaggccagauggua

SEQ ID NO: 560446 - RNA, 23 nt, Human
augcccuguagaggcugcugacc

SEQ ID NO: 560447 - RNA, 22 nt, Human
aguuacaucuguuauguguguu

SEQ ID NO: 560448 - RNA, 18 nt, Human
auugcuuuuguaccaacc

SEQ ID NO: 560449 - RNA, 22 nt, Human
ggcagagaugugggucagaauc

SEQ ID NO: 560450 - RNA, 22 nt, Human
uaguucuucaugaauucagcuu

SEQ ID NO: 560451 - RNA, 22 nt, Human
gcuggcucagggacuagaguuu

SEQ ID NO: 560452 - RNA, 22 nt, Human
gcaggugggggucggugcaucu

SEQ ID NO: 560453 - RNA, 22 nt, Human
cucaggauucucgacacucaca

SEQ ID NO: 560454 - RNA, 22 nt, Human
uuucugcucgcucucaaucagg

SEQ ID NO: 560455 - RNA, 23 nt, Human
augcccugugcagaaauguggaa

SEQ ID NO: 560456 - RNA, 22 nt, Human
aguggcagagcugugucuugaa

SEQ ID NO: 560457 - RNA, 22 nt, Human
cuggcccucgucaguuucacug

SEQ ID NO: 560458 - RNA, 22 nt, Human
gcagacuguaucaaugucagua

SEQ ID NO: 560459 - RNA, 22 nt, Human
uaauaccuggccuugauacagu

SEQ ID NO: 560460 - RNA, 22 nt, Human
agucacuuucuacuugguuucu

SEQ ID NO: 560461 - RNA, 22 nt, Human
auaauuaauuucaguaaucucc

SEQ ID NO: 560462 - RNA, 22 nt, Human
guuauucugcacaccuuuaaaa

SEQ ID NO: 560463 - RNA, 22 nt, Human
uggacccuggacugcccuggcc

SEQ ID NO: 560464 - RNA, 22 nt, Human
ugggcuuaggucggaggcggcc

SEQ ID NO: 560465 - RNA, 22 nt, Human
ucucaaacuaacaaugauuaua

SEQ ID NO: 560466 - RNA, 22 nt, Human
ccacugugcccagccucauggg

SEQ ID NO: 560467 - RNA, 22 nt, Human
caagcagagguuuauguauuag

SEQ ID NO: 560468 - RNA, 22 nt, Human
uguuuauagggucugucacuug

SEQ ID NO: 560469 - RNA, 22 nt, Human
uauuuucuggacagucuugcuu

SEQ ID NO: 560470 - RNA, 22 nt, Human
uacagaauguguaucauuacca

SEQ ID NO: 560471 - RNA, 20 nt, Human
gucagugucuucaguaguga

SEQ ID NO: 560472 - RNA, 18 nt, Human
cauaauuuucuuucuuua

SEQ ID NO: 560473 - RNA, 22 nt, Human
gcagccucagggcacucagaug

SEQ ID NO: 560474 - RNA, 20 nt, Human
ucccaggcuccacccuagac

SEQ ID NO: 560475 - RNA, 22 nt, Human
ucaaauguucccuguacuggcc

SEQ ID NO: 560476 - RNA, 22 nt, Human
gcugccaugguccaggcuccag

SEQ ID NO: 560477 - RNA, 17 nt, Human
aggccagaugaggcaag

SEQ ID NO: 560478 - RNA, 22 nt, Human
ggcgcaggccuuggauccuggu

SEQ ID NO: 560479 - RNA, 22 nt, Human
gcaggcuggaggcuguucuggg

SEQ ID NO: 560480 - RNA, 22 nt, Human
uugugguuaaccgcacauuuuu

SEQ ID NO: 560481 - RNA, 22 nt, Human
uuucccaggcuggaaugcagug

SEQ ID NO: 560482 - RNA, 22 nt, Human
auguuugucccugacauccucu

SEQ ID NO: 560483 - RNA, 22 nt, Human
aaguuuuauuggcuauagcacu

SEQ ID NO: 560484 - RNA, 20 nt, Human
ugucauuuauuuaucaaaug

SEQ ID NO: 560485 - RNA, 22 nt, Human
caauguuuuguugaaugaauag

SEQ ID NO: 560486 - RNA, 22 nt, Human
ucuguucaugaaauaucuuuuu

SEQ ID NO: 560487 - RNA, 22 nt, Human
guggaggagaggcgccuugcgg

SEQ ID NO: 560488 - RNA, 22 nt, Human
uccuggcagagagcaugaggcc

SEQ ID NO: 560489 - RNA, 22 nt, Human
ccaagggaaaccgagaggcugg

SEQ ID NO: 560490 - RNA, 22 nt, Human
ccaguggacaauuucugaggaa

SEQ ID NO: 560491 - RNA, 22 nt, Human
aggaaugacuuguagcucugag

SEQ ID NO: 560492 - RNA, 22 nt, Human
ucugccuggcucauggcaguga

SEQ ID NO: 560493 - RNA, 22 nt, Human
cugugcaagcccaagauaaaac

SEQ ID NO: 560494 - RNA, 22 nt, Human
aaguguuuggggaucauuuuaa

SEQ ID NO: 560495 - RNA, 22 nt, Human
ugagcuguagcagaugcuguug

SEQ ID NO: 560496 - RNA, 22 nt, Human
aacaaagucguugccuagaaga

SEQ ID NO: 560497 - RNA, 22 nt, Human
cugcugagaugccaggagcucu

SEQ ID NO: 560498 - RNA, 22 nt, Human
guccagaagcagugcacaucac

SEQ ID NO: 560499 - RNA, 22 nt, Human
aguaacuaugcuugagaaucag

SEQ ID NO: 560500 - RNA, 22 nt, Human
aaguggaggccgaguucacgca

SEQ ID NO: 560501 - RNA, 21 nt, Human
ggucuuccaaauaaggagaaa

SEQ ID NO: 560502 - RNA, 22 nt, Human
uuaaaacugcaaauccuacuga

SEQ ID NO: 560503 - RNA, 22 nt, Human
uggcugggggugcuauagcugc

SEQ ID NO: 560504 - RNA, 22 nt, Human
gcacugcaucuacuggcaagua

SEQ ID NO: 560505 - RNA, 21 nt, Human
ugacauaauccauaguacaaa

SEQ ID NO: 560506 - RNA, 22 nt, Human
aguaaaucagaccucauuaugu

SEQ ID NO: 560507 - RNA, 22 nt, Human
caauuauauuuagaaugauaca

SEQ ID NO: 560508 - RNA, 22 nt, Human
ucauugucuugauaugauuguc

SEQ ID NO: 560509 - RNA, 22 nt, Human
caagggaccugagauggucucu

SEQ ID NO: 560510 - RNA, 22 nt, Human
uacagugacccuauuuccaaau

SEQ ID NO: 560511 - RNA, 22 nt, Human
cagguggaucucuaaggacuga

SEQ ID NO: 560512 - RNA, 22 nt, Human
gcaaacaagcugccugaagauu

SEQ ID NO: 560513 - RNA, 22 nt, Human
cucaggaugaaagucaugguga

SEQ ID NO: 560514 - RNA, 22 nt, Human
ucucaagaucucaagauggccc

SEQ ID NO: 560515 - RNA, 22 nt, Human
guauauaucggcacuauuuuaa

SEQ ID NO: 560516 - RNA, 22 nt, Human
ugaggggaacugaugcccauug

SEQ ID NO: 560517 - RNA, 22 nt, Human
ugcuccuuccucauccugugca

SEQ ID NO: 560518 - RNA, 22 nt, Human
ucagagguaagggcugagagga

SEQ ID NO: 560519 - RNA, 22 nt, Human
ucuuugaacuuuuuguaaguua

SEQ ID NO: 560520 - RNA, 22 nt, Human
uucuuuaugcuucuguuuaggc

SEQ ID NO: 560521 - RNA, 22 nt, Human
ccugccugcggcccgcggggag

SEQ ID NO: 560522 - RNA, 22 nt, Human
ucauuucaugucucaggcacug

SEQ ID NO: 560523 - RNA, 22 nt, Human
ucuggcugccaccauccucccc

SEQ ID NO: 560524 - RNA, 22 nt, Human
cgcugggggaacagcgagggug

SEQ ID NO: 560525 - RNA, 22 nt, Human
agggccugcaucaggagcuugg

SEQ ID NO: 560526 - RNA, 19 nt, Human
uggcagcauugguaccuug

SEQ ID NO: 560527 - RNA, 22 nt, Human
uugaucuugugauaguucaacu

SEQ ID NO: 560528 - RNA, 22 nt, Human
gccaggcagcagcgaggauggu

SEQ ID NO: 560529 - RNA, 22 nt, Human
gggaccugcgccacucacuguc

SEQ ID NO: 560530 - RNA, 22 nt, Human
ggaggaccccagcagcucccca

SEQ ID NO: 560531 - RNA, 22 nt, Human
ucaggggcccuucccucagcag

SEQ ID NO: 560532 - RNA, 22 nt, Human
ccuuuacaucugacuucuuuca

SEQ ID NO: 560533 - RNA, 22 nt, Human
ugcaggugguuuggacacugcu

SEQ ID NO: 560534 - RNA, 22 nt, Human
ggauggagguucucagaugcuc

SEQ ID NO: 560535 - RNA, 22 nt, Human
uuuauucauuguuucgucgcag

SEQ ID NO: 560536 - RNA, 22 nt, Human
guccuggggauuauagaguguu

SEQ ID NO: 560537 - RNA, 22 nt, Human
cagagagagugggguguggauu

SEQ ID NO: 560538 - RNA, 22 nt, Human
aagagcaggcugucaauggggc

SEQ ID NO: 560539 - RNA, 20 nt, Human
cugcaggguuagaggcucca

SEQ ID NO: 560540 - RNA, 22 nt, Human
ucucuguggugggaggcugagu

SEQ ID NO: 560541 - RNA, 19 nt, Human
uggcaucuguaaaauggug

SEQ ID NO: 560542 - RNA, 22 nt, Human
cagcuguugucucucacauauu

SEQ ID NO: 560543 - RNA, 22 nt, Human
uagacacaucaaguauaguuaa

SEQ ID NO: 560544 - RNA, 22 nt, Human
uagguuccaugagggaggcaaa

SEQ ID NO: 560545 - RNA, 22 nt, Human
aggacccugcucaagcaucucc

SEQ ID NO: 560546 - RNA, 22 nt, Human
gggcuggaccgcucgccucccu

SEQ ID NO: 560547 - RNA, 22 nt, Human
cucucuguuaugcuuucaugaa

SEQ ID NO: 560548 - RNA, 22 nt, Human
auccuuuaucuuuccuaggaau

SEQ ID NO: 560549 - RNA, 22 nt, Human
cauagagugauguaagguaugu

SEQ ID NO: 560550 - RNA, 22 nt, Human
ugacauaaguugguagaaagga

SEQ ID NO: 560551 - RNA, 22 nt, Human
ucugggggcgaccagggacugc

SEQ ID NO: 560552 - RNA, 22 nt, Human
cccagcucucucaguucugcuu

SEQ ID NO: 560553 - RNA, 22 nt, Human
ucagaaauacuaucagcuuuug

SEQ ID NO: 560554 - RNA, 17 nt, Human
cagucgaggaggaccug

SEQ ID NO: 560555 - RNA, 23 nt, Human
agggcaugaagcagaggacgugg

SEQ ID NO: 560556 - RNA, 22 nt, Human
aaguucuacuguggguaaaaug

SEQ ID NO: 560557 - RNA, 22 nt, Human
aggagcucugggcagggccucc

SEQ ID NO: 560558 - RNA, 18 nt, Human
ugagaggcagguagagga

SEQ ID NO: 560559 - RNA, 22 nt, Human
ugcagaagcugcaggucagugg

SEQ ID NO: 560560 - RNA, 22 nt, Human
uuaaauuccagccucauaauag

SEQ ID NO: 560561 - RNA, 22 nt, Human
gcagagccccauugcuggcggg

SEQ ID NO: 560562 - RNA, 22 nt, Human
acauucuaacauuguacagaua

SEQ ID NO: 560563 - RNA, 18 nt, Human
cuucagugacagucuggc

SEQ ID NO: 560564 - RNA, 22 nt, Human
ccuggcugcaguuuuugcagaa

SEQ ID NO: 560565 - RNA, 22 nt, Human
auuuugcuuuauguaaauaugu

SEQ ID NO: 560566 - RNA, 22 nt, Human
agugcccuggcccagcuggacc

SEQ ID NO: 560567 - RNA, 22 nt, Human
ucaauucuagagccuuacauug

SEQ ID NO: 560568 - RNA, 22 nt, Human
gauuucaaguaucuugggcgag

SEQ ID NO: 560569 - RNA, 22 nt, Human
aucaaagauguuucagggugua

SEQ ID NO: 560570 - RNA, 22 nt, Human
ccaggcagccaagugugugugu

SEQ ID NO: 560571 - RNA, 20 nt, Human
aaagagaagccucaccuugu

SEQ ID NO: 560572 - RNA, 22 nt, Human
cagaauuuagcacaauguaugg

SEQ ID NO: 560573 - RNA, 22 nt, Human
auuuaagauugcguauucaugu

SEQ ID NO: 560574 - RNA, 22 nt, Human
ggcagguguggugaccagagau

SEQ ID NO: 560575 - RNA, 22 nt, Human
auaauucagguuuucuggcaca

SEQ ID NO: 560576 - RNA, 22 nt, Human
ccagguguaggacaccaaggga

SEQ ID NO: 560577 - RNA, 22 nt, Human
agcccugcugccugaauuagcu

SEQ ID NO: 560578 - RNA, 22 nt, Human
uaccagggaacagggauauuaa

SEQ ID NO: 560579 - RNA, 22 nt, Human
ccuuuaaagacugcauaacuuc

SEQ ID NO: 560580 - RNA, 22 nt, Human
gcuggccauauauuuugcuguu

SEQ ID NO: 560581 - RNA, 22 nt, Human
agaugcugccucuccucacaag

SEQ ID NO: 560582 - RNA, 20 nt, Human
gaguuccccauuucuccugg

SEQ ID NO: 560583 - RNA, 22 nt, Human
gaggacagugugaucugccagc

SEQ ID NO: 560584 - RNA, 22 nt, Human
aaggagggaaagcagugcuucu

SEQ ID NO: 560585 - RNA, 22 nt, Human
gagucacaaagccuuucuuauu

SEQ ID NO: 560586 - RNA, 22 nt, Human
uuuguagaacuauacuuacauu

SEQ ID NO: 560587 - RNA, 22 nt, Human
ccccauccuauucauguuucug

SEQ ID NO: 560588 - RNA, 21 nt, Human
agagccugagaucuuccagca

SEQ ID NO: 560589 - RNA, 22 nt, Human
cugagaggugcugguggcugca

SEQ ID NO: 560590 - RNA, 22 nt, Human
cagcuuuauugagguauaauug

SEQ ID NO: 560591 - RNA, 22 nt, Human
aaauccuaauaaugcacuagug

SEQ ID NO: 560592 - RNA, 22 nt, Human
gggucuggacggcugcaggaag

SEQ ID NO: 560593 - RNA, 22 nt, Human
ugccagggugucaggagagcua

SEQ ID NO: 560594 - RNA, 22 nt, Human
aaugauuuggcaaaggaaucca

SEQ ID NO: 560595 - RNA, 22 nt, Human
uuccagaggcuugaggaaaauu

SEQ ID NO: 560596 - RNA, 19 nt, Human
agcuccaggccuggaugcu

SEQ ID NO: 560597 - RNA, 22 nt, Human
gcucugagaggugcagcaguaa

SEQ ID NO: 560598 - RNA, 22 nt, Human
cugcugagguccuugcucagac

SEQ ID NO: 560599 - RNA, 17 nt, Human
uggaugugggaucugga

SEQ ID NO: 560600 - RNA, 22 nt, Human
aaaugcaggaaauuaugcuuuu

SEQ ID NO: 560601 - RNA, 22 nt, Human
ugcagggauuauguagggguug

SEQ ID NO: 560602 - RNA, 22 nt, Human
aacaugcuugcuuagaaucagc

SEQ ID NO: 560603 - RNA, 22 nt, Human
cagaaacauguauaaaguugua

SEQ ID NO: 560604 - RNA, 22 nt, Human
uuucuaagugugauuuuagauu

SEQ ID NO: 560605 - RNA, 22 nt, Human
aaucacaauuacuuuugcacca

SEQ ID NO: 560606 - RNA, 22 nt, Human
gccuccugaagugcugggauua

SEQ ID NO: 560607 - RNA, 22 nt, Human
caaugauugcuauuuacauaaa

SEQ ID NO: 560608 - RNA, 22 nt, Human
ucaagcaggguagcaagcuggu

SEQ ID NO: 560609 - RNA, 22 nt, Human
cagccccucacagagcuguccu

SEQ ID NO: 560610 - RNA, 22 nt, Human
auaaggaaguugcagaagugga

SEQ ID NO: 560611 - RNA, 22 nt, Human
ccagggcacuuaggcccagccc

SEQ ID NO: 560612 - RNA, 22 nt, Human
agggcucaauggugggcaugua

SEQ ID NO: 560613 - RNA, 22 nt, Human
gcagcugccuauucagggcuug

SEQ ID NO: 560614 - RNA, 21 nt, Human
uuucacaaaaguaugugacaa

SEQ ID NO: 560615 - RNA, 21 nt, Human
ugcaggagucugugagucagg

SEQ ID NO: 560616 - RNA, 20 nt, Human
uccaguggccugaaucugga

SEQ ID NO: 560617 - RNA, 22 nt, Human
aaggccaacuaggaugagcuag

SEQ ID NO: 560618 - RNA, 19 nt, Human
agcuccugggcucugggcc

SEQ ID NO: 560619 - RNA, 22 nt, Human
ucacuuuugaucccuaugcagu

SEQ ID NO: 560620 - RNA, 22 nt, Human
ggcaggcaggagcgugcuuggg

SEQ ID NO: 560621 - RNA, 22 nt, Human
ccuggacuguguccugugguca

SEQ ID NO: 560622 - RNA, 22 nt, Human
ugucaccaugccagcuucugcc

SEQ ID NO: 560623 - RNA, 22 nt, Human
uaggaguaacucucgucaucau

SEQ ID NO: 560624 - RNA, 19 nt, Human
gaauguuucugucucuucu

SEQ ID NO: 560625 - RNA, 22 nt, Human
guggcugguuuccugcaugcaa

SEQ ID NO: 560626 - RNA, 22 nt, Human
gagucccaugaugauagccaca

SEQ ID NO: 560627 - RNA, 22 nt, Human
cugggccuugagaaucauguuu

SEQ ID NO: 560628 - RNA, 22 nt, Human
ggaggggccggcugccugccac

SEQ ID NO: 560629 - RNA, 22 nt, Human
ggcacugaucugauuucccucc

SEQ ID NO: 560630 - RNA, 22 nt, Human
uugaaaguccuucuugaguuac

SEQ ID NO: 560631 - RNA, 22 nt, Human
acagagagaaacaaucagcagc

SEQ ID NO: 560632 - RNA, 22 nt, Human
cagucccagcugcucagaaggc

SEQ ID NO: 560633 - RNA, 22 nt, Human
auuagaaugaaguauaggauuu

SEQ ID NO: 560634 - RNA, 19 nt, Human
acagagcucucugcuucug

SEQ ID NO: 560635 - RNA, 20 nt, Human
ugcagagcuggcuggcuccu

SEQ ID NO: 560636 - RNA, 22 nt, Human
gaagcccaggcuuccuuggcuu

SEQ ID NO: 560637 - RNA, 22 nt, Human
uagaaaucuacuuagacuuucu

SEQ ID NO: 560638 - RNA, 20 nt, Human
accagguggcugaugacacc

SEQ ID NO: 560639 - RNA, 22 nt, Human
uuuuuagaguguuaccaguaua

SEQ ID NO: 560640 - RNA, 22 nt, Human
uucaaacaguugcacaacuuau

SEQ ID NO: 560641 - RNA, 22 nt, Human
gcuugggauaugcugauguaaa

SEQ ID NO: 560642 - RNA, 21 nt, Human
uggcucuguucaauauaugga

SEQ ID NO: 560643 - RNA, 22 nt, Human
agugaucagcuugaaguaguuu

SEQ ID NO: 560644 - RNA, 22 nt, Human
agggcagagcacugaauuggga

SEQ ID NO: 560645 - RNA, 22 nt, Human
ucucaaguuauguaacagcugu

SEQ ID NO: 560646 - RNA, 22 nt, Human
ugcugccucagcuuccugggcu

SEQ ID NO: 560647 - RNA, 22 nt, Human
ugccucagcugaggccgcucca

SEQ ID NO: 560648 - RNA, 23 nt, Human
gaguguucauagcaggcucuugc

SEQ ID NO: 560649 - RNA, 22 nt, Human
gccucugggcucugccccuggc

SEQ ID NO: 560650 - RNA, 22 nt, Human
ugauuauauuaacuauguuccu

SEQ ID NO: 560651 - RNA, 22 nt, Human
ucagggcauguauguuucuuua

SEQ ID NO: 560652 - RNA, 22 nt, Human
ucuggcagcaagauaacaaugg

SEQ ID NO: 560653 - RNA, 22 nt, Human
acagcuggcaggggggcaugaa

SEQ ID NO: 560654 - RNA, 22 nt, Human
ugcuucugaugugagcagcccc

SEQ ID NO: 560655 - RNA, 22 nt, Human
agcuagaggugaaacaugccaa

SEQ ID NO: 560656 - RNA, 21 nt, Human
ccaugucagaugugggcugug

SEQ ID NO: 560657 - RNA, 22 nt, Human
uuacagaagagaaagaauucag

SEQ ID NO: 560658 - RNA, 22 nt, Human
ucaugcuaguuaagaacacaau

SEQ ID NO: 560659 - RNA, 22 nt, Human
ugcagggccuucuagaccaugg

SEQ ID NO: 560660 - RNA, 18 nt, Human
ugacucacccugucagug

SEQ ID NO: 560661 - RNA, 22 nt, Human
agggagccagaguugggagcuc

SEQ ID NO: 560662 - RNA, 22 nt, Human
guggcagcugguaugcagacag

SEQ ID NO: 560663 - RNA, 22 nt, Human
agagcagagggcucugggacaa

SEQ ID NO: 560664 - RNA, 22 nt, Human
aaguccaucucugccccacaca

SEQ ID NO: 560665 - RNA, 22 nt, Human
auggaauugaagacagcauagg

SEQ ID NO: 560666 - RNA, 22 nt, Human
gauccuugcaacucugugaggu

SEQ ID NO: 560667 - RNA, 22 nt, Human
uucaacaauuaaguaucagccu

SEQ ID NO: 560668 - RNA, 22 nt, Human
gucuugaucuccugaccuugug

SEQ ID NO: 560669 - RNA, 23 nt, Human
uucaucaguugcuguugcagaac

SEQ ID NO: 560670 - RNA, 23 nt, Human
cauguacacacagcuguacagug

SEQ ID NO: 560671 - RNA, 22 nt, Human
ucaaauguaauuuauuguuuua

SEQ ID NO: 560672 - RNA, 19 nt, Human
aggcagcaggccagggaug

SEQ ID NO: 560673 - RNA, 22 nt, Human
auuguuaaaguaauaaccaugg

SEQ ID NO: 560674 - RNA, 22 nt, Human
ccuccaggauaagucagggccu

SEQ ID NO: 560675 - RNA, 22 nt, Human
acuggcucagaguuccuagaga

SEQ ID NO: 560676 - RNA, 22 nt, Human
gcugugcagccaagugccucug

SEQ ID NO: 560677 - RNA, 21 nt, Human
uggcucaguugcugggcacag

SEQ ID NO: 560678 - RNA, 22 nt, Human
agggucagagucaggugcagua

SEQ ID NO: 560679 - RNA, 22 nt, Human
uggcucagugaagagauaacuu

SEQ ID NO: 560680 - RNA, 22 nt, Human
uuucuucuugauuuaaacaggg

SEQ ID NO: 560681 - RNA, 22 nt, Human
uagaauguaaauuccaagggca

SEQ ID NO: 560682 - RNA, 22 nt, Human
cagaccuggaaaacaggcuugc

SEQ ID NO: 560683 - RNA, 22 nt, Human
uauucacaggcuggagugaugu

SEQ ID NO: 560684 - RNA, 20 nt, Human
ugggcugaggaucaggugcc

SEQ ID NO: 560685 - RNA, 22 nt, Human
ucagaagacuacuaggacacau

SEQ ID NO: 560686 - RNA, 22 nt, Human
uaaauuaaagauuggagaagga

SEQ ID NO: 560687 - RNA, 22 nt, Human
aaguuugagagccuuuaguaua

SEQ ID NO: 560688 - RNA, 21 nt, Human
gggcagcacgucauuccugug

SEQ ID NO: 560689 - RNA, 22 nt, Human
agaagcagcuuucaaggugauu

SEQ ID NO: 560690 - RNA, 19 nt, Human
accugcaguaauaauuccu

SEQ ID NO: 560691 - RNA, 22 nt, Human
ugcagcucauugguguccuggu

SEQ ID NO: 560692 - RNA, 22 nt, Human
uaaugcaacgugagauaauuaa

SEQ ID NO: 560693 - RNA, 21 nt, Human
aaaaggaggcaggugaacagc

SEQ ID NO: 560694 - RNA, 22 nt, Human
gccugcuucucagucagcuugg

SEQ ID NO: 560695 - RNA, 22 nt, Human
ggucagccuuggauuugguagc

SEQ ID NO: 560696 - RNA, 22 nt, Human
ugaaaaacuuuaauccauaaag

SEQ ID NO: 560697 - RNA, 22 nt, Human
acaauguaggauauguacuugu

SEQ ID NO: 560698 - RNA, 22 nt, Human
uuucaauguaacauuuccaggc

SEQ ID NO: 560699 - RNA, 22 nt, Human
cagguuggggacuuaggaugac

SEQ ID NO: 560700 - RNA, 22 nt, Human
uacauagcaaggaaaugacaga

SEQ ID NO: 560701 - RNA, 22 nt, Human
uccaaagggaagcgcuuucugu

SEQ ID NO: 560702 - RNA, 22 nt, Human
gaccagguccaaagcuacuguc

SEQ ID NO: 560703 - RNA, 22 nt, Human
guugaaugaaucauucuaugua

SEQ ID NO: 560704 - RNA, 22 nt, Human
ucuucauacaauuucagacauc

SEQ ID NO: 560705 - RNA, 22 nt, Human
cccugagaugccucacccuagu

SEQ ID NO: 560706 - RNA, 22 nt, Human
uccugagaugagacagugcugc

SEQ ID NO: 560707 - RNA, 22 nt, Human
cacuauuuuucacuuaggcuua

SEQ ID NO: 560708 - RNA, 22 nt, Human
ucugccuucgcugcucccugaa

SEQ ID NO: 560709 - RNA, 22 nt, Human
uaaggccaaggggccauagucu

SEQ ID NO: 560710 - RNA, 22 nt, Human
ucucagagaaaugugucaccau

SEQ ID NO: 560711 - RNA, 22 nt, Human
uauuuuaaagugaagggucuug

SEQ ID NO: 560712 - RNA, 22 nt, Human
uagggcuauucugaguaauaau

SEQ ID NO: 560713 - RNA, 22 nt, Human
aguggccagugcugcucugggg

SEQ ID NO: 560714 - RNA, 22 nt, Human
caaaauuagggagugagcugga

SEQ ID NO: 560715 - RNA, 22 nt, Human
aguuuacaacaguagcuaugga

SEQ ID NO: 560716 - RNA, 22 nt, Human
ggccuugagagccagugcaggc

SEQ ID NO: 560717 - RNA, 22 nt, Human
uacacacuuacuggagaugaag

SEQ ID NO: 560718 - RNA, 22 nt, Human
uuguaaagcuuugagacuacau

SEQ ID NO: 560719 - RNA, 22 nt, Human
aaagcucuuuuccaaguauuga

SEQ ID NO: 560720 - RNA, 22 nt, Human
ugcauccuuaaccagcaucacu

SEQ ID NO: 560721 - RNA, 22 nt, Human
acagaaaaugccagaagggugg

SEQ ID NO: 560722 - RNA, 22 nt, Human
auuauuagauucuuaauuguaa

SEQ ID NO: 560723 - RNA, 22 nt, Human
ugagccugguugcagugucugg

SEQ ID NO: 560724 - RNA, 22 nt, Human
aggcaggugcuuaugacuugcu

SEQ ID NO: 560725 - RNA, 22 nt, Human
uaacaacuggacaauguugcuc

SEQ ID NO: 560726 - RNA, 22 nt, Human
cuguauaucaugguuuugcagu

SEQ ID NO: 560727 - RNA, 22 nt, Human
gucagcagugucagcucugggg

SEQ ID NO: 560728 - RNA, 22 nt, Human
gagcagcuggacaggccucccu

SEQ ID NO: 560729 - RNA, 22 nt, Human
ucuuuguaagacauguaagucc

SEQ ID NO: 560730 - RNA, 21 nt, Human
uuuucccacugaaagcuccca

SEQ ID NO: 560731 - RNA, 22 nt, Human
uguguacauaucuauccuagau

SEQ ID NO: 560732 - RNA, 22 nt, Human
gaggcccaguccugcaagcacg

SEQ ID NO: 560733 - RNA, 22 nt, Human
ucaaggagcccacagucuaaug

SEQ ID NO: 560734 - RNA, 22 nt, Human
uacuacaaggccgaagcucuca

SEQ ID NO: 560735 - RNA, 22 nt, Human
gaaaagggcaagagagagggca

SEQ ID NO: 560736 - RNA, 22 nt, Human
guucuccauucagcuuccugug

SEQ ID NO: 560737 - RNA, 22 nt, Human
agcccuuaguacauuucucaag

SEQ ID NO: 560738 - RNA, 22 nt, Human
gagauucuguagucaggcaucu

SEQ ID NO: 560739 - RNA, 22 nt, Human
uccuggaguugugcagugcaca

SEQ ID NO: 560740 - RNA, 22 nt, Human
aagccacugagauuucacugca

SEQ ID NO: 560741 - RNA, 22 nt, Human
uauuuagaacagacaauagaaa

SEQ ID NO: 560742 - RNA, 19 nt, Human
ccagagcccgccagauggg

SEQ ID NO: 560743 - RNA, 22 nt, Human
cagcaauaguguguuuguuuca

SEQ ID NO: 560744 - RNA, 22 nt, Human
auaaagauuucuuuuucucuac

SEQ ID NO: 560745 - RNA, 22 nt, Human
uuuuguguagagauggggucuu

SEQ ID NO: 560746 - RNA, 22 nt, Human
augaggcauuccacucaaacuc

SEQ ID NO: 560747 - RNA, 22 nt, Human
acagucuugagcaucagccaga

SEQ ID NO: 560748 - RNA, 22 nt, Human
ugcaaggugcuuuuugguguca

SEQ ID NO: 560749 - RNA, 22 nt, Human
uguuugcauuaauuagaaggua

SEQ ID NO: 560750 - RNA, 22 nt, Human
cuccaggccagggaaguggaca

SEQ ID NO: 560751 - RNA, 22 nt, Human
cuguguagccucaugugggcuu

SEQ ID NO: 560752 - RNA, 22 nt, Human
ugcucugguccucccucggcgc

SEQ ID NO: 560753 - RNA, 22 nt, Human
uucauguuuugagccauucuga

SEQ ID NO: 560754 - RNA, 22 nt, Human
uucauuccuucuguaccuugcc

SEQ ID NO: 560755 - RNA, 21 nt, Human
cauuucaugauuauagaaaug

SEQ ID NO: 560756 - RNA, 22 nt, Human
uuugcuauuuuucugugcagcu

SEQ ID NO: 560757 - RNA, 22 nt, Human
uaacacauauuucaagaguagu

SEQ ID NO: 560758 - RNA, 22 nt, Human
ucugucuccugccagugccucu

SEQ ID NO: 560759 - RNA, 22 nt, Human
cuuaauuuaagccuagaaugca

SEQ ID NO: 560760 - RNA, 21 nt, Human
aagagcuggaucaaggauaag

SEQ ID NO: 560761 - RNA, 22 nt, Human
caggaugguggcaugaucagaa

SEQ ID NO: 560762 - RNA, 22 nt, Human
ucuuuuuuuccugugcagagcu

SEQ ID NO: 560763 - RNA, 22 nt, Human
cucucagacacccauuuggaaa

SEQ ID NO: 560764 - RNA, 22 nt, Human
aucagaauagugggggacaguc

SEQ ID NO: 560765 - RNA, 22 nt, Human
cagucucuuuauccaccaagcc

SEQ ID NO: 560766 - RNA, 22 nt, Human
cugccagcucaaagcgcagcua

SEQ ID NO: 560767 - RNA, 23 nt, Human
cucugcaggagagugggcagggc

SEQ ID NO: 560768 - RNA, 22 nt, Human
agagccacggcaggccuaggaa

SEQ ID NO: 560769 - RNA, 22 nt, Human
aggcccugaagucggccccuca

SEQ ID NO: 560770 - RNA, 22 nt, Human
ucaaacuguuuacagugagaua

SEQ ID NO: 560771 - RNA, 18 nt, Human
acccucuggcuucugagc

SEQ ID NO: 560772 - RNA, 22 nt, Human
cagaguggcgacccccucagcu

SEQ ID NO: 560773 - RNA, 22 nt, Human
uccucuacucgcuugcccuuug

SEQ ID NO: 560774 - RNA, 22 nt, Human
uggcagaguggaccauacucaa

SEQ ID NO: 560775 - RNA, 22 nt, Human
uggacccuacccggcccucggc

SEQ ID NO: 560776 - RNA, 22 nt, Human
cagagggcucaguccugcugga

SEQ ID NO: 560777 - RNA, 22 nt, Human
gucagcugucuccccagagugg

SEQ ID NO: 560778 - RNA, 22 nt, Human
uccugggcugcagggaagagca

SEQ ID NO: 560779 - RNA, 22 nt, Human
gagacauggcaaaagcacuggu

SEQ ID NO: 560780 - RNA, 22 nt, Human
gaagcagcagcuggggacaguu

SEQ ID NO: 560781 - RNA, 22 nt, Human
agccucucuccagcuuggcaga

SEQ ID NO: 560782 - RNA, 22 nt, Human
cauuucugcagaauugcucuuc

SEQ ID NO: 560783 - RNA, 23 nt, Human
ucugagugauuagccucuggggu

SEQ ID NO: 560784 - RNA, 22 nt, Human
uuucuuauauucugucauuguu

SEQ ID NO: 560785 - RNA, 22 nt, Human
ccuggggaagucacuucucuuu

SEQ ID NO: 560786 - RNA, 18 nt, Human
cugucaccgccaccacac

SEQ ID NO: 560787 - RNA, 22 nt, Human
ugcaggcuuggaucacaucucc

SEQ ID NO: 560788 - RNA, 22 nt, Human
uaaaaucgcacugcuguuguua

SEQ ID NO: 560789 - RNA, 22 nt, Human
guuucuuauuugcagguugcuu

SEQ ID NO: 560790 - RNA, 20 nt, Human
uccagcugucuuucagagac

SEQ ID NO: 560791 - RNA, 22 nt, Human
aggagaguaccauugggccgca

SEQ ID NO: 560792 - RNA, 22 nt, Human
uaggaaccuugaucuuggauuu

SEQ ID NO: 560793 - RNA, 21 nt, Human
ugaggccugccagucucagaa

SEQ ID NO: 560794 - RNA, 22 nt, Human
ccagguggaggugugagguccu

SEQ ID NO: 560795 - RNA, 22 nt, Human
aucuccagaggagucauggucu

SEQ ID NO: 560796 - RNA, 22 nt, Human
uuccauaauuaaguggagagaa

SEQ ID NO: 560797 - RNA, 22 nt, Human
ucagcugccucucccuggaaga

SEQ ID NO: 560798 - RNA, 22 nt, Human
aggcugccucgugagcucgcug

SEQ ID NO: 560799 - RNA, 22 nt, Human
agagccaggaaguggcgugggg

SEQ ID NO: 560800 - RNA, 22 nt, Human
aaacucuagggcuccacauucc

SEQ ID NO: 560801 - RNA, 22 nt, Human
ucccaggagcaccuuuugagcc

SEQ ID NO: 560802 - RNA, 22 nt, Human
uuuaauuuuccucuuccuggag

SEQ ID NO: 560803 - RNA, 22 nt, Human
agggcugagacuaaggccagau

SEQ ID NO: 560804 - RNA, 22 nt, Human
ggcuggcaggggaugucagaug

SEQ ID NO: 560805 - RNA, 22 nt, Human
agcugaagaaaugggaagcauu

SEQ ID NO: 560806 - RNA, 22 nt, Human
aacuuuuacaaauugucaucau

SEQ ID NO: 560807 - RNA, 22 nt, Human
uauguacaguccuuaacuuaaa

SEQ ID NO: 560808 - RNA, 22 nt, Human
uggcucugcaccucaguguacc

SEQ ID NO: 560809 - RNA, 22 nt, Human
agagcagguggcaacucuggga

SEQ ID NO: 560810 - RNA, 22 nt, Human
uuucaaacuuuacucuugaauc

SEQ ID NO: 560811 - RNA, 21 nt, Human
gccucuccaaauccugccuuc

SEQ ID NO: 560812 - RNA, 22 nt, Human
acucagcuugcacacaucaaug

SEQ ID NO: 560813 - RNA, 22 nt, Human
ucucauucauccaaggauuuau

SEQ ID NO: 560814 - RNA, 22 nt, Human
augggcugcuuggcuuccaccc

SEQ ID NO: 560815 - RNA, 22 nt, Human
cucugguucagggcucccuggc

SEQ ID NO: 560816 - RNA, 22 nt, Human
auugaaagguuuugagcagaua

SEQ ID NO: 560817 - RNA, 22 nt, Human
aacauugaaauauuugcaauag

SEQ ID NO: 560818 - RNA, 22 nt, Human
gcugcaggcauuuuccugggca

SEQ ID NO: 560819 - RNA, 22 nt, Human
uuccaugugaguacacugugau

SEQ ID NO: 560820 - RNA, 22 nt, Human
uuggagguuugaaaauaugugu

SEQ ID NO: 560821 - RNA, 23 nt, Human
aguaacaugcaaauaacagucug

SEQ ID NO: 560822 - RNA, 22 nt, Human
gcuggcaggguucucacugaaa

SEQ ID NO: 560823 - RNA, 22 nt, Human
ucucacugcaaauauuauguau

SEQ ID NO: 560824 - RNA, 18 nt, Human
agccagguggaauggaac

SEQ ID NO: 560825 - RNA, 22 nt, Human
cuacauaaauuuaucacagacu

SEQ ID NO: 560826 - RNA, 22 nt, Human
ugccugggagugaccaagacuc

SEQ ID NO: 560827 - RNA, 22 nt, Human
agguaauaggguucagaauuau

SEQ ID NO: 560828 - RNA, 22 nt, Human
ucagacaggccucuccagccuc

SEQ ID NO: 560829 - RNA, 22 nt, Human
auucacaguuacugcugaacca

SEQ ID NO: 560830 - RNA, 22 nt, Human
cccagccaaggugcugguguug

SEQ ID NO: 560831 - RNA, 21 nt, Human
ugcugaaucugccauauuuuc

SEQ ID NO: 560832 - RNA, 22 nt, Human
cuguccccgcgaguccagagcu

SEQ ID NO: 560833 - RNA, 22 nt, Human
caggucuuuucuacugguggag

SEQ ID NO: 560834 - RNA, 22 nt, Human
aucaaaguaggcauauguuuuu

SEQ ID NO: 560835 - RNA, 22 nt, Human
acugaaaaaguaugauucacug

SEQ ID NO: 560836 - RNA, 22 nt, Human
gaaaucugcggugaggccugag

SEQ ID NO: 560837 - RNA, 22 nt, Human
gggcacagagaagguuuuagug

SEQ ID NO: 560838 - RNA, 22 nt, Human
uccugagauaaaucucauguga

SEQ ID NO: 560839 - RNA, 22 nt, Human
gacauuuagguagcuuccaguu

SEQ ID NO: 560840 - RNA, 22 nt, Human
accugcagcugagaaaaugacu

SEQ ID NO: 560841 - RNA, 22 nt, Human
ccauuuuauuagugacauuuag

SEQ ID NO: 560842 - RNA, 22 nt, Human
agggcagagaucugagugggca

SEQ ID NO: 560843 - RNA, 22 nt, Human
agagaacacgugcaucugcaau

SEQ ID NO: 560844 - RNA, 22 nt, Human
ucccagggacugggcuaggcuu

SEQ ID NO: 560845 - RNA, 19 nt, Human
ggcagaagguguaggggga

SEQ ID NO: 560846 - RNA, 22 nt, Human
cagaggcucuuccucacugccc

SEQ ID NO: 560847 - RNA, 22 nt, Human
acaagagucugcauuucuaaca

SEQ ID NO: 560848 - RNA, 22 nt, Human
uuucaugcucauggaacacagc

SEQ ID NO: 560849 - RNA, 22 nt, Human
uacuguuuuuuagacucauggu

SEQ ID NO: 560850 - RNA, 22 nt, Human
agcaggaguguccccuggcugu

SEQ ID NO: 560851 - RNA, 22 nt, Human
ggcucuggcguccaauggagcg

SEQ ID NO: 560852 - RNA, 22 nt, Human
ugagguggcuagggaggcacuc

SEQ ID NO: 560853 - RNA, 22 nt, Human
ccaggagucaauaaaggaagcu

SEQ ID NO: 560854 - RNA, 22 nt, Human
cuccugguucagagagcugaga

SEQ ID NO: 560855 - RNA, 22 nt, Human
aacacuuuuuauauauuguauc

SEQ ID NO: 560856 - RNA, 22 nt, Human
ggagguggcagggaacauaauu

SEQ ID NO: 560857 - RNA, 22 nt, Human
gagcugccggcccacaguacua

SEQ ID NO: 560858 - RNA, 21 nt, Human
aggcacuuaaccaauguuagc

SEQ ID NO: 560859 - RNA, 22 nt, Human
gaggcugagaguuuguucuacu

SEQ ID NO: 560860 - RNA, 22 nt, Human
aacuuucuaauuuuggcugagc

SEQ ID NO: 560861 - RNA, 22 nt, Human
gggacagacccaugggccaggu

SEQ ID NO: 560862 - RNA, 22 nt, Human
uucugaugaggaggucucuaag

SEQ ID NO: 560863 - RNA, 22 nt, Human
cagcccagcagggucuggcccu

SEQ ID NO: 560864 - RNA, 22 nt, Human
guauaucagacacucauaugua

SEQ ID NO: 560865 - RNA, 22 nt, Human
gggaagcagcauugugcuggcu

SEQ ID NO: 560866 - RNA, 22 nt, Human
gaggggcucuuuaauaguaaca

SEQ ID NO: 560867 - RNA, 22 nt, Human
cucaacauaugacuuugguggg

SEQ ID NO: 560868 - RNA, 22 nt, Human
acacauuuaaaaaggaacauau

SEQ ID NO: 560869 - RNA, 22 nt, Human
uccuugaagaaugauucuugga

SEQ ID NO: 560870 - RNA, 22 nt, Human
gcaggccuuggcaaugagccug

SEQ ID NO: 560871 - RNA, 22 nt, Human
ugcccugucuaagcugucagua

SEQ ID NO: 560872 - RNA, 22 nt, Human
uaugcacaccuggguccuuguc

SEQ ID NO: 560873 - RNA, 22 nt, Human
acagugauuuuuucgagcagaa

SEQ ID NO: 560874 - RNA, 22 nt, Human
cauugcacaucugagaagagau

SEQ ID NO: 560875 - RNA, 22 nt, Human
ugagggaggcccuuugagcaga

SEQ ID NO: 560876 - RNA, 22 nt, Human
cagaggaggccaccgcauaggc

SEQ ID NO: 560877 - RNA, 20 nt, Human
ccuccaggcacacccaugug

SEQ ID NO: 560878 - RNA, 22 nt, Human
aaacuacugaugccugggcccu

SEQ ID NO: 560879 - RNA, 22 nt, Human
acaaagucacaauaauuaaccu

SEQ ID NO: 560880 - RNA, 22 nt, Human
gccuggaggaauguagcugagg

SEQ ID NO: 560881 - RNA, 22 nt, Human
acagccugagaguggagcuggc

SEQ ID NO: 560882 - RNA, 22 nt, Human
ccugggcuguaccugugcgcgg

SEQ ID NO: 560883 - RNA, 22 nt, Human
auggcagccuguggacagucaa

SEQ ID NO: 560884 - RNA, 22 nt, Human
ugcuuuauggauuuguguccug

SEQ ID NO: 560885 - RNA, 22 nt, Human
uaccaaaaccaagccauuaucu

SEQ ID NO: 560886 - RNA, 22 nt, Human
gccugaugagcuuccagcugag

SEQ ID NO: 560887 - RNA, 22 nt, Human
cuccagugagcgcggggcaugg

SEQ ID NO: 560888 - RNA, 22 nt, Human
ugaggaagccaaacagcuacac

SEQ ID NO: 560889 - RNA, 22 nt, Human
cauuuguuaauuacuauuaucu

SEQ ID NO: 560890 - RNA, 22 nt, Human
gaguccaggcucagaaacccgu

SEQ ID NO: 560891 - RNA, 22 nt, Human
uggugcagucauuggcccaggg

SEQ ID NO: 560892 - RNA, 22 nt, Human
guucucucugcuuccaagaugg

SEQ ID NO: 560893 - RNA, 22 nt, Human
ucaacacuauccaggcaaucuu

SEQ ID NO: 560894 - RNA, 22 nt, Human
ugccuuggugcuucuucaugug

SEQ ID NO: 560895 - RNA, 22 nt, Human
gcaaugauauugaagugaugaa

SEQ ID NO: 560896 - RNA, 22 nt, Human
gugugccagacaugaugcuaug

SEQ ID NO: 560897 - RNA, 22 nt, Human
ugugaaaugaguauauuugaau

SEQ ID NO: 560898 - RNA, 22 nt, Human
aagagcuggucacagguccauu

SEQ ID NO: 560899 - RNA, 22 nt, Human
ggcugaggcucaugccaucuug

SEQ ID NO: 560900 - RNA, 19 nt, Human
ggggccugugauggucaca

SEQ ID NO: 560901 - RNA, 22 nt, Human
aauguaaacagcaagagaaggg

SEQ ID NO: 560902 - RNA, 22 nt, Human
uugucaaguaaggcugacauuu

SEQ ID NO: 560903 - RNA, 22 nt, Human
caggugggcugccucuccagcu

SEQ ID NO: 560904 - RNA, 22 nt, Human
ugcuucugggucccagccuggc

SEQ ID NO: 560905 - RNA, 22 nt, Human
uugccagugccagcccaggcag

SEQ ID NO: 560906 - RNA, 22 nt, Human
gguuucaacuuuugugaggaau

SEQ ID NO: 560907 - RNA, 22 nt, Human
aauacugcugccugcaaauuau

SEQ ID NO: 560908 - RNA, 22 nt, Human
acagauuuuauuauucagguau

SEQ ID NO: 560909 - RNA, 22 nt, Human
aaauaugauacucccuuuuagu

SEQ ID NO: 560910 - RNA, 22 nt, Human
acuucaugcagaagagagcugu

SEQ ID NO: 560911 - RNA, 22 nt, Human
uacaaacuguuauuauuauugu

SEQ ID NO: 560912 - RNA, 22 nt, Human
augauacaucuucaugucagug

SEQ ID NO: 560913 - RNA, 22 nt, Human
uuuaaauucugucugccgcuua

SEQ ID NO: 560914 - RNA, 22 nt, Human
aaagaugucauacacauuaaga

SEQ ID NO: 560915 - RNA, 22 nt, Human
ggagagcugacaucaugauguu

SEQ ID NO: 560916 - RNA, 22 nt, Human
uagagcuagcuucaaaaugcga

SEQ ID NO: 560917 - RNA, 22 nt, Human
uuugugugcgucuggccugggg

SEQ ID NO: 560918 - RNA, 22 nt, Human
uugauuucaaaauauaugcuug

SEQ ID NO: 560919 - RNA, 22 nt, Human
uccaugggaagauuuugagugg

SEQ ID NO: 560920 - RNA, 22 nt, Human
guauuauucucagcuuugggau

SEQ ID NO: 560921 - RNA, 22 nt, Human
ucucccaagccuggcaggggca

SEQ ID NO: 560922 - RNA, 22 nt, Human
ggaaagauuugucacaugaaug

SEQ ID NO: 560923 - RNA, 22 nt, Human
uuucuuuugcccuguggguuag

SEQ ID NO: 560924 - RNA, 22 nt, Human
augcacuugcguguuugcaaau

SEQ ID NO: 560925 - RNA, 22 nt, Human
auuuccugaucuguaaaauagc

SEQ ID NO: 560926 - RNA, 18 nt, Human
ggaaaaggagugucuagc

SEQ ID NO: 560927 - RNA, 22 nt, Human
gccugaagaacagcugugagga

SEQ ID NO: 560928 - RNA, 22 nt, Human
acauuuuuacugggcaucugca

SEQ ID NO: 560929 - RNA, 22 nt, Human
agagguggagcucuuggcauca

SEQ ID NO: 560930 - RNA, 22 nt, Human
gucugcccggccuuccuccacc

SEQ ID NO: 560931 - RNA, 22 nt, Human
uggcuggcuguccagcugggca

SEQ ID NO: 560932 - RNA, 20 nt, Human
ggcaggugcucgcuuggucu

SEQ ID NO: 560933 - RNA, 22 nt, Human
ucagccauggugagagugagag

SEQ ID NO: 560934 - RNA, 22 nt, Human
ccagaagagaucacaguucuug

SEQ ID NO: 560935 - RNA, 22 nt, Human
uggggcuagaauccugcaggaa

SEQ ID NO: 560936 - RNA, 22 nt, Human
gugggguagaucuuucucagga

SEQ ID NO: 560937 - RNA, 22 nt, Human
aggcuggaguacaguggcuauu

SEQ ID NO: 560938 - RNA, 22 nt, Human
acaggugauucaggcucuggga

SEQ ID NO: 560939 - RNA, 22 nt, Human
aagggcuguaagccaaguaaag

SEQ ID NO: 560940 - RNA, 22 nt, Human
uuguaaagcugauuagaaagcc

SEQ ID NO: 560941 - RNA, 22 nt, Human
gucugcccugcagacaugccuc

SEQ ID NO: 560942 - RNA, 22 nt, Human
gagauggcccuggcauguagcu

SEQ ID NO: 560943 - RNA, 22 nt, Human
cuguguccucccgcugcaccca

SEQ ID NO: 560944 - RNA, 22 nt, Human
gcuguucauuagaaauagaaug

SEQ ID NO: 560945 - RNA, 22 nt, Human
uuguacacaauucuuaacauac

SEQ ID NO: 560946 - RNA, 22 nt, Human
cacaggagauugaucuauuggu

SEQ ID NO: 560947 - RNA, 22 nt, Human
ccagucacuggaaaaugggaau

SEQ ID NO: 560948 - RNA, 22 nt, Human
ugauugauggaggugauuuacc

SEQ ID NO: 560949 - RNA, 22 nt, Human
agaauuagaggccauguacuug

SEQ ID NO: 560950 - RNA, 22 nt, Human
cccaugccuucugacucacagg

SEQ ID NO: 560951 - RNA, 22 nt, Human
gcucagagaugucugcugccuu

SEQ ID NO: 560952 - RNA, 22 nt, Human
agggaauucacuggaacgcccu

SEQ ID NO: 560953 - RNA, 22 nt, Human
gacccaggguuucugcacaggg

SEQ ID NO: 560954 - RNA, 22 nt, Human
aagcacagaaaaggagcaugga

SEQ ID NO: 560955 - RNA, 22 nt, Human
ugccugccaugcagaaagcuga

SEQ ID NO: 560956 - RNA, 22 nt, Human
ccagauagaaaagaaggcagga

SEQ ID NO: 560957 - RNA, 18 nt, Human
gguggcucagucaugggg

SEQ ID NO: 560958 - RNA, 19 nt, Human
aagcuccagcagauccuuu

SEQ ID NO: 560959 - RNA, 22 nt, Human
ggcuucugguaaagaccacacc

SEQ ID NO: 560960 - RNA, 22 nt, Human
uggcagcagacaaaaggccauu

SEQ ID NO: 560961 - RNA, 22 nt, Human
cacuuuuaacaggagaauuccc

SEQ ID NO: 560962 - RNA, 22 nt, Human
cagcugccccgcuggcugacca

SEQ ID NO: 560963 - RNA, 22 nt, Human
ggcaggcugcuugggucauguc

SEQ ID NO: 560964 - RNA, 22 nt, Human
cauauacuuuucuauagcuuuc

SEQ ID NO: 560965 - RNA, 22 nt, Human
gugcauuucucauacacuaaau

SEQ ID NO: 560966 - RNA, 22 nt, Human
cagaugaggggcauauaacaau

SEQ ID NO: 560967 - RNA, 22 nt, Human
acacacuggcccccaguacuga

SEQ ID NO: 560968 - RNA, 22 nt, Human
cucagccccaauucuccccauu

SEQ ID NO: 560969 - RNA, 22 nt, Human
cccucaggagaugucagcugga

SEQ ID NO: 560970 - RNA, 22 nt, Human
agucucugggcaugguugugac

SEQ ID NO: 560971 - RNA, 22 nt, Human
ucaguggauuggaugagaucug

SEQ ID NO: 560972 - RNA, 22 nt, Human
agcaggcugccuuccaaagccu

SEQ ID NO: 560973 - RNA, 22 nt, Human
auacaucuugucagauucaugu

SEQ ID NO: 560974 - RNA, 22 nt, Human
caacuauagggagagugguuaa

SEQ ID NO: 560975 - RNA, 22 nt, Human
cucccuggcagccgcacuccug

SEQ ID NO: 560976 - RNA, 22 nt, Human
gaucaauacuauuaagaucaua

SEQ ID NO: 560977 - RNA, 22 nt, Human
ucacacauuucucaaguguagg

SEQ ID NO: 560978 - RNA, 22 nt, Human
gaaaccucuuagccucucuuug

SEQ ID NO: 560979 - RNA, 22 nt, Human
uggcucagcuuacuuuugaggg

SEQ ID NO: 560980 - RNA, 22 nt, Human
ugcaugcauguuuuuacccaca

SEQ ID NO: 560981 - RNA, 21 nt, Human
gacaggggaagaagcaaggag

SEQ ID NO: 560982 - RNA, 22 nt, Human
agggagaaugaccaagguauau

SEQ ID NO: 560983 - RNA, 22 nt, Human
uucaggauggaguaccuuuuau

SEQ ID NO: 560984 - RNA, 22 nt, Human
cuuccucacggugcaacaggaa

SEQ ID NO: 560985 - RNA, 22 nt, Human
cauuuagacauuugauuugggg

SEQ ID NO: 560986 - RNA, 22 nt, Human
gaggggcuggguagggcaaccc

SEQ ID NO: 560987 - RNA, 22 nt, Human
agcacacaguauuagccauugu

SEQ ID NO: 560988 - RNA, 22 nt, Human
ucucccaaggcacagaaagagu

SEQ ID NO: 560989 - RNA, 22 nt, Human
aaucaagaggcgauggauggaa

SEQ ID NO: 560990 - RNA, 22 nt, Human
agcugugguucugggcagcgac

SEQ ID NO: 560991 - RNA, 22 nt, Human
uaaguucagaguucucauuugu

SEQ ID NO: 560992 - RNA, 22 nt, Human
ggacagagcccugguggccuaa

SEQ ID NO: 560993 - RNA, 22 nt, Human
ccaaggaguagagcaggaagcu

SEQ ID NO: 560994 - RNA, 22 nt, Human
uugcugaaaucuaugacauccu

SEQ ID NO: 560995 - RNA, 22 nt, Human
aaggcacuuuucuaaagaccuu

SEQ ID NO: 560996 - RNA, 22 nt, Human
ucucagagaacaguuggugcuu

SEQ ID NO: 560997 - RNA, 22 nt, Human
uccugcagugugucuccugcac

SEQ ID NO: 560998 - RNA, 22 nt, Human
gccuggcaguugacaguuugcu

SEQ ID NO: 560999 - RNA, 22 nt, Human
ucuuaugggaaagauguaauua

SEQ ID NO: 561000 - RNA, 22 nt, Human
ccagaggagggcucugaugagg

SEQ ID NO: 561001 - RNA, 22 nt, Human
agagcuggcugguagcccugau

SEQ ID NO: 561002 - RNA, 22 nt, Human
gccucugcugcaagccugguug

SEQ ID NO: 561003 - RNA, 22 nt, Human
aacaguuuaugagauaugcuau

SEQ ID NO: 561004 - RNA, 21 nt, Human
agaauuaaauuggauuugugu

SEQ ID NO: 561005 - RNA, 22 nt, Human
cccugcacacucgugucuugac

SEQ ID NO: 561006 - RNA, 22 nt, Human
uuucauuauucaugcuaguuau

SEQ ID NO: 561007 - RNA, 22 nt, Human
gugggcuccccuggcaugucca

SEQ ID NO: 561008 - RNA, 22 nt, Human
gaggagaaugcgcaccacauau

SEQ ID NO: 561009 - RNA, 22 nt, Human
aagcagagaaaagcuuagguuc

SEQ ID NO: 561010 - RNA, 22 nt, Human
agggaaaggcugaugcuguggg

SEQ ID NO: 561011 - RNA, 22 nt, Human
ggccucugccucaucugggcac

SEQ ID NO: 561012 - RNA, 22 nt, Human
aaaucaguaaauguucauuaac

SEQ ID NO: 561013 - RNA, 22 nt, Human
gacagccucaugaggagcaaaa

SEQ ID NO: 561014 - RNA, 22 nt, Human
agguuauaugucauacugaagu

SEQ ID NO: 561015 - RNA, 22 nt, Human
cuguuuguuggcuauugacagu

SEQ ID NO: 561016 - RNA, 22 nt, Human
ucacagacgccuccccucgccu

SEQ ID NO: 561017 - RNA, 22 nt, Human
cuugaauccaaaugggagauga

SEQ ID NO: 561018 - RNA, 22 nt, Human
auggaguucugccagcgcugcu

SEQ ID NO: 561019 - RNA, 22 nt, Human
uuauguacaauguuaauguaaa

SEQ ID NO: 561020 - RNA, 22 nt, Human
cacugcccagcgucuuaggcac

SEQ ID NO: 561021 - RNA, 22 nt, Human
gcugagggcagccuccuagguc

SEQ ID NO: 561022 - RNA, 22 nt, Human
aaagccacugcauguguaguau

SEQ ID NO: 561023 - RNA, 22 nt, Human
aacugcuugagauauguuuguc

SEQ ID NO: 561024 - RNA, 22 nt, Human
uagcagugccaggauuuugcug

SEQ ID NO: 561025 - RNA, 22 nt, Human
ucuuuccuuagaauaauucuuu

SEQ ID NO: 561026 - RNA, 20 nt, Human
aagauucauuguaauuaggg

SEQ ID NO: 561027 - RNA, 22 nt, Human
agugaaagguugagaauauucu

SEQ ID NO: 561028 - RNA, 22 nt, Human
cuguugauuagaauuucacauc

SEQ ID NO: 561029 - RNA, 22 nt, Human
aucuagcaguguuauaauugga

SEQ ID NO: 561030 - RNA, 21 nt, Human
gguggccuuggugagagaccu

SEQ ID NO: 561031 - RNA, 22 nt, Human
cacaauuuccaagucauguuau

SEQ ID NO: 561032 - RNA, 22 nt, Human
ucagaggaggcauuuaaacaga

SEQ ID NO: 561033 - RNA, 22 nt, Human
agucucuuaauuuuuucuaagu

SEQ ID NO: 561034 - RNA, 22 nt, Human
aagcuagaugacguuauuuuuu

SEQ ID NO: 561035 - RNA, 22 nt, Human
gacauuuauuagaaaacuauca

SEQ ID NO: 561036 - RNA, 22 nt, Human
gaggcugaggguuagagaguca

SEQ ID NO: 561037 - RNA, 22 nt, Human
uaaggcauucucaugcugugaa

SEQ ID NO: 561038 - RNA, 22 nt, Human
ugugggcucccccucacucugu

SEQ ID NO: 561039 - RNA, 22 nt, Human
cucuuuccucagccacagucua

SEQ ID NO: 561040 - RNA, 22 nt, Human
ugggcagaauugugguaguuaa

SEQ ID NO: 561041 - RNA, 22 nt, Human
ccugggcaggccggacgcuggg

SEQ ID NO: 561042 - RNA, 22 nt, Human
caccaggcuggagugcagaggu

SEQ ID NO: 561043 - RNA, 22 nt, Human
uggagccauaacccuuucguac

SEQ ID NO: 561044 - RNA, 22 nt, Human
augauuuccaguuguugcuaag

SEQ ID NO: 561045 - RNA, 22 nt, Human
aaggugucggcagagccgcuuc

SEQ ID NO: 561046 - RNA, 23 nt, Human
ugaguguguucccugugagauuu

SEQ ID NO: 561047 - RNA, 22 nt, Human
caguuacauaaaugauaaaaug

SEQ ID NO: 561048 - RNA, 22 nt, Human
uccuguggagaggacuggaggu

SEQ ID NO: 561049 - RNA, 22 nt, Human
uuugaacuucuccauucugaug

SEQ ID NO: 561050 - RNA, 22 nt, Human
cuuugaaaggaagccacacagc

SEQ ID NO: 561051 - RNA, 22 nt, Human
cuccaggagcugugucuuucuu

SEQ ID NO: 561052 - RNA, 22 nt, Human
aaaguguugggaagaaagugca

SEQ ID NO: 561053 - RNA, 22 nt, Human
agauguuuuggagacacuaacc

SEQ ID NO: 561054 - RNA, 22 nt, Human
cagugaguaaguagacagcuua

SEQ ID NO: 561055 - RNA, 22 nt, Human
gagcugcacaucugaggcuaau

SEQ ID NO: 561056 - RNA, 19 nt, Human
ucuggcuccugccaggcug

SEQ ID NO: 561057 - RNA, 22 nt, Human
gacauuucaaucucauuauggg

SEQ ID NO: 561058 - RNA, 22 nt, Human
uggucuucuuuguugcuauuau

SEQ ID NO: 561059 - RNA, 22 nt, Human
cagggccuccccggcagucuuu

SEQ ID NO: 561060 - RNA, 22 nt, Human
gaggcagcaauaaaaagaauuu

SEQ ID NO: 561061 - RNA, 22 nt, Human
aaggcuuuugggaauuuucaac

SEQ ID NO: 561062 - RNA, 22 nt, Human
augcugaugcugcuuuugcccu

SEQ ID NO: 561063 - RNA, 22 nt, Human
uggggcuggggaucuugagccu

SEQ ID NO: 561064 - RNA, 22 nt, Human
uagcugccuuugggcuccugcu

SEQ ID NO: 561065 - RNA, 22 nt, Human
ccagcucucaaggcucccuggg

SEQ ID NO: 561066 - RNA, 22 nt, Human
uccugggaagacugugaggaca

SEQ ID NO: 561067 - RNA, 22 nt, Human
cagagaaagggugaauuccuuc

SEQ ID NO: 561068 - RNA, 22 nt, Human
acucugagcaucccaagucuua

SEQ ID NO: 561069 - RNA, 22 nt, Human
uggagcagaggaagaaggcuuu

SEQ ID NO: 561070 - RNA, 22 nt, Human
uggcucuguuuguuaacuagac

SEQ ID NO: 561071 - RNA, 22 nt, Human
cauuccuuaacguggggagucu

SEQ ID NO: 561072 - RNA, 18 nt, Human
ugaguggaaugagggggc

SEQ ID NO: 561073 - RNA, 22 nt, Human
uaaguucauaagcuuauucuua

SEQ ID NO: 561074 - RNA, 22 nt, Human
guacauguugguuguuuccagu

SEQ ID NO: 561075 - RNA, 22 nt, Human
aaagaacuaccuguaugauauu

SEQ ID NO: 561076 - RNA, 17 nt, Human
gaauuucuuggucaaaa

SEQ ID NO: 561077 - RNA, 22 nt, Human
ucgggcucgcucuccuagcgga

SEQ ID NO: 561078 - RNA, 22 nt, Human
cucccaagggguaagggagcug

SEQ ID NO: 561079 - RNA, 22 nt, Human
aauuaugauuggucuaaaccag

SEQ ID NO: 561080 - RNA, 22 nt, Human
caaagaugcugauguuggauca

SEQ ID NO: 561081 - RNA, 22 nt, Human
cugcucugaguauuaacggagg

SEQ ID NO: 561082 - RNA, 22 nt, Human
ugcuucuggguaggccucagga

SEQ ID NO: 561083 - RNA, 22 nt, Human
ggucagagggugggcugccugu

SEQ ID NO: 561084 - RNA, 22 nt, Human
uuucacauuggcuucuauuucu

SEQ ID NO: 561085 - RNA, 22 nt, Human
auuuucauggcuucugcucagu

SEQ ID NO: 561086 - RNA, 22 nt, Human
ugaaaugauguacaagaaggca

SEQ ID NO: 561087 - RNA, 18 nt, Human
ugaacagaugaguugaag

SEQ ID NO: 561088 - RNA, 22 nt, Human
ggggagugacgcagggccauag

SEQ ID NO: 561089 - RNA, 22 nt, Human
acuuuuugcauaguaagugucu

SEQ ID NO: 561090 - RNA, 22 nt, Human
cugggcagugguggcccuuccc

SEQ ID NO: 561091 - RNA, 22 nt, Human
uaaacaagcugucugauauucu

SEQ ID NO: 561092 - RNA, 22 nt, Human
uggugagacaggaucaaccccu

SEQ ID NO: 561093 - RNA, 17 nt, Human
uguggccuucugagcuu

SEQ ID NO: 561094 - RNA, 22 nt, Human
aagaggggugugugucaaccca

SEQ ID NO: 561095 - RNA, 22 nt, Human
uuaacuauuauuagcaucuuug

SEQ ID NO: 561096 - RNA, 22 nt, Human
agcagguguuggcugggccauc

SEQ ID NO: 561097 - RNA, 20 nt, Human
ucacuaguaaccaucugcuu

SEQ ID NO: 561098 - RNA, 22 nt, Human
ccagucacagguguguuuauau

SEQ ID NO: 561099 - RNA, 22 nt, Human
gccugugcauagcagcggacuc

SEQ ID NO: 561100 - RNA, 22 nt, Human
cccaggaccgcgcggcugagcg

SEQ ID NO: 561101 - RNA, 22 nt, Human
ugagaggcagaauggugccugc

SEQ ID NO: 561102 - RNA, 22 nt, Human
cuguauuucccacauucucuau

SEQ ID NO: 561103 - RNA, 22 nt, Human
gugccuggcacacagaaggcaa

SEQ ID NO: 561104 - RNA, 21 nt, Human
ccugugugucugacugggcua

SEQ ID NO: 561105 - RNA, 22 nt, Human
caaagugcuggaauuacaggug

SEQ ID NO: 561106 - RNA, 22 nt, Human
accacuguaucuccagcacauu

SEQ ID NO: 561107 - RNA, 22 nt, Human
ugaaacaaugugaaguugcuga

SEQ ID NO: 561108 - RNA, 22 nt, Human
ugggccagcacugggugcucau

SEQ ID NO: 561109 - RNA, 22 nt, Human
aguggcaguggggcagggcccu

SEQ ID NO: 561110 - RNA, 22 nt, Human
aaguguguauuguuuaugcugc

SEQ ID NO: 561111 - RNA, 22 nt, Human
cacauaaucaccaaguccuuuc

SEQ ID NO: 561112 - RNA, 22 nt, Human
auguccuucuccucuuaccugc

SEQ ID NO: 561113 - RNA, 22 nt, Human
ugggggugacuaucucgggaau

SEQ ID NO: 561114 - RNA, 22 nt, Human
ucucagugcagagaggcuaucu

SEQ ID NO: 561115 - RNA, 22 nt, Human
uaaggcacccgugagcugccag

SEQ ID NO: 561116 - RNA, 22 nt, Human
uuguugucauuguagaggauuu

SEQ ID NO: 561117 - RNA, 22 nt, Human
uuacauauuauccaaaacugcu

SEQ ID NO: 561118 - RNA, 22 nt, Human
acucccagguugccuggcaggc

SEQ ID NO: 561119 - RNA, 22 nt, Human
aaccaggacaauuuugaaagua

SEQ ID NO: 561120 - RNA, 20 nt, Human
uggggccuguuucugugguu

SEQ ID NO: 561121 - RNA, 22 nt, Human
gggcacagaagucuaagacauc

SEQ ID NO: 561122 - RNA, 22 nt, Human
ugcaggcaggggaugagcagcc

SEQ ID NO: 561123 - RNA, 22 nt, Human
augacacauaaaacaaggacug

SEQ ID NO: 561124 - RNA, 21 nt, Human
uggccaaacuggagcauuuga

SEQ ID NO: 561125 - RNA, 22 nt, Human
ggguccuggaaucugcauuuua

SEQ ID NO: 561126 - RNA, 22 nt, Human
cacaccaaaguauuugguauuu

SEQ ID NO: 561127 - RNA, 22 nt, Human
gacaucaauucagcauuuuaag

SEQ ID NO: 561128 - RNA, 22 nt, Human
ggcagcuggccuccucgcccac

SEQ ID NO: 561129 - RNA, 22 nt, Human
aguggcagaagucacuggguag

SEQ ID NO: 561130 - RNA, 22 nt, Human
uucugaaagucuuuuuaaguua

SEQ ID NO: 561131 - RNA, 22 nt, Human
auucuacauuuggagugauguc

SEQ ID NO: 561132 - RNA, 22 nt, Human
acugagaguugaaaagggagga

SEQ ID NO: 561133 - RNA, 20 nt, Human
auacacaugcagacagaugc

SEQ ID NO: 561134 - RNA, 22 nt, Human
cuucuggguaauucuucuucau

SEQ ID NO: 561135 - RNA, 22 nt, Human
cuggcucccagcuuucagggag

SEQ ID NO: 561136 - RNA, 18 nt, Human
auccaacuaucgcucauu

SEQ ID NO: 561137 - RNA, 22 nt, Human
ccagagagaaaauggagggcca

SEQ ID NO: 561138 - RNA, 22 nt, Human
ucauuuguucaucugcucuucu

SEQ ID NO: 561139 - RNA, 22 nt, Human
ggaggaagcacacggcuuguau

SEQ ID NO: 561140 - RNA, 22 nt, Human
gaauacaaauaauaccaaggug

SEQ ID NO: 561141 - RNA, 22 nt, Human
accugggaggcggagguugcag

SEQ ID NO: 561142 - RNA, 22 nt, Human
auuguuaaacugaagcauuacu

SEQ ID NO: 561143 - RNA, 22 nt, Human
cugugcaagacuuacuuuaaua

SEQ ID NO: 561144 - RNA, 22 nt, Human
gcugagugagguccagagcuug

SEQ ID NO: 561145 - RNA, 22 nt, Human
uuaacagacuugggauuuucua

SEQ ID NO: 561146 - RNA, 17 nt, Human
caauuucauagguuuug

SEQ ID NO: 561147 - RNA, 22 nt, Human
uacauaauaaggggcauggugu

SEQ ID NO: 561148 - RNA, 22 nt, Human
uuccaacuucccaucccugcug

SEQ ID NO: 561149 - RNA, 22 nt, Human
guggauggauugaggcaguggg

SEQ ID NO: 561150 - RNA, 22 nt, Human
agaggggcucaagcaguggucu

SEQ ID NO: 561151 - RNA, 22 nt, Human
uuuucauuguaaaucaggaaac

SEQ ID NO: 561152 - RNA, 22 nt, Human
ucuuccaguguagacaucugcc

SEQ ID NO: 561153 - RNA, 22 nt, Human
acagggccagccugggaccugg

SEQ ID NO: 561154 - RNA, 22 nt, Human
agcaggcuuucaagagucuucu

SEQ ID NO: 561155 - RNA, 23 nt, Human
cugcagccgcguggggacgugga

SEQ ID NO: 561156 - RNA, 22 nt, Human
gauucagugggcuuugggacag

SEQ ID NO: 561157 - RNA, 23 nt, Human
aggauccugguacaggagcagag

SEQ ID NO: 561158 - RNA, 22 nt, Human
caggcuuuacuuucucucugaa

SEQ ID NO: 561159 - RNA, 22 nt, Human
gcuggccauagaagccaaagag

SEQ ID NO: 561160 - RNA, 20 nt, Human
auacacauauucuugcaacu

SEQ ID NO: 561161 - RNA, 22 nt, Human
ccucuucugagugagacucccu

SEQ ID NO: 561162 - RNA, 21 nt, Human
gcagaaaggaaucuuaggucc

SEQ ID NO: 561163 - RNA, 22 nt, Human
gcccaagcuggacugcaguggc

SEQ ID NO: 561164 - RNA, 22 nt, Human
cauucacaucuuguuccaucac

SEQ ID NO: 561165 - RNA, 22 nt, Human
aggugcuagguguguaguggag

SEQ ID NO: 561166 - RNA, 22 nt, Human
ccagugcccagucucccugguc

SEQ ID NO: 561167 - RNA, 22 nt, Human
gccaggcuggcaaaaggaaacc

SEQ ID NO: 561168 - RNA, 22 nt, Human
agggaaauuaaugugagcaaug

SEQ ID NO: 561169 - RNA, 22 nt, Human
ugcacgugggcucucugcucuu

SEQ ID NO: 561170 - RNA, 22 nt, Human
caguuuuucaaaauuacaugau

SEQ ID NO: 561171 - RNA, 22 nt, Human
gaggccaaguuggagaccaggu

SEQ ID NO: 561172 - RNA, 22 nt, Human
uucaagaugacccagucacacg

SEQ ID NO: 561173 - RNA, 23 nt, Human
ucaucaaaggaaguacgugucac

SEQ ID NO: 561174 - RNA, 22 nt, Human
uagaagagacauagccuguggu

SEQ ID NO: 561175 - RNA, 22 nt, Human
cuaucuuuuguucauuuugagu

SEQ ID NO: 561176 - RNA, 20 nt, Human
aggcucagauacccagggaa

SEQ ID NO: 561177 - RNA, 22 nt, Human
cucaccacagagccuguccagc

SEQ ID NO: 561178 - RNA, 22 nt, Human
cuucugggugccugugaguguu

SEQ ID NO: 561179 - RNA, 22 nt, Human
agcaaggauuauccugggaagg

SEQ ID NO: 561180 - RNA, 22 nt, Human
ugcuuuauagacaaggaaguag

SEQ ID NO: 561181 - RNA, 22 nt, Human
uuauccaaacuggugaaucauu

SEQ ID NO: 561182 - RNA, 23 nt, Human
uuguacagcccagauuccucuuc

SEQ ID NO: 561183 - RNA, 22 nt, Human
ugccuuuugaagccucacaggu

SEQ ID NO: 561184 - RNA, 22 nt, Human
ccucugaggugagcccagcugg

SEQ ID NO: 561185 - RNA, 22 nt, Human
ggugcccugccaggaugugcca

SEQ ID NO: 561186 - RNA, 22 nt, Human
cuguccuaugaguacucacuag

SEQ ID NO: 561187 - RNA, 22 nt, Human
gacagggcaagacucugucuaa

SEQ ID NO: 561188 - RNA, 22 nt, Human
auacaaaguauuaauccuggau

SEQ ID NO: 561189 - RNA, 22 nt, Human
ucccacugcuuugcucugcuca

SEQ ID NO: 561190 - RNA, 22 nt, Human
ggcuucccaaggagccaggaug

SEQ ID NO: 561191 - RNA, 22 nt, Human
ccacauuuggagaagauacuuu

SEQ ID NO: 561192 - RNA, 22 nt, Human
ccagagaguaucauggagagua

SEQ ID NO: 561193 - RNA, 22 nt, Human
uuuaaagugcugcuccuauccu

SEQ ID NO: 561194 - RNA, 22 nt, Human
acacauaagaaacuacaaagag

SEQ ID NO: 561195 - RNA, 22 nt, Human
guuaaauaaccucauguccguu

SEQ ID NO: 561196 - RNA, 22 nt, Human
uacacuauuuuacugauacaaa

SEQ ID NO: 561197 - RNA, 22 nt, Human
uaaaguucagugcaugaaugug

SEQ ID NO: 561198 - RNA, 22 nt, Human
ccuggcagcaggugggcccgug

SEQ ID NO: 561199 - RNA, 22 nt, Human
uauauagaaaagcagauguugg

SEQ ID NO: 561200 - RNA, 22 nt, Human
acaaauuucauaggcaaauuuu

SEQ ID NO: 561201 - RNA, 22 nt, Human
ucagaauuuuaaaccaaggaaa

SEQ ID NO: 561202 - RNA, 22 nt, Human
uuacauucaaggaacucauucu

SEQ ID NO: 561203 - RNA, 22 nt, Human
cugcagagcuaggcugagugaa

SEQ ID NO: 561204 - RNA, 22 nt, Human
aagggcugagcacagugagcca

SEQ ID NO: 561205 - RNA, 22 nt, Human
aacacaaagaagcugcaggauc

SEQ ID NO: 561206 - RNA, 22 nt, Human
cagcugccuguauuguccucau

SEQ ID NO: 561207 - RNA, 22 nt, Human
aaucagaaauucuacaucacaa

SEQ ID NO: 561208 - RNA, 22 nt, Human
aacuagaaaacaagaugcugau

SEQ ID NO: 561209 - RNA, 22 nt, Human
gccugagauucugcauuucuaa

SEQ ID NO: 561210 - RNA, 22 nt, Human
cuggauucucaucagagccaga

SEQ ID NO: 561211 - RNA, 22 nt, Human
ucucagggagggcgagucagcg

SEQ ID NO: 561212 - RNA, 22 nt, Human
agacccugcaccucucgugggc

SEQ ID NO: 561213 - RNA, 22 nt, Human
gaugguuugguaaaaguauguu

SEQ ID NO: 561214 - RNA, 22 nt, Human
aggucagcugcugauaggcagc

SEQ ID NO: 561215 - RNA, 22 nt, Human
agcagcuguacuuucaucuguu

SEQ ID NO: 561216 - RNA, 22 nt, Human
acaugcuuucuagguccuucug

SEQ ID NO: 561217 - RNA, 20 nt, Human
uccuucaggcagggccuagu

SEQ ID NO: 561218 - RNA, 22 nt, Human
gauaaaauauguggccuuuagu

SEQ ID NO: 561219 - RNA, 21 nt, Human
uggcauggagguagcagugug

SEQ ID NO: 561220 - RNA, 22 nt, Human
uucaagucuguuucauugcaug

SEQ ID NO: 561221 - RNA, 21 nt, Human
aagcaggacauaugaugcccu

SEQ ID NO: 561222 - RNA, 22 nt, Human
uuauuuauucauucugucuguc

SEQ ID NO: 561223 - RNA, 22 nt, Human
aacuagaacgucuaguugcugg

SEQ ID NO: 561224 - RNA, 22 nt, Human
uauuccagguuucuuguuguau

SEQ ID NO: 561225 - RNA, 22 nt, Human
cuacauuuguucaaauaagcug

SEQ ID NO: 561226 - RNA, 22 nt, Human
aacagcuuugagcaguucugua

SEQ ID NO: 561227 - RNA, 22 nt, Human
uuacuuuggauggucaagaaag

SEQ ID NO: 561228 - RNA, 20 nt, Human
aaggcacuaugucugcuagc

SEQ ID NO: 561229 - RNA, 22 nt, Human
ggcuccugaugcucagauuuca

SEQ ID NO: 561230 - RNA, 22 nt, Human
acuucauguuucuauuagcuca

SEQ ID NO: 561231 - RNA, 22 nt, Human
acuccuggggcugccaucacag

SEQ ID NO: 561232 - RNA, 22 nt, Human
acucuacagaaugaauaccugu

SEQ ID NO: 561233 - RNA, 22 nt, Human
ucccauauaugcaaaaauguaa

SEQ ID NO: 561234 - RNA, 22 nt, Human
gaaauauuguacuggagauguu

SEQ ID NO: 561235 - RNA, 22 nt, Human
acagagagguaaaauauauagu

SEQ ID NO: 561236 - RNA, 22 nt, Human
ucuggcucccagccugcucuca

SEQ ID NO: 561237 - RNA, 22 nt, Human
cagcuucccuuggcugagcaga

SEQ ID NO: 561238 - RNA, 22 nt, Human
cagucucagaggugggaguggg

SEQ ID NO: 561239 - RNA, 22 nt, Human
auucacaguauggacgaaauga

SEQ ID NO: 561240 - RNA, 22 nt, Human
uauucucagugcuauaaguaga

SEQ ID NO: 561241 - RNA, 22 nt, Human
gggugggaucuguggagccuca

SEQ ID NO: 561242 - RNA, 22 nt, Human
acacuuuuaagacuuuaaugaa

SEQ ID NO: 561243 - RNA, 22 nt, Human
agcauuuaugacuaauguaaaa

SEQ ID NO: 561244 - RNA, 22 nt, Human
ugcuuccuucccguucuucucc

SEQ ID NO: 561245 - RNA, 22 nt, Human
uuuguaaauagcaguacucaug

SEQ ID NO: 561246 - RNA, 22 nt, Human
ccccuggguccaggcuucucug

SEQ ID NO: 561247 - RNA, 22 nt, Human
uugccugugaggauucugguug

SEQ ID NO: 561248 - RNA, 22 nt, Human
agcaggugguaggcagucagca

SEQ ID NO: 561249 - RNA, 22 nt, Human
aaagccuugcccgucacuggga

SEQ ID NO: 561250 - RNA, 22 nt, Human
cagugucuccagaugcuccaau

SEQ ID NO: 561251 - RNA, 22 nt, Human
uagaaauccccagucucauagu

SEQ ID NO: 561252 - RNA, 22 nt, Human
caagaauaaccagacaauagca

SEQ ID NO: 561253 - RNA, 22 nt, Human
aagcuuuaugacuuggagacag

SEQ ID NO: 561254 - RNA, 22 nt, Human
gagaagaacuugggcaaaguca

SEQ ID NO: 561255 - RNA, 22 nt, Human
guuugaaaaaagcaguauguaa

SEQ ID NO: 561256 - RNA, 22 nt, Human
ucgccagggaugcuguaaggaa

SEQ ID NO: 561257 - RNA, 22 nt, Human
uauuuccaggccccacucuaga

SEQ ID NO: 561258 - RNA, 22 nt, Human
cuuaaaaguugcuucccuaacu

SEQ ID NO: 561259 - RNA, 22 nt, Human
aaacacaccuuuggaacuguga

SEQ ID NO: 561260 - RNA, 22 nt, Human
auaaacagaguaguugcuacug

SEQ ID NO: 561261 - RNA, 22 nt, Human
uucuuucagaacacaagugauu

SEQ ID NO: 561262 - RNA, 22 nt, Human
caguacuuuucuggcuuucuac

SEQ ID NO: 561263 - RNA, 23 nt, Human
accaugaugggagugcaaauaag

SEQ ID NO: 561264 - RNA, 22 nt, Human
uugugugucuucuucacugccc

SEQ ID NO: 561265 - RNA, 22 nt, Human
caggaugagaggcccagggaag

SEQ ID NO: 561266 - RNA, 22 nt, Human
caggcccugggcaggcacagag

SEQ ID NO: 561267 - RNA, 22 nt, Human
uaaagacaaacccacuaggguu

SEQ ID NO: 561268 - RNA, 22 nt, Human
ugcuccuggcuccuucccuaac

SEQ ID NO: 561269 - RNA, 22 nt, Human
uuccugugaagccgguggucuc

SEQ ID NO: 561270 - RNA, 22 nt, Human
uacccagcccaugccuaccuca

SEQ ID NO: 561271 - RNA, 22 nt, Human
ggagcugugcugggugaucagg

SEQ ID NO: 561272 - RNA, 22 nt, Human
agccaggggagucagcugcugg

SEQ ID NO: 561273 - RNA, 22 nt, Human
ucaguuuucaauuucaucagag

SEQ ID NO: 561274 - RNA, 22 nt, Human
agugugagccuacaggccaaag

SEQ ID NO: 561275 - RNA, 20 nt, Human
agcuugccccugucuuugcc

SEQ ID NO: 561276 - RNA, 22 nt, Human
ucagcuuuuaaaaacaagaagu

SEQ ID NO: 561277 - RNA, 22 nt, Human
acuggggagugguuuugggaag

SEQ ID NO: 561278 - RNA, 22 nt, Human
aggacugacuuuugccaugaaa

SEQ ID NO: 561279 - RNA, 22 nt, Human
agcucugguuauugaagcaggg

SEQ ID NO: 561280 - RNA, 22 nt, Human
ugucaucagcauauaagacagu

SEQ ID NO: 561281 - RNA, 23 nt, Human
aguguuccaguugguugagagug

SEQ ID NO: 561282 - RNA, 22 nt, Human
acuauaacccauggaauauaag

SEQ ID NO: 561283 - RNA, 22 nt, Human
gggaggaaaugugcagcgaauu

SEQ ID NO: 561284 - RNA, 22 nt, Human
uuagcaucugcuguaagcuuau

SEQ ID NO: 561285 - RNA, 22 nt, Human
agcugcaggcccaugcucaguc

SEQ ID NO: 561286 - RNA, 22 nt, Human
aggcacagagaaugcccuccau

SEQ ID NO: 561287 - RNA, 22 nt, Human
aauguuuggcuagauagaugga

SEQ ID NO: 561288 - RNA, 22 nt, Human
aacuagaacgagaaagcugaac

SEQ ID NO: 561289 - RNA, 22 nt, Human
ugcaguggaaagacucagacuu

SEQ ID NO: 561290 - RNA, 22 nt, Human
uguaugcagcaaaacaauuagu

SEQ ID NO: 561291 - RNA, 22 nt, Human
gggcucugggaugcucuuagag

SEQ ID NO: 561292 - RNA, 22 nt, Human
uucuuaagaggaacauuuuugu

SEQ ID NO: 561293 - RNA, 22 nt, Human
uuaaacagguuuuugaauggcc

SEQ ID NO: 561294 - RNA, 18 nt, Human
gagguccugcucuagccc

SEQ ID NO: 561295 - RNA, 22 nt, Human
ucccaagauuagguuggaaagg

SEQ ID NO: 561296 - RNA, 22 nt, Human
cagcuguucacauuuccaaaac

SEQ ID NO: 561297 - RNA, 22 nt, Human
gaggugggaugugugugcuacu

SEQ ID NO: 561298 - RNA, 22 nt, Human
cuaagauaaaugcuuugaugaa

SEQ ID NO: 561299 - RNA, 22 nt, Human
uaauacacugcuuuuuguaacu

SEQ ID NO: 561300 - RNA, 22 nt, Human
agagugcaaccgaaacaagcag

SEQ ID NO: 561301 - RNA, 22 nt, Human
cugccaaggcuggggaggacaa

SEQ ID NO: 561302 - RNA, 22 nt, Human
agcagcaacuuauuuuucuuau

SEQ ID NO: 561303 - RNA, 22 nt, Human
uguguccauucaggcacugacc

SEQ ID NO: 561304 - RNA, 22 nt, Human
aaguuaugaaauuuggacagcu

SEQ ID NO: 561305 - RNA, 16 nt, Human
uguaugaacgucucca

SEQ ID NO: 561306 - RNA, 16 nt, Human
ugguggggaggacagc

SEQ ID NO: 561307 - RNA, 22 nt, Human
gucccauuuucuacuauggaau

SEQ ID NO: 561308 - RNA, 22 nt, Human
aaaggucauugaaaaggaggaa

SEQ ID NO: 561309 - RNA, 22 nt, Human
uaguaaaucucagaaaaagauc

SEQ ID NO: 561310 - RNA, 22 nt, Human
uucaacaugcaaacuuugggag

SEQ ID NO: 561311 - RNA, 22 nt, Human
cacacaucaaccuagacauugu

SEQ ID NO: 561312 - RNA, 22 nt, Human
agguggggcccaccaauuugca

SEQ ID NO: 561313 - RNA, 22 nt, Human
gcugucuccauagcuguguguc

SEQ ID NO: 561314 - RNA, 22 nt, Human
agcagcuuuaagucacugguua

SEQ ID NO: 561315 - RNA, 22 nt, Human
aguuuauguaaaauuaguaaug

SEQ ID NO: 561316 - RNA, 22 nt, Human
ucagaauugucuggggaauguu

SEQ ID NO: 561317 - RNA, 22 nt, Human
gcugccucugcgacucugggcg

SEQ ID NO: 561318 - RNA, 22 nt, Human
aagcacauuaaggaacauugaa

SEQ ID NO: 561319 - RNA, 22 nt, Human
cccacacacauuuaugauagga

SEQ ID NO: 561320 - RNA, 22 nt, Human
cucacugacgaggaagcugaga

SEQ ID NO: 561321 - RNA, 22 nt, Human
aguguuaaggcugguugcuaua

SEQ ID NO: 561322 - RNA, 22 nt, Human
ucuuuguauguauguuucaaag

SEQ ID NO: 561323 - RNA, 21 nt, Human
uagcagagaucauuuucuccu

SEQ ID NO: 561324 - RNA, 22 nt, Human
uuugcaaagugcuugcagagua

SEQ ID NO: 561325 - RNA, 21 nt, Human
acugccuggggugcuggccaa

SEQ ID NO: 561326 - RNA, 22 nt, Human
uuggugaacacauacacauuuu

SEQ ID NO: 561327 - RNA, 22 nt, Human
gagacacacacaggagguggca

SEQ ID NO: 561328 - RNA, 22 nt, Human
uucaugaagggugaauauaguc

SEQ ID NO: 561329 - RNA, 20 nt, Human
ugugggccuucggcgugcuc

SEQ ID NO: 561330 - RNA, 22 nt, Human
uuacaaagugcugcaccauuuu

SEQ ID NO: 561331 - RNA, 20 nt, Human
uuugucuguuaaguguuucu

SEQ ID NO: 561332 - RNA, 22 nt, Human
ccuggcuguuugagcggggaau

SEQ ID NO: 561333 - RNA, 22 nt, Human
gcucugcuggaaguucucugga

SEQ ID NO: 561334 - RNA, 22 nt, Human
acccuggguucccgcagcacca

SEQ ID NO: 561335 - RNA, 22 nt, Human
acuacauuuccugaccccugug

SEQ ID NO: 561336 - RNA, 22 nt, Human
auaaggaaugauguaucaguuu

SEQ ID NO: 561337 - RNA, 22 nt, Human
gccugugcuguucccucugcca

SEQ ID NO: 561338 - RNA, 22 nt, Human
aggccugggcaagaaggggcgu

SEQ ID NO: 561339 - RNA, 22 nt, Human
ggcuuuauguuuuucauguggu

SEQ ID NO: 561340 - RNA, 22 nt, Human
aaagcagaacugagagagcugg

SEQ ID NO: 561341 - RNA, 22 nt, Human
auaugaaaauguuuuagcugua

SEQ ID NO: 561342 - RNA, 19 nt, Human
ggcugagcgccuuggcugc

SEQ ID NO: 561343 - RNA, 22 nt, Human
aacaugaagguaggaugguuuu

SEQ ID NO: 561344 - RNA, 22 nt, Human
caugccaguuuugagaugcacc

SEQ ID NO: 561345 - RNA, 22 nt, Human
guggccagcaagugcugccucu

SEQ ID NO: 561346 - RNA, 22 nt, Human
ccugccuggggacaaaggaggg

SEQ ID NO: 561347 - RNA, 22 nt, Human
aggacaggauugagcugaacug

SEQ ID NO: 561348 - RNA, 22 nt, Human
agcugcuguccuaggcacugua

SEQ ID NO: 561349 - RNA, 22 nt, Human
ggcuacagggccuggccaaggu

SEQ ID NO: 561350 - RNA, 22 nt, Human
aaaagguuuugaguacaaauau

SEQ ID NO: 561351 - RNA, 22 nt, Human
uccaucagauucccuccugaga

SEQ ID NO: 561352 - RNA, 22 nt, Human
acacagccaggguaguaaggcu

SEQ ID NO: 561353 - RNA, 22 nt, Human
uucugggcauguuacauucugu

SEQ ID NO: 561354 - RNA, 22 nt, Human
augcaagagauggacuuguguu

SEQ ID NO: 561355 - RNA, 22 nt, Human
aggcucugaucagguggcugug

SEQ ID NO: 561356 - RNA, 23 nt, Human
aggcuggcuucaggagccucucc

SEQ ID NO: 561357 - RNA, 22 nt, Human
ucucacagugcaggucugucuc

SEQ ID NO: 561358 - RNA, 22 nt, Human
uagagucagagaaucauuacag

SEQ ID NO: 561359 - RNA, 22 nt, Human
cagaggaaguuccuugaugaga

SEQ ID NO: 561360 - RNA, 22 nt, Human
gcuccagaugaaaggccagagg

SEQ ID NO: 561361 - RNA, 22 nt, Human
caguguccucagccagcagcua

SEQ ID NO: 561362 - RNA, 22 nt, Human
cagaggccuauccaguguccau

SEQ ID NO: 561363 - RNA, 22 nt, Human
ugagagagcgccugggaucauu

SEQ ID NO: 561364 - RNA, 22 nt, Human
uucuguuuugcacagacuugaa

SEQ ID NO: 561365 - RNA, 22 nt, Human
ugcagagguguugcugagauaa

SEQ ID NO: 561366 - RNA, 23 nt, Human
ggccauggagacuuagaaugggc

SEQ ID NO: 561367 - RNA, 22 nt, Human
cucugagauaguuucuaucaau

SEQ ID NO: 561368 - RNA, 22 nt, Human
ucucuggaagcgcagaucuguu

SEQ ID NO: 561369 - RNA, 21 nt, Human
ucuugaaaauuguagcaguuu

SEQ ID NO: 561370 - RNA, 22 nt, Human
gccuggcaccacagccuuucag

SEQ ID NO: 561371 - RNA, 22 nt, Human
augauugcagcccuacagcugu

SEQ ID NO: 561372 - RNA, 22 nt, Human
gugcucuggcuggucucccggu

SEQ ID NO: 561373 - RNA, 19 nt, Human
uuucccagcccuugcugug

SEQ ID NO: 561374 - RNA, 22 nt, Human
aaaaacuguaauuacuuuugca

SEQ ID NO: 561375 - RNA, 20 nt, Human
auugugcagcccuuggcaga

SEQ ID NO: 561376 - RNA, 22 nt, Human
ccauguggcuagcgugccugca

SEQ ID NO: 561377 - RNA, 22 nt, Human
aaggaagacuugagaagguucc

SEQ ID NO: 561378 - RNA, 22 nt, Human
auucuccagcucacuguccaua

SEQ ID NO: 561379 - RNA, 19 nt, Human
uggcagggagugauauuag

SEQ ID NO: 561380 - RNA, 22 nt, Human
uucauuugaguuuauaguugcu

SEQ ID NO: 561381 - RNA, 22 nt, Human
uccugcagccaagggucaucga

SEQ ID NO: 561382 - RNA, 22 nt, Human
ggccugagucacaucaggagag

SEQ ID NO: 561383 - RNA, 22 nt, Human
aaacaaugagcuuuuacacacu

SEQ ID NO: 561384 - RNA, 22 nt, Human
ucuggaugcucugagcccaagg

SEQ ID NO: 561385 - RNA, 22 nt, Human
uggaggaaucagggcuuaggcu

SEQ ID NO: 561386 - RNA, 22 nt, Human
caaaguccauaguuuacaauag

SEQ ID NO: 561387 - RNA, 22 nt, Human
uuccacauuccuuacauucaua

SEQ ID NO: 561388 - RNA, 22 nt, Human
ucagaggaacuggacuaaagcc

SEQ ID NO: 561389 - RNA, 22 nt, Human
uaauacauguauuccagagagu

SEQ ID NO: 561390 - RNA, 22 nt, Human
cugcugucuuuauuucacugcu

SEQ ID NO: 561391 - RNA, 22 nt, Human
ccagcugguuaaaauagagaaa

SEQ ID NO: 561392 - RNA, 22 nt, Human
ccugggcucugaggagggaguc

SEQ ID NO: 561393 - RNA, 22 nt, Human
cugccagcacugccuccugagg

SEQ ID NO: 561394 - RNA, 19 nt, Human
gcuggcuggaggagggaca

SEQ ID NO: 561395 - RNA, 22 nt, Human
gaggaagaagcaaaccagcuaa

SEQ ID NO: 561396 - RNA, 22 nt, Human
gcaggagccaggccgagcuggu

SEQ ID NO: 561397 - RNA, 22 nt, Human
aggaagccaugguggacgucua

SEQ ID NO: 561398 - RNA, 16 nt, Human
cagccugcagugguca

SEQ ID NO: 561399 - RNA, 22 nt, Human
uaacauucccuuugugccaagg

SEQ ID NO: 561400 - RNA, 23 nt, Human
uggcaccaggcauucuaggggua

SEQ ID NO: 561401 - RNA, 20 nt, Human
ggaagcagagaacuguuuuc

SEQ ID NO: 561402 - RNA, 23 nt, Human
ugagccuguuaauacuggcucug

SEQ ID NO: 561403 - RNA, 22 nt, Human
aguauucuggaauucuauguga

SEQ ID NO: 561404 - RNA, 22 nt, Human
gagacguggccuuugccugagc

SEQ ID NO: 561405 - RNA, 22 nt, Human
ugaaggagggaagaaggcucug

SEQ ID NO: 561406 - RNA, 22 nt, Human
gcauuucaaaauuccaggcaag

SEQ ID NO: 561407 - RNA, 22 nt, Human
ggcagccauggacacuggcuag

SEQ ID NO: 561408 - RNA, 19 nt, Human
uucaacaugcugaggcagc

SEQ ID NO: 561409 - RNA, 22 nt, Human
ggugaagcucuaccauucccag

SEQ ID NO: 561410 - RNA, 22 nt, Human
aaggcacuuuuccugagaugau

SEQ ID NO: 561411 - RNA, 22 nt, Human
ucagaggagaaguugggaaaau

SEQ ID NO: 561412 - RNA, 22 nt, Human
cacaugcuccauacagaauggg

SEQ ID NO: 561413 - RNA, 22 nt, Human
gugggagcuuuggcaucaggcu

SEQ ID NO: 561414 - RNA, 22 nt, Human
auuccuaaaguaauacacuaga

SEQ ID NO: 561415 - RNA, 22 nt, Human
cugccucuauaggaguccacca

SEQ ID NO: 561416 - RNA, 22 nt, Human
aggcccaaaagaaaccacuggg

SEQ ID NO: 561417 - RNA, 22 nt, Human
gaugcugggaccacagaguguu

SEQ ID NO: 561418 - RNA, 22 nt, Human
uaucuuuagaggaagagaaucu

SEQ ID NO: 561419 - RNA, 22 nt, Human
uuacaucauugagacauacaua

SEQ ID NO: 561420 - RNA, 22 nt, Human
cacaaugcguacauauaucaaa

SEQ ID NO: 561421 - RNA, 22 nt, Human
ucccucuaaacuguaagauucu

SEQ ID NO: 561422 - RNA, 22 nt, Human
agugcagaguacauuuguggca

SEQ ID NO: 561423 - RNA, 22 nt, Human
agcaggagcccuuaucaccagg

SEQ ID NO: 561424 - RNA, 22 nt, Human
guacaaguugccuaccuuaagu

SEQ ID NO: 561425 - RNA, 22 nt, Human
guuugcauguguacuuaauugg

SEQ ID NO: 561426 - RNA, 22 nt, Human
cagcugaacauguagagcaucu

SEQ ID NO: 561427 - RNA, 22 nt, Human
cacuauuugcuuugggcuagag

SEQ ID NO: 561428 - RNA, 22 nt, Human
cugggacagcugagacaggaga

SEQ ID NO: 561429 - RNA, 22 nt, Human
ugaggcaggacugagcgggaug

SEQ ID NO: 561430 - RNA, 22 nt, Human
uuuuuccuagcgauuugucagc

SEQ ID NO: 561431 - RNA, 22 nt, Human
uuuguuaaauauuuauugagug

SEQ ID NO: 561432 - RNA, 22 nt, Human
gagcugccuguugcauagcaac

SEQ ID NO: 561433 - RNA, 19 nt, Human
agucccaggcccgaaagag

SEQ ID NO: 561434 - RNA, 22 nt, Human
cacuuuaacucacauuucagcu

SEQ ID NO: 561435 - RNA, 23 nt, Human
uggcccugugcaugcugcuuccc

SEQ ID NO: 561436 - RNA, 19 nt, Human
gaggaggaaaacuagugua

SEQ ID NO: 561437 - RNA, 22 nt, Human
augaugguaaauucaguauccg

SEQ ID NO: 561438 - RNA, 22 nt, Human
gucaggggccaugggccaagga

SEQ ID NO: 561439 - RNA, 22 nt, Human
ucacuucuucccuugcacauau

SEQ ID NO: 561440 - RNA, 22 nt, Human
cuauuucugccuaaugaccugu

SEQ ID NO: 561441 - RNA, 22 nt, Human
cuccugggcuaugucugcuugg

SEQ ID NO: 561442 - RNA, 22 nt, Human
cuccaaguauguuaaaaucuaa

SEQ ID NO: 561443 - RNA, 22 nt, Human
cuguauauggcuuacuuuauau

SEQ ID NO: 561444 - RNA, 22 nt, Human
ucaccugggagggcugugguag

SEQ ID NO: 561445 - RNA, 22 nt, Human
ccugauggagcccugcugcaug

SEQ ID NO: 561446 - RNA, 22 nt, Human
aguaaauuauuuagcuuccaga

SEQ ID NO: 561447 - RNA, 22 nt, Human
gccuucucccuaaccaaauccu

SEQ ID NO: 561448 - RNA, 22 nt, Human
uuucugaacuugguacuggagc

SEQ ID NO: 561449 - RNA, 22 nt, Human
ccaauuguccuaauuaauuaga

SEQ ID NO: 561450 - RNA, 22 nt, Human
gccugccuagaauugcagcuuu

SEQ ID NO: 561451 - RNA, 22 nt, Human
cuggaaaguacagugugucaca

SEQ ID NO: 561452 - RNA, 22 nt, Human
gcacauccaaugauuguuuuga

SEQ ID NO: 561453 - RNA, 22 nt, Human
gccucccuggcccacagcagcg

SEQ ID NO: 561454 - RNA, 22 nt, Human
ggaaaaggccauuguuucucug

SEQ ID NO: 561455 - RNA, 22 nt, Human
ggccaggagcaagccaggcucu

SEQ ID NO: 561456 - RNA, 22 nt, Human
cugggccuggggcuguugagag

SEQ ID NO: 561457 - RNA, 19 nt, Human
uggcuguggggaaaugcuu

SEQ ID NO: 561458 - RNA, 22 nt, Human
agcuugaguuuuggaugaagug

SEQ ID NO: 561459 - RNA, 22 nt, Human
auagaauuacaguguguuugga

SEQ ID NO: 561460 - RNA, 22 nt, Human
ccugcccagcuucccgagugca

SEQ ID NO: 561461 - RNA, 22 nt, Human
uccuucaggguugaggccgacu

SEQ ID NO: 561462 - RNA, 20 nt, Human
uaucaaucagaaagaagacu

SEQ ID NO: 561463 - RNA, 22 nt, Human
ucuggcccagccccugagguca

SEQ ID NO: 561464 - RNA, 22 nt, Human
uauuccaguucaccuuuucauc

SEQ ID NO: 561465 - RNA, 22 nt, Human
aguggaaggucaggggacagug

SEQ ID NO: 561466 - RNA, 22 nt, Human
ggaagagauucuuuacauucau

SEQ ID NO: 561467 - RNA, 22 nt, Human
uccaggcccagacggggugagg

SEQ ID NO: 561468 - RNA, 19 nt, Human
ggaaacaggggccagagga

SEQ ID NO: 561469 - RNA, 22 nt, Human
cugggguggugcaggccucaug

SEQ ID NO: 561470 - RNA, 18 nt, Human
aagaggaggaaacccagg

SEQ ID NO: 561471 - RNA, 22 nt, Human
gaggcagcugaagcuucaaaga

SEQ ID NO: 561472 - RNA, 22 nt, Human
aaaauguguuuaugcauuucgu

SEQ ID NO: 561473 - RNA, 22 nt, Human
ugagccagaguggagugugccu

SEQ ID NO: 561474 - RNA, 22 nt, Human
ccugggagugucagacuugcuu

SEQ ID NO: 561475 - RNA, 18 nt, Human
ggccucuggacuggcagc

SEQ ID NO: 561476 - RNA, 22 nt, Human
gcucagugcaucauuccaggcu

SEQ ID NO: 561477 - RNA, 22 nt, Human
gcuggcagggacagcugcgugu

SEQ ID NO: 561478 - RNA, 22 nt, Human
auaugcauaugucaaaacuuau

SEQ ID NO: 561479 - RNA, 21 nt, Human
cauugucgacauuuuccccuc

SEQ ID NO: 561480 - RNA, 22 nt, Human
cugcaggucucugugugcauuc

SEQ ID NO: 561481 - RNA, 22 nt, Human
ugggcagcagcaaagccagacu

SEQ ID NO: 561482 - RNA, 22 nt, Human
uguagaaagcucuucugaaauc

SEQ ID NO: 561483 - RNA, 22 nt, Human
ugucagaacucuauugaugucc

SEQ ID NO: 561484 - RNA, 23 nt, Human
ggccucuguguucugcccacaug

SEQ ID NO: 561485 - RNA, 22 nt, Human
cagugagguagacagcuuuuuc

SEQ ID NO: 561486 - RNA, 22 nt, Human
uccugcuccaccgugggcugga

SEQ ID NO: 561487 - RNA, 22 nt, Human
cagggugccucccgcucgccgg

SEQ ID NO: 561488 - RNA, 22 nt, Human
agaggccacuuugccugugaug

SEQ ID NO: 561489 - RNA, 22 nt, Human
aaaucuguaagcaauugcucag

SEQ ID NO: 561490 - RNA, 22 nt, Human
uaagaccaaaguucuguaggga

SEQ ID NO: 561491 - RNA, 22 nt, Human
ugagcagaaaagaaugcugagc

SEQ ID NO: 561492 - RNA, 22 nt, Human
ucuugauuuugugaauaaguug

SEQ ID NO: 561493 - RNA, 22 nt, Human
ccugucuguucugacuggucag

SEQ ID NO: 561494 - RNA, 22 nt, Human
auugacaauuagcccuuaggug

SEQ ID NO: 561495 - RNA, 22 nt, Human
acauaauaggugccugaauauu

SEQ ID NO: 561496 - RNA, 22 nt, Human
cucccaggguagggagagacua

SEQ ID NO: 561497 - RNA, 22 nt, Human
aucuuuuuaucuguuuggaaca

SEQ ID NO: 561498 - RNA, 22 nt, Human
gcuuaaaagccacuuagucuau

SEQ ID NO: 561499 - RNA, 22 nt, Human
gcagaggacagggauuuagauu

SEQ ID NO: 561500 - RNA, 22 nt, Human
aucaguuuguauaugaaacacu

SEQ ID NO: 561501 - RNA, 22 nt, Human
gugcccugcaugccccggguau

SEQ ID NO: 561502 - RNA, 22 nt, Human
gcagugccuugcuucucugucu

SEQ ID NO: 561503 - RNA, 22 nt, Human
guguaugaggggagaauguuuu

SEQ ID NO: 561504 - RNA, 19 nt, Human
aguguguacugaaagcacu

SEQ ID NO: 561505 - RNA, 22 nt, Human
ccucuggggugagugggccacu

SEQ ID NO: 561506 - RNA, 22 nt, Human
ugccaggcgauugcuaucagca

SEQ ID NO: 561507 - RNA, 22 nt, Human
ucagaagucccagaauucacau

SEQ ID NO: 561508 - RNA, 19 nt, Human
cuuauacagauuuucucau

SEQ ID NO: 561509 - RNA, 22 nt, Human
augggcagcagcugccauucau

SEQ ID NO: 561510 - RNA, 22 nt, Human
gcaaagcaaaugccugaaggcg

SEQ ID NO: 561511 - RNA, 19 nt, Human
aggugcaggucacagggga

SEQ ID NO: 561512 - RNA, 22 nt, Human
ccaggguggggcaggcccacug

SEQ ID NO: 561513 - RNA, 22 nt, Human
aaagcaugguuaaagacagugg

SEQ ID NO: 561514 - RNA, 22 nt, Human
aaaacagacagccaguguagag

SEQ ID NO: 561515 - RNA, 22 nt, Human
aaggcacuugcccagagcugca

SEQ ID NO: 561516 - RNA, 22 nt, Human
aaucugauguuaaauguaaggu

SEQ ID NO: 561517 - RNA, 22 nt, Human
aggcugagccacggggcuggcu

SEQ ID NO: 561518 - RNA, 22 nt, Human
ggcugccacgucgaggguccaa

SEQ ID NO: 561519 - RNA, 22 nt, Human
gcuuuacagggcacaaagggag

SEQ ID NO: 561520 - RNA, 22 nt, Human
ucuggccacccgaggccccugc

SEQ ID NO: 561521 - RNA, 22 nt, Human
ggcccugggaugcucagcagug

SEQ ID NO: 561522 - RNA, 22 nt, Human
uaggcuggaggaagcagugccu

SEQ ID NO: 561523 - RNA, 22 nt, Human
gacagagugcagggcuagaaga

SEQ ID NO: 561524 - RNA, 22 nt, Human
caggugucuaauucucaccccc

SEQ ID NO: 561525 - RNA, 22 nt, Human
gacauaauaaucugaccuagau

SEQ ID NO: 561526 - RNA, 22 nt, Human
uuucuagaggcuccaggggagu

SEQ ID NO: 561527 - RNA, 22 nt, Human
agccagaaaggggcauuaucug

SEQ ID NO: 561528 - RNA, 22 nt, Human
gacaauuucucaauauagaaac

SEQ ID NO: 561529 - RNA, 22 nt, Human
guuguauagagggcaugaaucu

SEQ ID NO: 561530 - RNA, 22 nt, Human
gaggcccuccagcugucagcug

SEQ ID NO: 561531 - RNA, 22 nt, Human
acagcagccuuguugguuucga

SEQ ID NO: 561532 - RNA, 22 nt, Human
uucacagcuaagagcuaaguaa

SEQ ID NO: 561533 - RNA, 22 nt, Human
uggcucuguugagguauggauu

SEQ ID NO: 561534 - RNA, 22 nt, Human
augcccgauaccuaguuaacuc

SEQ ID NO: 561535 - RNA, 22 nt, Human
gugcuuccaucuagagggucac

SEQ ID NO: 561536 - RNA, 22 nt, Human
ugcucugguaacucacuuccau

SEQ ID NO: 561537 - RNA, 22 nt, Human
ucucagaggcccgacguucucc

SEQ ID NO: 561538 - RNA, 22 nt, Human
gcagggguagugucuuccugag

SEQ ID NO: 561539 - RNA, 22 nt, Human
ucacagacuggucagucaacuu

SEQ ID NO: 561540 - RNA, 22 nt, Human
gugucaugggagucagaaguga

SEQ ID NO: 561541 - RNA, 22 nt, Human
auuccaaacagugcugcagacu

SEQ ID NO: 561542 - RNA, 22 nt, Human
uucuggagccgggccugggcag

SEQ ID NO: 561543 - RNA, 19 nt, Human
ugugaaagcuaguguucuu

SEQ ID NO: 561544 - RNA, 22 nt, Human
gggguggaucaggcaggcccag

SEQ ID NO: 561545 - RNA, 22 nt, Human
aaaguguggagauugaacuaaa

SEQ ID NO: 561546 - RNA, 22 nt, Human
guucuucucuuguaauggaauc

SEQ ID NO: 561547 - RNA, 22 nt, Human
cacuggggaaaacaggcuucuu

SEQ ID NO: 561548 - RNA, 22 nt, Human
caugaguuuuuuaguucaugca

SEQ ID NO: 561549 - RNA, 20 nt, Human
agaauucuuacccuuugaug

SEQ ID NO: 561550 - RNA, 22 nt, Human
guuaauuugcagcuuucgagcu

SEQ ID NO: 561551 - RNA, 22 nt, Human
cagggcuggauccuccagacuc

SEQ ID NO: 561552 - RNA, 22 nt, Human
gugcuguaacaacagagugucu

SEQ ID NO: 561553 - RNA, 22 nt, Human
aguguuccuugcuuucccagag

SEQ ID NO: 561554 - RNA, 22 nt, Human
aaaucagucccucuuggaauuu

SEQ ID NO: 561555 - RNA, 22 nt, Human
ucuuggucuuucauccuucaac

SEQ ID NO: 561556 - RNA, 22 nt, Human
gacagcaggagaucaugauaga

SEQ ID NO: 561557 - RNA, 22 nt, Human
gaaggccuagggaugcucugcg

SEQ ID NO: 561558 - RNA, 19 nt, Human
ggucacagggguuacaagg

SEQ ID NO: 561559 - RNA, 22 nt, Human
ucgugucagaucagagguuccu

SEQ ID NO: 561560 - RNA, 22 nt, Human
gacacaggggggcgcuagaaga

SEQ ID NO: 561561 - RNA, 22 nt, Human
gccugcagacguguuuuccuca

SEQ ID NO: 561562 - RNA, 21 nt, Human
ccuucuccacagggucuccgg

SEQ ID NO: 561563 - RNA, 22 nt, Human
ugcuucauuuccuuauauugua

SEQ ID NO: 561564 - RNA, 22 nt, Human
gccugcccugaaagaggugaag

SEQ ID NO: 561565 - RNA, 22 nt, Human
agaugcuucaguguuuaauuua

SEQ ID NO: 561566 - RNA, 22 nt, Human
agcccagaggguagcagaagaa

SEQ ID NO: 561567 - RNA, 22 nt, Human
cuguggcucucagaggcugcug

SEQ ID NO: 561568 - RNA, 22 nt, Human
uugaagagugccuuccagacau

SEQ ID NO: 561569 - RNA, 22 nt, Human
cugugcaguaggucagggcugg

SEQ ID NO: 561570 - RNA, 22 nt, Human
auucacauuuuauuucacugga

SEQ ID NO: 561571 - RNA, 22 nt, Human
auucuuccucaucaaucuguag

SEQ ID NO: 561572 - RNA, 22 nt, Human
ucacuguaccuuccauuucauu

SEQ ID NO: 561573 - RNA, 20 nt, Human
ucauuguguugccaauuccc

SEQ ID NO: 561574 - RNA, 22 nt, Human
aggucccugcagcagacugcca

SEQ ID NO: 561575 - RNA, 22 nt, Human
caauacugaguuuacauucauc

SEQ ID NO: 561576 - RNA, 22 nt, Human
gcuggcagagcucugggcuggg

SEQ ID NO: 561577 - RNA, 22 nt, Human
agccccuuccaguucucagauc

SEQ ID NO: 561578 - RNA, 18 nt, Human
gggcucugauccuucacc

SEQ ID NO: 561579 - RNA, 22 nt, Human
uccagucaucucccuucacauu

SEQ ID NO: 561580 - RNA, 22 nt, Human
ggcuggcuugccaagcucaggg

SEQ ID NO: 561581 - RNA, 22 nt, Human
auaaacucaugccaagaaauga

SEQ ID NO: 561582 - RNA, 22 nt, Human
acucacauuucaucaggccaag

SEQ ID NO: 561583 - RNA, 22 nt, Human
cugcuccaggauuucaggccag

SEQ ID NO: 561584 - RNA, 22 nt, Human
gaggggcuugaggcccugaugg

SEQ ID NO: 561585 - RNA, 22 nt, Human
agggcugggcugcuuguuguca

SEQ ID NO: 561586 - RNA, 22 nt, Human
aaaugcuuagagguguucaaau

SEQ ID NO: 561587 - RNA, 22 nt, Human
cucagcccagcccaggaccagg

SEQ ID NO: 561588 - RNA, 22 nt, Human
gcugggcccagaucccaggauc

SEQ ID NO: 561589 - RNA, 22 nt, Human
gcagcgagugcggcugccacag

SEQ ID NO: 561590 - RNA, 22 nt, Human
cauuuauucauuugcuagggcu

SEQ ID NO: 561591 - RNA, 22 nt, Human
cuguggcaggaagggacuagca

SEQ ID NO: 561592 - RNA, 22 nt, Human
cacaaucauaauguauguacau

SEQ ID NO: 561593 - RNA, 22 nt, Human
aauacaaucaaauucacuagca

SEQ ID NO: 561594 - RNA, 22 nt, Human
uuuucauuguuacuaugagcua

SEQ ID NO: 561595 - RNA, 22 nt, Human
ugucccaggccucauguugcca

SEQ ID NO: 561596 - RNA, 22 nt, Human
aggaggccgcugaugggcuccc

SEQ ID NO: 561597 - RNA, 22 nt, Human
guccugagaauacuaggcacaa

SEQ ID NO: 561598 - RNA, 22 nt, Human
caguuuauuuccaagaugacaa

SEQ ID NO: 561599 - RNA, 22 nt, Human
acaggacauguaccaggugguc

SEQ ID NO: 561600 - RNA, 22 nt, Human
cccagaggugcuucagaggugc

SEQ ID NO: 561601 - RNA, 22 nt, Human
ggcucaggccagaccacgacuc

SEQ ID NO: 561602 - RNA, 22 nt, Human
ggagcugcuccuucagccaagu

SEQ ID NO: 561603 - RNA, 22 nt, Human
caaauuuaaguuagaaagcaau

SEQ ID NO: 561604 - RNA, 22 nt, Human
auacaguaaccacauucuauag

SEQ ID NO: 561605 - RNA, 22 nt, Human
gcagcuuucuacuuccuacagc

SEQ ID NO: 561606 - RNA, 22 nt, Human
uuggaaggcccugccuagcagg

SEQ ID NO: 561607 - RNA, 22 nt, Human
uugguucauuauugaaugugcu

SEQ ID NO: 561608 - RNA, 22 nt, Human
uggaagggagugacagucagag

SEQ ID NO: 561609 - RNA, 22 nt, Human
agguggggaggagugucucuuu

SEQ ID NO: 561610 - RNA, 22 nt, Human
acaggaagugcuggcacuuaca

SEQ ID NO: 561611 - RNA, 22 nt, Human
aacaucuugaagauugggaaag

SEQ ID NO: 561612 - RNA, 22 nt, Human
augaaaagggagugauauuugu

SEQ ID NO: 561613 - RNA, 21 nt, Human
ugaggccucuccugggcuggc

SEQ ID NO: 561614 - RNA, 22 nt, Human
ggggccagguccagcuuccaaa

SEQ ID NO: 561615 - RNA, 22 nt, Human
gcuuuucuucagcagccugaug

SEQ ID NO: 561616 - RNA, 22 nt, Human
cagcacagugcagaugcugacu

SEQ ID NO: 561617 - RNA, 19 nt, Human
guugaaaguaggugagggu

SEQ ID NO: 561618 - RNA, 22 nt, Human
agugcaaagcugcugcuguggu

SEQ ID NO: 561619 - RNA, 22 nt, Human
uuggauccaucucaggcauagg

SEQ ID NO: 561620 - RNA, 22 nt, Human
aaaugcagguaguauuuauuuu

SEQ ID NO: 561621 - RNA, 22 nt, Human
uaugagaagguauggugacuug

SEQ ID NO: 561622 - RNA, 19 nt, Human
acaagggcaggcaagguga

SEQ ID NO: 561623 - RNA, 22 nt, Human
gugggacucuucuuuggcagug

SEQ ID NO: 561624 - RNA, 22 nt, Human
gcucccugccuacacggaccuu

SEQ ID NO: 561625 - RNA, 22 nt, Human
gaaugaguauucuuuauaggau

SEQ ID NO: 561626 - RNA, 22 nt, Human
agaugaagauaucugcaggggc

SEQ ID NO: 561627 - RNA, 22 nt, Human
gaagcagaagguuuggacgugc

SEQ ID NO: 561628 - RNA, 22 nt, Human
cugagaggcacaaggcauuucg

SEQ ID NO: 561629 - RNA, 22 nt, Human
uauugcagaagaaaugaaugaa

SEQ ID NO: 561630 - RNA, 22 nt, Human
ugaggcucugcuucuguggcuc

SEQ ID NO: 561631 - RNA, 22 nt, Human
ccagccagcugcccuuggggcc

SEQ ID NO: 561632 - RNA, 22 nt, Human
ugcagccauuuucugccaaugc

SEQ ID NO: 561633 - RNA, 22 nt, Human
uucugcagcccaacaguaguuu

SEQ ID NO: 561634 - RNA, 20 nt, Human
auauaauaaauuuugguuac

SEQ ID NO: 561635 - RNA, 22 nt, Human
agucccagaucuccauucgguc

SEQ ID NO: 561636 - RNA, 22 nt, Human
ugggaaagucuuuauuucucuu

SEQ ID NO: 561637 - RNA, 20 nt, Human
ugugaaagcaguagaaugac

SEQ ID NO: 561638 - RNA, 22 nt, Human
aaauugagacuuuuuuccucca

SEQ ID NO: 561639 - RNA, 20 nt, Human
caggccucugggggcccugg

SEQ ID NO: 561640 - RNA, 22 nt, Human
acauuucacuguucacagcagg

SEQ ID NO: 561641 - RNA, 22 nt, Human
ugucucagggcagcagcagggg

SEQ ID NO: 561642 - RNA, 22 nt, Human
cagggcuggcucaugaaaaguu

SEQ ID NO: 561643 - RNA, 22 nt, Human
gugcccuguucauuucucuccc

SEQ ID NO: 561644 - RNA, 22 nt, Human
ggagugaguggccuugucacug

SEQ ID NO: 561645 - RNA, 22 nt, Human
agcuggcaauguaagucccugg

SEQ ID NO: 561646 - RNA, 20 nt, Human
ggaaaucaccaggcuccacc

SEQ ID NO: 561647 - RNA, 22 nt, Human
gcacacaguauaugcucauuaa

SEQ ID NO: 561648 - RNA, 22 nt, Human
agcagccagugggagugauaca

SEQ ID NO: 561649 - RNA, 22 nt, Human
uguuucauguggacauaguugu

SEQ ID NO: 561650 - RNA, 22 nt, Human
cugagauggccacugggucuca

SEQ ID NO: 561651 - RNA, 22 nt, Human
cuaagaaggaggaaaagugcca

SEQ ID NO: 561652 - RNA, 22 nt, Human
caucaguguucacuauuccuuc

SEQ ID NO: 561653 - RNA, 22 nt, Human
cagccugacaccagcuuugggc

SEQ ID NO: 561654 - RNA, 22 nt, Human
gcaaggcugagcacauuugcau

SEQ ID NO: 561655 - RNA, 22 nt, Human
ggccaggaagggaagaucagca

SEQ ID NO: 561656 - RNA, 22 nt, Human
uagaugaagcaacauguguaau

SEQ ID NO: 561657 - RNA, 22 nt, Human
gucaccauggauaagaaucacu

SEQ ID NO: 561658 - RNA, 22 nt, Human
agccucugugacucacagguca

SEQ ID NO: 561659 - RNA, 22 nt, Human
cacagaggacuguagcggggag

SEQ ID NO: 561660 - RNA, 22 nt, Human
aguggggacuuaugccagcauu

SEQ ID NO: 561661 - RNA, 22 nt, Human
aagcagcagaccugauuuugaa

SEQ ID NO: 561662 - RNA, 22 nt, Human
ugcagagaaaacuccuggguac

SEQ ID NO: 561663 - RNA, 22 nt, Human
acaauuuauccauuguauaguu

SEQ ID NO: 561664 - RNA, 20 nt, Human
acauuuguaucucccagugg

SEQ ID NO: 561665 - RNA, 20 nt, Human
ugucugugccacggcacucc

SEQ ID NO: 561666 - RNA, 20 nt, Human
uucauuugggaaaaucugcg

SEQ ID NO: 561667 - RNA, 22 nt, Human
gaggaugugucuggucugggca

SEQ ID NO: 561668 - RNA, 22 nt, Human
ucuggcuccaggaccgggcaca

SEQ ID NO: 561669 - RNA, 22 nt, Human
ggagggagcauccccuugcuga

SEQ ID NO: 561670 - RNA, 22 nt, Human
ucuggcucuguguccccaccca

SEQ ID NO: 561671 - RNA, 21 nt, Human
acaguucaugauaacuccauc

SEQ ID NO: 561672 - RNA, 22 nt, Human
uuuacacugcuugaacaaucuc

SEQ ID NO: 561673 - RNA, 22 nt, Human
uagaaacacagagagacccaug

SEQ ID NO: 561674 - RNA, 22 nt, Human
cagaacagagucaaaaguaugu

SEQ ID NO: 561675 - RNA, 22 nt, Human
ggucacaggggagaagagugau

SEQ ID NO: 561676 - RNA, 22 nt, Human
uagcagagcugggacuagauua

SEQ ID NO: 561677 - RNA, 22 nt, Human
uguaaagacgcuuauagcuugc

SEQ ID NO: 561678 - RNA, 21 nt, Human
uaacuuuugugccuaucuugu

SEQ ID NO: 561679 - RNA, 22 nt, Human
gcugagguggagauugcaguga

SEQ ID NO: 561680 - RNA, 22 nt, Human
ccucccauggagcucuguccau

SEQ ID NO: 561681 - RNA, 22 nt, Human
cagccugcuagggcaaugccuu

SEQ ID NO: 561682 - RNA, 21 nt, Human
uccaggaguggcugggcaggg

SEQ ID NO: 561683 - RNA, 22 nt, Human
gcucccaccaggcagaccuacc

SEQ ID NO: 561684 - RNA, 22 nt, Human
uagcagggaagaugaucagaau

SEQ ID NO: 561685 - RNA, 21 nt, Human
ucuccaguauccuucucugag

SEQ ID NO: 561686 - RNA, 22 nt, Human
ccacagcaugcaggccugacac

SEQ ID NO: 561687 - RNA, 22 nt, Human
aucagcaaucucguguauuagg

SEQ ID NO: 561688 - RNA, 22 nt, Human
uuuugcuugagugcacaaaaug

SEQ ID NO: 561689 - RNA, 22 nt, Human
agcuggccuccgggugccuggg

SEQ ID NO: 561690 - RNA, 18 nt, Human
uugcuuuguaagcuugca

SEQ ID NO: 561691 - RNA, 22 nt, Human
cucugcccgcggaugccacguc

SEQ ID NO: 561692 - RNA, 22 nt, Human
ccuguggcucucuuuggagguc

SEQ ID NO: 561693 - RNA, 22 nt, Human
agcccugcauagaagggaacac

SEQ ID NO: 561694 - RNA, 22 nt, Human
uccuugaaaagaaugucuccau

SEQ ID NO: 561695 - RNA, 22 nt, Human
gucaccagcaccaaugccacau

SEQ ID NO: 561696 - RNA, 22 nt, Human
cuguccagcugaccagagcagc

SEQ ID NO: 561697 - RNA, 22 nt, Human
uaacacacugaaggugagaugg

SEQ ID NO: 561698 - RNA, 22 nt, Human
ucaccgccuugcccggccgggc

SEQ ID NO: 561699 - RNA, 22 nt, Human
uuuuaacacucagcacuaucuc

SEQ ID NO: 561700 - RNA, 22 nt, Human
gagccagagcuacaagugucug

SEQ ID NO: 561701 - RNA, 22 nt, Human
ugcugggcuucaacugccugag

SEQ ID NO: 561702 - RNA, 22 nt, Human
cauuugaaauaguucauucuug

SEQ ID NO: 561703 - RNA, 22 nt, Human
ggcagcugagcauggcuaccuu

SEQ ID NO: 561704 - RNA, 22 nt, Human
uaaaauguguuucuguaugguu

SEQ ID NO: 561705 - RNA, 22 nt, Human
gauuuguagcuuuucagucugu

SEQ ID NO: 561706 - RNA, 22 nt, Human
cugcagggugacguugcccacc

SEQ ID NO: 561707 - RNA, 22 nt, Human
caggcagcugacugucagauau

SEQ ID NO: 561708 - RNA, 21 nt, Human
aggugcaggccucaagcccca

SEQ ID NO: 561709 - RNA, 22 nt, Human
cagggcucccugcagccucugu

SEQ ID NO: 561710 - RNA, 22 nt, Human
cucugggcaaagaugccucauc

SEQ ID NO: 561711 - RNA, 22 nt, Human
uuucuaaguguauugagcuugg

SEQ ID NO: 561712 - RNA, 22 nt, Human
gagggacagcuaaagagaaauu

SEQ ID NO: 561713 - RNA, 22 nt, Human
uguuugacaccucaguguuucu

SEQ ID NO: 561714 - RNA, 22 nt, Human
cuaggaauccuuuuagaguugg

SEQ ID NO: 561715 - RNA, 22 nt, Human
aagaaaugcagaaaugugcugg

SEQ ID NO: 561716 - RNA, 22 nt, Human
auguccagagccggccugcuga

SEQ ID NO: 561717 - RNA, 22 nt, Human
cugagccuuauucaccagcccu

SEQ ID NO: 561718 - RNA, 22 nt, Human
uugauacaggcucuauuucauc

SEQ ID NO: 561719 - RNA, 22 nt, Human
gcagagccugggggucugcgga

SEQ ID NO: 561720 - RNA, 22 nt, Human
cagcaggauagguuucuuugga

SEQ ID NO: 561721 - RNA, 22 nt, Human
uggcucaggcuugaaaauagau

SEQ ID NO: 561722 - RNA, 22 nt, Human
uaacagcauuugaaugaguaac

SEQ ID NO: 561723 - RNA, 22 nt, Human
uuguuucaaauauuucagaaua

SEQ ID NO: 561724 - RNA, 22 nt, Human
aagcucugcucagcagacuagg

SEQ ID NO: 561725 - RNA, 22 nt, Human
gcucccagggaccgcagggcag

SEQ ID NO: 561726 - RNA, 22 nt, Human
caaagaagagauuuacagagcu

SEQ ID NO: 561727 - RNA, 22 nt, Human
acucagaguuugcguuccauac

SEQ ID NO: 561728 - RNA, 22 nt, Human
uccauauuaacuaaaacuagaa

SEQ ID NO: 561729 - RNA, 22 nt, Human
agcuuuauuugucauucacggc

SEQ ID NO: 561730 - RNA, 22 nt, Human
uuccaaguugagcgauuuuccu

SEQ ID NO: 561731 - RNA, 22 nt, Human
acuaaagcucacagaguugaac

SEQ ID NO: 561732 - RNA, 22 nt, Human
cuggagcccaggccuggugucu

SEQ ID NO: 561733 - RNA, 22 nt, Human
ucacauauuuaagaaaguuaaa

SEQ ID NO: 561734 - RNA, 22 nt, Human
ugcagggccuugggucuuucuu

SEQ ID NO: 561735 - RNA, 17 nt, Human
aaacugaaaaauucacu

SEQ ID NO: 561736 - RNA, 19 nt, Human
uccauaagcuuguguucau

SEQ ID NO: 561737 - RNA, 22 nt, Human
auucuuuuaagccccagggauu

SEQ ID NO: 561738 - RNA, 22 nt, Human
aggccuggugugccggaugcag

SEQ ID NO: 561739 - RNA, 18 nt, Human
aagaaguuggccaaagag

SEQ ID NO: 561740 - RNA, 22 nt, Human
ucucccacagucucccauggcu

SEQ ID NO: 561741 - RNA, 22 nt, Human
ucaggcucucagaccaacagca

SEQ ID NO: 561742 - RNA, 22 nt, Human
uggagaaggacagccugagaaa

SEQ ID NO: 561743 - RNA, 22 nt, Human
gcguggugcugcccugcacaca

SEQ ID NO: 561744 - RNA, 22 nt, Human
caaaugcauaguuuauaagaag

SEQ ID NO: 561745 - RNA, 22 nt, Human
cagcccaaagccccaggcuaga

SEQ ID NO: 561746 - RNA, 22 nt, Human
cugggcuguuuguucuggucuc

SEQ ID NO: 561747 - RNA, 22 nt, Human
ucaauguuuguucaugaaaaua

SEQ ID NO: 561748 - RNA, 22 nt, Human
uuucaacauauaccauaaugcc

SEQ ID NO: 561749 - RNA, 22 nt, Human
gaaucucaguggaagcaggaag

SEQ ID NO: 561750 - RNA, 22 nt, Human
gccugugguuugauuaagcauu

SEQ ID NO: 561751 - RNA, 22 nt, Human
uuugcauucuagaaaaauuucu

SEQ ID NO: 561752 - RNA, 22 nt, Human
gcagggcacagacagugccaag

SEQ ID NO: 561753 - RNA, 22 nt, Human
auccuuggaugugucuuuuugu

SEQ ID NO: 561754 - RNA, 22 nt, Human
cuggaagguuccucccagcucc

SEQ ID NO: 561755 - RNA, 22 nt, Human
aagcugcagacccccugucuca

SEQ ID NO: 561756 - RNA, 22 nt, Human
gcagagcaccaaagugaaagau

SEQ ID NO: 561757 - RNA, 22 nt, Human
ucccagccuggacccugccagu

SEQ ID NO: 561758 - RNA, 22 nt, Human
uuuuaagaugcuaguauuucag

SEQ ID NO: 561759 - RNA, 22 nt, Human
uacuuuaaaaacugauaauuca

SEQ ID NO: 561760 - RNA, 22 nt, Human
uccagggaaggugugaggcugg

SEQ ID NO: 561761 - RNA, 22 nt, Human
acagaaauauucguggugcuug

SEQ ID NO: 561762 - RNA, 22 nt, Human
agaggggcucauauccugucau

SEQ ID NO: 561763 - RNA, 23 nt, Human
gggcugcuccaggccaaggcugg

SEQ ID NO: 561764 - RNA, 22 nt, Human
uuuaauauucugcauucuccuu

SEQ ID NO: 561765 - RNA, 22 nt, Human
cuuguggcccauggcuuccugc

SEQ ID NO: 561766 - RNA, 22 nt, Human
gcaaauguucuauauuugcugu

SEQ ID NO: 561767 - RNA, 22 nt, Human
uccuucagaaaaccucagucuu

SEQ ID NO: 561768 - RNA, 22 nt, Human
caaaugcaugagaaauaagagg

SEQ ID NO: 561769 - RNA, 22 nt, Human
agagcagaggcauggccguggg

SEQ ID NO: 561770 - RNA, 22 nt, Human
acauacuuauguguauaugugu

SEQ ID NO: 561771 - RNA, 22 nt, Human
cugcugggucuaugcaagugga

SEQ ID NO: 561772 - RNA, 22 nt, Human
ccaggcucugucuggucagaag

SEQ ID NO: 561773 - RNA, 22 nt, Human
acaaaggugagcagaagacaca

SEQ ID NO: 561774 - RNA, 22 nt, Human
ccugagagugagugccuccuua

SEQ ID NO: 561775 - RNA, 22 nt, Human
cucccuggcacagcgagagguu

SEQ ID NO: 561776 - RNA, 22 nt, Human
gggcugagauuggugcccuguc

SEQ ID NO: 561777 - RNA, 22 nt, Human
aucaggaaauacuuauuuauaa

SEQ ID NO: 561778 - RNA, 22 nt, Human
agagacugauggaucaccaaau

SEQ ID NO: 561779 - RNA, 22 nt, Human
uccauguggccagacacuggca

SEQ ID NO: 561780 - RNA, 22 nt, Human
cuggcuuucauuucaagcacgu

SEQ ID NO: 561781 - RNA, 22 nt, Human
ucucugugguuugagagccggg

SEQ ID NO: 561782 - RNA, 22 nt, Human
gaaaugucuuugacaagagagg

SEQ ID NO: 561783 - RNA, 18 nt, Human
uccugcagcuucuaugua

SEQ ID NO: 561784 - RNA, 22 nt, Human
uuccagaagauggcagcaaagg

SEQ ID NO: 561785 - RNA, 22 nt, Human
uacaaagugcuuuagaaaugaa

SEQ ID NO: 561786 - RNA, 17 nt, Human
aaauaugaccucaaagu

SEQ ID NO: 561787 - RNA, 22 nt, Human
caaauguguagagcuuuugggg

SEQ ID NO: 561788 - RNA, 22 nt, Human
augugaaacugaagcauccaua

SEQ ID NO: 561789 - RNA, 22 nt, Human
gggcugcuuccuggggaaugcu

SEQ ID NO: 561790 - RNA, 23 nt, Human
uucauuugucuacuucacuuguu

SEQ ID NO: 561791 - RNA, 22 nt, Human
uucuauauuggaagugagaaau

SEQ ID NO: 561792 - RNA, 22 nt, Human
aacuuuagaaaggaaggaagug

SEQ ID NO: 561793 - RNA, 22 nt, Human
aaagaugaccguaugucagagc

SEQ ID NO: 561794 - RNA, 22 nt, Human
gaaaucaugagaucucuuggac

SEQ ID NO: 561795 - RNA, 21 nt, Human
cagagguggccugaccucuga

SEQ ID NO: 561796 - RNA, 22 nt, Human
guucacauguguuaucuucuuu

SEQ ID NO: 561797 - RNA, 22 nt, Human
uuccaggaagauucaacaaaag

SEQ ID NO: 561798 - RNA, 22 nt, Human
gcagaugccagaucaugcaggg

SEQ ID NO: 561799 - RNA, 22 nt, Human
aaggcugaggcagugaggcaga

SEQ ID NO: 561800 - RNA, 22 nt, Human
gccugcugagggaaguugggca

SEQ ID NO: 561801 - RNA, 22 nt, Human
gcugcagcucgccuuccggccu

SEQ ID NO: 561802 - RNA, 22 nt, Human
acuuccuggcguagcugacauu

SEQ ID NO: 561803 - RNA, 22 nt, Human
ucacacgugagguucuauccug

SEQ ID NO: 561804 - RNA, 22 nt, Human
augcaguaaauguucuaguuug

SEQ ID NO: 561805 - RNA, 22 nt, Human
ugagugaggaagcgguggagga

SEQ ID NO: 561806 - RNA, 22 nt, Human
agggcuggcaucucuaaugcug

SEQ ID NO: 561807 - RNA, 22 nt, Human
ucaauucaguccaacaguaauu

SEQ ID NO: 561808 - RNA, 22 nt, Human
uaagagcauaggcuugaaaaua

SEQ ID NO: 561809 - RNA, 22 nt, Human
uaacaucuuuagcagcucgaac

SEQ ID NO: 561810 - RNA, 22 nt, Human
guccaggucuggacccugagcc

SEQ ID NO: 561811 - RNA, 22 nt, Human
cugcccugugaggguccuuggg

SEQ ID NO: 561812 - RNA, 22 nt, Human
gcugucugucuucacaucucgc

SEQ ID NO: 561813 - RNA, 22 nt, Human
ugcagggagggcccagcaaucu

SEQ ID NO: 561814 - RNA, 22 nt, Human
uugggcugaacccugcagcuga

SEQ ID NO: 561815 - RNA, 22 nt, Human
cagagaaagaagcccauucauu

SEQ ID NO: 561816 - RNA, 22 nt, Human
uauguacaaucagcaguucaua

SEQ ID NO: 561817 - RNA, 22 nt, Human
uccuccagcaggacugaggccc

SEQ ID NO: 561818 - RNA, 22 nt, Human
cauauuaaggucuguaaggggu

SEQ ID NO: 561819 - RNA, 22 nt, Human
cuuaacagauacaucugugguu

SEQ ID NO: 561820 - RNA, 22 nt, Human
ccagcuuuccugcgaguugauu

SEQ ID NO: 561821 - RNA, 22 nt, Human
aagauggcugcagcaauuccaa

SEQ ID NO: 561822 - RNA, 22 nt, Human
aagcuuucagagcagaauguga

SEQ ID NO: 561823 - RNA, 22 nt, Human
ugccccugaccucaggcgaagg

SEQ ID NO: 561824 - RNA, 22 nt, Human
gccaggcuccaggcccuccuga

SEQ ID NO: 561825 - RNA, 22 nt, Human
uucuuuucaagaggggcaagga

SEQ ID NO: 561826 - RNA, 19 nt, Human
gguggcagaacgugggucc

SEQ ID NO: 561827 - RNA, 22 nt, Human
ucauuuacuucuaugacaacau

SEQ ID NO: 561828 - RNA, 23 nt, Human
uugcauccugacgucuauuuucu

SEQ ID NO: 561829 - RNA, 22 nt, Human
gggagggauuaguucugccugg

SEQ ID NO: 561830 - RNA, 22 nt, Human
cccaggcagcccuucugacgca

SEQ ID NO: 561831 - RNA, 22 nt, Human
ucucagagugguggucccucug

SEQ ID NO: 561832 - RNA, 22 nt, Human
auucuacaacccaauaauaauu

SEQ ID NO: 561833 - RNA, 22 nt, Human
agggcugaugcaccauguagcc

SEQ ID NO: 561834 - RNA, 22 nt, Human
cugccugcaucccacagugggg

SEQ ID NO: 561835 - RNA, 22 nt, Human
auaaauucaaagcauuuaggac

SEQ ID NO: 561836 - RNA, 22 nt, Human
agagcagccugugaugaugcac

SEQ ID NO: 561837 - RNA, 22 nt, Human
ugaaggaaugagggaguggguc

SEQ ID NO: 561838 - RNA, 23 nt, Human
ucaaacauauugugagacacagg

SEQ ID NO: 561839 - RNA, 23 nt, Human
gcauugucuccccacuucugggc

SEQ ID NO: 561840 - RNA, 22 nt, Human
ggcaugggguguauguggcacg

SEQ ID NO: 561841 - RNA, 22 nt, Human
agaagccacuggagguugagau

SEQ ID NO: 561842 - RNA, 21 nt, Human
ucugggcagcccaguccugag

SEQ ID NO: 561843 - RNA, 22 nt, Human
uaugaagugaguuaugguugcu

SEQ ID NO: 561844 - RNA, 22 nt, Human
guggggcaugcacgcugcuccu

SEQ ID NO: 561845 - RNA, 23 nt, Human
acuuuagauaaauuaugugcaca

SEQ ID NO: 561846 - RNA, 22 nt, Human
gccagcucagugccaggccccu

SEQ ID NO: 561847 - RNA, 22 nt, Human
agauguuuuagaguuugacuug

SEQ ID NO: 561848 - RNA, 22 nt, Human
gggccagugaacaaugagggaa

SEQ ID NO: 561849 - RNA, 21 nt, Human
aagaagcaauuuauuggaagg

SEQ ID NO: 561850 - RNA, 22 nt, Human
gcuaacauugauucagugccug

SEQ ID NO: 561851 - RNA, 22 nt, Human
uacugacacaaagccaaucccu

SEQ ID NO: 561852 - RNA, 22 nt, Human
ugcagguggcuccagggacugc

SEQ ID NO: 561853 - RNA, 22 nt, Human
aucucccagccacagcauucuu

SEQ ID NO: 561854 - RNA, 22 nt, Human
cugaagcaggaacagcgagauu

SEQ ID NO: 561855 - RNA, 22 nt, Human
uucccuccgaaccucagugcug

SEQ ID NO: 561856 - RNA, 22 nt, Human
ucacaaauguuugcaugugucu

SEQ ID NO: 561857 - RNA, 22 nt, Human
ucaugaauauugaaugcuucau

SEQ ID NO: 561858 - RNA, 22 nt, Human
ugcaugugugacaaggacaguu

SEQ ID NO: 561859 - RNA, 22 nt, Human
aaggaagacucgcaggucuaug

SEQ ID NO: 561860 - RNA, 22 nt, Human
uagauuucaggcuggcuugcgg

SEQ ID NO: 561861 - RNA, 22 nt, Human
cccuccagccauggacccaggu

SEQ ID NO: 561862 - RNA, 22 nt, Human
auggggugagacuaggauuaaa

SEQ ID NO: 561863 - RNA, 22 nt, Human
gggcccuggcuuuccuguucuu

SEQ ID NO: 561864 - RNA, 22 nt, Human
aaagcaccuagcauagugcuua

SEQ ID NO: 561865 - RNA, 22 nt, Human
aauuagggaaaacauuugcuuu

SEQ ID NO: 561866 - RNA, 22 nt, Human
gagccuucaucgcagccuuguu

SEQ ID NO: 561867 - RNA, 22 nt, Human
gagguggcuuagucucuggaca

SEQ ID NO: 561868 - RNA, 22 nt, Human
ggcacugggcaccggcugaggg

SEQ ID NO: 561869 - RNA, 22 nt, Human
acuccaggcaucugcuucugcu

SEQ ID NO: 561870 - RNA, 22 nt, Human
auaaaugauucagcaggaaaua

SEQ ID NO: 561871 - RNA, 22 nt, Human
aucuccaggcauuucaagagac

SEQ ID NO: 561872 - RNA, 22 nt, Human
aacucacagcuguuuggauuag

SEQ ID NO: 561873 - RNA, 22 nt, Human
uuuacuuugugucaagucaaga

SEQ ID NO: 561874 - RNA, 22 nt, Human
uuucacagagaauauugccuug

SEQ ID NO: 561875 - RNA, 22 nt, Human
gccacugcacuccagcccaggc

SEQ ID NO: 561876 - RNA, 22 nt, Human
cgaugguucuggcugcuuguau

SEQ ID NO: 561877 - RNA, 22 nt, Human
gggagaaggaggacugugcugu

SEQ ID NO: 561878 - RNA, 22 nt, Human
cugcugugcaacauugcaccua

SEQ ID NO: 561879 - RNA, 22 nt, Human
uuucaaauggagucgugaaaug

SEQ ID NO: 561880 - RNA, 22 nt, Human
gggagaaggagcuaguucuuga

SEQ ID NO: 561881 - RNA, 22 nt, Human
ugugcagaguaaggcagcuguu

SEQ ID NO: 561882 - RNA, 22 nt, Human
gggcccugccccguggcucuga

SEQ ID NO: 561883 - RNA, 22 nt, Human
ccucaggguggcaucagaucuu

SEQ ID NO: 561884 - RNA, 22 nt, Human
gaggcagcaaaauauaucauaa

SEQ ID NO: 561885 - RNA, 22 nt, Human
uguucuuucaguuagacacagu

SEQ ID NO: 561886 - RNA, 22 nt, Human
uaucaacauuaauauuuucugg

SEQ ID NO: 561887 - RNA, 22 nt, Human
augcagaagcagaacuuacaca

SEQ ID NO: 561888 - RNA, 22 nt, Human
ugggcucucuggcaggaaggcu

SEQ ID NO: 561889 - RNA, 22 nt, Human
ccuuuucuaaucuuaagaaugu

SEQ ID NO: 561890 - RNA, 22 nt, Human
aaauacagaguugcuuaaaagc

SEQ ID NO: 561891 - RNA, 22 nt, Human
gcugcucuuuucagagaugaga

SEQ ID NO: 561892 - RNA, 22 nt, Human
ugcaggugugguuccucagcca

SEQ ID NO: 561893 - RNA, 20 nt, Human
gcagagugugagagggugaa

SEQ ID NO: 561894 - RNA, 22 nt, Human
gaaauuuacaacuuucucaugg

SEQ ID NO: 561895 - RNA, 22 nt, Human
aaaugacacuaggcuuuuugca

SEQ ID NO: 561896 - RNA, 22 nt, Human
ggccaggcugcugggaccccgc

SEQ ID NO: 561897 - RNA, 22 nt, Human
agaaugauacucuaugccaaau

SEQ ID NO: 561898 - RNA, 22 nt, Human
gagccagcgccuugccucuggg

SEQ ID NO: 561899 - RNA, 22 nt, Human
uggaggcaacugaagauguagu

SEQ ID NO: 561900 - RNA, 22 nt, Human
cugcagaggguuugagcauccu

SEQ ID NO: 561901 - RNA, 22 nt, Human
ugcuuuaucugacuuggcgcug

SEQ ID NO: 561902 - RNA, 22 nt, Human
cuggccaggcuugggacagaca

SEQ ID NO: 561903 - RNA, 21 nt, Human
gcugucucuggcuccugggaa

SEQ ID NO: 561904 - RNA, 22 nt, Human
ugugaaggagcaugcagagggg

SEQ ID NO: 561905 - RNA, 22 nt, Human
ggcugagccacugcgccuggcu

SEQ ID NO: 561906 - RNA, 22 nt, Human
aguuucuuauucuuaguuaugu

SEQ ID NO: 561907 - RNA, 22 nt, Human
ucuucaugucucugcuugaguc

SEQ ID NO: 561908 - RNA, 22 nt, Human
ccuuagagaguacugggcugcc

SEQ ID NO: 561909 - RNA, 22 nt, Human
uguggcucuccuccugcugccc

SEQ ID NO: 561910 - RNA, 22 nt, Human
uagagcaguuggcagcuguauu

SEQ ID NO: 561911 - RNA, 22 nt, Human
cagggguggcugcagcagaggu

SEQ ID NO: 561912 - RNA, 22 nt, Human
ucucuggguugagaacuaggac

SEQ ID NO: 561913 - RNA, 22 nt, Human
aguuacaaacacuaucaguucu

SEQ ID NO: 561914 - RNA, 22 nt, Human
gagccaggcaccuucuguguug

SEQ ID NO: 561915 - RNA, 22 nt, Human
ccagagucugugugugucaucc

SEQ ID NO: 561916 - RNA, 22 nt, Human
ccagagccucaacacagguccu

SEQ ID NO: 561917 - RNA, 22 nt, Human
uagggacccucccugcucuaac

SEQ ID NO: 561918 - RNA, 22 nt, Human
agauuuagugguggaauuuugg

SEQ ID NO: 561919 - RNA, 22 nt, Human
uuugcaaagugacuauuauaug

SEQ ID NO: 561920 - RNA, 20 nt, Human
uaagaacaagacuaggaagc

SEQ ID NO: 561921 - RNA, 22 nt, Human
ucccacauuacccugacugaca

SEQ ID NO: 561922 - RNA, 22 nt, Human
gcugcuggaagcaugcgaugaa

SEQ ID NO: 561923 - RNA, 22 nt, Human
aggaaggacuccaugguccguc

SEQ ID NO: 561924 - RNA, 22 nt, Human
gaggcugaugcugccucacaga

SEQ ID NO: 561925 - RNA, 22 nt, Human
auauuucucucagacauggaag

SEQ ID NO: 561926 - RNA, 22 nt, Human
ugcaaucucggcacuuugggag

SEQ ID NO: 561927 - RNA, 22 nt, Human
uaguauuuccuguaagcuauag

SEQ ID NO: 561928 - RNA, 22 nt, Human
aggaaucccgcaccagcugcug

SEQ ID NO: 561929 - RNA, 22 nt, Human
ugugaaauucuugaaaugcaca

SEQ ID NO: 561930 - RNA, 22 nt, Human
agcagcuucuuucacuccugga

SEQ ID NO: 561931 - RNA, 19 nt, Human
acagaaauguaagugagac

SEQ ID NO: 561932 - RNA, 22 nt, Human
uaaggcucauguaauuagagau

SEQ ID NO: 561933 - RNA, 22 nt, Human
aaggccagcuuguagggcuggu

SEQ ID NO: 561934 - RNA, 22 nt, Human
cacaaaaguaggaggcaggcgg

SEQ ID NO: 561935 - RNA, 22 nt, Human
agccugugacauugacuaugaa

SEQ ID NO: 561936 - RNA, 22 nt, Human
agugcagcucccucaccugcuu

SEQ ID NO: 561937 - RNA, 22 nt, Human
aagcuggacucugccauuuacu

SEQ ID NO: 561938 - RNA, 23 nt, Human
ucccaugggcucacugcccugca

SEQ ID NO: 561939 - RNA, 21 nt, Human
aggacaggaacuggcugaaua

SEQ ID NO: 561940 - RNA, 22 nt, Human
uuugaaauuggcucauugguuu

SEQ ID NO: 561941 - RNA, 19 nt, Human
uccuccuuacuuccucuug

SEQ ID NO: 561942 - RNA, 22 nt, Human
ugccagcacaaguuaagagauc

SEQ ID NO: 561943 - RNA, 22 nt, Human
ucuggcagugaagucaugaggu

SEQ ID NO: 561944 - RNA, 22 nt, Human
gaggccugguuuccagcauccu

SEQ ID NO: 561945 - RNA, 22 nt, Human
uaagaacauuuucggaaagaua

SEQ ID NO: 561946 - RNA, 22 nt, Human
gugggaguggggaagcagagug

SEQ ID NO: 561947 - RNA, 22 nt, Human
uuucucaaggugucauguauuu

SEQ ID NO: 561948 - RNA, 22 nt, Human
agggucugacugaauggaaaag

SEQ ID NO: 561949 - RNA, 22 nt, Human
cuuuuuuaagguagcuccuccu

SEQ ID NO: 561950 - RNA, 22 nt, Human
ccccugaagacaauggagaggu

SEQ ID NO: 561951 - RNA, 22 nt, Human
gguggccuuucaguggaucagg

SEQ ID NO: 561952 - RNA, 22 nt, Human
gaaggcuguaggcaaaguagga

SEQ ID NO: 561953 - RNA, 20 nt, Human
uagaggggacaaucauugcc

SEQ ID NO: 561954 - RNA, 22 nt, Human
caguguggcugagacagaggcu

SEQ ID NO: 561955 - RNA, 22 nt, Human
gacauguugaagaauauuugga

SEQ ID NO: 561956 - RNA, 22 nt, Human
ucuuuuauccuacauuuagcuc

SEQ ID NO: 561957 - RNA, 22 nt, Human
uuuacaaggcaguuauuuuccu

SEQ ID NO: 561958 - RNA, 22 nt, Human
ugugagagagugcauuugcaua

SEQ ID NO: 561959 - RNA, 22 nt, Human
cucaagucagaaauaaaagcau

SEQ ID NO: 561960 - RNA, 22 nt, Human
uuuauucaagaugagguucaug

SEQ ID NO: 561961 - RNA, 22 nt, Human
uugauuugauuguaauggcucu

SEQ ID NO: 561962 - RNA, 22 nt, Human
uggugcagauagugguguagua

SEQ ID NO: 561963 - RNA, 20 nt, Human
gaaggaagggggcaagguga

SEQ ID NO: 561964 - RNA, 18 nt, Human
ccucaggggaccuggcag

SEQ ID NO: 561965 - RNA, 22 nt, Human
aaauuauuauaggcagagcuga

SEQ ID NO: 561966 - RNA, 22 nt, Human
agaagccaaaugccagugaccu

SEQ ID NO: 561967 - RNA, 22 nt, Human
aagcaaggccggaaggaaacuc

SEQ ID NO: 561968 - RNA, 22 nt, Human
ugagaaagacagacauuccuaa

SEQ ID NO: 561969 - RNA, 18 nt, Human
uccccugcucuggugcuc

SEQ ID NO: 561970 - RNA, 22 nt, Human
ccagagcagggcagcagggcuc

SEQ ID NO: 561971 - RNA, 22 nt, Human
cuguuauuucugccaggugagu

SEQ ID NO: 561972 - RNA, 22 nt, Human
uacauuguucaugcaugagaaa

SEQ ID NO: 561973 - RNA, 22 nt, Human
aauguguauacuggcaauuaag

SEQ ID NO: 561974 - RNA, 21 nt, Human
gagagggcauuauaggaagug

SEQ ID NO: 561975 - RNA, 19 nt, Human
ggagaagcccaggaauccu

SEQ ID NO: 561976 - RNA, 22 nt, Human
uuguuuccauugcagacugugu

SEQ ID NO: 561977 - RNA, 22 nt, Human
gggcugucacgccccugcaccu

SEQ ID NO: 561978 - RNA, 22 nt, Human
uaggcagcugcaaacuucgguc

SEQ ID NO: 561979 - RNA, 23 nt, Human
uguaaacaucacccccuggaguu

SEQ ID NO: 561980 - RNA, 22 nt, Human
gacccugccaugagugacaggg

SEQ ID NO: 561981 - RNA, 22 nt, Human
cuccucacacccacugcaacca

SEQ ID NO: 561982 - RNA, 22 nt, Human
aggcaggggagcuggaagggua

SEQ ID NO: 561983 - RNA, 22 nt, Human
caggaagauuguggaggugguu

SEQ ID NO: 561984 - RNA, 22 nt, Human
acacuucagcaguaugcuuggg

SEQ ID NO: 561985 - RNA, 22 nt, Human
uguacagagguguacauaugau

SEQ ID NO: 561986 - RNA, 22 nt, Human
gugguccuuuagaggauguaau

SEQ ID NO: 561987 - RNA, 22 nt, Human
aaggcagcaagaauuccagguu

SEQ ID NO: 561988 - RNA, 22 nt, Human
agaggcugagaaacccucuucu

SEQ ID NO: 561989 - RNA, 22 nt, Human
auaugaagaaucuaggauaggc

SEQ ID NO: 561990 - RNA, 22 nt, Human
ccucaggaaccacauugcugcu

SEQ ID NO: 561991 - RNA, 22 nt, Human
gcacagccuugcccugugcccu

SEQ ID NO: 561992 - RNA, 22 nt, Human
ccuggcagguggagguugcagu

SEQ ID NO: 561993 - RNA, 18 nt, Human
aggcaggcuggagugacu

SEQ ID NO: 561994 - RNA, 22 nt, Human
uuauugccugauugaggucauu

SEQ ID NO: 561995 - RNA, 21 nt, Human
agcuuguguguaucacagugu

SEQ ID NO: 561996 - RNA, 18 nt, Human
aaacagugccuaaguguc

SEQ ID NO: 561997 - RNA, 22 nt, Human
auuuuugagcugugaacauagc

SEQ ID NO: 561998 - RNA, 22 nt, Human
ccuggccucgugcucacggcuc

SEQ ID NO: 561999 - RNA, 22 nt, Human
aggggugaaggcccgauaggag

SEQ ID NO: 562000 - RNA, 22 nt, Human
cuggccuggucuggccucucca

SEQ ID NO: 562001 - RNA, 22 nt, Human
aguauuucugaauauuaucaua

SEQ ID NO: 562002 - RNA, 22 nt, Human
aagaacagguucuagaaccauu

SEQ ID NO: 562003 - RNA, 22 nt, Human
gcuggcaggauagaagucuaau

SEQ ID NO: 562004 - RNA, 22 nt, Human
ugaggcaguauucuccauucca

SEQ ID NO: 562005 - RNA, 22 nt, Human
ugggcugagcagugaagcucau

SEQ ID NO: 562006 - RNA, 22 nt, Human
cuguggcucaaaaucccaugau

SEQ ID NO: 562007 - RNA, 22 nt, Human
ugcagggacacgaagacaaaua

SEQ ID NO: 562008 - RNA, 22 nt, Human
gcuggagucuggaggugugcca

SEQ ID NO: 562009 - RNA, 22 nt, Human
agaugguuuugucuuuaugauu

SEQ ID NO: 562010 - RNA, 22 nt, Human
cugggccuuuaccuacggaguu

SEQ ID NO: 562011 - RNA, 22 nt, Human
gagguacagaguguuccaaugu

SEQ ID NO: 562012 - RNA, 22 nt, Human
caggcacucauucagagaggug

SEQ ID NO: 562013 - RNA, 22 nt, Human
uggcuucauuauuguuuuuccu

SEQ ID NO: 562014 - RNA, 22 nt, Human
ucugagugauguugagucagaa

SEQ ID NO: 562015 - RNA, 22 nt, Human
agauuugucagcucagucuuua

SEQ ID NO: 562016 - RNA, 23 nt, Human
guccagaacccaggcuggggugg

SEQ ID NO: 562017 - RNA, 22 nt, Human
uuucacagcugggaagagauau

SEQ ID NO: 562018 - RNA, 22 nt, Human
cacaggaaugaacagggaaaga

SEQ ID NO: 562019 - RNA, 22 nt, Human
aaauuucaagcaaaguagcuau

SEQ ID NO: 562020 - RNA, 22 nt, Human
guuauucaacuugugucucuua

SEQ ID NO: 562021 - RNA, 22 nt, Human
caggucagaggcgcagccccca

SEQ ID NO: 562022 - RNA, 22 nt, Human
acuuucauuuguaauaaacuuc

SEQ ID NO: 562023 - RNA, 22 nt, Human
gcaaaugcuaaaguguagagac

SEQ ID NO: 562024 - RNA, 22 nt, Human
guuucuuuuaaaauauguagac

SEQ ID NO: 562025 - RNA, 21 nt, Human
uucaaugaaaacaaagugagg

SEQ ID NO: 562026 - RNA, 22 nt, Human
aguggugccggguggguuuugc

SEQ ID NO: 562027 - RNA, 22 nt, Human
uuccaaugacuaguggcauccu

SEQ ID NO: 562028 - RNA, 22 nt, Human
acugcacagaagaaacuaucaa

SEQ ID NO: 562029 - RNA, 22 nt, Human
gcugccuggagaggcagggaug

SEQ ID NO: 562030 - RNA, 22 nt, Human
acaggcagggaccuuggcuaag

SEQ ID NO: 562031 - RNA, 22 nt, Human
uaaauuaugucacaugacucug

SEQ ID NO: 562032 - RNA, 22 nt, Human
uaucuacauucuuguaucuucu

SEQ ID NO: 562033 - RNA, 22 nt, Human
aggaaagggguagguguggacg

SEQ ID NO: 562034 - RNA, 22 nt, Human
cagggagcuauuaggguuagug

SEQ ID NO: 562035 - RNA, 23 nt, Human
ccagcugugccuggcccaggagc

SEQ ID NO: 562036 - RNA, 22 nt, Human
aguguuccugcucucaggaagc

SEQ ID NO: 562037 - RNA, 22 nt, Human
acuguuuuccuaaugagcaaga

SEQ ID NO: 562038 - RNA, 22 nt, Human
cuuaggaacgcucugccuagug

SEQ ID NO: 562039 - RNA, 22 nt, Human
uugaaggacauccuauuucuag

SEQ ID NO: 562040 - RNA, 20 nt, Human
aggagcugaauuagaggguu

SEQ ID NO: 562041 - RNA, 22 nt, Human
ugagcuuacuucuguacacaga

SEQ ID NO: 562042 - RNA, 22 nt, Human
agccaggauuggcugagccuua

SEQ ID NO: 562043 - RNA, 22 nt, Human
augcauaagugcagcagauuug

SEQ ID NO: 562044 - RNA, 20 nt, Human
gauuacaaaaugaaaugcau

SEQ ID NO: 562045 - RNA, 22 nt, Human
ggcugggccagggccuguggac

SEQ ID NO: 562046 - RNA, 22 nt, Human
agcccugcaggaggugggagag

SEQ ID NO: 562047 - RNA, 22 nt, Human
cagcagcuuugccaagucagcc

SEQ ID NO: 562048 - RNA, 22 nt, Human
uuaacacagggggagacaaagu

SEQ ID NO: 562049 - RNA, 22 nt, Human
gcaaaauuuacacuccuucuuc

SEQ ID NO: 562050 - RNA, 22 nt, Human
aaugaacaucaaaugccuacca

SEQ ID NO: 562051 - RNA, 22 nt, Human
agggagguaggagcuucuagcu

SEQ ID NO: 562052 - RNA, 22 nt, Human
uucaaacuguguaauuuauaaa

SEQ ID NO: 562053 - RNA, 22 nt, Human
ucagagucuaaauagaagaaua

SEQ ID NO: 562054 - RNA, 22 nt, Human
cccaggcaguagaaagaagagg

SEQ ID NO: 562055 - RNA, 22 nt, Human
agcgagguuuguucuauucagu

SEQ ID NO: 562056 - RNA, 22 nt, Human
uacauacauguauguguguauu

SEQ ID NO: 562057 - RNA, 22 nt, Human
agaaaucucaguaucucaggga

SEQ ID NO: 562058 - RNA, 22 nt, Human
aagggccauaacuugcaguguu

SEQ ID NO: 562059 - RNA, 22 nt, Human
uaccacaguuuaucuauucagc

SEQ ID NO: 562060 - RNA, 23 nt, Human
ucuucaugcccaggccuuggugc

SEQ ID NO: 562061 - RNA, 22 nt, Human
gcagcaggcuuuucauaccuug

SEQ ID NO: 562062 - RNA, 20 nt, Human
uggagguggucugcuguccu

SEQ ID NO: 562063 - RNA, 18 nt, Human
ccucagggagagagacgc

SEQ ID NO: 562064 - RNA, 22 nt, Human
cugggaugauagugcuaguauu

SEQ ID NO: 562065 - RNA, 22 nt, Human
agcugaagcaacaacaggaugg

SEQ ID NO: 562066 - RNA, 22 nt, Human
cacaggagguuaggaagugguc

SEQ ID NO: 562067 - RNA, 22 nt, Human
uuccagaaaccugaaaguuucu

SEQ ID NO: 562068 - RNA, 22 nt, Human
auuguugggucucacuccuaga

SEQ ID NO: 562069 - RNA, 22 nt, Human
cacugcuucuggaggaauuugg

SEQ ID NO: 562070 - RNA, 22 nt, Human
ggcaggcuccagagcccucucc

SEQ ID NO: 562071 - RNA, 22 nt, Human
uuucuaaaauagauuuuauggu

SEQ ID NO: 562072 - RNA, 22 nt, Human
agcuagagaaugacagagucug

SEQ ID NO: 562073 - RNA, 22 nt, Human
acccaggaugauaauguucaca

SEQ ID NO: 562074 - RNA, 22 nt, Human
uuugcagcaaggagagagcauu

SEQ ID NO: 562075 - RNA, 22 nt, Human
uuugaaacccgucacuuugagu

SEQ ID NO: 562076 - RNA, 20 nt, Human
uacugggcaagcccacagac

SEQ ID NO: 562077 - RNA, 18 nt, Human
cccagcuggugggucagu

SEQ ID NO: 562078 - RNA, 22 nt, Human
cacaugcaucugucauguuugg

SEQ ID NO: 562079 - RNA, 21 nt, Human
ucagagucucaggagcaaggg

SEQ ID NO: 562080 - RNA, 21 nt, Human
aggucccagguuugggcagca

SEQ ID NO: 562081 - RNA, 22 nt, Human
cugccucuauucacugaggcag

SEQ ID NO: 562082 - RNA, 22 nt, Human
aggcucuucuuuuauuaacuga

SEQ ID NO: 562083 - RNA, 22 nt, Human
agugcaaagcagccuguacacc

SEQ ID NO: 562084 - RNA, 22 nt, Human
ucaaagaagauuacccucccau

SEQ ID NO: 562085 - RNA, 21 nt, Human
uuucugaaggcaacaucuauc

SEQ ID NO: 562086 - RNA, 22 nt, Human
ccagagaggccaaggucguggu

SEQ ID NO: 562087 - RNA, 22 nt, Human
uggggccagagauggggcgcag

SEQ ID NO: 562088 - RNA, 22 nt, Human
accuuucacgguaucagacauc

SEQ ID NO: 562089 - RNA, 22 nt, Human
gcagggcauagaggcacggagg

SEQ ID NO: 562090 - RNA, 20 nt, Human
uuuauucagccuacccucuu

SEQ ID NO: 562091 - RNA, 22 nt, Human
agcaagcuaccuagauagucua

SEQ ID NO: 562092 - RNA, 22 nt, Human
uagagcuggaauuugcagcaag

SEQ ID NO: 562093 - RNA, 22 nt, Human
cacugccugugagcugugugcc

SEQ ID NO: 562094 - RNA, 23 nt, Human
uuucauaugguguggaugaagaa

SEQ ID NO: 562095 - RNA, 22 nt, Human
gccagaaacauacacaucacuu

SEQ ID NO: 562096 - RNA, 22 nt, Human
gggcuguguacuaugaggaggg

SEQ ID NO: 562097 - RNA, 23 nt, Human
cagcagagagcagaccuuugugu

SEQ ID NO: 562098 - RNA, 22 nt, Human
cuguugucuccucucagauuau

SEQ ID NO: 562099 - RNA, 22 nt, Human
gggcagccucggugccugcugc

SEQ ID NO: 562100 - RNA, 22 nt, Human
ugcagggcagauaugacuguag

SEQ ID NO: 562101 - RNA, 22 nt, Human
ccacagggcacagacaggaagc

SEQ ID NO: 562102 - RNA, 22 nt, Human
ccuggcugcuauagcagcaugu

SEQ ID NO: 562103 - RNA, 23 nt, Human
uggccaggguacuacacccaccc

SEQ ID NO: 562104 - RNA, 22 nt, Human
gaggagagagggacugucugca

SEQ ID NO: 562105 - RNA, 22 nt, Human
acauuaaagaguaagguuaguu

SEQ ID NO: 562106 - RNA, 22 nt, Human
ccccuuccaggaagcagaaucg

SEQ ID NO: 562107 - RNA, 22 nt, Human
cagacacugcagcagucuccca

SEQ ID NO: 562108 - RNA, 22 nt, Human
guauuucuaguuucuuccacag

SEQ ID NO: 562109 - RNA, 22 nt, Human
uggcugagccuuuggggcuuuc

SEQ ID NO: 562110 - RNA, 22 nt, Human
agcuccugggccaagcccaugc

SEQ ID NO: 562111 - RNA, 22 nt, Human
agcuuguuaaggaugcauauua

SEQ ID NO: 562112 - RNA, 22 nt, Human
uaaauaucaccuggaauuguua

SEQ ID NO: 562113 - RNA, 22 nt, Human
ggcagguggauuuucuacucua

SEQ ID NO: 562114 - RNA, 22 nt, Human
agauaaaaugauuuucuggauc

SEQ ID NO: 562115 - RNA, 22 nt, Human
agcagcaaagaauaggcccucu

SEQ ID NO: 562116 - RNA, 22 nt, Human
gggcugagccauuugaaccuug

SEQ ID NO: 562117 - RNA, 22 nt, Human
cuggcugcuuguagacucgacu

SEQ ID NO: 562118 - RNA, 21 nt, Human
uucaagauauuuaaaaggugg

SEQ ID NO: 562119 - RNA, 22 nt, Human
uacagauauuguacaguuauag

SEQ ID NO: 562120 - RNA, 22 nt, Human
uacauuaucuuguuaucuuuca

SEQ ID NO: 562121 - RNA, 22 nt, Human
uauuucaggggguacaagaaga

SEQ ID NO: 562122 - RNA, 22 nt, Human
gagagucuaggaaccucauaua

SEQ ID NO: 562123 - RNA, 22 nt, Human
acugggaggcaaagagcaagga

SEQ ID NO: 562124 - RNA, 23 nt, Human
gccucuggagccccagugcucag

SEQ ID NO: 562125 - RNA, 22 nt, Human
aaugcaauaccuuuuuaugcug

SEQ ID NO: 562126 - RNA, 22 nt, Human
ggcugcaggcagaggcugucug

SEQ ID NO: 562127 - RNA, 22 nt, Human
cuuauguaaaacggaaagggaa

SEQ ID NO: 562128 - RNA, 22 nt, Human
cacacacaguuuuguauucugu

SEQ ID NO: 562129 - RNA, 20 nt, Human
cagcuuuagaucuuugauua

SEQ ID NO: 562130 - RNA, 22 nt, Human
uugcugaaguuaaugcuugcaa

SEQ ID NO: 562131 - RNA, 22 nt, Human
acugaaggaaacuuuuguguuu

SEQ ID NO: 562132 - RNA, 22 nt, Human
cagcuauggugacaaggucagg

SEQ ID NO: 562133 - RNA, 22 nt, Human
gguggguuuggaagagcaggcu

SEQ ID NO: 562134 - RNA, 22 nt, Human
ccucauggaccucagacugucc

SEQ ID NO: 562135 - RNA, 22 nt, Human
cacaggcuugucagcaugaggc

SEQ ID NO: 562136 - RNA, 22 nt, Human
accaagcuguauauuauugguu

SEQ ID NO: 562137 - RNA, 17 nt, Human
uucaaagcuuaucaagg

SEQ ID NO: 562138 - RNA, 21 nt, Human
acagacaguccagagaaaaga

SEQ ID NO: 562139 - RNA, 22 nt, Human
accccaagacaguagaagagaa

SEQ ID NO: 562140 - RNA, 22 nt, Human
cuauuuuaagaggccauuaggu

SEQ ID NO: 562141 - RNA, 22 nt, Human
gaugcugaagugaagugaucuu

SEQ ID NO: 562142 - RNA, 22 nt, Human
aagcagccucauuugugguaag

SEQ ID NO: 562143 - RNA, 22 nt, Human
ucucuucacaugcuugcuccaa

SEQ ID NO: 562144 - RNA, 18 nt, Human
ugcccagaaaagcaggga

SEQ ID NO: 562145 - RNA, 22 nt, Human
uggcagagcccagacuccaguc

SEQ ID NO: 562146 - RNA, 22 nt, Human
cagcuguggagggaggaaaugc

SEQ ID NO: 562147 - RNA, 22 nt, Human
gauuguaaaacagaucauuauc

SEQ ID NO: 562148 - RNA, 19 nt, Human
uuuauucaccuuuaccuug

SEQ ID NO: 562149 - RNA, 22 nt, Human
uugcauguguaauuuuucuaaa

SEQ ID NO: 562150 - RNA, 22 nt, Human
gcagccugaugaucuggguugu

SEQ ID NO: 562151 - RNA, 22 nt, Human
gcccagcuuuuugaggcaggca

SEQ ID NO: 562152 - RNA, 22 nt, Human
gucuuugugguaguccucagcc

SEQ ID NO: 562153 - RNA, 22 nt, Human
ugcagagaagaggacaguucua

SEQ ID NO: 562154 - RNA, 21 nt, Human
agugugugauaggcaggaaga

SEQ ID NO: 562155 - RNA, 19 nt, Human
ucucccagcugagaagggc

SEQ ID NO: 562156 - RNA, 22 nt, Human
uccucaggcggugaggaggggc

SEQ ID NO: 562157 - RNA, 22 nt, Human
agacaggcagaggcugcagagg

SEQ ID NO: 562158 - RNA, 22 nt, Human
ugagccaggcucaagugauccu

SEQ ID NO: 562159 - RNA, 22 nt, Human
acagccuugcuuauuugucucu

SEQ ID NO: 562160 - RNA, 22 nt, Human
aauguguuuaguuaaugaguug

SEQ ID NO: 562161 - RNA, 20 nt, Human
ccuuccccacccgcugaggu

SEQ ID NO: 562162 - RNA, 22 nt, Human
uguuuacuagccaacauggaga

SEQ ID NO: 562163 - RNA, 22 nt, Human
ucgcauuuguuaaagcauguug

SEQ ID NO: 562164 - RNA, 22 nt, Human
cccaggaauuggaggcugcagu

SEQ ID NO: 562165 - RNA, 22 nt, Human
auucuacaaucauguagauccu

SEQ ID NO: 562166 - RNA, 22 nt, Human
ucuuauaccccuaaacugcagc

SEQ ID NO: 562167 - RNA, 22 nt, Human
gccuggcagccuccaaccuuca

SEQ ID NO: 562168 - RNA, 18 nt, Human
agggaucaucacugcagc

SEQ ID NO: 562169 - RNA, 22 nt, Human
caggggcuuuuccucuauaagg

SEQ ID NO: 562170 - RNA, 22 nt, Human
uggagggcaugcuguccauggg

SEQ ID NO: 562171 - RNA, 22 nt, Human
uauuuuguuaauaauccagucc

SEQ ID NO: 562172 - RNA, 22 nt, Human
cccuggagggauuucucaauca

SEQ ID NO: 562173 - RNA, 22 nt, Human
ccaugggcuggcugccuuauca

SEQ ID NO: 562174 - RNA, 22 nt, Human
gacuauuuaaaaagaacuacug

SEQ ID NO: 562175 - RNA, 22 nt, Human
gaugaaaaaagacgagcauaua

SEQ ID NO: 562176 - RNA, 22 nt, Human
aagaugcagcaaacuacuuuuu

SEQ ID NO: 562177 - RNA, 22 nt, Human
acagaugaggaauuuauuuggu

SEQ ID NO: 562178 - RNA, 22 nt, Human
uccucaggaugugggguagaau

SEQ ID NO: 562179 - RNA, 23 nt, Human
aggcugcagaagaauagggucau

SEQ ID NO: 562180 - RNA, 22 nt, Human
agcaacuauauugaaagccacc

SEQ ID NO: 562181 - RNA, 22 nt, Human
aguauguauuuuauacuuacag

SEQ ID NO: 562182 - RNA, 20 nt, Human
ugggaaagucuaagugccuc

SEQ ID NO: 562183 - RNA, 22 nt, Human
aaagcauggcaugaagaacaug

SEQ ID NO: 562184 - RNA, 22 nt, Human
uugaaaaguuuugaaacacucu

SEQ ID NO: 562185 - RNA, 22 nt, Human
cucagugguugagagccugggc

SEQ ID NO: 562186 - RNA, 22 nt, Human
cucucugguuucagcgaagggg

SEQ ID NO: 562187 - RNA, 22 nt, Human
gcaggcugauagaggauuccau

SEQ ID NO: 562188 - RNA, 22 nt, Human
gucuuuuucuacgauagcgccu

SEQ ID NO: 562189 - RNA, 22 nt, Human
agugggcugguggcagggagaa

SEQ ID NO: 562190 - RNA, 22 nt, Human
ggaagccagagugcugggcagg

SEQ ID NO: 562191 - RNA, 22 nt, Human
gcacagguugcaaaaguucaca

SEQ ID NO: 562192 - RNA, 22 nt, Human
cuuuaagagaucaccaaucaca

SEQ ID NO: 562193 - RNA, 20 nt, Human
agccaggguucuggaugcac

SEQ ID NO: 562194 - RNA, 22 nt, Human
cccuuuaaguagaauauauuau

SEQ ID NO: 562195 - RNA, 22 nt, Human
accuuaaaacugacacauggag

SEQ ID NO: 562196 - RNA, 22 nt, Human
cagucccacuagugccaauacc

SEQ ID NO: 562197 - RNA, 20 nt, Human
gacauucauaguuauuacca

SEQ ID NO: 562198 - RNA, 22 nt, Human
uauuccuuggcaaaaaauauau

SEQ ID NO: 562199 - RNA, 22 nt, Human
uaauuauaacaguuacaucuua

SEQ ID NO: 562200 - RNA, 22 nt, Human
agagccuggcucccagcuaccg

SEQ ID NO: 562201 - RNA, 22 nt, Human
acuggaaaguugauuaugucca

SEQ ID NO: 562202 - RNA, 22 nt, Human
aggcugagucaaguuaggguga

SEQ ID NO: 562203 - RNA, 22 nt, Human
uauuauuauauuggaugagacu

SEQ ID NO: 562204 - RNA, 22 nt, Human
agacucuuggagaagagcuaua

SEQ ID NO: 562205 - RNA, 22 nt, Human
auuaauuuuucugacagccaca

SEQ ID NO: 562206 - RNA, 22 nt, Human
caauguacuacaaagauuguca

SEQ ID NO: 562207 - RNA, 18 nt, Human
cucucuuuccacucuuug

SEQ ID NO: 562208 - RNA, 22 nt, Human
gucccaggaguugcugggccuu

SEQ ID NO: 562209 - RNA, 22 nt, Human
ggaugcuggggaccaaucucug

SEQ ID NO: 562210 - RNA, 22 nt, Human
ccugggcaggaugggcccggug

SEQ ID NO: 562211 - RNA, 22 nt, Human
ugggcucagccucagucugugg

SEQ ID NO: 562212 - RNA, 22 nt, Human
uguugagacacagacacaagcc

SEQ ID NO: 562213 - RNA, 22 nt, Human
gagccccaggacagcucuaguu

SEQ ID NO: 562214 - RNA, 22 nt, Human
ugcagugccucggcagugcagc

SEQ ID NO: 562215 - RNA, 22 nt, Human
agcaguuuuuauaacacuggaa

SEQ ID NO: 562216 - RNA, 22 nt, Human
aaaggccacuugaaggauuuuu

SEQ ID NO: 562217 - RNA, 22 nt, Human
gagcagugggaaggaacagggu

SEQ ID NO: 562218 - RNA, 22 nt, Human
uccugcagccacugcaggcaga

SEQ ID NO: 562219 - RNA, 19 nt, Human
gcuguuaaggacccucgga

SEQ ID NO: 562220 - RNA, 22 nt, Human
ugggccuguugccugaguccau

SEQ ID NO: 562221 - RNA, 22 nt, Human
gcugccuggauuugcaauccuc

SEQ ID NO: 562222 - RNA, 22 nt, Human
agcagagccaggucucucugua

SEQ ID NO: 562223 - RNA, 23 nt, Human
ucuucauggccaucugguucuuc

SEQ ID NO: 562224 - RNA, 23 nt, Human
ucagugauguugaaccuagcagu

SEQ ID NO: 562225 - RNA, 22 nt, Human
gaggcagcagggcugguuccuu

SEQ ID NO: 562226 - RNA, 22 nt, Human
aaagcaauugugguuuuugcca

SEQ ID NO: 562227 - RNA, 22 nt, Human
uuuuauaagcaagaaagggaaa

SEQ ID NO: 562228 - RNA, 22 nt, Human
uugggguacgcaggucugggag

SEQ ID NO: 562229 - RNA, 22 nt, Human
uguaaaagguuguucuuucguu

SEQ ID NO: 562230 - RNA, 22 nt, Human
cugugggagggugagagaacca

SEQ ID NO: 562231 - RNA, 22 nt, Human
ucuguccucuuugaagcugcuc

SEQ ID NO: 562232 - RNA, 22 nt, Human
cccagcccccgagugucuggaa

SEQ ID NO: 562233 - RNA, 22 nt, Human
gaggcacaauacaugucucaag

SEQ ID NO: 562234 - RNA, 22 nt, Human
aaugauggauuuagacaagcug

SEQ ID NO: 562235 - RNA, 22 nt, Human
ucaccagggagcuuguccucug

SEQ ID NO: 562236 - RNA, 22 nt, Human
gcaggggcaggagaucucaggc

SEQ ID NO: 562237 - RNA, 19 nt, Human
cugguccugacugaggggu

SEQ ID NO: 562238 - RNA, 22 nt, Human
caaaucuaggaugcauguagug

SEQ ID NO: 562239 - RNA, 22 nt, Human
ccaaaauuauuacauuuguagg

SEQ ID NO: 562240 - RNA, 22 nt, Human
caguggggaggccaggauagaa

SEQ ID NO: 562241 - RNA, 22 nt, Human
aguaaacauuuucauauuuucu

SEQ ID NO: 562242 - RNA, 22 nt, Human
uguaugcuuuccaaaaaugcug

SEQ ID NO: 562243 - RNA, 22 nt, Human
augaggcaaggcuggccguguu

SEQ ID NO: 562244 - RNA, 22 nt, Human
gccuggagggucccucucugga

SEQ ID NO: 562245 - RNA, 22 nt, Human
gaagaagcauucugcuguuuug

SEQ ID NO: 562246 - RNA, 22 nt, Human
ggccugcuccgggggcugagcu

SEQ ID NO: 562247 - RNA, 22 nt, Human
uccauaaaccagaaaaucaaga

SEQ ID NO: 562248 - RNA, 22 nt, Human
aauaugugagguauguucagug

SEQ ID NO: 562249 - RNA, 22 nt, Human
ugggaaagacucaggacaggag

SEQ ID NO: 562250 - RNA, 22 nt, Human
uuugaaauaugugaugagagag

SEQ ID NO: 562251 - RNA, 22 nt, Human
uuacuacauuguaacacaguac

SEQ ID NO: 562252 - RNA, 22 nt, Human
guucaaaggccuguggaaaggg

SEQ ID NO: 562253 - RNA, 22 nt, Human
uucagagcaucucuaaagccag

SEQ ID NO: 562254 - RNA, 22 nt, Human
cugugcuuaccugcccagguga

SEQ ID NO: 562255 - RNA, 22 nt, Human
uggcaggaaaguaacagagcac

SEQ ID NO: 562256 - RNA, 21 nt, Human
augaagucuaugcuucugugu

SEQ ID NO: 562257 - RNA, 22 nt, Human
ggcuagaguggaacuggagcgg

SEQ ID NO: 562258 - RNA, 22 nt, Human
uuuguguuuguacaaugcacua

SEQ ID NO: 562259 - RNA, 22 nt, Human
uucuuuauguuaaugaaucuau

SEQ ID NO: 562260 - RNA, 22 nt, Human
aaucuuaaagaauauucuacca

SEQ ID NO: 562261 - RNA, 22 nt, Human
uacaagaaggauggagcccacu

SEQ ID NO: 562262 - RNA, 22 nt, Human
cugggacuuuacccuguggccc

SEQ ID NO: 562263 - RNA, 22 nt, Human
ugcgcaggagcucugccaggag

SEQ ID NO: 562264 - RNA, 22 nt, Human
aauaauaagauacuaagggagu

SEQ ID NO: 562265 - RNA, 22 nt, Human
uucuuaaguauuucagagacug

SEQ ID NO: 562266 - RNA, 22 nt, Human
aucaggaucacugggagucuug

SEQ ID NO: 562267 - RNA, 22 nt, Human
ucccaagagcuacucaauggaa

SEQ ID NO: 562268 - RNA, 22 nt, Human
acaggccuuggcaggcauguga

SEQ ID NO: 562269 - RNA, 22 nt, Human
ugggaugggaucucgcuguguc

SEQ ID NO: 562270 - RNA, 22 nt, Human
uauuucuugaguggucaguuuc

SEQ ID NO: 562271 - RNA, 22 nt, Human
acugccuugucucuugccuguu

SEQ ID NO: 562272 - RNA, 22 nt, Human
uuacagauguuucaggaauacu

SEQ ID NO: 562273 - RNA, 22 nt, Human
aaaguucuauguaauguuuuuu

SEQ ID NO: 562274 - RNA, 22 nt, Human
ucuaaagcuccuuccacuaaaa

SEQ ID NO: 562275 - RNA, 22 nt, Human
ggcagaagacaggcaaaucaug

SEQ ID NO: 562276 - RNA, 22 nt, Human
cggcagagcccugagucagccu

SEQ ID NO: 562277 - RNA, 22 nt, Human
ccucaggaaaugaauaaauggc

SEQ ID NO: 562278 - RNA, 22 nt, Human
aggugcagaaaaaaguccuuua

SEQ ID NO: 562279 - RNA, 22 nt, Human
acuggacagguucaugguuuua

SEQ ID NO: 562280 - RNA, 22 nt, Human
caugugacaggagcagcucuaa

SEQ ID NO: 562281 - RNA, 22 nt, Human
aaauuucaguuaccuuuacguu

SEQ ID NO: 562282 - RNA, 19 nt, Human
cuccagaauacauguuccu

SEQ ID NO: 562283 - RNA, 22 nt, Human
ugagaagauugggcagagugga

SEQ ID NO: 562284 - RNA, 22 nt, Human
gagaggccauggcugugcagug

SEQ ID NO: 562285 - RNA, 22 nt, Human
aggggagaggugagcaacuucu

SEQ ID NO: 562286 - RNA, 22 nt, Human
cugugccuaagaugcaugucuc

SEQ ID NO: 562287 - RNA, 22 nt, Human
ugaagaagccaauugguaggcu

SEQ ID NO: 562288 - RNA, 22 nt, Human
gaggaggaggaaguggaaccca

SEQ ID NO: 562289 - RNA, 22 nt, Human
uggcauuuccucagugcucaga

SEQ ID NO: 562290 - RNA, 22 nt, Human
cagagugaacagugggaugugc

SEQ ID NO: 562291 - RNA, 22 nt, Human
uuucacauuagauaugucauuu

SEQ ID NO: 562292 - RNA, 22 nt, Human
auuucuuaugaauauugacugu

SEQ ID NO: 562293 - RNA, 22 nt, Human
gaaggcuaaaggggcagagguu

SEQ ID NO: 562294 - RNA, 22 nt, Human
acaguguagaauccuguacuua

SEQ ID NO: 562295 - RNA, 22 nt, Human
gggccacacagaaccuccuggu

SEQ ID NO: 562296 - RNA, 22 nt, Human
aagggcagaauagagaagaugg

SEQ ID NO: 562297 - RNA, 22 nt, Human
agaaauguggaggaacagggcu

SEQ ID NO: 562298 - RNA, 22 nt, Human
uggcauuucaccuuucauuucc

SEQ ID NO: 562299 - RNA, 19 nt, Human
ggugaccaccuggucagug

SEQ ID NO: 562300 - RNA, 22 nt, Human
cagccaccauacagcagaagcu

SEQ ID NO: 562301 - RNA, 22 nt, Human
uacacuuucguuuguggauuag

SEQ ID NO: 562302 - RNA, 21 nt, Human
ucagcagcuuuugcagucccu

SEQ ID NO: 562303 - RNA, 19 nt, Human
uuagaaacuguugacacug

SEQ ID NO: 562304 - RNA, 19 nt, Human
cuggcucuuggguggagga

SEQ ID NO: 562305 - RNA, 20 nt, Human
acagccagaggaggcagaca

SEQ ID NO: 562306 - RNA, 22 nt, Human
cuguccuuacugcuucuggcuu

SEQ ID NO: 562307 - RNA, 22 nt, Human
gaaaguauuuacauuaacaucu

SEQ ID NO: 562308 - RNA, 22 nt, Human
uagcagaguuugguaccugggg

SEQ ID NO: 562309 - RNA, 22 nt, Human
augcagcugugggcaagaaaug

SEQ ID NO: 562310 - RNA, 22 nt, Human
caguauuuauggcuugaguauu

SEQ ID NO: 562311 - RNA, 22 nt, Human
ccuggcagcauugguagagauu

SEQ ID NO: 562312 - RNA, 22 nt, Human
cucucugggcccaguuggcacc

SEQ ID NO: 562313 - RNA, 22 nt, Human
ugggaccaagucauuucuuuag

SEQ ID NO: 562314 - RNA, 22 nt, Human
gcugaggacaucauggaaggaa

SEQ ID NO: 562315 - RNA, 22 nt, Human
caauuucagugcuguggagagg

SEQ ID NO: 562316 - RNA, 22 nt, Human
ugugagcaagauucagagauuc

SEQ ID NO: 562317 - RNA, 22 nt, Human
uguggccagcagguggcugugu

SEQ ID NO: 562318 - RNA, 22 nt, Human
uggaggaaaauuacuggggucu

SEQ ID NO: 562319 - RNA, 22 nt, Human
cccaguggcuuuugcccagguu

SEQ ID NO: 562320 - RNA, 23 nt, Human
cuggaagugcuuuuauagcuuug

SEQ ID NO: 562321 - RNA, 22 nt, Human
ucccugccucucagacuuccuu

SEQ ID NO: 562322 - RNA, 22 nt, Human
agcagaacugaugagacuugag

SEQ ID NO: 562323 - RNA, 22 nt, Human
auuuacacauucauaagauuuc

SEQ ID NO: 562324 - RNA, 22 nt, Human
uagcugccuagacagcuauagc

SEQ ID NO: 562325 - RNA, 22 nt, Human
uucuacaugagaaaauguauuu

SEQ ID NO: 562326 - RNA, 22 nt, Human
ucuggcucauaggaaggccauu

SEQ ID NO: 562327 - RNA, 22 nt, Human
gugggccuugcagggugcaggg

SEQ ID NO: 562328 - RNA, 22 nt, Human
cuguccagaaagggggcaacaa

SEQ ID NO: 562329 - RNA, 22 nt, Human
ugggaaggugauuuuccaaaag

SEQ ID NO: 562330 - RNA, 22 nt, Human
cuccagaaggugggggagccac

SEQ ID NO: 562331 - RNA, 22 nt, Human
uuuuaccugaaccacacaguau

SEQ ID NO: 562332 - RNA, 22 nt, Human
guaggaagcucugaggcuaguu

SEQ ID NO: 562333 - RNA, 22 nt, Human
guggggcuaaaaacugugcagu

SEQ ID NO: 562334 - RNA, 22 nt, Human
uucagaaaugucagccaucaga

SEQ ID NO: 562335 - RNA, 22 nt, Human
aggcaggucacaugcuuggcga

SEQ ID NO: 562336 - RNA, 22 nt, Human
cuuauuagaguuguguucuguu

SEQ ID NO: 562337 - RNA, 22 nt, Human
cugcagccuccuccagcuacgu

SEQ ID NO: 562338 - RNA, 22 nt, Human
caggggcaagaaugcugucagc

SEQ ID NO: 562339 - RNA, 22 nt, Human
gucucccaauccgggacagccu

SEQ ID NO: 562340 - RNA, 22 nt, Human
gcaccaugacagugaggagaac

SEQ ID NO: 562341 - RNA, 22 nt, Human
aagcugaggcccauggcaaggu

SEQ ID NO: 562342 - RNA, 22 nt, Human
uuuauugcauacacaaauguca

SEQ ID NO: 562343 - RNA, 22 nt, Human
ugggccuccuuuccauucagag

SEQ ID NO: 562344 - RNA, 22 nt, Human
uuuguuuugaacuagcucagaa

SEQ ID NO: 562345 - RNA, 22 nt, Human
gccugucugcagggcugucauu

SEQ ID NO: 562346 - RNA, 22 nt, Human
aaacucaagucuaugaacaagg

SEQ ID NO: 562347 - RNA, 22 nt, Human
acuggcaguggcagcagaaaga

SEQ ID NO: 562348 - RNA, 23 nt, Human
gugcucuucaguuuuagggucau

SEQ ID NO: 562349 - RNA, 22 nt, Human
cuggccuggagccucugggugg

SEQ ID NO: 562350 - RNA, 22 nt, Human
aguggguggcgcagaggaggaa

SEQ ID NO: 562351 - RNA, 22 nt, Human
uuaaagucccugccuuaauucc

SEQ ID NO: 562352 - RNA, 22 nt, Human
ucccagcccagacuucuccagu

SEQ ID NO: 562353 - RNA, 22 nt, Human
uuugugugcuugguauugaaga

SEQ ID NO: 562354 - RNA, 21 nt, Human
cucuugugucagagccagagg

SEQ ID NO: 562355 - RNA, 22 nt, Human
aggcuuuguaccuggggucuua

SEQ ID NO: 562356 - RNA, 20 nt, Human
cagaggcaaggagacuugga

SEQ ID NO: 562357 - RNA, 22 nt, Human
cuuauucauauauucucgguag

SEQ ID NO: 562358 - RNA, 22 nt, Human
cuccucuuuggggauuuacaca

SEQ ID NO: 562359 - RNA, 18 nt, Human
aggagccuuugcacugga

SEQ ID NO: 562360 - RNA, 22 nt, Human
ggugcccuguaaaagccaugca

SEQ ID NO: 562361 - RNA, 19 nt, Human
gccugcagaaaaggcaggg

SEQ ID NO: 562362 - RNA, 22 nt, Human
uuauuauagauuaugcaagauu

SEQ ID NO: 562363 - RNA, 22 nt, Human
gagaauaucuuggcagucucug

SEQ ID NO: 562364 - RNA, 22 nt, Human
acucucccugcuauccacuucc

SEQ ID NO: 562365 - RNA, 22 nt, Human
cugcagaggccucgccuccucu

SEQ ID NO: 562366 - RNA, 22 nt, Human
ucugcugcacaaauucaucucu

SEQ ID NO: 562367 - RNA, 22 nt, Human
gucacccugcuggcuguucagc

SEQ ID NO: 562368 - RNA, 22 nt, Human
auuguucauguaugaauaaaua

SEQ ID NO: 562369 - RNA, 22 nt, Human
caggccagguggcaggcaaaac

SEQ ID NO: 562370 - RNA, 22 nt, Human
guccuggggauacagaagugaa

SEQ ID NO: 562371 - RNA, 23 nt, Human
ucucccaagccuggcaggggcac

SEQ ID NO: 562372 - RNA, 21 nt, Human
cuacuuaaguaggggauuagg

SEQ ID NO: 562373 - RNA, 22 nt, Human
cuagggacugggaccuuaguua

SEQ ID NO: 562374 - RNA, 22 nt, Human
ugaaauguugguaauuuuauau

SEQ ID NO: 562375 - RNA, 22 nt, Human
ccagagaggcaaaacuccuucc

SEQ ID NO: 562376 - RNA, 22 nt, Human
ucugggagcagcucagcagauu

SEQ ID NO: 562377 - RNA, 22 nt, Human
ucuuuucacagacaaauggaga

SEQ ID NO: 562378 - RNA, 22 nt, Human
guaucgguuuauuuuugggaua

SEQ ID NO: 562379 - RNA, 22 nt, Human
cagcugcaguucaaugcuugcu

SEQ ID NO: 562380 - RNA, 22 nt, Human
ucuuugaaguugaaguaguugg

SEQ ID NO: 562381 - RNA, 22 nt, Human
uguacuugaacuugacuguaga

SEQ ID NO: 562382 - RNA, 22 nt, Human
cuuuauuagauguagacuuucu

SEQ ID NO: 562383 - RNA, 22 nt, Human
uaccauuucaguaaaaacuuag

SEQ ID NO: 562384 - RNA, 22 nt, Human
ggccucagggucacucuguaga

SEQ ID NO: 562385 - RNA, 22 nt, Human
ugaggccugucauugucuuguu

SEQ ID NO: 562386 - RNA, 22 nt, Human
cccacacacuggcugcugccaa

SEQ ID NO: 562387 - RNA, 22 nt, Human
agaaaucuaagaugcucaagga

SEQ ID NO: 562388 - RNA, 22 nt, Human
uugcugagucucuagguaugau

SEQ ID NO: 562389 - RNA, 22 nt, Human
ucuucaaacugaaaauuuagaa

SEQ ID NO: 562390 - RNA, 22 nt, Human
ccagggcagccaacccagaugc

SEQ ID NO: 562391 - RNA, 22 nt, Human
caggugggcguggcgagaaggc

SEQ ID NO: 562392 - RNA, 22 nt, Human
cccugggcagucugcacuucag

SEQ ID NO: 562393 - RNA, 22 nt, Human
agggugcaaaagcaaggacagu

SEQ ID NO: 562394 - RNA, 22 nt, Human
gcuguucaaaagccacaguuac

SEQ ID NO: 562395 - RNA, 22 nt, Human
aggggcucaaagugugcaggga

SEQ ID NO: 562396 - RNA, 22 nt, Human
agguuuucagcuguauccugag

SEQ ID NO: 562397 - RNA, 22 nt, Human
caggcagauauguucgcuuuaa

SEQ ID NO: 562398 - RNA, 22 nt, Human
ucugugcucaaguucugccucu

SEQ ID NO: 562399 - RNA, 22 nt, Human
aggccuguuccaggccccuuuu

SEQ ID NO: 562400 - RNA, 22 nt, Human
gucacacagguugaaaugcagu

SEQ ID NO: 562401 - RNA, 22 nt, Human
aguuuguaucaauuugcuuuau

SEQ ID NO: 562402 - RNA, 22 nt, Human
cacugggcuuuguaguuagcau

SEQ ID NO: 562403 - RNA, 22 nt, Human
acagugaugagggaauuuugug

SEQ ID NO: 562404 - RNA, 22 nt, Human
aaggagaagucuguugagauug

SEQ ID NO: 562405 - RNA, 22 nt, Human
ucaguauuucuaaacauuggcu

SEQ ID NO: 562406 - RNA, 22 nt, Human
uccuuuguggaaauacuugugg

SEQ ID NO: 562407 - RNA, 22 nt, Human
agcaucugcuuaauggcuuaac

SEQ ID NO: 562408 - RNA, 22 nt, Human
uacacauucuagggcacaguua

SEQ ID NO: 562409 - RNA, 22 nt, Human
uaggccauucuuggagcuuacu

SEQ ID NO: 562410 - RNA, 22 nt, Human
uggagcuggaagacagugauau

SEQ ID NO: 562411 - RNA, 21 nt, Human
aaggcagaagcauggaaugag

SEQ ID NO: 562412 - RNA, 22 nt, Human
guuuacauguacucauuauacu

SEQ ID NO: 562413 - RNA, 21 nt, Human
ugaaaucugaugggacaaaug

SEQ ID NO: 562414 - RNA, 22 nt, Human
ggccacugccuccgccauggcu

SEQ ID NO: 562415 - RNA, 23 nt, Human
agaugaggcuucuccauguuggu

SEQ ID NO: 562416 - RNA, 22 nt, Human
ugaagcagcuucuuucugucaa

SEQ ID NO: 562417 - RNA, 22 nt, Human
gggagggaaggaccuuaugaau

SEQ ID NO: 562418 - RNA, 22 nt, Human
gcugggcccugggugcccuagc

SEQ ID NO: 562419 - RNA, 22 nt, Human
aaaugccucccauucuacugac

SEQ ID NO: 562420 - RNA, 22 nt, Human
acuguguccucauguggcagaa

SEQ ID NO: 562421 - RNA, 22 nt, Human
ucagaaaagacucaggggcuga

SEQ ID NO: 562422 - RNA, 22 nt, Human
agggcugagugggagagaguug

SEQ ID NO: 562423 - RNA, 22 nt, Human
cuguauuuucaugccuacguac

SEQ ID NO: 562424 - RNA, 22 nt, Human
ggaaaucaagaagcagaugagu

SEQ ID NO: 562425 - RNA, 20 nt, Human
uggugagagcaccugauggg

SEQ ID NO: 562426 - RNA, 22 nt, Human
agauacauuguucuaagcauug

SEQ ID NO: 562427 - RNA, 22 nt, Human
cacacaguaggcacucauuaau

SEQ ID NO: 562428 - RNA, 21 nt, Human
aguuuucugaguuauaaaaua

SEQ ID NO: 562429 - RNA, 22 nt, Human
cuuguucaguugccucuccugc

SEQ ID NO: 562430 - RNA, 22 nt, Human
ggaggcugaggccccucacagg

SEQ ID NO: 562431 - RNA, 22 nt, Human
aagauauuuuagaacauucacu

SEQ ID NO: 562432 - RNA, 22 nt, Human
uauauuaaccauaggguucuag

SEQ ID NO: 562433 - RNA, 22 nt, Human
augaugguuguccuaggugcau

SEQ ID NO: 562434 - RNA, 22 nt, Human
cuucccaagcuuuaguuauuuu

SEQ ID NO: 562435 - RNA, 22 nt, Human
aacaugauuuaguauaaugcag

SEQ ID NO: 562436 - RNA, 22 nt, Human
accagagcagacuacuggaggu

SEQ ID NO: 562437 - RNA, 22 nt, Human
uggcagggccugcucaucaucc

SEQ ID NO: 562438 - RNA, 22 nt, Human
gggcugagugucccaggccgaa

SEQ ID NO: 562439 - RNA, 21 nt, Human
ugaagccugaggcauagcccc

SEQ ID NO: 562440 - RNA, 22 nt, Human
aagugacaccucuucccuuucc

SEQ ID NO: 562441 - RNA, 22 nt, Human
uauuuccacccucaguaaggaa

SEQ ID NO: 562442 - RNA, 22 nt, Human
gcuuccugauauucauacuguu

SEQ ID NO: 562443 - RNA, 20 nt, Human
ugggccuguggcagaagucu

SEQ ID NO: 562444 - RNA, 22 nt, Human
aagaacagauucagccugaacu

SEQ ID NO: 562445 - RNA, 22 nt, Human
ugucucugccagcuagcagaau

SEQ ID NO: 562446 - RNA, 22 nt, Human
aauguuuuacagaucccauuag

SEQ ID NO: 562447 - RNA, 22 nt, Human
ugcugagguuucugacuaugga

SEQ ID NO: 562448 - RNA, 19 nt, Human
ugcauacauguuaacaugu

SEQ ID NO: 562449 - RNA, 22 nt, Human
acagaguaggugcugucgacug

SEQ ID NO: 562450 - RNA, 22 nt, Human
ugccaggcauuugacagacacu

SEQ ID NO: 562451 - RNA, 23 nt, Human
uuucuaagguuuuuaucugcuac

SEQ ID NO: 562452 - RNA, 22 nt, Human
ugcaccaagucuggcacugaau

SEQ ID NO: 562453 - RNA, 22 nt, Human
agcaguggccuggggcucugug

SEQ ID NO: 562454 - RNA, 22 nt, Human
cugggcuugaguuccugcucgu

SEQ ID NO: 562455 - RNA, 19 nt, Human
aaaguuuuauucucauuug

SEQ ID NO: 562456 - RNA, 22 nt, Human
uauuauuaucuuugaaugggac

SEQ ID NO: 562457 - RNA, 22 nt, Human
cugcuuugaggggcucuguaua

SEQ ID NO: 562458 - RNA, 22 nt, Human
cagcagagcugugugggaaggg

SEQ ID NO: 562459 - RNA, 22 nt, Human
accagccaccaccaggagaucg

SEQ ID NO: 562460 - RNA, 22 nt, Human
uccuggagggaggcggugcuac

SEQ ID NO: 562461 - RNA, 22 nt, Human
aaagagaaacuuagaagccuga

SEQ ID NO: 562462 - RNA, 22 nt, Human
cagucccuaguggagcucacag

SEQ ID NO: 562463 - RNA, 22 nt, Human
aacauuuauugagcaccuacug

SEQ ID NO: 562464 - RNA, 22 nt, Human
cagcuggcguggagugauugca

SEQ ID NO: 562465 - RNA, 22 nt, Human
uuccaaauguuggacaacugua

SEQ ID NO: 562466 - RNA, 22 nt, Human
auuuccauuuucagccauuacu

SEQ ID NO: 562467 - RNA, 22 nt, Human
caggaaagggaugggcugccac

SEQ ID NO: 562468 - RNA, 22 nt, Human
acaagaauuauuucuaguuaac

SEQ ID NO: 562469 - RNA, 18 nt, Human
agagaugguguagaguuu

SEQ ID NO: 562470 - RNA, 22 nt, Human
cugggcuggagugcaauggcgc

SEQ ID NO: 562471 - RNA, 22 nt, Human
ucaaaguccuugcuuuuucugu

SEQ ID NO: 562472 - RNA, 22 nt, Human
acucuucacacuugucuccagg

SEQ ID NO: 562473 - RNA, 22 nt, Human
ccuagaugggauggcggccggg

SEQ ID NO: 562474 - RNA, 22 nt, Human
ugagaaaacaguuuguaauaau

SEQ ID NO: 562475 - RNA, 22 nt, Human
gguggcugguuuuauaagaggu

SEQ ID NO: 562476 - RNA, 22 nt, Human
gcagccacuaguuuuccuguuu

SEQ ID NO: 562477 - RNA, 22 nt, Human
guguaaggccccagguucuuua

SEQ ID NO: 562478 - RNA, 22 nt, Human
cuucuucaauagcaagcgcaua

SEQ ID NO: 562479 - RNA, 22 nt, Human
uuucuuccuaaauaugauuucc

SEQ ID NO: 562480 - RNA, 22 nt, Human
gccaggcacaguucuaggugcu

SEQ ID NO: 562481 - RNA, 22 nt, Human
ugcuggccgugagcucucggga

SEQ ID NO: 562482 - RNA, 22 nt, Human
uggagcaggcaucuuucucucu

SEQ ID NO: 562483 - RNA, 22 nt, Human
aggugggcaccaggcuuguggu

SEQ ID NO: 562484 - RNA, 22 nt, Human
cagggcucuucaucacacagua

SEQ ID NO: 562485 - RNA, 22 nt, Human
gccaggcuggucuugaacuccu

SEQ ID NO: 562486 - RNA, 22 nt, Human
auuucauccauuaagaguacuc

SEQ ID NO: 562487 - RNA, 22 nt, Human
cugagcugcucccgcugcagcg

SEQ ID NO: 562488 - RNA, 22 nt, Human
aauggccuggagggaauacaga

SEQ ID NO: 562489 - RNA, 22 nt, Human
ugcagggaaaacccaggaugcu

SEQ ID NO: 562490 - RNA, 22 nt, Human
uguguccuuuggaggaucagcg

SEQ ID NO: 562491 - RNA, 22 nt, Human
gaggcugcuguuagcccugggc

SEQ ID NO: 562492 - RNA, 22 nt, Human
uggagcagcaucacuuugagcu

SEQ ID NO: 562493 - RNA, 23 nt, Human
aggagccaggaaccagcuucccc

SEQ ID NO: 562494 - RNA, 22 nt, Human
gacagaggagaagaugcugugg

SEQ ID NO: 562495 - RNA, 22 nt, Human
uagggcagauucgguggaguuu

SEQ ID NO: 562496 - RNA, 22 nt, Human
uccuuuaaagaacugugcuuuu

SEQ ID NO: 562497 - RNA, 22 nt, Human
auguucaaacuuuuuacacacc

SEQ ID NO: 562498 - RNA, 19 nt, Human
acacagggcuagaguuaca

SEQ ID NO: 562499 - RNA, 22 nt, Human
ucagccuggcaggauggccugg

SEQ ID NO: 562500 - RNA, 17 nt, Human
agcagaagucagaggga

SEQ ID NO: 562501 - RNA, 18 nt, Human
uuucugaaugucuauuuc

SEQ ID NO: 562502 - RNA, 22 nt, Human
uguggugagaaacugguagauu

SEQ ID NO: 562503 - RNA, 22 nt, Human
cagccugacuauggcugcaggu

SEQ ID NO: 562504 - RNA, 22 nt, Human
uuagccauauagaaaaagagcu

SEQ ID NO: 562505 - RNA, 22 nt, Human
uuaaugcuugucuagaucuucu

SEQ ID NO: 562506 - RNA, 22 nt, Human
aucagagacaaaaccagcacuu

SEQ ID NO: 562507 - RNA, 22 nt, Human
gaggcagcgggucaggaccgug

SEQ ID NO: 562508 - RNA, 22 nt, Human
uugcagcugcaguaaauguuca

SEQ ID NO: 562509 - RNA, 22 nt, Human
caguucuggaggauagaagucu

SEQ ID NO: 562510 - RNA, 22 nt, Human
uuguuucuuugaaguuucuaga

SEQ ID NO: 562511 - RNA, 22 nt, Human
ccuacagagcagcaggaccaga

SEQ ID NO: 562512 - RNA, 22 nt, Human
cugaaaauguuacacaggaaga

SEQ ID NO: 562513 - RNA, 22 nt, Human
ggaaagcauccaggugccccca

SEQ ID NO: 562514 - RNA, 22 nt, Human
guccaguguguuuaucuuggau

SEQ ID NO: 562515 - RNA, 22 nt, Human
gcauuaaaugcuagggaccuaa

SEQ ID NO: 562516 - RNA, 22 nt, Human
agucucugcaugaugcagcaca

SEQ ID NO: 562517 - RNA, 22 nt, Human
aauuuacaguugcugaugguac

SEQ ID NO: 562518 - RNA, 22 nt, Human
ggggauggauuccgggucccug

SEQ ID NO: 562519 - RNA, 22 nt, Human
cugaaugucgaucagcuugggu

SEQ ID NO: 562520 - RNA, 22 nt, Human
agcauccaacaggagggaaggg

SEQ ID NO: 562521 - RNA, 22 nt, Human
gcagacaggauuggguuaauag

SEQ ID NO: 562522 - RNA, 22 nt, Human
auuucauguuaacugaacagaa

SEQ ID NO: 562523 - RNA, 22 nt, Human
ggcugcuuuaucggcugcugaa

SEQ ID NO: 562524 - RNA, 22 nt, Human
cuauuaggcuuccauuucaugc

SEQ ID NO: 562525 - RNA, 23 nt, Human
ucuuuuuaagagaucuagugacg

SEQ ID NO: 562526 - RNA, 22 nt, Human
aaaggccaagcaugagguggac

SEQ ID NO: 562527 - RNA, 22 nt, Human
uacauauuugucuuuguacugu

SEQ ID NO: 562528 - RNA, 22 nt, Human
uauagcauggcuauauuguugc

SEQ ID NO: 562529 - RNA, 22 nt, Human
aaacacuucaaggacuucuguc

SEQ ID NO: 562530 - RNA, 22 nt, Human
gcuuugccuugaacucucaugu

SEQ ID NO: 562531 - RNA, 20 nt, Human
cugcacugaacaugucugag

SEQ ID NO: 562532 - RNA, 22 nt, Human
uccuccaguggcccaguccuuc

SEQ ID NO: 562533 - RNA, 22 nt, Human
gggcagguuggcaucccgggca

SEQ ID NO: 562534 - RNA, 22 nt, Human
aacacuuugggcauggccuucc

SEQ ID NO: 562535 - RNA, 22 nt, Human
agccauccucccaccucagccu

SEQ ID NO: 562536 - RNA, 22 nt, Human
ugucagcucauugaaggcacaa

SEQ ID NO: 562537 - RNA, 22 nt, Human
agagccacugggagacagagca

SEQ ID NO: 562538 - RNA, 22 nt, Human
acauuucuuugcuagacagcag

SEQ ID NO: 562539 - RNA, 22 nt, Human
aaacaagcugcagacaagccau

SEQ ID NO: 562540 - RNA, 22 nt, Human
agcccugcccugccauguggca

SEQ ID NO: 562541 - RNA, 22 nt, Human
uauuagguaaaggacuugcagg

SEQ ID NO: 562542 - RNA, 20 nt, Human
uuccuguauacaaagaguuc

SEQ ID NO: 562543 - RNA, 22 nt, Human
gugcagcugugugagagcucca

SEQ ID NO: 562544 - RNA, 20 nt, Human
aagcaauauagugcaaaugu

SEQ ID NO: 562545 - RNA, 22 nt, Human
aaaucucaggccucuauuuacu

SEQ ID NO: 562546 - RNA, 22 nt, Human
ggccuagggaguggccaugccu

SEQ ID NO: 562547 - RNA, 22 nt, Human
ugacccugcuucuuggugcagg

SEQ ID NO: 562548 - RNA, 22 nt, Human
agcccugcucaucuggaucccg

SEQ ID NO: 562549 - RNA, 22 nt, Human
cauucugacccuaugauuuaag

SEQ ID NO: 562550 - RNA, 22 nt, Human
uaaacauggauucugaucacag

SEQ ID NO: 562551 - RNA, 22 nt, Human
ccaggcuccccaggaggcccuu

SEQ ID NO: 562552 - RNA, 22 nt, Human
cugcugagcccuggcacaggug

SEQ ID NO: 562553 - RNA, 22 nt, Human
auaugagaauuggaaaauauca

SEQ ID NO: 562554 - RNA, 22 nt, Human
uuaugacaggaaaaucacagaa

SEQ ID NO: 562555 - RNA, 22 nt, Human
agugcugucccgacaacugagg

SEQ ID NO: 562556 - RNA, 22 nt, Human
cggcugagcagugcugauggaa

SEQ ID NO: 562557 - RNA, 22 nt, Human
cuggucaggaagguggggacag

SEQ ID NO: 562558 - RNA, 22 nt, Human
cuucuggguauuccagauaccu

SEQ ID NO: 562559 - RNA, 22 nt, Human
cagguccccuccccuaccaggc

SEQ ID NO: 562560 - RNA, 22 nt, Human
cagugggaagggcagaggcuuu

SEQ ID NO: 562561 - RNA, 22 nt, Human
cagcccaggccgacaguuccuc

SEQ ID NO: 562562 - RNA, 22 nt, Human
ucucugagcccaauguagcaau

SEQ ID NO: 562563 - RNA, 22 nt, Human
gguaacaguuacaguaacagua

SEQ ID NO: 562564 - RNA, 21 nt, Human
gaggcugucugcugcuggccu

SEQ ID NO: 562565 - RNA, 22 nt, Human
auuacagauuauaaauuugagc

SEQ ID NO: 562566 - RNA, 22 nt, Human
uuuuggaauuuauacaguaaug

SEQ ID NO: 562567 - RNA, 22 nt, Human
gagaggccaaaaucccugcccc

SEQ ID NO: 562568 - RNA, 22 nt, Human
ugacagaaauaguucuuaauuu

SEQ ID NO: 562569 - RNA, 22 nt, Human
cuguccugauggugccacuggu

SEQ ID NO: 562570 - RNA, 22 nt, Human
acauuugacauuuaguaucagc

SEQ ID NO: 562571 - RNA, 22 nt, Human
cuguguccaauggccuuagcag

SEQ ID NO: 562572 - RNA, 22 nt, Human
cugggccagaccuuguggucuu

SEQ ID NO: 562573 - RNA, 22 nt, Human
caaguaaagaaucacauuucuu

SEQ ID NO: 562574 - RNA, 20 nt, Human
gggcagcaagacauuugaca

SEQ ID NO: 562575 - RNA, 22 nt, Human
aaauuucuggaagugucagagu

SEQ ID NO: 562576 - RNA, 23 nt, Human
uaagaacagacaagcauuuacau

SEQ ID NO: 562577 - RNA, 23 nt, Human
ugugaagguggguccaagggcug

SEQ ID NO: 562578 - RNA, 22 nt, Human
uaaaguauauuuuuucucaaua

SEQ ID NO: 562579 - RNA, 21 nt, Human
guuauacauucuauggauuug

SEQ ID NO: 562580 - RNA, 22 nt, Human
ggagcugaaggggugggcucag

SEQ ID NO: 562581 - RNA, 22 nt, Human
ggcugcuggcauugagguaggu

SEQ ID NO: 562582 - RNA, 22 nt, Human
aagcgccacgagaagcuggacc

SEQ ID NO: 562583 - RNA, 20 nt, Human
uuucaagucagcaauucuca

SEQ ID NO: 562584 - RNA, 22 nt, Human
ucugaaaguaucuggaucuuuu

SEQ ID NO: 562585 - RNA, 23 nt, Human
auuuuuagccucucugagcugag

SEQ ID NO: 562586 - RNA, 22 nt, Human
augugaggaagaaagagguaag

SEQ ID NO: 562587 - RNA, 23 nt, Human
ccaggcaguagcuauugaaguga

SEQ ID NO: 562588 - RNA, 18 nt, Human
gcagugaagaaagagcuu

SEQ ID NO: 562589 - RNA, 22 nt, Human
caagaacauugugaucacuuca

SEQ ID NO: 562590 - RNA, 21 nt, Human
acagaacuguauagugauaaa

SEQ ID NO: 562591 - RNA, 22 nt, Human
ugcauuaugcuugugcuguaua

SEQ ID NO: 562592 - RNA, 23 nt, Human
uuucacauuuacuguuagauggc

SEQ ID NO: 562593 - RNA, 22 nt, Human
gugaggugggcuggccagagac

SEQ ID NO: 562594 - RNA, 22 nt, Human
gguggggccagggcuccaaccu

SEQ ID NO: 562595 - RNA, 22 nt, Human
gcuguccucuuggacucagggc

SEQ ID NO: 562596 - RNA, 22 nt, Human
acaugacuuuucucuuccagag

SEQ ID NO: 562597 - RNA, 22 nt, Human
uggccugggucacaccaggguc

SEQ ID NO: 562598 - RNA, 22 nt, Human
caguggagagacuuuuacucuu

SEQ ID NO: 562599 - RNA, 22 nt, Human
auccaaagauggaaagaacuuu

SEQ ID NO: 562600 - RNA, 22 nt, Human
aaagaauacuccuuuugccuug

SEQ ID NO: 562601 - RNA, 22 nt, Human
ugaauucaccugaaagucugga

SEQ ID NO: 562602 - RNA, 22 nt, Human
uuuagggacaagggucuggggu

SEQ ID NO: 562603 - RNA, 22 nt, Human
ggcaggguccacaccugggaaa

SEQ ID NO: 562604 - RNA, 22 nt, Human
agggccagggaagcuguauuuu

SEQ ID NO: 562605 - RNA, 22 nt, Human
ugggccuguggcuuggcucuag

SEQ ID NO: 562606 - RNA, 22 nt, Human
ucagccucagguguucagauuu

SEQ ID NO: 562607 - RNA, 23 nt, Human
ugguucaagugagaaguaauguu

SEQ ID NO: 562608 - RNA, 22 nt, Human
uucaggauuauacucucuuccc

SEQ ID NO: 562609 - RNA, 22 nt, Human
aauagcauagaguuaaaaugca

SEQ ID NO: 562610 - RNA, 22 nt, Human
cuguccugcccacccugcaggg

SEQ ID NO: 562611 - RNA, 22 nt, Human
aaggccaugaccacuugcugug

SEQ ID NO: 562612 - RNA, 22 nt, Human
uucuuaagacugcaaaucaacc

SEQ ID NO: 562613 - RNA, 20 nt, Human
aggagccauugacugcagca

SEQ ID NO: 562614 - RNA, 22 nt, Human
uuguauuucuccacuuucuguu

SEQ ID NO: 562615 - RNA, 22 nt, Human
uaaaugcaagggaaaggcaaga

SEQ ID NO: 562616 - RNA, 22 nt, Human
ucccuggccauuccucuaggcc

SEQ ID NO: 562617 - RNA, 22 nt, Human
cugguggguagagggcaucagg

SEQ ID NO: 562618 - RNA, 19 nt, Human
gcaggcaguggcauucgga

SEQ ID NO: 562619 - RNA, 22 nt, Human
uaacugcucagugaguauuuuu

SEQ ID NO: 562620 - RNA, 21 nt, Human
gcucagaguauugcacuguuu

SEQ ID NO: 562621 - RNA, 22 nt, Human
uguacaguauauuucaaagcca

SEQ ID NO: 562622 - RNA, 22 nt, Human
gagagcuggguucaaguagcug

SEQ ID NO: 562623 - RNA, 22 nt, Human
gggcaggaugcaguuucagaga

SEQ ID NO: 562624 - RNA, 22 nt, Human
aggucauugaaguuauuuucuu

SEQ ID NO: 562625 - RNA, 22 nt, Human
gauuaaguggaaugaguauuug

SEQ ID NO: 562626 - RNA, 22 nt, Human
gggaagggacuuguuuaagguc

SEQ ID NO: 562627 - RNA, 22 nt, Human
caucacuguccaaaguucaguu

SEQ ID NO: 562628 - RNA, 23 nt, Human
cuucaugagagcccugaggaaaa

SEQ ID NO: 562629 - RNA, 19 nt, Human
ucuggcuccgccucuuagu

SEQ ID NO: 562630 - RNA, 22 nt, Human
uguauacaggcauaagagauac

SEQ ID NO: 562631 - RNA, 22 nt, Human
ugccaggcacgugagaguggcc

SEQ ID NO: 562632 - RNA, 20 nt, Human
ccugccugccucggcucauu

SEQ ID NO: 562633 - RNA, 19 nt, Human
agcagccauagacaauaug

SEQ ID NO: 562634 - RNA, 22 nt, Human
gaggagaagcuaagaaacacag

SEQ ID NO: 562635 - RNA, 22 nt, Human
cccugugagcggcuggaugccu

SEQ ID NO: 562636 - RNA, 22 nt, Human
cacaucagguagaccuacagag

SEQ ID NO: 562637 - RNA, 23 nt, Human
acugccugcuacuaugcccacgg

SEQ ID NO: 562638 - RNA, 22 nt, Human
gagcugggcacacgccacuuga

SEQ ID NO: 562639 - RNA, 22 nt, Human
cugugcuggagaugggccagag

SEQ ID NO: 562640 - RNA, 22 nt, Human
acuucucuucauagguggcaau

SEQ ID NO: 562641 - RNA, 22 nt, Human
gaggucaaggucaagagacaga

SEQ ID NO: 562642 - RNA, 22 nt, Human
guuguacagcauccagugcaga

SEQ ID NO: 562643 - RNA, 22 nt, Human
ggcagaggagcuggaaacaugg

SEQ ID NO: 562644 - RNA, 22 nt, Human
uucaaauuugguaugcaagcca

SEQ ID NO: 562645 - RNA, 21 nt, Human
cauauuaaaucggugccuuua

SEQ ID NO: 562646 - RNA, 22 nt, Human
aauguguacuuuuucaugcuca

SEQ ID NO: 562647 - RNA, 22 nt, Human
auggagcacacgccaucacaua

SEQ ID NO: 562648 - RNA, 22 nt, Human
acaacuuugacccuuguucuua

SEQ ID NO: 562649 - RNA, 22 nt, Human
guggcagggcaaugcucccucu

SEQ ID NO: 562650 - RNA, 22 nt, Human
ugaauccagagcuauuucgucc

SEQ ID NO: 562651 - RNA, 22 nt, Human
ccacagggcucuaggcgcuucc

SEQ ID NO: 562652 - RNA, 22 nt, Human
aaauacuggcaagugcuaauuc

SEQ ID NO: 562653 - RNA, 22 nt, Human
cacugggcguguccugggugag

SEQ ID NO: 562654 - RNA, 22 nt, Human
gucauuuucuagaauuauuuga

SEQ ID NO: 562655 - RNA, 22 nt, Human
ccaucccuucaccacagcagua

SEQ ID NO: 562656 - RNA, 21 nt, Human
aggugggagaccauguagguc

SEQ ID NO: 562657 - RNA, 22 nt, Human
cagcuuuaguaacccacugcuc

SEQ ID NO: 562658 - RNA, 22 nt, Human
uauaagaaacaaggcaaauuuu

SEQ ID NO: 562659 - RNA, 22 nt, Human
ggcccacacugacagcugagcu

SEQ ID NO: 562660 - RNA, 19 nt, Human
aguuaaugagcuuuugauc

SEQ ID NO: 562661 - RNA, 22 nt, Human
ugaggcaggagguugagaacug

SEQ ID NO: 562662 - RNA, 22 nt, Human
gugcacaucgugcagguuuguu

SEQ ID NO: 562663 - RNA, 22 nt, Human
cauuugcuggggucuugggagu

SEQ ID NO: 562664 - RNA, 22 nt, Human
gucuguaucagaggagugaaug

SEQ ID NO: 562665 - RNA, 21 nt, Human
ccacauucucauucugacugc

SEQ ID NO: 562666 - RNA, 22 nt, Human
ugguaugaccguggugcaagca

SEQ ID NO: 562667 - RNA, 22 nt, Human
ucauuucaguuguucccugguu

SEQ ID NO: 562668 - RNA, 22 nt, Human
gcagagcauguccucaggacag

SEQ ID NO: 562669 - RNA, 22 nt, Human
aaagcagcagcaccugcauuuc

SEQ ID NO: 562670 - RNA, 22 nt, Human
ucuagaaaguacuagagcuggu

SEQ ID NO: 562671 - RNA, 22 nt, Human
uuugcauuauauuuauagaaga

SEQ ID NO: 562672 - RNA, 22 nt, Human
cagcuguugcagcacugagaga

SEQ ID NO: 562673 - RNA, 22 nt, Human
cucagcuggcaauucuggcucc

SEQ ID NO: 562674 - RNA, 23 nt, Human
cacacccaucacuaagagcuccu

SEQ ID NO: 562675 - RNA, 22 nt, Human
caaacauucaaguacaagucuu

SEQ ID NO: 562676 - RNA, 22 nt, Human
caggagccagcugucccaacca

SEQ ID NO: 562677 - RNA, 22 nt, Human
uauauuaaagugcuuugcagug

SEQ ID NO: 562678 - RNA, 22 nt, Human
caaaugcaaaauauaacccugu

SEQ ID NO: 562679 - RNA, 22 nt, Human
acagagcaguucuggagcuggc

SEQ ID NO: 562680 - RNA, 22 nt, Human
ugguccagacauuucugaggua

SEQ ID NO: 562681 - RNA, 22 nt, Human
aguaauagugaaucgacuauga

SEQ ID NO: 562682 - RNA, 22 nt, Human
aguuaacuaaacugugaguaaa

SEQ ID NO: 562683 - RNA, 22 nt, Human
agcugguggauuaugcuguaca

SEQ ID NO: 562684 - RNA, 22 nt, Human
cggggacacacuggcagcuccu

SEQ ID NO: 562685 - RNA, 22 nt, Human
cauauucuuuaagcaaugcucu

SEQ ID NO: 562686 - RNA, 22 nt, Human
auucacagaauaguuuuaccag

SEQ ID NO: 562687 - RNA, 22 nt, Human
gcuggaguacaucuuuggcggc

SEQ ID NO: 562688 - RNA, 22 nt, Human
aagccaggccauucucugguuc

SEQ ID NO: 562689 - RNA, 22 nt, Human
cagguggcuucucugcagccuu

SEQ ID NO: 562690 - RNA, 22 nt, Human
gucaacauuuacugcccuggcc

SEQ ID NO: 562691 - RNA, 22 nt, Human
ccacccagccagaugcaggaag

SEQ ID NO: 562692 - RNA, 22 nt, Human
ucaguaacuuacuuauucaccu

SEQ ID NO: 562693 - RNA, 23 nt, Human
gaauucuuaaggucacuaaaguc

SEQ ID NO: 562694 - RNA, 22 nt, Human
acagauauaaacuauaguagug

SEQ ID NO: 562695 - RNA, 22 nt, Human
aagaaucauccugcaagagucu

SEQ ID NO: 562696 - RNA, 22 nt, Human
ggcuggcacccuuggggauagg

SEQ ID NO: 562697 - RNA, 22 nt, Human
cuauucagguguccauuaaucc

SEQ ID NO: 562698 - RNA, 22 nt, Human
ucuacauuccuuuuauaauauc

SEQ ID NO: 562699 - RNA, 22 nt, Human
cugagucucccggcaguggagg

SEQ ID NO: 562700 - RNA, 22 nt, Human
ucuggaguugagagugugcgag

SEQ ID NO: 562701 - RNA, 22 nt, Human
gggcagugaauauuggugggaa

SEQ ID NO: 562702 - RNA, 22 nt, Human
uggauggggcagcuuaggugug

SEQ ID NO: 562703 - RNA, 22 nt, Human
gccaaaucacagggccaaaagc

SEQ ID NO: 562704 - RNA, 22 nt, Human
gcagcuguguaaugagcccaca

SEQ ID NO: 562705 - RNA, 22 nt, Human
uauugacaauaggcaacugagg

SEQ ID NO: 562706 - RNA, 22 nt, Human
cuccagggaggucugcaggacu

SEQ ID NO: 562707 - RNA, 21 nt, Human
uccaggccaugguggggaggc

SEQ ID NO: 562708 - RNA, 21 nt, Human
uagaauacagguauuuuggau

SEQ ID NO: 562709 - RNA, 22 nt, Human
ugcaaauuuaaugaaacuaugu

SEQ ID NO: 562710 - RNA, 22 nt, Human
ccagagagagaggucaauggca

SEQ ID NO: 562711 - RNA, 22 nt, Human
aaucaguuaaauauugaguaca

SEQ ID NO: 562712 - RNA, 22 nt, Human
uuuuaauccucuugguaucuua

SEQ ID NO: 562713 - RNA, 22 nt, Human
ccaggcuggauuuugcaguuca

SEQ ID NO: 562714 - RNA, 22 nt, Human
ucugagcauugaauuuucuucc

SEQ ID NO: 562715 - RNA, 22 nt, Human
uuuggaauguaguuuaaucauc

SEQ ID NO: 562716 - RNA, 20 nt, Human
aacagggggcugcagagggc

SEQ ID NO: 562717 - RNA, 22 nt, Human
aacagccacugauacugaauag

SEQ ID NO: 562718 - RNA, 22 nt, Human
uuugacuucuaucuaguaagaa

SEQ ID NO: 562719 - RNA, 22 nt, Human
agcuggguguguaucagauaaa

SEQ ID NO: 562720 - RNA, 22 nt, Human
agccaggaaugcaugcucugcu

SEQ ID NO: 562721 - RNA, 18 nt, Human
uguagagccagguuugcc

SEQ ID NO: 562722 - RNA, 22 nt, Human
uaauaaaugaaagugcuggcau

SEQ ID NO: 562723 - RNA, 22 nt, Human
aaauucuuuggccuacuuugaa

SEQ ID NO: 562724 - RNA, 22 nt, Human
uagaaacauguucuguucuguu

SEQ ID NO: 562725 - RNA, 22 nt, Human
agucaauucuuuucaacucaag

SEQ ID NO: 562726 - RNA, 22 nt, Human
cuacagacccaccuuggaagaa

SEQ ID NO: 562727 - RNA, 22 nt, Human
uauaagaagugaagaagaguua

SEQ ID NO: 562728 - RNA, 22 nt, Human
auauaaaguguuuagaaagcug

SEQ ID NO: 562729 - RNA, 22 nt, Human
ggaaggcuuuguagaagugcca

SEQ ID NO: 562730 - RNA, 21 nt, Human
agaaaaacacgauauaagccc

SEQ ID NO: 562731 - RNA, 22 nt, Human
aaagaacaucggagugggcggg

SEQ ID NO: 562732 - RNA, 21 nt, Human
agcuggcucucucuggagaga

SEQ ID NO: 562733 - RNA, 22 nt, Human
cgagcagaagccugguggucug

SEQ ID NO: 562734 - RNA, 22 nt, Human
ccucucccagggagagccugag

SEQ ID NO: 562735 - RNA, 22 nt, Human
aggaaaugcugaugcuccugga

SEQ ID NO: 562736 - RNA, 22 nt, Human
auauagaucaaaugaugcuaau

SEQ ID NO: 562737 - RNA, 21 nt, Human
gacacaaaggguaguaauggu

SEQ ID NO: 562738 - RNA, 22 nt, Human
aacacucuacgugcagcuccua

SEQ ID NO: 562739 - RNA, 22 nt, Human
guacagauuaauaauauacuga

SEQ ID NO: 562740 - RNA, 22 nt, Human
aauguacaccguggguuuuuua

SEQ ID NO: 562741 - RNA, 21 nt, Human
accagcaggagaucagaagga

SEQ ID NO: 562742 - RNA, 21 nt, Human
cagcccagcuucuuccccagu

SEQ ID NO: 562743 - RNA, 22 nt, Human
gaagucuucauucucucugaga

SEQ ID NO: 562744 - RNA, 22 nt, Human
cugagaguagcuggagaacauu

SEQ ID NO: 562745 - RNA, 22 nt, Human
acacauuucucccagucuccau

SEQ ID NO: 562746 - RNA, 17 nt, Human
agugaaauuuacauugc

SEQ ID NO: 562747 - RNA, 22 nt, Human
ggggaccuaggcucugucucuu

SEQ ID NO: 562748 - RNA, 22 nt, Human
gcaggucucaaucugagcaggc

SEQ ID NO: 562749 - RNA, 22 nt, Human
ugagaggccccagcucuuggcc

SEQ ID NO: 562750 - RNA, 22 nt, Human
gccugcuuccuuuucauagaug

SEQ ID NO: 562751 - RNA, 22 nt, Human
uucaguuucguuaucuaugaga

SEQ ID NO: 562752 - RNA, 22 nt, Human
uaacagcaaccacagugcuggu

SEQ ID NO: 562753 - RNA, 23 nt, Human
gcagacagagcagacuaagacaa

SEQ ID NO: 562754 - RNA, 22 nt, Human
uugggguguuggauggagcaag

SEQ ID NO: 562755 - RNA, 22 nt, Human
augggcucggcgcugcugggau

SEQ ID NO: 562756 - RNA, 22 nt, Human
ggagaaggugcuggucacugug

SEQ ID NO: 562757 - RNA, 22 nt, Human
gugugcaggugucagugcagcu

SEQ ID NO: 562758 - RNA, 23 nt, Human
gccuggccaccccagggcugcuu

SEQ ID NO: 562759 - RNA, 22 nt, Human
uaagccacuagucuguuaugaa

SEQ ID NO: 562760 - RNA, 22 nt, Human
ucaaagcacuggggaaagccug

SEQ ID NO: 562761 - RNA, 22 nt, Human
ccugggcuugcaucugugcugg

SEQ ID NO: 562762 - RNA, 22 nt, Human
cugcuuuaucugagacaaguca

SEQ ID NO: 562763 - RNA, 22 nt, Human
ggcuucugagugcucugcuguu

SEQ ID NO: 562764 - RNA, 22 nt, Human
gaauuucuggacccuuugagaa

SEQ ID NO: 562765 - RNA, 22 nt, Human
uugucuuuggaaauuuaauguu

SEQ ID NO: 562766 - RNA, 22 nt, Human
gaauccaggguuguuugagcua

SEQ ID NO: 562767 - RNA, 22 nt, Human
aaaugcaccuugcugugagacu

SEQ ID NO: 562768 - RNA, 22 nt, Human
uacaaaugaaccaacuuugaug

SEQ ID NO: 562769 - RNA, 19 nt, Human
agccagugagccucugggu

SEQ ID NO: 562770 - RNA, 22 nt, Human
cugucuccagggcaggugcagg

SEQ ID NO: 562771 - RNA, 22 nt, Human
cccugccuuguuggagccuaug

SEQ ID NO: 562772 - RNA, 22 nt, Human
aggggugauuugggacaggaca

SEQ ID NO: 562773 - RNA, 22 nt, Human
cagcuguuacugaaguaaaaug

SEQ ID NO: 562774 - RNA, 22 nt, Human
ggagaugcuauguaguuugguu

SEQ ID NO: 562775 - RNA, 22 nt, Human
acauuaaaauggagaauuuuga

SEQ ID NO: 562776 - RNA, 22 nt, Human
aaguguagauuauggagugucu

SEQ ID NO: 562777 - RNA, 22 nt, Human
uuuuuaccuggaggauaaaugu

SEQ ID NO: 562778 - RNA, 23 nt, Human
cacauauagcagccacuaagguc

SEQ ID NO: 562779 - RNA, 20 nt, Human
ucuggggaugaggucuagga

SEQ ID NO: 562780 - RNA, 22 nt, Human
guggcugcagcccagcggcacg

SEQ ID NO: 562781 - RNA, 22 nt, Human
ccagggcacguugggacaguac

SEQ ID NO: 562782 - RNA, 22 nt, Human
uauuugaugaagguaaagucuu

SEQ ID NO: 562783 - RNA, 22 nt, Human
uuuccucuccaccaggaggucu

SEQ ID NO: 562784 - RNA, 22 nt, Human
ugucacauugaauaugauuuau

SEQ ID NO: 562785 - RNA, 22 nt, Human
agugaguauuuguugagugcua

SEQ ID NO: 562786 - RNA, 22 nt, Human
uuacacaacaucuguauuauua

SEQ ID NO: 562787 - RNA, 19 nt, Human
gaacacuuacuauauuucu

SEQ ID NO: 562788 - RNA, 20 nt, Human
auucuacaagaauaagcaug

SEQ ID NO: 562789 - RNA, 22 nt, Human
ugcagguguaaauuuucaagag

SEQ ID NO: 562790 - RNA, 22 nt, Human
guuauguaugagggaaugauua

SEQ ID NO: 562791 - RNA, 22 nt, Human
ucaggagcugcacugggcccac

SEQ ID NO: 562792 - RNA, 22 nt, Human
acuguugaagugccagcuugau

SEQ ID NO: 562793 - RNA, 22 nt, Human
gcagggcagcucacugugguuc

SEQ ID NO: 562794 - RNA, 19 nt, Human
ucuuucauuucuagcucug

SEQ ID NO: 562795 - RNA, 20 nt, Human
cugagcgucuaagaggugag

SEQ ID NO: 562796 - RNA, 22 nt, Human
acaguguccuuguggucccugu

SEQ ID NO: 562797 - RNA, 22 nt, Human
ccagguggugccucuguucgca

SEQ ID NO: 562798 - RNA, 22 nt, Human
aaggucauuuaacaauuuauga

SEQ ID NO: 562799 - RNA, 17 nt, Human
uccuggcucugccacug

SEQ ID NO: 562800 - RNA, 22 nt, Human
guucagauuugacugguuucuc

SEQ ID NO: 562801 - RNA, 22 nt, Human
gaugaagcuuugaagucuaauc

SEQ ID NO: 562802 - RNA, 22 nt, Human
ccagggcugguggcugcagagg

SEQ ID NO: 562803 - RNA, 22 nt, Human
guacucucuugaaggccuuucu

SEQ ID NO: 562804 - RNA, 22 nt, Human
ucaaugaugcugaagguagcgu

SEQ ID NO: 562805 - RNA, 22 nt, Human
guuugugucaaugacuucugca

SEQ ID NO: 562806 - RNA, 22 nt, Human
agguccaguugccagaauggcc

SEQ ID NO: 562807 - RNA, 22 nt, Human
cacacauuucagaugcuacaau

SEQ ID NO: 562808 - RNA, 22 nt, Human
uacuuccagcaaucugcauauu

SEQ ID NO: 562809 - RNA, 22 nt, Human
agcaauaugacauugcuacauc

SEQ ID NO: 562810 - RNA, 22 nt, Human
uaacaagauuuguaaaauugua

SEQ ID NO: 562811 - RNA, 22 nt, Human
ugaagaaccugaugagcugugu

SEQ ID NO: 562812 - RNA, 22 nt, Human
ccaggguaccccaagggcaggu

SEQ ID NO: 562813 - RNA, 22 nt, Human
caggguggaaaagcuaguugga

SEQ ID NO: 562814 - RNA, 22 nt, Human
ggcagaccucuccagccccaca

SEQ ID NO: 562815 - RNA, 22 nt, Human
aagcuagauaacuuuuauauuu

SEQ ID NO: 562816 - RNA, 22 nt, Human
uggaccugaagaauaggaagua

SEQ ID NO: 562817 - RNA, 22 nt, Human
uccucuuuaaaugcuuuuaucu

SEQ ID NO: 562818 - RNA, 22 nt, Human
aguuguaacagauucuaacaua

SEQ ID NO: 562819 - RNA, 22 nt, Human
agcuuuaucccuugcccaucga

SEQ ID NO: 562820 - RNA, 22 nt, Human
aguugcacuuucuagauacugu

SEQ ID NO: 562821 - RNA, 22 nt, Human
aggggagccgaggggcaucugu

SEQ ID NO: 562822 - RNA, 22 nt, Human
ugaaccagagucuccagugguu

SEQ ID NO: 562823 - RNA, 22 nt, Human
uuacaaguacugaauaugauuu

SEQ ID NO: 562824 - RNA, 22 nt, Human
guauuauuaaguguauuugacc

SEQ ID NO: 562825 - RNA, 22 nt, Human
aggaagcuuggggcagggcuac

SEQ ID NO: 562826 - RNA, 22 nt, Human
cugccuggaugaauggcgccuu

SEQ ID NO: 562827 - RNA, 22 nt, Human
aggggccauuguucugcccgcu

SEQ ID NO: 562828 - RNA, 22 nt, Human
ggugaagggugucauggcauuu

SEQ ID NO: 562829 - RNA, 22 nt, Human
ucuggucuccaggagugguggu

SEQ ID NO: 562830 - RNA, 22 nt, Human
ggcuucucucuucacauggcuu

SEQ ID NO: 562831 - RNA, 22 nt, Human
acagguggggaggcugagguuc

SEQ ID NO: 562832 - RNA, 22 nt, Human
uacagagacccacaagagacug

SEQ ID NO: 562833 - RNA, 22 nt, Human
ccacagcugaccgcaggugagc

SEQ ID NO: 562834 - RNA, 22 nt, Human
agaugaaaagauaagcagcaau

SEQ ID NO: 562835 - RNA, 22 nt, Human
gcuccucugucaaaugagagug

SEQ ID NO: 562836 - RNA, 22 nt, Human
uaaugugugucaucaguagagu

SEQ ID NO: 562837 - RNA, 22 nt, Human
ggaggcuccacugcucuuccug

SEQ ID NO: 562838 - RNA, 22 nt, Human
acauucuuccagcuggcuguug

SEQ ID NO: 562839 - RNA, 22 nt, Human
caguacuuaacuuauaggagag

SEQ ID NO: 562840 - RNA, 22 nt, Human
ugcaggcuauaucuuauuugac

SEQ ID NO: 562841 - RNA, 22 nt, Human
gccugggacccuuagcucuugg

SEQ ID NO: 562842 - RNA, 22 nt, Human
auucuuuauugcugaugguuau

SEQ ID NO: 562843 - RNA, 22 nt, Human
cugcccagaagccagaugggca

SEQ ID NO: 562844 - RNA, 22 nt, Human
guggcagguuccguagacagca

SEQ ID NO: 562845 - RNA, 22 nt, Human
caguagcauguaauaaagacag

SEQ ID NO: 562846 - RNA, 22 nt, Human
aacucagcauccugcacagaga

SEQ ID NO: 562847 - RNA, 21 nt, Human
cacugcagccuugaccugggc

SEQ ID NO: 562848 - RNA, 22 nt, Human
gcccagcuccucugcagacccu

SEQ ID NO: 562849 - RNA, 19 nt, Human
ucuuuucacgcauuuugaa

SEQ ID NO: 562850 - RNA, 22 nt, Human
auaucuuuguaugguucagcag

SEQ ID NO: 562851 - RNA, 22 nt, Human
acagugaucuuuuaguuggaac

SEQ ID NO: 562852 - RNA, 16 nt, Human
cagcuuuaugucagug

SEQ ID NO: 562853 - RNA, 22 nt, Human
cagcugaagaaagagugguuag

SEQ ID NO: 562854 - RNA, 22 nt, Human
agcuuagucacucuuaaauuua

SEQ ID NO: 562855 - RNA, 22 nt, Human
aguccaggaguugggugacauu

SEQ ID NO: 562856 - RNA, 22 nt, Human
uggcagcagcaaauggcauauc

SEQ ID NO: 562857 - RNA, 16 nt, Human
ccagguggggcuguga

SEQ ID NO: 562858 - RNA, 23 nt, Human
augacaaacaggacaucuugugc

SEQ ID NO: 562859 - RNA, 22 nt, Human
gccaguuccuguggagucagag

SEQ ID NO: 562860 - RNA, 22 nt, Human
gucaggccaauacucuccagca

SEQ ID NO: 562861 - RNA, 22 nt, Human
caguaauagauuugagaguggu

SEQ ID NO: 562862 - RNA, 22 nt, Human
uagcagggaaggugugcugagc

SEQ ID NO: 562863 - RNA, 22 nt, Human
gccucccugagucacccaagca

SEQ ID NO: 562864 - RNA, 22 nt, Human
aagaagagaacuggcauccuaa

SEQ ID NO: 562865 - RNA, 22 nt, Human
caucagcucuucauucuugauu

SEQ ID NO: 562866 - RNA, 22 nt, Human
guuuuggcucuggcauguggaa

SEQ ID NO: 562867 - RNA, 22 nt, Human
uauuugauagagauaaaugaua

SEQ ID NO: 562868 - RNA, 22 nt, Human
uucuaaguccuaccugaaagca

SEQ ID NO: 562869 - RNA, 22 nt, Human
gaacaacuccaagggacaucau

SEQ ID NO: 562870 - RNA, 22 nt, Human
gccuggcugccggccuuggcaa

SEQ ID NO: 562871 - RNA, 23 nt, Human
uacuauaacgcugugucagcucc

SEQ ID NO: 562872 - RNA, 22 nt, Human
uccucagggggccaacccagcc

SEQ ID NO: 562873 - RNA, 22 nt, Human
gccguccuacgccaucauagcg

SEQ ID NO: 562874 - RNA, 22 nt, Human
ugggcagggagcuggaaccaca

SEQ ID NO: 562875 - RNA, 22 nt, Human
auagucuuagaaucuugagugu

SEQ ID NO: 562876 - RNA, 22 nt, Human
cccacucccugcacgccugccg

SEQ ID NO: 562877 - RNA, 22 nt, Human
ggcugagcuuuucaugaugguu

SEQ ID NO: 562878 - RNA, 22 nt, Human
cugagggccuucuaugcugagc

SEQ ID NO: 562879 - RNA, 22 nt, Human
gcacugagcuuuggaggagcag

SEQ ID NO: 562880 - RNA, 22 nt, Human
gcuuccaaugcuucuaucacau

SEQ ID NO: 562881 - RNA, 22 nt, Human
uguacacauuaagcucuuuaga

SEQ ID NO: 562882 - RNA, 22 nt, Human
aguguucuagcgcugugcuugu

SEQ ID NO: 562883 - RNA, 22 nt, Human
uuacccagugaagccgaggcag

SEQ ID NO: 562884 - RNA, 22 nt, Human
agugccucugcagguccgaguu

SEQ ID NO: 562885 - RNA, 22 nt, Human
gcaggccugucuugcucgcccu

SEQ ID NO: 562886 - RNA, 22 nt, Human
acuuaccagagaggauccgccc

SEQ ID NO: 562887 - RNA, 22 nt, Human
auuucagagugagagugcucaa

SEQ ID NO: 562888 - RNA, 22 nt, Human
acagugucuccugguacccagu

SEQ ID NO: 562889 - RNA, 22 nt, Human
uuuguaguuguggaugcugaag

SEQ ID NO: 562890 - RNA, 22 nt, Human
augaacaguacaaagcacagac

SEQ ID NO: 562891 - RNA, 22 nt, Human
cagacucuugagcugauuguau

SEQ ID NO: 562892 - RNA, 16 nt, Human
aggagcuggguaggag

SEQ ID NO: 562893 - RNA, 22 nt, Human
cagaccagccauuugccucuuc

SEQ ID NO: 562894 - RNA, 22 nt, Human
uguauuucugcuuucucuagua

SEQ ID NO: 562895 - RNA, 22 nt, Human
uccagugguggcucccggaccu

SEQ ID NO: 562896 - RNA, 22 nt, Human
ucuggcuucaguaggguucacu

SEQ ID NO: 562897 - RNA, 22 nt, Human
cgcacuggagcuggaacgaguc

SEQ ID NO: 562898 - RNA, 22 nt, Human
uucuuuuaauagagauccugug

SEQ ID NO: 562899 - RNA, 22 nt, Human
gucuguggaguugcuugcugga

SEQ ID NO: 562900 - RNA, 17 nt, Human
aggucugagaguaucug

SEQ ID NO: 562901 - RNA, 22 nt, Human
auguuguugaacucuuugcaug

SEQ ID NO: 562902 - RNA, 17 nt, Human
gcccgugggcuacggua

SEQ ID NO: 562903 - RNA, 22 nt, Human
caggccuugaaggccugcggga

SEQ ID NO: 562904 - RNA, 22 nt, Human
ccaggaggaaagaccagcccau

SEQ ID NO: 562905 - RNA, 21 nt, Human
uccugccuuaguccagagcag

SEQ ID NO: 562906 - RNA, 22 nt, Human
ccgaggcuggccucagggcugu

SEQ ID NO: 562907 - RNA, 22 nt, Human
agacgcgguggugcaugccugu

SEQ ID NO: 562908 - RNA, 22 nt, Human
acuggaaaguauucuuucacug

SEQ ID NO: 562909 - RNA, 18 nt, Human
cgauguguaugugauuug

SEQ ID NO: 562910 - RNA, 22 nt, Human
acccggagucggagguugcagu

SEQ ID NO: 562911 - RNA, 22 nt, Human
ugugcugcucucagugacagcc

SEQ ID NO: 562912 - RNA, 22 nt, Human
uauuaugguuguagguuaacaa

SEQ ID NO: 562913 - RNA, 22 nt, Human
ucgucugugaaauugggauaag

SEQ ID NO: 562914 - RNA, 22 nt, Human
uucucacguuauuggcugagag

SEQ ID NO: 562915 - RNA, 22 nt, Human
cuuuggucuccgucaucaauca

SEQ ID NO: 562916 - RNA, 22 nt, Human
ucaccccuugugaaugcugcuc

SEQ ID NO: 562917 - RNA, 22 nt, Human
gccacaggucggcuagaggguc

SEQ ID NO: 562918 - RNA, 17 nt, Human
agccugcugaucucaca

SEQ ID NO: 562919 - RNA, 22 nt, Human
gugucccaaagauuagaaauca

SEQ ID NO: 562920 - RNA, 21 nt, Human
ugcuccaggagggggcagucc

SEQ ID NO: 562921 - RNA, 22 nt, Human
gugugcgccgacacagccaggu

SEQ ID NO: 562922 - RNA, 22 nt, Human
augcaauaguaauucuagucug

SEQ ID NO: 562923 - RNA, 22 nt, Human
uagcugucagcaaucaaguggu

SEQ ID NO: 562924 - RNA, 22 nt, Human
ccagucagccaagcugcagcgg

SEQ ID NO: 562925 - RNA, 21 nt, Human
uguguucuucuaggucagcua

SEQ ID NO: 562926 - RNA, 19 nt, Human
agacaaguuuccagaagcc

SEQ ID NO: 562927 - RNA, 22 nt, Human
aaaagagccacuuaugaccuca

SEQ ID NO: 562928 - RNA, 22 nt, Human
uccaaggacauuguucuaguug

SEQ ID NO: 562929 - RNA, 22 nt, Human
aggcugagguaggaggaucgcu

SEQ ID NO: 562930 - RNA, 22 nt, Human
gugcaugucuuuggaggccucc

SEQ ID NO: 562931 - RNA, 22 nt, Human
uuuguguuggaagaaaugcuac

SEQ ID NO: 562932 - RNA, 21 nt, Human
ugugacagaggcggugccuac

SEQ ID NO: 562933 - RNA, 22 nt, Human
gagcugagggucuaggaggguu

SEQ ID NO: 562934 - RNA, 22 nt, Human
ccacugugcccagccucauggg

SEQ ID NO: 562935 - RNA, 22 nt, Human
gcugucugcugggucgcucagg

SEQ ID NO: 562936 - RNA, 22 nt, Human
ucguuagccucgagaucuuugu

SEQ ID NO: 562937 - RNA, 22 nt, Human
ggggaagaaauagaacauuuug

SEQ ID NO: 562938 - RNA, 22 nt, Human
uccagcucugcugugcgccggu

SEQ ID NO: 562939 - RNA, 22 nt, Human
uccaggagcucauccacgucaa

SEQ ID NO: 562940 - RNA, 22 nt, Human
cuugccaguguugcagaagcuc

SEQ ID NO: 562941 - RNA, 22 nt, Human
ucagccaggccaggcauucaca

SEQ ID NO: 562942 - RNA, 22 nt, Human
uccugccaccggggguggcgau

SEQ ID NO: 562943 - RNA, 22 nt, Human
aguacaagugaugugguaaaaa

SEQ ID NO: 562944 - RNA, 22 nt, Human
ccucguccacaauccuugcaca

SEQ ID NO: 562945 - RNA, 22 nt, Human
uugaacaguccuaagagacccu

SEQ ID NO: 562946 - RNA, 22 nt, Human
cagaguccugcaccagcuccag

SEQ ID NO: 562947 - RNA, 22 nt, Human
gauguaucugagcugcuuaggu

SEQ ID NO: 562948 - RNA, 22 nt, Human
uuuccuguccugguacuuggca

SEQ ID NO: 562949 - RNA, 22 nt, Human
gcaguugcaggauuuguguugu

SEQ ID NO: 562950 - RNA, 22 nt, Human
uucuuuccucccagccuuugga

SEQ ID NO: 562951 - RNA, 22 nt, Human
aagugcaggucucagcuacucu

SEQ ID NO: 562952 - RNA, 22 nt, Human
ugauuuacaguagugucuaaac

SEQ ID NO: 562953 - RNA, 22 nt, Human
auccaggcgaaugcagaaggcc

SEQ ID NO: 562954 - RNA, 22 nt, Human
cagcccuugcgacacccuggcu

SEQ ID NO: 562955 - RNA, 20 nt, Human
ucucccugcccaucucagau

SEQ ID NO: 562956 - RNA, 22 nt, Human
guuucuccucugugucuuguuu

SEQ ID NO: 562957 - RNA, 22 nt, Human
ccaagaggggcagagggcugca

SEQ ID NO: 562958 - RNA, 22 nt, Human
cuccagaggcgacuugcaucac

SEQ ID NO: 562959 - RNA, 22 nt, Human
uaaagcaaugaaaguuuugcag

SEQ ID NO: 562960 - RNA, 22 nt, Human
gggggcgccgccgcucaucuca

SEQ ID NO: 562961 - RNA, 22 nt, Human
agggcagagauuaauuaagaca

SEQ ID NO: 562962 - RNA, 22 nt, Human
acugagaacuuggggacagagg

SEQ ID NO: 562963 - RNA, 22 nt, Human
aggacugggugcagagggcauc

SEQ ID NO: 562964 - RNA, 22 nt, Human
uaaagugaaguucagaauggcu

SEQ ID NO: 562965 - RNA, 22 nt, Human
aaggcagcaugaaucccuguac

SEQ ID NO: 562966 - RNA, 22 nt, Human
ucaugcaccucuccaugucccc

SEQ ID NO: 562967 - RNA, 22 nt, Human
ccggcucggcgaccaggcugaa

SEQ ID NO: 562968 - RNA, 22 nt, Human
agcagugugggcugcacgcugg

SEQ ID NO: 562969 - RNA, 22 nt, Human
gccugagauucccggagccgug

SEQ ID NO: 562970 - RNA, 22 nt, Human
uuccaaggagagcucgaccuca

SEQ ID NO: 562971 - RNA, 22 nt, Human
uuaaguauauccauuugacugg

SEQ ID NO: 562972 - RNA, 22 nt, Human
gaggagagaagcuaacggugcu

SEQ ID NO: 562973 - RNA, 22 nt, Human
accagagucaauuauuuugcca

SEQ ID NO: 562974 - RNA, 22 nt, Human
gcggcgccugggacccgccagc

SEQ ID NO: 562975 - RNA, 22 nt, Human
ugauucaguacuuucucuaacu

SEQ ID NO: 562976 - RNA, 22 nt, Human
uggcugaggcacagcugccgcc

SEQ ID NO: 562977 - RNA, 22 nt, Human
uucagaaaggcugugccagcca

SEQ ID NO: 562978 - RNA, 23 nt, Human
gggcagcuuaagcuuguuuuucu

SEQ ID NO: 562979 - RNA, 22 nt, Human
ucuccccaguauggauucucug

SEQ ID NO: 562980 - RNA, 20 nt, Human
uggcccagcacgacgaggac

SEQ ID NO: 562981 - RNA, 23 nt, Human
uaucauuucagcucucugccugg

SEQ ID NO: 562982 - RNA, 22 nt, Human
caggaggaaaguuccacucaac

SEQ ID NO: 562983 - RNA, 22 nt, Human
cacaguuuuaucuuauacugau

SEQ ID NO: 562984 - RNA, 22 nt, Human
ucuuccagauacuuccugacuu

SEQ ID NO: 562985 - RNA, 22 nt, Human
ggaccugaacauaaaacgaggc

SEQ ID NO: 562986 - RNA, 22 nt, Human
acagccaggaauucuggagaag

SEQ ID NO: 562987 - RNA, 22 nt, Human
gcacguguucuguggcaugggu

SEQ ID NO: 562988 - RNA, 22 nt, Human
uccucuucaaaauagcucugaa

SEQ ID NO: 562989 - RNA, 22 nt, Human
caggccacacggcggcucccug

SEQ ID NO: 562990 - RNA, 19 nt, Human
uccuggggaggggcauggc

SEQ ID NO: 562991 - RNA, 22 nt, Human
gggggcuggacuuucccacaca

SEQ ID NO: 562992 - RNA, 19 nt, Human
agcaguggagccaugccug

SEQ ID NO: 562993 - RNA, 22 nt, Human
cagcuugcacacauauuagacg

SEQ ID NO: 562994 - RNA, 19 nt, Human
augggaagcggccagcgga

SEQ ID NO: 562995 - RNA, 22 nt, Human
ggcggugguugagaggacggcg

SEQ ID NO: 562996 - RNA, 18 nt, Human
cagaaaguuauuuacucu

SEQ ID NO: 562997 - RNA, 22 nt, Human
auuuacucgugcuucauugaau

SEQ ID NO: 562998 - RNA, 22 nt, Human
augauugaaaaugacauugcca

SEQ ID NO: 562999 - RNA, 22 nt, Human
caggcacaaugagcgccaucuu

SEQ ID NO: 563000 - RNA, 22 nt, Human
auuuacagacguggauuagugc

SEQ ID NO: 563001 - RNA, 22 nt, Human
gagcuccuauggucgguggcuc

SEQ ID NO: 563002 - RNA, 22 nt, Human
gaaacuguauguaguuuuuggg

SEQ ID NO: 563003 - RNA, 22 nt, Human
acagcagguuauuguuauggca

SEQ ID NO: 563004 - RNA, 22 nt, Human
aucaugcagcaacaagcaaggc

SEQ ID NO: 563005 - RNA, 22 nt, Human
ugcaugguuauauacuacuagu

SEQ ID NO: 563006 - RNA, 22 nt, Human
ugguccucacccuacccagcug

SEQ ID NO: 563007 - RNA, 22 nt, Human
uggggugugcucagagcagggg

SEQ ID NO: 563008 - RNA, 18 nt, Human
gccagcccuccaaccucc

SEQ ID NO: 563009 - RNA, 18 nt, Human
cugccuguugcugagagg

SEQ ID NO: 563010 - RNA, 22 nt, Human
uccuggccucugagucaagaac

SEQ ID NO: 563011 - RNA, 22 nt, Human
gccugagccgccugagcggcgg

SEQ ID NO: 563012 - RNA, 22 nt, Human
uugacccgaguccuucuugggg

SEQ ID NO: 563013 - RNA, 22 nt, Human
aggacagcagugcuggcacuug

SEQ ID NO: 563014 - RNA, 22 nt, Human
ucccagucuagagccggauugg

SEQ ID NO: 563015 - RNA, 22 nt, Human
ugggaugggaucucgcuguguc

SEQ ID NO: 563016 - RNA, 17 nt, Human
agcuuggagcagcauga

SEQ ID NO: 563017 - RNA, 22 nt, Human
gcaggccuccccugcuggagcu

SEQ ID NO: 563018 - RNA, 22 nt, Human
acauuugauauggaguugugua

SEQ ID NO: 563019 - RNA, 22 nt, Human
guuuauuggguauuguggagcc

SEQ ID NO: 563020 - RNA, 22 nt, Human
cacccucaagcaguggcacgug

SEQ ID NO: 563021 - RNA, 22 nt, Human
guugggcugaagugugugcuua

SEQ ID NO: 563022 - RNA, 22 nt, Human
ugaggaggugggcacacagagu

SEQ ID NO: 563023 - RNA, 22 nt, Human
acagaguaucuaucaggaguau

SEQ ID NO: 563024 - RNA, 23 nt, Human
acacauguuuaugcuugggggca

SEQ ID NO: 563025 - RNA, 22 nt, Human
cauaaauuguacccauuccaac

SEQ ID NO: 563026 - RNA, 22 nt, Human
agggccacgugcaccgcggucu

SEQ ID NO: 563027 - RNA, 22 nt, Human
caucaggaauaaaugaggcugu

SEQ ID NO: 563028 - RNA, 22 nt, Human
agagaccuuccugacuccagag

SEQ ID NO: 563029 - RNA, 22 nt, Human
ccacugcuaacuugcugcagcu

SEQ ID NO: 563030 - RNA, 22 nt, Human
gcugcuggcuuccugcuguuuu

SEQ ID NO: 563031 - RNA, 22 nt, Human
gcggggacagaaggcgguucuc

SEQ ID NO: 563032 - RNA, 22 nt, Human
caacagcuggaggcuuggcccg

SEQ ID NO: 563033 - RNA, 22 nt, Human
ugcagcaucuccuugugccaug

SEQ ID NO: 563034 - RNA, 22 nt, Human
gcagcugccgugagcucacgcc

SEQ ID NO: 563035 - RNA, 22 nt, Human
uggaaagaggaagugcccagca

SEQ ID NO: 563036 - RNA, 22 nt, Human
uacuuugagaugaugcugaucg

SEQ ID NO: 563037 - RNA, 23 nt, Human
acagaagccaggagccgcugggc

SEQ ID NO: 563038 - RNA, 22 nt, Human
gcggggggcaggcaguacguug

SEQ ID NO: 563039 - RNA, 22 nt, Human
caggaacagcaccaggagcuag

SEQ ID NO: 563040 - RNA, 22 nt, Human
cagguuagcaacaugguuagag

SEQ ID NO: 563041 - RNA, 22 nt, Human
uaguguguggucucucccuugu

SEQ ID NO: 563042 - RNA, 22 nt, Human
gcagauggauguggacggcgcc

SEQ ID NO: 563043 - RNA, 21 nt, Human
ucacuagugccuucugucauu

SEQ ID NO: 563044 - RNA, 22 nt, Human
cccacugcaugaguugguauua

SEQ ID NO: 563045 - RNA, 22 nt, Human
acggugcuggguauugggguuc

SEQ ID NO: 563046 - RNA, 22 nt, Human
ugucuuaugcugcauagacuau

SEQ ID NO: 563047 - RNA, 19 nt, Human
ugcuccaggccuugccgca

SEQ ID NO: 563048 - RNA, 22 nt, Human
cgggaagguggagguugcagug

SEQ ID NO: 563049 - RNA, 22 nt, Human
uuugacucugggugcuuuuucg

SEQ ID NO: 563050 - RNA, 22 nt, Human
aaagugacaaccauuuauuaag

SEQ ID NO: 563051 - RNA, 22 nt, Human
gaaaacacuuugaucugaaagu

SEQ ID NO: 563052 - RNA, 22 nt, Human
caggcacaagaucggcuagaua

SEQ ID NO: 563053 - RNA, 22 nt, Human
aagcccgguugggaacguggug

SEQ ID NO: 563054 - RNA, 22 nt, Human
aaagugcugggauuacaggugu

SEQ ID NO: 563055 - RNA, 22 nt, Human
uuuacuuuugguaaggucauuu

SEQ ID NO: 563056 - RNA, 22 nt, Human
ggcuuucugucugcgucugugu

SEQ ID NO: 563057 - RNA, 18 nt, Human
ucuuccaacacugacacc

SEQ ID NO: 563058 - RNA, 22 nt, Human
gggaaacuuucacaauguccag

SEQ ID NO: 563059 - RNA, 22 nt, Human
gcucugugccccugccguggac

SEQ ID NO: 563060 - RNA, 22 nt, Human
gcccagccccuggguggacgug

SEQ ID NO: 563061 - RNA, 22 nt, Human
ggagucugugucuugaagcagu

SEQ ID NO: 563062 - RNA, 22 nt, Human
guacuuucaggcuuucccuuaa

SEQ ID NO: 563063 - RNA, 22 nt, Human
uugcauauccuccaacacaugg

SEQ ID NO: 563064 - RNA, 22 nt, Human
aguuauugagugcagagcaggg

SEQ ID NO: 563065 - RNA, 22 nt, Human
cagcgguggcaaggugacugug

SEQ ID NO: 563066 - RNA, 22 nt, Human
agcugaacgugcuucugcagca

SEQ ID NO: 563067 - RNA, 22 nt, Human
ugucauuggugaucugaugccu

SEQ ID NO: 563068 - RNA, 22 nt, Human
agccagucggggccaugcuggg

SEQ ID NO: 563069 - RNA, 22 nt, Human
guuuccaggcuuugguaugguu

SEQ ID NO: 563070 - RNA, 22 nt, Human
gaaagcagaugaaauugcaaca

SEQ ID NO: 563071 - RNA, 22 nt, Human
cagcugcucugguggucucucc

SEQ ID NO: 563072 - RNA, 22 nt, Human
guccuuucgagggugagugaaa

SEQ ID NO: 563073 - RNA, 19 nt, Human
acacaccagugccugugac

SEQ ID NO: 563074 - RNA, 22 nt, Human
gaagcgcggcgucggcgugggu

SEQ ID NO: 563075 - RNA, 22 nt, Human
cagcagcaacaacggaagccuu

SEQ ID NO: 563076 - RNA, 22 nt, Human
cuccgcuuguguauaccuccaa

SEQ ID NO: 563077 - RNA, 22 nt, Human
agaaggcaucagaaguguguag

SEQ ID NO: 563078 - RNA, 22 nt, Human
accuuuaugaaacagcugucgu

SEQ ID NO: 563079 - RNA, 22 nt, Human
cggcgcaggcagaccgcgggcu

SEQ ID NO: 563080 - RNA, 22 nt, Human
cacgcacgcuggguggaggcgc

SEQ ID NO: 563081 - RNA, 22 nt, Human
cugagcagaagggugcacgugc

SEQ ID NO: 563082 - RNA, 22 nt, Human
caggcuugaugugucuauacuu

SEQ ID NO: 563083 - RNA, 22 nt, Human
gagaugggcgagaagguggacu

SEQ ID NO: 563084 - RNA, 22 nt, Human
aggagggagcuuaagccaggca

SEQ ID NO: 563085 - RNA, 22 nt, Human
ccacccuuccauucuuccucuu

SEQ ID NO: 563086 - RNA, 22 nt, Human
agaagagccacuguugacggca

SEQ ID NO: 563087 - RNA, 22 nt, Human
gugcugagugcagagugcagag

SEQ ID NO: 563088 - RNA, 22 nt, Human
uugaggucuggcaguagcguug

SEQ ID NO: 563089 - RNA, 22 nt, Human
guuuccagccuccuggguaaag

SEQ ID NO: 563090 - RNA, 22 nt, Human
cucuggagggaggcugagcugg

SEQ ID NO: 563091 - RNA, 22 nt, Human
aaauugaauuugggaaacauug

SEQ ID NO: 563092 - RNA, 22 nt, Human
aacaggcuaaauuguccauuuc

SEQ ID NO: 563093 - RNA, 22 nt, Human
uuucuucucacccaggacagag

SEQ ID NO: 563094 - RNA, 22 nt, Human
auggugguagaagcacuaugug

SEQ ID NO: 563095 - RNA, 22 nt, Human
ggcagccuccagggcacuggug

SEQ ID NO: 563096 - RNA, 22 nt, Human
caggugggagccacagcguaca

SEQ ID NO: 563097 - RNA, 22 nt, Human
gucugugcaguuacuagcuggu

SEQ ID NO: 563098 - RNA, 22 nt, Human
acuuccagaaaugauuuaauuu

SEQ ID NO: 563099 - RNA, 22 nt, Human
gagaugaagaggcccuuggagu

SEQ ID NO: 563100 - RNA, 22 nt, Human
cugcugccuuccaaaggccagg

SEQ ID NO: 563101 - RNA, 22 nt, Human
uucuuuuaauuucugucugcag

SEQ ID NO: 563102 - RNA, 22 nt, Human
uuggccguuucacugggcaguu

SEQ ID NO: 563103 - RNA, 20 nt, Human
gccaagaauaugcccgacuc

SEQ ID NO: 563104 - RNA, 22 nt, Human
agccagcauauauauaguugaa

SEQ ID NO: 563105 - RNA, 22 nt, Human
ccugcagacacuuguccagcaa

SEQ ID NO: 563106 - RNA, 22 nt, Human
cauaacauccuugcuacuuuga

SEQ ID NO: 563107 - RNA, 22 nt, Human
ugaacaugcuguugauggccug

SEQ ID NO: 563108 - RNA, 22 nt, Human
uccaaggucagcgagagucacu

SEQ ID NO: 563109 - RNA, 22 nt, Human
cauuccgcuccccuuccuugcg

SEQ ID NO: 563110 - RNA, 22 nt, Human
gcugccauggcugggggccgug

SEQ ID NO: 563111 - RNA, 22 nt, Human
cuugugaaaugccagauaaucu

SEQ ID NO: 563112 - RNA, 22 nt, Human
cuggaaggagcccgggcggauc

SEQ ID NO: 563113 - RNA, 22 nt, Human
aguucugacucugaaucuggga

SEQ ID NO: 563114 - RNA, 22 nt, Human
gggggaaaguggagguucguga

SEQ ID NO: 563115 - RNA, 22 nt, Human
cagcuuugccaaguaaggucuu

SEQ ID NO: 563116 - RNA, 22 nt, Human
gucccaggggagcucucugauu

SEQ ID NO: 563117 - RNA, 22 nt, Human
cagagggagcccuccaggagca

SEQ ID NO: 563118 - RNA, 22 nt, Human
guuggcuaugagagcuuuagug

SEQ ID NO: 563119 - RNA, 22 nt, Human
gcagcugcgcugguguggggca

SEQ ID NO: 563120 - RNA, 19 nt, Human
acccagcccaggaguggca

SEQ ID NO: 563121 - RNA, 22 nt, Human
uucagaacugucuguccuuuuc

SEQ ID NO: 563122 - RNA, 22 nt, Human
ggcuucaguggccagagaugau

SEQ ID NO: 563123 - RNA, 22 nt, Human
guggccaaggcagagaaagagc

SEQ ID NO: 563124 - RNA, 22 nt, Human
agugggagcggcagucggggac

SEQ ID NO: 563125 - RNA, 22 nt, Human
aggcauuacaucuaaauauuua

SEQ ID NO: 563126 - RNA, 20 nt, Human
acaacuuaguugagagacua

SEQ ID NO: 563127 - RNA, 22 nt, Human
gcguggcuuagagugggguacc

SEQ ID NO: 563128 - RNA, 22 nt, Human
uuuacagcuacuguccuauuuc

SEQ ID NO: 563129 - RNA, 22 nt, Human
gccaaaguaccuagcccucugc

SEQ ID NO: 563130 - RNA, 22 nt, Human
uucuggagacccagcaacaggg

SEQ ID NO: 563131 - RNA, 22 nt, Human
uuccugcaggccauagagccug

SEQ ID NO: 563132 - RNA, 22 nt, Human
cggagaggugggggcagcaucu

SEQ ID NO: 563133 - RNA, 22 nt, Human
aucccugugacgagcaucccua

SEQ ID NO: 563134 - RNA, 21 nt, Human
uugcuguuuucccaaugcagu

SEQ ID NO: 563135 - RNA, 22 nt, Human
aaacccaggguuuugucuuccc

SEQ ID NO: 563136 - RNA, 22 nt, Human
guccuggugccaccugcgggau

SEQ ID NO: 563137 - RNA, 22 nt, Human
aucauuaacccuugaugcuggg

SEQ ID NO: 563138 - RNA, 23 nt, Human
ugaaagcaaugggucuauaguau

SEQ ID NO: 563139 - RNA, 21 nt, Human
gacauugagcgugucgcagug

SEQ ID NO: 563140 - RNA, 19 nt, Human
uccugcccaccagccaggg

SEQ ID NO: 563141 - RNA, 22 nt, Human
ggcggcgcguagccggagacuu

SEQ ID NO: 563142 - RNA, 22 nt, Human
ggcaguggugggaggcucgcuc

SEQ ID NO: 563143 - RNA, 22 nt, Human
cuucuuaaaguugucacagcug

SEQ ID NO: 563144 - RNA, 20 nt, Human
uuuuccacuccucaaaacag

SEQ ID NO: 563145 - RNA, 22 nt, Human
aucagagcuaguacuugcaggu

SEQ ID NO: 563146 - RNA, 22 nt, Human
gcagcagugugggcugaaccua

SEQ ID NO: 563147 - RNA, 22 nt, Human
ccagcugggucccugcuggggc

SEQ ID NO: 563148 - RNA, 22 nt, Human
aacacugagaggggaguggcac

SEQ ID NO: 563149 - RNA, 20 nt, Human
cugcuccacccggcucucag

SEQ ID NO: 563150 - RNA, 22 nt, Human
ggccuuccugcugcuccgggcc

SEQ ID NO: 563151 - RNA, 22 nt, Human
ucaucuguuaugggaguuuuug

SEQ ID NO: 563152 - RNA, 22 nt, Human
gaugggcaucaaacaugacgug

SEQ ID NO: 563153 - RNA, 22 nt, Human
agacacuguguacagaaaaaga

SEQ ID NO: 563154 - RNA, 22 nt, Human
cugcaucacagcaggaggcaca

SEQ ID NO: 563155 - RNA, 22 nt, Human
ugagcagacuugaugaggcagc

SEQ ID NO: 563156 - RNA, 22 nt, Human
uaucuguauucugacagucacu

SEQ ID NO: 563157 - RNA, 18 nt, Human
gguccugggccuggcuca

SEQ ID NO: 563158 - RNA, 22 nt, Human
aagguggugaucaucuugaagg

SEQ ID NO: 563159 - RNA, 22 nt, Human
uugagcugccuggcuguggcuc

SEQ ID NO: 563160 - RNA, 22 nt, Human
uuucaugauuaacuuagugaau

SEQ ID NO: 563161 - RNA, 22 nt, Human
ggugcggagacuccaugaggcc

SEQ ID NO: 563162 - RNA, 22 nt, Human
aggaagagcuggaccagaggac

SEQ ID NO: 563163 - RNA, 22 nt, Human
gugcgccagcucaaggggaggc

SEQ ID NO: 563164 - RNA, 22 nt, Human
ccuuugugaauaugcagaaaau

SEQ ID NO: 563165 - RNA, 22 nt, Human
aagagucccaaaaugauucuua

SEQ ID NO: 563166 - RNA, 22 nt, Human
gaccacaguccagucaucaugg

SEQ ID NO: 563167 - RNA, 22 nt, Human
ugggcccaucauugcugugggc

SEQ ID NO: 563168 - RNA, 22 nt, Human
agccagugucgugugacaugag

SEQ ID NO: 563169 - RNA, 22 nt, Human
uuuggcgucucucaggagcuca

SEQ ID NO: 563170 - RNA, 22 nt, Human
ggccagccuggggcucccagac

SEQ ID NO: 563171 - RNA, 22 nt, Human
cccugcacagccuggcucucuu

SEQ ID NO: 563172 - RNA, 22 nt, Human
acaggacagucuaguaacagua

SEQ ID NO: 563173 - RNA, 22 nt, Human
ccugugggcgcagcuggaguca

SEQ ID NO: 563174 - RNA, 22 nt, Human
guacauauccuuuacguuuugu

SEQ ID NO: 563175 - RNA, 22 nt, Human
cugguuuuccaauguuuugacu

SEQ ID NO: 563176 - RNA, 22 nt, Human
aaauacaguggcagcagauaau

SEQ ID NO: 563177 - RNA, 22 nt, Human
uggcggugacggcggcgccugg

SEQ ID NO: 563178 - RNA, 22 nt, Human
ggggaggaagcuggaacacggg

SEQ ID NO: 563179 - RNA, 22 nt, Human
cagagccuuaguucuccuagaa

SEQ ID NO: 563180 - RNA, 20 nt, Human
cucuuuucacucucaguggu

SEQ ID NO: 563181 - RNA, 22 nt, Human
gagcaacacauugaaugaggau

SEQ ID NO: 563182 - RNA, 22 nt, Human
ggcacugggugagggucacugg

SEQ ID NO: 563183 - RNA, 22 nt, Human
cauggggcccaugugcuccaag

SEQ ID NO: 563184 - RNA, 22 nt, Human
ucuguuauaaaucacacugcau

SEQ ID NO: 563185 - RNA, 22 nt, Human
uacuggacacguauauauagau

SEQ ID NO: 563186 - RNA, 22 nt, Human
uguccagcugaaggcagccuca

SEQ ID NO: 563187 - RNA, 22 nt, Human
cugagaggcacaaggcauuucg

SEQ ID NO: 563188 - RNA, 22 nt, Human
acagcugggaacucacacagca

SEQ ID NO: 563189 - RNA, 22 nt, Human
gccagcagcgagaguuuaaccu

SEQ ID NO: 563190 - RNA, 22 nt, Human
ggagaggguguggaaaguuauc

SEQ ID NO: 563191 - RNA, 22 nt, Human
uggccagucuuagcugugccug

SEQ ID NO: 563192 - RNA, 21 nt, Human
cuagaaagaauguugucgucu

SEQ ID NO: 563193 - RNA, 22 nt, Human
ugccaggccucaggagucucca

SEQ ID NO: 563194 - RNA, 20 nt, Human
cagagcagugcccaggcggc

SEQ ID NO: 563195 - RNA, 22 nt, Human
acuagaaacuaauggauuauua

SEQ ID NO: 563196 - RNA, 22 nt, Human
cuggccagccucccagguaccc

SEQ ID NO: 563197 - RNA, 22 nt, Human
uagaggaugauccuuccuugcc

SEQ ID NO: 563198 - RNA, 22 nt, Human
caacuguaauauuggaagauca

SEQ ID NO: 563199 - RNA, 19 nt, Human
agcagggagugguuguggg

SEQ ID NO: 563200 - RNA, 22 nt, Human
cugcagggcccaaggucaacgg

SEQ ID NO: 563201 - RNA, 21 nt, Human
gcaaccagaccacagggcagu

SEQ ID NO: 563202 - RNA, 22 nt, Human
acuugguggcgaacgaggguca

SEQ ID NO: 563203 - RNA, 22 nt, Human
ugcugcacuuauggcucugagg

SEQ ID NO: 563204 - RNA, 22 nt, Human
agugaauuagccuauuuguaaa

SEQ ID NO: 563205 - RNA, 22 nt, Human
aaggaucauguauauguuuaag

SEQ ID NO: 563206 - RNA, 21 nt, Human
gcaggguuugugcugugaguu

SEQ ID NO: 563207 - RNA, 22 nt, Human
uccuggguccauggcagccgaa

SEQ ID NO: 563208 - RNA, 22 nt, Human
guguaucaaagcacagacuuca

SEQ ID NO: 563209 - RNA, 22 nt, Human
caguguuuagcacagugcuugg

SEQ ID NO: 563210 - RNA, 22 nt, Human
uccaggcuccccugcgugcucc

SEQ ID NO: 563211 - RNA, 19 nt, Human
uggcagcauugguaccuug

SEQ ID NO: 563212 - RNA, 22 nt, Human
uugucgggcuuacgcagggcca

SEQ ID NO: 563213 - RNA, 22 nt, Human
uucagcacuggacagcgagucu

SEQ ID NO: 563214 - RNA, 22 nt, Human
aacagaaaucauuuagggcucu

SEQ ID NO: 563215 - RNA, 22 nt, Human
cucugugaaccccuccuuucuu

SEQ ID NO: 563216 - RNA, 22 nt, Human
cuggagcagcagguggccaggg

SEQ ID NO: 563217 - RNA, 22 nt, Human
agacagcacuuuuguauggggg

SEQ ID NO: 563218 - RNA, 22 nt, Human
cuggcuccauccuugagcucug

SEQ ID NO: 563219 - RNA, 22 nt, Human
acugggcaaggauaugaugggu

SEQ ID NO: 563220 - RNA, 22 nt, Human
agcuuugcugcuggagaagggu

SEQ ID NO: 563221 - RNA, 22 nt, Human
uagugucucuuccuguuugaaa

SEQ ID NO: 563222 - RNA, 22 nt, Human
aguccgcgcuccaugggagucc

SEQ ID NO: 563223 - RNA, 22 nt, Human
agcugugaccuucaagagcuac

SEQ ID NO: 563224 - RNA, 22 nt, Human
uggagcagccuuuucuaagcaa

SEQ ID NO: 563225 - RNA, 20 nt, Human
ucagugggaaagugagagug

SEQ ID NO: 563226 - RNA, 22 nt, Human
auaaugacauucuuagacugga

SEQ ID NO: 563227 - RNA, 22 nt, Human
uaaagacaauuucgagcuguag

SEQ ID NO: 563228 - RNA, 21 nt, Human
ucugugcuuuuuuggcuccua

SEQ ID NO: 563229 - RNA, 22 nt, Human
aguggcagggacuucauauaaa

SEQ ID NO: 563230 - RNA, 23 nt, Human
uccugcagauaagcugguugaca

SEQ ID NO: 563231 - RNA, 22 nt, Human
agacauauuggcuugcuuuaau

SEQ ID NO: 563232 - RNA, 22 nt, Human
ucggugcgcgaggcgcgguccc

SEQ ID NO: 563233 - RNA, 20 nt, Human
gcugugccaugacccucgag

SEQ ID NO: 563234 - RNA, 22 nt, Human
uuggcgcccaggacgccgccgc

SEQ ID NO: 563235 - RNA, 22 nt, Human
ucugcuggaaaaccagggaauu

SEQ ID NO: 563236 - RNA, 22 nt, Human
agccaccaccacugaaagguua

SEQ ID NO: 563237 - RNA, 22 nt, Human
ccucugagcuggccuguggggc

SEQ ID NO: 563238 - RNA, 22 nt, Human
uuccaggaagcucucggccucu

SEQ ID NO: 563239 - RNA, 19 nt, Human
ccgucauggagaguggggu

SEQ ID NO: 563240 - RNA, 22 nt, Human
uaugcgugccucugucugucug

SEQ ID NO: 563241 - RNA, 21 nt, Human
uccaggagcacgggacuagga

SEQ ID NO: 563242 - RNA, 22 nt, Human
caggccagcagggccuccgugg

SEQ ID NO: 563243 - RNA, 22 nt, Human
cuggcuuucauggcgcaguuga

SEQ ID NO: 563244 - RNA, 22 nt, Human
gcaagcagcccagaacagcucu

SEQ ID NO: 563245 - RNA, 22 nt, Human
cagugacguaaacugcaugugc

SEQ ID NO: 563246 - RNA, 21 nt, Human
uaaagcucguucaggaaaguc

SEQ ID NO: 563247 - RNA, 22 nt, Human
gcgagucgccgcugcagcccua

SEQ ID NO: 563248 - RNA, 22 nt, Human
gcucuagcuggcgcugaccugg

SEQ ID NO: 563249 - RNA, 22 nt, Human
gggaagugagcuggaaucaagg

SEQ ID NO: 563250 - RNA, 22 nt, Human
caggccugugacaccgugucug

SEQ ID NO: 563251 - RNA, 22 nt, Human
acaccacaaguaacucuuuucc

SEQ ID NO: 563252 - RNA, 22 nt, Human
uacuguauacuacugcuguucu

SEQ ID NO: 563253 - RNA, 22 nt, Human
ugucuguccaucugucugggac

SEQ ID NO: 563254 - RNA, 22 nt, Human
uggccuugcccagcgccuaggu

SEQ ID NO: 563255 - RNA, 22 nt, Human
agccuuacauaaacagccuuau

SEQ ID NO: 563256 - RNA, 22 nt, Human
acuuuggugcgaagucacuuua

SEQ ID NO: 563257 - RNA, 21 nt, Human
uggcccuggccacggcugcca

SEQ ID NO: 563258 - RNA, 22 nt, Human
uggagugcaguugggaggacac

SEQ ID NO: 563259 - RNA, 22 nt, Human
ucguggaugcgcagggcggccu

SEQ ID NO: 563260 - RNA, 18 nt, Human
gaucgggggcgccccaag

SEQ ID NO: 563261 - RNA, 21 nt, Human
gcuggcugucucuuacacggu

SEQ ID NO: 563262 - RNA, 22 nt, Human
ccuaggccgcccggugcguggg

SEQ ID NO: 563263 - RNA, 22 nt, Human
caugaccagagaggacggccag

SEQ ID NO: 563264 - RNA, 22 nt, Human
ucuuugcagaauuuaacuuugc

SEQ ID NO: 563265 - RNA, 22 nt, Human
uuguugcugcucaaccucuaua

SEQ ID NO: 563266 - RNA, 22 nt, Human
guggcauuuuagaacagcugac

SEQ ID NO: 563267 - RNA, 22 nt, Human
gcgagaaacuaagugcccuuug

SEQ ID NO: 563268 - RNA, 22 nt, Human
agcauucuguggucuucuaugg

SEQ ID NO: 563269 - RNA, 22 nt, Human
auucagaaauagaaaauuugau

SEQ ID NO: 563270 - RNA, 22 nt, Human
ccuggccgacauggugaaacgc

SEQ ID NO: 563271 - RNA, 22 nt, Human
ggucagugccuaucaugugggc

SEQ ID NO: 563272 - RNA, 22 nt, Human
gaggucaggggagaggcugaug

SEQ ID NO: 563273 - RNA, 22 nt, Human
gggagagcgcgcuagggccgag

SEQ ID NO: 563274 - RNA, 22 nt, Human
acacauggucuacuucuucuca

SEQ ID NO: 563275 - RNA, 21 nt, Human
agggccagaucaccaaggagc

SEQ ID NO: 563276 - RNA, 22 nt, Human
ccuguaccgcgaucugcugcgc

SEQ ID NO: 563277 - RNA, 22 nt, Human
gacaaagcgccugcucgcgggc

SEQ ID NO: 563278 - RNA, 22 nt, Human
agccccaguucccuggaagucu

SEQ ID NO: 563279 - RNA, 22 nt, Human
gagucgagcagaaagccgucgg

SEQ ID NO: 563280 - RNA, 22 nt, Human
cagguugaaaguggaggagcua

SEQ ID NO: 563281 - RNA, 22 nt, Human
uguccagaucaaugcccacaug

SEQ ID NO: 563282 - RNA, 22 nt, Human
gggcagcaaaucugagucuggu

SEQ ID NO: 563283 - RNA, 21 nt, Human
ccuuugaguguguuugaagua

SEQ ID NO: 563284 - RNA, 22 nt, Human
ugagaagcauuaggaagaacau

SEQ ID NO: 563285 - RNA, 22 nt, Human
aggcucaguauagcuggcaagu

SEQ ID NO: 563286 - RNA, 22 nt, Human
gguccagcacaacacuggcaug

SEQ ID NO: 563287 - RNA, 22 nt, Human
ccugggcaaaugccagagacaa

SEQ ID NO: 563288 - RNA, 22 nt, Human
ugaaaacacuuuaguuuagguc

SEQ ID NO: 563289 - RNA, 22 nt, Human
ucggagcgucacuggcuggagg

SEQ ID NO: 563290 - RNA, 22 nt, Human
cauggccaaagaauuauauuuu

SEQ ID NO: 563291 - RNA, 22 nt, Human
gcagacaucaagcacaggccca

SEQ ID NO: 563292 - RNA, 22 nt, Human
ggcuguggucauuaggagguug

SEQ ID NO: 563293 - RNA, 17 nt, Human
gccuggcccagccuggc

SEQ ID NO: 563294 - RNA, 22 nt, Human
gccaaucaggaggcuguacauc

SEQ ID NO: 563295 - RNA, 22 nt, Human
ucacccagacugucugacucuu

SEQ ID NO: 563296 - RNA, 22 nt, Human
ugccgcugucgccaccauggcu

SEQ ID NO: 563297 - RNA, 22 nt, Human
agcuccagggaaagaguggauc

SEQ ID NO: 563298 - RNA, 22 nt, Human
gaagcgugcagguccguauacu

SEQ ID NO: 563299 - RNA, 22 nt, Human
uugcuauuuugagagucauagu

SEQ ID NO: 563300 - RNA, 22 nt, Human
ggcagcugaagaggaacuuugg

SEQ ID NO: 563301 - RNA, 22 nt, Human
uuaugcaaaggggccucuuccu

SEQ ID NO: 563302 - RNA, 22 nt, Human
auuaauaucccccgccguucug

SEQ ID NO: 563303 - RNA, 22 nt, Human
gagcagcagcugggccagguuc

SEQ ID NO: 563304 - RNA, 22 nt, Human
gagcugcagcggcugacgcaac

SEQ ID NO: 563305 - RNA, 22 nt, Human
acagauccugguuacagccauu

SEQ ID NO: 563306 - RNA, 22 nt, Human
ccaggaugacccccacuuuccu

SEQ ID NO: 563307 - RNA, 17 nt, Human
acuuguauugugcuuua

SEQ ID NO: 563308 - RNA, 18 nt, Human
uucggcagauacgcuugg

SEQ ID NO: 563309 - RNA, 22 nt, Human
gacggggcagccagcugguggc

SEQ ID NO: 563310 - RNA, 22 nt, Human
auguggcuuucugcguuuucuc

SEQ ID NO: 563311 - RNA, 22 nt, Human
gcucccuggaauguuggcugcc

SEQ ID NO: 563312 - RNA, 20 nt, Human
ccagguggugccuggagagg

SEQ ID NO: 563313 - RNA, 22 nt, Human
gggcugacaccacccaggcgca

SEQ ID NO: 563314 - RNA, 22 nt, Human
uagcccuugaugcugcggccag

SEQ ID NO: 563315 - RNA, 22 nt, Human
guggccuuuucaaguaggguau

SEQ ID NO: 563316 - RNA, 20 nt, Human
uccagccacuuccgcugguc

SEQ ID NO: 563317 - RNA, 22 nt, Human
cccagguaaggaugcuccucau

SEQ ID NO: 563318 - RNA, 22 nt, Human
ccgcuguccuggagcugcugcu

SEQ ID NO: 563319 - RNA, 22 nt, Human
gacuguggacucucaugauaga

SEQ ID NO: 563320 - RNA, 22 nt, Human
ccucuugauugguuggaagcgg

SEQ ID NO: 563321 - RNA, 22 nt, Human
cuccacagccccuccaguggca

SEQ ID NO: 563322 - RNA, 22 nt, Human
uaugccuaccuccaaaauauau

SEQ ID NO: 563323 - RNA, 22 nt, Human
caagagcuuuagaaaugcucau

SEQ ID NO: 563324 - RNA, 22 nt, Human
cgggcagugcccagcggggcag

SEQ ID NO: 563325 - RNA, 22 nt, Human
uuuucaguugugcucucuaguu

SEQ ID NO: 563326 - RNA, 22 nt, Human
ugccaggcugcccuccagucug

SEQ ID NO: 563327 - RNA, 22 nt, Human
ugcaggccuggacugauguggu

SEQ ID NO: 563328 - RNA, 22 nt, Human
cggagcagagccacucgggccg

SEQ ID NO: 563329 - RNA, 22 nt, Human
ggcaauuacguauuagucaugu

SEQ ID NO: 563330 - RNA, 22 nt, Human
auggccuuucucaguggugcuu

SEQ ID NO: 563331 - RNA, 22 nt, Human
aacuuucugaaaagcuugauca

SEQ ID NO: 563332 - RNA, 22 nt, Human
cgcagcuucagggccaggaggg

SEQ ID NO: 563333 - RNA, 22 nt, Human
uuacuaguggagaaacugaggc

SEQ ID NO: 563334 - RNA, 22 nt, Human
acuggcuuugagggaauagcua

SEQ ID NO: 563335 - RNA, 22 nt, Human
aagcgcagacacagagagugga

SEQ ID NO: 563336 - RNA, 22 nt, Human
gaacaguuucccuguagaaaau

SEQ ID NO: 563337 - RNA, 20 nt, Human
augcacccucagggucccug

SEQ ID NO: 563338 - RNA, 22 nt, Human
ugcuggaguggcacuguguggc

SEQ ID NO: 563339 - RNA, 22 nt, Human
ucccaaguagaugggaauacag

SEQ ID NO: 563340 - RNA, 22 nt, Human
caggguggcaggcaccauggcc

SEQ ID NO: 563341 - RNA, 22 nt, Human
acuuuucuuaucagaaaggcca

SEQ ID NO: 563342 - RNA, 22 nt, Human
agcugcugcaaguggugcuaac

SEQ ID NO: 563343 - RNA, 22 nt, Human
ucugcgcccugucgccugcucc

SEQ ID NO: 563344 - RNA, 22 nt, Human
caugcuggucagccaguggaug

SEQ ID NO: 563345 - RNA, 22 nt, Human
auuuuguaucuuacggggacua

SEQ ID NO: 563346 - RNA, 22 nt, Human
gagcagcaggccagguugcagg

SEQ ID NO: 563347 - RNA, 20 nt, Human
ugugguuuuugccaguugaa

SEQ ID NO: 563348 - RNA, 22 nt, Human
uugcaggucuggggguccuggu

SEQ ID NO: 563349 - RNA, 22 nt, Human
uccuucccaggugucgccgccu

SEQ ID NO: 563350 - RNA, 22 nt, Human
ucauugacuugaagaaaacaau

SEQ ID NO: 563351 - RNA, 22 nt, Human
uccuggccaaguagauguggcg

SEQ ID NO: 563352 - RNA, 22 nt, Human
uugcuucacuacuucuaggcuc

SEQ ID NO: 563353 - RNA, 22 nt, Human
ggcagccagagggcagcuggau

SEQ ID NO: 563354 - RNA, 22 nt, Human
uccagcaguccaugugagacac

SEQ ID NO: 563355 - RNA, 22 nt, Human
ggcagguguggugaccagagau

SEQ ID NO: 563356 - RNA, 22 nt, Human
aaagcagaacugagagagcugg

SEQ ID NO: 563357 - RNA, 21 nt, Human
gcugcucgagauccagugcuu

SEQ ID NO: 563358 - RNA, 22 nt, Human
ucuguggcaugguaucuggagg

SEQ ID NO: 563359 - RNA, 22 nt, Human
ugcuuguauucauaucacagcu

SEQ ID NO: 563360 - RNA, 22 nt, Human
ggagaugccuuguuucaggaac

SEQ ID NO: 563361 - RNA, 22 nt, Human
agcaccauugcaaauauggcag

SEQ ID NO: 563362 - RNA, 22 nt, Human
gaaaggcucagauucccccagg

SEQ ID NO: 563363 - RNA, 22 nt, Human
gcagcccucuuggucacuaggc

SEQ ID NO: 563364 - RNA, 22 nt, Human
caagaaguugacagccagguga

SEQ ID NO: 563365 - RNA, 22 nt, Human
uuccaauaaaauguuauuugca

SEQ ID NO: 563366 - RNA, 22 nt, Human
ucagguagugguuaaguucugu

SEQ ID NO: 563367 - RNA, 22 nt, Human
gagggaaacagauggguugugg

SEQ ID NO: 563368 - RNA, 22 nt, Human
ggacauggaaguauggagugga

SEQ ID NO: 563369 - RNA, 22 nt, Human
ugccagcaguagcaguaggcca

SEQ ID NO: 563370 - RNA, 22 nt, Human
ugucaccuugcucauccucgga

SEQ ID NO: 563371 - RNA, 22 nt, Human
ugaguggacgugaggcugagua

SEQ ID NO: 563372 - RNA, 22 nt, Human
aagaggaggacgguucccagaa

SEQ ID NO: 563373 - RNA, 20 nt, Human
gggcucugcauccaucagcc

SEQ ID NO: 563374 - RNA, 22 nt, Human
uggggugccgacagggagggca

SEQ ID NO: 563375 - RNA, 22 nt, Human
gccaggucgucuccauguccaa

SEQ ID NO: 563376 - RNA, 22 nt, Human
uccgguccggguacuccucucu

SEQ ID NO: 563377 - RNA, 22 nt, Human
uuuucuuggaguggcuguccuu

SEQ ID NO: 563378 - RNA, 22 nt, Human
ucaccucucuggccgucuaccu

SEQ ID NO: 563379 - RNA, 22 nt, Human
aggggagccagggcugcgaguu

SEQ ID NO: 563380 - RNA, 22 nt, Human
cugcucaauuccggcacgcugg

SEQ ID NO: 563381 - RNA, 22 nt, Human
ugcuccguucuucugcuucuug

SEQ ID NO: 563382 - RNA, 22 nt, Human
cagaaacacuguauuuagggaa

SEQ ID NO: 563383 - RNA, 21 nt, Human
ugcuuugcagguggauuuagu

SEQ ID NO: 563384 - RNA, 22 nt, Human
aacacuaaaggucaguuagaag

SEQ ID NO: 563385 - RNA, 22 nt, Human
gcacuuguuuuauguuccugag

SEQ ID NO: 563386 - RNA, 22 nt, Human
gcuggccugaccugaggcuggg

SEQ ID NO: 563387 - RNA, 22 nt, Human
auuuugacauugcggcauugcu

SEQ ID NO: 563388 - RNA, 22 nt, Human
auugugcaccuacugugugcag

SEQ ID NO: 563389 - RNA, 22 nt, Human
agacacauuuucagcucugcca

SEQ ID NO: 563390 - RNA, 22 nt, Human
gcaguggccacauggaggagga

SEQ ID NO: 563391 - RNA, 22 nt, Human
guuucgucaggcuuauucuauc

SEQ ID NO: 563392 - RNA, 22 nt, Human
agcuccacucccugccuguuuc

SEQ ID NO: 563393 - RNA, 22 nt, Human
uuguagucuaggauagauuuuu

SEQ ID NO: 563394 - RNA, 23 nt, Human
aggcagguuugggcucuucuugu

SEQ ID NO: 563395 - RNA, 22 nt, Human
ucagcccggguucgcaaacacu

SEQ ID NO: 563396 - RNA, 22 nt, Human
ccugugcuucacucaacaagcc

SEQ ID NO: 563397 - RNA, 22 nt, Human
ccauuuguaccauuucuuugua

SEQ ID NO: 563398 - RNA, 22 nt, Human
uagaaaagccccagcuggaggg

SEQ ID NO: 563399 - RNA, 22 nt, Human
gcugccaccguggagaugagug

SEQ ID NO: 563400 - RNA, 22 nt, Human
uauagugucucuagaucaaaga

SEQ ID NO: 563401 - RNA, 22 nt, Human
cugcugucuuuauuucacugcu

SEQ ID NO: 563402 - RNA, 22 nt, Human
gaggagaggcuggacgcgguga

SEQ ID NO: 563403 - RNA, 22 nt, Human
guggcgcagaggguggcagaga

SEQ ID NO: 563404 - RNA, 22 nt, Human
uccagguccuacuggcccauag

SEQ ID NO: 563405 - RNA, 22 nt, Human
gcagccuccgcacugcgagucc

SEQ ID NO: 563406 - RNA, 22 nt, Human
gugcauauguguguauacaaac

SEQ ID NO: 563407 - RNA, 22 nt, Human
uaaguugauuauaaccacugga

SEQ ID NO: 563408 - RNA, 22 nt, Human
cuucauguacaguuauuggaga

SEQ ID NO: 563409 - RNA, 22 nt, Human
uuggaggacuaguuaagagacc

SEQ ID NO: 563410 - RNA, 22 nt, Human
cuacauuauguuuauugggacu

SEQ ID NO: 563411 - RNA, 22 nt, Human
guagcccaccuggggagggcga

SEQ ID NO: 563412 - RNA, 22 nt, Human
cgagagauggguuggcaggggc

SEQ ID NO: 563413 - RNA, 22 nt, Human
cugguuuuuagugcuuaggagu

SEQ ID NO: 563414 - RNA, 22 nt, Human
acaaaugcuuaguucaccaaaa

SEQ ID NO: 563415 - RNA, 22 nt, Human
uuguaacaguagcugucagcuc

SEQ ID NO: 563416 - RNA, 22 nt, Human
uucuuucugggguccuucggcu

SEQ ID NO: 563417 - RNA, 22 nt, Human
gugggcaucuccuuggaagcca

SEQ ID NO: 563418 - RNA, 22 nt, Human
ccucuuccuucucacuguggaa

SEQ ID NO: 563419 - RNA, 22 nt, Human
ugucugccugcgggccggcaca

SEQ ID NO: 563420 - RNA, 22 nt, Human
augguuuuguccucuuugguuc

SEQ ID NO: 563421 - RNA, 22 nt, Human
aggcugcagaggugcugccaga

SEQ ID NO: 563422 - RNA, 22 nt, Human
agaaacaucgcuuaguccucau

SEQ ID NO: 563423 - RNA, 22 nt, Human
ccugugggagggagcggcugga

SEQ ID NO: 563424 - RNA, 22 nt, Human
uucuccacccacucuuuuguug

SEQ ID NO: 563425 - RNA, 22 nt, Human
ugggugaagaggcuaugcuacu

SEQ ID NO: 563426 - RNA, 22 nt, Human
cucacucaguuuuuaguucauc

SEQ ID NO: 563427 - RNA, 22 nt, Human
gcugaagagagaugcguccagc

SEQ ID NO: 563428 - RNA, 22 nt, Human
uggcagcauuuuuuccagaaca

SEQ ID NO: 563429 - RNA, 22 nt, Human
gccuucugauugcuggacugac

SEQ ID NO: 563430 - RNA, 22 nt, Human
acuggauucucuuacacagaug

SEQ ID NO: 563431 - RNA, 22 nt, Human
ugagcugcuucuuauaaugugu

SEQ ID NO: 563432 - RNA, 22 nt, Human
ucccugagugggcugguaguau

SEQ ID NO: 563433 - RNA, 22 nt, Human
uggaauguuaaaccucaaugau

SEQ ID NO: 563434 - RNA, 22 nt, Human
cacagauaaggcuuugucccca

SEQ ID NO: 563435 - RNA, 22 nt, Human
accuccuccaaggagccauagg

SEQ ID NO: 563436 - RNA, 22 nt, Human
uaucuguagucucaugguuccu

SEQ ID NO: 563437 - RNA, 22 nt, Human
gccauguucuugaaucuggguc

SEQ ID NO: 563438 - RNA, 23 nt, Human
uggugggcccugcuugcucacug

SEQ ID NO: 563439 - RNA, 22 nt, Human
uccuuacacuggggaaggugua

SEQ ID NO: 563440 - RNA, 20 nt, Human
ggccggggagcucuccaggg

SEQ ID NO: 563441 - RNA, 23 nt, Human
ggacaugucucuggguauuuuga

SEQ ID NO: 563442 - RNA, 22 nt, Human
aguguuugaguuugcggcauug

SEQ ID NO: 563443 - RNA, 22 nt, Human
ugucuacaagccuuguucggca

SEQ ID NO: 563444 - RNA, 22 nt, Human
agcaggggcaggguuuugugcu

SEQ ID NO: 563445 - RNA, 22 nt, Human
acaagcgggccacagugcuggu

SEQ ID NO: 563446 - RNA, 22 nt, Human
uggaagguguggcaggucuagu

SEQ ID NO: 563447 - RNA, 22 nt, Human
uggcccagcucagggugggcgg

SEQ ID NO: 563448 - RNA, 22 nt, Human
ggacagacuuuacagccccggg

SEQ ID NO: 563449 - RNA, 22 nt, Human
ugagaugaagugauguaaaaca

SEQ ID NO: 563450 - RNA, 22 nt, Human
gcagcagcaggcgcucggccgu

SEQ ID NO: 563451 - RNA, 22 nt, Human
cggcuucucgggucggauuccg

SEQ ID NO: 563452 - RNA, 22 nt, Human
gcuguggcuccaauggugagcc

SEQ ID NO: 563453 - RNA, 22 nt, Human
ggcgcggugacucagccucgcu

SEQ ID NO: 563454 - RNA, 22 nt, Human
gcugcagugagccaagaucgug

SEQ ID NO: 563455 - RNA, 22 nt, Human
ucuguggcauguugcacuugua

SEQ ID NO: 563456 - RNA, 22 nt, Human
gaggcugaacagguucucauga

SEQ ID NO: 563457 - RNA, 22 nt, Human
ccaggcccugcuccucacacca

SEQ ID NO: 563458 - RNA, 22 nt, Human
guugcagcaucacugcugagug

SEQ ID NO: 563459 - RNA, 20 nt, Human
ccuggagccuggaaggaguc

SEQ ID NO: 563460 - RNA, 22 nt, Human
auuucagaguagaucguuauuu

SEQ ID NO: 563461 - RNA, 22 nt, Human
gcucguacaccagcguggaggu

SEQ ID NO: 563462 - RNA, 22 nt, Human
agguggcagacuaacagaagga

SEQ ID NO: 563463 - RNA, 22 nt, Human
uggugcugccaccuccucugcu

SEQ ID NO: 563464 - RNA, 22 nt, Human
agguggaguuaagugugaacug

SEQ ID NO: 563465 - RNA, 22 nt, Human
aauucagguuauauuugcaacu

SEQ ID NO: 563466 - RNA, 22 nt, Human
acauuuaaugauccuacuguga

SEQ ID NO: 563467 - RNA, 22 nt, Human
gcggccugcgcugcucccgacg

SEQ ID NO: 563468 - RNA, 22 nt, Human
uuguauuaaaauguguuucugu

SEQ ID NO: 563469 - RNA, 22 nt, Human
ggcagugaugucaaacagugaa

SEQ ID NO: 563470 - RNA, 22 nt, Human
gagcugcuggccuccugcggga

SEQ ID NO: 563471 - RNA, 22 nt, Human
ggccauggcgggagccggcguc

SEQ ID NO: 563472 - RNA, 22 nt, Human
cccacugcugcucuccauggca

SEQ ID NO: 563473 - RNA, 22 nt, Human
acauucaugcaccuuccuaucc

SEQ ID NO: 563474 - RNA, 22 nt, Human
cuggccgcaguguggaguugug

SEQ ID NO: 563475 - RNA, 22 nt, Human
gcugucucauacaaggcccugc

SEQ ID NO: 563476 - RNA, 22 nt, Human
ucacacuuuauuuauuucaugc

SEQ ID NO: 563477 - RNA, 22 nt, Human
cuugcuacuaugccuggcuaau

SEQ ID NO: 563478 - RNA, 22 nt, Human
gggaggaaggcuugggugagua

SEQ ID NO: 563479 - RNA, 22 nt, Human
gggcauuucuugucaauguagg

SEQ ID NO: 563480 - RNA, 22 nt, Human
ucgggguagacgccagcucgga

SEQ ID NO: 563481 - RNA, 22 nt, Human
gauacuugaggagaucaccaca

SEQ ID NO: 563482 - RNA, 19 nt, Human
cacuguccuagucgaggcc

SEQ ID NO: 563483 - RNA, 22 nt, Human
ugacagugugcccggagguuag

SEQ ID NO: 563484 - RNA, 22 nt, Human
agaaguaucaggaagauucuca

SEQ ID NO: 563485 - RNA, 22 nt, Human
uucacagaauugucuugacugg

SEQ ID NO: 563486 - RNA, 22 nt, Human
agcagccuugugacuccggggu

SEQ ID NO: 563487 - RNA, 22 nt, Human
uuuauacuccacucugcaagcg

SEQ ID NO: 563488 - RNA, 22 nt, Human
caccgagugacaguagccauca

SEQ ID NO: 563489 - RNA, 22 nt, Human
acagacuccccagguuaucuca

SEQ ID NO: 563490 - RNA, 22 nt, Human
uuaaccagguccuuugaaaaca

SEQ ID NO: 563491 - RNA, 22 nt, Human
agaaaagaggcuuucuaagcau

SEQ ID NO: 563492 - RNA, 22 nt, Human
ugcacauggccugagugccuga

SEQ ID NO: 563493 - RNA, 22 nt, Human
gcugacugguucaggucccgcu

SEQ ID NO: 563494 - RNA, 22 nt, Human
guaguucuuucucaauguucaa

SEQ ID NO: 563495 - RNA, 22 nt, Human
gcccagcccagaaagguucgga

SEQ ID NO: 563496 - RNA, 22 nt, Human
agcaggaggagagccuggcggu

SEQ ID NO: 563497 - RNA, 22 nt, Human
gcugcagggagcuggaaggcuc

SEQ ID NO: 563498 - RNA, 21 nt, Human
agaugcagugacccacugggg

SEQ ID NO: 563499 - RNA, 22 nt, Human
uggugcaggccaagcugcgagc

SEQ ID NO: 563500 - RNA, 22 nt, Human
ggccgugcuccaaagucaucgu

SEQ ID NO: 563501 - RNA, 22 nt, Human
acccggaggcgggggaugcagu

SEQ ID NO: 563502 - RNA, 22 nt, Human
uugugcccucaaagggugcguc

SEQ ID NO: 563503 - RNA, 22 nt, Human
ucauggaugauagcuucauugc

SEQ ID NO: 563504 - RNA, 22 nt, Human
ggauguuuauccuaucuuaguu

SEQ ID NO: 563505 - RNA, 22 nt, Human
ugagucaccucucagaagccac

SEQ ID NO: 563506 - RNA, 22 nt, Human
ucugggccggagccgacggcag

SEQ ID NO: 563507 - RNA, 22 nt, Human
gcaggggcugagcaccagcggg

SEQ ID NO: 563508 - RNA, 19 nt, Human
cugggacaaugaaagcauc

SEQ ID NO: 563509 - RNA, 22 nt, Human
uagcuucccugcuggaucauaa

SEQ ID NO: 563510 - RNA, 22 nt, Human
agcauggccucccgggccuggc

SEQ ID NO: 563511 - RNA, 22 nt, Human
ggcgaggugucugccaucaagc

SEQ ID NO: 563512 - RNA, 22 nt, Human
cccguguggaugcgcuggugcu

SEQ ID NO: 563513 - RNA, 22 nt, Human
caaccugaugugcaugccacgg

SEQ ID NO: 563514 - RNA, 21 nt, Human
gcuccuggugcugcguggcgc

SEQ ID NO: 563515 - RNA, 22 nt, Human
ccucuuccacugggccccaucc

SEQ ID NO: 563516 - RNA, 22 nt, Human
gcccagcaccucucucaggguu

SEQ ID NO: 563517 - RNA, 22 nt, Human
auacacauguuauuguggaagc

SEQ ID NO: 563518 - RNA, 22 nt, Human
agguggcuaugaggaugcaguc

SEQ ID NO: 563519 - RNA, 23 nt, Human
agugaugucacccacagacaagg

SEQ ID NO: 563520 - RNA, 22 nt, Human
ucucagucuuugcaaggaugcu

SEQ ID NO: 563521 - RNA, 22 nt, Human
caucucccacuuccuugggggu

SEQ ID NO: 563522 - RNA, 22 nt, Human
ccugugguuuacucuguggcua

SEQ ID NO: 563523 - RNA, 22 nt, Human
gcccagcgagcagagguggacg

SEQ ID NO: 563524 - RNA, 22 nt, Human
gacagucccccagcagcaaacc

SEQ ID NO: 563525 - RNA, 22 nt, Human
ucucugguuauuaacuaacucc

SEQ ID NO: 563526 - RNA, 22 nt, Human
cagaaccaggaacugauggaga

SEQ ID NO: 563527 - RNA, 21 nt, Human
acugaacuuguguucuagagg

SEQ ID NO: 563528 - RNA, 22 nt, Human
caugucaagacugaagauccag

SEQ ID NO: 563529 - RNA, 22 nt, Human
gugcacagaaacauacaaugug

SEQ ID NO: 563530 - RNA, 22 nt, Human
cugcggcuggggacagcuguug

SEQ ID NO: 563531 - RNA, 22 nt, Human
accuggaccugccaccuaugag

SEQ ID NO: 563532 - RNA, 22 nt, Human
agugauguagguggauucuggc

SEQ ID NO: 563533 - RNA, 19 nt, Human
aacuacagcgcacuguccu

SEQ ID NO: 563534 - RNA, 22 nt, Human
gagacagagagguacucaacau

SEQ ID NO: 563535 - RNA, 22 nt, Human
ggggcccagcaccccuccucgc

SEQ ID NO: 563536 - RNA, 22 nt, Human
uggcaggaaaaagggccagagg

SEQ ID NO: 563537 - RNA, 22 nt, Human
uguggccaccagagcugcuauu

SEQ ID NO: 563538 - RNA, 22 nt, Human
auagacgcggccgcugaugcag

SEQ ID NO: 563539 - RNA, 22 nt, Human
auggcuucugucuuggaaauuu

SEQ ID NO: 563540 - RNA, 22 nt, Human
cuguuuauucucaucuaaaaug

SEQ ID NO: 563541 - RNA, 22 nt, Human
acggagcccgugucagguggga

SEQ ID NO: 563542 - RNA, 22 nt, Human
ggcuuccuccuuccugcuguca

SEQ ID NO: 563543 - RNA, 22 nt, Human
uuuccagggaggaauguggggu

SEQ ID NO: 563544 - RNA, 22 nt, Human
uacugcauuaucaaggggaagg

SEQ ID NO: 563545 - RNA, 22 nt, Human
ggaguagcugcauuccgagcac

SEQ ID NO: 563546 - RNA, 22 nt, Human
cccaccacgugcuuugcuggag

SEQ ID NO: 563547 - RNA, 22 nt, Human
agcacauucccaccuguacuuc

SEQ ID NO: 563548 - RNA, 22 nt, Human
gcagcagcggggccccugcgcg

SEQ ID NO: 563549 - RNA, 22 nt, Human
uuccuggugguggugacagcac

SEQ ID NO: 563550 - RNA, 18 nt, Human
cugccagugugcucuccg

SEQ ID NO: 563551 - RNA, 16 nt, Human
ucucccuugucaccug

SEQ ID NO: 563552 - RNA, 22 nt, Human
cuuccucuguggccagagugua

SEQ ID NO: 563553 - RNA, 23 nt, Human
uggcucuguggaucccucaggag

SEQ ID NO: 563554 - RNA, 18 nt, Human
gugacugccccaaaaggc

SEQ ID NO: 563555 - RNA, 22 nt, Human
uguauauacacacucccauguu

SEQ ID NO: 563556 - RNA, 20 nt, Human
uugagcagcagugcuguguc

SEQ ID NO: 563557 - RNA, 21 nt, Human
uccuccuguagaggguccugg

SEQ ID NO: 563558 - RNA, 22 nt, Human
gggcuggagagucccacguggg

SEQ ID NO: 563559 - RNA, 22 nt, Human
gcucaugggcccagagcagccc

SEQ ID NO: 563560 - RNA, 22 nt, Human
cauguguauuauucuuguggaa

SEQ ID NO: 563561 - RNA, 23 nt, Human
agacagaggcugaggcuggccgc

SEQ ID NO: 563562 - RNA, 22 nt, Human
cuugggcaggggaaacagcugc

SEQ ID NO: 563563 - RNA, 22 nt, Human
uccguggggccuguggcuuccg

SEQ ID NO: 563564 - RNA, 22 nt, Human
ugcaaggcacccacucugcuuu

SEQ ID NO: 563565 - RNA, 18 nt, Human
ucaguccuccauagagcu

SEQ ID NO: 563566 - RNA, 22 nt, Human
cccugaaaguacacugggacgg

SEQ ID NO: 563567 - RNA, 23 nt, Human
aaacuacauuuauaguuuuucuc

SEQ ID NO: 563568 - RNA, 22 nt, Human
ugcugggauuacagucaugagc

SEQ ID NO: 563569 - RNA, 23 nt, Human
cucaccaagcgccgccgcugugu

SEQ ID NO: 563570 - RNA, 22 nt, Human
cugaaagcaaaguaauucuuaa

SEQ ID NO: 563571 - RNA, 21 nt, Human
gugugucuaauguaguggaaa

SEQ ID NO: 563572 - RNA, 22 nt, Human
aggcaguguggagggcuguugc

SEQ ID NO: 563573 - RNA, 22 nt, Human
uuccugguaacaaucucaaagu

SEQ ID NO: 563574 - RNA, 22 nt, Human
cugacagcgagagaguugcccc

SEQ ID NO: 563575 - RNA, 22 nt, Human
cucagucucuugggcugugaag

SEQ ID NO: 563576 - RNA, 22 nt, Human
cacagcuaccugcaugccugcu

SEQ ID NO: 563577 - RNA, 22 nt, Human
ccagguaggagagucaacaugu

SEQ ID NO: 563578 - RNA, 22 nt, Human
cagagccacugucugccaggca

SEQ ID NO: 563579 - RNA, 22 nt, Human
agaugcugccaggccccucagu

SEQ ID NO: 563580 - RNA, 21 nt, Human
ccuguggugccagaucgccag

SEQ ID NO: 563581 - RNA, 22 nt, Human
auacaccaccuuggaucuuuca

SEQ ID NO: 563582 - RNA, 22 nt, Human
agccagcuaccggggcuccugg

SEQ ID NO: 563583 - RNA, 22 nt, Human
cugcauaucaaauuacuccugg

SEQ ID NO: 563584 - RNA, 22 nt, Human
caucaguuccugccccugcccc

SEQ ID NO: 563585 - RNA, 22 nt, Human
cagggagcuggugccagccgac

SEQ ID NO: 563586 - RNA, 22 nt, Human
gauugcugccagcguguccgug

SEQ ID NO: 563587 - RNA, 22 nt, Human
cuguguccaauggccuuagcag

SEQ ID NO: 563588 - RNA, 19 nt, Human
ccuggcccugcugcgcggg

SEQ ID NO: 563589 - RNA, 22 nt, Human
ugguggggccagacuucagcuc

SEQ ID NO: 563590 - RNA, 23 nt, Human
aaauugucguaagguggagaugu

SEQ ID NO: 563591 - RNA, 22 nt, Human
accgugucugacacuuugggcg

SEQ ID NO: 563592 - RNA, 22 nt, Human
cgcccacgaaguagguggcauu

SEQ ID NO: 563593 - RNA, 22 nt, Human
gggagacaaaggugagguucuu

SEQ ID NO: 563594 - RNA, 22 nt, Human
cucuccaggcgagguccuacug

SEQ ID NO: 563595 - RNA, 22 nt, Human
agauguuuauaacucaugagug

SEQ ID NO: 563596 - RNA, 22 nt, Human
cugagccagcgggcucacuuuu

SEQ ID NO: 563597 - RNA, 22 nt, Human
gacacugcacuuggggcccaca

SEQ ID NO: 563598 - RNA, 22 nt, Human
uacagcgaaaauuuagcuugau

SEQ ID NO: 563599 - RNA, 22 nt, Human
uccgcgcucucacccgcucccg

SEQ ID NO: 563600 - RNA, 22 nt, Human
ggcagcagaacuggcccuguau

SEQ ID NO: 563601 - RNA, 22 nt, Human
cugccguugugaagcucuuaga

SEQ ID NO: 563602 - RNA, 22 nt, Human
acccugccucugcuuccuguag

SEQ ID NO: 563603 - RNA, 22 nt, Human
uucaaacaguguagaauauaug

SEQ ID NO: 563604 - RNA, 22 nt, Human
gcaccagccugagccucuugca

SEQ ID NO: 563605 - RNA, 22 nt, Human
uuuacaaggcaguuauuuuccu

SEQ ID NO: 563606 - RNA, 23 nt, Human
uggccucuccccaccuggcagaa

SEQ ID NO: 563607 - RNA, 22 nt, Human
ugcaugcagcuggucgggcgcc

SEQ ID NO: 563608 - RNA, 22 nt, Human
ucauccugaagaaccugcuucc

SEQ ID NO: 563609 - RNA, 22 nt, Human
gagcagcuguucugacuugucu

SEQ ID NO: 563610 - RNA, 22 nt, Human
gaucuguccuggcaguuaacac

SEQ ID NO: 563611 - RNA, 22 nt, Human
uagggcuguuaguaauucucag

SEQ ID NO: 563612 - RNA, 22 nt, Human
cugcuuuaaaacugauacauga

SEQ ID NO: 563613 - RNA, 22 nt, Human
ggcugcccucggggucgcaggc

SEQ ID NO: 563614 - RNA, 22 nt, Human
cacagcuucuccccgcugcggc

SEQ ID NO: 563615 - RNA, 22 nt, Human
ccugugucaucagcuguggcua

SEQ ID NO: 563616 - RNA, 22 nt, Human
cuccaaaggauaaaagcagagu

SEQ ID NO: 563617 - RNA, 22 nt, Human
cugucaccucugcccuuugccc

SEQ ID NO: 563618 - RNA, 22 nt, Human
gcagcucacagucuccgccauc

SEQ ID NO: 563619 - RNA, 22 nt, Human
ugcagcuucucugcaacaggag

SEQ ID NO: 563620 - RNA, 22 nt, Human
cucaguggggcgacagggugcu

SEQ ID NO: 563621 - RNA, 22 nt, Human
agugacagauuaccggcagagc

SEQ ID NO: 563622 - RNA, 22 nt, Human
gcuugcugaacaggaaccuggc

SEQ ID NO: 563623 - RNA, 22 nt, Human
uugcugccagcgcccugcaggg

SEQ ID NO: 563624 - RNA, 22 nt, Human
caaagccaggcuuucuaaugua

SEQ ID NO: 563625 - RNA, 22 nt, Human
uucagaagguaggaaugucccu

SEQ ID NO: 563626 - RNA, 22 nt, Human
cccaggucgucagcaguguggu

SEQ ID NO: 563627 - RNA, 22 nt, Human
ucauacauguuguguucaaaug

SEQ ID NO: 563628 - RNA, 22 nt, Human
uucuuugcccauguuuccuaag

SEQ ID NO: 563629 - RNA, 22 nt, Human
cgccaguggcagcuggaacagg

SEQ ID NO: 563630 - RNA, 22 nt, Human
gguggcaagggcagccaguaac

SEQ ID NO: 563631 - RNA, 22 nt, Human
cagaguggugcaagggcagugu

SEQ ID NO: 563632 - RNA, 21 nt, Human
agcgucaauaucgucaacagg

SEQ ID NO: 563633 - RNA, 22 nt, Human
gucacccguuugacuauccacc

SEQ ID NO: 563634 - RNA, 22 nt, Human
uggcagugugggaggaagguac

SEQ ID NO: 563635 - RNA, 22 nt, Human
cuggcccagguggucguugagg

SEQ ID NO: 563636 - RNA, 22 nt, Human
agcggcgccgagcuuggccagg

SEQ ID NO: 563637 - RNA, 22 nt, Human
cagaaagugauuugcuauucca

SEQ ID NO: 563638 - RNA, 22 nt, Human
ucuugggcaauuucucuagagg

SEQ ID NO: 563639 - RNA, 19 nt, Human
agcagccaucgaccaugga

SEQ ID NO: 563640 - RNA, 22 nt, Human
ccaucuucucuugaaccuccuu

SEQ ID NO: 563641 - RNA, 22 nt, Human
ugggggagccuucacaguagcu

SEQ ID NO: 563642 - RNA, 21 nt, Human
uagaccagcugugcuccucgg

SEQ ID NO: 563643 - RNA, 22 nt, Human
caccugagcaacccugugcggg

SEQ ID NO: 563644 - RNA, 22 nt, Human
gggacaaccaacuuagcauuac

SEQ ID NO: 563645 - RNA, 22 nt, Human
aggccagugguucucugugucc

SEQ ID NO: 563646 - RNA, 22 nt, Human
cccaugacucucauucacaguc

SEQ ID NO: 563647 - RNA, 22 nt, Human
uacaccagauuauuuauaacau

SEQ ID NO: 563648 - RNA, 22 nt, Human
cacggccacugcagcaccccag

SEQ ID NO: 563649 - RNA, 22 nt, Human
uuucucuuucaaucugcaguac

SEQ ID NO: 563650 - RNA, 22 nt, Human
ugaccguuuuggcacccaugcu

SEQ ID NO: 563651 - RNA, 22 nt, Human
cuggaucaugggaaagggauca

SEQ ID NO: 563652 - RNA, 22 nt, Human
cucugcaaggcccuccaguagc

SEQ ID NO: 563653 - RNA, 22 nt, Human
gggcagcaucaggaggggcuuu

SEQ ID NO: 563654 - RNA, 21 nt, Human
cccgugccuucagcaguccug

SEQ ID NO: 563655 - RNA, 22 nt, Human
gagcagcaucuccggcuuaaag

SEQ ID NO: 563656 - RNA, 22 nt, Human
cugucaaauggaaacuuauccu

SEQ ID NO: 563657 - RNA, 22 nt, Human
ugacauuugagagagauauaca

SEQ ID NO: 563658 - RNA, 22 nt, Human
ggagguggagcuggaaguucca

SEQ ID NO: 563659 - RNA, 22 nt, Human
cagggacucgcuggacauaccg

SEQ ID NO: 563660 - RNA, 22 nt, Human
ggagggaaccuuggcuggauug

SEQ ID NO: 563661 - RNA, 22 nt, Human
gagcuguucugugauugaucua

SEQ ID NO: 563662 - RNA, 22 nt, Human
gguguugcaguugaagacuggu

SEQ ID NO: 563663 - RNA, 22 nt, Human
gaagaccccagagcgagguaag

SEQ ID NO: 563664 - RNA, 22 nt, Human
ugggaaggggagcuggaaagga

SEQ ID NO: 563665 - RNA, 22 nt, Human
acagcuggaggucugugagcac

SEQ ID NO: 563666 - RNA, 21 nt, Human
ugcauauauaagugcauacac

SEQ ID NO: 563667 - RNA, 22 nt, Human
uccuuucugucuuuacucugga

SEQ ID NO: 563668 - RNA, 22 nt, Human
aagcagggugucuugacccaug

SEQ ID NO: 563669 - RNA, 22 nt, Human
aaagaggcucaaggugggccag

SEQ ID NO: 563670 - RNA, 22 nt, Human
gcuagaaacuguuuaaucucuu

SEQ ID NO: 563671 - RNA, 22 nt, Human
gccuggaucccagggagucagg

SEQ ID NO: 563672 - RNA, 22 nt, Human
gggucugcuccaccugcagccc

SEQ ID NO: 563673 - RNA, 22 nt, Human
guuaacaacacugugagugcug

SEQ ID NO: 563674 - RNA, 22 nt, Human
gagugugucggucagcguggcg

SEQ ID NO: 563675 - RNA, 22 nt, Human
uuauuccauagaagucaaggaa

SEQ ID NO: 563676 - RNA, 22 nt, Human
uuccagaacaauguggacguau

SEQ ID NO: 563677 - RNA, 22 nt, Human
cagucccaguuugagacucugg

SEQ ID NO: 563678 - RNA, 22 nt, Human
agcccuugguauuuuccgaucc

SEQ ID NO: 563679 - RNA, 22 nt, Human
gcagcagaaggccaaggggagc

SEQ ID NO: 563680 - RNA, 22 nt, Human
aggcuuuugcucuggcuccucu

SEQ ID NO: 563681 - RNA, 22 nt, Human
acaugcacagcaagggugagag

SEQ ID NO: 563682 - RNA, 19 nt, Human
cacuaagaagcaggggagc

SEQ ID NO: 563683 - RNA, 22 nt, Human
gcugccaauccagcugugggag

SEQ ID NO: 563684 - RNA, 22 nt, Human
ccugcgggcugugcugaagccu

SEQ ID NO: 563685 - RNA, 22 nt, Human
aguaccaucucugccucugccu

SEQ ID NO: 563686 - RNA, 23 nt, Human
uguguucagucaaggaucagagu

SEQ ID NO: 563687 - RNA, 22 nt, Human
ugcauaaacuucucugguguga

SEQ ID NO: 563688 - RNA, 22 nt, Human
cggcagagcccugagucagccu

SEQ ID NO: 563689 - RNA, 22 nt, Human
gccacaggaaagcacccuggag

SEQ ID NO: 563690 - RNA, 22 nt, Human
ugcugcgggacccacugugggc

SEQ ID NO: 563691 - RNA, 18 nt, Human
gagaggagccagaauuuu

SEQ ID NO: 563692 - RNA, 22 nt, Human
cuggagggcugcagcgaggcug

SEQ ID NO: 563693 - RNA, 18 nt, Human
agcugaggggacugaaga

SEQ ID NO: 563694 - RNA, 17 nt, Human
aaaugguccuagggauu

SEQ ID NO: 563695 - RNA, 22 nt, Human
cuccuucacgcaggcugccaug

SEQ ID NO: 563696 - RNA, 21 nt, Human
acagaagcggcgaguggcccc

SEQ ID NO: 563697 - RNA, 22 nt, Human
guccguaguggcugaugcuuug

SEQ ID NO: 563698 - RNA, 22 nt, Human
ugccagagaggagaaagcauuu

SEQ ID NO: 563699 - RNA, 22 nt, Human
cugccaggauucugugaacccc

SEQ ID NO: 563700 - RNA, 21 nt, Human
agaugcaguuugcaggugggu

SEQ ID NO: 563701 - RNA, 22 nt, Human
gugcagcugugguggagccagg

SEQ ID NO: 563702 - RNA, 17 nt, Human
ugcaugcgucugugaua

SEQ ID NO: 563703 - RNA, 22 nt, Human
uggcacugaagcuggaaagccu

SEQ ID NO: 563704 - RNA, 19 nt, Human
auacacguguauacauaca

SEQ ID NO: 563705 - RNA, 22 nt, Human
ggugauuuccuuuugcaaaguc

SEQ ID NO: 563706 - RNA, 22 nt, Human
gcggcccgagcaggacgggugg

SEQ ID NO: 563707 - RNA, 22 nt, Human
auaggcauaacacugauguccu

SEQ ID NO: 563708 - RNA, 22 nt, Human
guggccuccuccguccgccucu

SEQ ID NO: 563709 - RNA, 22 nt, Human
cccugccuacaggguuuucuuu

SEQ ID NO: 563710 - RNA, 22 nt, Human
gaugcgggcccgcuccacugcc

SEQ ID NO: 563711 - RNA, 22 nt, Human
ugugucuaaugacuauuucuuc

SEQ ID NO: 563712 - RNA, 22 nt, Human
ugccauagcaaugguaagcuga

SEQ ID NO: 563713 - RNA, 22 nt, Human
uagaaagagcuuugcuuccuuu

SEQ ID NO: 563714 - RNA, 22 nt, Human
agaggagguccuuuucugaugu

SEQ ID NO: 563715 - RNA, 22 nt, Human
agaguuuacagaaauaagcugu

SEQ ID NO: 563716 - RNA, 22 nt, Human
cagcugccuaugaccuagccuc

SEQ ID NO: 563717 - RNA, 22 nt, Human
cugcaguucuucuccucaaggc

SEQ ID NO: 563718 - RNA, 22 nt, Human
acgugcaggaucugguuggcga

SEQ ID NO: 563719 - RNA, 21 nt, Human
cagaggggcuagccuggcugc

SEQ ID NO: 563720 - RNA, 22 nt, Human
gucccuggucuaccguggcuuc

SEQ ID NO: 563721 - RNA, 22 nt, Human
cguggcucugggcuccuuugcc

SEQ ID NO: 563722 - RNA, 22 nt, Human
gccugcuggcuggaaauucucc

SEQ ID NO: 563723 - RNA, 22 nt, Human
gcaggguaggugacagguaguc

SEQ ID NO: 563724 - RNA, 18 nt, Human
ggugagggagcuggaagc

SEQ ID NO: 563725 - RNA, 22 nt, Human
agcagggagaccaucucuuccu

SEQ ID NO: 563726 - RNA, 22 nt, Human
uuccuuggaaagagacgucgcu

SEQ ID NO: 563727 - RNA, 22 nt, Human
uccagcugugcuccaggaggug

SEQ ID NO: 563728 - RNA, 22 nt, Human
cuucucaaaguugugaaucagg

SEQ ID NO: 563729 - RNA, 20 nt, Human
aucggcuugccuggaaacaa

SEQ ID NO: 563730 - RNA, 22 nt, Human
ugggguccucucacuuggaggg

SEQ ID NO: 563731 - RNA, 22 nt, Human
ccaggcccugccugugguuccu

SEQ ID NO: 563732 - RNA, 22 nt, Human
gcugcccauugcucucccacuc

SEQ ID NO: 563733 - RNA, 22 nt, Human
acaguguuacuugauaguguau

SEQ ID NO: 563734 - RNA, 22 nt, Human
cuccagagagaaaggaggccgc

SEQ ID NO: 563735 - RNA, 22 nt, Human
ggccuuccauugcucuuuucua

SEQ ID NO: 563736 - RNA, 22 nt, Human
ucagccuggcaggauggccugg

SEQ ID NO: 563737 - RNA, 22 nt, Human
ugguggcacugacaucagacac

SEQ ID NO: 563738 - RNA, 21 nt, Human
agggccucuguguacuggggg

SEQ ID NO: 563739 - RNA, 16 nt, Human
gcagguggggcgcgca

SEQ ID NO: 563740 - RNA, 22 nt, Human
aggccagggcacugcucuuuag

SEQ ID NO: 563741 - RNA, 22 nt, Human
agcuuucuauauaugaguugcu

SEQ ID NO: 563742 - RNA, 22 nt, Human
ggcuggaacuucuucuggcauu

SEQ ID NO: 563743 - RNA, 22 nt, Human
gcugccgacccacagggguuaa

SEQ ID NO: 563744 - RNA, 20 nt, Human
ucauaugugguuguauacaa

SEQ ID NO: 563745 - RNA, 22 nt, Human
gcacccagggcaggaagugagg

SEQ ID NO: 563746 - RNA, 22 nt, Human
cagugccaaggauggccuggga

SEQ ID NO: 563747 - RNA, 21 nt, Human
auacaagaagauggcagucug

SEQ ID NO: 563748 - RNA, 22 nt, Human
cagcugcuguucaguuuuguuu

SEQ ID NO: 563749 - RNA, 22 nt, Human
ggaguugacggccgacacccag

SEQ ID NO: 563750 - RNA, 22 nt, Human
aaagcuauuuuauugcagcucu

SEQ ID NO: 563751 - RNA, 22 nt, Human
ucacccuucccagcuguccgcc

SEQ ID NO: 563752 - RNA, 22 nt, Human
uacauguuauuucacuauuggu

SEQ ID NO: 563753 - RNA, 22 nt, Human
ggcagguguuuuuauauuaaag

SEQ ID NO: 563754 - RNA, 22 nt, Human
uuuuuugucuugaagaaauggu

SEQ ID NO: 563755 - RNA, 22 nt, Human
uuugacuccuguguuucuggaa

SEQ ID NO: 563756 - RNA, 22 nt, Human
gagagaagggggauaugagccu

SEQ ID NO: 563757 - RNA, 22 nt, Human
cuagcagcauucuucuaguuag

SEQ ID NO: 563758 - RNA, 22 nt, Human
agaagcagaaggaagcagggcc

SEQ ID NO: 563759 - RNA, 22 nt, Human
ucucugguuaugucauuaagca

SEQ ID NO: 563760 - RNA, 22 nt, Human
agagcgagucuggggcucggau

SEQ ID NO: 563761 - RNA, 22 nt, Human
cagggcuccccagagagccucu

SEQ ID NO: 563762 - RNA, 22 nt, Human
acaaaggugagcagaagacaca

SEQ ID NO: 563763 - RNA, 22 nt, Human
guguggcuaggauggcuuugcu

SEQ ID NO: 563764 - RNA, 22 nt, Human
uacauuccaaaggaaacuggcu

SEQ ID NO: 563765 - RNA, 20 nt, Human
ugcuggaggcgccggcgcuc

SEQ ID NO: 563766 - RNA, 22 nt, Human
aguaucagaugugauuaaaggg

SEQ ID NO: 563767 - RNA, 22 nt, Human
uguagggaggaaggguuggaaa

SEQ ID NO: 563768 - RNA, 22 nt, Human
uguuucaggcuucugggauuuu

SEQ ID NO: 563769 - RNA, 22 nt, Human
auggcucugcugggcaaagcaa

SEQ ID NO: 563770 - RNA, 22 nt, Human
uccggcggccggccugagcccg

SEQ ID NO: 563771 - RNA, 21 nt, Human
aggcagcgauuuucauauugc

SEQ ID NO: 563772 - RNA, 22 nt, Human
gaggugggaugugugugcuacu

SEQ ID NO: 563773 - RNA, 22 nt, Human
gaaggacccucuggggucucag

SEQ ID NO: 563774 - RNA, 22 nt, Human
agcgcuugccgcacuccaagca

SEQ ID NO: 563775 - RNA, 22 nt, Human
uguguuuuggaaggaacaugca

SEQ ID NO: 563776 - RNA, 22 nt, Human
accaggaguuuugaccaggggc

SEQ ID NO: 563777 - RNA, 22 nt, Human
ggcugcugcccaccccugcaug

SEQ ID NO: 563778 - RNA, 20 nt, Human
ggccugagcauggcuggcag

SEQ ID NO: 563779 - RNA, 22 nt, Human
ccacuguuuccuuucugcuggc

SEQ ID NO: 563780 - RNA, 22 nt, Human
aggcagccuauggggagcucag

SEQ ID NO: 563781 - RNA, 22 nt, Human
ugcugcucuucaccauggccuc

SEQ ID NO: 563782 - RNA, 22 nt, Human
uuauugagcacauaguaugugg

SEQ ID NO: 563783 - RNA, 22 nt, Human
aaaccggguccagaucuucagg

SEQ ID NO: 563784 - RNA, 21 nt, Human
ggcagcucagcagauggggac

SEQ ID NO: 563785 - RNA, 22 nt, Human
agagaugcuguggguagaggca

SEQ ID NO: 563786 - RNA, 20 nt, Human
uuacagaaaugauguuauuu

SEQ ID NO: 563787 - RNA, 22 nt, Human
gcucccugguauugcugccacu

SEQ ID NO: 563788 - RNA, 22 nt, Human
cugagcaugcuacaugcagcac

SEQ ID NO: 563789 - RNA, 22 nt, Human
ugugacguuguucuggauuccc

SEQ ID NO: 563790 - RNA, 22 nt, Human
aggccgugugagcaugugugag

SEQ ID NO: 563791 - RNA, 22 nt, Human
uauaagaaacaaggcaaauuuu

SEQ ID NO: 563792 - RNA, 22 nt, Human
ccucaaaggccuggcaccagaa

SEQ ID NO: 563793 - RNA, 22 nt, Human
aaagcacauuacaagcucaguc

SEQ ID NO: 563794 - RNA, 22 nt, Human
aagcuggccuguaccugcugag

SEQ ID NO: 563795 - RNA, 22 nt, Human
cuggccuggcaggggaccucua

SEQ ID NO: 563796 - RNA, 23 nt, Human
uagacugcaggcuccuugagggc

SEQ ID NO: 563797 - RNA, 22 nt, Human
caagucugaccucugggugaag

SEQ ID NO: 563798 - RNA, 22 nt, Human
uuuuccuuaacagagggagaaa

SEQ ID NO: 563799 - RNA, 22 nt, Human
cuggucaauaaucauguaguac

SEQ ID NO: 563800 - RNA, 22 nt, Human
agcuaauguauguugaaagcac

SEQ ID NO: 563801 - RNA, 22 nt, Human
aguucugggaggugcacgucca

SEQ ID NO: 563802 - RNA, 22 nt, Human
ucaagaaagggcuucaccagga

SEQ ID NO: 563803 - RNA, 22 nt, Human
ucaugucccguugcuggcugcc

SEQ ID NO: 563804 - RNA, 22 nt, Human
guggggacgggauggcucacug

SEQ ID NO: 563805 - RNA, 17 nt, Human
gcccucagcuuuaacca

SEQ ID NO: 563806 - RNA, 22 nt, Human
gcaaaacagucgaugccuccca

SEQ ID NO: 563807 - RNA, 22 nt, Human
cgugaugcucaggaggucauag

SEQ ID NO: 563808 - RNA, 22 nt, Human
cguggggcggguggacacuugc

SEQ ID NO: 563809 - RNA, 22 nt, Human
gggcucuguuuagaccagagau

SEQ ID NO: 563810 - RNA, 22 nt, Human
ugcagguggcagcggggcacca

SEQ ID NO: 563811 - RNA, 22 nt, Human
gcggggccauguccaacggccu

SEQ ID NO: 563812 - RNA, 22 nt, Human
accagagcuggcagaguaucaa

SEQ ID NO: 563813 - RNA, 22 nt, Human
aggcagaugggagcuggaaguu

SEQ ID NO: 563814 - RNA, 19 nt, Human
ugguggaggccccauguuc

SEQ ID NO: 563815 - RNA, 22 nt, Human
gauguucgagcagaagaccagg

SEQ ID NO: 563816 - RNA, 22 nt, Human
uccuggcccuguggccugcagu

SEQ ID NO: 563817 - RNA, 22 nt, Human
cccaggaggcagaaguugcagu

SEQ ID NO: 563818 - RNA, 22 nt, Human
gaagccaaguccucgaguuuca

SEQ ID NO: 563819 - RNA, 17 nt, Human
ucuccuggcucuaucag

SEQ ID NO: 563820 - RNA, 22 nt, Human
gagucacauacuauguaauaga

SEQ ID NO: 563821 - RNA, 22 nt, Human
agcaccaggucgcuggcacgcu

SEQ ID NO: 563822 - RNA, 22 nt, Human
auacaacagaaaaugauuauuc

SEQ ID NO: 563823 - RNA, 22 nt, Human
uauaaacuccucuugcauuccu

SEQ ID NO: 563824 - RNA, 22 nt, Human
ccagguggacggcgaguacagg

SEQ ID NO: 563825 - RNA, 22 nt, Human
agcucaguggcuggggcgcugc

SEQ ID NO: 563826 - RNA, 22 nt, Human
cgugcagcggagcuggucacug

SEQ ID NO: 563827 - RNA, 22 nt, Human
augcugccuccucuucagccgc

SEQ ID NO: 563828 - RNA, 22 nt, Human
cacagagagcuacgugcagcgu

SEQ ID NO: 563829 - RNA, 22 nt, Human
aggcugagccugggcguggugg

SEQ ID NO: 563830 - RNA, 22 nt, Human
uaaaaucaugacagauugacau

SEQ ID NO: 563831 - RNA, 22 nt, Human
acacacagaaggaagccccacu

SEQ ID NO: 563832 - RNA, 22 nt, Human
ccaggcauccauugcuuccucu

SEQ ID NO: 563833 - RNA, 22 nt, Human
cuugccagggacucagucaggg

SEQ ID NO: 563834 - RNA, 22 nt, Human
caccucucauuucuacagauuc

SEQ ID NO: 563835 - RNA, 22 nt, Human
gccaaaguccuccagccaugca

SEQ ID NO: 563836 - RNA, 22 nt, Human
uguguacauguaucaacuaucg

SEQ ID NO: 563837 - RNA, 22 nt, Human
ggcacagcugaugcagacacac

SEQ ID NO: 563838 - RNA, 22 nt, Human
cccagaaugauucagcgacagu

SEQ ID NO: 563839 - RNA, 15 nt, Human
gccccaggaaucaaa

SEQ ID NO: 563840 - RNA, 22 nt, Human
ugugaggaccucagcagagucu

SEQ ID NO: 563841 - RNA, 22 nt, Human
acagagccuccaggagugcugg

SEQ ID NO: 563842 - RNA, 19 nt, Human
gaugcucauucagguggaa

SEQ ID NO: 563843 - RNA, 22 nt, Human
ccauggccaggaaagccaaggu

SEQ ID NO: 563844 - RNA, 22 nt, Human
auacaugugugugcauacaugu

SEQ ID NO: 563845 - RNA, 22 nt, Human
augaagcauuacaggaugacag

SEQ ID NO: 563846 - RNA, 22 nt, Human
uccguuuucacacugcuauaaa

SEQ ID NO: 563847 - RNA, 22 nt, Human
gugcuggggagauaggaagaga

SEQ ID NO: 563848 - RNA, 20 nt, Human
aggaaggagaaucugagcaa

SEQ ID NO: 563849 - RNA, 22 nt, Human
gucaucaucaggcagaugcugc

SEQ ID NO: 563850 - RNA, 22 nt, Human
caggcgggcaggugcggccccu

SEQ ID NO: 563851 - RNA, 22 nt, Human
aggucacguccugugaugucau

SEQ ID NO: 563852 - RNA, 22 nt, Human
cagcacauggauggaguuagga

SEQ ID NO: 563853 - RNA, 22 nt, Human
caggcgaccccuaggagcaaca

SEQ ID NO: 563854 - RNA, 22 nt, Human
gggagggcuuggacccagaugu

SEQ ID NO: 563855 - RNA, 22 nt, Human
gagccaagauugugucccugca

SEQ ID NO: 563856 - RNA, 22 nt, Human
cugaugcucuggauguagucaa

SEQ ID NO: 563857 - RNA, 22 nt, Human
acccacagccgcugugcguccc

SEQ ID NO: 563858 - RNA, 22 nt, Human
cucucugggcccaguuggcacc

SEQ ID NO: 563859 - RNA, 22 nt, Human
gcugguggcagagcuccgcggc

SEQ ID NO: 563860 - RNA, 22 nt, Human
aaacuggauuaccaggcuggug

SEQ ID NO: 563861 - RNA, 22 nt, Human
aacaugaugacauuguaagcuu

SEQ ID NO: 563862 - RNA, 22 nt, Human
uacauguacaugcauagguaga

SEQ ID NO: 563863 - RNA, 22 nt, Human
cuggugcuguagccugauugag

SEQ ID NO: 563864 - RNA, 22 nt, Human
aaggcuguuugagcacuggagc

SEQ ID NO: 563865 - RNA, 22 nt, Human
cgcaggugccggcagauggggu

SEQ ID NO: 563866 - RNA, 22 nt, Human
uuuuccuucugauacuccauuu

SEQ ID NO: 563867 - RNA, 22 nt, Human
uuuugguaauuaaguagauauu

SEQ ID NO: 563868 - RNA, 22 nt, Human
cuccagcagaaagggcgagugg

SEQ ID NO: 563869 - RNA, 22 nt, Human
cuucucuuggguguggugucuu

SEQ ID NO: 563870 - RNA, 22 nt, Human
ugucuuggccacuaggagugcc

SEQ ID NO: 563871 - RNA, 22 nt, Human
cccaggacucugacacccccaa

SEQ ID NO: 563872 - RNA, 22 nt, Human
gagggccaaugugucccugagc

SEQ ID NO: 563873 - RNA, 22 nt, Human
aaccagacucuccaaaggcaaa

SEQ ID NO: 563874 - RNA, 22 nt, Human
ugcagggcagcuagggagcuuu

SEQ ID NO: 563875 - RNA, 22 nt, Human
guccagaguagucgaguauucu

SEQ ID NO: 563876 - RNA, 22 nt, Human
aaugacaguggcacagucacuu

SEQ ID NO: 563877 - RNA, 22 nt, Human
ggugggucuuguggggcagcuu

SEQ ID NO: 563878 - RNA, 22 nt, Human
cagcuccagcccaggcagcucc

SEQ ID NO: 563879 - RNA, 22 nt, Human
ugcugugagaccauuuguugag

SEQ ID NO: 563880 - RNA, 22 nt, Human
uuggggaagcuuugaaauacuu

SEQ ID NO: 563881 - RNA, 22 nt, Human
uaaucuuagacauguauuuuuc

SEQ ID NO: 563882 - RNA, 22 nt, Human
agaauccuggagaagcuguacc

SEQ ID NO: 563883 - RNA, 22 nt, Human
uccugaccacuaggaccaggcu

SEQ ID NO: 563884 - RNA, 22 nt, Human
cugaggagauccccccagaagu

SEQ ID NO: 563885 - RNA, 22 nt, Human
cagcuggcgacucuccucgaug

SEQ ID NO: 563886 - RNA, 22 nt, Human
ccuuugagccugggcgcggacc

SEQ ID NO: 563887 - RNA, 22 nt, Human
ggccugcuucucugggcuuucu

SEQ ID NO: 563888 - RNA, 22 nt, Human
gucuuaagaaugaaugcugaga

SEQ ID NO: 563889 - RNA, 22 nt, Human
uuccuuucucuggacugcagcc

SEQ ID NO: 563890 - RNA, 22 nt, Human
aacacugugcccacccuagucc

SEQ ID NO: 563891 - RNA, 22 nt, Human
gaugucuggcuaccacucgcac

SEQ ID NO: 563892 - RNA, 22 nt, Human
uccagaugcugcacauuccuga

SEQ ID NO: 563893 - RNA, 18 nt, Human
gccugccagccgagggac

SEQ ID NO: 563894 - RNA, 22 nt, Human
ccugcgcgucugggucugucuc

SEQ ID NO: 563895 - RNA, 22 nt, Human
auguaguauuuggaaauguaaa

SEQ ID NO: 563896 - RNA, 22 nt, Human
gucaccuugaacaggcuacuca

SEQ ID NO: 563897 - RNA, 18 nt, Human
cccacggugcuguagggc

SEQ ID NO: 563898 - RNA, 22 nt, Human
cucccagggucuaggcugcugg

SEQ ID NO: 563899 - RNA, 22 nt, Human
ucccuguccugggcaaucccag

SEQ ID NO: 563900 - RNA, 22 nt, Human
ccucugcccuuuuccuguauca

SEQ ID NO: 563901 - RNA, 22 nt, Human
ugaggauggaaugcugugcaag

SEQ ID NO: 563902 - RNA, 22 nt, Human
cauggccagauucuuucuucuc

SEQ ID NO: 563903 - RNA, 22 nt, Human
gcagacccugaacugggcaugg

SEQ ID NO: 563904 - RNA, 22 nt, Human
aucugccuggcuccaggugagc

SEQ ID NO: 563905 - RNA, 22 nt, Human
ucacuacaaccgcuaccugaca

SEQ ID NO: 563906 - RNA, 22 nt, Human
gccuggcgccgggcugccuguc

SEQ ID NO: 563907 - RNA, 22 nt, Human
cacagaggaugcccaagcgauc

SEQ ID NO: 563908 - RNA, 22 nt, Human
guggcauuugggagaugcgugg

SEQ ID NO: 563909 - RNA, 21 nt, Human
ucccacuggcccagggcucca

SEQ ID NO: 563910 - RNA, 22 nt, Human
cagcucugguuccugggcccag

SEQ ID NO: 563911 - RNA, 22 nt, Human
ucuccauggauuuggaaaugau

SEQ ID NO: 563912 - RNA, 22 nt, Human
ucuuuuaucuguuguguaacaa

SEQ ID NO: 563913 - RNA, 22 nt, Human
augcuacauuuugguuuauaaa

SEQ ID NO: 563914 - RNA, 22 nt, Human
agagcagaggcauggccguggg

SEQ ID NO: 563915 - RNA, 22 nt, Human
gacaggugcuaagggaccuggc

SEQ ID NO: 563916 - RNA, 22 nt, Human
auauacacuguuucaguugaag

SEQ ID NO: 563917 - RNA, 22 nt, Human
caagccaggaaggauccagcac

SEQ ID NO: 563918 - RNA, 22 nt, Human
auuuccuauacaguuguccaua

SEQ ID NO: 563919 - RNA, 22 nt, Human
ucuacaacgugguuuuguugua

SEQ ID NO: 563920 - RNA, 22 nt, Human
aucauugaguaaaaugaauaca

SEQ ID NO: 563921 - RNA, 23 nt, Human
uuguccucuggaucgguuugguu

SEQ ID NO: 563922 - RNA, 22 nt, Human
ugggaagaguuagagacagcug

SEQ ID NO: 563923 - RNA, 22 nt, Human
caggcccuuuccugggcauagg

SEQ ID NO: 563924 - RNA, 22 nt, Human
uugcugugucauuuguuuaauc

SEQ ID NO: 563925 - RNA, 22 nt, Human
uuccagagaguuauuccccugg

SEQ ID NO: 563926 - RNA, 22 nt, Human
gaggcagagacuccaccuucag

SEQ ID NO: 563927 - RNA, 22 nt, Human
caggccacagcuaaagaggauu

SEQ ID NO: 563928 - RNA, 22 nt, Human
aggggcacgaguagagcucuag

SEQ ID NO: 563929 - RNA, 22 nt, Human
ggcggccugugggucggccuca

SEQ ID NO: 563930 - RNA, 22 nt, Human
aagcaauucacaguucacuuaa

SEQ ID NO: 563931 - RNA, 22 nt, Human
uagcgggucacccugcugugaa

SEQ ID NO: 563932 - RNA, 22 nt, Human
ugggagagauaggcuucuggac

SEQ ID NO: 563933 - RNA, 22 nt, Human
ccugaggcccuggcugugcuga

SEQ ID NO: 563934 - RNA, 19 nt, Human
uuugauagggcauaauaua

SEQ ID NO: 563935 - RNA, 22 nt, Human
cucugcguggcugggcccaggg

SEQ ID NO: 563936 - RNA, 22 nt, Human
gugagguccucccugcugggag

SEQ ID NO: 563937 - RNA, 22 nt, Human
cgaggaggaaacgcggagaacu

SEQ ID NO: 563938 - RNA, 22 nt, Human
gcuuuugagguccugcucagcc

SEQ ID NO: 563939 - RNA, 20 nt, Human
agugauuuguuaguacauug

SEQ ID NO: 563940 - RNA, 22 nt, Human
uguaagcuucaaauaucuguga

SEQ ID NO: 563941 - RNA, 20 nt, Human
ggggcccaagcccucuugcc

SEQ ID NO: 563942 - RNA, 20 nt, Human
aggggcaccugcgacggggc

SEQ ID NO: 563943 - RNA, 22 nt, Human
uacagugaguggcagagccaga

SEQ ID NO: 563944 - RNA, 22 nt, Human
uccagagaacgaugaaagcugg

SEQ ID NO: 563945 - RNA, 22 nt, Human
ugcugcucaagcugcagcaaaa

SEQ ID NO: 563946 - RNA, 22 nt, Human
gggcagcaggcuccacguuccu

SEQ ID NO: 563947 - RNA, 22 nt, Human
ucuucaugucaugguauauuga

SEQ ID NO: 563948 - RNA, 22 nt, Human
uguguggcaagcuguaugcuag

SEQ ID NO: 563949 - RNA, 22 nt, Human
gccagaggggcucgaaggcgcg

SEQ ID NO: 563950 - RNA, 22 nt, Human
aaaccuguuaauagagcgaugc

SEQ ID NO: 563951 - RNA, 22 nt, Human
gugcugccuccauauccgucag

SEQ ID NO: 563952 - RNA, 22 nt, Human
auguaugagagauucuuuuauu

SEQ ID NO: 563953 - RNA, 22 nt, Human
guguggucgaaguucucccgga

SEQ ID NO: 563954 - RNA, 22 nt, Human
uaaggcuguuaggaggauuaaa

SEQ ID NO: 563955 - RNA, 22 nt, Human
ugggcagacgggagcuugccuu

SEQ ID NO: 563956 - RNA, 22 nt, Human
ucccggcgcugggagguggguc

SEQ ID NO: 563957 - RNA, 22 nt, Human
uuaguguccagaguuuuuauua

SEQ ID NO: 563958 - RNA, 22 nt, Human
gaugaaggggcuggugcccucu

SEQ ID NO: 563959 - RNA, 22 nt, Human
aagcaaaagguuacacuucugg

SEQ ID NO: 563960 - RNA, 18 nt, Human
ggaaaaggagugucuagc

SEQ ID NO: 563961 - RNA, 18 nt, Human
ggcggguguuuuauucac

SEQ ID NO: 563962 - RNA, 22 nt, Human
ugcuggaagggucggcgugggc

SEQ ID NO: 563963 - RNA, 22 nt, Human
cucccagccuucgccagucuga

SEQ ID NO: 563964 - RNA, 22 nt, Human
aaugucaacacaagagaaaugc

SEQ ID NO: 563965 - RNA, 22 nt, Human
gcugucccgaaccccugguaau

SEQ ID NO: 563966 - RNA, 22 nt, Human
ggaggugacuggaucaugggca

SEQ ID NO: 563967 - RNA, 20 nt, Human
aaaaacaguaaugcugaaga

SEQ ID NO: 563968 - RNA, 22 nt, Human
gcgguauuugugugggugucga

SEQ ID NO: 563969 - RNA, 22 nt, Human
ccagaacagaccugccugaccu

SEQ ID NO: 563970 - RNA, 21 nt, Human
agccugcaauguagguaccgg

SEQ ID NO: 563971 - RNA, 21 nt, Human
gcagcaugagaaagccccaaa

SEQ ID NO: 563972 - RNA, 22 nt, Human
uagcagcacuauuuguuguagu

SEQ ID NO: 563973 - RNA, 23 nt, Human
gcugccaaggaggcaggggugcc

SEQ ID NO: 563974 - RNA, 22 nt, Human
ugcacccacuuagcugaaguuc

SEQ ID NO: 563975 - RNA, 22 nt, Human
cugcccaucuggccacacacag

SEQ ID NO: 563976 - RNA, 21 nt, Human
acaaauuguuuauauaggaag

SEQ ID NO: 563977 - RNA, 22 nt, Human
gucugcccuuggccugggacuu

SEQ ID NO: 563978 - RNA, 22 nt, Human
cuuccagcugauuggcauccag

SEQ ID NO: 563979 - RNA, 22 nt, Human
gauacuuuguggaauccuggau

SEQ ID NO: 563980 - RNA, 22 nt, Human
ggucuccugaccuuuagucccu

SEQ ID NO: 563981 - RNA, 22 nt, Human
acccagcucuuugauggucuug

SEQ ID NO: 563982 - RNA, 22 nt, Human
auguccagaguaaagcacauuc

SEQ ID NO: 563983 - RNA, 22 nt, Human
cugagguagaggaaauguagcu

SEQ ID NO: 563984 - RNA, 22 nt, Human
ugcccuccacaguggcuccacc

SEQ ID NO: 563985 - RNA, 22 nt, Human
ccuggaaaaugccacuuucaca

SEQ ID NO: 563986 - RNA, 22 nt, Human
gcuaagggauaggcugccuccu

SEQ ID NO: 563987 - RNA, 22 nt, Human
cagguuccaguugcagggacuu

SEQ ID NO: 563988 - RNA, 20 nt, Human
aucagguguucagccacugc

SEQ ID NO: 563989 - RNA, 22 nt, Human
guggccaucuuuggcccugacu

SEQ ID NO: 563990 - RNA, 20 nt, Human
gcagcagacagacaggggac

SEQ ID NO: 563991 - RNA, 22 nt, Human
uggcuguagaaucagagacuug

SEQ ID NO: 563992 - RNA, 22 nt, Human
uggcuccaggggacacgcagua

SEQ ID NO: 563993 - RNA, 22 nt, Human
acacucaugcucagcuggugcu

SEQ ID NO: 563994 - RNA, 22 nt, Human
ccagcaggagacuagcaacaua

SEQ ID NO: 563995 - RNA, 22 nt, Human
uaacaaaguauuguuuguguau

SEQ ID NO: 563996 - RNA, 22 nt, Human
aguggcugugaaauacauggga

SEQ ID NO: 563997 - RNA, 22 nt, Human
caugugaccgcugggugagcga

SEQ ID NO: 563998 - RNA, 22 nt, Human
cagccggaccugagggauuccu

SEQ ID NO: 563999 - RNA, 22 nt, Human
uuccagcuaacucacaucccuu

SEQ ID NO: 564000 - RNA, 21 nt, Human
ugcuggguuugcccaucaggc

SEQ ID NO: 564001 - RNA, 22 nt, Human
ugaguguuguaaccauaugauu

SEQ ID NO: 564002 - RNA, 22 nt, Human
gcacagagagcagugggggaca

SEQ ID NO: 564003 - RNA, 22 nt, Human
uguaccgccuugugggguuggg

SEQ ID NO: 564004 - RNA, 22 nt, Human
uggcacguuggauugggaguuc

SEQ ID NO: 564005 - RNA, 22 nt, Human
ggcuagcuuagagucaugcuag

SEQ ID NO: 564006 - RNA, 22 nt, Human
uguuugcucugacuaucuugcg

SEQ ID NO: 564007 - RNA, 22 nt, Human
ccagagaggccuuggcaagaca

SEQ ID NO: 564008 - RNA, 19 nt, Human
ggcugccuucugcucaucu

SEQ ID NO: 564009 - RNA, 22 nt, Human
gcuguagguaaggauggcaaag

SEQ ID NO: 564010 - RNA, 22 nt, Human
gcacuagauucugaagcagcag

SEQ ID NO: 564011 - RNA, 22 nt, Human
cagcuggaggagcagcuuccag

SEQ ID NO: 564012 - RNA, 22 nt, Human
gccugccuucggugcgcagcgg

SEQ ID NO: 564013 - RNA, 18 nt, Human
agguguguuucuaggagc

SEQ ID NO: 564014 - RNA, 18 nt, Human
cuggucucccuucgcuuu

SEQ ID NO: 564015 - RNA, 22 nt, Human
cuccugcagcccucagcagcca

SEQ ID NO: 564016 - RNA, 22 nt, Human
ugagcaccaggcaccacagcuc

SEQ ID NO: 564017 - RNA, 22 nt, Human
agcugcaccggcuggaccacug

SEQ ID NO: 564018 - RNA, 22 nt, Human
gcccagaguuugaagauacagu

SEQ ID NO: 564019 - RNA, 22 nt, Human
uucaacaacuugguucaaaugg

SEQ ID NO: 564020 - RNA, 22 nt, Human
ucagagccccuccgcuguccca

SEQ ID NO: 564021 - RNA, 23 nt, Human
aucauagucuuugugacuggccc

SEQ ID NO: 564022 - RNA, 22 nt, Human
uacugucuuuuccuaaaugggu

SEQ ID NO: 564023 - RNA, 22 nt, Human
ugugugaacucucugauguaca

SEQ ID NO: 564024 - RNA, 22 nt, Human
gcggcccggguccccagcagca

SEQ ID NO: 564025 - RNA, 22 nt, Human
uuugaagauaaauauggagaaa

SEQ ID NO: 564026 - RNA, 22 nt, Human
ugacuuuggacuagugauuuaa

SEQ ID NO: 564027 - RNA, 22 nt, Human
uuggaaauguagaaaagcagau

SEQ ID NO: 564028 - RNA, 22 nt, Human
cagacugaaaaucccugguagu

SEQ ID NO: 564029 - RNA, 22 nt, Human
uugcuggaagguggcuggaauc

SEQ ID NO: 564030 - RNA, 21 nt, Human
cugugauguugccgggguagg

SEQ ID NO: 564031 - RNA, 22 nt, Human
cuccagcucgcgagcucugcuc

SEQ ID NO: 564032 - RNA, 22 nt, Human
uucaccugugacagguagaguu

SEQ ID NO: 564033 - RNA, 22 nt, Human
uuuguagauuuucucuccagua

SEQ ID NO: 564034 - RNA, 22 nt, Human
ccuccccacagcccaggagacu

SEQ ID NO: 564035 - RNA, 19 nt, Human
ugcagcuguaugagcuuaa

SEQ ID NO: 564036 - RNA, 22 nt, Human
ugcuggccucggcgcugggccu

SEQ ID NO: 564037 - RNA, 22 nt, Human
cccaggcacacugaagugacau

SEQ ID NO: 564038 - RNA, 22 nt, Human
ucggggauggugucugagggag

SEQ ID NO: 564039 - RNA, 22 nt, Human
cagaugaggcaaccucauugcu

SEQ ID NO: 564040 - RNA, 22 nt, Human
accaagaguccaagugagguug

SEQ ID NO: 564041 - RNA, 22 nt, Human
acaugcauaaacuacuucuuau

SEQ ID NO: 564042 - RNA, 23 nt, Human
cagcugguugugggaguggcugc

SEQ ID NO: 564043 - RNA, 22 nt, Human
ggagcugugcugggugaucagg

SEQ ID NO: 564044 - RNA, 22 nt, Human
gucagcaggguccccuugagug

SEQ ID NO: 564045 - RNA, 22 nt, Human
ugucccuggacuccaggagcca

SEQ ID NO: 564046 - RNA, 20 nt, Human
gaacagucuucugagccaca

SEQ ID NO: 564047 - RNA, 22 nt, Human
ccuggguccaauucuggcuugu

SEQ ID NO: 564048 - RNA, 22 nt, Human
cagcaugaauguguucguaggg

SEQ ID NO: 564049 - RNA, 22 nt, Human
gcggcuccgaagccaggccgcg

SEQ ID NO: 564050 - RNA, 22 nt, Human
uucuguaauucuguuaguuuca

SEQ ID NO: 564051 - RNA, 20 nt, Human
gggugugugcagggccuggu

SEQ ID NO: 564052 - RNA, 23 nt, Human
ggaagcucacguaguccugcacu

SEQ ID NO: 564053 - RNA, 22 nt, Human
cacagaggacuguagcggggag

SEQ ID NO: 564054 - RNA, 22 nt, Human
aagccagguguuuaggccagcg

SEQ ID NO: 564055 - RNA, 19 nt, Human
cuucuggauccgcagggcc

SEQ ID NO: 564056 - RNA, 23 nt, Human
uuguucuuggaucuuccugaagc

SEQ ID NO: 564057 - RNA, 22 nt, Human
gccaggaugacuauacaacagc

SEQ ID NO: 564058 - RNA, 22 nt, Human
ccugcacuaccuggggcugcug

SEQ ID NO: 564059 - RNA, 22 nt, Human
ucagaagcauccauuucaccac

SEQ ID NO: 564060 - RNA, 22 nt, Human
aggcagagaaaaaccagauaug

SEQ ID NO: 564061 - RNA, 22 nt, Human
ccagagagggcgccaccuggag

SEQ ID NO: 564062 - RNA, 22 nt, Human
cucggaauggaacaacagcggu

SEQ ID NO: 564063 - RNA, 22 nt, Human
gagguccacugaggcaacaggg

SEQ ID NO: 564064 - RNA, 22 nt, Human
ccaggcagccaagugugugugu

SEQ ID NO: 564065 - RNA, 22 nt, Human
uaaaguuggaccugauuuuauu

SEQ ID NO: 564066 - RNA, 22 nt, Human
aggagccgggccugggcccugc

SEQ ID NO: 564067 - RNA, 22 nt, Human
caagagcuggguggcaagcuag

SEQ ID NO: 564068 - RNA, 22 nt, Human
gcagaggggaagcugaggaauu

SEQ ID NO: 564069 - RNA, 22 nt, Human
acuggcccuggcugcuaggcug

SEQ ID NO: 564070 - RNA, 22 nt, Human
gccugcacucaaacacucucuu

SEQ ID NO: 564071 - RNA, 22 nt, Human
ggagcugcucagagccaguccc

SEQ ID NO: 564072 - RNA, 22 nt, Human
uuugcacuuaaauuuacaacac

SEQ ID NO: 564073 - RNA, 22 nt, Human
ggagugggaacaaugacauggu

SEQ ID NO: 564074 - RNA, 17 nt, Human
uagauuaaacacggcca

SEQ ID NO: 564075 - RNA, 22 nt, Human
ccaggaagaaacagucuuuaua

SEQ ID NO: 564076 - RNA, 22 nt, Human
agcggcgccggagggaggugcg

SEQ ID NO: 564077 - RNA, 22 nt, Human
ucaccggcagacguggccugau

SEQ ID NO: 564078 - RNA, 22 nt, Human
uucaguaagcacuucuagagcu

SEQ ID NO: 564079 - RNA, 22 nt, Human
ggugucagugaagguagaguuu

SEQ ID NO: 564080 - RNA, 22 nt, Human
uugcacagaugcacaugguugc

SEQ ID NO: 564081 - RNA, 20 nt, Human
uggccucugagaugccacgg

SEQ ID NO: 564082 - RNA, 21 nt, Human
caaaagagacugauucuugga

SEQ ID NO: 564083 - RNA, 22 nt, Human
cucaugucggcaggacucgccc

SEQ ID NO: 564084 - RNA, 21 nt, Human
uugauuuagcagaucuagcug

SEQ ID NO: 564085 - RNA, 22 nt, Human
aagcagcauaugacagcaucca

SEQ ID NO: 564086 - RNA, 22 nt, Human
gccuucugaucgcuggacugac

SEQ ID NO: 564087 - RNA, 22 nt, Human
augaaacaacagacuuggucaa

SEQ ID NO: 564088 - RNA, 22 nt, Human
ugcagcugccuagggcuggcuu

SEQ ID NO: 564089 - RNA, 22 nt, Human
caagcagauauuuuagucaaga

SEQ ID NO: 564090 - RNA, 22 nt, Human
cacugguugccucuuucuguuc

SEQ ID NO: 564091 - RNA, 22 nt, Human
cucugaguagauagggaaccug

SEQ ID NO: 564092 - RNA, 20 nt, Human
ucugccacuuuuucugucac

SEQ ID NO: 564093 - RNA, 22 nt, Human
aggggagguguccccaaaucuc

SEQ ID NO: 564094 - RNA, 22 nt, Human
gguuccaggcauggcaggaugu

SEQ ID NO: 564095 - RNA, 22 nt, Human
ucagaagcauguggggagccug

SEQ ID NO: 564096 - RNA, 22 nt, Human
gcccucugccacaggacgccag

SEQ ID NO: 564097 - RNA, 22 nt, Human
ugcugaggagguggcugugcuu

SEQ ID NO: 564098 - RNA, 22 nt, Human
ccagcugcugcaccgugcaugg

SEQ ID NO: 564099 - RNA, 22 nt, Human
gccagugccugcugcucagggc

SEQ ID NO: 564100 - RNA, 22 nt, Human
ggaaacugcuuacacuagaggg

SEQ ID NO: 564101 - RNA, 22 nt, Human
agcaggaacucagggaguucuc

SEQ ID NO: 564102 - RNA, 22 nt, Human
gagguggcugcuugcugggaaa

SEQ ID NO: 564103 - RNA, 22 nt, Human
gcgacuguacagaauugccccu

SEQ ID NO: 564104 - RNA, 22 nt, Human
acaguuaguugaggaguguuug

SEQ ID NO: 564105 - RNA, 22 nt, Human
cugagggagcugcuggccuugg

SEQ ID NO: 564106 - RNA, 22 nt, Human
aggcuguagaucuagacaugua

SEQ ID NO: 564107 - RNA, 22 nt, Human
agccccaguccgcugcgggcgg

SEQ ID NO: 564108 - RNA, 16 nt, Human
ucauugaagacaguac

SEQ ID NO: 564109 - RNA, 22 nt, Human
guccaggccugccucugaggag

SEQ ID NO: 564110 - RNA, 22 nt, Human
gucuggagccacugcugcugcu

SEQ ID NO: 564111 - RNA, 22 nt, Human
aacccagaaacgcaggcgguca

SEQ ID NO: 564112 - RNA, 20 nt, Human
caucaacaccuugucagccu

SEQ ID NO: 564113 - RNA, 22 nt, Human
ggcucagaggagcuggaacggu

SEQ ID NO: 564114 - RNA, 22 nt, Human
guucuuaaagauucaucaagca

SEQ ID NO: 564115 - RNA, 22 nt, Human
uagcuguucucuguaaauugga

SEQ ID NO: 564116 - RNA, 22 nt, Human
ggaacaguugcgucaugggccu

SEQ ID NO: 564117 - RNA, 22 nt, Human
ggaaggcuuuaagcaccaaagc

SEQ ID NO: 564118 - RNA, 22 nt, Human
cuguccauggcaaugaugcaga

SEQ ID NO: 564119 - RNA, 22 nt, Human
uacagcagcccaccuucuucug

SEQ ID NO: 564120 - RNA, 22 nt, Human
aggccuuccucggagacaggga

SEQ ID NO: 564121 - RNA, 22 nt, Human
accacaucgggcggacacuggg

SEQ ID NO: 564122 - RNA, 22 nt, Human
ucaucaucauucucccccacuu

SEQ ID NO: 564123 - RNA, 22 nt, Human
uugacguccucgauggggaacu

SEQ ID NO: 564124 - RNA, 22 nt, Human
aagcccagcaucccugcaccag

SEQ ID NO: 564125 - RNA, 22 nt, Human
auccgcuuaucucagcuggcag

SEQ ID NO: 564126 - RNA, 22 nt, Human
uagcauuuagaacaccuugaga

SEQ ID NO: 564127 - RNA, 22 nt, Human
uagcagaacaauagucaaugau

SEQ ID NO: 564128 - RNA, 22 nt, Human
cugaccaguccuuagcaccugg

SEQ ID NO: 564129 - RNA, 22 nt, Human
aaagagcucggaaaguguugaa

SEQ ID NO: 564130 - RNA, 19 nt, Human
gcacacccugcaccaccau

SEQ ID NO: 564131 - RNA, 22 nt, Human
cuuauuggucccaggaggagaa

SEQ ID NO: 564132 - RNA, 22 nt, Human
cuggcuaaagagcaagaagaug

SEQ ID NO: 564133 - RNA, 22 nt, Human
ccaggugugcucugcaguggau

SEQ ID NO: 564134 - RNA, 22 nt, Human
ggccucugccccgcggggcucg

SEQ ID NO: 564135 - RNA, 22 nt, Human
cgucaggguugagcagguagau

SEQ ID NO: 564136 - RNA, 22 nt, Human
acugccaggauggcacuagagg

SEQ ID NO: 564137 - RNA, 22 nt, Human
augcccugggagugcuguacca

SEQ ID NO: 564138 - RNA, 17 nt, Human
ucugcagggggccgugu

SEQ ID NO: 564139 - RNA, 22 nt, Human
uucccuggugggugagaaccug

SEQ ID NO: 564140 - RNA, 22 nt, Human
uggcacugucaccaaugcuguc

SEQ ID NO: 564141 - RNA, 22 nt, Human
uuuacagagaauguacauaaag

SEQ ID NO: 564142 - RNA, 22 nt, Human
uucaaacacugcuuugagaggg

SEQ ID NO: 564143 - RNA, 22 nt, Human
cagagcagcagagcuuccaugg

SEQ ID NO: 564144 - RNA, 18 nt, Human
uccaccgcgugcaccucu

SEQ ID NO: 564145 - RNA, 22 nt, Human
uccagcagguccgagacaaguu

SEQ ID NO: 564146 - RNA, 22 nt, Human
gugaagcacaugggcguugggu

SEQ ID NO: 564147 - RNA, 22 nt, Human
aguccggggucuggacaccugg

SEQ ID NO: 564148 - RNA, 22 nt, Human
uaccaggagcccccuucugguc

SEQ ID NO: 564149 - RNA, 23 nt, Human
ugucuccaucucauuacuugggg

SEQ ID NO: 564150 - RNA, 22 nt, Human
ugaauagagcugcaguggacau

SEQ ID NO: 564151 - RNA, 22 nt, Human
ucucaguccaaaugagagguug

SEQ ID NO: 564152 - RNA, 22 nt, Human
ggaaggguuuaagcaggagagu

SEQ ID NO: 564153 - RNA, 22 nt, Human
gucugcccugcagacaugccuc

SEQ ID NO: 564154 - RNA, 22 nt, Human
uggggcuccuccuggcaggagg

SEQ ID NO: 564155 - RNA, 22 nt, Human
ucaguccuuaucugguguucag

SEQ ID NO: 564156 - RNA, 22 nt, Human
augaaaacagccuccugugaua

SEQ ID NO: 564157 - RNA, 22 nt, Human
cugagauggaguuucgcucuuc

SEQ ID NO: 564158 - RNA, 22 nt, Human
aggugggacccguggggugcga

SEQ ID NO: 564159 - RNA, 22 nt, Human
guggaaauuuuaggaucaucuu

SEQ ID NO: 564160 - RNA, 22 nt, Human
cgccguccccuaggaaagagcu

SEQ ID NO: 564161 - RNA, 22 nt, Human
auucaugcaggauugucuccaa

SEQ ID NO: 564162 - RNA, 22 nt, Human
ccaugcagugcuggagcugauu

SEQ ID NO: 564163 - RNA, 22 nt, Human
caggcuacauuugcucugagaa

SEQ ID NO: 564164 - RNA, 19 nt, Human
gggaaugauggaagacuuc

SEQ ID NO: 564165 - RNA, 22 nt, Human
gccagcuagaggcugcagugca

SEQ ID NO: 564166 - RNA, 22 nt, Human
uagugucuuccaggacauggua

SEQ ID NO: 564167 - RNA, 22 nt, Human
gaugugugugcccugggccugc

SEQ ID NO: 564168 - RNA, 22 nt, Human
cugccguguuuuucauguuaaa

SEQ ID NO: 564169 - RNA, 22 nt, Human
guucuccaggggcuguucaucu

SEQ ID NO: 564170 - RNA, 17 nt, Human
ugagcaguagaagaugc

SEQ ID NO: 564171 - RNA, 22 nt, Human
caggcucgguccaguggcaccc

SEQ ID NO: 564172 - RNA, 22 nt, Human
aggagccauugcaggauggcag

SEQ ID NO: 564173 - RNA, 22 nt, Human
uuucaaguagagggaucgcuag

SEQ ID NO: 564174 - RNA, 22 nt, Human
gcugggucucucccugguccug

SEQ ID NO: 564175 - RNA, 19 nt, Human
acccucuccccacuggguc

SEQ ID NO: 564176 - RNA, 22 nt, Human
gcucgguggccagccugaggcc

SEQ ID NO: 564177 - RNA, 22 nt, Human
gacagcagccacagggagaggg

SEQ ID NO: 564178 - RNA, 22 nt, Human
uagcugcacaggaaguaagauu

SEQ ID NO: 564179 - RNA, 23 nt, Human
gguucugccgcuuacugcugugc

SEQ ID NO: 564180 - RNA, 22 nt, Human
gagcuguguaugcaucauucug

SEQ ID NO: 564181 - RNA, 21 nt, Human
uuggaacaagcagcaguuugc

SEQ ID NO: 564182 - RNA, 22 nt, Human
cugagcacguaguuagggucca

SEQ ID NO: 564183 - RNA, 22 nt, Human
agauuucaauggauauugcaag

SEQ ID NO: 564184 - RNA, 22 nt, Human
ucucugucucccguguguccgg

SEQ ID NO: 564185 - RNA, 22 nt, Human
agcaugucuaacucuucagggu

SEQ ID NO: 564186 - RNA, 22 nt, Human
ccagagacaaggagcuggaguc

SEQ ID NO: 564187 - RNA, 22 nt, Human
ggcagagcuugcagugagccga

SEQ ID NO: 564188 - RNA, 20 nt, Human
guggcagugguggcagcagu

SEQ ID NO: 564189 - RNA, 22 nt, Human
gugauuucaaauauagagugag

SEQ ID NO: 564190 - RNA, 23 nt, Human
gccagagcugccugcccuugcug

SEQ ID NO: 564191 - RNA, 22 nt, Human
gaggcuggcagaaaagcacagg

SEQ ID NO: 564192 - RNA, 22 nt, Human
ggagcggagggagggccacugu

SEQ ID NO: 564193 - RNA, 22 nt, Human
acagcuggccgaggcucaggga

SEQ ID NO: 564194 - RNA, 17 nt, Human
gcguguccccgcgucuc

SEQ ID NO: 564195 - RNA, 22 nt, Human
aaaggagacuucagaucuccuu

SEQ ID NO: 564196 - RNA, 22 nt, Human
ccccacaccugccgggcagcag

SEQ ID NO: 564197 - RNA, 22 nt, Human
ucuccaggcuuaaucucagcuu

SEQ ID NO: 564198 - RNA, 21 nt, Human
aggcaugagcccugcauggac

SEQ ID NO: 564199 - RNA, 17 nt, Human
agcagcuggguugaucu

SEQ ID NO: 564200 - RNA, 22 nt, Human
agcuuuauuugucauucacggc

SEQ ID NO: 564201 - RNA, 22 nt, Human
auggccugcagugcugccacag

SEQ ID NO: 564202 - RNA, 22 nt, Human
cuccguggcuguggacgcagcc

SEQ ID NO: 564203 - RNA, 22 nt, Human
guggcagcggcccaggccgucu

SEQ ID NO: 564204 - RNA, 18 nt, Human
ucagacaaguuagacagg

SEQ ID NO: 564205 - RNA, 22 nt, Human
aaguuauugguggagagcacug

SEQ ID NO: 564206 - RNA, 23 nt, Human
agcccagcagagaaccuaggucc

SEQ ID NO: 564207 - RNA, 22 nt, Human
uuccuggggacuuaccgucauu

SEQ ID NO: 564208 - RNA, 22 nt, Human
ccaggcagccugcuccauucug

SEQ ID NO: 564209 - RNA, 21 nt, Human
gcuguucggcggcccucgcgc

SEQ ID NO: 564210 - RNA, 22 nt, Human
gcggccuuguggcggagcaggc

SEQ ID NO: 564211 - RNA, 22 nt, Human
cacgugcaggucuuaggagaca

SEQ ID NO: 564212 - RNA, 22 nt, Human
ugaggucuguccugucuuugga

SEQ ID NO: 564213 - RNA, 22 nt, Human
ucuggcuucaacuuuacugaaa

SEQ ID NO: 564214 - RNA, 22 nt, Human
ccacccagccagaugcaggaag

SEQ ID NO: 564215 - RNA, 22 nt, Human
uccccaguaagccugcacugug

SEQ ID NO: 564216 - RNA, 19 nt, Human
gcuuccagcacugcaggag

SEQ ID NO: 564217 - RNA, 22 nt, Human
agucaacauuugagaugcaaug

SEQ ID NO: 564218 - RNA, 22 nt, Human
gggcacagucugcagcccccca

SEQ ID NO: 564219 - RNA, 22 nt, Human
gaaagagaaccugggccuagau

SEQ ID NO: 564220 - RNA, 22 nt, Human
ugcauuucccauuguguggcuc

SEQ ID NO: 564221 - RNA, 19 nt, Human
ggguccauggugucaagga

SEQ ID NO: 564222 - RNA, 22 nt, Human
uaaaucccuacaucuguguuuu

SEQ ID NO: 564223 - RNA, 22 nt, Human
agcaguuuauccucauaaugga

SEQ ID NO: 564224 - RNA, 22 nt, Human
gccacguagaagugccgcgaga

SEQ ID NO: 564225 - RNA, 21 nt, Human
gccaccucaaucuucuagcgc

SEQ ID NO: 564226 - RNA, 22 nt, Human
ccgggagguggagauugcggug

SEQ ID NO: 564227 - RNA, 22 nt, Human
ccuccugggccuugcucuguga

SEQ ID NO: 564228 - RNA, 21 nt, Human
uaggugggagccccaguaugc

SEQ ID NO: 564229 - RNA, 22 nt, Human
agccacagucuguagccagcuu

SEQ ID NO: 564230 - RNA, 22 nt, Human
uuucucagccuccuugcuggag

SEQ ID NO: 564231 - RNA, 22 nt, Human
ugcagaauauucuggugacaau

SEQ ID NO: 564232 - RNA, 22 nt, Human
gcuuuuauuucuucacaaaagu

SEQ ID NO: 564233 - RNA, 22 nt, Human
gcagagcacccugcagugguau

SEQ ID NO: 564234 - RNA, 22 nt, Human
aucucuguaaaccauaaauuga

SEQ ID NO: 564235 - RNA, 22 nt, Human
cccuguccugcuaggcccuggu

SEQ ID NO: 564236 - RNA, 22 nt, Human
ugcucagaauugcgcuggugga

SEQ ID NO: 564237 - RNA, 22 nt, Human
cagaaagcaguugucaaugggc

SEQ ID NO: 564238 - RNA, 22 nt, Human
uccaggaguccuggguggcccc

SEQ ID NO: 564239 - RNA, 22 nt, Human
gagaugugucagguccuggggg

SEQ ID NO: 564240 - RNA, 22 nt, Human
uguaauguuagaaacaauugcu

SEQ ID NO: 564241 - RNA, 22 nt, Human
aaggagucugggccauucagag

SEQ ID NO: 564242 - RNA, 22 nt, Human
aguuuccacuggagacacugug

SEQ ID NO: 564243 - RNA, 19 nt, Human
gggugaggaagagcguugc

SEQ ID NO: 564244 - RNA, 22 nt, Human
uaugcuguauucuguauguuag

SEQ ID NO: 564245 - RNA, 22 nt, Human
caugggaauaaaguuauuucaa

SEQ ID NO: 564246 - RNA, 22 nt, Human
ugacagcccaccucacaggauu

SEQ ID NO: 564247 - RNA, 17 nt, Human
cagucacaggucuuuuc

SEQ ID NO: 564248 - RNA, 22 nt, Human
ugaggcuggaugggaugccucc

SEQ ID NO: 564249 - RNA, 22 nt, Human
cugagcagucuagccagguguu

SEQ ID NO: 564250 - RNA, 22 nt, Human
agcacguucuucauuacuucac

SEQ ID NO: 564251 - RNA, 22 nt, Human
aguggcaguagaugagcugguu

SEQ ID NO: 564252 - RNA, 22 nt, Human
guuucuuauuucaacuggaaca

SEQ ID NO: 564253 - RNA, 18 nt, Human
ggccucagccuggccgga

SEQ ID NO: 564254 - RNA, 22 nt, Human
cuuccagugcauagguagauca

SEQ ID NO: 564255 - RNA, 22 nt, Human
gguuguaguuggagguuguaua

SEQ ID NO: 564256 - RNA, 22 nt, Human
ggugacgaauccauagcaucga

SEQ ID NO: 564257 - RNA, 22 nt, Human
uggcuccuuccgcagcaugccu

SEQ ID NO: 564258 - RNA, 22 nt, Human
agacagcgaggacagaggggug

SEQ ID NO: 564259 - RNA, 19 nt, Human
ugguucuccuuccacaguc

SEQ ID NO: 564260 - RNA, 22 nt, Human
caggacccaucagccaggcacu

SEQ ID NO: 564261 - RNA, 22 nt, Human
aaacacaucauucaugucguca

SEQ ID NO: 564262 - RNA, 22 nt, Human
cagugcagccaaggacaggcac

SEQ ID NO: 564263 - RNA, 22 nt, Human
acucgcggcggacggcggccag

SEQ ID NO: 564264 - RNA, 22 nt, Human
ugaguccagaugggccagcagg

SEQ ID NO: 564265 - RNA, 22 nt, Human
ugggaagauaugagugaccaac

SEQ ID NO: 564266 - RNA, 22 nt, Human
auguaacauaugugaucgcauu

SEQ ID NO: 564267 - RNA, 22 nt, Human
gcccaguggcaucuucacugcu

SEQ ID NO: 564268 - RNA, 22 nt, Human
ugcauguuucuguauguuaaug

SEQ ID NO: 564269 - RNA, 22 nt, Human
ucaccuguucaacagcaauaau

SEQ ID NO: 564270 - RNA, 22 nt, Human
ucaccgccuugcccggccgggc

SEQ ID NO: 564271 - RNA, 22 nt, Human
uguggagcccccaggagugggg

SEQ ID NO: 564272 - RNA, 22 nt, Human
gccagcagcucuugggcgggca

SEQ ID NO: 564273 - RNA, 22 nt, Human
uuuauucucuaguuggucagau

SEQ ID NO: 564274 - RNA, 22 nt, Human
ugcuugucacccugccugagug

SEQ ID NO: 564275 - RNA, 22 nt, Human
cagacguuggaggaaauauacc

SEQ ID NO: 564276 - RNA, 22 nt, Human
gccagagaggccuuagaaucca

SEQ ID NO: 564277 - RNA, 21 nt, Human
uccaaaggagacugagugugu

SEQ ID NO: 564278 - RNA, 22 nt, Human
cagggagaucuuggcuccuggu

SEQ ID NO: 564279 - RNA, 23 nt, Human
acucguggaauucucugcgaucg

SEQ ID NO: 564280 - RNA, 22 nt, Human
gacagcaggaugugaggggaug

SEQ ID NO: 564281 - RNA, 20 nt, Human
ucaggguuucccauucuugg

SEQ ID NO: 564282 - RNA, 22 nt, Human
gaggcuguaacuugggcacugg

SEQ ID NO: 564283 - RNA, 22 nt, Human
uggaaauacaagaaguauguca

SEQ ID NO: 564284 - RNA, 19 nt, Human
ccugugucccacguagaug

SEQ ID NO: 564285 - RNA, 22 nt, Human
acgucuucguuggcagagauuu

SEQ ID NO: 564286 - RNA, 22 nt, Human
gccggggcuggggagagacaug

SEQ ID NO: 564287 - RNA, 22 nt, Human
aaggcuuugugcugaguugucg

SEQ ID NO: 564288 - RNA, 22 nt, Human
cgugcggccucggggcccggcu

SEQ ID NO: 564289 - RNA, 22 nt, Human
cuguuccuccaccucaacaaac

SEQ ID NO: 564290 - RNA, 22 nt, Human
agggugcccaccgcuucugccc

SEQ ID NO: 564291 - RNA, 22 nt, Human
caggagcucaagaccacccugg

SEQ ID NO: 564292 - RNA, 22 nt, Human
cagcccacugccucugugguag

SEQ ID NO: 564293 - RNA, 22 nt, Human
augcauaucuccuaucuccuca

SEQ ID NO: 564294 - RNA, 22 nt, Human
gugccgcuggagcuggaauuga

SEQ ID NO: 564295 - RNA, 22 nt, Human
ugcaaaaagagcgaggagcccu

SEQ ID NO: 564296 - RNA, 22 nt, Human
gcaugagacuagcucaugagca

SEQ ID NO: 564297 - RNA, 22 nt, Human
acacggcacuuuaggaaggggc

SEQ ID NO: 564298 - RNA, 22 nt, Human
cccagcauuucugggcugcacu

SEQ ID NO: 564299 - RNA, 22 nt, Human
auauaugaagaagucuugauua

SEQ ID NO: 564300 - RNA, 23 nt, Human
agguggagcugugcagccggggc

SEQ ID NO: 564301 - RNA, 21 nt, Human
ccaccaggucuucugcucggg

SEQ ID NO: 564302 - RNA, 22 nt, Human
gccagcuggcugcaggucccag

SEQ ID NO: 564303 - RNA, 22 nt, Human
gguggcugugagcauuauguga

SEQ ID NO: 564304 - RNA, 22 nt, Human
uccuucagaggacggcagccag

SEQ ID NO: 564305 - RNA, 22 nt, Human
gcccagcugagaagcgcggggc

SEQ ID NO: 564306 - RNA, 22 nt, Human
gagcugggaagauagcuugagc

SEQ ID NO: 564307 - RNA, 22 nt, Human
uugaccacugaaugguucugaa

SEQ ID NO: 564308 - RNA, 22 nt, Human
gccaugaacucgggcauggaga

SEQ ID NO: 564309 - RNA, 22 nt, Human
ucugcuguuuacugugugauau

SEQ ID NO: 564310 - RNA, 22 nt, Human
caucccugauuccuaguacagu

SEQ ID NO: 564311 - RNA, 22 nt, Human
accuuguuguagguacaaaaga

SEQ ID NO: 564312 - RNA, 22 nt, Human
agagaagcagggagucaucugu

SEQ ID NO: 564313 - RNA, 22 nt, Human
cagcauggagacaaagugggca

SEQ ID NO: 564314 - RNA, 22 nt, Human
gggucagggaggccccaccaug

SEQ ID NO: 564315 - RNA, 22 nt, Human
augaucaagaauuuuguauucc

SEQ ID NO: 564316 - RNA, 22 nt, Human
cugcgugguaggacucaguucu

SEQ ID NO: 564317 - RNA, 22 nt, Human
ugggcaaggcuggagccugcag

SEQ ID NO: 564318 - RNA, 19 nt, Human
uccuugacuguauucagag

SEQ ID NO: 564319 - RNA, 22 nt, Human
acuucagugugguauaaaacgu

SEQ ID NO: 564320 - RNA, 23 nt, Human
agugggcucaguccuccaacccc

SEQ ID NO: 564321 - RNA, 22 nt, Human
ggcagcaggguagccauuucuc

SEQ ID NO: 564322 - RNA, 18 nt, Human
uggcaugcuuugauacau

SEQ ID NO: 564323 - RNA, 22 nt, Human
gaugugucccuuucaacucaga

SEQ ID NO: 564324 - RNA, 22 nt, Human
auuguugacuugauuacucaac

SEQ ID NO: 564325 - RNA, 22 nt, Human
ccaagcuggacagcagcaagga

SEQ ID NO: 564326 - RNA, 22 nt, Human
ugucggccacgagggagccgcg

SEQ ID NO: 564327 - RNA, 22 nt, Human
uuucuuggucuucccgaccugg

SEQ ID NO: 564328 - RNA, 19 nt, Human
cuggcuucaagcaguccuc

SEQ ID NO: 564329 - RNA, 22 nt, Human
cuggcagcugcccgagaugccc

SEQ ID NO: 564330 - RNA, 22 nt, Human
gcgacgcaggcacgacguguug

SEQ ID NO: 564331 - RNA, 22 nt, Human
gcucguugaaccuguccccgag

SEQ ID NO: 564332 - RNA, 22 nt, Human
gucccagaggacagggucacau

SEQ ID NO: 564333 - RNA, 22 nt, Human
cucguugcugaagccaaaguca

SEQ ID NO: 564334 - RNA, 22 nt, Human
ucacugaauuucaagcuagugg

SEQ ID NO: 564335 - RNA, 22 nt, Human
uggcauuggaauuuguguugca

SEQ ID NO: 564336 - RNA, 22 nt, Human
gagguauaguucuauuagauga

SEQ ID NO: 564337 - RNA, 22 nt, Human
gccuggggaacuugauccuguc

SEQ ID NO: 564338 - RNA, 23 nt, Human
cagcacaguacauuuccugucuc

SEQ ID NO: 564339 - RNA, 22 nt, Human
agggagcauugugacauaucac

SEQ ID NO: 564340 - RNA, 22 nt, Human
uaucugucgggagucuuccgga

SEQ ID NO: 564341 - RNA, 22 nt, Human
aaggcacauauuuuagagucac

SEQ ID NO: 564342 - RNA, 22 nt, Human
uagaagaugccuuaaaguugaa

SEQ ID NO: 564343 - RNA, 22 nt, Human
ggaauccugguguuuucugccu

SEQ ID NO: 564344 - RNA, 22 nt, Human
gccggucuuaagcugacuguga

SEQ ID NO: 564345 - RNA, 22 nt, Human
ucaggccaggagaucagauuga

SEQ ID NO: 564346 - RNA, 22 nt, Human
cccugauguuuucucugccuuu

SEQ ID NO: 564347 - RNA, 22 nt, Human
guauuaugaaugccgaggcggc

SEQ ID NO: 564348 - RNA, 22 nt, Human
uagcccauggacuggucagcug

SEQ ID NO: 564349 - RNA, 22 nt, Human
cugggcccaggcggcucucgga

SEQ ID NO: 564350 - RNA, 22 nt, Human
gugcuccaggucgcucagagag

SEQ ID NO: 564351 - RNA, 22 nt, Human
agacuucucuaacuugaggacc

SEQ ID NO: 564352 - RNA, 22 nt, Human
gaggcugugugucccucuggac

SEQ ID NO: 564353 - RNA, 22 nt, Human
uucaaaccuaucuaagaaauag

SEQ ID NO: 564354 - RNA, 22 nt, Human
ugcccagucuccgggccagccc

SEQ ID NO: 564355 - RNA, 22 nt, Human
ugccgcgcgcccagguuaggug

SEQ ID NO: 564356 - RNA, 21 nt, Human
agggaaaaggcugagugaggg

SEQ ID NO: 564357 - RNA, 22 nt, Human
guuguuuuugaacggugguggc

SEQ ID NO: 564358 - RNA, 22 nt, Human
gcagcaaucuucacagugucau

SEQ ID NO: 564359 - RNA, 22 nt, Human
uuccggacgcccgucuuccagc

SEQ ID NO: 564360 - RNA, 22 nt, Human
cagcccaggacugcagguguuu

SEQ ID NO: 564361 - RNA, 21 nt, Human
ucucugacccaggaagagggc

SEQ ID NO: 564362 - RNA, 22 nt, Human
gucuuuuuuacaccuuacauca

SEQ ID NO: 564363 - RNA, 22 nt, Human
gccugaucagguccucggcaua

SEQ ID NO: 564364 - RNA, 22 nt, Human
gguccccguggaggcuggagcg

SEQ ID NO: 564365 - RNA, 22 nt, Human
aggaaagcucccaguagggcuc

SEQ ID NO: 564366 - RNA, 22 nt, Human
aguuggaagacacccugaaauc

SEQ ID NO: 564367 - RNA, 22 nt, Human
cagcuccaucuugcuuauacca

SEQ ID NO: 564368 - RNA, 22 nt, Human
gaguaaaagaugaggcaguaga

SEQ ID NO: 564369 - RNA, 22 nt, Human
ggcggcacgcaggcugcugucg

SEQ ID NO: 564370 - RNA, 22 nt, Human
gcagaagucagaccaucugaau

SEQ ID NO: 564371 - RNA, 22 nt, Human
cgcgcugcagacagcggaggcc

SEQ ID NO: 564372 - RNA, 22 nt, Human
agcacugugagcaccagcacgc

SEQ ID NO: 564373 - RNA, 22 nt, Human
gaugauuacacuuuuaaaacag

SEQ ID NO: 564374 - RNA, 22 nt, Human
gcaaggaagcagaguugcuauc

SEQ ID NO: 564375 - RNA, 21 nt, Human
gcccacagugaggaggauccc

SEQ ID NO: 564376 - RNA, 21 nt, Human
ggucaggcaugugcccugagc

SEQ ID NO: 564377 - RNA, 22 nt, Human
auucuggacaaggcaagcuccu

SEQ ID NO: 564378 - RNA, 22 nt, Human
cccaggaacagcacagaacagc

SEQ ID NO: 564379 - RNA, 22 nt, Human
agcaccagcucaaggugcaccu

SEQ ID NO: 564380 - RNA, 22 nt, Human
acaguucuguccuagacuucgu

SEQ ID NO: 564381 - RNA, 22 nt, Human
ccagcuggaacggcagcccagc

SEQ ID NO: 564382 - RNA, 19 nt, Human
cuccacagggauugugauu

SEQ ID NO: 564383 - RNA, 22 nt, Human
agggccagcagcuuggccaacc

SEQ ID NO: 564384 - RNA, 18 nt, Human
uggggggcuugucugaag

SEQ ID NO: 564385 - RNA, 18 nt, Human
gccuggcuucggagccgc

SEQ ID NO: 564386 - RNA, 22 nt, Human
ugcaugguguaauucuaaugcu

SEQ ID NO: 564387 - RNA, 22 nt, Human
uuuggaaaugagaagccaccuu

SEQ ID NO: 564388 - RNA, 22 nt, Human
gaagauuaccugagaccacuug

SEQ ID NO: 564389 - RNA, 22 nt, Human
auggaggaugugcagcaugggc

SEQ ID NO: 564390 - RNA, 22 nt, Human
agaggaaguaaucaggaccugc

SEQ ID NO: 564391 - RNA, 22 nt, Human
acacugagcuuccaagaugggg

SEQ ID NO: 564392 - RNA, 22 nt, Human
gccuggcaaggcccuguugacu

SEQ ID NO: 564393 - RNA, 22 nt, Human
auuccucagcaggccuuuuguu

SEQ ID NO: 564394 - RNA, 19 nt, Human
gagcagcuuccuaucuggu

SEQ ID NO: 564395 - RNA, 19 nt, Human
agugagcauggcuugacug

SEQ ID NO: 564396 - RNA, 22 nt, Human
caggcuguguuccuggaacccc

SEQ ID NO: 564397 - RNA, 22 nt, Human
auggguggccccgugugcaguc

SEQ ID NO: 564398 - RNA, 22 nt, Human
agauaaaguccaaacuguguag

SEQ ID NO: 564399 - RNA, 22 nt, Human
uggcuggcuguccagcugggca

SEQ ID NO: 564400 - RNA, 22 nt, Human
ggacauugaagcuggaaaggga

SEQ ID NO: 564401 - RNA, 22 nt, Human
guuagguagaaguuuacuuuga

SEQ ID NO: 564402 - RNA, 22 nt, Human
augaugaagcaugguuacacug

SEQ ID NO: 564403 - RNA, 22 nt, Human
agccacugugugaccagcuguc

SEQ ID NO: 564404 - RNA, 22 nt, Human
gacuuugccacuugcuccagcu

SEQ ID NO: 564405 - RNA, 22 nt, Human
cuacagaauucaacaaaugguu

SEQ ID NO: 564406 - RNA, 22 nt, Human
ggcgcaguugagcgugcuguuc

SEQ ID NO: 564407 - RNA, 22 nt, Human
uggccucuccuggcagcaucca

SEQ ID NO: 564408 - RNA, 22 nt, Human
acaugcacccaguuacacucuc

SEQ ID NO: 564409 - RNA, 22 nt, Human
ucaagcggacugagauacucug

SEQ ID NO: 564410 - RNA, 22 nt, Human
gcagcccaggaggcgggagccc

SEQ ID NO: 564411 - RNA, 22 nt, Human
gcuguccugggaacaggcacua

SEQ ID NO: 564412 - RNA, 22 nt, Human
gaauguuaaugcacuucuagcu

SEQ ID NO: 564413 - RNA, 18 nt, Human
ggaaggugcuggagugca

SEQ ID NO: 564414 - RNA, 22 nt, Human
gugcagcugggcgcugaccuuc

SEQ ID NO: 564415 - RNA, 22 nt, Human
aagaaaagguaaccgcuuaucu

SEQ ID NO: 564416 - RNA, 22 nt, Human
aacccaggaguuggaggcugug

SEQ ID NO: 564417 - RNA, 22 nt, Human
cagggagccccaauuccaugcc

SEQ ID NO: 564418 - RNA, 22 nt, Human
accagucauagaaagcaguggu

SEQ ID NO: 564419 - RNA, 22 nt, Human
gugcuaaugaauuggagugccu

SEQ ID NO: 564420 - RNA, 16 nt, Human
ggcagcagcuccgugc

SEQ ID NO: 564421 - RNA, 22 nt, Human
cagcaguacuucucagagguau

SEQ ID NO: 564422 - RNA, 22 nt, Human
aaggaggaauguagccagcucc

SEQ ID NO: 564423 - RNA, 22 nt, Human
augugaaagagguguucagugg

SEQ ID NO: 564424 - RNA, 22 nt, Human
ugagaacaaaguugaaaguuug

SEQ ID NO: 564425 - RNA, 22 nt, Human
gcugauggcuugcuggcugaca

SEQ ID NO: 564426 - RNA, 17 nt, Human
gcaggcacugcugccug

SEQ ID NO: 564427 - RNA, 22 nt, Human
ugugguuuugguucagaaacaa

SEQ ID NO: 564428 - RNA, 21 nt, Human
aacaggucccccacgggcuuu

SEQ ID NO: 564429 - RNA, 22 nt, Human
uguguuucugagaaucccaccu

SEQ ID NO: 564430 - RNA, 18 nt, Human
gaaggcauucaguggcuu

SEQ ID NO: 564431 - RNA, 22 nt, Human
agaaaucugacugcugugcaca

SEQ ID NO: 564432 - RNA, 20 nt, Human
ggcagagcuaugucuguugc

SEQ ID NO: 564433 - RNA, 22 nt, Human
gcaccgagaaggaagcaugccu

SEQ ID NO: 564434 - RNA, 22 nt, Human
guugugcaaacacuggggucug

SEQ ID NO: 564435 - RNA, 22 nt, Human
cuggcaguguccagcucgugau

SEQ ID NO: 564436 - RNA, 22 nt, Human
ccccuuucucccgcgucuggcc

SEQ ID NO: 564437 - RNA, 22 nt, Human
uuugaacuucuaccugucauau

SEQ ID NO: 564438 - RNA, 22 nt, Human
ccucuggccuaggccgggagag

SEQ ID NO: 564439 - RNA, 23 nt, Human
uggaaacauucugaauguccauc

SEQ ID NO: 564440 - RNA, 22 nt, Human
aggccagaacagcucugcacca

SEQ ID NO: 564441 - RNA, 22 nt, Human
caggaugccuuugaacucugga

SEQ ID NO: 564442 - RNA, 22 nt, Human
uugcucuauguuuguaaacaga

SEQ ID NO: 564443 - RNA, 22 nt, Human
uaaauacuuuuacuccacugau

SEQ ID NO: 564444 - RNA, 19 nt, Human
aggaaggcggcggcugccc

SEQ ID NO: 564445 - RNA, 22 nt, Human
gcagcugcgaagaagucuaucu

SEQ ID NO: 564446 - RNA, 20 nt, Human
cgggacacucaagcucuggg

SEQ ID NO: 564447 - RNA, 22 nt, Human
cagcuccagccaccggggggug

SEQ ID NO: 564448 - RNA, 22 nt, Human
uuugcaaaguccauugaaguua

SEQ ID NO: 564449 - RNA, 22 nt, Human
aguggcuguuccaggugaggac

SEQ ID NO: 564450 - RNA, 22 nt, Human
caggucuucuucagcacuugga

SEQ ID NO: 564451 - RNA, 22 nt, Human
caaagcccagaggccucacuuu

SEQ ID NO: 564452 - RNA, 22 nt, Human
ggucuuucuuugauaguggaga

SEQ ID NO: 564453 - RNA, 22 nt, Human
gucugcacgugccagggagggg

SEQ ID NO: 564454 - RNA, 22 nt, Human
uagaugaacagaaagccacugu

SEQ ID NO: 564455 - RNA, 22 nt, Human
aggugccugucgucucugguua

SEQ ID NO: 564456 - RNA, 22 nt, Human
aggacaaaggaccagaucugga

SEQ ID NO: 564457 - RNA, 22 nt, Human
cugcgggcugucaggcgugcca

SEQ ID NO: 564458 - RNA, 22 nt, Human
uggccaggcagguagaacggcc

SEQ ID NO: 564459 - RNA, 23 nt, Human
uggggcugauggagacggaccag

SEQ ID NO: 564460 - RNA, 22 nt, Human
uggcugggagcuggaacugggc

SEQ ID NO: 564461 - RNA, 22 nt, Human
aagcagaaaaacugagcuccaa

SEQ ID NO: 564462 - RNA, 22 nt, Human
aggaggguggggucugccuguc

SEQ ID NO: 564463 - RNA, 22 nt, Human
ugcuggcugggcugcuggagac

SEQ ID NO: 564464 - RNA, 22 nt, Human
aaccccgcucaggcugggugag

SEQ ID NO: 564465 - RNA, 22 nt, Human
gggcggggcuuccguccuccac

SEQ ID NO: 564466 - RNA, 22 nt, Human
agaagugaguugugacuauggg

SEQ ID NO: 564467 - RNA, 21 nt, Human
gcacuucugcagggcugcugg

SEQ ID NO: 564468 - RNA, 22 nt, Human
acuguagucuaaauauagucuu

SEQ ID NO: 564469 - RNA, 22 nt, Human
cuuguauuaggaagaaugcuuu

SEQ ID NO: 564470 - RNA, 22 nt, Human
gaggagcuucagaggaaucuua

SEQ ID NO: 564471 - RNA, 22 nt, Human
agcugccgaugcccagcugcau

SEQ ID NO: 564472 - RNA, 22 nt, Human
aggugugcaggaugaaccccuc

SEQ ID NO: 564473 - RNA, 22 nt, Human
ugcaggaacucgaaaacuauag

SEQ ID NO: 564474 - RNA, 22 nt, Human
cuuucuuucgaagacgugauua

SEQ ID NO: 564475 - RNA, 22 nt, Human
gggacagcuguagugcuuggcu

SEQ ID NO: 564476 - RNA, 22 nt, Human
ggaagaggcugaggccaugcug

SEQ ID NO: 564477 - RNA, 22 nt, Human
aagcacagggacucaggaccgg

SEQ ID NO: 564478 - RNA, 22 nt, Human
gccagguaugaauuacgcacga

SEQ ID NO: 564479 - RNA, 22 nt, Human
uggcugagcugcagcguggcuu

SEQ ID NO: 564480 - RNA, 22 nt, Human
cgcagcugcugcucugaaacag

SEQ ID NO: 564481 - RNA, 22 nt, Human
agauguuuuuccaggucuaauu

SEQ ID NO: 564482 - RNA, 22 nt, Human
ccagcagcgauagggugagugc

SEQ ID NO: 564483 - RNA, 22 nt, Human
gccaccagccccaugcgcugug

SEQ ID NO: 564484 - RNA, 22 nt, Human
gcccagcugcacccuggugggu

SEQ ID NO: 564485 - RNA, 22 nt, Human
gcauuacuucuuucauagguca

SEQ ID NO: 564486 - RNA, 22 nt, Human
ugggugguugcugaggcuccuu

SEQ ID NO: 564487 - RNA, 22 nt, Human
cucacaggguucuaucgaagag

SEQ ID NO: 564488 - RNA, 22 nt, Human
gcugcugcuugaaggcucggag

SEQ ID NO: 564489 - RNA, 19 nt, Human
ucuuucauuucuagcucug

SEQ ID NO: 564490 - RNA, 22 nt, Human
gcaggcuuauggggagacagag

SEQ ID NO: 564491 - RNA, 22 nt, Human
gggcugagggguaucucauggg

SEQ ID NO: 564492 - RNA, 18 nt, Human
uauaaacacacuuagguu

SEQ ID NO: 564493 - RNA, 22 nt, Human
cgccccagccaguugagcggcg

SEQ ID NO: 564494 - RNA, 22 nt, Human
ggaagcuguuaucaucuguauc

SEQ ID NO: 564495 - RNA, 22 nt, Human
uucaguaugcugaaugauuuuu

SEQ ID NO: 564496 - RNA, 22 nt, Human
uggccagaacucagacaugugg

SEQ ID NO: 564497 - RNA, 22 nt, Human
auuuacugagguaaauaaacug

SEQ ID NO: 564498 - RNA, 22 nt, Human
gugcaggacagcacaucuccug

SEQ ID NO: 564499 - RNA, 22 nt, Human
cggcagcgguuggagguuguag

SEQ ID NO: 564500 - RNA, 22 nt, Human
acugugugccaggcgcuggucu

SEQ ID NO: 564501 - RNA, 22 nt, Human
ggcuuuuguuucagcucugcua

SEQ ID NO: 564502 - RNA, 22 nt, Human
cagggccugccugguuccugga

SEQ ID NO: 564503 - RNA, 22 nt, Human
auagacacagcuaugauuugag

SEQ ID NO: 564504 - RNA, 22 nt, Human
aacuagaaagaacauauuucca

SEQ ID NO: 564505 - RNA, 22 nt, Human
agggggcuccuuggugugcaga

SEQ ID NO: 564506 - RNA, 22 nt, Human
gcugccuggaauaacggcuggc

SEQ ID NO: 564507 - RNA, 22 nt, Human
ugcccguggccuggggcagcuu

SEQ ID NO: 564508 - RNA, 22 nt, Human
gggcuccagccaggugucccca

SEQ ID NO: 564509 - RNA, 22 nt, Human
cagacaggguccuguccgucac

SEQ ID NO: 564510 - RNA, 22 nt, Human
gagcucauccccaugguccguc

SEQ ID NO: 564511 - RNA, 22 nt, Human
gugcagcugguggagucugggg

SEQ ID NO: 564512 - RNA, 22 nt, Human
uggcagcagggccccuggagga

SEQ ID NO: 564513 - RNA, 22 nt, Human
gagcaccgccuccacgaugccc

SEQ ID NO: 564514 - RNA, 22 nt, Human
cugcaccgugucucgggcugcc

SEQ ID NO: 564515 - RNA, 22 nt, Human
uagucaccuguugugugaugcc

SEQ ID NO: 564516 - RNA, 22 nt, Human
acaguguuucacuuaaccguuu

SEQ ID NO: 564517 - RNA, 22 nt, Human
cagggccagggcuauggugaag

SEQ ID NO: 564518 - RNA, 22 nt, Human
uguuccucugaacuucuuccaa

SEQ ID NO: 564519 - RNA, 22 nt, Human
cccaccagaccugcaccggcac

SEQ ID NO: 564520 - RNA, 22 nt, Human
caauaaaguggaggcccgggcu

SEQ ID NO: 564521 - RNA, 22 nt, Human
cagagccaaaccucagggcccg

SEQ ID NO: 564522 - RNA, 22 nt, Human
ucagaacauccugguuuaaaau

SEQ ID NO: 564523 - RNA, 22 nt, Human
gugcucuagaaauugucagugg

SEQ ID NO: 564524 - RNA, 22 nt, Human
uggugcagacaggagccccgcu

SEQ ID NO: 564525 - RNA, 22 nt, Human
ccaagagcuucccauagcuucu

SEQ ID NO: 564526 - RNA, 22 nt, Human
caggaacacaaugagucucaaa

SEQ ID NO: 564527 - RNA, 22 nt, Human
ucccagccugacagugcaucaa

SEQ ID NO: 564528 - RNA, 22 nt, Human
guccuguguaaguacuugcuca

SEQ ID NO: 564529 - RNA, 20 nt, Human
acuagaaagucacugggggg

SEQ ID NO: 564530 - RNA, 22 nt, Human
ugcacagagggaggcauaaaau

SEQ ID NO: 564531 - RNA, 22 nt, Human
auuccaaagccugaauaaugga

SEQ ID NO: 564532 - RNA, 22 nt, Human
cagaggccuggcuuggacaccu

SEQ ID NO: 564533 - RNA, 22 nt, Human
guguguggaaugcucauuuauu

SEQ ID NO: 564534 - RNA, 22 nt, Human
cuguucccgguggccgggccag

SEQ ID NO: 564535 - RNA, 22 nt, Human
ugacucacuuaauuuacaaguc

SEQ ID NO: 564536 - RNA, 22 nt, Human
uuccaaguuaggcgagcuggug

SEQ ID NO: 564537 - RNA, 20 nt, Human
uuugauugccccucugacuu

SEQ ID NO: 564538 - RNA, 22 nt, Human
gggcuccagaggcucacccugg

SEQ ID NO: 564539 - RNA, 20 nt, Human
ggaaaaguacuccuccuuaa

SEQ ID NO: 564540 - RNA, 22 nt, Human
uaagaaacauuuuuaugacagu

SEQ ID NO: 564541 - RNA, 22 nt, Human
aacuugccaagagcuuugcuag

SEQ ID NO: 564542 - RNA, 22 nt, Human
ucccugagcucacauggcagga

SEQ ID NO: 564543 - RNA, 22 nt, Human
agcugaaacuucccauuaauug

SEQ ID NO: 564544 - RNA, 21 nt, Human
caggaacauucuuuacauuua

SEQ ID NO: 564545 - RNA, 22 nt, Human
uaagccugcaugaaccaugaga

SEQ ID NO: 564546 - RNA, 22 nt, Human
cgcugccuucaucccacgccua

SEQ ID NO: 564547 - RNA, 22 nt, Human
auuagccuguugcauuuucacu

SEQ ID NO: 564548 - RNA, 22 nt, Human
gacaagaugacaucauggcuuc

SEQ ID NO: 564549 - RNA, 22 nt, Human
cagaugaaguaggugacgagca

SEQ ID NO: 564550 - RNA, 22 nt, Human
gccaagaaugcgacagccguca

SEQ ID NO: 564551 - RNA, 22 nt, Human
gccaggcaggccacgcuguguu

SEQ ID NO: 564552 - RNA, 22 nt, Human
uccaguggugguuugaagggca

SEQ ID NO: 564553 - RNA, 22 nt, Human
agcagcaggugaccucgaugcc

SEQ ID NO: 564554 - RNA, 18 nt, Human
gaggcacauaguuggggc

SEQ ID NO: 564555 - RNA, 22 nt, Human
cugggagaugacucagagcagg

SEQ ID NO: 564556 - RNA, 22 nt, Human
gaaaccuuugccgauggggucc

SEQ ID NO: 564557 - RNA, 21 nt, Human
agccaggcaagcacccccacu

SEQ ID NO: 564558 - RNA, 22 nt, Human
cugggguccuugccauguguca

SEQ ID NO: 564559 - RNA, 22 nt, Human
gugcuuccuguauugauuccau

SEQ ID NO: 564560 - RNA, 22 nt, Human
uugaugcugucuuucagaauca

SEQ ID NO: 564561 - RNA, 22 nt, Human
agcuaugaagccacuuuuaaca

SEQ ID NO: 564562 - RNA, 21 nt, Human
agcugugguuuuacaucuuuu

SEQ ID NO: 564563 - RNA, 22 nt, Human
aagccuucaguccguugcagag

SEQ ID NO: 564564 - RNA, 22 nt, Human
acgugcuggagaagagcucgcc

SEQ ID NO: 564565 - RNA, 22 nt, Human
ucggaaccgaccugggagcugg

SEQ ID NO: 564566 - RNA, 22 nt, Human
gcugcaggcucugcaggaauug

SEQ ID NO: 564567 - RNA, 22 nt, Human
cuguauaugugcauacacacac

SEQ ID NO: 564568 - RNA, 22 nt, Human
cagguagaggcugccaucagcu

SEQ ID NO: 564569 - RNA, 22 nt, Human
aggugcaucucguagcucuucu

SEQ ID NO: 564570 - RNA, 22 nt, Human
uugauguaauacuuugcaacca

SEQ ID NO: 564571 - RNA, 22 nt, Human
acaugaggaacucaggagucac

SEQ ID NO: 564572 - RNA, 22 nt, Human
cugcuguguggauucaauggcu

SEQ ID NO: 564573 - RNA, 22 nt, Human
cacucacccgguccuucccagu

SEQ ID NO: 564574 - RNA, 22 nt, Human
cugggccacaagccugugugau

SEQ ID NO: 564575 - RNA, 22 nt, Human
ccugugacucugucugaugguc

SEQ ID NO: 564576 - RNA, 22 nt, Human
gguguggcaguggaccugugaa

SEQ ID NO: 564577 - RNA, 22 nt, Human
aagggccagggcucuagagaua

SEQ ID NO: 564578 - RNA, 22 nt, Human
ggcuggccuguguggccgccac

SEQ ID NO: 564579 - RNA, 16 nt, Human
guagccguggccgcug

SEQ ID NO: 564580 - RNA, 22 nt, Human
uguccugugaccuggcaccaca

SEQ ID NO: 564581 - RNA, 18 nt, Human
aguaaauguuaaauauug

SEQ ID NO: 564582 - RNA, 22 nt, Human
cuccccacgccuggacuaagag

SEQ ID NO: 564583 - RNA, 22 nt, Human
gagcugcauagcugggauccuc

SEQ ID NO: 564584 - RNA, 22 nt, Human
uacaaagugauuuuggaauuga

SEQ ID NO: 564585 - RNA, 22 nt, Human
augacagcucuagcacacagua

SEQ ID NO: 564586 - RNA, 22 nt, Human
uaguauuuccuguaagcuauag

SEQ ID NO: 564587 - RNA, 20 nt, Human
cauuccugaggaauucaugu

SEQ ID NO: 564588 - RNA, 22 nt, Human
ucccacacagcccgcucaccgg

SEQ ID NO: 564589 - RNA, 19 nt, Human
cgcacagccugccaggcgc

SEQ ID NO: 564590 - RNA, 22 nt, Human
gauguauagcuuuaacugaccc

SEQ ID NO: 564591 - RNA, 22 nt, Human
gccagccccagacauccuaucg

SEQ ID NO: 564592 - RNA, 22 nt, Human
uuggaggaagcucaugggggau

SEQ ID NO: 564593 - RNA, 22 nt, Human
ugucauauagaauguucuauga

SEQ ID NO: 564594 - RNA, 22 nt, Human
gaccuccguguacaccucccag

SEQ ID NO: 564595 - RNA, 22 nt, Human
auuuccaggaguugaggucuga

SEQ ID NO: 564596 - RNA, 22 nt, Human
agggaagcagcagccgccuguc

SEQ ID NO: 564597 - RNA, 16 nt, Human
uugccgcacaggucgc

SEQ ID NO: 564598 - RNA, 19 nt, Human
gcagcugugggaagagcca

SEQ ID NO: 564599 - RNA, 22 nt, Human
ccucagucuauuuccagcaggu

SEQ ID NO: 564600 - RNA, 22 nt, Human
aggcuuuaauuaucuacaggag

SEQ ID NO: 564601 - RNA, 22 nt, Human
caugcauuucuaccaaggaaua

SEQ ID NO: 564602 - RNA, 22 nt, Human
cuucuccgacaaccgacgccgg

SEQ ID NO: 564603 - RNA, 22 nt, Human
cucucuccuuagcugcagacca

SEQ ID NO: 564604 - RNA, 22 nt, Human
aagagcuggcucuugcagcagc

SEQ ID NO: 564605 - RNA, 22 nt, Human
agcauggcuuuggaggauagca

SEQ ID NO: 564606 - RNA, 22 nt, Human
guguuucccuggcacaagaacc

SEQ ID NO: 564607 - RNA, 22 nt, Human
ugcuccaucuagagcucugcag

SEQ ID NO: 564608 - RNA, 22 nt, Human
ugguacauggguagguaucucu

SEQ ID NO: 564609 - RNA, 16 nt, Human
ugcggcaacuugcggc

SEQ ID NO: 564610 - RNA, 22 nt, Human
cccagcugaacuugcauuccaa

SEQ ID NO: 564611 - RNA, 19 nt, Human
ugguggaggugcaccugac

SEQ ID NO: 564612 - RNA, 22 nt, Human
agugacauuauuuuguguacua

SEQ ID NO: 564613 - RNA, 22 nt, Human
ugagaauacugcauuguuagga

SEQ ID NO: 564614 - RNA, 22 nt, Human
ggugggugagcccugggagcug

SEQ ID NO: 564615 - RNA, 19 nt, Human
augagcuggcauuucaggu

SEQ ID NO: 564616 - RNA, 22 nt, Human
uuucagacaggcucagagccgu

SEQ ID NO: 564617 - RNA, 22 nt, Human
acugccaguuguuuuguccagu

SEQ ID NO: 564618 - RNA, 22 nt, Human
ggcgagcaugagucacucuggg

SEQ ID NO: 564619 - RNA, 22 nt, Human
gccuggagcucggcugagggcg

SEQ ID NO: 564620 - RNA, 22 nt, Human
cagcagcucaggcuccuuccca

SEQ ID NO: 564621 - RNA, 22 nt, Human
gggaagugcccucuucaggaga

SEQ ID NO: 564622 - RNA, 17 nt, Human
gugcuggccuggggcuc

SEQ ID NO: 564623 - RNA, 22 nt, Human
aagggccacaugccauuuaaaa

SEQ ID NO: 564624 - RNA, 23 nt, Human
acauuacacgcaguaauugcccc

SEQ ID NO: 564625 - RNA, 22 nt, Human
ugguaccagcuguguguucacu

SEQ ID NO: 564626 - RNA, 22 nt, Human
ggaaugugcugacacgcgagag

SEQ ID NO: 564627 - RNA, 22 nt, Human
uuuccaaagguggcaggaacaa

SEQ ID NO: 564628 - RNA, 19 nt, Human
ggggcccggggucugcgag

SEQ ID NO: 564629 - RNA, 22 nt, Human
uucuccccgucucucugaggcc

SEQ ID NO: 564630 - RNA, 22 nt, Human
accccagaggcggaggcugcag

SEQ ID NO: 564631 - RNA, 22 nt, Human
gcagugacagacaacuguuuga

SEQ ID NO: 564632 - RNA, 22 nt, Human
auauggcuguugcacaucuaag

SEQ ID NO: 564633 - RNA, 22 nt, Human
gcagcccaggcucgcucacugc

SEQ ID NO: 564634 - RNA, 22 nt, Human
aucugucccuccucacagccuc

SEQ ID NO: 564635 - RNA, 22 nt, Human
uucccagauuggagggcagggg

SEQ ID NO: 564636 - RNA, 22 nt, Human
cagcugccuguauuguccucau

SEQ ID NO: 564637 - RNA, 22 nt, Human
uccgggagcugaacgucuugcg

SEQ ID NO: 564638 - RNA, 22 nt, Human
cgggagccucugggucacacug

SEQ ID NO: 564639 - RNA, 22 nt, Human
ccagcagccaccuucucgaaau

SEQ ID NO: 564640 - RNA, 22 nt, Human
ucagagaaguaggcuaauggug

SEQ ID NO: 564641 - RNA, 21 nt, Human
cacuccacuuagaacaggguu

SEQ ID NO: 564642 - RNA, 22 nt, Human
gagccaggcccguacuugcugu

SEQ ID NO: 564643 - RNA, 22 nt, Human
gucugcugacagagcauggacc

SEQ ID NO: 564644 - RNA, 20 nt, Human
uaugauaauuacaaaauagu

SEQ ID NO: 564645 - RNA, 22 nt, Human
uucuccucagcaaggcagcuuu

SEQ ID NO: 564646 - RNA, 22 nt, Human
aaggggaguuagugauaaaacc

SEQ ID NO: 564647 - RNA, 22 nt, Human
ccuuuuauauggcucaucacag

SEQ ID NO: 564648 - RNA, 22 nt, Human
cagggacugagauccagacugu

SEQ ID NO: 564649 - RNA, 22 nt, Human
cagcagcaggcgcacggccguc

SEQ ID NO: 564650 - RNA, 22 nt, Human
gcgcuccucccggcccuggugg

SEQ ID NO: 564651 - RNA, 22 nt, Human
ugugacagugccagcuucauag

SEQ ID NO: 564652 - RNA, 22 nt, Human
gugggaguggagcucagcaugu

SEQ ID NO: 564653 - RNA, 22 nt, Human
ccagcagcucccucaggguccg

SEQ ID NO: 564654 - RNA, 22 nt, Human
auucuugauauagauaguuaau

SEQ ID NO: 564655 - RNA, 22 nt, Human
uccuuucuucuucugcccaugg

SEQ ID NO: 564656 - RNA, 22 nt, Human
cugucuacagaugaaauaagca

SEQ ID NO: 564657 - RNA, 22 nt, Human
agccccaggcccggacgccucu

SEQ ID NO: 564658 - RNA, 22 nt, Human
uccaggagggggagccgugccg

SEQ ID NO: 564659 - RNA, 22 nt, Human
ucccgggcaggucgagcgagcc

SEQ ID NO: 564660 - RNA, 22 nt, Human
gccugagauuggacauuauuua

SEQ ID NO: 564661 - RNA, 22 nt, Human
cucaguguuaaagacuuuccag

SEQ ID NO: 564662 - RNA, 22 nt, Human
aaugugcugguaacugcuuugc

SEQ ID NO: 564663 - RNA, 22 nt, Human
gguggcagaggugcaucagccc

SEQ ID NO: 564664 - RNA, 23 nt, Human
uggcucugagcuuccugguggcc

SEQ ID NO: 564665 - RNA, 22 nt, Human
gauggugcaggugaagugcugg

SEQ ID NO: 564666 - RNA, 22 nt, Human
agaggcucuuugagcugggaga

SEQ ID NO: 564667 - RNA, 22 nt, Human
augcugugccuggaaagcggcu

SEQ ID NO: 564668 - RNA, 22 nt, Human
uguguuucucugaggggucccu

SEQ ID NO: 564669 - RNA, 22 nt, Human
cuaccugguacauagaaauguu

SEQ ID NO: 564670 - RNA, 22 nt, Human
cucagagagacaaugugggaca

SEQ ID NO: 564671 - RNA, 22 nt, Human
ccggcgucucuuccacuuccua

SEQ ID NO: 564672 - RNA, 22 nt, Human
aaaacuuucagggauacagaaa

SEQ ID NO: 564673 - RNA, 22 nt, Human
cucucuguuaugcuuucaugaa

SEQ ID NO: 564674 - RNA, 23 nt, Human
ugagagccuggcagccuggguuc

SEQ ID NO: 564675 - RNA, 22 nt, Human
gaggaggcuuccgggaggcacg

SEQ ID NO: 564676 - RNA, 22 nt, Human
ggcucugcugguaagaugccuc

SEQ ID NO: 564677 - RNA, 22 nt, Human
uguuuuaagggucaacugucac

SEQ ID NO: 564678 - RNA, 22 nt, Human
cagagcagaaaccugggugauu

SEQ ID NO: 564679 - RNA, 22 nt, Human
uggcugaggagagggcggaagu

SEQ ID NO: 564680 - RNA, 22 nt, Human
uggaaacacccacgcaugcaua

SEQ ID NO: 564681 - RNA, 22 nt, Human
gaggcuggacgugcauuucuac

SEQ ID NO: 564682 - RNA, 22 nt, Human
agggcccaccuuggugcugagg

SEQ ID NO: 564683 - RNA, 22 nt, Human
gugcgggccuggggguuucucu

SEQ ID NO: 564684 - RNA, 22 nt, Human
cuggcacaggauccgagaccuu

SEQ ID NO: 564685 - RNA, 22 nt, Human
ggcagaggaagcuggaaguggg

SEQ ID NO: 564686 - RNA, 22 nt, Human
acaggcgcacaugagggccgug

SEQ ID NO: 564687 - RNA, 23 nt, Human
gggugcugccuguagucaugcug

SEQ ID NO: 564688 - RNA, 22 nt, Human
uguccuguccuuccuggaaguc

SEQ ID NO: 564689 - RNA, 22 nt, Human
agcagcaccuguccucgcugcu

SEQ ID NO: 564690 - RNA, 22 nt, Human
accaggcccuccagcugcgugg

SEQ ID NO: 564691 - RNA, 22 nt, Human
ggucuggccuccgggcaggugg

SEQ ID NO: 564692 - RNA, 22 nt, Human
gagcuuuucccgucuuucucgu

SEQ ID NO: 564693 - RNA, 21 nt, Human
uccagcacagaugaccucccc

SEQ ID NO: 564694 - RNA, 22 nt, Human
ugucuucuaccuugacagcauu

SEQ ID NO: 564695 - RNA, 22 nt, Human
auggucacuucacccaugagcu

SEQ ID NO: 564696 - RNA, 22 nt, Human
agaaagcacccugcacuuucug

SEQ ID NO: 564697 - RNA, 22 nt, Human
accaugucauuuauuggccaaa

SEQ ID NO: 564698 - RNA, 22 nt, Human
gguuuguugggguccaggccca

SEQ ID NO: 564699 - RNA, 23 nt, Human
aguguucagcauguaguaaauac

SEQ ID NO: 564700 - RNA, 22 nt, Human
gcugugaaagcugccacacugu

SEQ ID NO: 564701 - RNA, 22 nt, Human
ggagcagggaauuacagcgcag

SEQ ID NO: 564702 - RNA, 21 nt, Human
aauuucagacccauuuugccu

SEQ ID NO: 564703 - RNA, 22 nt, Human
gcuucugcagagccguccugag

SEQ ID NO: 564704 - RNA, 22 nt, Human
ugaaacagucuccagacuugga

SEQ ID NO: 564705 - RNA, 22 nt, Human
ggggaccuuuccauuucugaga

SEQ ID NO: 564706 - RNA, 20 nt, Human
aggcccuccccacuguugcu

SEQ ID NO: 564707 - RNA, 22 nt, Human
gccgugcgugcgcaggugcugu

SEQ ID NO: 564708 - RNA, 22 nt, Human
gggaggugauuaggaccaugua

SEQ ID NO: 564709 - RNA, 22 nt, Human
aguaauggguugaaauuuaguu

SEQ ID NO: 564710 - RNA, 22 nt, Human
ccuggggaccugccucagcccu

SEQ ID NO: 564711 - RNA, 22 nt, Human
acagugcuaucaauagcuagaa

SEQ ID NO: 564712 - RNA, 22 nt, Human
auuuccagcagcauauuugucu

SEQ ID NO: 564713 - RNA, 22 nt, Human
aacaguaugugagauuuacaca

SEQ ID NO: 564714 - RNA, 22 nt, Human
cccaggcuggggcuccuccagc

SEQ ID NO: 564715 - RNA, 22 nt, Human
aagggugguguaggagaucaaa

SEQ ID NO: 564716 - RNA, 22 nt, Human
gcuuucagggucacugucaaca

SEQ ID NO: 564717 - RNA, 19 nt, Human
ugggcagugccagggcuua

SEQ ID NO: 564718 - RNA, 22 nt, Human
agccaggucaggaaagguccca

SEQ ID NO: 564719 - RNA, 22 nt, Human
cgcggucucuuuaaggcggguc

SEQ ID NO: 564720 - RNA, 22 nt, Human
guggcccaggcuuggcgcuggc

SEQ ID NO: 564721 - RNA, 22 nt, Human
gagaggaagccuucuguacuug

SEQ ID NO: 564722 - RNA, 22 nt, Human
gcugcuccgcagagugugugug

SEQ ID NO: 564723 - RNA, 22 nt, Human
uuccugagucgccgagucuaug

SEQ ID NO: 564724 - RNA, 22 nt, Human
gugaagaugccucaggugaccc

SEQ ID NO: 564725 - RNA, 22 nt, Human
gcagcuuuggagguggaacucu

SEQ ID NO: 564726 - RNA, 18 nt, Human
ucugugggaucagugagg

SEQ ID NO: 564727 - RNA, 22 nt, Human
uuugagaaacagacgaaagaca

SEQ ID NO: 564728 - RNA, 22 nt, Human
ccugucugaaggcagggggaug

SEQ ID NO: 564729 - RNA, 22 nt, Human
gaccaggagauuugagcuaggc

SEQ ID NO: 564730 - RNA, 22 nt, Human
cuggccagggugcgaucguggu

SEQ ID NO: 564731 - RNA, 22 nt, Human
uguccugugcacuguagcaugu

SEQ ID NO: 564732 - RNA, 22 nt, Human
gucgaucaccucguccuccgug

SEQ ID NO: 564733 - RNA, 22 nt, Human
ccagcugcgggcaucgagaguu

SEQ ID NO: 564734 - RNA, 22 nt, Human
uggcaauguggaaugguccagg

SEQ ID NO: 564735 - RNA, 22 nt, Human
gcagagcuggaacugguacuca

SEQ ID NO: 564736 - RNA, 22 nt, Human
ucugugggcauuuauaaucugg

SEQ ID NO: 564737 - RNA, 22 nt, Human
cucacagcugcuucaggaucca

SEQ ID NO: 564738 - RNA, 22 nt, Human
aggcggguuuaggacaaugcuu

SEQ ID NO: 564739 - RNA, 22 nt, Human
gcccucugguggccgccucggc

SEQ ID NO: 564740 - RNA, 22 nt, Human
gucuggaggaggaagaaggcac

SEQ ID NO: 564741 - RNA, 22 nt, Human
agguagcuggugcugggcuccu

SEQ ID NO: 564742 - RNA, 22 nt, Human
gcuggccugcgagggcaggcug

SEQ ID NO: 564743 - RNA, 22 nt, Human
agccacauggaccugaugcuag

SEQ ID NO: 564744 - RNA, 22 nt, Human
gggcucggcaucuguggacucu

SEQ ID NO: 564745 - RNA, 22 nt, Human
ucucuuaauuguaaugguuccu

SEQ ID NO: 564746 - RNA, 22 nt, Human
augaauaaaacauuuuaaucag

SEQ ID NO: 564747 - RNA, 22 nt, Human
uugggauacaucuugcugagcc

SEQ ID NO: 564748 - RNA, 22 nt, Human
uggcugaguuacgaacagagca

SEQ ID NO: 564749 - RNA, 22 nt, Human
guguacacuugaacugacgguu

SEQ ID NO: 564750 - RNA, 23 nt, Human
cugagggcuggucugaagucugc

SEQ ID NO: 564751 - RNA, 22 nt, Human
ucucucugcagcccgggacacu

SEQ ID NO: 564752 - RNA, 22 nt, Human
aagcagccagccaucaugcccg

SEQ ID NO: 564753 - RNA, 22 nt, Human
guuuuguucaugaacauugggu

SEQ ID NO: 564754 - RNA, 22 nt, Human
gcugucaggaacaugccuuggu

SEQ ID NO: 564755 - RNA, 22 nt, Human
ucaggggcuugaggugcauguc

SEQ ID NO: 564756 - RNA, 20 nt, Human
auacuuguuuucaggcuuuu

SEQ ID NO: 564757 - RNA, 22 nt, Human
cgaggagugugaaggcuugucg

SEQ ID NO: 564758 - RNA, 22 nt, Human
gugcaggugguuggcccagccg

SEQ ID NO: 564759 - RNA, 22 nt, Human
acaugacagugacuuuauaaga

SEQ ID NO: 564760 - RNA, 22 nt, Human
ggccgcggauuuucccgcuggc

SEQ ID NO: 564761 - RNA, 22 nt, Human
cauagacauugauagguuauau

SEQ ID NO: 564762 - RNA, 22 nt, Human
uccuggggaggucgaggcugag

SEQ ID NO: 564763 - RNA, 22 nt, Human
uuccaaggcugcuauuuguuuc

SEQ ID NO: 564764 - RNA, 22 nt, Human
uccugucucaguguauuugcag

SEQ ID NO: 564765 - RNA, 22 nt, Human
ugagucacuggcaaggcuuuga

SEQ ID NO: 564766 - RNA, 22 nt, Human
ggaagcaaauuccagaaccaca

SEQ ID NO: 564767 - RNA, 22 nt, Human
agcaggccugccaccucggggu

SEQ ID NO: 564768 - RNA, 22 nt, Human
ugaggagcaggguggcuuacuc

SEQ ID NO: 564769 - RNA, 22 nt, Human
ccgcguggcacccuccuggagg

SEQ ID NO: 564770 - RNA, 22 nt, Human
acucaucuuugaauuuucagua

SEQ ID NO: 564771 - RNA, 22 nt, Human
gcucuggcuacuguggcuaccg

SEQ ID NO: 564772 - RNA, 22 nt, Human
acggccgaugacuccagcaugg

SEQ ID NO: 564773 - RNA, 17 nt, Human
gcuccagaauucuaguc

SEQ ID NO: 564774 - RNA, 22 nt, Human
cccagaggcugaguugggagca

SEQ ID NO: 564775 - RNA, 22 nt, Human
gacggagcugguugcugcggcu

SEQ ID NO: 564776 - RNA, 23 nt, Human
ggucccaguggagaggccucacc

SEQ ID NO: 564777 - RNA, 21 nt, Human
ucagagggcccuggaggcuca

SEQ ID NO: 564778 - RNA, 22 nt, Human
ccagcaggaaagugacguuuga

SEQ ID NO: 564779 - RNA, 22 nt, Human
ggcgcucaguguugccccagag

SEQ ID NO: 564780 - RNA, 22 nt, Human
gagccucguggcggccacugcg

SEQ ID NO: 564781 - RNA, 22 nt, Human
gcgcugccucugcucuccccac

SEQ ID NO: 564782 - RNA, 22 nt, Human
aacccaggguggagguugcagu

SEQ ID NO: 564783 - RNA, 22 nt, Human
uccacagggaugccugcggcuu

SEQ ID NO: 564784 - RNA, 22 nt, Human
uuccuggccucuuccaccacca

SEQ ID NO: 564785 - RNA, 22 nt, Human
cucgcggcgcccgaagcccuug

SEQ ID NO: 564786 - RNA, 22 nt, Human
aaggcaguuaauuuggcuagaa

SEQ ID NO: 564787 - RNA, 21 nt, Human
uggcaggcagcuggaagcuug

SEQ ID NO: 564788 - RNA, 22 nt, Human
ccagugugcauuaucauguguc

SEQ ID NO: 564789 - RNA, 22 nt, Human
aaccagcacugcuggggccugc

SEQ ID NO: 564790 - RNA, 21 nt, Human
uggacauuuacccuucaggga

SEQ ID NO: 564791 - RNA, 22 nt, Human
ccagccagcugcccuuggggcc

SEQ ID NO: 564792 - RNA, 22 nt, Human
uggccgggaagggacagugugg

SEQ ID NO: 564793 - RNA, 22 nt, Human
gcgaguccacuggggggcgcag

SEQ ID NO: 564794 - RNA, 22 nt, Human
ugguccugagcaccagccugac

SEQ ID NO: 564795 - RNA, 22 nt, Human
ccagcagaagcucccgcugggu

SEQ ID NO: 564796 - RNA, 19 nt, Human
auagaguagaguaucuguu

SEQ ID NO: 564797 - RNA, 22 nt, Human
gauggaggagauggcagggugc

SEQ ID NO: 564798 - RNA, 22 nt, Human
agccucucuguuagucacuggg

SEQ ID NO: 564799 - RNA, 18 nt, Human
ucugagggugcgggagcu

SEQ ID NO: 564800 - RNA, 22 nt, Human
cuagcagaagcuccuugagggu

SEQ ID NO: 564801 - RNA, 22 nt, Human
ucaucuccauacggucucgcag

SEQ ID NO: 564802 - RNA, 22 nt, Human
ucccagugggaagcagcacgcu

SEQ ID NO: 564803 - RNA, 22 nt, Human
uugggcccugcucugaguugcu

SEQ ID NO: 564804 - RNA, 22 nt, Human
uucacguuguugaagaaaauac

SEQ ID NO: 564805 - RNA, 22 nt, Human
ccugaguucuuauuuccaguca

SEQ ID NO: 564806 - RNA, 22 nt, Human
aaaugcaugugcuauagaugug

SEQ ID NO: 564807 - RNA, 22 nt, Human
gggcccuggacguggcggcaga

SEQ ID NO: 564808 - RNA, 22 nt, Human
gugggggcaggcagugcuagga

SEQ ID NO: 564809 - RNA, 22 nt, Human
ugguuuacucuguaaaccagga

SEQ ID NO: 564810 - RNA, 22 nt, Human
uggagccagcaggacucagagg

SEQ ID NO: 564811 - RNA, 22 nt, Human
agacugugagaagauggcugcg

SEQ ID NO: 564812 - RNA, 22 nt, Human
uaggcagggauuaggguugauu

SEQ ID NO: 564813 - RNA, 22 nt, Human
cccgaccucgcaaagcgcacuc

SEQ ID NO: 564814 - RNA, 22 nt, Human
guagagcagggagcaggaagcu

SEQ ID NO: 564815 - RNA, 22 nt, Human
acccaggucucucgacuucugg

SEQ ID NO: 564816 - RNA, 22 nt, Human
cagcaguguacaaggugucaga

SEQ ID NO: 564817 - RNA, 22 nt, Human
cagacagagucuucccaucagu

SEQ ID NO: 564818 - RNA, 22 nt, Human
ugucuuacagcaaucuguucug

SEQ ID NO: 564819 - RNA, 22 nt, Human
cacuuuuaacaggagaauuccc

SEQ ID NO: 564820 - RNA, 22 nt, Human
gcuguaacuuuuucauuuucaa

SEQ ID NO: 564821 - RNA, 22 nt, Human
uaaaguucuuagaacaaggccu

SEQ ID NO: 564822 - RNA, 22 nt, Human herpesvirus 5
auagccuccggcugucaugggu

SEQ ID NO: 564823 - RNA, 22 nt, Human herpesvirus 5
auggagugagaggccggaccac

SEQ ID NO: 564824 - RNA, 22 nt, Human herpesvirus 5
auguggacauggccuaugccug

SEQ ID NO: 564825 - RNA, 22 nt, Human herpesvirus 5
aucaccaugguaauagcgauga

SEQ ID NO: 564826 - RNA, 21 nt, Human herpesvirus 5
aucuccucucgcucggcggcg

SEQ ID NO: 564827 - RNA, 22 nt, Human herpesvirus 5
aaagcaaggcacguucauaaug

SEQ ID NO: 564828 - RNA, 22 nt, Human herpesvirus 5
aaaggcuaagucggaaaacucg

SEQ ID NO: 564829 - RNA, 22 nt, Human herpesvirus 5
gagcagccggagcccgcacacu

SEQ ID NO: 564830 - RNA, 22 nt, Human herpesvirus 5
gagccgcagauccgagagccuc

SEQ ID NO: 564831 - RNA, 22 nt, Human herpesvirus 5
acgccgggucgcaccgaggugg

SEQ ID NO: 564832 - RNA, 21 nt, Human herpesvirus 5
aaugugaagaugguggaccgc

SEQ ID NO: 564833 - RNA, 22 nt, Human herpesvirus 5
augucgcagccggucuagcagg

SEQ ID NO: 564834 - RNA, 23 nt, Human herpesvirus 5
auuugaguauacgguuaauguau

SEQ ID NO: 564835 - RNA, 22 nt, Human herpesvirus 5
caaaacugucagcggcgcucag

SEQ ID NO: 564836 - RNA, 22 nt, Human herpesvirus 5
caaagagaccccgcugugccgc

SEQ ID NO: 564837 - RNA, 22 nt, Human herpesvirus 5
caaguauguggaacagcucgug

SEQ ID NO: 564838 - RNA, 22 nt, Human herpesvirus 5
caaguucaccugguggaaacga

SEQ ID NO: 564839 - RNA, 22 nt, Human herpesvirus 5
agguggagauucuaaagccacg

SEQ ID NO: 564840 - RNA, 22 nt, Human herpesvirus 5
agguugaaaaaccgcguaucug

SEQ ID NO: 564841 - RNA, 22 nt, Human herpesvirus 5
aguggcaggcccggguucgcga

SEQ ID NO: 564842 - RNA, 22 nt, Human herpesvirus 5
auagauucaacgugaugagacc

SEQ ID NO: 564843 - RNA, 22 nt, Human herpesvirus 5
augaaaaacacgacgaaagcgu

SEQ ID NO: 564844 - RNA, 22 nt, Human herpesvirus 5
agccgugcugggccucaacgcg

SEQ ID NO: 564845 - RNA, 22 nt, Human herpesvirus 5
acuuggaacgccgcggcgcaca

SEQ ID NO: 564846 - RNA, 22 nt, Human herpesvirus 5
agacgcagugguccgucggugu

SEQ ID NO: 564847 - RNA, 22 nt, Human herpesvirus 5
cagggcgcuuuggcaaaaggcg

SEQ ID NO: 564848 - RNA, 22 nt, Human herpesvirus 5
caguugacugagauugagaucc

SEQ ID NO: 564849 - RNA, 22 nt, Human herpesvirus 5
ccauguuguccaaggguaucau

SEQ ID NO: 564850 - RNA, 21 nt, Human herpesvirus 5
cccaacaggaucaucgaccuc

SEQ ID NO: 564851 - RNA, 22 nt, Human herpesvirus 5
ccagagcugcuaggaaccgguc

SEQ ID NO: 564852 - RNA, 22 nt, Human herpesvirus 5
cggcgguuucgccaccgcugac

SEQ ID NO: 564853 - RNA, 22 nt, Human herpesvirus 5
cggugggggcgugccccgcaga

SEQ ID NO: 564854 - RNA, 22 nt, Human herpesvirus 5
cguggaugagaucguagagggc

SEQ ID NO: 564855 - RNA, 23 nt, Human herpesvirus 5
cucaguugucaaguccgagugcc

SEQ ID NO: 564856 - RNA, 22 nt, Human herpesvirus 5
cuccccaacuacuacuaccgug

SEQ ID NO: 564857 - RNA, 22 nt, Human herpesvirus 5
cugcaggaaccaguugugcgga

SEQ ID NO: 564858 - RNA, 22 nt, Human herpesvirus 5
cugcgccuccagccgcuccgag

SEQ ID NO: 564859 - RNA, 22 nt, Human herpesvirus 5
cuggaaauggacuuuugcucuc

SEQ ID NO: 564860 - RNA, 18 nt, Human herpesvirus 5
cgagaacgcgcccuuucc

SEQ ID NO: 564861 - RNA, 22 nt, Human herpesvirus 5
cugggaaaauugaaagacacgc

SEQ ID NO: 564862 - RNA, 22 nt, Human herpesvirus 5
ccaacgcaacagaccuaggcac

SEQ ID NO: 564863 - RNA, 22 nt, Human herpesvirus 5
gacggguguauaccagaugugg

SEQ ID NO: 564864 - RNA, 22 nt, Human herpesvirus 5
acguucaaccccauguuuuuca

SEQ ID NO: 564865 - RNA, 22 nt, Human herpesvirus 5
aaucauccuguacgaagaggaa

SEQ ID NO: 564866 - RNA, 22 nt, Human herpesvirus 5
agaggggacgucggggcccucc

SEQ ID NO: 564867 - RNA, 22 nt, Human herpesvirus 5
agaggucacucgcggcgugccg

SEQ ID NO: 564868 - RNA, 21 nt, Human herpesvirus 5
acuggcccgacaagcggugca

SEQ ID NO: 564869 - RNA, 22 nt, Human herpesvirus 5
aggaacuaucuucaucgggccg

SEQ ID NO: 564870 - RNA, 22 nt, Human herpesvirus 5
agcagacaguguaguucuugcc

SEQ ID NO: 564871 - RNA, 22 nt, Human herpesvirus 5
agcagcgugugcaguucggcgu

SEQ ID NO: 564872 - RNA, 22 nt, Human herpesvirus 5
agccgcgcaugacgcaggugag

SEQ ID NO: 564873 - RNA, 22 nt, Human herpesvirus 5
aacgcuuucgucguguuuuuca

SEQ ID NO: 564874 - RNA, 22 nt, Human herpesvirus 5
aaucacagguaccguaucuauu

SEQ ID NO: 564875 - RNA, 22 nt, Human herpesvirus 5
acaccuccguuuugagcguguu

SEQ ID NO: 564876 - RNA, 22 nt, Human herpesvirus 5
acagggaaugggaaaaacacgc

SEQ ID NO: 564877 - RNA, 22 nt, Human herpesvirus 5
aggccagaggcuaagccgaaac

SEQ ID NO: 564878 - RNA, 21 nt, Human herpesvirus 5
aguggcaggcccggguucgcg

SEQ ID NO: 564879 - RNA, 22 nt, Human herpesvirus 5
agugugagcacuacccuaguuu

SEQ ID NO: 564880 - RNA, 22 nt, Human herpesvirus 5
aggcggacgagguagagguuug

SEQ ID NO: 564881 - RNA, 22 nt, Human herpesvirus 5
agggcauucaguugaugggugg

SEQ ID NO: 564882 - RNA, 22 nt, Human herpesvirus 5
acuucuuucgcucccucgaccc

SEQ ID NO: 564883 - RNA, 22 nt, Human herpesvirus 5
accagccguagccaaucccgau

SEQ ID NO: 564884 - RNA, 22 nt, Human herpesvirus 5
agccguguuuuuugcacaauuu

SEQ ID NO: 564885 - RNA, 22 nt, Human herpesvirus 5
gguccgagacacccagguuguu

SEQ ID NO: 564886 - RNA, 22 nt, Human herpesvirus 5
ggucugcgcgacauuuuggguc

SEQ ID NO: 564887 - RNA, 22 nt, Human herpesvirus 5
guacuuuccgcuguuuuccguc

SEQ ID NO: 564888 - RNA, 22 nt, Human herpesvirus 5
uuuuuccacugggcggccgcac

SEQ ID NO: 564889 - RNA, 22 nt, Human herpesvirus 5
uuuuugugcuggaacuucccuc

SEQ ID NO: 564890 - RNA, 22 nt, Human herpesvirus 5
uucagcgucucauuugucuuua

SEQ ID NO: 564891 - RNA, 22 nt, Human herpesvirus 5
ugucggagcugucggcgcuggg

SEQ ID NO: 564892 - RNA, 22 nt, Human herpesvirus 5
gccgaggacgccgugggcggcg

SEQ ID NO: 564893 - RNA, 22 nt, Human herpesvirus 5
uuucugauacuggaucgucugu

SEQ ID NO: 564894 - RNA, 22 nt, Human herpesvirus 5
gcaguugcaguagagcaauuua

SEQ ID NO: 564895 - RNA, 22 nt, Human herpesvirus 5
gcgcugaucugcagcugcacgg

SEQ ID NO: 564896 - RNA, 22 nt, Human herpesvirus 5
gcgcuggaggaccugcugccca

SEQ ID NO: 564897 - RNA, 22 nt, Human herpesvirus 5
gggccacgucgggcugcugccg

SEQ ID NO: 564898 - RNA, 23 nt, Human herpesvirus 5
gcgggcacugggucugcacgacg

SEQ ID NO: 564899 - RNA, 22 nt, Human herpesvirus 5
gcggggucguggcggcuguguc

SEQ ID NO: 564900 - RNA, 22 nt, Human herpesvirus 5
uccaaggaucggaaaguagcgu

SEQ ID NO: 564901 - RNA, 22 nt, Human herpesvirus 5
guggguucaugcugccuaucua

SEQ ID NO: 564902 - RNA, 20 nt, Human herpesvirus 5
ucuccacggaucaggccucg

SEQ ID NO: 564903 - RNA, 22 nt, Human herpesvirus 5
ucuuuccagguguuuucaacgu

SEQ ID NO: 564904 - RNA, 22 nt, Human herpesvirus 5
ugauccugagaacgucaucuau

SEQ ID NO: 564905 - RNA, 22 nt, Human herpesvirus 5
uguaaggaagcuuuuaucgugc

SEQ ID NO: 564906 - RNA, 22 nt, Human herpesvirus 5
uguggcgccagcgaaccggcgg

SEQ ID NO: 564907 - RNA, 22 nt, Human herpesvirus 5
uguucgaugaucguauguuaca

SEQ ID NO: 564908 - RNA, 22 nt, Human herpesvirus 5
ugguccuuuuguuggugccgcc

SEQ ID NO: 564909 - RNA, 22 nt, Human herpesvirus 5
ugguuugggguggcauccaaac

SEQ ID NO: 564910 - RNA, 22 nt, Human herpesvirus 5
ugaggcucucggaucugcggcu

SEQ ID NO: 564911 - RNA, 22 nt, Human herpesvirus 5
ugcgcuguuacacggaauccag

SEQ ID NO: 564912 - RNA, 22 nt, Human herpesvirus 5
ugcuggagcgcgacgacgaggc

SEQ ID NO: 564913 - RNA, 22 nt, Human herpesvirus 5
uuccuuuccuguuuuguacucg

SEQ ID NO: 564914 - RNA, 22 nt, Human herpesvirus 5
uugaccagcagcuugcagcgcu

SEQ ID NO: 564915 - RNA, 22 nt, Human herpesvirus 5
uucagcuucauaagaugucugc

SEQ ID NO: 564916 - RNA, 22 nt, Human herpesvirus 5
ucuagagggaagguggggaaug

SEQ ID NO: 564917 - RNA, 22 nt, Human herpesvirus 5
ucucaccagaaugcuaguuugu

SEQ ID NO: 564918 - RNA, 22 nt, Human herpesvirus 5
ucugcagcucgucggccggcgu

SEQ ID NO: 564919 - RNA, 23 nt, Human herpesvirus 5
ucugcggaggaacagcaacggcg

SEQ ID NO: 564920 - RNA, 22 nt, Human herpesvirus 5
gcgaggacacgcagacggcgga

SEQ ID NO: 564921 - RNA, 22 nt, Human herpesvirus 5
gggcgagacggugcaggagucc

SEQ ID NO: 564922 - RNA, 22 nt, Human herpesvirus 5
ggcguuggccuguggauagauu

SEQ ID NO: 564923 - RNA, 22 nt, Human herpesvirus 5
ggcccucgcucgucgugccucu

SEQ ID NO: 564924 - RNA, 22 nt, Human herpesvirus 5
gucacagagcgugcugacgugg

SEQ ID NO: 564925 - RNA, 22 nt, Human herpesvirus 5
guggccgcuaaauauggcgacg

SEQ ID NO: 564926 - RNA, 22 nt, Human herpesvirus 5
guggcgcuucgcuacgcgguga

SEQ ID NO: 564927 - RNA, 22 nt, Human herpesvirus 5
guaaagacaaaugagacgcuga

SEQ ID NO: 564928 - RNA, 22 nt, Human herpesvirus 5
cugcgcacgcucucggucacgg

SEQ ID NO: 564929 - RNA, 21 nt, Human herpesvirus 5
gaacaugaugccguugcagac

SEQ ID NO: 564930 - RNA, 22 nt, Human herpesvirus 5
gacuaggucgucuuggaagccg

SEQ ID NO: 564931 - RNA, 22 nt, Human herpesvirus 5
gacuucuacggaguuuucccuc

SEQ ID NO: 564932 - RNA, 22 nt, Human herpesvirus 5
gagacgcacgacaguauacgug

SEQ ID NO: 564933 - RNA, 22 nt, Human herpesvirus 5
caaaauaucgaacucuucgcgg

SEQ ID NO: 564934 - RNA, 22 nt, Human herpesvirus 5
caaguaagaaacaggaugaggc

SEQ ID NO: 564935 - RNA, 22 nt, Human herpesvirus 5
auguccaccucgaaggugucgg

SEQ ID NO: 564936 - RNA, 22 nt, Human herpesvirus 5
augucucccuuggagaacgucg

SEQ ID NO: 564937 - RNA, 22 nt, Human herpesvirus 5
aucugcuguagauaucauaacg

SEQ ID NO: 564938 - RNA, 22 nt, Human herpesvirus 5
cuccuccuccgacugcgguggu

SEQ ID NO: 564939 - RNA, 22 nt, Human herpesvirus 5
cugagagucgccuguacgacgc

SEQ ID NO: 564940 - RNA, 22 nt, Human herpesvirus 5
cuggagaacgccggggcagcag

SEQ ID NO: 564941 - RNA, 22 nt, Human herpesvirus 5
cgagcugcugaugugccgucgc

SEQ ID NO: 564942 - RNA, 22 nt, Human herpesvirus 5
cgagcugucggaauccucgucg

SEQ ID NO: 564943 - RNA, 22 nt, Human herpesvirus 5
cucaccuggaccggugguacug

SEQ ID NO: 564944 - RNA, 20 nt, Human herpesvirus 5
cgucaagcgguuauaggugc

SEQ ID NO: 564945 - RNA, 22 nt, Human herpesvirus 5
cguccucccgcccaggaccugu

SEQ ID NO: 564946 - RNA, 22 nt, Human herpesvirus 5
cguuguaaacaagcuauugcug

SEQ ID NO: 564947 - RNA, 22 nt, Human herpesvirus 5
cgccugugcuuuguuacgacgg

SEQ ID NO: 564948 - RNA, 19 nt, Human herpesvirus 5
cgcgagcggcggacuuggc

SEQ ID NO: 564949 - RNA, 22 nt, Human herpesvirus 5
cgcgcaggggcuccgacguggc

SEQ ID NO: 564950 - RNA, 22 nt, Human herpesvirus 5
cggagacugggcugcaggcggc

SEQ ID NO: 564951 - RNA, 22 nt, Human herpesvirus 5
cggcggcgcccgagcgggacau

SEQ ID NO: 564952 - RNA, 22 nt, Human herpesvirus 5
ccccucuuucugcgucguggcu

SEQ ID NO: 564953 - RNA, 22 nt, Human herpesvirus 5
ccugccgcgucaccgugugucc

SEQ ID NO: 564954 - RNA, 22 nt, Human herpesvirus 5
ccagcaguaugacgugcgaugg

SEQ ID NO: 564955 - RNA, 22 nt, Human herpesvirus 5
uuucucaucaaccugucgaugg

SEQ ID NO: 564956 - RNA, 22 nt, Human herpesvirus 5
ugcguuccagccuggccgcgcg

SEQ ID NO: 564957 - RNA, 22 nt, Human herpesvirus 5
ugcuuuuauugcugauaacugu

SEQ ID NO: 564958 - RNA, 22 nt, Human herpesvirus 5
uggaacaccaaauuguacgugg

SEQ ID NO: 564959 - RNA, 22 nt, Human herpesvirus 5
uggacgccgccucugccggcuc

SEQ ID NO: 564960 - RNA, 22 nt, Human herpesvirus 5
uggagcgucagacccagggcgc

SEQ ID NO: 564961 - RNA, 22 nt, Human herpesvirus 5
uggcggguuccgagggcggucc

SEQ ID NO: 564962 - RNA, 22 nt, Human herpesvirus 5
uggcguggcgcacgcagcgacc

SEQ ID NO: 564963 - RNA, 22 nt, Human herpesvirus 5
uguuguugcgggauguucaagg

SEQ ID NO: 564964 - RNA, 22 nt, Human herpesvirus 5
uuaaagcaaaaagucuggugag

SEQ ID NO: 564965 - RNA, 22 nt, Human herpesvirus 5
ugucugcucauucuggcggcgc

SEQ ID NO: 564966 - RNA, 23 nt, Human herpesvirus 5
ugagcagcaaaacgaccagaauc

SEQ ID NO: 564967 - RNA, 21 nt, Human herpesvirus 5
ucuauacauuguaguucauca

SEQ ID NO: 564968 - RNA, 20 nt, Human herpesvirus 5
ucuccaggcugucggccucg

SEQ ID NO: 564969 - RNA, 22 nt, Human herpesvirus 5
uccagucucuaacugccguguu

SEQ ID NO: 564970 - RNA, 22 nt, Human herpesvirus 5
ucccuagccagcgugccgugua

SEQ ID NO: 564971 - RNA, 22 nt, Human herpesvirus 5
uaggcgcacgauggccaugcgc

SEQ ID NO: 564972 - RNA, 22 nt, Human herpesvirus 5
uagaagaagcaccggcggccgc

SEQ ID NO: 564973 - RNA, 22 nt, Human herpesvirus 5
gaugagcagcuccaacagcgug

SEQ ID NO: 564974 - RNA, 22 nt, Human herpesvirus 5
gcaggugguucaccacguccgu

SEQ ID NO: 564975 - RNA, 23 nt, Human herpesvirus 5
gccggcaaaauguagguggcguu

SEQ ID NO: 564976 - RNA, 22 nt, Human herpesvirus 5
gccuccggaucacaugguuacu

SEQ ID NO: 564977 - RNA, 20 nt, Human herpesvirus 5
gcgcaggauauggcagccug

SEQ ID NO: 564978 - RNA, 22 nt, Human herpesvirus 5
gcgccuggacguugcacgcggc

SEQ ID NO: 564979 - RNA, 21 nt, Human herpesvirus 5
uacgacaucaccgaggcggag

SEQ ID NO: 564980 - RNA, 22 nt, Human herpesvirus 5
uacgauuucaaaaugugcaauc

SEQ ID NO: 564981 - RNA, 22 nt, Human herpesvirus 5
guucccaggccgagaacgcgca

SEQ ID NO: 564982 - RNA, 18 nt, Human herpesvirus 5
guucuccaauggauacgu

SEQ ID NO: 564983 - RNA, 22 nt, Human herpesvirus 5
guuguccuccucguccucgugg

SEQ ID NO: 564984 - RNA, 20 nt, Human herpesvirus 5
guuuaacgugagguugaaga

SEQ ID NO: 564985 - RNA, 22 nt, Human herpesvirus 5
gcucgcaguaguggcgcagcug

SEQ ID NO: 564986 - RNA, 22 nt, Human herpesvirus 5
gucucuggccggcgccagaccg

SEQ ID NO: 564987 - RNA, 19 nt, Human herpesvirus 5
guauuaaggccugaacgcc

SEQ ID NO: 564988 - RNA, 22 nt, Human herpesvirus 5
caccgcccauggguuccugcug

SEQ ID NO: 564989 - RNA, 22 nt, Human herpesvirus 5
cacggccagcgccuugucgcgg

SEQ ID NO: 564990 - RNA, 22 nt, Human herpesvirus 5
augaagggccagacgccuuuga

SEQ ID NO: 564991 - RNA, 22 nt, Human herpesvirus 5
augucacaggcgcccgaggcgu

SEQ ID NO: 564992 - RNA, 22 nt, Human herpesvirus 5
cuaccugaccguagcgguuagc

SEQ ID NO: 564993 - RNA, 22 nt, Human herpesvirus 5
cugcaggaaacguuggcgacgg

SEQ ID NO: 564994 - RNA, 22 nt, Human herpesvirus 5
gagaggaguggcugcuguguug

SEQ ID NO: 564995 - RNA, 22 nt, Human herpesvirus 5
cuucagccaucaucccgaguuc

SEQ ID NO: 564996 - RNA, 22 nt, Human herpesvirus 5
cccagguuucuggagauuguac

SEQ ID NO: 564997 - RNA, 19 nt, Human herpesvirus 5
cgcggagccaggcugcggc

SEQ ID NO: 564998 - RNA, 22 nt, Human herpesvirus 5
cgacgcagaaccacgcgcaguu

SEQ ID NO: 564999 - RNA, 22 nt, Human herpesvirus 5
ccugcgugccagucuguccguc

SEQ ID NO: 565000 - RNA, 22 nt, Human herpesvirus 5
cagugucagcgccgagccgcgg

SEQ ID NO: 565001 - RNA, 22 nt, Human herpesvirus 5
ccaggagcucaucauguucggg

SEQ ID NO: 565002 - RNA, 22 nt, Human herpesvirus 5
cggcgaccgcggacucgccucg

SEQ ID NO: 565003 - RNA, 22 nt, Human herpesvirus 5
cgggccaguagcagagguggac

SEQ ID NO: 565004 - RNA, 23 nt, Human herpesvirus 5
cucgggcgccugugacaugaggc

SEQ ID NO: 565005 - RNA, 22 nt, Human herpesvirus 5
cugagcaagaucaguuggcugg

SEQ ID NO: 565006 - RNA, 22 nt, Human herpesvirus 5
cugcugugaaaacgggcacggu

SEQ ID NO: 565007 - RNA, 22 nt, Human herpesvirus 5
ccugaugcuggucaugguauau

SEQ ID NO: 565008 - RNA, 23 nt, Human herpesvirus 5
ccuucgguaucaucgucuuugcu

SEQ ID NO: 565009 - RNA, 22 nt, Human herpesvirus 5
cgaggccgacagccuggagaug

SEQ ID NO: 565010 - RNA, 22 nt, Human herpesvirus 5
cgaggccugauccguggagaac

SEQ ID NO: 565011 - RNA, 21 nt, Human herpesvirus 5
cgccugucuccugggcgagca

SEQ ID NO: 565012 - RNA, 22 nt, Human herpesvirus 5
cggcagcugcagcacguggaga

SEQ ID NO: 565013 - RNA, 22 nt, Human herpesvirus 5
gaccucuggccagucgugcgcg

SEQ ID NO: 565014 - RNA, 22 nt, Human herpesvirus 5
cuucuugaccguuaucacggug

SEQ ID NO: 565015 - RNA, 22 nt, Human herpesvirus 5
gcaagugcuucagcagcagcuu

SEQ ID NO: 565016 - RNA, 22 nt, Human herpesvirus 5
gccaugucguuucgcgucggca

SEQ ID NO: 565017 - RNA, 22 nt, Human herpesvirus 5
aaacucaacggggugcagcgcu

SEQ ID NO: 565018 - RNA, 19 nt, Human herpesvirus 5
aagaguucgauauuuugcg

SEQ ID NO: 565019 - RNA, 22 nt, Human herpesvirus 5
aaggauggcaacuuggacacgu

SEQ ID NO: 565020 - RNA, 22 nt, Human herpesvirus 5
acacggcaguuagagacuggag

SEQ ID NO: 565021 - RNA, 22 nt, Human herpesvirus 5
acgcggccccgcaccggcggug

SEQ ID NO: 565022 - RNA, 22 nt, Human herpesvirus 5
agguggugugcgaucccuucca

SEQ ID NO: 565023 - RNA, 20 nt, Human herpesvirus 5
agguugagccacccgccgca

SEQ ID NO: 565024 - RNA, 22 nt, Human herpesvirus 5
ucgugcagccgcaugagacgug

SEQ ID NO: 565025 - RNA, 22 nt, Human herpesvirus 5
ucgcggcggcucccucucggcg

SEQ ID NO: 565026 - RNA, 22 nt, Human herpesvirus 5
guccgcacagagguaacaacgu

SEQ ID NO: 565027 - RNA, 19 nt, Human herpesvirus 5
gaucucuggcaucaugaga

SEQ ID NO: 565028 - RNA, 22 nt, Human herpesvirus 5
gccacgcgauuggccgucggcg

SEQ ID NO: 565029 - RNA, 22 nt, Human herpesvirus 5
gccgugugggaaugacggugau

SEQ ID NO: 565030 - RNA, 22 nt, Human herpesvirus 5
gcugggaucguugcgguugucg

SEQ ID NO: 565031 - RNA, 22 nt, Human herpesvirus 5
gcugugccugucauccacuugg

SEQ ID NO: 565032 - RNA, 22 nt, Human herpesvirus 5
ggcgaccagaagcccggugccg

SEQ ID NO: 565033 - RNA, 22 nt, Human herpesvirus 5
ggcgugaccacgucaccgugcc

SEQ ID NO: 565034 - RNA, 22 nt, Human herpesvirus 5
ggcgugcgcgaccccuagucgg

SEQ ID NO: 565035 - RNA, 22 nt, Human herpesvirus 5
gguacuugacgcgggugcgcgu

SEQ ID NO: 565036 - RNA, 22 nt, Human herpesvirus 5
ggaggcuuucgccacaccuauc

SEQ ID NO: 565037 - RNA, 22 nt, Human herpesvirus 5
ggcaagccgagcgggaggcggu

SEQ ID NO: 565038 - RNA, 22 nt, Human herpesvirus 5
guggcgguaggguaugugucug

SEQ ID NO: 565039 - RNA, 23 nt, Human herpesvirus 5
uggggcaguuugagcagcccacc

SEQ ID NO: 565040 - RNA, 22 nt, Human herpesvirus 5
uucuggucguuuugcugcucau

SEQ ID NO: 565041 - RNA, 22 nt, Human herpesvirus 5
ugugaagcagcaacccgaacgc

SEQ ID NO: 565042 - RNA, 22 nt, Human herpesvirus 5
ugugaucugggcagcggcugcg

SEQ ID NO: 565043 - RNA, 22 nt, Human herpesvirus 5
gaggagcgcauguucguggggu

SEQ ID NO: 565044 - RNA, 22 nt, Human herpesvirus 5
ugcugauaacuguuguacugua

SEQ ID NO: 565045 - RNA, 22 nt, Human herpesvirus 5
ugccugugucuaggcugcucuc

SEQ ID NO: 565046 - RNA, 20 nt, Human herpesvirus 5
ugcgccagguaguaaagcac

SEQ ID NO: 565047 - RNA, 22 nt, Human herpesvirus 5
ucuuuccaggugucuucaacga

SEQ ID NO: 565048 - RNA, 22 nt, Human herpesvirus 5
ucuuuuuucaauacgucaaggu

SEQ ID NO: 565049 - RNA, 22 nt, Human herpesvirus 5
ugaagcggagugcaucucgagu

SEQ ID NO: 565050 - RNA, 22 nt, Human herpesvirus 5
ugcagaucaucaugucgcugcu

SEQ ID NO: 565051 - RNA, 22 nt, Human herpesvirus 5
ggagcggggcguccgaaggcga

SEQ ID NO: 565052 - RNA, 22 nt, Human herpesvirus 5
ggagugacggacggccaguacg

SEQ ID NO: 565053 - RNA, 22 nt, Human herpesvirus 5
ggcacggucucgcacgccaccu

SEQ ID NO: 565054 - RNA, 22 nt, Human herpesvirus 5
gguuugcuuccuauauagugga

SEQ ID NO: 565055 - RNA, 22 nt, Human herpesvirus 5
gggucccggcacgggccgagga

SEQ ID NO: 565056 - RNA, 20 nt, Human herpesvirus 5
gggauuguugccggccaggu

SEQ ID NO: 565057 - RNA, 22 nt, Human herpesvirus 5
gucugcaggacggcgcucguuc

SEQ ID NO: 565058 - RNA, 22 nt, Human herpesvirus 5
gugcacgcgcugcuuucgcacg

SEQ ID NO: 565059 - RNA, 22 nt, Human herpesvirus 5
guggaugagggcucuucacggu

SEQ ID NO: 565060 - RNA, 17 nt, Human herpesvirus 5
uaguggggcccuugugu

SEQ ID NO: 565061 - RNA, 22 nt, Human herpesvirus 5
ucggaggcgugcucguaucccg

SEQ ID NO: 565062 - RNA, 20 nt, Human herpesvirus 5
uaugcuggaucaagaucagc

SEQ ID NO: 565063 - RNA, 22 nt, Human herpesvirus 5
ugcagaucaucaugucgcugcu

SEQ ID NO: 565064 - RNA, 22 nt, Human herpesvirus 5
ugaugcugugcaauaaaauuuu

SEQ ID NO: 565065 - RNA, 23 nt, Human herpesvirus 5
ugagcagcaaaacgaccagaauc

SEQ ID NO: 565066 - RNA, 22 nt, Human herpesvirus 5
ugacaagccugacgagagcguu

SEQ ID NO: 565067 - RNA, 22 nt, Human herpesvirus 5
ugauagaacuguuguauacgaa

SEQ ID NO: 565068 - RNA, 22 nt, Human herpesvirus 5
uaggcgcacgauggccaugcgc

SEQ ID NO: 565069 - RNA, 20 nt, Human herpesvirus 5
uauccguguccaccaucggg

SEQ ID NO: 565070 - RNA, 22 nt, Human herpesvirus 5
uccccguagccggccuacggcg

SEQ ID NO: 565071 - RNA, 22 nt, Human herpesvirus 5
ucaucguuugggguguagaauu

SEQ ID NO: 565072 - RNA, 22 nt, Human herpesvirus 5
uccaaggaucggaaaguagcgu

SEQ ID NO: 565073 - RNA, 22 nt, Human herpesvirus 5
uccgccacucgucagcucgccg

SEQ ID NO: 565074 - RNA, 22 nt, Human herpesvirus 5
uccgccguguuucucggcguac

SEQ ID NO: 565075 - RNA, 22 nt, Human herpesvirus 5
ucguuuccaccaggugaacuug

SEQ ID NO: 565076 - RNA, 22 nt, Human herpesvirus 5
ucguuuucagcaggaacccaug

SEQ ID NO: 565077 - RNA, 22 nt, Human herpesvirus 5
uccgcguguaaugcacgcggug

SEQ ID NO: 565078 - RNA, 22 nt, Human herpesvirus 5
ucucaccagaaugcuaguuugu

SEQ ID NO: 565079 - RNA, 22 nt, Human herpesvirus 5
ucucacgggaaggcuaguuaga

SEQ ID NO: 565080 - RNA, 22 nt, Human herpesvirus 5
ucuaacuagccuucccgugaga

SEQ ID NO: 565081 - RNA, 22 nt, Human herpesvirus 5
ucuagagggaagguggggaaug

SEQ ID NO: 565082 - RNA, 20 nt, Human herpesvirus 5
ucuccaggcugucggccucg

SEQ ID NO: 565083 - RNA, 22 nt, Human herpesvirus 5
ucugcagcucgucggccggcgu

SEQ ID NO: 565084 - RNA, 21 nt, Human herpesvirus 5
ucugcgcgacauuuuggguca

SEQ ID NO: 565085 - RNA, 22 nt, Human herpesvirus 5
ucugcgcggcgacagcugcuuu

SEQ ID NO: 565086 - RNA, 23 nt, Human herpesvirus 5
ucugcggaggaacagcaacggcg

SEQ ID NO: 565087 - RNA, 22 nt, Human herpesvirus 5
ucuuuccaggugucuucaacga

SEQ ID NO: 565088 - RNA, 22 nt, Human herpesvirus 5
ucuuuccagguguuuucaacgu

SEQ ID NO: 565089 - RNA, 22 nt, Human herpesvirus 5
ucuuuuuucaauacgucaaggu

SEQ ID NO: 565090 - RNA, 20 nt, Human herpesvirus 5
gauuugaugcgcuagcguca

SEQ ID NO: 565091 - RNA, 22 nt, Human herpesvirus 5
gaugagcagcuccaacagcgug

SEQ ID NO: 565092 - RNA, 22 nt, Human herpesvirus 5
gauaggugugacgaugucuuua

SEQ ID NO: 565093 - RNA, 22 nt, Human herpesvirus 5
gagcucgccggcggcgaaacaa

SEQ ID NO: 565094 - RNA, 22 nt, Human herpesvirus 5
gagccgcagauccgagagccuc

SEQ ID NO: 565095 - RNA, 22 nt, Human herpesvirus 5
gaggagcgcauguucguggggu

SEQ ID NO: 565096 - RNA, 22 nt, Human herpesvirus 5
gaggcgcggaccgugaguuaua

SEQ ID NO: 565097 - RNA, 22 nt, Human herpesvirus 5
gaguaucgggccgucgcuugcc

SEQ ID NO: 565098 - RNA, 19 nt, Human herpesvirus 5
gagaugcgggguggugcuc

SEQ ID NO: 565099 - RNA, 22 nt, Human herpesvirus 5
gagacgcacgacaguauacgug

SEQ ID NO: 565100 - RNA, 22 nt, Human herpesvirus 5
gagaggaguggcugcuguguug

SEQ ID NO: 565101 - RNA, 22 nt, Human herpesvirus 5
gagcagccggagcccgcacacu

SEQ ID NO: 565102 - RNA, 22 nt, Human herpesvirus 5
gacuucuacggaguuuucccuc

SEQ ID NO: 565103 - RNA, 22 nt, Human herpesvirus 5
gacguugaccguuguggggauu

SEQ ID NO: 565104 - RNA, 22 nt, Human herpesvirus 5
gacguuugugcugcuggucaua

SEQ ID NO: 565105 - RNA, 22 nt, Human herpesvirus 5
gacguccgcccgacgguggugg

SEQ ID NO: 565106 - RNA, 22 nt, Human herpesvirus 5
cguggaugagaucguagagggc

SEQ ID NO: 565107 - RNA, 22 nt, Human herpesvirus 5
gacggguguauaccagaugugg

SEQ ID NO: 565108 - RNA, 22 nt, Human herpesvirus 5
cgugaugcgcaccuucggcggu

SEQ ID NO: 565109 - RNA, 22 nt, Human herpesvirus 5
cgugcacgccgucgccgaggau

SEQ ID NO: 565110 - RNA, 22 nt, Human herpesvirus 5
cgucguguagccacacggucuc

SEQ ID NO: 565111 - RNA, 17 nt, Human herpesvirus 5
cgucucuuuauuuuuau

SEQ ID NO: 565112 - RNA, 22 nt, Human herpesvirus 5
cgucgcagugugagguguucac

SEQ ID NO: 565113 - RNA, 22 nt, Human herpesvirus 5
cguccucccgcccaggaccugu

SEQ ID NO: 565114 - RNA, 22 nt, Human herpesvirus 5
cgguuucggcuuagccucuggc

SEQ ID NO: 565115 - RNA, 17 nt, Human herpesvirus 5
cgguuucucauacgcgc

SEQ ID NO: 565116 - RNA, 22 nt, Human herpesvirus 5
cgguuauuaucaacgucucugu

SEQ ID NO: 565117 - RNA, 23 nt, Human herpesvirus 5
cgccucgucugagccggggugcc

SEQ ID NO: 565118 - RNA, 21 nt, Human herpesvirus 5
cgccugucuccugggcgagca

SEQ ID NO: 565119 - RNA, 22 nt, Human herpesvirus 5
cgccugugcuuuguuacgacgg

SEQ ID NO: 565120 - RNA, 22 nt, Human herpesvirus 5
cgcgacggccucgcugacugga

SEQ ID NO: 565121 - RNA, 22 nt, Human herpesvirus 5
cgcgcccacgguccgggcacaa

SEQ ID NO: 565122 - RNA, 22 nt, Human herpesvirus 5
cgcgcccagguaggccguuacu

SEQ ID NO: 565123 - RNA, 22 nt, Human herpesvirus 5
cgcgcaggggcuccgacguggc

SEQ ID NO: 565124 - RNA, 19 nt, Human herpesvirus 5
cgcgagcggcggacuuggc

SEQ ID NO: 565125 - RNA, 22 nt, Human herpesvirus 5
cgcggccgggugggugugugcc

SEQ ID NO: 565126 - RNA, 19 nt, Human herpesvirus 5
cgcggagccaggcugcggc

SEQ ID NO: 565127 - RNA, 19 nt, Human herpesvirus 5
cgcggcacaggcuuucgcg

SEQ ID NO: 565128 - RNA, 22 nt, Human herpesvirus 5
cggcgguuucgccaccgcugac

SEQ ID NO: 565129 - RNA, 22 nt, Human herpesvirus 5
cgguagauguccaggugcuuac

SEQ ID NO: 565130 - RNA, 18 nt, Human herpesvirus 5
cgguagcucucgucgcuc

SEQ ID NO: 565131 - RNA, 22 nt, Human herpesvirus 5
cgguaguaguaguuggggagga

SEQ ID NO: 565132 - RNA, 22 nt, Human herpesvirus 5
cggucgacguuggcugcgcacc

SEQ ID NO: 565133 - RNA, 22 nt, Human herpesvirus 5
cggugggggcgugccccgcaga

SEQ ID NO: 565134 - RNA, 22 nt, Human herpesvirus 5
cgggaagaggagggugguucau

SEQ ID NO: 565135 - RNA, 22 nt, Human herpesvirus 5
cgggccaguagcagagguggac

SEQ ID NO: 565136 - RNA, 22 nt, Human herpesvirus 5
cggcggcgcccgagcgggacau

SEQ ID NO: 565137 - RNA, 22 nt, Human herpesvirus 5
cgggcguacuaccccacgucaa

SEQ ID NO: 565138 - RNA, 22 nt, Human herpesvirus 5
cggcgaccgcggacucgccucg

SEQ ID NO: 565139 - RNA, 22 nt, Human herpesvirus 5
cgcguaaccguuguccguuaua

SEQ ID NO: 565140 - RNA, 22 nt, Human herpesvirus 5
cgcguucuggacugcauccguc

SEQ ID NO: 565141 - RNA, 22 nt, Human herpesvirus 5
cgcguugcgaacggugucguua

SEQ ID NO: 565142 - RNA, 22 nt, Human herpesvirus 5
cgcuaaccuucggggcuguugc

SEQ ID NO: 565143 - RNA, 22 nt, Human herpesvirus 5
cggcagcugcagcacguggaga

SEQ ID NO: 565144 - RNA, 22 nt, Human herpesvirus 5
cggagaauggccggcgcugcgc

SEQ ID NO: 565145 - RNA, 22 nt, Human herpesvirus 5
cggagacugggcugcaggcggc

SEQ ID NO: 565146 - RNA, 22 nt, Human herpesvirus 5
cggaggucacgccacaugaagc

SEQ ID NO: 565147 - RNA, 22 nt, Human herpesvirus 5
cgcuguuggagcugcucaucga

SEQ ID NO: 565148 - RNA, 22 nt, Human herpesvirus 5
cggacgugucaucucgcccgga

SEQ ID NO: 565149 - RNA, 22 nt, Human herpesvirus 5
uggaacaccaaauuguacgugg

SEQ ID NO: 565150 - RNA, 22 nt, Human herpesvirus 5
ugcuuuuauugcugauaacugu

SEQ ID NO: 565151 - RNA, 22 nt, Human herpesvirus 5
uggacgccgccucugccggcuc

SEQ ID NO: 565152 - RNA, 22 nt, Human herpesvirus 5
ugcugauaacuguuguacugua

SEQ ID NO: 565153 - RNA, 22 nt, Human herpesvirus 5
ugcuggagcgcgacgacgaggc

SEQ ID NO: 565154 - RNA, 22 nt, Human herpesvirus 5
ugcgcuguuacacggaauccag

SEQ ID NO: 565155 - RNA, 22 nt, Human herpesvirus 5
ugcgggaacuggccuggcggcg

SEQ ID NO: 565156 - RNA, 22 nt, Human herpesvirus 5
ugcguuccagccuggccgcgcg

SEQ ID NO: 565157 - RNA, 22 nt, Human herpesvirus 5
ugcucacggccacgggcugcug

SEQ ID NO: 565158 - RNA, 22 nt, Human herpesvirus 5
ugcuccgacugucggggcgcag

SEQ ID NO: 565159 - RNA, 22 nt, Human herpesvirus 5
ugcucgcaguaguggcgcagcu

SEQ ID NO: 565160 - RNA, 22 nt, Human herpesvirus 5
ugcccgggccaugcaucgccuc

SEQ ID NO: 565161 - RNA, 22 nt, Human herpesvirus 5
ugcccgucuacgcgguccacgg

SEQ ID NO: 565162 - RNA, 22 nt, Human herpesvirus 5
accucgucaaucuugacgcgac

SEQ ID NO: 565163 - RNA, 20 nt, Human herpesvirus 5
ugcgccagguaguaaagcac

SEQ ID NO: 565164 - RNA, 22 nt, Human herpesvirus 5
ugcgccgguacgccgggaaggu

SEQ ID NO: 565165 - RNA, 19 nt, Human herpesvirus 5
acgaggcuggugagcgcga

SEQ ID NO: 565166 - RNA, 20 nt, Human herpesvirus 5
acgcaccgagagacugaggc

SEQ ID NO: 565167 - RNA, 21 nt, Human herpesvirus 5
acgcacgucgccguccauguc

SEQ ID NO: 565168 - RNA, 21 nt, Human herpesvirus 5
acgcacgugaggcaaucuccg

SEQ ID NO: 565169 - RNA, 22 nt, Human herpesvirus 5
acgcaggagcgucugacuagca

SEQ ID NO: 565170 - RNA, 22 nt, Human herpesvirus 5
accgcuauccacgcccauugau

SEQ ID NO: 565171 - RNA, 22 nt, Human herpesvirus 5
acgcuguuuccgaauaccggga

SEQ ID NO: 565172 - RNA, 22 nt, Human herpesvirus 5
acgcuguuuuacuuuugucggg

SEQ ID NO: 565173 - RNA, 22 nt, Human herpesvirus 5
acgcggccccgcaccggcggug

SEQ ID NO: 565174 - RNA, 22 nt, Human herpesvirus 5
acgccgggucgcaccgaggugg

SEQ ID NO: 565175 - RNA, 22 nt, Human herpesvirus 5
acgcaggggcuggacgugguua

SEQ ID NO: 565176 - RNA, 22 nt, Human herpesvirus 5
acacggcaguuagagacuggag

SEQ ID NO: 565177 - RNA, 22 nt, Human herpesvirus 5
acagggaaugggaaaaacacgc

SEQ ID NO: 565178 - RNA, 22 nt, Human herpesvirus 5
accaguucugcccucggugcau

SEQ ID NO: 565179 - RNA, 22 nt, Human herpesvirus 5
accagacgcgauggcccgcuau

SEQ ID NO: 565180 - RNA, 22 nt, Human herpesvirus 5
accagccguagccaaucccgau

SEQ ID NO: 565181 - RNA, 22 nt, Human herpesvirus 5
accaguccaagcacguccgguc

SEQ ID NO: 565182 - RNA, 22 nt, Human herpesvirus 5
acaaacuagcauucuggugaga

SEQ ID NO: 565183 - RNA, 22 nt, Human herpesvirus 5
acaccuccguuuugagcguguu

SEQ ID NO: 565184 - RNA, 22 nt, Human herpesvirus 5
aaucauccuguacgaagaggaa

SEQ ID NO: 565185 - RNA, 22 nt, Human herpesvirus 5
uacugcugaaugagcaucugaa

SEQ ID NO: 565186 - RNA, 22 nt, Human herpesvirus 5
uagcuccggcauggugcugccg

SEQ ID NO: 565187 - RNA, 22 nt, Human herpesvirus 5
uagaagaagcaccggcggccgc

SEQ ID NO: 565188 - RNA, 17 nt, Human herpesvirus 5
uacgccgcgacgcgugc

SEQ ID NO: 565189 - RNA, 16 nt, Human herpesvirus 5
uacggaguuuucccuc

SEQ ID NO: 565190 - RNA, 21 nt, Human herpesvirus 5
uacgacaucaccgaggcggag

SEQ ID NO: 565191 - RNA, 22 nt, Human herpesvirus 5
uacgaugcgagccacggcuugg

SEQ ID NO: 565192 - RNA, 22 nt, Human herpesvirus 5
uaauauuccuuugaacgcugag

SEQ ID NO: 565193 - RNA, 22 nt, Human herpesvirus 5
uaccgccgcgucgucucguauu

SEQ ID NO: 565194 - RNA, 22 nt, Human herpesvirus 5
uaccgcgagauccucuuucguu

SEQ ID NO: 565195 - RNA, 22 nt, Human herpesvirus 5
uacgucggccaacaaccacggc

SEQ ID NO: 565196 - RNA, 22 nt, Human herpesvirus 5
uacguggcuauguuugccaguu

SEQ ID NO: 565197 - RNA, 22 nt, Human herpesvirus 5
uacuaguggaauaguuaacggu

SEQ ID NO: 565198 - RNA, 22 nt, Human herpesvirus 5
guucccaggccgagaacgcgca

SEQ ID NO: 565199 - RNA, 22 nt, Human herpesvirus 5
guugagguaaaugaugauauag

SEQ ID NO: 565200 - RNA, 22 nt, Human herpesvirus 5
guugcacgcgucgcggcguaug

SEQ ID NO: 565201 - RNA, 22 nt, Human herpesvirus 5
guugcacgggcucgggugacgg

SEQ ID NO: 565202 - RNA, 22 nt, Human herpesvirus 5
guuugucuuugagcgcgcgaca

SEQ ID NO: 565203 - RNA, 22 nt, Human herpesvirus 5
guuuuccgacuuagccuuuggu

SEQ ID NO: 565204 - RNA, 22 nt, Human herpesvirus 5
uaaccacguccagccccugcgu

SEQ ID NO: 565205 - RNA, 22 nt, Human herpesvirus 5
guucaucguaacguuguugcug

SEQ ID NO: 565206 - RNA, 22 nt, Human herpesvirus 5
guucaugcugccuaucuacgag

SEQ ID NO: 565207 - RNA, 18 nt, Human herpesvirus 5
guucuccaauggauacgu

SEQ ID NO: 565208 - RNA, 22 nt, Human herpesvirus 5
guuguccuccucguccucgugg

SEQ ID NO: 565209 - RNA, 21 nt, Human herpesvirus 5
guuguuggccgacguagcgcc

SEQ ID NO: 565210 - RNA, 20 nt, Human herpesvirus 5
guuuaacgugagguugaaga

SEQ ID NO: 565211 - RNA, 21 nt, Human herpesvirus 5
guuuaacgugagguugaagau

SEQ ID NO: 565212 - RNA, 22 nt, Human herpesvirus 5
guuucgcggcagcgcaagccgu

SEQ ID NO: 565213 - RNA, 22 nt, Human herpesvirus 5
gugcucuuugucgacgacgugg

SEQ ID NO: 565214 - RNA, 22 nt, Human herpesvirus 5
gugcacgcgcugcuuucgcacg

SEQ ID NO: 565215 - RNA, 22 nt, Human herpesvirus 5
gugcaacagcccgugucgcgca

SEQ ID NO: 565216 - RNA, 22 nt, Human herpesvirus 5
guggccgcuaaauauggcgacg

SEQ ID NO: 565217 - RNA, 22 nt, Human herpesvirus 5
guggcgcuucgcuacgcgguga

SEQ ID NO: 565218 - RNA, 22 nt, Human herpesvirus 5
guggcgguaggguaugugucug

SEQ ID NO: 565219 - RNA, 22 nt, Human herpesvirus 5
guggcgguuguuucuccgucgc

SEQ ID NO: 565220 - RNA, 22 nt, Human herpesvirus 5
guggguucaugcugccuaucua

SEQ ID NO: 565221 - RNA, 22 nt, Human herpesvirus 5
gucucgagcgccccccgaugua

SEQ ID NO: 565222 - RNA, 22 nt, Human herpesvirus 5
guguucguggacgcguacggcg

SEQ ID NO: 565223 - RNA, 22 nt, Human herpesvirus 5
guccgcacagagguaacaacgu

SEQ ID NO: 565224 - RNA, 18 nt, Human herpesvirus 5
guccgccgccgccgcggu

SEQ ID NO: 565225 - RNA, 22 nt, Human herpesvirus 5
gucugcaggacggcgcucguuc

SEQ ID NO: 565226 - RNA, 22 nt, Human herpesvirus 5
gucucuggccggcgccagaccg

SEQ ID NO: 565227 - RNA, 22 nt, Human herpesvirus 5
gucguaacgauucacggagcac

SEQ ID NO: 565228 - RNA, 22 nt, Human herpesvirus 5
gugauccgccgaucgaugacca

SEQ ID NO: 565229 - RNA, 22 nt, Human herpesvirus 5
gugaucuacgaacugguguagg

SEQ ID NO: 565230 - RNA, 22 nt, Human herpesvirus 5
gugacguagcaauuaucguauu

SEQ ID NO: 565231 - RNA, 22 nt, Human herpesvirus 5
gucgcagucagacccacuaccu

SEQ ID NO: 565232 - RNA, 22 nt, Human herpesvirus 5
uuguuucgccgccggcgagcuc

SEQ ID NO: 565233 - RNA, 22 nt, Human herpesvirus 5
uugccgucguccgucacccggg

SEQ ID NO: 565234 - RNA, 22 nt, Human herpesvirus 5
uugcgauagcgggccaucgcgu

SEQ ID NO: 565235 - RNA, 22 nt, Human herpesvirus 5
uugcgcguuaaguugcaauuuu

SEQ ID NO: 565236 - RNA, 22 nt, Human herpesvirus 5
uucuggucguuuugcugcucau

SEQ ID NO: 565237 - RNA, 22 nt, Human herpesvirus 5
uugaccagcagcuugcagcgcu

SEQ ID NO: 565238 - RNA, 22 nt, Human herpesvirus 5
uuccuuuccuguuuuguacucg

SEQ ID NO: 565239 - RNA, 22 nt, Human herpesvirus 5
uucgccguugcuguuccuccgc

SEQ ID NO: 565240 - RNA, 23 nt, Human herpesvirus 5
uucguagagaacgauggaggacg

SEQ ID NO: 565241 - RNA, 21 nt, Human herpesvirus 5
uuacgaggucugcauguuggu

SEQ ID NO: 565242 - RNA, 22 nt, Human herpesvirus 5
uuaaagcaaaaagucuggugag

SEQ ID NO: 565243 - RNA, 22 nt, Human herpesvirus 5
uucaccgucgcugugcaacgcg

SEQ ID NO: 565244 - RNA, 22 nt, Human herpesvirus 5
uucagcgucucauuugucuuua

SEQ ID NO: 565245 - RNA, 22 nt, Human herpesvirus 5
uucagcuucauaagaugucugc

SEQ ID NO: 565246 - RNA, 22 nt, Human herpesvirus 5
uuccaccgugguguaaccgcga

SEQ ID NO: 565247 - RNA, 22 nt, Human herpesvirus 5
uguuguugcgggauguucaagg

SEQ ID NO: 565248 - RNA, 17 nt, Human herpesvirus 5
ccgugaagacgaccugu

SEQ ID NO: 565249 - RNA, 22 nt, Human herpesvirus 5
ccgugaugagcacgguguucug

SEQ ID NO: 565250 - RNA, 21 nt, Human herpesvirus 5
cccaacaggaucaucgaccuc

SEQ ID NO: 565251 - RNA, 22 nt, Human herpesvirus 5
ccccucuuucugcgucguggcu

SEQ ID NO: 565252 - RNA, 22 nt, Human herpesvirus 5
ccaucgagggccugcgcgccug

SEQ ID NO: 565253 - RNA, 22 nt, Human herpesvirus 5
aucugcuguagauaucauaacg

SEQ ID NO: 565254 - RNA, 21 nt, Human herpesvirus 5
aucuccucucgcucggcggcg

SEQ ID NO: 565255 - RNA, 22 nt, Human herpesvirus 5
aguauacuaauaugaagcgucg

SEQ ID NO: 565256 - RNA, 22 nt, Human herpesvirus 5
aucggcuuccaagacgaccuag

SEQ ID NO: 565257 - RNA, 22 nt, Human herpesvirus 5
augaaaaacacgacgaaagcgu

SEQ ID NO: 565258 - RNA, 22 nt, Human herpesvirus 5
aucuugagcggcagcgcguaca

SEQ ID NO: 565259 - RNA, 22 nt, Human herpesvirus 5
ccgcgugucuaaaccgcgugcu

SEQ ID NO: 565260 - RNA, 22 nt, Human herpesvirus 5
ccgguauucggaaacagcgucc

SEQ ID NO: 565261 - RNA, 22 nt, Human herpesvirus 5
ccggcgagcugacgaguggcgg

SEQ ID NO: 565262 - RNA, 22 nt, Human herpesvirus 5
ccgggaaagagcugcgacagcg

SEQ ID NO: 565263 - RNA, 22 nt, Human herpesvirus 5
ccgaucaccagaaggcggacau

SEQ ID NO: 565264 - RNA, 22 nt, Human herpesvirus 5
ccgccuccucgaguauuguucc

SEQ ID NO: 565265 - RNA, 22 nt, Human herpesvirus 5
ccgccucgcccauguguacgca

SEQ ID NO: 565266 - RNA, 22 nt, Human herpesvirus 5
ccgacugugggaagcuguccac

SEQ ID NO: 565267 - RNA, 22 nt, Human herpesvirus 5
agugacggugagauccaggcug

SEQ ID NO: 565268 - RNA, 20 nt, Human herpesvirus 5
agugcgccgagcggccguug

SEQ ID NO: 565269 - RNA, 22 nt, Human herpesvirus 5
aguggcaggcccggguucgcga

SEQ ID NO: 565270 - RNA, 22 nt, Human herpesvirus 5
aucaccaugguaauagcgauga

SEQ ID NO: 565271 - RNA, 22 nt, Human herpesvirus 5
aucagcggcgugaugguaagca

SEQ ID NO: 565272 - RNA, 22 nt, Human herpesvirus 5
agguggugugcgaucccuucca

SEQ ID NO: 565273 - RNA, 22 nt, Human herpesvirus 5
agguugcuguugcggcgcgagc

SEQ ID NO: 565274 - RNA, 22 nt, Human herpesvirus 5
ucggcgucagguaggcgcgcag

SEQ ID NO: 565275 - RNA, 22 nt, Human herpesvirus 5
ucguacgugagcgagucgaguc

SEQ ID NO: 565276 - RNA, 22 nt, Human herpesvirus 5
ucgucacgcucaaggacaucga

SEQ ID NO: 565277 - RNA, 22 nt, Human herpesvirus 5
ucgugcagccgcaugagacgug

SEQ ID NO: 565278 - RNA, 19 nt, Human herpesvirus 5
ucggcccgugccgggaccc

SEQ ID NO: 565279 - RNA, 22 nt, Human herpesvirus 5
ucggccuacggagugcugacga

SEQ ID NO: 565280 - RNA, 22 nt, Human herpesvirus 5
ucggccuuaaggcggccgcgug

SEQ ID NO: 565281 - RNA, 22 nt, Human herpesvirus 5
ucgcaacagcagcucucggugc

SEQ ID NO: 565282 - RNA, 22 nt, Human herpesvirus 5
ucgcggcggcucccucucggcg

SEQ ID NO: 565283 - RNA, 22 nt, Human herpesvirus 5
ucggaggcgugcucguaucccg

SEQ ID NO: 565284 - RNA, 22 nt, Human herpesvirus 5
ucgccgcgauaacgacagguca

SEQ ID NO: 565285 - RNA, 22 nt, Human herpesvirus 5
ucgccgucgaguacgugcugau

SEQ ID NO: 565286 - RNA, 22 nt, Human herpesvirus 5
ucgcgaucuccgagaggaggag

SEQ ID NO: 565287 - RNA, 22 nt, Human herpesvirus 5
ucgcgcaccauaaacucgccua

SEQ ID NO: 565288 - RNA, 22 nt, Human herpesvirus 5
ucgcgcguacggacgaguggaa

SEQ ID NO: 565289 - RNA, 22 nt, Human herpesvirus 5
gucaacgguggcgacaccguac

SEQ ID NO: 565290 - RNA, 18 nt, Human herpesvirus 5
ucgacucguccgagaccc

SEQ ID NO: 565291 - RNA, 22 nt, Human herpesvirus 5
gguuugcuuccuauauagugga

SEQ ID NO: 565292 - RNA, 22 nt, Human herpesvirus 5
guaaagacaaaugagacgcuga

SEQ ID NO: 565293 - RNA, 22 nt, Human herpesvirus 5
guacuuuccgcuguuuuccguc

SEQ ID NO: 565294 - RNA, 22 nt, Human herpesvirus 5
guaucggggcuccgacgccuua

SEQ ID NO: 565295 - RNA, 22 nt, Human herpesvirus 5
gucacagagcgugcugacgugg

SEQ ID NO: 565296 - RNA, 22 nt, Human herpesvirus 5
gguacuugacgcgggugcgcgu

SEQ ID NO: 565297 - RNA, 22 nt, Human herpesvirus 5
gguccgcgucgcguagcgcuuc

SEQ ID NO: 565298 - RNA, 22 nt, Human herpesvirus 5
gggucccggcacgggccgagga

SEQ ID NO: 565299 - RNA, 22 nt, Human herpesvirus 5
gggucucggacgagucgacacg

SEQ ID NO: 565300 - RNA, 22 nt, Human herpesvirus 5
ggucgcgcugcuuuccccgagc

SEQ ID NO: 565301 - RNA, 22 nt, Human herpesvirus 5
ggucugcgcgacauuuuggguc

SEQ ID NO: 565302 - RNA, 22 nt, Human herpesvirus 5
ggugaaguggagggccacggug

SEQ ID NO: 565303 - RNA, 22 nt, Human herpesvirus 5
ggugguaaaacuucggcccgca

SEQ ID NO: 565304 - RNA, 22 nt, Human herpesvirus 5
ggugcacguugaugcuggggau

SEQ ID NO: 565305 - RNA, 22 nt, Human herpesvirus 5
ggagaacuauuuucuuugucaa

SEQ ID NO: 565306 - RNA, 22 nt, Human herpesvirus 5
ggagccguagcggcgggaaccg

SEQ ID NO: 565307 - RNA, 22 nt, Human herpesvirus 5
ggagcggggcguccgaaggcga

SEQ ID NO: 565308 - RNA, 22 nt, Human herpesvirus 5
ggaggcuuucgccacaccuauc

SEQ ID NO: 565309 - RNA, 22 nt, Human herpesvirus 5
ggagugacggacggccaguacg

SEQ ID NO: 565310 - RNA, 22 nt, Human herpesvirus 5
ggcaagccgagcgggaggcggu

SEQ ID NO: 565311 - RNA, 22 nt, Human herpesvirus 5
ggccgccuagcgcuuccagcug

SEQ ID NO: 565312 - RNA, 22 nt, Human herpesvirus 5
ggcacggaccgcaacgugcugc

SEQ ID NO: 565313 - RNA, 22 nt, Human herpesvirus 5
ggcacggucucgcacgccaccu

SEQ ID NO: 565314 - RNA, 22 nt, Human herpesvirus 5
ggcgaccagaagcccggugccg

SEQ ID NO: 565315 - RNA, 23 nt, Human herpesvirus 5
ggcgauucgccgccgccgauacc

SEQ ID NO: 565316 - RNA, 22 nt, Human herpesvirus 5
gcgccggcacgaugcagcuggc

SEQ ID NO: 565317 - RNA, 22 nt, Human herpesvirus 5
gcgccuggacguugcacgcggc

SEQ ID NO: 565318 - RNA, 22 nt, Human herpesvirus 5
gcgcucacggccgaguucggcc

SEQ ID NO: 565319 - RNA, 22 nt, Human herpesvirus 5
gcgcucguuaaucugaacgaag

SEQ ID NO: 565320 - RNA, 22 nt, Human herpesvirus 5
gcgcugaucugcagcugcacgg

SEQ ID NO: 565321 - RNA, 23 nt, Human herpesvirus 5
gcgggcacugggucugcacgacg

SEQ ID NO: 565322 - RNA, 22 nt, Human herpesvirus 5
gcggcgucgaauuaccgggcgg

SEQ ID NO: 565323 - RNA, 22 nt, Human herpesvirus 5
gcggccuuggcggucgggucug

SEQ ID NO: 565324 - RNA, 21 nt, Human herpesvirus 5
gcggcgaaucgcccgggcugc

SEQ ID NO: 565325 - RNA, 22 nt, Human herpesvirus 5
gcggagcagggagcgcaaggcc

SEQ ID NO: 565326 - RNA, 22 nt, Human herpesvirus 5
gcggaucggacaucauacugac

SEQ ID NO: 565327 - RNA, 22 nt, Human herpesvirus 5
gcgcuggaggaccugcugccca

SEQ ID NO: 565328 - RNA, 22 nt, Human herpesvirus 5
aacucgcgugccgacggggucu

SEQ ID NO: 565329 - RNA, 21 nt, Human herpesvirus 5
aacgcggcacaugggcggcgg

SEQ ID NO: 565330 - RNA, 22 nt, Human herpesvirus 5
aacgcuuucgucguguuuuuca

SEQ ID NO: 565331 - RNA, 22 nt, Human herpesvirus 5
aacgacguggacuuuugguuac

SEQ ID NO: 565332 - RNA, 22 nt, Human herpesvirus 5
aacgagcgcuguguggccgucu

SEQ ID NO: 565333 - RNA, 22 nt, Human herpesvirus 5
aaacgacguagacgaugaaccg

SEQ ID NO: 565334 - RNA, 22 nt, Human herpesvirus 5
aaagcaaggcacguucauaaug

SEQ ID NO: 565335 - RNA, 22 nt, Human herpesvirus 5
aaaguuggcugcgcccguuggu

SEQ ID NO: 565336 - RNA, 22 nt, Human herpesvirus 5
aaauaacgguacagagcgcgaa

SEQ ID NO: 565337 - RNA, 22 nt, Human herpesvirus 5
aaaggcuaagucggaaaacucg

SEQ ID NO: 565338 - RNA, 22 nt, Human herpesvirus 5
aaggauggcaacuuggacacgu

SEQ ID NO: 565339 - RNA, 22 nt, Human herpesvirus 5
gcgacauggacggcgacgugcg

SEQ ID NO: 565340 - RNA, 22 nt, Human herpesvirus 5
gcgacggucuuuuuugccuggg

SEQ ID NO: 565341 - RNA, 22 nt, Human herpesvirus 5
gccuucuuuggacucugcggcc

SEQ ID NO: 565342 - RNA, 22 nt, Human herpesvirus 5
gcgcagccaacuuucauacuug

SEQ ID NO: 565343 - RNA, 20 nt, Human herpesvirus 5
gcgcaggauauggcagccug

SEQ ID NO: 565344 - RNA, 22 nt, Human herpesvirus 5
gcgcaugaaggguugcggguug

SEQ ID NO: 565345 - RNA, 22 nt, Human herpesvirus 5
gcgaggacacgcagacggcgga

SEQ ID NO: 565346 - RNA, 22 nt, Human herpesvirus 5
uguggcgccagcgaaccggcgg

SEQ ID NO: 565347 - RNA, 22 nt, Human herpesvirus 5
ugugcucggaccgugacggugg

SEQ ID NO: 565348 - RNA, 22 nt, Human herpesvirus 5
ugucggagcugucggcgcuggg

SEQ ID NO: 565349 - RNA, 22 nt, Human herpesvirus 5
ugucgguaggcgccuacggccg

SEQ ID NO: 565350 - RNA, 22 nt, Human herpesvirus 5
ugucugcucauucuggcggcgc

SEQ ID NO: 565351 - RNA, 22 nt, Human herpesvirus 5
uguacucaagagagcgauuggu

SEQ ID NO: 565352 - RNA, 23 nt, Human herpesvirus 5
uggggcaguuugagcagcccacc

SEQ ID NO: 565353 - RNA, 22 nt, Human herpesvirus 5
ccaggagcucaucauguucggg

SEQ ID NO: 565354 - RNA, 22 nt, Human herpesvirus 5
ccaccgauccgcacgaccgcga

SEQ ID NO: 565355 - RNA, 22 nt, Human herpesvirus 5
ccacggaaaacgguaguuuugu

SEQ ID NO: 565356 - RNA, 22 nt, Human herpesvirus 5
ccagcaguaugacgugcgaugg

SEQ ID NO: 565357 - RNA, 22 nt, Human herpesvirus 5
uggcguggcgcacgcagcgacc

SEQ ID NO: 565358 - RNA, 22 nt, Human herpesvirus 5
caguaucguguugugcuucaac

SEQ ID NO: 565359 - RNA, 22 nt, Human herpesvirus 5
caggucgcggauuuguuaucgg

SEQ ID NO: 565360 - RNA, 22 nt, Human herpesvirus 5
cauacguuuuugggaaaguugg

SEQ ID NO: 565361 - RNA, 22 nt, Human herpesvirus 5
caucacguccuuuaagagcugu

SEQ ID NO: 565362 - RNA, 22 nt, Human herpesvirus 5
cagggcgcuuuggcaaaaggcg

SEQ ID NO: 565363 - RNA, 22 nt, Human herpesvirus 5
cagcucgucuuuuuagccguga

SEQ ID NO: 565364 - RNA, 22 nt, Human herpesvirus 5
cagcgggucgcucuugauaaac

SEQ ID NO: 565365 - RNA, 21 nt, Human herpesvirus 5
ccaaccgucaagauccgcguu

SEQ ID NO: 565366 - RNA, 22 nt, Human herpesvirus 5
ccaacgcaacagaccuaggcac

SEQ ID NO: 565367 - RNA, 22 nt, Human herpesvirus 5
ccaagucagagcagcgucgguc

SEQ ID NO: 565368 - RNA, 22 nt, Human herpesvirus 5
cagugucagcgccgagccgcgg

SEQ ID NO: 565369 - RNA, 22 nt, Human herpesvirus 5
caguugacugagauugagaucc

SEQ ID NO: 565370 - RNA, 22 nt, Human herpesvirus 5
caccgcccauggguuccugcug

SEQ ID NO: 565371 - RNA, 22 nt, Human herpesvirus 5
cagccgccgucgcuggugggca

SEQ ID NO: 565372 - RNA, 22 nt, Human herpesvirus 5
cacugcgagggccagcccagcg

SEQ ID NO: 565373 - RNA, 22 nt, Human herpesvirus 5
cacguuaaugcgcgagacggcg

SEQ ID NO: 565374 - RNA, 21 nt, Human herpesvirus 5
cacguugcgguccgugcccgc

SEQ ID NO: 565375 - RNA, 22 nt, Human herpesvirus 5
cacggccagcgccuugucgcgg

SEQ ID NO: 565376 - RNA, 22 nt, Human herpesvirus 5
cacgccguccuugacgacgcag

SEQ ID NO: 565377 - RNA, 22 nt, Human herpesvirus 5
cacgaacguguccucggugaag

SEQ ID NO: 565378 - RNA, 22 nt, Human herpesvirus 5
caccaccgcagucggaggagga

SEQ ID NO: 565379 - RNA, 22 nt, Human herpesvirus 5
cacccguuucugccgcucgcga

SEQ ID NO: 565380 - RNA, 22 nt, Human herpesvirus 5
caacgacuggacgacgucguuu

SEQ ID NO: 565381 - RNA, 22 nt, Human herpesvirus 5
caaaauaucgaacucuucgcgg

SEQ ID NO: 565382 - RNA, 22 nt, Human herpesvirus 5
caacaccguaaagccguugcgc

SEQ ID NO: 565383 - RNA, 21 nt, Human herpesvirus 5
augucgcugaaauugcggauc

SEQ ID NO: 565384 - RNA, 22 nt, Human herpesvirus 5
augucucccuuggagaacgucg

SEQ ID NO: 565385 - RNA, 22 nt, Human herpesvirus 5
uuuuuccacugggcggccgcac

SEQ ID NO: 565386 - RNA, 22 nt, Human herpesvirus 5
cgccgcaggcccucauagucgc

SEQ ID NO: 565387 - RNA, 22 nt, Human herpesvirus 5
cgccgccagcggguacacgugc

SEQ ID NO: 565388 - RNA, 22 nt, Human herpesvirus 5
cgccgcccaugugccgcguucc

SEQ ID NO: 565389 - RNA, 22 nt, Human herpesvirus 5
uuucucaucaaccugucgaugg

SEQ ID NO: 565390 - RNA, 22 nt, Human herpesvirus 5
uuuguuggcggggcucacggug

SEQ ID NO: 565391 - RNA, 17 nt, Human herpesvirus 5
uuuggcuacgguggugu

SEQ ID NO: 565392 - RNA, 22 nt, Human herpesvirus 5
ccugccgcgucaccgugugucc

SEQ ID NO: 565393 - RNA, 22 nt, Human herpesvirus 5
ccugcgugccagucuguccguc

SEQ ID NO: 565394 - RNA, 23 nt, Human herpesvirus 5
ccuucgguaucaucgucuuugcu

SEQ ID NO: 565395 - RNA, 22 nt, Human herpesvirus 5
aggcggacgagguagagguuug

SEQ ID NO: 565396 - RNA, 22 nt, Human herpesvirus 5
aggcgugccggcgcccauggcc

SEQ ID NO: 565397 - RNA, 22 nt, Human herpesvirus 5
aggacgccguauuggugcgcga

SEQ ID NO: 565398 - RNA, 22 nt, Human herpesvirus 5
aggagagccuacagacgggacg

SEQ ID NO: 565399 - RNA, 22 nt, Human herpesvirus 5
agcggucguuuuaaccgcaggu

SEQ ID NO: 565400 - RNA, 22 nt, Human herpesvirus 5
aggccagaggcuaagccgaaac

SEQ ID NO: 565401 - RNA, 22 nt, Human herpesvirus 5
aggcgaguccgcggucgccgcc

SEQ ID NO: 565402 - RNA, 22 nt, Human herpesvirus 5
cgcacgaccuaugguguugcug

SEQ ID NO: 565403 - RNA, 22 nt, Human herpesvirus 5
cgcacgauggccaugcgcguca

SEQ ID NO: 565404 - RNA, 22 nt, Human herpesvirus 5
cgaggccgacagccuggagaug

SEQ ID NO: 565405 - RNA, 22 nt, Human herpesvirus 5
cgaggcggugcccgcgacucgc

SEQ ID NO: 565406 - RNA, 18 nt, Human herpesvirus 5
cgagaacgcgcccuuucc

SEQ ID NO: 565407 - RNA, 22 nt, Human herpesvirus 5
cgagcugcugaugugccgucgc

SEQ ID NO: 565408 - RNA, 22 nt, Human herpesvirus 5
cgagcugucggaauccucgucg

SEQ ID NO: 565409 - RNA, 22 nt, Human herpesvirus 5
cgacgcagaaccacgcgcaguu

SEQ ID NO: 565410 - RNA, 22 nt, Human herpesvirus 5
agguggagauucuaaagccacg

SEQ ID NO: 565411 - RNA, 22 nt, Human herpesvirus 5
cgacgaagaugcgucgaaucgc

SEQ ID NO: 565412 - RNA, 22 nt, Human herpesvirus 5
cgacgacgaugcagccugccgc

SEQ ID NO: 565413 - RNA, 22 nt, Human herpesvirus 5
agcaccgagagcugcuguugcg

SEQ ID NO: 565414 - RNA, 22 nt, Human herpesvirus 5
agcagacaguguaguucuugcc

SEQ ID NO: 565415 - RNA, 22 nt, Human herpesvirus 5
agcagcgugugcaguucggcgu

SEQ ID NO: 565416 - RNA, 22 nt, Human herpesvirus 5
agacggguacggcgcgccgcau

SEQ ID NO: 565417 - RNA, 22 nt, Human herpesvirus 5
agaggggacgucggggcccucc

SEQ ID NO: 565418 - RNA, 22 nt, Human herpesvirus 5
agacgcagugguccgucggugu

SEQ ID NO: 565419 - RNA, 22 nt, Human herpesvirus 5
agcggcgugaugauacggagcg

SEQ ID NO: 565420 - RNA, 22 nt, Human herpesvirus 5
agcggguaaguucuaagaaaca

SEQ ID NO: 565421 - RNA, 22 nt, Human herpesvirus 5
agccgugcugggccucaacgcg

SEQ ID NO: 565422 - RNA, 22 nt, Human herpesvirus 5
agccguguuuuuugcacaauuu

SEQ ID NO: 565423 - RNA, 22 nt, Human herpesvirus 5
agcgcgugcuucggcgguugcu

SEQ ID NO: 565424 - RNA, 22 nt, Human herpesvirus 5
agccgcgcaugacgcaggugag

SEQ ID NO: 565425 - RNA, 22 nt, Human herpesvirus 5
agcgcgaggcgucggagcucgg

SEQ ID NO: 565426 - RNA, 22 nt, Human herpesvirus 5
acgugguuuuugcuuccgagcu

SEQ ID NO: 565427 - RNA, 22 nt, Human herpesvirus 5
acuguugcagcgcuugggucag

SEQ ID NO: 565428 - RNA, 22 nt, Human herpesvirus 5
acuuccccgucguacuggcggc

SEQ ID NO: 565429 - RNA, 22 nt, Human herpesvirus 5
acuucuuucgcucccucgaccc

SEQ ID NO: 565430 - RNA, 22 nt, Human herpesvirus 5
acuuggaacgccgcggcgcaca

SEQ ID NO: 565431 - RNA, 22 nt, Human herpesvirus 5
acggcggacgaccggcauggcg

SEQ ID NO: 565432 - RNA, 22 nt, Human herpesvirus 5
acggcgugauugagcaccugcg

SEQ ID NO: 565433 - RNA, 22 nt, Human herpesvirus 5
acgucagcgguggcgaaaccgc

SEQ ID NO: 565434 - RNA, 22 nt, Human herpesvirus 5
acgucgcgagaccugguguuug

SEQ ID NO: 565435 - RNA, 22 nt, Human herpesvirus 5
acgucugagcgccgcugacagu

SEQ ID NO: 565436 - RNA, 22 nt, Human herpesvirus 5
acggguaucugcagcuggaccu

SEQ ID NO: 565437 - RNA, 22 nt, Human herpesvirus 5
acggugucgccaccguugacgu

SEQ ID NO: 565438 - RNA, 22 nt, Human herpesvirus 5
ggcguuggccuguggauagauu

SEQ ID NO: 565439 - RNA, 22 nt, Human herpesvirus 5
gggccacgucgggcugcugccg

SEQ ID NO: 565440 - RNA, 22 nt, Human herpesvirus 5
gggcgagacggugcaggagucc

SEQ ID NO: 565441 - RNA, 22 nt, Human herpesvirus 5
gggcgagucgcgggcaccgccu

SEQ ID NO: 565442 - RNA, 22 nt, Human herpesvirus 5
ggcgcgcacagccuccugucga

SEQ ID NO: 565443 - RNA, 22 nt, Human herpesvirus 5
ggcgcguucucgcccuugaggc

SEQ ID NO: 565444 - RNA, 22 nt, Human herpesvirus 5
ggcgucggagccccgauacaug

SEQ ID NO: 565445 - RNA, 22 nt, Human herpesvirus 5
ggcgugcgcgaccccuagucgg

SEQ ID NO: 565446 - RNA, 19 nt, Human herpesvirus 5
ggcugucggguacgugacg

SEQ ID NO: 565447 - RNA, 22 nt, Human herpesvirus 5
gggaucauuuucuuggccgugg

SEQ ID NO: 565448 - RNA, 22 nt, Human herpesvirus 5
gcgugcugauuguaguuuuugc

SEQ ID NO: 565449 - RNA, 22 nt, Human herpesvirus 5
gcguuucgguccacguguccug

SEQ ID NO: 565450 - RNA, 22 nt, Human herpesvirus 5
gcgguccaacugcagccgcuuc

SEQ ID NO: 565451 - RNA, 23 nt, Human herpesvirus 5
gcgguucgccgucaucguugucg

SEQ ID NO: 565452 - RNA, 22 nt, Human herpesvirus 5
gcgucaaacuggugacgacgga

SEQ ID NO: 565453 - RNA, 22 nt, Human herpesvirus 5
gcuuggucuucacguccagcag

SEQ ID NO: 565454 - RNA, 22 nt, Human herpesvirus 5
gcucgucuuuuuagccgugacc

SEQ ID NO: 565455 - RNA, 22 nt, Human herpesvirus 5
gcucgcaguaguggcgcagcug

SEQ ID NO: 565456 - RNA, 22 nt, Human herpesvirus 5
gcaguacccgaacacggcgccc

SEQ ID NO: 565457 - RNA, 22 nt, Human herpesvirus 5
gcaggugguucaccacguccgu

SEQ ID NO: 565458 - RNA, 22 nt, Human herpesvirus 5
gcagcgagccgcguaacgucug

SEQ ID NO: 565459 - RNA, 22 nt, Human herpesvirus 5
gcagcucgggcguguuuucguc

SEQ ID NO: 565460 - RNA, 22 nt, Human herpesvirus 5
gaccgaccgccgcuuuggucgg

SEQ ID NO: 565461 - RNA, 22 nt, Human herpesvirus 5
gacggcgucuucggucucgagc

SEQ ID NO: 565462 - RNA, 22 nt, Human herpesvirus 5
gcaagugcuucagcagcagcuu

SEQ ID NO: 565463 - RNA, 22 nt, Human herpesvirus 5
gcacuccgggcgagaugacacg

SEQ ID NO: 565464 - RNA, 22 nt, Human herpesvirus 5
gccacgcgauuggccgucggcg

SEQ ID NO: 565465 - RNA, 22 nt, Human herpesvirus 5
gcaguugcaguagagcaauuua

SEQ ID NO: 565466 - RNA, 22 nt, Human herpesvirus 5
gccaugucguuucgcgucggca

SEQ ID NO: 565467 - RNA, 22 nt, Human herpesvirus 5
gccgaggacgccgugggcggcg

SEQ ID NO: 565468 - RNA, 22 nt, Human herpesvirus 5
gcggggucguggcggcuguguc

SEQ ID NO: 565469 - RNA, 23 nt, Human herpesvirus 5
gccggcaaaauguagguggcguu

SEQ ID NO: 565470 - RNA, 22 nt, Human herpesvirus 5
gccgugugggaaugacggugau

SEQ ID NO: 565471 - RNA, 22 nt, Human herpesvirus 5
gccgucugcagcucgucggccg

SEQ ID NO: 565472 - RNA, 22 nt, Human herpesvirus 5
gccgucugcguguccucgcugg

SEQ ID NO: 565473 - RNA, 22 nt, Human herpesvirus 5
gacaacgugguccaguacgucc

SEQ ID NO: 565474 - RNA, 22 nt, Human herpesvirus 5
gacagcaacaggcgcuccgggc

SEQ ID NO: 565475 - RNA, 22 nt, Human herpesvirus 5
gaccguggcgguggcgggcaug

SEQ ID NO: 565476 - RNA, 22 nt, Human herpesvirus 5
gaccucuggccagucgugcgcg

SEQ ID NO: 565477 - RNA, 21 nt, Human herpesvirus 5
gaacaugaugccguugcagac

SEQ ID NO: 565478 - RNA, 22 nt, Human herpesvirus 5
cugucguuaucgcggcgaaugc

SEQ ID NO: 565479 - RNA, 22 nt, Human herpesvirus 5
cugcgugcacggccaagacauu

SEQ ID NO: 565480 - RNA, 22 nt, Human herpesvirus 5
cuguggcgggucgcgacgacga

SEQ ID NO: 565481 - RNA, 22 nt, Human herpesvirus 5
cuggacacguuguuaagcggcg

SEQ ID NO: 565482 - RNA, 22 nt, Human herpesvirus 5
cuggagaacgccggggcagcag

SEQ ID NO: 565483 - RNA, 22 nt, Human herpesvirus 5
cugcugugaaaacgggcacggu

SEQ ID NO: 565484 - RNA, 22 nt, Human herpesvirus 5
cuucagaucguggacguguuug

SEQ ID NO: 565485 - RNA, 22 nt, Human herpesvirus 5
cuucgaggcccaugguucucug

SEQ ID NO: 565486 - RNA, 17 nt, Human herpesvirus 5
cuuugcgggcauguacg

SEQ ID NO: 565487 - RNA, 22 nt, Human herpesvirus 5
cuugugguuaaguuguagauag

SEQ ID NO: 565488 - RNA, 22 nt, Human herpesvirus 5
cuuggcguggcgcacgcagcga

SEQ ID NO: 565489 - RNA, 22 nt, Human herpesvirus 5
cuucuugaccguuaucacggug

SEQ ID NO: 565490 - RNA, 22 nt, Human herpesvirus 5
cguuccggcgggugguugacgu

SEQ ID NO: 565491 - RNA, 22 nt, Human herpesvirus 5
cgugucgaugcgcuggugccag

SEQ ID NO: 565492 - RNA, 22 nt, Human herpesvirus 5
cguguacgaucaccggcuggcu

SEQ ID NO: 565493 - RNA, 22 nt, Human herpesvirus 5
cucaccuggaccggugguacug

SEQ ID NO: 565494 - RNA, 22 nt, Human herpesvirus 5
cucgguuucgcuguagcugugg

SEQ ID NO: 565495 - RNA, 22 nt, Human herpesvirus 5
cugccuacgcgaucggcggccg

SEQ ID NO: 565496 - RNA, 22 nt, Human herpesvirus 5
cugcgcacgcucucggucacgg

SEQ ID NO: 565497 - RNA, 22 nt, Human herpesvirus 5
cugcaggaaacguuggcgacgg

SEQ ID NO: 565498 - RNA, 22 nt, Human herpesvirus 5
cugcaggaaccaguugugcgga

SEQ ID NO: 565499 - RNA, 22 nt, Human herpesvirus 5
cuccuccuccgacugcgguggu

SEQ ID NO: 565500 - RNA, 22 nt, Human herpesvirus 5
cucggcgcgucacaugagcgau

SEQ ID NO: 565501 - RNA, 23 nt, Human herpesvirus 5
cucgggcgccugugacaugaggc

SEQ ID NO: 565502 - RNA, 22 nt, Human herpesvirus 5
cucgagaccgaagacgccguca

SEQ ID NO: 565503 - RNA, 22 nt, Human herpesvirus 5
cucgagaugcacuccgcuucag

SEQ ID NO: 565504 - RNA, 22 nt, Human
aaacucuuuccacgauuacuuu

SEQ ID NO: 565505 - RNA, 22 nt, Human
ugagcugggaguggugaugagg

SEQ ID NO: 565506 - RNA, 22 nt, Human
acauuucuaguuguucaucucc

SEQ ID NO: 565507 - RNA, 22 nt, Human
uauuucuauuccccaggcaagu

SEQ ID NO: 565508 - RNA, 22 nt, Human
uucuaccauugggaaaacagcc

SEQ ID NO: 565509 - RNA, 22 nt, Human
acugauacaucuguggaagugg

SEQ ID NO: 565510 - RNA, 22 nt, Human
uucuaguuuagggcucuucaac

SEQ ID NO: 565511 - RNA, 22 nt, Human
cagguccuggcaucaggcaggu

SEQ ID NO: 565512 - RNA, 22 nt, Human
cuguuauuuagaacauggaauc

SEQ ID NO: 565513 - RNA, 22 nt, Human
uucuaguucccucuggaaugua

SEQ ID NO: 565514 - RNA, 22 nt, Human
guuucuuuugugaucaccaacc

SEQ ID NO: 565515 - RNA, 22 nt, Human
auguaacacccacuuuuauagc

SEQ ID NO: 565516 - RNA, 22 nt, Human
acuguacaacugcugagcagaa

SEQ ID NO: 565517 - RNA, 22 nt, Human
uagcauuucacugaucuucacu

SEQ ID NO: 565518 - RNA, 22 nt, Human
uaggaaaaauacagaauuauau

SEQ ID NO: 565519 - RNA, 23 nt, Human
cuacaagagcaagcauggacaag

SEQ ID NO: 565520 - RNA, 22 nt, Human
ucucugaguaagugacaguuca

SEQ ID NO: 565521 - RNA, 22 nt, Human
acaggccucaagacacccaggu

SEQ ID NO: 565522 - RNA, 22 nt, Human
ucuuauuauuguuguaaaagca

SEQ ID NO: 565523 - RNA, 22 nt, Human
uauggaaaguguuuucuucugu

SEQ ID NO: 565524 - RNA, 22 nt, Human
cucaggaggaggaaguucauug

SEQ ID NO: 565525 - RNA, 22 nt, Human
gaaaaagugaccuugguagcua

SEQ ID NO: 565526 - RNA, 22 nt, Human
uaccacuacauuugcuaauggc

SEQ ID NO: 565527 - RNA, 22 nt, Human
ugagacaguucugcagcugggu

SEQ ID NO: 565528 - RNA, 22 nt, Human
acauuucugucuuagggacugu

SEQ ID NO: 565529 - RNA, 22 nt, Human
acuaagaccuagauacuagggg

SEQ ID NO: 565530 - RNA, 22 nt, Human
uaucugcaucugcauguguauu

SEQ ID NO: 565531 - RNA, 22 nt, Human
uuccagcuaacucacaucccuu

SEQ ID NO: 565532 - RNA, 22 nt, Human
aaacacuagcaggaagcacuga

SEQ ID NO: 565533 - RNA, 23 nt, Human
ucuguacacaucagcaucuccca

SEQ ID NO: 565534 - RNA, 22 nt, Human
ucaagucuggagaucuggaacu

SEQ ID NO: 565535 - RNA, 22 nt, Human
uuuccuuugcccaauacauguc

SEQ ID NO: 565536 - RNA, 22 nt, Human
ggcaggagcucuccaguuugcc

SEQ ID NO: 565537 - RNA, 22 nt, Human
cuuggucauuuggggcugcuau

SEQ ID NO: 565538 - RNA, 22 nt, Human
ugaaggaaaugacggcagaaga

SEQ ID NO: 565539 - RNA, 22 nt, Human
aaacuguaaauacuaguaagug

SEQ ID NO: 565540 - RNA, 22 nt, Human
gacaagacaccucucuccaucc

SEQ ID NO: 565541 - RNA, 22 nt, Human
ugggaaugugagcauucauuca

SEQ ID NO: 565542 - RNA, 22 nt, Human
uuuaccauccucuuuuagaauu

SEQ ID NO: 565543 - RNA, 17 nt, Human
gacaagacagaauucau

SEQ ID NO: 565544 - RNA, 23 nt, Human
agaaaaguucauaccuuuuuaac

SEQ ID NO: 565545 - RNA, 22 nt, Human
gguucaguuuacauuaaaaucu

SEQ ID NO: 565546 - RNA, 22 nt, Human
aagacuguacauuuuccagucu

SEQ ID NO: 565547 - RNA, 22 nt, Human
uuauuuauucauucugucuguc

SEQ ID NO: 565548 - RNA, 22 nt, Human
gaaauugucagcuucuuucagu

SEQ ID NO: 565549 - RNA, 22 nt, Human
gacuguacgucauugaaggcca

SEQ ID NO: 565550 - RNA, 22 nt, Human
aacaugaaaaccuccacagcaa

SEQ ID NO: 565551 - RNA, 22 nt, Human
uucuacacucacccagcuguaa

SEQ ID NO: 565552 - RNA, 22 nt, Human
ucuuugcauggacauguguuuu

SEQ ID NO: 565553 - RNA, 22 nt, Human
uaauccaauggcacaauguaug

SEQ ID NO: 565554 - RNA, 22 nt, Human
aggcugugacagggucauggag

SEQ ID NO: 565555 - RNA, 22 nt, Human
cugcuuccauggucuggagacu

SEQ ID NO: 565556 - RNA, 22 nt, Human
uauuucuaagcuguaagucuga

SEQ ID NO: 565557 - RNA, 22 nt, Human
aaaguucucuaugguguaaaaa

SEQ ID NO: 565558 - RNA, 22 nt, Human
uaauccaaaacugaaucugugg

SEQ ID NO: 565559 - RNA, 20 nt, Human
uacagucagggcacaggcag

SEQ ID NO: 565560 - RNA, 22 nt, Human
acaacugucaguaaagaauauu

SEQ ID NO: 565561 - RNA, 22 nt, Human
guccaagagucaagaagggggc

SEQ ID NO: 565562 - RNA, 22 nt, Human
aaauauguaagauuagcacuag

SEQ ID NO: 565563 - RNA, 22 nt, Human
cauuucuauggcaaugggaaaa

SEQ ID NO: 565564 - RNA, 22 nt, Human
ucuguacacuucagcaugcauc

SEQ ID NO: 565565 - RNA, 22 nt, Human
uucuggaaguguuagaaucugg

SEQ ID NO: 565566 - RNA, 22 nt, Human
uaacagcuggcguuauaggaau

SEQ ID NO: 565567 - RNA, 22 nt, Human
acagcaaaggacgaacacucug

SEQ ID NO: 565568 - RNA, 22 nt, Human
gcuguacaggguuauccuuucc

SEQ ID NO: 565569 - RNA, 22 nt, Human
cugcuuccaugcaauggcaguc

SEQ ID NO: 565570 - RNA, 22 nt, Human
cuccagcuuuuucccaguuggc

SEQ ID NO: 565571 - RNA, 22 nt, Human
aaaauccacaacgcucauuuca

SEQ ID NO: 565572 - RNA, 22 nt, Human
aaaaaccuuucccauacuaaga

SEQ ID NO: 565573 - RNA, 22 nt, Human
uuuugauaucaugaugaacaga

SEQ ID NO: 565574 - RNA, 22 nt, Human
accaucuuaguggccagcucuc

SEQ ID NO: 565575 - RNA, 22 nt, Human
caauaguaaauuacggaggaga

SEQ ID NO: 565576 - RNA, 22 nt, Human
acagacuguuugguucaugucu

SEQ ID NO: 565577 - RNA, 22 nt, Human
agcuuuuaguacguuaaaauug

SEQ ID NO: 565578 - RNA, 22 nt, Human
uuuccacuguagagauguugaa

SEQ ID NO: 565579 - RNA, 22 nt, Human
gcuguacauucugcacaggccc

SEQ ID NO: 565580 - RNA, 22 nt, Human
aaaaacugcaauuacuuuuguc

SEQ ID NO: 565581 - RNA, 22 nt, Human
ggcagaggaggggugaauuugc

SEQ ID NO: 565582 - RNA, 22 nt, Human
gcgguagcucaagcuuguaauc

SEQ ID NO: 565583 - RNA, 22 nt, Human
cugagcugguucucuugugaaa

SEQ ID NO: 565584 - RNA, 22 nt, Human
caaaagaagcucuuggggcuag

SEQ ID NO: 565585 - RNA, 22 nt, Human
uguuuuuccaugugcagaacaa

SEQ ID NO: 565586 - RNA, 22 nt, Human
acauuucucauucuccccuaac

SEQ ID NO: 565587 - RNA, 22 nt, Human
aagaagaaguguuauuuuuaga

SEQ ID NO: 565588 - RNA, 22 nt, Human
acauaaaggugacuaacaucuu

SEQ ID NO: 565589 - RNA, 22 nt, Human
uaaacaagcugucugauauucu

SEQ ID NO: 565590 - RNA, 22 nt, Human
cacuuggaggaaggccuauuca

SEQ ID NO: 565591 - RNA, 22 nt, Human
ucaggagacuuaugucacagug

SEQ ID NO: 565592 - RNA, 22 nt, Human
gaaauucaggacaaagacucuu

SEQ ID NO: 565593 - RNA, 22 nt, Human
ucagaaugaaauuucuuucaga

SEQ ID NO: 565594 - RNA, 22 nt, Human
ggcagagguagcuggaaccagg

SEQ ID NO: 565595 - RNA, 22 nt, Human
ucuuuuaucuguuguguaacaa

SEQ ID NO: 565596 - RNA, 22 nt, Human
ggaggcucgcuggucgcacagc

SEQ ID NO: 565597 - RNA, 22 nt, Human
aagaauuuuccagcaugucagu

SEQ ID NO: 565598 - RNA, 22 nt, Human
acauuucuucccuuuagcagaa

SEQ ID NO: 565599 - RNA, 22 nt, Human
aagucaaucacaugcacacuga

SEQ ID NO: 565600 - RNA, 22 nt, Human
cuccagcuucccucagcugugg

SEQ ID NO: 565601 - RNA, 22 nt, Human
acaguucccgucuugcacagcu

SEQ ID NO: 565602 - RNA, 22 nt, Human
ccuguacuagggucucauugcc

SEQ ID NO: 565603 - RNA, 22 nt, Human
uucuaguucauauucucaaaga

SEQ ID NO: 565604 - RNA, 22 nt, Human
acuguaaauuuugguugcaggu

SEQ ID NO: 565605 - RNA, 22 nt, Human
auaaacugaagggaacacugag

SEQ ID NO: 565606 - RNA, 21 nt, Human
aaacugaagagacaggaacuu

SEQ ID NO: 565607 - RNA, 22 nt, Human
acuguacaugcaucuugucuau

SEQ ID NO: 565608 - RNA, 22 nt, Human
gguuccacgguguuuggaggca

SEQ ID NO: 565609 - RNA, 22 nt, Human
cuacagcagagcuacacuaacu

SEQ ID NO: 565610 - RNA, 22 nt, Human
guuauauauaguauuucucuga

SEQ ID NO: 565611 - RNA, 22 nt, Human
uucugucugauggugccagaac

SEQ ID NO: 565612 - RNA, 22 nt, Human
cuauuuaucuauuucugaauga

SEQ ID NO: 565613 - RNA, 22 nt, Human
uucucuugugccaaguuguugc

SEQ ID NO: 565614 - RNA, 22 nt, Human
gguuccccaggcggcccuugga

SEQ ID NO: 565615 - RNA, 22 nt, Human
cucaggaguuggaggcuacagu

SEQ ID NO: 565616 - RNA, 20 nt, Human
uuuuauauguaggguauaug

SEQ ID NO: 565617 - RNA, 22 nt, Human
aauaagaauuuacuugucaaga

SEQ ID NO: 565618 - RNA, 22 nt, Human
ucuccacucugagugccuuuca

SEQ ID NO: 565619 - RNA, 22 nt, Human
auuucuacaguacacaugcauu

SEQ ID NO: 565620 - RNA, 22 nt, Human
augcagaaggagccaugcuugc

SEQ ID NO: 565621 - RNA, 18 nt, Human
acauuucuaggugaaagc

SEQ ID NO: 565622 - RNA, 22 nt, Human
aauguuacgaucaacaacacau

SEQ ID NO: 565623 - RNA, 22 nt, Human
gcuguacaguuuacuagguggg

SEQ ID NO: 565624 - RNA, 22 nt, Human
uuccacuuaguggaagggcaug

SEQ ID NO: 565625 - RNA, 21 nt, Human
uguuuauggaaaagagacaaa

SEQ ID NO: 565626 - RNA, 22 nt, Human
caaaacugucuagagagagaag

SEQ ID NO: 565627 - RNA, 22 nt, Human
auuuauuauugugguuacuucu

SEQ ID NO: 565628 - RNA, 22 nt, Human
guguuaaccagcuaaacuuugc

SEQ ID NO: 565629 - RNA, 22 nt, Human
gcaaaaacugcaauuacuuuug

SEQ ID NO: 565630 - RNA, 23 nt, Human
aggagaagagauuuccacaugca

SEQ ID NO: 565631 - RNA, 22 nt, Human
acuuucuuaggcuguauaaaug

SEQ ID NO: 565632 - RNA, 22 nt, Human
acaagaauuauuucuaguuaac

SEQ ID NO: 565633 - RNA, 22 nt, Human
uaaaacugcuugguauggucua

SEQ ID NO: 565634 - RNA, 22 nt, Human
uccagcucaggguuggcucaag

SEQ ID NO: 565635 - RNA, 22 nt, Human
augucuuucuuauggucuguug

SEQ ID NO: 565636 - RNA, 22 nt, Human
acuuuuuuauaaggaagaagau

SEQ ID NO: 565637 - RNA, 22 nt, Human
uuucuauuuacagugcuaggua

SEQ ID NO: 565638 - RNA, 22 nt, Human
aacauuucuucugaaacugagu

SEQ ID NO: 565639 - RNA, 21 nt, Human
uuuguucaggggcaaaguuaa

SEQ ID NO: 565640 - RNA, 18 nt, Human
aagaacugagguccuaga

SEQ ID NO: 565641 - RNA, 22 nt, Human
ggaggcuccuaagcugacuuga

SEQ ID NO: 565642 - RNA, 22 nt, Human
aggcagagagcaguggccgucu

SEQ ID NO: 565643 - RNA, 22 nt, Human
aaauguucuacuuugauaauua

SEQ ID NO: 565644 - RNA, 22 nt, Human
aguuucuguuaccauauuugac

SEQ ID NO: 565645 - RNA, 22 nt, Human
acagacaaguaguucagacaag

SEQ ID NO: 565646 - RNA, 22 nt, Human
aagacuguaugagacaauauaa

SEQ ID NO: 565647 - RNA, 22 nt, Human
acauuucucagguaagucauuu

SEQ ID NO: 565648 - RNA, 22 nt, Human
uauugaaauccauuacguucuu

SEQ ID NO: 565649 - RNA, 22 nt, Human
acuguccauaauauuggugaac

SEQ ID NO: 565650 - RNA, 22 nt, Human
cacuguacugugaauaaggagg

SEQ ID NO: 565651 - RNA, 16 nt, Human
aggcagagauuuaccc

SEQ ID NO: 565652 - RNA, 22 nt, Human
ucagaaauagucuuuaaaauga

SEQ ID NO: 565653 - RNA, 22 nt, Human
aaacuguaaagcaggugaguag

SEQ ID NO: 565654 - RNA, 22 nt, Human
aguuucuaacauauagcauugg

SEQ ID NO: 565655 - RNA, 22 nt, Human
ucugucuuuagaggccugugcu

SEQ ID NO: 565656 - RNA, 21 nt, Human
agaaaaacacgauauaagccc

SEQ ID NO: 565657 - RNA, 19 nt, Human
agacucugugugagacuuu

SEQ ID NO: 565658 - RNA, 22 nt, Human
cacuguacagcauuaacaaggc

SEQ ID NO: 565659 - RNA, 22 nt, Human
uugucuuuggaaauuuaauguu

SEQ ID NO: 565660 - RNA, 22 nt, Human
ccuguauuagguagacaacuau

SEQ ID NO: 565661 - RNA, 20 nt, Human
acuggacacugaggugagcu

SEQ ID NO: 565662 - RNA, 22 nt, Human
uucuaguuuucaguccaccagg

SEQ ID NO: 565663 - RNA, 22 nt, Human
ucagucuccuuuccucuagaca

SEQ ID NO: 565664 - RNA, 21 nt, Human
uuuauuaacaacuguggacgu

SEQ ID NO: 565665 - RNA, 22 nt, Human
acuauacauugaauguuaaggu

SEQ ID NO: 565666 - RNA, 22 nt, Human
uacaagacgagggaaguucuuu

SEQ ID NO: 565667 - RNA, 23 nt, Human
aaagacugcugagaauuuuagga

SEQ ID NO: 565668 - RNA, 22 nt, Human
uuucuacagguugauggguuug

SEQ ID NO: 565669 - RNA, 22 nt, Human
gacccuguuucuacaaauaauu

SEQ ID NO: 565670 - RNA, 22 nt, Human
auucagaaauagaaaauuugau

SEQ ID NO: 565671 - RNA, 22 nt, Human
acauuucucagggaguuuugcu

SEQ ID NO: 565672 - RNA, 19 nt, Human
cuggaaugauagagaccuc

SEQ ID NO: 565673 - RNA, 22 nt, Human
acauuucugagcagggagcugu

SEQ ID NO: 565674 - RNA, 22 nt, Human
aagaaaguggguaauaugauuu

SEQ ID NO: 565675 - RNA, 22 nt, Human
cuacaagauuuuuaaaacugua

SEQ ID NO: 565676 - RNA, 23 nt, Human
uuuuccagaaucgacucuguaga

SEQ ID NO: 565677 - RNA, 22 nt, Human
aaaaacuguaauuacuuuugca

SEQ ID NO: 565678 - RNA, 22 nt, Human
uucuaguucccacauaguugcc

SEQ ID NO: 565679 - RNA, 22 nt, Human
cuuuggaacauacugcugagcu

SEQ ID NO: 565680 - RNA, 22 nt, Human
gcugugagcugccugugucaca

SEQ ID NO: 565681 - RNA, 22 nt, Human
auggcagagggauugaacagcu

SEQ ID NO: 565682 - RNA, 22 nt, Human
gcagaggccaucaacuuugcca

SEQ ID NO: 565683 - RNA, 22 nt, Human
cagcugaguuuccaagucugcc

SEQ ID NO: 565684 - RNA, 22 nt, Human
gaaagacauaguugcaagaugg

SEQ ID NO: 565685 - RNA, 22 nt, Human
cuguacaggucaaugauaagau

SEQ ID NO: 565686 - RNA, 22 nt, Human
uaaggaaacaacuuguauuuuu

SEQ ID NO: 565687 - RNA, 22 nt, Human
acauuucugcauguaggguaau

SEQ ID NO: 565688 - RNA, 22 nt, Human
guacaaaaguuauugcgguuuu

SEQ ID NO: 565689 - RNA, 22 nt, Human
cucaggagguuuccugucuagg

SEQ ID NO: 565690 - RNA, 22 nt, Human
caguuucucucauacauauuug

SEQ ID NO: 565691 - RNA, 22 nt, Human
uagcauuuggacauugucaccu

SEQ ID NO: 565692 - RNA, 22 nt, Human
aaagacugggacugcagcaggc

SEQ ID NO: 565693 - RNA, 22 nt, Human
gcuguacauuuguguacacuug

SEQ ID NO: 565694 - RNA, 21 nt, Human
ggcuguggagccaugacucac

SEQ ID NO: 565695 - RNA, 22 nt, Human
gcuuuaaauggcuugcccaagu

SEQ ID NO: 565696 - RNA, 22 nt, Human
agaggaaaaugaguuccagaau

SEQ ID NO: 565697 - RNA, 22 nt, Human
auaaaaaugagggcgguagcua

SEQ ID NO: 565698 - RNA, 22 nt, Human
aaaguucagugccuucuauaca

SEQ ID NO: 565699 - RNA, 22 nt, Human
ccuguacacggucuaugccucc

SEQ ID NO: 565700 - RNA, 22 nt, Human
cuguacagaguucugaguguac

SEQ ID NO: 565701 - RNA, 22 nt, Human
ugaaacaagggaccguccuuuc

SEQ ID NO: 565702 - RNA, 22 nt, Human
uuuguucacugagcaaugauua

SEQ ID NO: 565703 - RNA, 22 nt, Human
uucuacuuuggacauaaaggac

SEQ ID NO: 565704 - RNA, 22 nt, Human
gcuguacaaggccucugccauc

SEQ ID NO: 565705 - RNA, 22 nt, Human
gguuccaccuggcgagggguau

SEQ ID NO: 565706 - RNA, 22 nt, Human
caauuucuaacauuccauggau

SEQ ID NO: 565707 - RNA, 22 nt, Human
aacauuucagcaaauaagaaca

SEQ ID NO: 565708 - RNA, 22 nt, Human
caaacuguucucugugggauuc

SEQ ID NO: 565709 - RNA, 22 nt, Human
acauuucuuucuauucaguagc

SEQ ID NO: 565710 - RNA, 22 nt, Human
uuucuacaugucaauccaaacc

SEQ ID NO: 565711 - RNA, 21 nt, Human
uaaaacuguaacuuuguccug

SEQ ID NO: 565712 - RNA, 22 nt, Human
caaaauucugcauuucuaauaa

SEQ ID NO: 565713 - RNA, 22 nt, Human
acauuguauaaugauuaucaca

SEQ ID NO: 565714 - RNA, 22 nt, Human
gcuguacaaauuccacaagaga

SEQ ID NO: 565715 - RNA, 22 nt, Human
uuggccacacucacuagagccc

SEQ ID NO: 565716 - RNA, 22 nt, Human
ucuguacauuuggggaccccag

SEQ ID NO: 565717 - RNA, 22 nt, Human
gagaaaauagcauguguaguau

SEQ ID NO: 565718 - RNA, 22 nt, Human
auccacccugugguggcuuucu

SEQ ID NO: 565719 - RNA, 22 nt, Human
gcagaauguaggccuucagugu

SEQ ID NO: 565720 - RNA, 22 nt, Human
ucacaagauacaguuagaagca

SEQ ID NO: 565721 - RNA, 22 nt, Human
ccuguacauggccaucuuuacc

SEQ ID NO: 565722 - RNA, 22 nt, Human
acacuguagcugagggcaugcg

SEQ ID NO: 565723 - RNA, 22 nt, Human
uaggaaaagcacaggauguucu

SEQ ID NO: 565724 - RNA, 20 nt, Human
aacacugugcgugguaggug

SEQ ID NO: 565725 - RNA, 22 nt, Human
agaacugguggugaucaguuau

SEQ ID NO: 565726 - RNA, 22 nt, Human
gaaaacugugauuagaaugccu

SEQ ID NO: 565727 - RNA, 22 nt, Human
cuguaaaacugcuuaaguaugc

SEQ ID NO: 565728 - RNA, 22 nt, Human
ugcucagugagucugugacagg

SEQ ID NO: 565729 - RNA, 22 nt, Human
aagacugucugggacaagauga

SEQ ID NO: 565730 - RNA, 22 nt, Human
caguuccuaugggcaaaacaca

SEQ ID NO: 565731 - RNA, 22 nt, Human
caguucuaauuaauaggaguaa

SEQ ID NO: 565732 - RNA, 22 nt, Human
cucuccagaucugcugagccag

SEQ ID NO: 565733 - RNA, 22 nt, Human
caggagacuauggcccaaggcc

SEQ ID NO: 565734 - RNA, 17 nt, Human
ucugucuugacugucac

SEQ ID NO: 565735 - RNA, 22 nt, Human
uuuacacauaccucuuuaaagu

SEQ ID NO: 565736 - RNA, 22 nt, Human
uggaaacuaagacuagagagac

SEQ ID NO: 565737 - RNA, 22 nt, Human
uucaaguucauguguagucagu

SEQ ID NO: 565738 - RNA, 23 nt, Human
cagaggcaucggauucaacauca

SEQ ID NO: 565739 - RNA, 22 nt, Human
uaaggaaagugccaugauuucu

SEQ ID NO: 565740 - RNA, 22 nt, Human
uacuguacugcaguucugcaaa

SEQ ID NO: 565741 - RNA, 22 nt, Human
auuuaacaagacagagaacugg

SEQ ID NO: 565742 - RNA, 22 nt, Human
auucuacaacccaauaauaauu

SEQ ID NO: 565743 - RNA, 22 nt, Human
caaagacugcauaacacaugaa

SEQ ID NO: 565744 - RNA, 22 nt, Human
aacauguagcagaaacgacuaa

SEQ ID NO: 565745 - RNA, 22 nt, Human
auacaaagcuuucugucuggua

SEQ ID NO: 565746 - RNA, 22 nt, Human
ggaaacagagggcaccugagcc

SEQ ID NO: 565747 - RNA, 22 nt, Human
gacaaaacacauuaguuuaaaa

SEQ ID NO: 565748 - RNA, 23 nt, Human
ucuguacaauugagaagagaaca

SEQ ID NO: 565749 - RNA, 19 nt, Human
gcuguacaguaaggagaca

SEQ ID NO: 565750 - RNA, 22 nt, Human
ucaggagauguaaccuuagcug

SEQ ID NO: 565751 - RNA, 22 nt, Human
ucuaccacuuauuagcucugug

SEQ ID NO: 565752 - RNA, 22 nt, Human
acuguaaccaguguggugagag

SEQ ID NO: 565753 - RNA, 22 nt, Human
ucccuagucgcaucuguggaga

SEQ ID NO: 565754 - RNA, 22 nt, Human
aaacaguagaaguguauuuuau

SEQ ID NO: 565755 - RNA, 22 nt, Human
cucccacuccuggcucaccaca

SEQ ID NO: 565756 - RNA, 22 nt, Human
aggcugugauuccaccacucuc

SEQ ID NO: 565757 - RNA, 22 nt, Human
ugaaacaaauuuggaaaaucua

SEQ ID NO: 565758 - RNA, 22 nt, Human
agacuguacuuucugcagcucu

SEQ ID NO: 565759 - RNA, 22 nt, Human
auuguacagaugagguaaguga

SEQ ID NO: 565760 - RNA, 22 nt, Human
agugcaauguguacagaaaaau

SEQ ID NO: 565761 - RNA, 22 nt, Human
aagauuuaccacuuuauucaag

SEQ ID NO: 565762 - RNA, 22 nt, Human
caugaaaaauuuacuguuaaca

SEQ ID NO: 565763 - RNA, 22 nt, Human
cugucuuugguccugucuguua

SEQ ID NO: 565764 - RNA, 22 nt, Human
cugugacagagcuugagugaga

SEQ ID NO: 565765 - RNA, 19 nt, Human
acaaacugaguacacuugu

SEQ ID NO: 565766 - RNA, 22 nt, Human
aauacagauauucagugguacu

SEQ ID NO: 565767 - RNA, 22 nt, Human
cucaggaggccauucucaaggu

SEQ ID NO: 565768 - RNA, 22 nt, Human
ggcagaggaaggaugaauucac

SEQ ID NO: 565769 - RNA, 17 nt, Human
gguucaguucugcauuc

SEQ ID NO: 565770 - RNA, 22 nt, Human
uucuacuuuagcaugcucauuc

SEQ ID NO: 565771 - RNA, 22 nt, Human
guucaaguucauaucucuuaac

SEQ ID NO: 565772 - RNA, 22 nt, Human
aacuguaauuuuuacauaguaa

SEQ ID NO: 565773 - RNA, 22 nt, Human
aggcagaggaaggguggauuug

SEQ ID NO: 565774 - RNA, 22 nt, Human
aacuuucuuucacagaaguauc

SEQ ID NO: 565775 - RNA, 22 nt, Human
acuguauaaggcauagguaagc

SEQ ID NO: 565776 - RNA, 22 nt, Human
acauuucuaauuuaauguaaca

SEQ ID NO: 565777 - RNA, 22 nt, Human
agccaggauggucucgaucggc

SEQ ID NO: 565778 - RNA, 22 nt, Human
uugacaaaggaccuugcuauuu

SEQ ID NO: 565779 - RNA, 22 nt, Human
agcauaaaggucaacguuuuag

SEQ ID NO: 565780 - RNA, 22 nt, Human
aagcuuuaaggaauuuuaugga

SEQ ID NO: 565781 - RNA, 22 nt, Human
uuucuacauucaaaaacuacca

SEQ ID NO: 565782 - RNA, 22 nt, Human
aacuguaaggcuuagaacagca

SEQ ID NO: 565783 - RNA, 22 nt, Human
ugucucaucucuuaaccccacu

SEQ ID NO: 565784 - RNA, 22 nt, Human
aaaaguuaccucuguaauauaa

SEQ ID NO: 565785 - RNA, 22 nt, Human
auucuucugccuacuuucaucc

SEQ ID NO: 565786 - RNA, 22 nt, Human
gacauaaaauucaauaauuugu

SEQ ID NO: 565787 - RNA, 22 nt, Human
ucauuucucugagucugauaau

SEQ ID NO: 565788 - RNA, 22 nt, Human
gcuuuuauugucuuuacgacga

SEQ ID NO: 565789 - RNA, 22 nt, Human
auaccuguguauccacaagcgu

SEQ ID NO: 565790 - RNA, 22 nt, Human
cuuggucauuucuuguccuguu

SEQ ID NO: 565791 - RNA, 22 nt, Human
acauuucucuuagaguuggacu

SEQ ID NO: 565792 - RNA, 22 nt, Human
aggcaagaacagacaugggagu

SEQ ID NO: 565793 - RNA, 22 nt, Human
cugguuccaggauggaucuuuc

SEQ ID NO: 565794 - RNA, 22 nt, Human
auagcagaaaccaagcuucuuc

SEQ ID NO: 565795 - RNA, 22 nt, Human
caggaaugacccaacaguuuca

SEQ ID NO: 565796 - RNA, 22 nt, Human
acuguacacagugguguacugu

SEQ ID NO: 565797 - RNA, 22 nt, Human
ccaguucugacacaagcacagu

SEQ ID NO: 565798 - RNA, 22 nt, Human
auacuguaucacuugugaguga

SEQ ID NO: 565799 - RNA, 22 nt, Human
caguauuuucaggauuuggaag

SEQ ID NO: 565800 - RNA, 19 nt, Human
aaaaggaauauucuuuggg

SEQ ID NO: 565801 - RNA, 22 nt, Human
aggcagagcugauguucuguga

SEQ ID NO: 565802 - RNA, 22 nt, Human
ggcaggaggaagaguuagcacc

SEQ ID NO: 565803 - RNA, 20 nt, Human
ucuguacacucaucuucugc

SEQ ID NO: 565804 - RNA, 22 nt, Human
gacaagacagcuugcagacaac

SEQ ID NO: 565805 - RNA, 22 nt, Human
aaagacugcaaaaacgcacaga

SEQ ID NO: 565806 - RNA, 22 nt, Human
agcaauaacagaaaacuuuccu

SEQ ID NO: 565807 - RNA, 22 nt, Human
uggacaacauagugagaccuca

SEQ ID NO: 565808 - RNA, 22 nt, Human
acuguacuuuucuuggcuagau

SEQ ID NO: 565809 - RNA, 22 nt, Human
cuguacauaaaggaauaggugu

SEQ ID NO: 565810 - RNA, 22 nt, Human
uugaaaaaauugguagaggaug

SEQ ID NO: 565811 - RNA, 22 nt, Human
cugucugucaccaaaacagacu

SEQ ID NO: 565812 - RNA, 22 nt, Human
uucauaguguuuccuuccagug

SEQ ID NO: 565813 - RNA, 22 nt, Human
aaacuguaggagggaaaggaag

SEQ ID NO: 565814 - RNA, 22 nt, Human
uaggaaaagucuagauugauga

SEQ ID NO: 565815 - RNA, 22 nt, Human
uuucuauucuggaucuguggca

SEQ ID NO: 565816 - RNA, 23 nt, Human
uggcuccaugaaaauuacgagga

SEQ ID NO: 565817 - RNA, 22 nt, Human
ucuguacauuuguguugugaau

SEQ ID NO: 565818 - RNA, 22 nt, Human
acuguacauauggauucuaaga

SEQ ID NO: 565819 - RNA, 22 nt, Human
aagaaacuguugcgugacagcg

SEQ ID NO: 565820 - RNA, 22 nt, Human
uaaagccacuucauucuagucu

SEQ ID NO: 565821 - RNA, 22 nt, Human
agaaaauuagauuuuacugugu

SEQ ID NO: 565822 - RNA, 22 nt, Human
ugaguccaccuuaguauauggg

SEQ ID NO: 565823 - RNA, 22 nt, Human
aagaaaacguuuugaggaguuu

SEQ ID NO: 565824 - RNA, 22 nt, Human
uccaucuguuuacuauaaagau

SEQ ID NO: 565825 - RNA, 22 nt, Human
gugcaaugugcuucgugccaug

SEQ ID NO: 565826 - RNA, 22 nt, Human
ugagcuggucacuccuucugaa

SEQ ID NO: 565827 - RNA, 20 nt, Human
uuucauugucagaaucuuau

SEQ ID NO: 565828 - RNA, 22 nt, Human
ucauuucuauugcuacugucug

SEQ ID NO: 565829 - RNA, 22 nt, Human
ccuguacauuagcugugaauug

SEQ ID NO: 565830 - RNA, 22 nt, Human
ggcagagacuggguuggcagag

SEQ ID NO: 565831 - RNA, 22 nt, Human
cugagcugagccaaaucugucu

SEQ ID NO: 565832 - RNA, 22 nt, Human
auacaagaucacuccagaaaau

SEQ ID NO: 565833 - RNA, 22 nt, Human
agggaaauuaaugugagcaaug

SEQ ID NO: 565834 - RNA, 19 nt, Human
gcuuuaguuuacucaucua

SEQ ID NO: 565835 - RNA, 22 nt, Human
aacuguucuucauuuucaguau

SEQ ID NO: 565836 - RNA, 22 nt, Human
uuuuaucagcagggauaacaag

SEQ ID NO: 565837 - RNA, 22 nt, Human
acauuucuuuucaucucuauau

SEQ ID NO: 565838 - RNA, 22 nt, Human
uggcuccaucauccaugcaaga

SEQ ID NO: 565839 - RNA, 22 nt, Human
acuuuggguaagccaggugcua

SEQ ID NO: 565840 - RNA, 22 nt, Human
augaaacaaaccucuauggagu

SEQ ID NO: 565841 - RNA, 22 nt, Human
cucaggaggaugacugccuugg

SEQ ID NO: 565842 - RNA, 22 nt, Human
caagucaaagacuagaacuagu

SEQ ID NO: 565843 - RNA, 19 nt, Human
caaguucuggagauuaggg

SEQ ID NO: 565844 - RNA, 22 nt, Human
uucaggaggugagcaagaaggg

SEQ ID NO: 565845 - RNA, 21 nt, Human
agaauucuuaaguauucuaau

SEQ ID NO: 565846 - RNA, 23 nt, Human
gcuguacaggaaccaguuuggag

SEQ ID NO: 565847 - RNA, 17 nt, Human
aucuggaagcuagcuga

SEQ ID NO: 565848 - RNA, 22 nt, Human
acagaacugagaauucucuauc

SEQ ID NO: 565849 - RNA, 22 nt, Human
ugaguccaagagccagugggaa

SEQ ID NO: 565850 - RNA, 22 nt, Human
acugaguguaggacuuugaguu

SEQ ID NO: 565851 - RNA, 22 nt, Human
agacuguagggauagaggucuu

SEQ ID NO: 565852 - RNA, 22 nt, Human
acuguucauuuguccuguaucu

SEQ ID NO: 565853 - RNA, 22 nt, Human
cucaggagcuuccucagcccau

SEQ ID NO: 565854 - RNA, 22 nt, Human
uaaggaaaguacauguuuugac

SEQ ID NO: 565855 - RNA, 22 nt, Human
uuucuacaguacugauuucaua

SEQ ID NO: 565856 - RNA, 22 nt, Human
ggcagaggugacagugucuuuu

SEQ ID NO: 565857 - RNA, 22 nt, Human
aggcugugcacagggcaccugc

SEQ ID NO: 565858 - RNA, 22 nt, Human
aaacucuuccuuucuuuaaagu

SEQ ID NO: 565859 - RNA, 22 nt, Human
gcuguacauucuguggguuugg

SEQ ID NO: 565860 - RNA, 22 nt, Human
gagauuuccauauuuuguaaca

SEQ ID NO: 565861 - RNA, 22 nt, Human
caguccugagccaaucaugaug

SEQ ID NO: 565862 - RNA, 22 nt, Human
gacauaaaccuugagauauuaa

SEQ ID NO: 565863 - RNA, 22 nt, Human
aagacugugucuauggcuacuc

SEQ ID NO: 565864 - RNA, 22 nt, Human
ugaaacaaaccaguaauuuugu

SEQ ID NO: 565865 - RNA, 22 nt, Human
aauguacaucucaguguaguac

SEQ ID NO: 565866 - RNA, 22 nt, Human
cagucucugugccagauccugg

SEQ ID NO: 565867 - RNA, 22 nt, Human
uagcauuucccaaaugcauuug

SEQ ID NO: 565868 - RNA, 22 nt, Human
aaauguucccaauaugaagcug

SEQ ID NO: 565869 - RNA, 22 nt, Human
caccugagcacuggggccgccc

SEQ ID NO: 565870 - RNA, 22 nt, Human
ucuauuugcugguugcuucugu

SEQ ID NO: 565871 - RNA, 22 nt, Human
uccagcuggggacaugggcuuc

SEQ ID NO: 565872 - RNA, 22 nt, Human
cagcugaguuacucugaggucu

SEQ ID NO: 565873 - RNA, 22 nt, Human
ucuuacagaaaauagauaacau

SEQ ID NO: 565874 - RNA, 22 nt, Human
aguuucuagccucacuguuuag

SEQ ID NO: 565875 - RNA, 22 nt, Human
gaaauccaguucccuacucuua

SEQ ID NO: 565876 - RNA, 22 nt, Human
agacucugugcuccuugcuuuc

SEQ ID NO: 565877 - RNA, 22 nt, Human
aacauuaauuacagucaaacau

SEQ ID NO: 565878 - RNA, 22 nt, Human
ggcagcagggucuagauugaug

SEQ ID NO: 565879 - RNA, 21 nt, Human
ugcaggagucugugagucagg

SEQ ID NO: 565880 - RNA, 22 nt, Human
uguaacaaaauaccuuggauug

SEQ ID NO: 565881 - RNA, 22 nt, Human
uucuaguugagggagacaaaua

SEQ ID NO: 565882 - RNA, 22 nt, Human
gccagccugugcuuggccaggc

SEQ ID NO: 565883 - RNA, 22 nt, Human
cucuggagggaggcugagcugg

SEQ ID NO: 565884 - RNA, 21 nt, Human
uccuguaagcuuggguggcuc

SEQ ID NO: 565885 - RNA, 22 nt, Human
gaacaaacacaucccagcagug

SEQ ID NO: 565886 - RNA, 22 nt, Human
uggucaacaggcagggaugaaa

SEQ ID NO: 565887 - RNA, 18 nt, Human
cugucuuuuuucucucca

SEQ ID NO: 565888 - RNA, 22 nt, Human
ccuguacacaauuccgaggaua

SEQ ID NO: 565889 - RNA, 22 nt, Human
aacacuguggucuuuucaguaa

SEQ ID NO: 565890 - RNA, 22 nt, Human
uacaggaagcacucaagaaaug

SEQ ID NO: 565891 - RNA, 22 nt, Human
gaacauuuaugaugcaauaccu

SEQ ID NO: 565892 - RNA, 22 nt, Human
uuuccacugggcacggggccag

SEQ ID NO: 565893 - RNA, 22 nt, Human
aggcagagcuggguuuugaaau

SEQ ID NO: 565894 - RNA, 22 nt, Human
uucuaauuguguuugcauaucu

SEQ ID NO: 565895 - RNA, 22 nt, Human
uucaggagaaaguucaguacuu

SEQ ID NO: 565896 - RNA, 22 nt, Human
acauuucuuccacaugcugcug

SEQ ID NO: 565897 - RNA, 22 nt, Human
ucaggaaagaguguauccauca

SEQ ID NO: 565898 - RNA, 19 nt, Human
ccuguacauuauucucccc

SEQ ID NO: 565899 - RNA, 19 nt, Human
uaaaaacugaaggaagcag

SEQ ID NO: 565900 - RNA, 22 nt, Human
cucaggaguaguucagcagcug

SEQ ID NO: 565901 - RNA, 22 nt, Human
ucugaaauguucucuuguuuug

SEQ ID NO: 565902 - RNA, 22 nt, Human
ugagaugaauaacuccugcuaa

SEQ ID NO: 565903 - RNA, 22 nt, Human
acugaaaaugaauuagaaacag

SEQ ID NO: 565904 - RNA, 22 nt, Human
acccucaacaaauucacucuau

SEQ ID NO: 565905 - RNA, 22 nt, Human
ucuuuugagggccagaggaaga

SEQ ID NO: 565906 - RNA, 22 nt, Human
ccagucugaggccuggugaggg

SEQ ID NO: 565907 - RNA, 22 nt, Human
acuguacacacuucucugucuu

SEQ ID NO: 565908 - RNA, 22 nt, Human
uucuaccagcuacucacugaua

SEQ ID NO: 565909 - RNA, 22 nt, Human
guaaucucagcuacuugggagg

SEQ ID NO: 565910 - RNA, 22 nt, Human
uccauauuaacuaaaacuagaa

SEQ ID NO: 565911 - RNA, 22 nt, Human
ccuuggagcggucagcacuggu

SEQ ID NO: 565912 - RNA, 22 nt, Human
aacaugaaacccaaacagaaua

SEQ ID NO: 565913 - RNA, 22 nt, Human
aauaacaggcucaucagaugcu

SEQ ID NO: 565914 - RNA, 22 nt, Human
uuuuucugccauucaaagagga

SEQ ID NO: 565915 - RNA, 22 nt, Human
ucuguacaaaggcuauuuggag

SEQ ID NO: 565916 - RNA, 19 nt, Human
ggcagacacaguugacaug

SEQ ID NO: 565917 - RNA, 22 nt, Human
gcuuuuauuucuucacaaaagu

SEQ ID NO: 565918 - RNA, 22 nt, Human
caaaguucucggcucaaguccu

SEQ ID NO: 565919 - RNA, 22 nt, Human
cuguaaaacacuguaguaucug

SEQ ID NO: 565920 - RNA, 22 nt, Human
cacuguacuggguugaaggacg

SEQ ID NO: 565921 - RNA, 22 nt, Human
acaucacagagcccagauaaag

SEQ ID NO: 565922 - RNA, 22 nt, Human
gacuguacuugagagaggaacu

SEQ ID NO: 565923 - RNA, 22 nt, Human
aaacaguauuaucaauauauuu

SEQ ID NO: 565924 - RNA, 22 nt, Human
ucuaccacuaagugugcuuuga

SEQ ID NO: 565925 - RNA, 20 nt, Human
gugcaauggcgcaaucucgg

SEQ ID NO: 565926 - RNA, 22 nt, Human
cuggcuuuuagugugaagacuu

SEQ ID NO: 565927 - RNA, 22 nt, Human
acauuucucaucuaguagagua

SEQ ID NO: 565928 - RNA, 22 nt, Human
uucugucuucccacugaggagc

SEQ ID NO: 565929 - RNA, 23 nt, Human
aaaaaaccauguaggcacucagu

SEQ ID NO: 565930 - RNA, 22 nt, Human
uuuauauagagauuugugcaug

SEQ ID NO: 565931 - RNA, 22 nt, Human
acuuuuaugauaaucaauguuc

SEQ ID NO: 565932 - RNA, 21 nt, Human
ucugagaacuucugcugcagc

SEQ ID NO: 565933 - RNA, 22 nt, Human
cugagggagggacuuugagacu

SEQ ID NO: 565934 - RNA, 22 nt, Human
acauuucuuagccuaguuccag

SEQ ID NO: 565935 - RNA, 22 nt, Human
aauguacaaaccuucuuuguag

SEQ ID NO: 565936 - RNA, 22 nt, Human
agugcaauagcaaagaacaaca

SEQ ID NO: 565937 - RNA, 22 nt, Human
ugcacaucuuucagcaucauac

SEQ ID NO: 565938 - RNA, 22 nt, Human
cuuuggaaaaauaccuggcaua

SEQ ID NO: 565939 - RNA, 22 nt, Human
aacuguaaagguugagugguaa

SEQ ID NO: 565940 - RNA, 22 nt, Human
ccagguggaaggucugugcucu

SEQ ID NO: 565941 - RNA, 22 nt, Human
aagagcugugggugguaguccu

SEQ ID NO: 565942 - RNA, 22 nt, Human
cacaguccagacuccuggaguu

SEQ ID NO: 565943 - RNA, 22 nt, Human
cuuagaugaagucacagaaccc

SEQ ID NO: 565944 - RNA, 22 nt, Human
accaucuuaaggggacuucuua

SEQ ID NO: 565945 - RNA, 23 nt, Human
aaauauucuuuuuuaguaagugc

SEQ ID NO: 565946 - RNA, 22 nt, Human
caauuucuuguuaauucucagg

SEQ ID NO: 565947 - RNA, 22 nt, Human
acauuucuuugcuagacagcag

SEQ ID NO: 565948 - RNA, 22 nt, Human
ucuguaaucaagauauuugaga

SEQ ID NO: 565949 - RNA, 22 nt, Human
acuguacacgugucauuuacag

SEQ ID NO: 565950 - RNA, 22 nt, Human
cugagcugcuuugcuuuugggg

SEQ ID NO: 565951 - RNA, 22 nt, Human
auaauacaugguugaucuuuuc

SEQ ID NO: 565952 - RNA, 22 nt, Human
cuuuggaauaauuuccuggagu

SEQ ID NO: 565953 - RNA, 22 nt, Human
acuguacauguaaacauuguca

SEQ ID NO: 565954 - RNA, 22 nt, Human
cagcugagcaucacuagucugg

SEQ ID NO: 565955 - RNA, 22 nt, Human
gaaaguuugccucucucuugag

SEQ ID NO: 565956 - RNA, 22 nt, Human
cauguacauucuguagauggag

SEQ ID NO: 565957 - RNA, 21 nt, Human
aucuggaagaacugguaagug

SEQ ID NO: 565958 - RNA, 22 nt, Human
agggagaagguuuagcugugag

SEQ ID NO: 565959 - RNA, 20 nt, Human
ucauuucuugggguuccaag

SEQ ID NO: 565960 - RNA, 22 nt, Human
aaauucuaugucaauguuuauu

SEQ ID NO: 565961 - RNA, 22 nt, Human
uuucuauugaucuaauaaacau

SEQ ID NO: 565962 - RNA, 22 nt, Human
cucaggagacaguguccacaug

SEQ ID NO: 565963 - RNA, 22 nt, Human
agacucugauaagcaacucuug

SEQ ID NO: 565964 - RNA, 22 nt, Human
ucuguacaguaccagauaguaa

SEQ ID NO: 565965 - RNA, 22 nt, Human
ucuguacaugaguugagaauca

SEQ ID NO: 565966 - RNA, 22 nt, Human
ugaucaguguugguucuaucua

SEQ ID NO: 565967 - RNA, 22 nt, Human
cugagcugacaucuuccucuuu

SEQ ID NO: 565968 - RNA, 22 nt, Human
acuguacaaccucugccccugu

SEQ ID NO: 565969 - RNA, 22 nt, Human
uuuguucaugccuauauucuca

SEQ ID NO: 565970 - RNA, 22 nt, Human
acaggccugugugcacacgagg

SEQ ID NO: 565971 - RNA, 22 nt, Human
aaaaacugguaacuauucccca

SEQ ID NO: 565972 - RNA, 22 nt, Human
aaacaacuucugcacuaugggu

SEQ ID NO: 565973 - RNA, 22 nt, Human
uucuaccagaccccagacuugu

SEQ ID NO: 565974 - RNA, 22 nt, Human
aauuuguuacacagcaauauaa

SEQ ID NO: 565975 - RNA, 22 nt, Human
acaaaaagcuccauuacugucc

SEQ ID NO: 565976 - RNA, 22 nt, Human
cauuucuagacaaguccuggag

SEQ ID NO: 565977 - RNA, 22 nt, Human
gguuugguuuuggccaucuucc

SEQ ID NO: 565978 - RNA, 22 nt, Human
auuuuuuagaaccuggccugau

SEQ ID NO: 565979 - RNA, 22 nt, Human
cugaaacauugcaauaacaaag

SEQ ID NO: 565980 - RNA, 22 nt, Human
aacacuguacuggaagauggac

SEQ ID NO: 565981 - RNA, 22 nt, Human
auggcagaauuaggauuucaag

SEQ ID NO: 565982 - RNA, 22 nt, Human
uaaaaaguagugagaauggcgc

SEQ ID NO: 565983 - RNA, 20 nt, Human
acuuuggggucuuucucaga

SEQ ID NO: 565984 - RNA, 22 nt, Human
cagugcuguuguaagcucauug

SEQ ID NO: 565985 - RNA, 22 nt, Human
cagcuccuauuagacacugaau

SEQ ID NO: 565986 - RNA, 19 nt, Human
ugaaacaaacuuaaaagga

SEQ ID NO: 565987 - RNA, 22 nt, Human
ucaggaaaauacugcuuaucca

SEQ ID NO: 565988 - RNA, 22 nt, Human
aacuguacgauaauaaauuugu

SEQ ID NO: 565989 - RNA, 22 nt, Human
ccagcuuuucuuaucauuauaa

SEQ ID NO: 565990 - RNA, 22 nt, Human
uucuucauggguucuuuuagga

SEQ ID NO: 565991 - RNA, 22 nt, Human
aaaauuuccaccaucuuugugu

SEQ ID NO: 565992 - RNA, 22 nt, Human
acacuacaaucucagaacuaua

SEQ ID NO: 565993 - RNA, 22 nt, Human
auguucuaaucccugcuaugua

SEQ ID NO: 565994 - RNA, 22 nt, Human
auaaaagaaguuuugguacuug

SEQ ID NO: 565995 - RNA, 22 nt, Human
uucagucuccucauuuuacaaa

SEQ ID NO: 565996 - RNA, 22 nt, Human
cacaguccuacagagaucagag

SEQ ID NO: 565997 - RNA, 22 nt, Human
cucaggagagucuuauaucucc

SEQ ID NO: 565998 - RNA, 22 nt, Human
gaacuguauaggagcaguguuu

SEQ ID NO: 565999 - RNA, 22 nt, Human
aaagacugguguguuacauaua

SEQ ID NO: 566000 - RNA, 22 nt, Human
uuucauugucaauaaacuguau

SEQ ID NO: 566001 - RNA, 22 nt, Human
gucccacugggcaacuagaaaa

SEQ ID NO: 566002 - RNA, 22 nt, Human
cuaguucuuaacuguuaugauu

SEQ ID NO: 566003 - RNA, 22 nt, Human
agucucuuggcauucugaaaca

SEQ ID NO: 566004 - RNA, 22 nt, Human
uaagacaauucuucagucacaa

SEQ ID NO: 566005 - RNA, 22 nt, Human
cacuguacccauuuaaauaaau

SEQ ID NO: 566006 - RNA, 22 nt, Human
aagaauguucauuaaacuguug

SEQ ID NO: 566007 - RNA, 22 nt, Human
aagucaauuaguaaacuuggaa

SEQ ID NO: 566008 - RNA, 22 nt, Human
augaaacugggauaacuauagc

SEQ ID NO: 566009 - RNA, 18 nt, Human
acaguaaagaaaggaauu

SEQ ID NO: 566010 - RNA, 22 nt, Human
gaacauuuccagaaaggaacua

SEQ ID NO: 566011 - RNA, 22 nt, Human
acuguacaaauauugcaaaaua

SEQ ID NO: 566012 - RNA, 22 nt, Human
aaagucaaugauuucuccugga

SEQ ID NO: 566013 - RNA, 22 nt, Human
accagacacugugaagacaggc

SEQ ID NO: 566014 - RNA, 20 nt, Human
acaugaaaggaaacaggaaa

SEQ ID NO: 566015 - RNA, 22 nt, Human
gacaagacaugugaugacauca

SEQ ID NO: 566016 - RNA, 22 nt, Human
ugaaacaaaaguauguagcuug

SEQ ID NO: 566017 - RNA, 22 nt, Human
uacaaaaaauugauacugacga

SEQ ID NO: 566018 - RNA, 23 nt, Human
aucaagucaucagcaaaauacau

SEQ ID NO: 566019 - RNA, 22 nt, Human
uauccaauucaccauugauggg

SEQ ID NO: 566020 - RNA, 22 nt, Human
aggcucuggcaacagcuggugu

SEQ ID NO: 566021 - RNA, 22 nt, Human
uucugaaaggcagguuguuugc

SEQ ID NO: 566022 - RNA, 22 nt, Human
uuagaucuuaggcaaauguguu

SEQ ID NO: 566023 - RNA, 22 nt, Human
uguauuccaaaaugcugaggau

SEQ ID NO: 566024 - RNA, 17 nt, Human
ccugucuuguuucugcc

SEQ ID NO: 566025 - RNA, 22 nt, Human
gcagaggcucuuuaaugcuuag

SEQ ID NO: 566026 - RNA, 23 nt, Human
uucuuauuuacuuuggaaucucc

SEQ ID NO: 566027 - RNA, 22 nt, Human
acaguccuguacaggccauauc

SEQ ID NO: 566028 - RNA, 20 nt, Human
auucuacaagaauaagcaug

SEQ ID NO: 566029 - RNA, 22 nt, Human
acauguguggacaugaaucuac

SEQ ID NO: 566030 - RNA, 22 nt, Human
aacaacuugcguucagagaugu

SEQ ID NO: 566031 - RNA, 22 nt, Human
aaagucaaaaugcucuccuguc

SEQ ID NO: 566032 - RNA, 22 nt, Human
agacuguaauuuguggccuccu

SEQ ID NO: 566033 - RNA, 22 nt, Human
cugucuuuucauacuuucccuc

SEQ ID NO: 566034 - RNA, 21 nt, Human
accaucuuccaugcauuauau

SEQ ID NO: 566035 - RNA, 22 nt, Human
aggcagaggagaaugaucuucc

SEQ ID NO: 566036 - RNA, 22 nt, Human
uaaacaaggguuacugagcaug

SEQ ID NO: 566037 - RNA, 22 nt, Human
aacuguaagacaaaugacuucu

SEQ ID NO: 566038 - RNA, 22 nt, Human
aaauuuucucucuaagacuuaa

SEQ ID NO: 566039 - RNA, 22 nt, Human
aaacugaaacaucaucauguug

SEQ ID NO: 566040 - RNA, 22 nt, Human
ccuguacaucugcucucauugc

SEQ ID NO: 566041 - RNA, 22 nt, Human
acuguacacauucgucaagacu

SEQ ID NO: 566042 - RNA, 22 nt, Human
acuaaaaacuacugccaauagc

SEQ ID NO: 566043 - RNA, 22 nt, Human
uguaaguaguaauggaaggaca

SEQ ID NO: 566044 - RNA, 22 nt, Human
uagcauuuggcaccaguuauuu

SEQ ID NO: 566045 - RNA, 21 nt, Human
acagcagagaucaagacuaag

SEQ ID NO: 566046 - RNA, 22 nt, Human
gacaagacugguuuauuuaagg

SEQ ID NO: 566047 - RNA, 22 nt, Human
gacaagacauugguaaagauau

SEQ ID NO: 566048 - RNA, 22 nt, Human
agacuguaauugacaugucagc

SEQ ID NO: 566049 - RNA, 19 nt, Human
aggcagaggcuuggcuagc

SEQ ID NO: 566050 - RNA, 22 nt, Human
uucuaguuaaaguauguauuag

SEQ ID NO: 566051 - RNA, 22 nt, Human
ccuguacagugaaugaauguga

SEQ ID NO: 566052 - RNA, 22 nt, Human
ugacaaaacugcaauuacuuuu

SEQ ID NO: 566053 - RNA, 20 nt, Human
agggcagagggauuacaggc

SEQ ID NO: 566054 - RNA, 22 nt, Human
gcuuuaaaccucuacucugucc

SEQ ID NO: 566055 - RNA, 22 nt, Human
acuuuggggaacuuuucuccuc

SEQ ID NO: 566056 - RNA, 22 nt, Human
ccuggcuuuuguuuauaaauuc

SEQ ID NO: 566057 - RNA, 21 nt, Human
acuuugggcacuuuccugccc

SEQ ID NO: 566058 - RNA, 22 nt, Human
aauucuauaggcaagcuauuuu

SEQ ID NO: 566059 - RNA, 22 nt, Human
ucagucuucccuccagugcaac

SEQ ID NO: 566060 - RNA, 22 nt, Human
gaagaacugugacagaagcagu

SEQ ID NO: 566061 - RNA, 21 nt, Human
ucuguacaucauugagucccc

SEQ ID NO: 566062 - RNA, 22 nt, Human
acauuucuccuugcaggaguca

SEQ ID NO: 566063 - RNA, 22 nt, Human
cucaggaggugguagaggcccu

SEQ ID NO: 566064 - RNA, 22 nt, Human
caguccuggggaccaggcugag

SEQ ID NO: 566065 - RNA, 22 nt, Human
ggagugacucacagcugggaca

SEQ ID NO: 566066 - RNA, 22 nt, Human
gaaauucacuguauuucuuggg

SEQ ID NO: 566067 - RNA, 22 nt, Human
aaacuagagcaugugaguggga

SEQ ID NO: 566068 - RNA, 22 nt, Human
cauuuacuuaaaucuuuacaag

SEQ ID NO: 566069 - RNA, 22 nt, Human
uccaauaacaucuaaaaacuua

SEQ ID NO: 566070 - RNA, 22 nt, Human
aacuguaaugaauuguucauga

SEQ ID NO: 566071 - RNA, 22 nt, Human
uuucuccaauguaucagcacac

SEQ ID NO: 566072 - RNA, 22 nt, Human
aaacuugauuuagaacuaaggc

SEQ ID NO: 566073 - RNA, 22 nt, Human
auaacagaugugaagugcuaau

SEQ ID NO: 566074 - RNA, 22 nt, Human
cuauuaaacacuacugugcacu

SEQ ID NO: 566075 - RNA, 22 nt, Human
aguuucuauguaagcuacguga

SEQ ID NO: 566076 - RNA, 22 nt, Human
gaaaucuuuauggaaauaacaa

SEQ ID NO: 566077 - RNA, 21 nt, Human
aagaacuauugagguacacag

SEQ ID NO: 566078 - RNA, 22 nt, Human
ucuuuuauuaggcugaaauggg

SEQ ID NO: 566079 - RNA, 22 nt, Human
cagcugagaagugauagcugca

SEQ ID NO: 566080 - RNA, 22 nt, Human
cucaggagaugacagaagguau

SEQ ID NO: 566081 - RNA, 22 nt, Human
uccauuuuagagaugaagaaac

SEQ ID NO: 566082 - RNA, 22 nt, Human
uucucaggugaggcugaggcug

SEQ ID NO: 566083 - RNA, 22 nt, Human
cauuucuagggaucauaaagua

SEQ ID NO: 566084 - RNA, 22 nt, Human
uccagcuggggcaguggcuggg

SEQ ID NO: 566085 - RNA, 18 nt, Human
acauuucuaugcuucugg

SEQ ID NO: 566086 - RNA, 19 nt, Human
cucuccagcuccaguagcu

SEQ ID NO: 566087 - RNA, 22 nt, Human
uacaagaugacaggugcaugau

SEQ ID NO: 566088 - RNA, 22 nt, Human
uccacauucucuguuacagaua

SEQ ID NO: 566089 - RNA, 22 nt, Human
aacaaguaaguuuauauauauu

SEQ ID NO: 566090 - RNA, 22 nt, Human
aaacuguaagagaauaaacuac

SEQ ID NO: 566091 - RNA, 22 nt, Human
cuauuacaauucugcaaggagu

SEQ ID NO: 566092 - RNA, 21 nt, Human
ucagcuuugcaacugcacauc

SEQ ID NO: 566093 - RNA, 22 nt, Human
aaagaacuuauccuagaauuug

SEQ ID NO: 566094 - RNA, 22 nt, Human
aucuggaagccagauacucagu

SEQ ID NO: 566095 - RNA, 22 nt, Human
acugcagacucuacaguuauaa

SEQ ID NO: 566096 - RNA, 22 nt, Human
auacaagacucagcacagacgg

SEQ ID NO: 566097 - RNA, 22 nt, Human
gaaacuuuuaaaccucaugagu

SEQ ID NO: 566098 - RNA, 22 nt, Human
cuacagaaaaucagccacaggc

SEQ ID NO: 566099 - RNA, 22 nt, Human
cuggaauguagagacagcuuag

SEQ ID NO: 566100 - RNA, 22 nt, Human
cagaaacuucuggugucaaaua

SEQ ID NO: 566101 - RNA, 20 nt, Human
aagaaacuugaaaguacaag

SEQ ID NO: 566102 - RNA, 22 nt, Human
aaaacuguaggaauugggugcc

SEQ ID NO: 566103 - RNA, 22 nt, Human
aucuuaaucgaguccaugaaaa

SEQ ID NO: 566104 - RNA, 22 nt, Human
cacuuggaggcccccugugccc

SEQ ID NO: 566105 - RNA, 22 nt, Human
acacuguaaauugagugcguga

SEQ ID NO: 566106 - RNA, 20 nt, Human
gaaauucucguauuaguuua

SEQ ID NO: 566107 - RNA, 22 nt, Human
aauacagaggggucacaauuca

SEQ ID NO: 566108 - RNA, 22 nt, Human
ccacugagaccuuuuggaggag

SEQ ID NO: 566109 - RNA, 22 nt, Human
guuuaauuuuagguugucaagc

SEQ ID NO: 566110 - RNA, 22 nt, Human
uggcacauagcagguacucagu

SEQ ID NO: 566111 - RNA, 22 nt, Human
uuauacuaaaacgcauugaauu

SEQ ID NO: 566112 - RNA, 22 nt, Human
ucugucuuagcaucuuugcuca

SEQ ID NO: 566113 - RNA, 22 nt, Human
ucccagcacgucugcuguuucu

SEQ ID NO: 566114 - RNA, 22 nt, Human
cugggcaggagggcucuaugga

SEQ ID NO: 566115 - RNA, 22 nt, Human
aaguucuacagcuucgcaggca

SEQ ID NO: 566116 - RNA, 22 nt, Human
ugugccuacugauagagccaag

SEQ ID NO: 566117 - RNA, 22 nt, Human
ugguuacacagcauguggacuu

SEQ ID NO: 566118 - RNA, 22 nt, Human
aaauguuccuuuggauuaaacu

SEQ ID NO: 566119 - RNA, 22 nt, Human
acagauccugguuacagccauu

SEQ ID NO: 566120 - RNA, 22 nt, Human
caguccuguguuaaacaagagc

SEQ ID NO: 566121 - RNA, 22 nt, Human
uauauguguggauucuuguaga

SEQ ID NO: 566122 - RNA, 22 nt, Human
ucuguacaacaaagggaugaga

SEQ ID NO: 566123 - RNA, 22 nt, Human
uucaucuugauggcuuccuaau

SEQ ID NO: 566124 - RNA, 22 nt, Human
uacuguacucaacaugugaguu

SEQ ID NO: 566125 - RNA, 22 nt, Human
gacaagacuauguagaaaguau

SEQ ID NO: 566126 - RNA, 22 nt, Human
acauuucugcuagaauagguga

SEQ ID NO: 566127 - RNA, 22 nt, Human
uacuguacauuccguuuguugc

SEQ ID NO: 566128 - RNA, 22 nt, Human
cagguccugcagggagaguaaa

SEQ ID NO: 566129 - RNA, 22 nt, Human
uccagucucuacucugagauaa

SEQ ID NO: 566130 - RNA, 22 nt, Human
uuguauauauucuuaaagaugu

SEQ ID NO: 566131 - RNA, 22 nt, Human
aucuggaauccuuguggacaau

SEQ ID NO: 566132 - RNA, 22 nt, Human
acauuucucccugcaugccugc

SEQ ID NO: 566133 - RNA, 22 nt, Human
cauuucuaagaaggcugcacau

SEQ ID NO: 566134 - RNA, 22 nt, Human
ucugucuuugagaucucagccu

SEQ ID NO: 566135 - RNA, 22 nt, Human
cauuucuacagcuucuucagaa

SEQ ID NO: 566136 - RNA, 22 nt, Human
auguaacaaaugguauacaugu

SEQ ID NO: 566137 - RNA, 22 nt, Human
cugagaaaggaccucaaacagg

SEQ ID NO: 566138 - RNA, 21 nt, Human
uacaagaccggauucgggccc

SEQ ID NO: 566139 - RNA, 22 nt, Human
uuuguucauuuugagcucauca

SEQ ID NO: 566140 - RNA, 22 nt, Human
auguaacauugaauuauauagu

SEQ ID NO: 566141 - RNA, 22 nt, Human
uucuaguuuugccuuaucaaca

SEQ ID NO: 566142 - RNA, 22 nt, Human
ucugaaaugcaggcaauuugcu

SEQ ID NO: 566143 - RNA, 23 nt, Human
uugcuuagagaccuccucaucag

SEQ ID NO: 566144 - RNA, 22 nt, Human
ucauuucuaucuaugcagcuuc

SEQ ID NO: 566145 - RNA, 22 nt, Human
uuaguaauguguuaauaugaau

SEQ ID NO: 566146 - RNA, 22 nt, Human
ugcuuccagcucucuguaaggu

SEQ ID NO: 566147 - RNA, 22 nt, Human
acagguccuuauaagagcacuc

SEQ ID NO: 566148 - RNA, 22 nt, Human
uuucuauuggcgucacuguugu

SEQ ID NO: 566149 - RNA, 22 nt, Human
uaacagcucuguguggcuguaa

SEQ ID NO: 566150 - RNA, 22 nt, Human
uucaggagaauuccaagaagua

SEQ ID NO: 566151 - RNA, 22 nt, Human
uacuguacugucuuuuuugcug

SEQ ID NO: 566152 - RNA, 20 nt, Human
gugcaauggcucagucucag

SEQ ID NO: 566153 - RNA, 22 nt, Human
ccugcuuaacauugccaugaca

SEQ ID NO: 566154 - RNA, 22 nt, Human
gcaaaaaccacaauuacuuuug

SEQ ID NO: 566155 - RNA, 23 nt, Human
cauguacacacagcuguacagug

SEQ ID NO: 566156 - RNA, 20 nt, Human
ucagguagaucuuugagguc

SEQ ID NO: 566157 - RNA, 22 nt, Human
uuuuauucucaagacaauggga

SEQ ID NO: 566158 - RNA, 22 nt, Human
ucaagucuugaugagacaaacc

SEQ ID NO: 566159 - RNA, 22 nt, Human
aaauguuccauuauuguguaau

SEQ ID NO: 566160 - RNA, 22 nt, Human
cuacaggucaguaagaccuaga

SEQ ID NO: 566161 - RNA, 22 nt, Human
uuuauauccaucuuugaaguaa

SEQ ID NO: 566162 - RNA, 22 nt, Human
auuaaacaauguaaaguucuug

SEQ ID NO: 566163 - RNA, 21 nt, Human
uuuauuuauauaggacacaug

SEQ ID NO: 566164 - RNA, 19 nt, Human
agacucugccacucuucuc

SEQ ID NO: 566165 - RNA, 22 nt, Human
acagaacugcaggaggaaaagc

SEQ ID NO: 566166 - RNA, 22 nt, Human
cacaagacuuauuuguguagaa

SEQ ID NO: 566167 - RNA, 22 nt, Human
aaaacuguaucuucuugggacu

SEQ ID NO: 566168 - RNA, 22 nt, Human
aguuucuauuuucaugucuguu

SEQ ID NO: 566169 - RNA, 22 nt, Human
acaagauuuuaugacucuuuuu

SEQ ID NO: 566170 - RNA, 22 nt, Human
augucuuucaaauucugccuag

SEQ ID NO: 566171 - RNA, 20 nt, Human
acagcagauaccacaacuau

SEQ ID NO: 566172 - RNA, 21 nt, Human
ccugucuuggacugaggcacc

SEQ ID NO: 566173 - RNA, 22 nt, Human
aggaccugagaguuggaaaucc

SEQ ID NO: 566174 - RNA, 22 nt, Human
uuucuacauuuguaaccagauu

SEQ ID NO: 566175 - RNA, 22 nt, Human
uucgaguuggcuuuauuaaacu

SEQ ID NO: 566176 - RNA, 22 nt, Human
cagagcuguauuuaucuuucca

SEQ ID NO: 566177 - RNA, 22 nt, Human
uuucuaguucucugccaaaaaa

SEQ ID NO: 566178 - RNA, 22 nt, Human
auacuaagcucauuacauuuug

SEQ ID NO: 566179 - RNA, 22 nt, Human
aaaaguguucaggaagaauaau

SEQ ID NO: 566180 - RNA, 22 nt, Human
ucugaaaauguugacuuuguuu

SEQ ID NO: 566181 - RNA, 19 nt, Human
aggcugugagggaggacuc

SEQ ID NO: 566182 - RNA, 22 nt, Human
uuucuaguccucaugcaucauu

SEQ ID NO: 566183 - RNA, 22 nt, Human
aggaaacagugaacuuggcagg

SEQ ID NO: 566184 - RNA, 22 nt, Human
auugauaucaguuugcugauug

SEQ ID NO: 566185 - RNA, 22 nt, Human
cuauugcauuugcaucuucauc

SEQ ID NO: 566186 - RNA, 22 nt, Human
ggagagcugguagcuggcucca

SEQ ID NO: 566187 - RNA, 22 nt, Human
aagaaacugaaaguggcuucau

SEQ ID NO: 566188 - RNA, 22 nt, Human
cuacagguaugugcaugacauc

SEQ ID NO: 566189 - RNA, 22 nt, Human
guggaaguagauuugagaaggu

SEQ ID NO: 566190 - RNA, 22 nt, Human
gcuguacaucacaauuugcugu

SEQ ID NO: 566191 - RNA, 22 nt, Human
auacaaaguauuaauccuggau

SEQ ID NO: 566192 - RNA, 22 nt, Human
uguugauuugugggcugcaaaa

SEQ ID NO: 566193 - RNA, 22 nt, Human
ccuguacaagagccaucuggau

SEQ ID NO: 566194 - RNA, 22 nt, Human
agcaaacagugugcuaagaaau

SEQ ID NO: 566195 - RNA, 21 nt, Human
cauuucuauugaugagaaaag

SEQ ID NO: 566196 - RNA, 21 nt, Human
uucuacaggaugaaugaaaac

SEQ ID NO: 566197 - RNA, 22 nt, Human
aaaacauguccauacagaaacu

SEQ ID NO: 566198 - RNA, 22 nt, Human
auuaagacugcccauguuuuua

SEQ ID NO: 566199 - RNA, 22 nt, Human
ccuguacaagcucuuggugaca

SEQ ID NO: 566200 - RNA, 22 nt, Human
ugcagcugaggccagcuaugcc

SEQ ID NO: 566201 - RNA, 22 nt, Human
uucugucucccugauguagagc

SEQ ID NO: 566202 - RNA, 22 nt, Human
cagaaacuauguaagaaaguga

SEQ ID NO: 566203 - RNA, 22 nt, Human
ucuguacaccaggggccauucu

SEQ ID NO: 566204 - RNA, 22 nt, Human
cacagcauaaugaaauauacuu

SEQ ID NO: 566205 - RNA, 20 nt, Human
gucuccacuggggguuaacc

SEQ ID NO: 566206 - RNA, 22 nt, Human
ccaguccuggccaguaacauga

SEQ ID NO: 566207 - RNA, 22 nt, Human
cuccagcugccaccagauguuu

SEQ ID NO: 566208 - RNA, 22 nt, Human
ucugaaaugcaaauuugacuga

SEQ ID NO: 566209 - RNA, 17 nt, Human
agcacuaaaaugcuucc

SEQ ID NO: 566210 - RNA, 22 nt, Human
acuuugcugcagguuuaaagag

SEQ ID NO: 566211 - RNA, 22 nt, Human
ccagucuggcaggagggggaac

SEQ ID NO: 566212 - RNA, 22 nt, Human
aaacagacugaagaguugaagc

SEQ ID NO: 566213 - RNA, 20 nt, Human
ccugucuggagacaaagaga

SEQ ID NO: 566214 - RNA, 22 nt, Human
acaugaaaagacuaucugauua

SEQ ID NO: 566215 - RNA, 22 nt, Human
acauuucucuugaugucucuau

SEQ ID NO: 566216 - RNA, 22 nt, Human
ucuuucuacaucauuugcuucu

SEQ ID NO: 566217 - RNA, 20 nt, Human
aggcagagcgcacuuuuaga

SEQ ID NO: 566218 - RNA, 22 nt, Human
acuguucauuuggauuucucug

SEQ ID NO: 566219 - RNA, 22 nt, Human
aucuggaacaaagcuuaggaau

SEQ ID NO: 566220 - RNA, 22 nt, Human
caguccugcccaggcugacaga

SEQ ID NO: 566221 - RNA, 22 nt, Human
cuggaaugagcagggcuuaugg

SEQ ID NO: 566222 - RNA, 22 nt, Human
ucauuucuccgaccugcugucc

SEQ ID NO: 566223 - RNA, 22 nt, Human
auguuacaauucaaaaugcugc

SEQ ID NO: 566224 - RNA, 22 nt, Human
aucagucuguguuagaaaagag

SEQ ID NO: 566225 - RNA, 22 nt, Human
ucuauuucgcauauaaguuuug

SEQ ID NO: 566226 - RNA, 21 nt, Human
cacaagacacauaggguguuu

SEQ ID NO: 566227 - RNA, 22 nt, Human
caaaaacugcaauuacuuuuac

SEQ ID NO: 566228 - RNA, 22 nt, Human
aucuggaaaacacaguguagac

SEQ ID NO: 566229 - RNA, 22 nt, Human
uaaucacagaaacagacuguuu

SEQ ID NO: 566230 - RNA, 22 nt, Human
ccuacacaucucaccucacagg

SEQ ID NO: 566231 - RNA, 22 nt, Human
cuccagucuaguagagccugcu

SEQ ID NO: 566232 - RNA, 22 nt, Human
uaaaacugaauacauacugagg

SEQ ID NO: 566233 - RNA, 22 nt, Human
ugagcuggaaucuucuugacug

SEQ ID NO: 566234 - RNA, 22 nt, Human
uuauuauagauuaugcaagauu

SEQ ID NO: 566235 - RNA, 22 nt, Human
agacucugauucccucauguca

SEQ ID NO: 566236 - RNA, 22 nt, Human
aggcagagcuaggaagaauugu

SEQ ID NO: 566237 - RNA, 18 nt, Human
agugucuggauauuuggg

SEQ ID NO: 566238 - RNA, 22 nt, Human
gcaaaaaccacaauuacuuuua

SEQ ID NO: 566239 - RNA, 22 nt, Human
ucaugaaaauagaucagaaauu

SEQ ID NO: 566240 - RNA, 22 nt, Human
cauuuguacagaacagcuuuau

SEQ ID NO: 566241 - RNA, 22 nt, Human
uggcuugucauguaucugaggc

SEQ ID NO: 566242 - RNA, 22 nt, Human
guccagcugaucuugacccagc

SEQ ID NO: 566243 - RNA, 22 nt, Human
caauuuuuaaacuaugaaguug

SEQ ID NO: 566244 - RNA, 22 nt, Human
augcaauaguaauucuagucug

SEQ ID NO: 566245 - RNA, 22 nt, Human
ugugguuuugguucagaaacaa

SEQ ID NO: 566246 - RNA, 22 nt, Human
gcugcaggcucugcaggaauug

SEQ ID NO: 566247 - RNA, 20 nt, Human
aucaggcuuucuguugcgau

SEQ ID NO: 566248 - RNA, 22 nt, Human
cacaggaagcaagccuggggcc

SEQ ID NO: 566249 - RNA, 22 nt, Human
gcggggggcagcagucgcucag

SEQ ID NO: 566250 - RNA, 23 nt, Human
uggagaauucagucuuuguuuug

SEQ ID NO: 566251 - RNA, 23 nt, Human
augccaggcugccuggccagccu

SEQ ID NO: 566252 - RNA, 22 nt, Human
uuauuugcccauguuuagcaga

SEQ ID NO: 566253 - RNA, 22 nt, Human
uaaaacuagugguugggacuaa

SEQ ID NO: 566254 - RNA, 21 nt, Human
gacauugagcgugucgcagug

SEQ ID NO: 566255 - RNA, 22 nt, Human
ccugugggagggagcggcugga

SEQ ID NO: 566256 - RNA, 22 nt, Human
guccacauaggaacccagcuuc

SEQ ID NO: 566257 - RNA, 17 nt, Human
aggucugagaguaucug

SEQ ID NO: 566258 - RNA, 22 nt, Human
gaucgauucagugugccuaccc

SEQ ID NO: 566259 - RNA, 22 nt, Human
ucaucuguuaugggaguuuuug

SEQ ID NO: 566260 - RNA, 22 nt, Human
acaaaggugagcagaagacaca

SEQ ID NO: 566261 - RNA, 22 nt, Human
ccugcgcgucugggucugucuc

SEQ ID NO: 566262 - RNA, 22 nt, Human
acugggcaaggauaugaugggu

SEQ ID NO: 566263 - RNA, 22 nt, Human
uugagacacaaggcacaguaag

SEQ ID NO: 566264 - RNA, 22 nt, Human
acauuuuuggguugaugucuga

SEQ ID NO: 566265 - RNA, 22 nt, Human
guggcagcggcccaggccgucu

SEQ ID NO: 566266 - RNA, 22 nt, Human
agaacaggaggaagccagcucc

SEQ ID NO: 566267 - RNA, 22 nt, Human
ucucagcucauggcagccuuga

SEQ ID NO: 566268 - RNA, 22 nt, Human
uugcuauuuugagagucauagu

SEQ ID NO: 566269 - RNA, 22 nt, Human
uuucugaggaauuaauacagaa

SEQ ID NO: 566270 - RNA, 22 nt, Human
gucccugauaagagccaucgau

SEQ ID NO: 566271 - RNA, 22 nt, Human
aauguuaaguuuagauuauaac

SEQ ID NO: 566272 - RNA, 22 nt, Human
ucggagcgucacuggcuggagg

SEQ ID NO: 566273 - RNA, 22 nt, Human
uaaaucccuacaucuguguuuu

SEQ ID NO: 566274 - RNA, 22 nt, Human
aggaaaugccgcggcucucuuu

SEQ ID NO: 566275 - RNA, 22 nt, Human
aagaauaagaggauuuagaaca

SEQ ID NO: 566276 - RNA, 22 nt, Human
uggguguguccauauuuugacu

SEQ ID NO: 566277 - RNA, 22 nt, Human
aaagucuuaauguaaguuuagu

SEQ ID NO: 566278 - RNA, 22 nt, Human
uugcaguuuugacagaccaaau

SEQ ID NO: 566279 - RNA, 22 nt, Human
aaugcuuuuugcgaaaugugca

SEQ ID NO: 566280 - RNA, 22 nt, Human
aauacagugaaagugagcaagg

SEQ ID NO: 566281 - RNA, 22 nt, Human
uuuacagagaauguacauaaag

SEQ ID NO: 566282 - RNA, 22 nt, Human
augaacaguacaaagcacagac

SEQ ID NO: 566283 - RNA, 22 nt, Human
cugagccagcgggcucacuuuu

SEQ ID NO: 566284 - RNA, 23 nt, Human
caaaaugcuaugugcccaaugca

SEQ ID NO: 566285 - RNA, 22 nt, Human
cuggcucgcauuauauuuuggg

SEQ ID NO: 566286 - RNA, 21 nt, Human
cccgugccuucagcaguccug

SEQ ID NO: 566287 - RNA, 22 nt, Human
ucacuaugcccagaauacaguu

SEQ ID NO: 566288 - RNA, 22 nt, Human
uuuggauugcuuggaugcuucg

SEQ ID NO: 566289 - RNA, 22 nt, Human
ggcaguggugggaggcucgcuc

SEQ ID NO: 566290 - RNA, 19 nt, Human
auacacguguauacauaca

SEQ ID NO: 566291 - RNA, 22 nt, Human
ccaggcuccccaggaggcccuu

SEQ ID NO: 566292 - RNA, 22 nt, Human
augaaaacagccuccugugaua

SEQ ID NO: 566293 - RNA, 22 nt, Human
uuucccaggcuggaaugcagug

SEQ ID NO: 566294 - RNA, 22 nt, Human
uuucugugauaggcugcgacgc

SEQ ID NO: 566295 - RNA, 22 nt, Human
aaguuacacauuuucauuguaa

SEQ ID NO: 566296 - RNA, 22 nt, Human
aggauaauaauaaucucguuua

SEQ ID NO: 566297 - RNA, 22 nt, Human
cuaguuuuaagcuccuugaggu

SEQ ID NO: 566298 - RNA, 22 nt, Human
uaucacauacuucucauccagg

SEQ ID NO: 566299 - RNA, 22 nt, Human
ucucauuuacuuccacaggcug

SEQ ID NO: 566300 - RNA, 22 nt, Human
gcugcuuugucuguaaaaugga

SEQ ID NO: 566301 - RNA, 22 nt, Human
cagagggagcccuccaggagca

SEQ ID NO: 566302 - RNA, 22 nt, Human
gagguggcugcuugcugggaaa

SEQ ID NO: 566303 - RNA, 22 nt, Human
ugacucauauuucauggauacg

SEQ ID NO: 566304 - RNA, 22 nt, Human
cagaggauauaugguuuguaug

SEQ ID NO: 566305 - RNA, 22 nt, Human
ggugucagugaagguagaguuu

SEQ ID NO: 566306 - RNA, 22 nt, Human
uuuggucuggaaucuucagggu

SEQ ID NO: 566307 - RNA, 17 nt, Human
uguguaaguugcauaga

SEQ ID NO: 566308 - RNA, 22 nt, Human
ggccaaggcucuugagggcuga

SEQ ID NO: 566309 - RNA, 22 nt, Human
cagcuugcacacauauuagacg

SEQ ID NO: 566310 - RNA, 22 nt, Human
augauugaaaaugacauugcca

SEQ ID NO: 566311 - RNA, 20 nt, Human
ccacccuguccggggcggag

SEQ ID NO: 566312 - RNA, 22 nt, Human
uuaggauuugaaaaggggcaga

SEQ ID NO: 566313 - RNA, 18 nt, Human
cuacauucauaggaaagg

SEQ ID NO: 566314 - RNA, 22 nt, Human
gauuugucuauauucaaauaug

SEQ ID NO: 566315 - RNA, 22 nt, Human
aaauugaauuugggaaacauug

SEQ ID NO: 566316 - RNA, 22 nt, Human
uagaaagagcuuugcuuccuuu

SEQ ID NO: 566317 - RNA, 22 nt, Human
agcugggugcccgaagccacgu

SEQ ID NO: 566318 - RNA, 22 nt, Human
gcccucugguggccgccucggc

SEQ ID NO: 566319 - RNA, 22 nt, Human
auuauguagcuaaaaauugugu

SEQ ID NO: 566320 - RNA, 22 nt, Human
ugccugugggugaugauuugau

SEQ ID NO: 566321 - RNA, 22 nt, Human
ccgcuguccuggagcugcugcu

SEQ ID NO: 566322 - RNA, 22 nt, Human
uaugaaggauacaccucugauu

SEQ ID NO: 566323 - RNA, 22 nt, Human
ucuccagaguaaccuuggagca

SEQ ID NO: 566324 - RNA, 22 nt, Human
gcucgguggccagccugaggcc

SEQ ID NO: 566325 - RNA, 22 nt, Human
ggucccagucccuuuccaccgu

SEQ ID NO: 566326 - RNA, 22 nt, Human
uucuuucugggguccuucggcu

SEQ ID NO: 566327 - RNA, 22 nt, Human
guguggucgaaguucucccgga

SEQ ID NO: 566328 - RNA, 22 nt, Human
guucugucugagcaccacagga

SEQ ID NO: 566329 - RNA, 22 nt, Human
uauaugcagauuuucaucaucg

SEQ ID NO: 566330 - RNA, 22 nt, Human
ugcaaaaagagcgaggagcccu

SEQ ID NO: 566331 - RNA, 22 nt, Human
ucugcuguuuacugugugauau

SEQ ID NO: 566332 - RNA, 22 nt, Human
gcuacaggggucaguccuuugc

SEQ ID NO: 566333 - RNA, 22 nt, Human
uuuguagauuuucucuccagua

SEQ ID NO: 566334 - RNA, 22 nt, Human
uggcagaaugaagacuggggcc

SEQ ID NO: 566335 - RNA, 18 nt, Human
auuugcaggcaugcaggc

SEQ ID NO: 566336 - RNA, 22 nt, Human
gguagccaauuuaaacauuucc

SEQ ID NO: 566337 - RNA, 22 nt, Human
aucauugaguaaaaugaauaca

SEQ ID NO: 566338 - RNA, 22 nt, Human
ucacccagacugucugacucuu

SEQ ID NO: 566339 - RNA, 22 nt, Human
uaggccacagagaggagauuuc

SEQ ID NO: 566340 - RNA, 22 nt, Human
cagagguagccgagugcaaucg

SEQ ID NO: 566341 - RNA, 22 nt, Human
uacguuuuaaacacggagccag

SEQ ID NO: 566342 - RNA, 22 nt, Human
aaaacauuuuacugccaucuca

SEQ ID NO: 566343 - RNA, 22 nt, Human
cugcuguguggauucaauggcu

SEQ ID NO: 566344 - RNA, 22 nt, Human
augcuugcccauguuucugaag

SEQ ID NO: 566345 - RNA, 22 nt, Human
ugugucuuuggcgaugucugga

SEQ ID NO: 566346 - RNA, 17 nt, Human
gcguguccccgcgucuc

SEQ ID NO: 566347 - RNA, 22 nt, Human
cucucuguuaugcuuucaugaa

SEQ ID NO: 566348 - RNA, 22 nt, Human
ggcaaucauuggcauucucugg

SEQ ID NO: 566349 - RNA, 22 nt, Human
aaaacuuucagggauacagaaa

SEQ ID NO: 566350 - RNA, 23 nt, Human
aaaguacuuaaucugcaaaccac

SEQ ID NO: 566351 - RNA, 22 nt, Human
ggagggaaccuuggcuggauug

SEQ ID NO: 566352 - RNA, 22 nt, Human
uguauuucugcuuucucuagua

SEQ ID NO: 566353 - RNA, 22 nt, Human
auugcacaucugcacuacagcc

SEQ ID NO: 566354 - RNA, 22 nt, Human
ugccaggcugcccuccagucug

SEQ ID NO: 566355 - RNA, 20 nt, Human
uaugauaauuacaaaauagu

SEQ ID NO: 566356 - RNA, 22 nt, Human
gcacaaaagguacuucauguag

SEQ ID NO: 566357 - RNA, 22 nt, Human
ugguaaaugucuaacaaucacu

SEQ ID NO: 566358 - RNA, 22 nt, Human
cagcuuuugcagacuucuugcc

SEQ ID NO: 566359 - RNA, 22 nt, Human
uucugagguccaugcaguacug

SEQ ID NO: 566360 - RNA, 22 nt, Human
ccaggcccugccugugguuccu

SEQ ID NO: 566361 - RNA, 22 nt, Human
gaagaccccagagcgagguaag

SEQ ID NO: 566362 - RNA, 22 nt, Human
aaaggagacuucagaucuccuu

SEQ ID NO: 566363 - RNA, 22 nt, Human
auguuuguguuucccauucagg

SEQ ID NO: 566364 - RNA, 22 nt, Human
ccugugggcgcagcuggaguca

SEQ ID NO: 566365 - RNA, 22 nt, Human
uugaguuuccugacagcgaagg

SEQ ID NO: 566366 - RNA, 22 nt, Human
agccugugcuguguuugcucca

SEQ ID NO: 566367 - RNA, 22 nt, Human
cauaacauccuugcuacuuuga

SEQ ID NO: 566368 - RNA, 22 nt, Human
ccugggcaaaugccagagacaa

SEQ ID NO: 566369 - RNA, 22 nt, Human
uuguuuguaaggcucuuagaau

SEQ ID NO: 566370 - RNA, 22 nt, Human
ggcggcgcguagccggagacuu

SEQ ID NO: 566371 - RNA, 22 nt, Human
gagaauacaaccagaagcugag

SEQ ID NO: 566372 - RNA, 22 nt, Human
uuaugcaaaggggccucuuccu

SEQ ID NO: 566373 - RNA, 22 nt, Human
uguuccucugaacuucuuccaa

SEQ ID NO: 566374 - RNA, 22 nt, Human
uuucaugauuaacuuagugaau

SEQ ID NO: 566375 - RNA, 22 nt, Human
aaauuaacuaucacuuuuguga

SEQ ID NO: 566376 - RNA, 22 nt, Human
uggcuguagaaucagagacuug

SEQ ID NO: 566377 - RNA, 22 nt, Human
uuucuuggucuucccgaccugg

SEQ ID NO: 566378 - RNA, 22 nt, Human
ucacugaauuucaagcuagugg

SEQ ID NO: 566379 - RNA, 22 nt, Human
ugguggcacugacaucagacac

SEQ ID NO: 566380 - RNA, 22 nt, Human
gaaauguuggacacuugaaauu

SEQ ID NO: 566381 - RNA, 22 nt, Human
uugauggacagggaccacuguc

SEQ ID NO: 566382 - RNA, 22 nt, Human
uuccuuuucuucuaccacaugu

SEQ ID NO: 566383 - RNA, 21 nt, Human
ccacaauucuaguuacauaug

SEQ ID NO: 566384 - RNA, 22 nt, Human
uuuccuacugcccuauacacac

SEQ ID NO: 566385 - RNA, 22 nt, Human
acauucucuuuuagaaagcugu

SEQ ID NO: 566386 - RNA, 22 nt, Human
aggcaguguggagggcuguugc

SEQ ID NO: 566387 - RNA, 22 nt, Human
gcuucugcagagccguccugag

SEQ ID NO: 566388 - RNA, 22 nt, Human
gauggaggagauggcagggugc

SEQ ID NO: 566389 - RNA, 22 nt, Human
auguaagagcuuugcagggaaa

SEQ ID NO: 566390 - RNA, 22 nt, Human
ggucuaaaaugagucuuccuag

SEQ ID NO: 566391 - RNA, 18 nt, Human
uuugggauccucuuuucu

SEQ ID NO: 566392 - RNA, 22 nt, Human
uuauguauggauggcugaaagu

SEQ ID NO: 566393 - RNA, 22 nt, Human
cuuuggaaaaauaccuggcaua

SEQ ID NO: 566394 - RNA, 22 nt, Human
ggacucucaggcugucggcuuc

SEQ ID NO: 566395 - RNA, 22 nt, Human
aacaguaugugagauuuacaca

SEQ ID NO: 566396 - RNA, 22 nt, Human
ucagccagaggcuucuugguuu

SEQ ID NO: 566397 - RNA, 22 nt, Human
gccacaggucggcuagaggguc

SEQ ID NO: 566398 - RNA, 22 nt, Human
auucugcugccuaguuuaugaa

SEQ ID NO: 566399 - RNA, 17 nt, Human
gcccgugggcuacggua

SEQ ID NO: 566400 - RNA, 22 nt, Human
agcaauguuggccuauauaccu

SEQ ID NO: 566401 - RNA, 22 nt, Human
ugcugcgggacccacugugggc

SEQ ID NO: 566402 - RNA, 18 nt, Human
ucagacaaguuagacagg

SEQ ID NO: 566403 - RNA, 22 nt, Human
cauugcuguuaauugucucuag

SEQ ID NO: 566404 - RNA, 22 nt, Human
ccacuuaagagaacagcuauag

SEQ ID NO: 566405 - RNA, 22 nt, Human
gaccuccguguacaccucccag

SEQ ID NO: 566406 - RNA, 22 nt, Human
uuaagagaagaguaucuagaac

SEQ ID NO: 566407 - RNA, 22 nt, Human
aucuaugugggaaucauaauag

SEQ ID NO: 566408 - RNA, 22 nt, Human
gagagagacauguaaacgcggu

SEQ ID NO: 566409 - RNA, 22 nt, Human
ugcugugagaccauuuguugag

SEQ ID NO: 566410 - RNA, 22 nt, Human
gccguccuacgccaucauagcg

SEQ ID NO: 566411 - RNA, 22 nt, Human
agugaauuagccuauuuguaaa

SEQ ID NO: 566412 - RNA, 22 nt, Human
ucugggugucacuccugccugc

SEQ ID NO: 566413 - RNA, 22 nt, Human
gccucugcaccaguacugugcc

SEQ ID NO: 566414 - RNA, 22 nt, Human
ccaaaauauuagugcuuaagua

SEQ ID NO: 566415 - RNA, 22 nt, Human
ucugcuugugucuguccagccu

SEQ ID NO: 566416 - RNA, 22 nt, Human
gaaaggagaggguuaaggagcu

SEQ ID NO: 566417 - RNA, 17 nt, Human
uagauuaaacacggcca

SEQ ID NO: 566418 - RNA, 22 nt, Human
cauuucaaacaguuacagcugc

SEQ ID NO: 566419 - RNA, 22 nt, Human
ugucuucauuccccaugaaguc

SEQ ID NO: 566420 - RNA, 22 nt, Human
gugauugugaaaacauuaagaa

SEQ ID NO: 566421 - RNA, 22 nt, Human
ugucauauagaauguucuauga

SEQ ID NO: 566422 - RNA, 22 nt, Human
ugggaaggggagcuggaaagga

SEQ ID NO: 566423 - RNA, 22 nt, Human
auugaagacuugguauccgugg

SEQ ID NO: 566424 - RNA, 22 nt, Human
cggagaggugggggcagcaucu

SEQ ID NO: 566425 - RNA, 22 nt, Human
gccaggucgucuccauguccaa

SEQ ID NO: 566426 - RNA, 22 nt, Human
acuguagucuaaauauagucuu

SEQ ID NO: 566427 - RNA, 22 nt, Human
cucaucuggcuucaguaacagu

SEQ ID NO: 566428 - RNA, 22 nt, Human
augagcuaagcagaaagcacac

SEQ ID NO: 566429 - RNA, 21 nt, Human
uuuaaggccagcaggagguga

SEQ ID NO: 566430 - RNA, 22 nt, Human
ucacacuuuauuuauuucaugc

SEQ ID NO: 566431 - RNA, 22 nt, Human
caaacauuuguuggaaccccug

SEQ ID NO: 566432 - RNA, 22 nt, Human
cagagaauaaaagggcauuccu

SEQ ID NO: 566433 - RNA, 22 nt, Human
agccugugagggaugcugcagu

SEQ ID NO: 566434 - RNA, 22 nt, Human
aggguugaagucugguccucau

SEQ ID NO: 566435 - RNA, 22 nt, Human
cacauuuaugggcugggaggca

SEQ ID NO: 566436 - RNA, 19 nt, Human
caggauuguuuaaagcuuu

SEQ ID NO: 566437 - RNA, 22 nt, Human
cagagcagcagagcuuccaugg

SEQ ID NO: 566438 - RNA, 22 nt, Human
ggcggcacgcaggcugcugucg

SEQ ID NO: 566439 - RNA, 22 nt, Human
uuuuccuucugauacuccauuu

SEQ ID NO: 566440 - RNA, 22 nt, Human
guuugcaaauuguguuaaagcu

SEQ ID NO: 566441 - RNA, 22 nt, Human
guguaucaacauguuuuuugug

SEQ ID NO: 566442 - RNA, 22 nt, Human
gauccacaggaaccaaaacgca

SEQ ID NO: 566443 - RNA, 22 nt, Human
uuauugcuaugaugauguguag

SEQ ID NO: 566444 - RNA, 22 nt, Human
ugcaggaacucgaaaacuauag

SEQ ID NO: 566445 - RNA, 22 nt, Human
agacaagagcugaggacauauu

SEQ ID NO: 566446 - RNA, 22 nt, Human
guugcagcaucacugcugagug

SEQ ID NO: 566447 - RNA, 22 nt, Human
caaauguuugguggcauuuugu

SEQ ID NO: 566448 - RNA, 22 nt, Human
agaaguaucaggaagauucuca

SEQ ID NO: 566449 - RNA, 22 nt, Human
ugcauuaagaauuucugaggau

SEQ ID NO: 566450 - RNA, 22 nt, Human
gguggcaccuuacccugcgcag

SEQ ID NO: 566451 - RNA, 22 nt, Human
uuaaguauauccauuugacugg

SEQ ID NO: 566452 - RNA, 22 nt, Human
uggugcagacaggagccccgcu

SEQ ID NO: 566453 - RNA, 22 nt, Human
cucugaauggacacuccagugu

SEQ ID NO: 566454 - RNA, 22 nt, Human
gcacguguucuguggcaugggu

SEQ ID NO: 566455 - RNA, 22 nt, Human
cagacagagucuucccaucagu

SEQ ID NO: 566456 - RNA, 22 nt, Human
auuucagaguagaucguuauuu

SEQ ID NO: 566457 - RNA, 22 nt, Human
ucauuguuucugcuuuucauga

SEQ ID NO: 566458 - RNA, 22 nt, Human
aaauugcaaaaguacuuuuagg

SEQ ID NO: 566459 - RNA, 22 nt, Human
ccacugcuguuacuuacgcaaa

SEQ ID NO: 566460 - RNA, 22 nt, Human
uccucuccaggugagccgaaau

SEQ ID NO: 566461 - RNA, 22 nt, Human
cuacuguaguuaaaguuuugua

SEQ ID NO: 566462 - RNA, 22 nt, Human
acauucuacaguuaaccauuag

SEQ ID NO: 566463 - RNA, 22 nt, Human
uaaagacaauuucgagcuguag

SEQ ID NO: 566464 - RNA, 22 nt, Human
uuguuuaaagaacuucugacuu

SEQ ID NO: 566465 - RNA, 22 nt, Human
cugcuuuaaaacugauacauga

SEQ ID NO: 566466 - RNA, 22 nt, Human
uauucauguguuggaaaggaac

SEQ ID NO: 566467 - RNA, 22 nt, Human
gaggagagaagcuaacggugcu

SEQ ID NO: 566468 - RNA, 22 nt, Human
aaaucugagaaauauuguccag

SEQ ID NO: 566469 - RNA, 22 nt, Human
ccaggcccugcuccucacacca

SEQ ID NO: 566470 - RNA, 22 nt, Human
caugcauuucuaccaaggaaua

SEQ ID NO: 566471 - RNA, 22 nt, Human
uaggcagggauuaggguugauu

SEQ ID NO: 566472 - RNA, 22 nt, Human
ugugaggaccucagcagagucu

SEQ ID NO: 566473 - RNA, 22 nt, Human
uuuauccaccuuacccuguucc

SEQ ID NO: 566474 - RNA, 22 nt, Human
uucguuuaguccacaaaugcau

SEQ ID NO: 566475 - RNA, 22 nt, Human
agagaauuaacauuccauggcu

SEQ ID NO: 566476 - RNA, 21 nt, Human
agaaggcaaaagcagacaucu

SEQ ID NO: 566477 - RNA, 19 nt, Human
cucugccauuugcugccug

SEQ ID NO: 566478 - RNA, 22 nt, Human
uucucugguuugcuguuucuga

SEQ ID NO: 566479 - RNA, 22 nt, Human
aucauuuaguggggcauuggaa

SEQ ID NO: 566480 - RNA, 22 nt, Human
ggccagccuggggcucccagac

SEQ ID NO: 566481 - RNA, 22 nt, Human
auugaacauuguucuaggaggc

SEQ ID NO: 566482 - RNA, 22 nt, Human
aagugcuuccauguuugagugu

SEQ ID NO: 566483 - RNA, 22 nt, Human
ccuugcagcauauagagucccu

SEQ ID NO: 566484 - RNA, 22 nt, Human
augugauacuccuucuagugga

SEQ ID NO: 566485 - RNA, 18 nt, Human
uggggggcuugucugaag

SEQ ID NO: 566486 - RNA, 22 nt, Human
uccgcgcucucacccgcucccg

SEQ ID NO: 566487 - RNA, 22 nt, Human
uggguccuggaaggcgacaggu

SEQ ID NO: 566488 - RNA, 19 nt, Human
ucuuucauuucuagcucug

SEQ ID NO: 566489 - RNA, 22 nt, Human
ccaagagcuucccauagcuucu

SEQ ID NO: 566490 - RNA, 22 nt, Human
ggacauggaaguauggagugga

SEQ ID NO: 566491 - RNA, 22 nt, Human
ugaaucaaugaauugcacuuca

SEQ ID NO: 566492 - RNA, 22 nt, Human
ccccacaccugccgggcagcag

SEQ ID NO: 566493 - RNA, 22 nt, Human
cugguuaauccauaaacagaga

SEQ ID NO: 566494 - RNA, 21 nt, Human
uugauuuagcagaucuagcug

SEQ ID NO: 566495 - RNA, 22 nt, Human
aggcagagaaaaaccagauaug

SEQ ID NO: 566496 - RNA, 22 nt, Human
uauaagaaacaaggcaaauuuu

SEQ ID NO: 566497 - RNA, 22 nt, Human
aaggccaucuacuuacggaauu

SEQ ID NO: 566498 - RNA, 22 nt, Human
aaagugacaaccauuuauuaag

SEQ ID NO: 566499 - RNA, 22 nt, Human
aacaggcuaaauuguccauuuc

SEQ ID NO: 566500 - RNA, 20 nt, Human
acagagauccucucuuuauc

SEQ ID NO: 566501 - RNA, 22 nt, Human
auuguacagacaugggaaacaa

SEQ ID NO: 566502 - RNA, 22 nt, Human
ugcuggaguggcacuguguggc

SEQ ID NO: 566503 - RNA, 22 nt, Human
uuuaauuuucugggcccagcag

SEQ ID NO: 566504 - RNA, 22 nt, Human
ucuccucuauuucuguauguau

SEQ ID NO: 566505 - RNA, 22 nt, Human
ucuuagaaacuguaucgauuag

SEQ ID NO: 566506 - RNA, 22 nt, Human
ucacaauacucacucaauggcu

SEQ ID NO: 566507 - RNA, 22 nt, Human
auuuacagacguggauuagugc

SEQ ID NO: 566508 - RNA, 22 nt, Human
gcagacccugaacugggcaugg

SEQ ID NO: 566509 - RNA, 22 nt, Human
uagaagaugccuuaaaguugaa

SEQ ID NO: 566510 - RNA, 22 nt, Human
uaucauuuuacugugacauuuu

SEQ ID NO: 566511 - RNA, 22 nt, Human
caugugaauuccaaagcuaggu

SEQ ID NO: 566512 - RNA, 22 nt, Human
gguguugcaguugaagacuggu

SEQ ID NO: 566513 - RNA, 18 nt, Human
agguauaugaaucucuuu

SEQ ID NO: 566514 - RNA, 22 nt, Human
acuguucacccagcacuagcag

SEQ ID NO: 566515 - RNA, 22 nt, Human
uuacuaguggagaaacugaggc

SEQ ID NO: 566516 - RNA, 22 nt, Human
ugugagauuuuauuugauaugc

SEQ ID NO: 566517 - RNA, 22 nt, Human
uucccuucuaguuuugagagac

SEQ ID NO: 566518 - RNA, 20 nt, Human
uugcaaagugaauagcaauu

SEQ ID NO: 566519 - RNA, 22 nt, Human
gcuuucuuuucaagaauguauu

SEQ ID NO: 566520 - RNA, 22 nt, Human
gacggagcugguugcugcggcu

SEQ ID NO: 566521 - RNA, 22 nt, Human
cugggucccggcuucuauccac

SEQ ID NO: 566522 - RNA, 22 nt, Human
uucugugcucaaaacuuuccaa

SEQ ID NO: 566523 - RNA, 20 nt, Human
uauuucugggcaaccauuua

SEQ ID NO: 566524 - RNA, 22 nt, Human
uuauuuuguagcucugaucuuu

SEQ ID NO: 566525 - RNA, 23 nt, Human
uaucauuucagcucucugccugg

SEQ ID NO: 566526 - RNA, 22 nt, Human
uucuguucccuaggaccugggg

SEQ ID NO: 566527 - RNA, 22 nt, Human
acacaagcagcuuuugagcgga

SEQ ID NO: 566528 - RNA, 22 nt, Human
cucugagguuccuuugcccucg

SEQ ID NO: 566529 - RNA, 22 nt, Human
ggagcagggaauuacagcgcag

SEQ ID NO: 566530 - RNA, 22 nt, Human
ccauuuguaccauuucuuugua

SEQ ID NO: 566531 - RNA, 22 nt, Human
uucaaacaguguagaauauaug

SEQ ID NO: 566532 - RNA, 21 nt, Human
acauguccccuaugcuuaagg

SEQ ID NO: 566533 - RNA, 22 nt, Human
aguucaugugguuuaacuuaau

SEQ ID NO: 566534 - RNA, 22 nt, Human
ugauuuacaguagugucuaaac

SEQ ID NO: 566535 - RNA, 22 nt, Human
cgaggagugugaaggcuugucg

SEQ ID NO: 566536 - RNA, 22 nt, Human
aguggcagggacuucauauaaa

SEQ ID NO: 566537 - RNA, 22 nt, Human
agccugugaaaucucugccacu

SEQ ID NO: 566538 - RNA, 20 nt, Human
cuuguuaaauaugcagguag

SEQ ID NO: 566539 - RNA, 22 nt, Human
augcggagccccaagcuugaag

SEQ ID NO: 566540 - RNA, 22 nt, Human
aaguuugucucauuugaucuuc

SEQ ID NO: 566541 - RNA, 22 nt, Human
uagaggaugauccuuccuugcc

SEQ ID NO: 566542 - RNA, 22 nt, Human
agauuauuuaagacaggaacca

SEQ ID NO: 566543 - RNA, 22 nt, Human
ucuuauugugaugaugaagaac

SEQ ID NO: 566544 - RNA, 22 nt, Human
aaggauuuuuggaaugagaugg

SEQ ID NO: 566545 - RNA, 22 nt, Human
gagcugcuggccuccugcggga

SEQ ID NO: 566546 - RNA, 22 nt, Human
acaugcuuucuagguccuucug

SEQ ID NO: 566547 - RNA, 22 nt, Human
ggugggugagcccugggagcug

SEQ ID NO: 566548 - RNA, 21 nt, Human
gucuuuuuaauugcgauuucc

SEQ ID NO: 566549 - RNA, 22 nt, Human
cuggcuccucaggacugcggga

SEQ ID NO: 566550 - RNA, 22 nt, Human
cgcugcgaggcgcccuuguugc

SEQ ID NO: 566551 - RNA, 22 nt, Human
uggcacaguuaaaguuguagaa

SEQ ID NO: 566552 - RNA, 22 nt, Human
gggagagcgcgcuagggccgag

SEQ ID NO: 566553 - RNA, 17 nt, Human
ucuggaugucauggaag

SEQ ID NO: 566554 - RNA, 22 nt, Human
uuacaguuuacauaagaauugu

SEQ ID NO: 566555 - RNA, 22 nt, Human
cugggagggguagccaauccua

SEQ ID NO: 566556 - RNA, 22 nt, Human
uugcauauccuccaacacaugg

SEQ ID NO: 566557 - RNA, 22 nt, Human
ugguuacccagucgcuggaguu

SEQ ID NO: 566558 - RNA, 22 nt, Human
uacuggacacguauauauagau

SEQ ID NO: 566559 - RNA, 22 nt, Human
ucuccuggcauuugguugagua

SEQ ID NO: 566560 - RNA, 21 nt, Human
aggucccagguuugggcagca

SEQ ID NO: 566561 - RNA, 22 nt, Human
caggccacacggcggcucccug

SEQ ID NO: 566562 - RNA, 22 nt, Human
ucugagaaugguggauguggug

SEQ ID NO: 566563 - RNA, 22 nt, Human
ccugaaaugaguucugcucacu

SEQ ID NO: 566564 - RNA, 22 nt, Human
cacucucacaugcccugucagu

SEQ ID NO: 566565 - RNA, 22 nt, Human
ugagcugcuucuuauaaugugu

SEQ ID NO: 566566 - RNA, 22 nt, Human
uaacauuucggugacaguggga

SEQ ID NO: 566567 - RNA, 22 nt, Human
gcugaagagagaugcguccagc

SEQ ID NO: 566568 - RNA, 18 nt, Human
ucaugcaaacgcuucaua

SEQ ID NO: 566569 - RNA, 22 nt, Human
acaaacuucccagacaagcucc

SEQ ID NO: 566570 - RNA, 22 nt, Human
cugucuggaaugcaguacauag

SEQ ID NO: 566571 - RNA, 22 nt, Human
ugugcuauuuuugcauaugugu

SEQ ID NO: 566572 - RNA, 22 nt, Human
uuucuucucacccaggacagag

SEQ ID NO: 566573 - RNA, 22 nt, Human
caauguacaaaauaauuacaca

SEQ ID NO: 566574 - RNA, 22 nt, Human
ugcccguucauucauacuuaac

SEQ ID NO: 566575 - RNA, 22 nt, Human
ccuaggccgcccggugcguggg

SEQ ID NO: 566576 - RNA, 20 nt, Human
uucacagaggacucagguca

SEQ ID NO: 566577 - RNA, 22 nt, Human
ugagaagcaguuucaguaagaa

SEQ ID NO: 566578 - RNA, 17 nt, Human
uuucugcaugauuggac

SEQ ID NO: 566579 - RNA, 22 nt, Human
cugcaucacagcaggaggcaca

SEQ ID NO: 566580 - RNA, 22 nt, Human
auauacacuguuucaguugaag

SEQ ID NO: 566581 - RNA, 18 nt, Human
uggcagccagcugcuccu

SEQ ID NO: 566582 - RNA, 22 nt, Human
uauccaaaggaacaaucacagc

SEQ ID NO: 566583 - RNA, 22 nt, Human
ccuuuguucacuggagagugga

SEQ ID NO: 566584 - RNA, 22 nt, Human
ggggucccugcaccagcauguc

SEQ ID NO: 566585 - RNA, 22 nt, Human
agacuucucuaacuugaggacc

SEQ ID NO: 566586 - RNA, 22 nt, Human
cugcggcuggggacagcuguug

SEQ ID NO: 566587 - RNA, 22 nt, Human
uuugacaacugugcaguuugua

SEQ ID NO: 566588 - RNA, 22 nt, Human
ggagaugccuuguuucaggaac

SEQ ID NO: 566589 - RNA, 22 nt, Human
uacuacauacagaauuuagaga

SEQ ID NO: 566590 - RNA, 22 nt, Human
gcggcuccgaagccaggccgcg

SEQ ID NO: 566591 - RNA, 22 nt, Human
guuuugaauacuacuagaacuu

SEQ ID NO: 566592 - RNA, 22 nt, Human
ggccgcggauuuucccgcuggc

SEQ ID NO: 566593 - RNA, 22 nt, Human
agcacauucccaccuguacuuc

SEQ ID NO: 566594 - RNA, 22 nt, Human
aaaugcaugugcuauagaugug

SEQ ID NO: 566595 - RNA, 22 nt, Human
uagaagaacaugucaaacuaua

SEQ ID NO: 566596 - RNA, 22 nt, Human
agauuucaauggauauugcaag

SEQ ID NO: 566597 - RNA, 22 nt, Human
auuuuagagaaacaaacguagg

SEQ ID NO: 566598 - RNA, 22 nt, Human
uuaauggauuggagguuucaau

SEQ ID NO: 566599 - RNA, 22 nt, Human
uaccugggcccaccagugccug

SEQ ID NO: 566600 - RNA, 21 nt, Human
aguuagcagauuucugucucc

SEQ ID NO: 566601 - RNA, 22 nt, Human
aagacagugacagucacaauug

SEQ ID NO: 566602 - RNA, 22 nt, Human
cagaugaaguaggugacgagca

SEQ ID NO: 566603 - RNA, 22 nt, Human
cugggcuccuaaccauccaggu

SEQ ID NO: 566604 - RNA, 22 nt, Human
ucuccauggauuuggaaaugau

SEQ ID NO: 566605 - RNA, 22 nt, Human
caucugcaggggaagccaguuu

SEQ ID NO: 566606 - RNA, 22 nt, Human
gagcaccgccuccacgaugccc

SEQ ID NO: 566607 - RNA, 22 nt, Human
aacaucuagguucucaucgaua

SEQ ID NO: 566608 - RNA, 21 nt, Human
aaagugguaaggauuauuuug

SEQ ID NO: 566609 - RNA, 22 nt, Human
aggggagguguccccaaaucuc

SEQ ID NO: 566610 - RNA, 22 nt, Human
aggacaaaggaccagaucugga

SEQ ID NO: 566611 - RNA, 22 nt, Human
auguacauuauucgagugaugg

SEQ ID NO: 566612 - RNA, 22 nt, Human
aguuuacccacuguugaaauua

SEQ ID NO: 566613 - RNA, 22 nt, Human
aaacaucuucucuugauucuuu

SEQ ID NO: 566614 - RNA, 22 nt, Human
aggugggacccguggggugcga

SEQ ID NO: 566615 - RNA, 22 nt, Human
uccacagggaugccugcggcuu

SEQ ID NO: 566616 - RNA, 22 nt, Human
augcauaucuccuaucuccuca

SEQ ID NO: 566617 - RNA, 22 nt, Human
cccacaggcaggugcaugggcu

SEQ ID NO: 566618 - RNA, 22 nt, Human
aagggaaacuuucacaaugucc

SEQ ID NO: 566619 - RNA, 22 nt, Human
cuugggcuuagaagguaaguga

SEQ ID NO: 566620 - RNA, 22 nt, Human
gucccagaggacagggucacau

SEQ ID NO: 566621 - RNA, 20 nt, Human
cucuuuucacucucaguggu

SEQ ID NO: 566622 - RNA, 22 nt, Human
ugcauguuuuauaccaaagcuu

SEQ ID NO: 566623 - RNA, 22 nt, Human
ggaaugcacuagacugugaaac

SEQ ID NO: 566624 - RNA, 22 nt, Human
gaaacauuuguugaguacuugc

SEQ ID NO: 566625 - RNA, 22 nt, Human
aggccgugugagcaugugugag

SEQ ID NO: 566626 - RNA, 22 nt, Human
ugucuuacagcaaucuguucug

SEQ ID NO: 566627 - RNA, 23 nt, Human
augcaacauugccaguaugggca

SEQ ID NO: 566628 - RNA, 22 nt, Human
agaguuauccuguccuagggga

SEQ ID NO: 566629 - RNA, 22 nt, Human
uauuucagcucuuuggauuauc

SEQ ID NO: 566630 - RNA, 22 nt, Human
uuaagguucagaaaucaauacc

SEQ ID NO: 566631 - RNA, 19 nt, Human
gggugaggaagagcguugc

SEQ ID NO: 566632 - RNA, 22 nt, Human
ggaaggggagcuggaaagggua

SEQ ID NO: 566633 - RNA, 22 nt, Human
guucucucagcgauagugaugg

SEQ ID NO: 566634 - RNA, 22 nt, Human
uuuuguguugccauguuaagca

SEQ ID NO: 566635 - RNA, 22 nt, Human
gagugcucgggccucugccugc

SEQ ID NO: 566636 - RNA, 22 nt, Human
uugcuggaagguggcuggaauc

SEQ ID NO: 566637 - RNA, 22 nt, Human
auuaguagcacacagagaucag

SEQ ID NO: 566638 - RNA, 21 nt, Human
agccaggcaagcacccccacu

SEQ ID NO: 566639 - RNA, 22 nt, Human
guuuuaguggguggccacugau

SEQ ID NO: 566640 - RNA, 22 nt, Human
uggcuccguuguacaggcugga

SEQ ID NO: 566641 - RNA, 22 nt, Human
uaaaaguuagcuaggacaaagu

SEQ ID NO: 566642 - RNA, 20 nt, Human
cagagccaggguuuuguuuu

SEQ ID NO: 566643 - RNA, 22 nt, Human
ccugguuuaaugcucacuguug

SEQ ID NO: 566644 - RNA, 22 nt, Human
gaaaauaguucaucacaaugau

SEQ ID NO: 566645 - RNA, 22 nt, Human
ugucacagugcacagcuaagaa

SEQ ID NO: 566646 - RNA, 22 nt, Human
agaaacaucgcuuaguccucau

SEQ ID NO: 566647 - RNA, 22 nt, Human
aagcaacuaaggcaaggaaaug

SEQ ID NO: 566648 - RNA, 22 nt, Human
aucccaggcggcacagguugca

SEQ ID NO: 566649 - RNA, 22 nt, Human
auuaaauuggacgcugggggaa

SEQ ID NO: 566650 - RNA, 22 nt, Human
uacugcaaaccauuuacaguag

SEQ ID NO: 566651 - RNA, 22 nt, Human
auauaaguguguggcuguuagu

SEQ ID NO: 566652 - RNA, 22 nt, Human
acaauuucuaauauagaucuua

SEQ ID NO: 566653 - RNA, 22 nt, Human
ucucuguaagcugccuucucgu

SEQ ID NO: 566654 - RNA, 22 nt, Human
aacugcuaacugguuugauacu

SEQ ID NO: 566655 - RNA, 22 nt, Human
agacagcgaggacagaggggug

SEQ ID NO: 566656 - RNA, 20 nt, Human
uuugauugccccucugacuu

SEQ ID NO: 566657 - RNA, 22 nt, Human
gcagcugcgcugguguggggca

SEQ ID NO: 566658 - RNA, 22 nt, Human
uguccagcugaaggcagccuca

SEQ ID NO: 566659 - RNA, 22 nt, Human
uccaaauagcuggaugauggug

SEQ ID NO: 566660 - RNA, 22 nt, Human
cugagcugguucucuugugaaa

SEQ ID NO: 566661 - RNA, 21 nt, Human
cuagaaagaauguugucgucu

SEQ ID NO: 566662 - RNA, 22 nt, Human
gccgugcgugcgcaggugcugu

SEQ ID NO: 566663 - RNA, 18 nt, Human
gaggcacauaguuggggc

SEQ ID NO: 566664 - RNA, 22 nt, Human
uccugggcccuccggaucaggu

SEQ ID NO: 566665 - RNA, 22 nt, Human
aauuauguuugcuuuagaugga

SEQ ID NO: 566666 - RNA, 22 nt, Human
ugaaaugccuaugaagucagga

SEQ ID NO: 566667 - RNA, 22 nt, Human
acucaucuuugaauuuucagua

SEQ ID NO: 566668 - RNA, 22 nt, Human
gcugggcaggccucgugagggc

SEQ ID NO: 566669 - RNA, 22 nt, Human
uucuuuuaauagagauccugug

SEQ ID NO: 566670 - RNA, 22 nt, Human
ggaagcaaauuccagaaccaca

SEQ ID NO: 566671 - RNA, 22 nt, Human
caaacugaacacgaaagucuuu

SEQ ID NO: 566672 - RNA, 22 nt, Human
acaucucacuucuuugaaggcu

SEQ ID NO: 566673 - RNA, 22 nt, Human
agauguuuauaacucaugagug

SEQ ID NO: 566674 - RNA, 22 nt, Human
ugaaaacacuuuaguuuagguc

SEQ ID NO: 566675 - RNA, 22 nt, Human
uccacagugguggaauuguuca

SEQ ID NO: 566676 - RNA, 22 nt, Human
cacuguuuuacauguuauuuaa

SEQ ID NO: 566677 - RNA, 22 nt, Human
guaauucugugugaaucuauua

SEQ ID NO: 566678 - RNA, 22 nt, Human
uaauucuagauugacauuuuga

SEQ ID NO: 566679 - RNA, 22 nt, Human
agucaacauuugagaugcaaug

SEQ ID NO: 566680 - RNA, 22 nt, Human
gguccccguggaggcuggagcg

SEQ ID NO: 566681 - RNA, 22 nt, Human
uucagaaagugaaucuuguuau

SEQ ID NO: 566682 - RNA, 22 nt, Human
aaauugcuugagauuagucucc

SEQ ID NO: 566683 - RNA, 22 nt, Human
uacuuugagaugaugcugaucg

SEQ ID NO: 566684 - RNA, 22 nt, Human
ugguuaaaugcuccgaucuugg

SEQ ID NO: 566685 - RNA, 22 nt, Human
uaucuguauucugacagucacu

SEQ ID NO: 566686 - RNA, 22 nt, Human
ggcagagcuugcagugagccga

SEQ ID NO: 566687 - RNA, 23 nt, Human
aucuguguguggguagggaugau

SEQ ID NO: 566688 - RNA, 21 nt, Human
ugcauauauaagugcauacac

SEQ ID NO: 566689 - RNA, 22 nt, Human
cagccuuugggucagaagauuc

SEQ ID NO: 566690 - RNA, 23 nt, Human
cuuuccuuucuuugacacccagc

SEQ ID NO: 566691 - RNA, 22 nt, Human
cugccaucugagccaaaagugc

SEQ ID NO: 566692 - RNA, 22 nt, Human
uuguaagacuguagaaugcaaa

SEQ ID NO: 566693 - RNA, 22 nt, Human
ggacaucuguugugguagagga

SEQ ID NO: 566694 - RNA, 22 nt, Human
cugccguugugaagcucuuaga

SEQ ID NO: 566695 - RNA, 22 nt, Human
cagaaccaggaacugauggaga

SEQ ID NO: 566696 - RNA, 22 nt, Human
augcacaagguagauuauuauu

SEQ ID NO: 566697 - RNA, 22 nt, Human
uccaagaagcuuacaaucuaau

SEQ ID NO: 566698 - RNA, 22 nt, Human
uagcgggucacccugcugugaa

SEQ ID NO: 566699 - RNA, 22 nt, Human
agagaccuuuugccuucuaguu

SEQ ID NO: 566700 - RNA, 22 nt, Human
ugcacagagggaggcauaaaau

SEQ ID NO: 566701 - RNA, 23 nt, Human
ggucccaguggagaggccucacc

SEQ ID NO: 566702 - RNA, 22 nt, Human
uuucaaguagagggaucgcuag

SEQ ID NO: 566703 - RNA, 22 nt, Human
gugacagguauacucaccauug

SEQ ID NO: 566704 - RNA, 22 nt, Human
cugggaggcccacguugggaag

SEQ ID NO: 566705 - RNA, 22 nt, Human
augaugaagcaugguuacacug

SEQ ID NO: 566706 - RNA, 21 nt, Human
ugcuaagugucacaugucugc

SEQ ID NO: 566707 - RNA, 23 nt, Human
aacugcaagguugcugggaagua

SEQ ID NO: 566708 - RNA, 22 nt, Human
ugcaugacaauugccgucaagu

SEQ ID NO: 566709 - RNA, 22 nt, Human
auguaacauaugugaucgcauu

SEQ ID NO: 566710 - RNA, 22 nt, Human
cgccguccccuaggaaagagcu

SEQ ID NO: 566711 - RNA, 22 nt, Human
uuguugcugcucaaccucuaua

SEQ ID NO: 566712 - RNA, 17 nt, Human
ccuuucuucccagaggg

SEQ ID NO: 566713 - RNA, 22 nt, Human
gcaguggccacauggaggagga

SEQ ID NO: 566714 - RNA, 17 nt, Human
aguuuuuggaccugugu

SEQ ID NO: 566715 - RNA, 22 nt, Human
ccaaacauuucaaauuuagaga

SEQ ID NO: 566716 - RNA, 22 nt, Human
ucagccaggccaggcauucaca

SEQ ID NO: 566717 - RNA, 22 nt, Human
agguaagguuuggaggcagugg

SEQ ID NO: 566718 - RNA, 22 nt, Human
cauuuagaagucuuagaacuau

SEQ ID NO: 566719 - RNA, 22 nt, Human
cuuucugaggagacgggcuuug

SEQ ID NO: 566720 - RNA, 22 nt, Human
ccaugcccuugucaucuccagg

SEQ ID NO: 566721 - RNA, 22 nt, Human
uauacuacgcaccaaacaaagg

SEQ ID NO: 566722 - RNA, 22 nt, Human
agccagcuaccggggcuccugg

SEQ ID NO: 566723 - RNA, 22 nt, Human
uguucaguuugcuaucauaauc

SEQ ID NO: 566724 - RNA, 22 nt, Human
uuggaggaagcucaugggggau

SEQ ID NO: 566725 - RNA, 22 nt, Human
acugcuuacccggccugacuuc

SEQ ID NO: 566726 - RNA, 18 nt, Human
acccauuauauuuguagc

SEQ ID NO: 566727 - RNA, 22 nt, Human
ugcagcaucuccuugugccaug

SEQ ID NO: 566728 - RNA, 21 nt, Human
ugagcaccagcugcaugcccc

SEQ ID NO: 566729 - RNA, 22 nt, Human
aaugaguuuguucuauuauuug

SEQ ID NO: 566730 - RNA, 22 nt, Human
uuuccaaagguggcaggaacaa

SEQ ID NO: 566731 - RNA, 22 nt, Human
ggugccuaauaauucuauugca

SEQ ID NO: 566732 - RNA, 21 nt, Human
ucccacuggcccagggcucca

SEQ ID NO: 566733 - RNA, 22 nt, Human
ugcacacaguucucaggaaaga

SEQ ID NO: 566734 - RNA, 22 nt, Human
uuucuacauuuguaaccagauu

SEQ ID NO: 566735 - RNA, 22 nt, Human
acaagauagcuuagaagauuca

SEQ ID NO: 566736 - RNA, 22 nt, Human
auauaguuggguuucauucuac

SEQ ID NO: 566737 - RNA, 22 nt, Human
accgugucugacacuuugggcg

SEQ ID NO: 566738 - RNA, 22 nt, Human
ugcagcuucucugcaacaggag

SEQ ID NO: 566739 - RNA, 22 nt, Human
agcuuuggcaucugacuagccg

SEQ ID NO: 566740 - RNA, 22 nt, Human
agcugucuaccugcagaguccu

SEQ ID NO: 566741 - RNA, 22 nt, Human
ucagaagucuggacugcuucuc

SEQ ID NO: 566742 - RNA, 22 nt, Human
ggugggucuuguggggcagcuu

SEQ ID NO: 566743 - RNA, 22 nt, Human
ugugaagaauuaaugugaauca

SEQ ID NO: 566744 - RNA, 22 nt, Human
cuacauuuacacaguuaggcuu

SEQ ID NO: 566745 - RNA, 22 nt, Human
ucccagaacccugccagguccu

SEQ ID NO: 566746 - RNA, 22 nt, Human
aacuuucugaaaagcuugauca

SEQ ID NO: 566747 - RNA, 22 nt, Human
uuugccaguauuuuauugauga

SEQ ID NO: 566748 - RNA, 22 nt, Human
auucucuguacagaagguaccg

SEQ ID NO: 566749 - RNA, 19 nt, Human
ugcagcuguaugagcuuaa

SEQ ID NO: 566750 - RNA, 22 nt, Human
caaagaagagauuuacagagcu

SEQ ID NO: 566751 - RNA, 22 nt, Human
cgccaguggcagcuggaacagg

SEQ ID NO: 566752 - RNA, 22 nt, Human
ucguggaugcgcagggcggccu

SEQ ID NO: 566753 - RNA, 22 nt, Human
accugccagaaugcuaguccug

SEQ ID NO: 566754 - RNA, 22 nt, Human
uuucucuuucaaucugcaguac

SEQ ID NO: 566755 - RNA, 21 nt, Human
cuguccccagugagcaccccc

SEQ ID NO: 566756 - RNA, 22 nt, Human
aucuuacaauuacaagacacuc

SEQ ID NO: 566757 - RNA, 22 nt, Human
uuuuucaagacaaccugcaugu

SEQ ID NO: 566758 - RNA, 20 nt, Human
uacaauauucccacuuugcu

SEQ ID NO: 566759 - RNA, 22 nt, Human
auuugcuuguucaccaguacuu

SEQ ID NO: 566760 - RNA, 22 nt, Human
acuugcaucuuagagacucacc

SEQ ID NO: 566761 - RNA, 22 nt, Human
uaguuacuuuugcucuucauua

SEQ ID NO: 566762 - RNA, 22 nt, Human
cuguggguggcugugccccagg

SEQ ID NO: 566763 - RNA, 22 nt, Human
cagaaagcaguugucaaugggc

SEQ ID NO: 566764 - RNA, 22 nt, Human
cuucucaaaguugugaaucagg

SEQ ID NO: 566765 - RNA, 22 nt, Human
gaugucuggcuaccacucgcac

SEQ ID NO: 566766 - RNA, 22 nt, Human
cagcccacugccucugugguag

SEQ ID NO: 566767 - RNA, 22 nt, Human
ggaguucaaaucuuuuggaucu

SEQ ID NO: 566768 - RNA, 22 nt, Human
aagucauugguagcuugauagg

SEQ ID NO: 566769 - RNA, 22 nt, Human
gccggacugcugcagcugcuag

SEQ ID NO: 566770 - RNA, 22 nt, Human
aagucaauuaguaaacuuggaa

SEQ ID NO: 566771 - RNA, 22 nt, Human
gaugaguucuuucuauucuauu

SEQ ID NO: 566772 - RNA, 22 nt, Human
cagacguuggaggaaauauacc

SEQ ID NO: 566773 - RNA, 22 nt, Human
uuccuucuucauuguguuacag

SEQ ID NO: 566774 - RNA, 22 nt, Human
ucagguagugguuaaguucugu

SEQ ID NO: 566775 - RNA, 22 nt, Human
acaaagugaaaagcaucgaauu

SEQ ID NO: 566776 - RNA, 22 nt, Human
cacaucucagggcuacaggcag

SEQ ID NO: 566777 - RNA, 22 nt, Human
uggaaauaguugugagucaggc

SEQ ID NO: 566778 - RNA, 22 nt, Human
aaucuguuuuaaaguuugugcc

SEQ ID NO: 566779 - RNA, 22 nt, Human
cugugaauguuauaucucaaug

SEQ ID NO: 566780 - RNA, 21 nt, Human
uaaacauaaccuuguauggcu

SEQ ID NO: 566781 - RNA, 22 nt, Human
uuugaaaggagcuuuauccaga

SEQ ID NO: 566782 - RNA, 22 nt, Human
uuuugaauaauucagaaacagc

SEQ ID NO: 566783 - RNA, 19 nt, Human
aguguuuauguagugccua

SEQ ID NO: 566784 - RNA, 22 nt, Human
uuguaacaguagcugucagcuc

SEQ ID NO: 566785 - RNA, 22 nt, Human
cuuuacuucagcaagcuuuccu

SEQ ID NO: 566786 - RNA, 22 nt, Human
ugccuguguccccuucuuggca

SEQ ID NO: 566787 - RNA, 22 nt, Human
cuuguauuaggaagaaugcuuu

SEQ ID NO: 566788 - RNA, 22 nt, Human
ccuuuuggccaggucagugcag

SEQ ID NO: 566789 - RNA, 21 nt, Human
auacaagaagauggcagucug

SEQ ID NO: 566790 - RNA, 22 nt, Human
ugcugcucaagcugcagcaaaa

SEQ ID NO: 566791 - RNA, 22 nt, Human
agugcuuuauguuguugugcaa

SEQ ID NO: 566792 - RNA, 22 nt, Human
gccaggcaggccacgcuguguu

SEQ ID NO: 566793 - RNA, 19 nt, Human
cugggacaaugaaagcauc

SEQ ID NO: 566794 - RNA, 22 nt, Human
ccaggccuguguuguguggagg

SEQ ID NO: 566795 - RNA, 22 nt, Human
uugcacgcuugcgguuccugcc

SEQ ID NO: 566796 - RNA, 22 nt, Human
uaccauuucaguaaaaacuuag

SEQ ID NO: 566797 - RNA, 22 nt, Human
auacagguucucuagggaacag

SEQ ID NO: 566798 - RNA, 22 nt, Human
gcacugggggcagcagugaggg

SEQ ID NO: 566799 - RNA, 22 nt, Human
auguaguauuuggaaauguaaa

SEQ ID NO: 566800 - RNA, 22 nt, Human
aacaugaugacauuguaagcuu

SEQ ID NO: 566801 - RNA, 22 nt, Human
ucagucucuggggcuucuguuu

SEQ ID NO: 566802 - RNA, 22 nt, Human
augcuacauuuugguuuauaaa

SEQ ID NO: 566803 - RNA, 19 nt, Human
ugcuccaggccuugccgca

SEQ ID NO: 566804 - RNA, 22 nt, Human
agcagcaggugaccucgaugcc

SEQ ID NO: 566805 - RNA, 22 nt, Human
aaggagcuuucauuacagccuu

SEQ ID NO: 566806 - RNA, 22 nt, Human
uuguccagcgaccaggcucugu

SEQ ID NO: 566807 - RNA, 22 nt, Human
acugaaauuuauauuuugggca

SEQ ID NO: 566808 - RNA, 22 nt, Human
cagcgguggcaaggugacugug

SEQ ID NO: 566809 - RNA, 22 nt, Human
gagauuuccauauuuuguaaca

SEQ ID NO: 566810 - RNA, 23 nt, Human
uggaaacauucugaauguccauc

SEQ ID NO: 566811 - RNA, 23 nt, Human
caccccacccugaggaggaggga

SEQ ID NO: 566812 - RNA, 22 nt, Human
caauaauugcuuuccagaguua

SEQ ID NO: 566813 - RNA, 20 nt, Human
uuucacuggcuugauaaggu

SEQ ID NO: 566814 - RNA, 22 nt, Human
auguuugaaauuguaaguauau

SEQ ID NO: 566815 - RNA, 22 nt, Human
ggagugggaacaaugacauggu

SEQ ID NO: 566816 - RNA, 22 nt, Human
uuuucuuggaguggcuguccuu

SEQ ID NO: 566817 - RNA, 22 nt, Human
aaccagacucuccaaaggcaaa

SEQ ID NO: 566818 - RNA, 22 nt, Human
cuguuuauucucaucuaaaaug

SEQ ID NO: 566819 - RNA, 22 nt, Human
aaacucuacauggucgcaaaaa

SEQ ID NO: 566820 - RNA, 22 nt, Human
uauuuggauagacagggagaug

SEQ ID NO: 566821 - RNA, 18 nt, Human
ucaguccuccauagagcu

SEQ ID NO: 566822 - RNA, 23 nt, Human
uugguuacuggauuugaggggcc

SEQ ID NO: 566823 - RNA, 22 nt, Human
cuccagauuccguuuauucagg

SEQ ID NO: 566824 - RNA, 22 nt, Human
gaugcugauuuuacuguuuucu

SEQ ID NO: 566825 - RNA, 22 nt, Human
uggaauuaucugaagugauuug

SEQ ID NO: 566826 - RNA, 22 nt, Human
caagccaggaaggauccagcac

SEQ ID NO: 566827 - RNA, 22 nt, Human
ucuuuugagggccagaggaaga

SEQ ID NO: 566828 - RNA, 22 nt, Human
ucaggggacagccagcuggagg

SEQ ID NO: 566829 - RNA, 22 nt, Human
augggucccuggccgcccucgg

SEQ ID NO: 566830 - RNA, 22 nt, Human
agacauauuggcuugcuuuaau

SEQ ID NO: 566831 - RNA, 22 nt, Human
aacccaggaguuggaggcugug

SEQ ID NO: 566832 - RNA, 20 nt, Human
cgggacacucaagcucuggg

SEQ ID NO: 566833 - RNA, 20 nt, Human
ucauaugugguuguauacaa

SEQ ID NO: 566834 - RNA, 22 nt, Human
gaagaaguguaagucuguuuca

SEQ ID NO: 566835 - RNA, 22 nt, Human
acaguguuacuugauaguguau

SEQ ID NO: 566836 - RNA, 22 nt, Human
agcaccauugcaaauauggcag

SEQ ID NO: 566837 - RNA, 22 nt, Human
aucuucaaggaaaaaauacagu

SEQ ID NO: 566838 - RNA, 22 nt, Human
augauuuguuaacagacuuaau

SEQ ID NO: 566839 - RNA, 22 nt, Human
uaucaguccaggguuuugugac

SEQ ID NO: 566840 - RNA, 22 nt, Human
gaacuuuaauuagcuuuugucu

SEQ ID NO: 566841 - RNA, 22 nt, Human
uuacaguuaaugugacuaacca

SEQ ID NO: 566842 - RNA, 22 nt, Human
acgccucugcagcugccgggcc

SEQ ID NO: 566843 - RNA, 22 nt, Human
uuucucggcagagaugaugggc

SEQ ID NO: 566844 - RNA, 22 nt, Human
gcagcugcgaagaagucuaucu

SEQ ID NO: 566845 - RNA, 22 nt, Human
uaucuguagucucaugguuccu

SEQ ID NO: 566846 - RNA, 22 nt, Human
uuaguuuccuguggugugaagu

SEQ ID NO: 566847 - RNA, 23 nt, Human
acauuacacgcaguaauugcccc

SEQ ID NO: 566848 - RNA, 20 nt, Human
gggugugugcagggccuggu

SEQ ID NO: 566849 - RNA, 22 nt, Human
uuuggaaaugagaagccaccuu

SEQ ID NO: 566850 - RNA, 22 nt, Human
cuuauguaaacuacagauaaua

SEQ ID NO: 566851 - RNA, 22 nt, Human
uacuguauacuacugcuguucu

SEQ ID NO: 566852 - RNA, 22 nt, Human
cauuuuccucugcugguguuca

SEQ ID NO: 566853 - RNA, 22 nt, Human
uauuacaguucgaguuucuagg

SEQ ID NO: 566854 - RNA, 22 nt, Human
uuucgagggauuagcuaggacu

SEQ ID NO: 566855 - RNA, 23 nt, Human
aguacauuugacccaaauaagcu

SEQ ID NO: 566856 - RNA, 22 nt, Human
aauacagauggcaugugaagau

SEQ ID NO: 566857 - RNA, 22 nt, Human
guuguuuuugaacggugguggc

SEQ ID NO: 566858 - RNA, 22 nt, Human
uaaaaucaugacagauugacau

SEQ ID NO: 566859 - RNA, 22 nt, Human
ggucuggccuccgggcaggugg

SEQ ID NO: 566860 - RNA, 22 nt, Human
gaccacugaaugcacuucuaau

SEQ ID NO: 566861 - RNA, 21 nt, Human
caaaagagacugauucuugga

SEQ ID NO: 566862 - RNA, 22 nt, Human
uacccacugucauauucagggu

SEQ ID NO: 566863 - RNA, 22 nt, Human
acgcggugcggcaaguucaugg

SEQ ID NO: 566864 - RNA, 22 nt, Human
cgugaugcucaggaggucauag

SEQ ID NO: 566865 - RNA, 22 nt, Human
aaaugcacaauaaaguaaaggc

SEQ ID NO: 566866 - RNA, 19 nt, Human
gagcagcuuccuaucuggu

SEQ ID NO: 566867 - RNA, 22 nt, Human
ggugauuuccuuuugcaaaguc

SEQ ID NO: 566868 - RNA, 19 nt, Human
ugcucucuggugcuucaug

SEQ ID NO: 566869 - RNA, 22 nt, Human
uuguacuuaaauaugcaaauag

SEQ ID NO: 566870 - RNA, 20 nt, Human
ugugguuuuugccaguugaa

SEQ ID NO: 566871 - RNA, 21 nt, Human
gcuggcugucucuuacacggu

SEQ ID NO: 566872 - RNA, 22 nt, Human
cagaggccccauuggcugugcg

SEQ ID NO: 566873 - RNA, 22 nt, Human
uuggcagugacugcgggccccg

SEQ ID NO: 566874 - RNA, 22 nt, Human
agcaggaaggggaugaugggca

SEQ ID NO: 566875 - RNA, 22 nt, Human
uguucugcaaugcugccuccuu

SEQ ID NO: 566876 - RNA, 22 nt, Human
agaauguaagaaugcaaagauu

SEQ ID NO: 566877 - RNA, 22 nt, Human
ugugucuaaugacuauuucuuc

SEQ ID NO: 566878 - RNA, 22 nt, Human
gauguaucugagcugcuuaggu

SEQ ID NO: 566879 - RNA, 22 nt, Human
gcgcuccucccggcccuggugg

SEQ ID NO: 566880 - RNA, 22 nt, Human
guucuccaggggcuguucaucu

SEQ ID NO: 566881 - RNA, 22 nt, Human
agagcagaggcauggccguggg

SEQ ID NO: 566882 - RNA, 22 nt, Human
ggaagcuguuaucaucuguauc

SEQ ID NO: 566883 - RNA, 22 nt, Human
cauuaacacuuuggauuuagac

SEQ ID NO: 566884 - RNA, 22 nt, Human
uaauccaaaacugaaucugugg

SEQ ID NO: 566885 - RNA, 22 nt, Human
ucagaagcauccauuucaccac

SEQ ID NO: 566886 - RNA, 22 nt, Human
gauuguacuuauugagcuaaac

SEQ ID NO: 566887 - RNA, 22 nt, Human
cccaggaggcagaaguugcagu

SEQ ID NO: 566888 - RNA, 22 nt, Human
uuguacaaauaggaaccucuga

SEQ ID NO: 566889 - RNA, 22 nt, Human
aagcauuucagguagagauauu

SEQ ID NO: 566890 - RNA, 22 nt, Human
guauuucuuuacauaugcucau

SEQ ID NO: 566891 - RNA, 22 nt, Human
ucaauuuauguggcuauucauu

SEQ ID NO: 566892 - RNA, 22 nt, Human
uuaaaagaauccuguuauccuc

SEQ ID NO: 566893 - RNA, 22 nt, Human
uugcaaucagcaguguuuucac

SEQ ID NO: 566894 - RNA, 22 nt, Human
agcuuugcugcuggagaagggu

SEQ ID NO: 566895 - RNA, 22 nt, Human
uuacuguagcuugacauauguc

SEQ ID NO: 566896 - RNA, 22 nt, Human
auuaauaucccccgccguucug

SEQ ID NO: 566897 - RNA, 22 nt, Human
ggcaagaaccucaauuaccuuu

SEQ ID NO: 566898 - RNA, 22 nt, Human
ugccuguggaaaggcuggugcu

SEQ ID NO: 566899 - RNA, 22 nt, Human
cucucugggcccaguuggcacc

SEQ ID NO: 566900 - RNA, 22 nt, Human
aaaagagccacuuaugaccuca

SEQ ID NO: 566901 - RNA, 22 nt, Human
gaacaguuucccuguagaaaau

SEQ ID NO: 566902 - RNA, 22 nt, Human
uccucauucuuggugcaucaaa

SEQ ID NO: 566903 - RNA, 22 nt, Human
ucugcuggaaaaccagggaauu

SEQ ID NO: 566904 - RNA, 22 nt, Human
guuucuuauuucaacuggaaca

SEQ ID NO: 566905 - RNA, 21 nt, Human
ccuguggugccagaucgccag

SEQ ID NO: 566906 - RNA, 22 nt, Human
ugcccguggccuggggcagcuu

SEQ ID NO: 566907 - RNA, 22 nt, Human
cuaaauguuuuaucuuccuggc

SEQ ID NO: 566908 - RNA, 22 nt, Human
uaucuguuuuuacagugucuuu

SEQ ID NO: 566909 - RNA, 22 nt, Human
ugaauaaucuuggguauuaaua

SEQ ID NO: 566910 - RNA, 22 nt, Human
cuaguauuaagugugaguaaaa

SEQ ID NO: 566911 - RNA, 22 nt, Human
aacacaguuucugcauugguag

SEQ ID NO: 566912 - RNA, 20 nt, Human
gcugugccaugacccucgag

SEQ ID NO: 566913 - RNA, 22 nt, Human
auuaguguuguggcuucauggc

SEQ ID NO: 566914 - RNA, 22 nt, Human
ugacauuugagagagauauaca

SEQ ID NO: 566915 - RNA, 22 nt, Human
aauucauacucuauauugcuuu

SEQ ID NO: 566916 - RNA, 22 nt, Human
auuuccaggaguugaggucuga

SEQ ID NO: 566917 - RNA, 22 nt, Human
uagcugcacaggaaguaagauu

SEQ ID NO: 566918 - RNA, 22 nt, Human
acauauuuugaaagcuuucuaa

SEQ ID NO: 566919 - RNA, 23 nt, Human
cguuuuuuccucagauguucugg

SEQ ID NO: 566920 - RNA, 22 nt, Human
ccuuuuaagggagacuagagau

SEQ ID NO: 566921 - RNA, 22 nt, Human
ggcagcagaacuggcccuguau

SEQ ID NO: 566922 - RNA, 22 nt, Human
guguuuugugaggccuucuuuc

SEQ ID NO: 566923 - RNA, 22 nt, Human
gcugucucauacaaggcccugc

SEQ ID NO: 566924 - RNA, 22 nt, Human
cauaaauuguacccauuccaac

SEQ ID NO: 566925 - RNA, 22 nt, Human
gagagaagggggauaugagccu

SEQ ID NO: 566926 - RNA, 22 nt, Human
ugcucccaggcauucucuguug

SEQ ID NO: 566927 - RNA, 22 nt, Human
augauccagauuuugggcaguu

SEQ ID NO: 566928 - RNA, 22 nt, Human
uugcuugaacccaggaagugga

SEQ ID NO: 566929 - RNA, 22 nt, Human
ucuuuuccuugaugguuaaaua

SEQ ID NO: 566930 - RNA, 22 nt, Human
cagaaacacuguauuuagggaa

SEQ ID NO: 566931 - RNA, 22 nt, Human
gucuuuuuuacaccuuacauca

SEQ ID NO: 566932 - RNA, 22 nt, Human
uagcaucuguacugacauaauc

SEQ ID NO: 566933 - RNA, 22 nt, Human
uauuaugguuguagguuaacaa

SEQ ID NO: 566934 - RNA, 21 nt, Human
guucaauagcucuuugaaugc

SEQ ID NO: 566935 - RNA, 22 nt, Human
auagcuuugagggcuccuuagg

SEQ ID NO: 566936 - RNA, 22 nt, Human
aauuauugagcaucuacugugu

SEQ ID NO: 566937 - RNA, 22 nt, Human
ucuucacaguccuggucagugg

SEQ ID NO: 566938 - RNA, 22 nt, Human
gagacagagagguacucaacau

SEQ ID NO: 566939 - RNA, 22 nt, Human
acaaaugcuuaguucaccaaaa

SEQ ID NO: 566940 - RNA, 18 nt, Human
uucggcagauacgcuugg

SEQ ID NO: 566941 - RNA, 22 nt, Human
ggucucugcagcucccggcccc

SEQ ID NO: 566942 - RNA, 22 nt, Human
uggaauguuaaaccucaaugau

SEQ ID NO: 566943 - RNA, 22 nt, Human
gauacuuuguggaauccuggau

SEQ ID NO: 566944 - RNA, 22 nt, Human
aguguauuugccuauaaaaaug

SEQ ID NO: 566945 - RNA, 22 nt, Human
aguguucuagcgcugugcuugu

SEQ ID NO: 566946 - RNA, 22 nt, Human
aucuggcucccuuggaauccgu

SEQ ID NO: 566947 - RNA, 22 nt, Human
uucucugaguacguuucagugu

SEQ ID NO: 566948 - RNA, 22 nt, Human
uuggaaauguagaaaagcagau

SEQ ID NO: 566949 - RNA, 22 nt, Human
cuagcagcauucuucuaguuag

SEQ ID NO: 566950 - RNA, 22 nt, Human
agacacauuuucagcucugcca

SEQ ID NO: 566951 - RNA, 22 nt, Human
guccaggccugccucugaggag

SEQ ID NO: 566952 - RNA, 22 nt, Human
ccucauucucgcguguguuucu

SEQ ID NO: 566953 - RNA, 22 nt, Human
agauguuuuuccaggucuaauu

SEQ ID NO: 566954 - RNA, 22 nt, Human
cucuauucuaauggauucuggg

SEQ ID NO: 566955 - RNA, 22 nt, Human
auacaugacucacacauucugc

SEQ ID NO: 566956 - RNA, 22 nt, Human
ucuaguuagugguugauacugu

SEQ ID NO: 566957 - RNA, 18 nt, Human
agguguguuucuaggagc

SEQ ID NO: 566958 - RNA, 22 nt, Human
cucacucaguuuuuaguucauc

SEQ ID NO: 566959 - RNA, 22 nt, Human
ugugugaacucucugauguaca

SEQ ID NO: 566960 - RNA, 21 nt, Human
auucugaguugucagucuuca

SEQ ID NO: 566961 - RNA, 21 nt, Human
uggagagugauuucagugugg

SEQ ID NO: 566962 - RNA, 22 nt, Human
gugauuucaaauauagagugag

SEQ ID NO: 566963 - RNA, 21 nt, Human
ucauccagguccugcuucuuc

SEQ ID NO: 566964 - RNA, 22 nt, Human
aauggagugguucuugcccucu

SEQ ID NO: 566965 - RNA, 22 nt, Human
uggaaggggccaggcgcggagu

SEQ ID NO: 566966 - RNA, 22 nt, Human
gggcuguuugcauauguuuaua

SEQ ID NO: 566967 - RNA, 22 nt, Human
ugaggucuguccugucuuugga

SEQ ID NO: 566968 - RNA, 23 nt, Human
uggggcugauggagacggaccag

SEQ ID NO: 566969 - RNA, 22 nt, Human
uucucaaagugugcucccugga

SEQ ID NO: 566970 - RNA, 22 nt, Human
ucaccuguuggauguauacugu

SEQ ID NO: 566971 - RNA, 20 nt, Human
gugcccaguuggugacagac

SEQ ID NO: 566972 - RNA, 22 nt, Human
ugugaagaucaggguccuagag

SEQ ID NO: 566973 - RNA, 22 nt, Human
ugucuucuaccuugacagcauu

SEQ ID NO: 566974 - RNA, 22 nt, Human
agugauguagguggauucuggc

SEQ ID NO: 566975 - RNA, 23 nt, Human
cauuugauccucacaauaaaugg

SEQ ID NO: 566976 - RNA, 22 nt, Human
uuuuuaagagucuggaaauagu

SEQ ID NO: 566977 - RNA, 22 nt, Human
acagacacaggcguggagucgc

SEQ ID NO: 566978 - RNA, 22 nt, Human
gugauuuucuccuccuagaagu

SEQ ID NO: 566979 - RNA, 22 nt, Human
caugucacaauucuuaauggga

SEQ ID NO: 566980 - RNA, 22 nt, Human
uccacagguccucuuugcaaag

SEQ ID NO: 566981 - RNA, 22 nt, Human
gacaguggagccacguugggag

SEQ ID NO: 566982 - RNA, 22 nt, Human
aagcccuuggcgcacaccgggc

SEQ ID NO: 566983 - RNA, 22 nt, Human
uugaugcugucuuucagaauca

SEQ ID NO: 566984 - RNA, 22 nt, Human
gccggggcuggggagagacaug

SEQ ID NO: 566985 - RNA, 22 nt, Human
cuccagcucgcgagcucugcuc

SEQ ID NO: 566986 - RNA, 22 nt, Human
uagauucugacccucuuuuuac

SEQ ID NO: 566987 - RNA, 22 nt, Human
uuugcaaaguccauugaaguua

SEQ ID NO: 566988 - RNA, 22 nt, Human
uuuguguuguacuucugugcau

SEQ ID NO: 566989 - RNA, 22 nt, Human
ucagcacaggucuugcaaaaca

SEQ ID NO: 566990 - RNA, 22 nt, Human
auagcaaaggacaauagucagu

SEQ ID NO: 566991 - RNA, 22 nt, Human
auuuagacaacaagccuucucc

SEQ ID NO: 566992 - RNA, 22 nt, Human
guuugagauggguuauugcucu

SEQ ID NO: 566993 - RNA, 22 nt, Human
augcuuuauuggagacagucau

SEQ ID NO: 566994 - RNA, 23 nt, Human
cagcacaguacauuuccugucuc

SEQ ID NO: 566995 - RNA, 22 nt, Human
ugggcccaucauugcugugggc

SEQ ID NO: 566996 - RNA, 22 nt, Human
ggcugagucugugacccaugcg

SEQ ID NO: 566997 - RNA, 22 nt, Human
ugcauuucccauuguguggcuc

SEQ ID NO: 566998 - RNA, 22 nt, Human
augcaacuacccccaggauuuu

SEQ ID NO: 566999 - RNA, 22 nt, Human
gcagcuuuggagguggaacucu

SEQ ID NO: 567000 - RNA, 22 nt, Human
caacuuuagaccccaaguagcu

SEQ ID NO: 567001 - RNA, 22 nt, Human
cuuguuuucuucugcagucuau

SEQ ID NO: 567002 - RNA, 22 nt, Human
ugcauguuucuguauguuaaug

SEQ ID NO: 567003 - RNA, 19 nt, Human
auucuucucuuccugcugu

SEQ ID NO: 567004 - RNA, 22 nt, Human
uuugacaugugcuuauaacuuu

SEQ ID NO: 567005 - RNA, 16 nt, Human
ucauugaagacaguac

SEQ ID NO: 567006 - RNA, 22 nt, Human
agccuugcaugauuucauucau

SEQ ID NO: 567007 - RNA, 22 nt, Human
acaggcgcacaugagggccgug

SEQ ID NO: 567008 - RNA, 23 nt, Human
uguguucagucaaggaucagagu

SEQ ID NO: 567009 - RNA, 22 nt, Human
cugacagcgagagaguugcccc

SEQ ID NO: 567010 - RNA, 22 nt, Human
ugaauaugugacuuugauuuca

SEQ ID NO: 567011 - RNA, 22 nt, Human
gucauuuuugacuuugaaguga

SEQ ID NO: 567012 - RNA, 22 nt, Human
acauuuguuucucuagaguagg

SEQ ID NO: 567013 - RNA, 20 nt, Human
ucacuguaacauuugggggg

SEQ ID NO: 567014 - RNA, 22 nt, Human
aaaucaugguggaagaaacaga

SEQ ID NO: 567015 - RNA, 20 nt, Human
cugggcagguguuugaucuc

SEQ ID NO: 567016 - RNA, 22 nt, Human
uuugggcuguacaauuucugua

SEQ ID NO: 567017 - RNA, 22 nt, Human
auacacauguuauuguggaagc

SEQ ID NO: 567018 - RNA, 22 nt, Human
aaaugcacugaauauuccaaau

SEQ ID NO: 567019 - RNA, 23 nt, Human
auaugucaugcaccagcacuuua

SEQ ID NO: 567020 - RNA, 22 nt, Human
cccacucccugcacgccugccg

SEQ ID NO: 567021 - RNA, 22 nt, Human
uuuguguuggaagaaaugcuac

SEQ ID NO: 567022 - RNA, 22 nt, Human
uuucacaugguacugccuguuu

SEQ ID NO: 567023 - RNA, 22 nt, Human
cagacucuugagcugauuguau

SEQ ID NO: 567024 - RNA, 22 nt, Human
gacaggugcuaagggaccuggc

SEQ ID NO: 567025 - RNA, 22 nt, Human
aguguauucugcaugggagacu

SEQ ID NO: 567026 - RNA, 22 nt, Human
ccugugguuuacucuguggcua

SEQ ID NO: 567027 - RNA, 22 nt, Human
ggccgugcuccaaagucaucgu

SEQ ID NO: 567028 - RNA, 22 nt, Human
ugacaagagaccccuccgcagg

SEQ ID NO: 567029 - RNA, 22 nt, Human
augaaacucuagcuuucagcac

SEQ ID NO: 567030 - RNA, 17 nt, Human
cauucuguaaucuuucu

SEQ ID NO: 567031 - RNA, 22 nt, Human
gguuauuguggagaaguuccgg

SEQ ID NO: 567032 - RNA, 20 nt, Human
gggugugggcccggccaggc

SEQ ID NO: 567033 - RNA, 22 nt, Human
cuacauuauguuuauugggacu

SEQ ID NO: 567034 - RNA, 22 nt, Human
aagcugccugggaggaagggcu

SEQ ID NO: 567035 - RNA, 22 nt, Human
cugucuacagaugaaauaagca

SEQ ID NO: 567036 - RNA, 22 nt, Human
auuuccuauacaguuguccaua

SEQ ID NO: 567037 - RNA, 22 nt, Human
ccaagcuggacagcagcaagga

SEQ ID NO: 567038 - RNA, 21 nt, Human
auccauccaucuuggccuaac

SEQ ID NO: 567039 - RNA, 22 nt, Human
cugcugucuuuauuucacugcu

SEQ ID NO: 567040 - RNA, 22 nt, Human
caguauuucauucagaauuguu

SEQ ID NO: 567041 - RNA, 22 nt, Human
ggagcugcucagagccaguccc

SEQ ID NO: 567042 - RNA, 22 nt, Human
agggcuccuaugccccauggac

SEQ ID NO: 567043 - RNA, 22 nt, Human
ucguuauagaacauucuugggu

SEQ ID NO: 567044 - RNA, 22 nt, Human
caagucuagcuuggucacuugg

SEQ ID NO: 567045 - RNA, 22 nt, Human
caguuaaacagauugaguguua

SEQ ID NO: 567046 - RNA, 22 nt, Human
ucucugccacagcuucugccuu

SEQ ID NO: 567047 - RNA, 22 nt, Human
guuguacauaugaggauaaguu

SEQ ID NO: 567048 - RNA, 22 nt, Human
accuuguuguagguacaaaaga

SEQ ID NO: 567049 - RNA, 23 nt, Human
aggcagguuugggcucuucuugu

SEQ ID NO: 567050 - RNA, 22 nt, Human
uaaauacuuuuacuccacugau

SEQ ID NO: 567051 - RNA, 22 nt, Human
acaucguguaucacugaaccuu

SEQ ID NO: 567052 - RNA, 22 nt, Human
ucuuauugguaaugauggcauu

SEQ ID NO: 567053 - RNA, 22 nt, Human
ucauggaugauagcuucauugc

SEQ ID NO: 567054 - RNA, 22 nt, Human
ucgucugugaaauugggauaag

SEQ ID NO: 567055 - RNA, 22 nt, Human
guuuacaacaucuuguccuuca

SEQ ID NO: 567056 - RNA, 22 nt, Human
ucugugggcauuuauaaucugg

SEQ ID NO: 567057 - RNA, 22 nt, Human
uccguggggccuguggcuuccg

SEQ ID NO: 567058 - RNA, 22 nt, Human
aaagcagaacugagagagcugg

SEQ ID NO: 567059 - RNA, 22 nt, Human
uuagaaaucaccucugaagauc

SEQ ID NO: 567060 - RNA, 22 nt, Human
aucauuugaacagaauuuguuu

SEQ ID NO: 567061 - RNA, 20 nt, Human
agugauuuguuaguacauug

SEQ ID NO: 567062 - RNA, 22 nt, Human
acuggaaaguauucuuucacug

SEQ ID NO: 567063 - RNA, 22 nt, Human
cgcagcugcugcucugaaacag

SEQ ID NO: 567064 - RNA, 22 nt, Human
aggccacucagggggccaagau

SEQ ID NO: 567065 - RNA, 20 nt, Human
ucauccaguugguuuauggu

SEQ ID NO: 567066 - RNA, 18 nt, Human
cuuuagcugucaucuuug

SEQ ID NO: 567067 - RNA, 22 nt, Human
ugaagccagggacugacacuuc

SEQ ID NO: 567068 - RNA, 22 nt, Human
cuugucugcuauaaaaauccag

SEQ ID NO: 567069 - RNA, 22 nt, Human
gaugaaggggcuggugcccucu

SEQ ID NO: 567070 - RNA, 22 nt, Human
cauuguguauuucuguaguacu

SEQ ID NO: 567071 - RNA, 22 nt, Human
uguacacauuaagcucuuuaga

SEQ ID NO: 567072 - RNA, 22 nt, Human
aaucuguugucaggaauccaca

SEQ ID NO: 567073 - RNA, 22 nt, Human
gggcucggcaucuguggacucu

SEQ ID NO: 567074 - RNA, 22 nt, Human
aaggaucauguauauguuuaag

SEQ ID NO: 567075 - RNA, 22 nt, Human
acaggaaaugaaaugguaucua

SEQ ID NO: 567076 - RNA, 20 nt, Human
gugugaccuccuguggaugc

SEQ ID NO: 567077 - RNA, 22 nt, Human
gucuggaggaggaagaaggcac

SEQ ID NO: 567078 - RNA, 22 nt, Human
gcucugugccccugccguggac

SEQ ID NO: 567079 - RNA, 22 nt, Human
uucuccccgucucucugaggcc

SEQ ID NO: 567080 - RNA, 22 nt, Human
ggagagagaccuccaugcccag

SEQ ID NO: 567081 - RNA, 21 nt, Human
aucuuaaaaggucuuaacuuu

SEQ ID NO: 567082 - RNA, 23 nt, Human
agcaacagugggugaguguugcu

SEQ ID NO: 567083 - RNA, 22 nt, Human
aauagcaaaugcucauuugaaa

SEQ ID NO: 567084 - RNA, 22 nt, Human
acaaguuucauuguuuagaacc

SEQ ID NO: 567085 - RNA, 21 nt, Human
uaagaacauuaucuucuuccu

SEQ ID NO: 567086 - RNA, 22 nt, Human
cagagccacugucugccaggca

SEQ ID NO: 567087 - RNA, 22 nt, Human
agacacuguguacagaaaaaga

SEQ ID NO: 567088 - RNA, 22 nt, Human
uagcuguucucuguaaauugga

SEQ ID NO: 567089 - RNA, 22 nt, Human
caggaacagcaccaggagcuag

SEQ ID NO: 567090 - RNA, 22 nt, Human
uguaauguuagaaacaauugcu

SEQ ID NO: 567091 - RNA, 22 nt, Human
ucugaaauuuuaguuauagaaa

SEQ ID NO: 567092 - RNA, 22 nt, Human
ucauugaggaaagguaguggcu

SEQ ID NO: 567093 - RNA, 22 nt, Human
cagacaggguccuguccgucac

SEQ ID NO: 567094 - RNA, 22 nt, Human
caguauuuaggauuaggagaga

SEQ ID NO: 567095 - RNA, 19 nt, Human
cacuaagaagcaggggagc

SEQ ID NO: 567096 - RNA, 22 nt, Human
uuuacaaggcaguuauuuuccu

SEQ ID NO: 567097 - RNA, 22 nt, Human
uguuuuaagggucaacugucac

SEQ ID NO: 567098 - RNA, 22 nt, Human
acaaucagcacugaguuuaucu

SEQ ID NO: 567099 - RNA, 22 nt, Human
aagugauuucugccugcauguu

SEQ ID NO: 567100 - RNA, 22 nt, Human
cugaacaucccgcagugcacga

SEQ ID NO: 567101 - RNA, 22 nt, Human
uuuguaguuguggaugcugaag

SEQ ID NO: 567102 - RNA, 22 nt, Human
ucucuuaauuguaaugguuccu

SEQ ID NO: 567103 - RNA, 22 nt, Human
gaggcagagacuccaccuucag

SEQ ID NO: 567104 - RNA, 22 nt, Human
caggaacacaaugagucucaaa

SEQ ID NO: 567105 - RNA, 22 nt, Human
guuauucuauuaaugugauugu

SEQ ID NO: 567106 - RNA, 23 nt, Human
cguguccuucagggagagugugg

SEQ ID NO: 567107 - RNA, 22 nt, Human
auuuggcauaggcagaggccca

SEQ ID NO: 567108 - RNA, 22 nt, Human
agcaggaacucagggaguucuc

SEQ ID NO: 567109 - RNA, 22 nt, Human
ucuacugagugcugagauuuug

SEQ ID NO: 567110 - RNA, 22 nt, Human
cucucuccuuagcugcagacca

SEQ ID NO: 567111 - RNA, 22 nt, Human
uuucauuauaaaaaguuggcuu

SEQ ID NO: 567112 - RNA, 20 nt, Human
gaccagaucccuuaccagcu

SEQ ID NO: 567113 - RNA, 22 nt, Human
agagcuauuucuuaaaagcugu

SEQ ID NO: 567114 - RNA, 22 nt, Human
cccaccacgugcuuugcuggag

SEQ ID NO: 567115 - RNA, 22 nt, Human
ucaccuguucaacagcaauaau

SEQ ID NO: 567116 - RNA, 22 nt, Human
ugcuccaggcugcugaagaucu

SEQ ID NO: 567117 - RNA, 22 nt, Human
cucaaaauccauaaaaucaggu

SEQ ID NO: 567118 - RNA, 22 nt, Human
ccagaacagaccugccugaccu

SEQ ID NO: 567119 - RNA, 22 nt, Human
aaauucuguccugaaugccauu

SEQ ID NO: 567120 - RNA, 22 nt, Human
uccuugcagcaggaacccacuu

SEQ ID NO: 567121 - RNA, 22 nt, Human
cgcacuggagcuggaacgaguc

SEQ ID NO: 567122 - RNA, 22 nt, Human
gauugcugggucccacucccag

SEQ ID NO: 567123 - RNA, 22 nt, Human
uccgggagcugaacgucuugcg

SEQ ID NO: 567124 - RNA, 22 nt, Human
uaaacagagaugccugggucug

SEQ ID NO: 567125 - RNA, 22 nt, Human
gaggaggcuuccgggaggcacg

SEQ ID NO: 567126 - RNA, 22 nt, Human
gcgacuguacagaauugccccu

SEQ ID NO: 567127 - RNA, 22 nt, Human
ugucuuaugcugcauagacuau

SEQ ID NO: 567128 - RNA, 22 nt, Human
ggucuuucuuugauaguggaga

SEQ ID NO: 567129 - RNA, 22 nt, Human
guggcaggagggcaucacuugg

SEQ ID NO: 567130 - RNA, 22 nt, Human
ucaguaaaugagcaaaaauuuc

SEQ ID NO: 567131 - RNA, 22 nt, Human
gaagcgcggcgucggcgugggu

SEQ ID NO: 567132 - RNA, 22 nt, Human
ggaaggaucuggcugaaaucca

SEQ ID NO: 567133 - RNA, 19 nt, Human
gaacugaggucugaggcuu

SEQ ID NO: 567134 - RNA, 22 nt, Human
auacuaagcucauuacauuuug

SEQ ID NO: 567135 - RNA, 22 nt, Human
ugcccuguuccugccuccagcu

SEQ ID NO: 567136 - RNA, 20 nt, Human
uuucacaaugaacaugucuc

SEQ ID NO: 567137 - RNA, 22 nt, Human
uuggaggacuaguuaagagacc

SEQ ID NO: 567138 - RNA, 22 nt, Human
agaguguggaaauguucagagu

SEQ ID NO: 567139 - RNA, 22 nt, Human
agccaggucaggaaagguccca

SEQ ID NO: 567140 - RNA, 20 nt, Human
agcuuugguuaagccagugg

SEQ ID NO: 567141 - RNA, 22 nt, Human
ucauuuacacuucacaaaugga

SEQ ID NO: 567142 - RNA, 22 nt, Human
gcauaaaggacuauaaggauca

SEQ ID NO: 567143 - RNA, 22 nt, Human
auugucgucaauggacacauag

SEQ ID NO: 567144 - RNA, 22 nt, Human
aaugcauacguguuuguggcaa

SEQ ID NO: 567145 - RNA, 22 nt, Human
uugcaucagcaggcauaauugg

SEQ ID NO: 567146 - RNA, 22 nt, Human
ugaaagcucugucaucauuccu

SEQ ID NO: 567147 - RNA, 22 nt, Human
ucauugacuugaagaaaacaau

SEQ ID NO: 567148 - RNA, 22 nt, Human
cuggaucaugggaaagggauca

SEQ ID NO: 567149 - RNA, 22 nt, Human
acuuuuaaggggccuugauuua

SEQ ID NO: 567150 - RNA, 22 nt, Human
gucuugcacuuaccuaagaacu

SEQ ID NO: 567151 - RNA, 22 nt, Human
cagcuauuguucuguauaauga

SEQ ID NO: 567152 - RNA, 22 nt, Human
augcauugaggaugacaugagu

SEQ ID NO: 567153 - RNA, 22 nt, Human
uggaaacacccacgcaugcaua

SEQ ID NO: 567154 - RNA, 22 nt, Human
cuacagaauucaacaaaugguu

SEQ ID NO: 567155 - RNA, 22 nt, Human
cccuguccugcuaggcccuggu

SEQ ID NO: 567156 - RNA, 22 nt, Human
gagugugucggucagcguggcg

SEQ ID NO: 567157 - RNA, 22 nt, Human
aauaucuagccuuuagcagcuu

SEQ ID NO: 567158 - RNA, 22 nt, Human
gacggggcagccagcugguggc

SEQ ID NO: 567159 - RNA, 22 nt, Human
cacaguuuuaucuuauacugau

SEQ ID NO: 567160 - RNA, 22 nt, Human
acucauguccuaggaguaaagc

SEQ ID NO: 567161 - RNA, 23 nt, Human
cagcugguugugggaguggcugc

SEQ ID NO: 567162 - RNA, 22 nt, Human
ccaggagagcucucguucagug

SEQ ID NO: 567163 - RNA, 16 nt, Human
gcagguggggcgcgca

SEQ ID NO: 567164 - RNA, 22 nt, Human
agguuaggaaugggagguaaug

SEQ ID NO: 567165 - RNA, 22 nt, Human
gcaguuaccuauuuuguagaaa

SEQ ID NO: 567166 - RNA, 22 nt, Human
gguuguaguuggagguuguaua

SEQ ID NO: 567167 - RNA, 22 nt, Human
ugaagacaguuuuacucaugag

SEQ ID NO: 567168 - RNA, 21 nt, Human
uuuguucaggggcaaaguuaa

SEQ ID NO: 567169 - RNA, 22 nt, Human
gcuguaacuuuuucauuuucaa

SEQ ID NO: 567170 - RNA, 22 nt, Human
uacauguacaugcauagguaga

SEQ ID NO: 567171 - RNA, 22 nt, Human
acucuguuugcagguagcucag

SEQ ID NO: 567172 - RNA, 21 nt, Human
uuccuggaggcagaaacguga

SEQ ID NO: 567173 - RNA, 22 nt, Human
ucuguaaacacccguaagcuuu

SEQ ID NO: 567174 - RNA, 22 nt, Human
uuagacaucaagaagccaaugu

SEQ ID NO: 567175 - RNA, 22 nt, Human
guugguccuuugagcaagaucc

SEQ ID NO: 567176 - RNA, 22 nt, Human
uucuguuuauaauuugcaguug

SEQ ID NO: 567177 - RNA, 22 nt, Human
augugaaagagguguucagugg

SEQ ID NO: 567178 - RNA, 22 nt, Human
uguacauacauagauauacaca

SEQ ID NO: 567179 - RNA, 22 nt, Human
ucuuugcagaauuuaacuuugc

SEQ ID NO: 567180 - RNA, 22 nt, Human
gcugugcagaggugagaaucca

SEQ ID NO: 567181 - RNA, 22 nt, Human
acaggaucgcccuguugcccag

SEQ ID NO: 567182 - RNA, 22 nt, Human
aagcauuuuagauaaagcauca

SEQ ID NO: 567183 - RNA, 22 nt, Human
aauugguuugaauaaauaaaga

SEQ ID NO: 567184 - RNA, 22 nt, Human
cacaauuuccauugagcagcag

SEQ ID NO: 567185 - RNA, 22 nt, Human
accaaucuccuauuuuguuuca

SEQ ID NO: 567186 - RNA, 22 nt, Human
cacuuuuaacaggagaauuccc

SEQ ID NO: 567187 - RNA, 22 nt, Human
gagucacuucccgaauaaaccc

SEQ ID NO: 567188 - RNA, 22 nt, Human
aguuuccacuggagacacugug

SEQ ID NO: 567189 - RNA, 22 nt, Human
gagucgagcagaaagccgucgg

SEQ ID NO: 567190 - RNA, 22 nt, Human
uggaaagaggaagugcccagca

SEQ ID NO: 567191 - RNA, 22 nt, Human
acucauuugcaugaugugcuau

SEQ ID NO: 567192 - RNA, 22 nt, Human
aagaaaagguaaccgcuuaucu

SEQ ID NO: 567193 - RNA, 22 nt, Human
uauagcagcaugauuuauaguc

SEQ ID NO: 567194 - RNA, 22 nt, Human
aggaagagcuggaccagaggac

SEQ ID NO: 567195 - RNA, 22 nt, Human
aguucugacucugaaucuggga

SEQ ID NO: 567196 - RNA, 18 nt, Human
uauaaacacacuuagguu

SEQ ID NO: 567197 - RNA, 22 nt, Human
agcagggagaccaucucuuccu

SEQ ID NO: 567198 - RNA, 22 nt, Human
ucguuagccucgagaucuuugu

SEQ ID NO: 567199 - RNA, 22 nt, Human
ucuggcuucaacuuuacugaaa

SEQ ID NO: 567200 - RNA, 22 nt, Human
gggaggaaggcuugggugagua

SEQ ID NO: 567201 - RNA, 22 nt, Human
aucaugcagcaacaagcaaggc

SEQ ID NO: 567202 - RNA, 16 nt, Human
ucucuggguugcacag

SEQ ID NO: 567203 - RNA, 22 nt, Human
cuucauuuggcaggcuggccuc

SEQ ID NO: 567204 - RNA, 22 nt, Human
gagcagcuguucugacuugucu

SEQ ID NO: 567205 - RNA, 23 nt, Human
aauagcugguaaugauagcacaa

SEQ ID NO: 567206 - RNA, 22 nt, Human
auuuacucgugcuucauugaau

SEQ ID NO: 567207 - RNA, 22 nt, Human
auuucauccauuaagaguacuc

SEQ ID NO: 567208 - RNA, 22 nt, Human
uaguauuuccuguaagcuauag

SEQ ID NO: 567209 - RNA, 22 nt, Human
guggaaauuuuaggaucaucuu

SEQ ID NO: 567210 - RNA, 22 nt, Human
cugcagaugguauuguucuggu

SEQ ID NO: 567211 - RNA, 22 nt, Human
ccuaugaaagacaggagaugcg

SEQ ID NO: 567212 - RNA, 22 nt, Human
uggguaggaccagaaaugcacu

SEQ ID NO: 567213 - RNA, 22 nt, Human
ucuugggcaauuucucuagagg

SEQ ID NO: 567214 - RNA, 22 nt, Human
ucuccacaccagaaggagcuga

SEQ ID NO: 567215 - RNA, 22 nt, Human
auuuacugagguaaauaaacug

SEQ ID NO: 567216 - RNA, 21 nt, Human
uaaagcucguucaggaaaguc

SEQ ID NO: 567217 - RNA, 22 nt, Human
guucuucagcccucagguccua

SEQ ID NO: 567218 - RNA, 22 nt, Human
gagguuggagggcuggccugca

SEQ ID NO: 567219 - RNA, 22 nt, Human
uucacagcuaagagcuaaguaa

SEQ ID NO: 567220 - RNA, 22 nt, Human
uggcacguuggauugggaguuc

SEQ ID NO: 567221 - RNA, 22 nt, Human
uacaggcucuugucagacguau

SEQ ID NO: 567222 - RNA, 22 nt, Human
ugauaguaucugauuauuucac

SEQ ID NO: 567223 - RNA, 22 nt, Human
agcuuugggcagaagaggauuc

SEQ ID NO: 567224 - RNA, 22 nt, Human
ccucugcccuuuuccuguauca

SEQ ID NO: 567225 - RNA, 22 nt, Human
cccaggucgucagcaguguggu

SEQ ID NO: 567226 - RNA, 22 nt, Human
ggcuggaacuucuucuggcauu

SEQ ID NO: 567227 - RNA, 22 nt, Human
uugaggucuggcaguagcguug

SEQ ID NO: 567228 - RNA, 22 nt, Human
cacauuuaaagguugaagcuga

SEQ ID NO: 567229 - RNA, 22 nt, Human
cuggagaggcugggaacagguu

SEQ ID NO: 567230 - RNA, 22 nt, Human
uccugccaccggggguggcgau

SEQ ID NO: 567231 - RNA, 22 nt, Human
cauagacauugauagguuauau

SEQ ID NO: 567232 - RNA, 22 nt, Human
auuuuguaucuuacggggacua

SEQ ID NO: 567233 - RNA, 22 nt, Human
acagaauugggguucuugggga

SEQ ID NO: 567234 - RNA, 22 nt, Human
ucuggauggucagcucuuccug

SEQ ID NO: 567235 - RNA, 22 nt, Human
ugacucacuuaauuuacaaguc

SEQ ID NO: 567236 - RNA, 22 nt, Human
ccagucagccaagcugcagcgg

SEQ ID NO: 567237 - RNA, 22 nt, Human
guuuccagccuccuggguaaag

SEQ ID NO: 567238 - RNA, 22 nt, Human
gaauacaaauaauaccaaggug

SEQ ID NO: 567239 - RNA, 22 nt, Human
cagcuccaucuugcuuauacca

SEQ ID NO: 567240 - RNA, 22 nt, Human
cucaggaaaauauugaagaagu

SEQ ID NO: 567241 - RNA, 22 nt, Human
gaaacuguauguaguuuuuggg

SEQ ID NO: 567242 - RNA, 22 nt, Human
ggaagaggcugaggccaugcug

SEQ ID NO: 567243 - RNA, 22 nt, Human
gucacucaggcuggaguucagu

SEQ ID NO: 567244 - RNA, 22 nt, Human
ucugaauucuuagaauuaaagg

SEQ ID NO: 567245 - RNA, 22 nt, Human
auuccaaagccugaauaaugga

SEQ ID NO: 567246 - RNA, 22 nt, Human
acaugcauaaacuacuucuuau

SEQ ID NO: 567247 - RNA, 22 nt, Human
auuuacagccuugccaucuaua

SEQ ID NO: 567248 - RNA, 22 nt, Human
gguguuguacauucuguggauu

SEQ ID NO: 567249 - RNA, 22 nt, Human
gguuccaggcauggcaggaugu

SEQ ID NO: 567250 - RNA, 20 nt, Human
cugcuccacccggcucucag

SEQ ID NO: 567251 - RNA, 22 nt, Human
caggaggaaaguuccacucaac

SEQ ID NO: 567252 - RNA, 22 nt, Human
gucugcccugcagacaugccuc

SEQ ID NO: 567253 - RNA, 22 nt, Human
auuaaugaaacuuugguuaagc

SEQ ID NO: 567254 - RNA, 22 nt, Human
gaggagaggcuggacgcgguga

SEQ ID NO: 567255 - RNA, 22 nt, Human
cccugcacagccuggcucucuu

SEQ ID NO: 567256 - RNA, 20 nt, Human
aauagcacagcucaaacauu

SEQ ID NO: 567257 - RNA, 22 nt, Human
auggaguucugccagcgcugcu

SEQ ID NO: 567258 - RNA, 22 nt, Human
uuuauucucuaguuggucagau

SEQ ID NO: 567259 - RNA, 22 nt, Human
acuucacagauauuuauuuggu

SEQ ID NO: 567260 - RNA, 22 nt, Human
uccugaaaauaauuucacaaga

SEQ ID NO: 567261 - RNA, 22 nt, Human
uuccugguaacaaucucaaagu

SEQ ID NO: 567262 - RNA, 22 nt, Human
aggcaguggcuuuuguuguguu

SEQ ID NO: 567263 - RNA, 22 nt, Human
ggcacagcugaugcagacacac

SEQ ID NO: 567264 - RNA, 22 nt, Human
ucaccucucuggccgucuaccu

SEQ ID NO: 567265 - RNA, 21 nt, Human
aauuucagacccauuuugccu

SEQ ID NO: 567266 - RNA, 22 nt, Human
cgggcuccgggucuuugcaguc

SEQ ID NO: 567267 - RNA, 22 nt, Human
uaccuugugagcuuucuaacau

SEQ ID NO: 567268 - RNA, 22 nt, Human
uccugugccuccaccugcuccg

SEQ ID NO: 567269 - RNA, 22 nt, Human
augcaggaagagcccuggagcu

SEQ ID NO: 567270 - RNA, 22 nt, Human
guuauguaaucuaacacucagu

SEQ ID NO: 567271 - RNA, 22 nt, Human
cggagcagagccacucgggccg

SEQ ID NO: 567272 - RNA, 20 nt, Human
ucugccacuuuuucugucac

SEQ ID NO: 567273 - RNA, 17 nt, Human
ucugagaaugcuggagg

SEQ ID NO: 567274 - RNA, 22 nt, Human
cucucuuuuucgugugccgaag

SEQ ID NO: 567275 - RNA, 22 nt, Human
uuauggcauucauuggggcuuu

SEQ ID NO: 567276 - RNA, 22 nt, Human
uucacauaaucugcagcaagcg

SEQ ID NO: 567277 - RNA, 22 nt, Human
gcggggggcaggcaguacguug

SEQ ID NO: 567278 - RNA, 22 nt, Human
gggcuccagaggcucacccugg

SEQ ID NO: 567279 - RNA, 22 nt, Human
auauaugaagaagucuugauua

SEQ ID NO: 567280 - RNA, 22 nt, Human
caguuuuaugaaugcuuauuag

SEQ ID NO: 567281 - RNA, 22 nt, Human
uuccccuugcacuaucacccug

SEQ ID NO: 567282 - RNA, 22 nt, Human
auguacaaucuaucacaagaag

SEQ ID NO: 567283 - RNA, 22 nt, Human
guuucuccucugugucuuguuu

SEQ ID NO: 567284 - RNA, 22 nt, Human
agcugccgaugcccagcugcau

SEQ ID NO: 567285 - RNA, 22 nt, Human
uucacguuguugaagaaaauac

SEQ ID NO: 567286 - RNA, 23 nt, Human
aaacuacauuuauaguuuuucuc

SEQ ID NO: 567287 - RNA, 22 nt, Human
gagggaaacagauggguugugg

SEQ ID NO: 567288 - RNA, 22 nt, Human
agcuggguguagggcuggacaa

SEQ ID NO: 567289 - RNA, 22 nt, Human
ccucuucuaggacguccuugug

SEQ ID NO: 567290 - RNA, 22 nt, Human
uucacagaauugucuugacugg

SEQ ID NO: 567291 - RNA, 22 nt, Human
ucccagccugacagugcaucaa

SEQ ID NO: 567292 - RNA, 22 nt, Human
gcccucugccacaggacgccag

SEQ ID NO: 567293 - RNA, 22 nt, Human
aaggcuauaucucaauacuauu

SEQ ID NO: 567294 - RNA, 22 nt, Human
agcaggugucacuuucacucca

SEQ ID NO: 567295 - RNA, 22 nt, Human
ggcagaggaagcuggaaguggg

SEQ ID NO: 567296 - RNA, 22 nt, Human
agauaaaguccaaacuguguag

SEQ ID NO: 567297 - RNA, 22 nt, Human
acaugacagugacuuuauaaga

SEQ ID NO: 567298 - RNA, 22 nt, Human
agucagcuugucucuaggguug

SEQ ID NO: 567299 - RNA, 22 nt, Human
cagcagcucaggcuccuuccca

SEQ ID NO: 567300 - RNA, 22 nt, Human
uucagauaagucaaguuaguau

SEQ ID NO: 567301 - RNA, 22 nt, Human
acggccgaugacuccagcaugg

SEQ ID NO: 567302 - RNA, 22 nt, Human
uaucuagagccuggaagucuug

SEQ ID NO: 567303 - RNA, 22 nt, Human
ucaauucugccucuaaauauuu

SEQ ID NO: 567304 - RNA, 22 nt, Human
aggaauuugggguuacaugaug

SEQ ID NO: 567305 - RNA, 22 nt, Human
aacagaaaucauuuagggcucu

SEQ ID NO: 567306 - RNA, 22 nt, Human
cucagcuucuaccuccugagug

SEQ ID NO: 567307 - RNA, 22 nt, Human
ccugucucugcagggcccugcc

SEQ ID NO: 567308 - RNA, 22 nt, Human
uccgguccggguacuccucucu

SEQ ID NO: 567309 - RNA, 22 nt, Human
uuuacuuuugguaaggucauuu

SEQ ID NO: 567310 - RNA, 22 nt, Human
gcccagcgagcagagguggacg

SEQ ID NO: 567311 - RNA, 22 nt, Human
gucaggggccaugggccaagga

SEQ ID NO: 567312 - RNA, 22 nt, Human
ucuuauaccccuaaacugcagc

SEQ ID NO: 567313 - RNA, 22 nt, Human
agauugucauugacgaugagca

SEQ ID NO: 567314 - RNA, 18 nt, Human
ccucuggguuuuguuccc

SEQ ID NO: 567315 - RNA, 22 nt, Human
cacaguuuugucuugguuucca

SEQ ID NO: 567316 - RNA, 22 nt, Human
gugauuucagguuuuucauacu

SEQ ID NO: 567317 - RNA, 22 nt, Human
uucuaguuacagaagccuugcu

SEQ ID NO: 567318 - RNA, 22 nt, Human
ucugagagcuguagaagccuau

SEQ ID NO: 567319 - RNA, 20 nt, Human
ccacaguggagacuggagac

SEQ ID NO: 567320 - RNA, 22 nt, Human
auucuugauauagauaguuaau

SEQ ID NO: 567321 - RNA, 22 nt, Human
ggaaacauuccaagaguugaaa

SEQ ID NO: 567322 - RNA, 22 nt, Human
uagaucuuucacuacuguguag

SEQ ID NO: 567323 - RNA, 22 nt, Human
uuuccuguccugguacuuggca

SEQ ID NO: 567324 - RNA, 22 nt, Human
gaaggaagcugucuggaugugu

SEQ ID NO: 567325 - RNA, 22 nt, Human
aacagguagggacucuaacuug

SEQ ID NO: 567326 - RNA, 22 nt, Human
cauuguccucugaugccuuccc

SEQ ID NO: 567327 - RNA, 22 nt, Human
cggcagcgguuggagguuguag

SEQ ID NO: 567328 - RNA, 22 nt, Human
ggcuagggaucuagaccaggac

SEQ ID NO: 567329 - RNA, 20 nt, Human
gcucagggccugggucugga

SEQ ID NO: 567330 - RNA, 22 nt, Human
uggaaauacaagaaguauguca

SEQ ID NO: 567331 - RNA, 22 nt, Human
uaacuucucugagccucauucc

SEQ ID NO: 567332 - RNA, 22 nt, Human
aacuuucuuugcaucuaaguuu

SEQ ID NO: 567333 - RNA, 22 nt, Human
uuuaaaccuaucuaagaaauag

SEQ ID NO: 567334 - RNA, 22 nt, Human
gcacagucaacacuuauucacc

SEQ ID NO: 567335 - RNA, 22 nt, Human
acaccuuuuauucgccaggcac

SEQ ID NO: 567336 - RNA, 22 nt, Human
gucgaucaccucguccuccgug

SEQ ID NO: 567337 - RNA, 22 nt, Human
cuugggcaggggaaacagcugc

SEQ ID NO: 567338 - RNA, 22 nt, Human
aucauuaacccuugaugcuggg

SEQ ID NO: 567339 - RNA, 21 nt, Human
aaacugaccuugccugagaca

SEQ ID NO: 567340 - RNA, 22 nt, Human
aguaaaaucaccaucucuuugu

SEQ ID NO: 567341 - RNA, 22 nt, Human
ugaaguuguuaagguugccauu

SEQ ID NO: 567342 - RNA, 22 nt, Human
uagcuucccugcuggaucauaa

SEQ ID NO: 567343 - RNA, 22 nt, Human
gauauucauaggcagguauuua

SEQ ID NO: 567344 - RNA, 22 nt, Human
uaacacauagauauuuuaacuu

SEQ ID NO: 567345 - RNA, 22 nt, Human
uugccaggagacaucuggagcc

SEQ ID NO: 567346 - RNA, 16 nt, Human
aggagcuggguaggag

SEQ ID NO: 567347 - RNA, 22 nt, Human
uccuucccaggugucgccgccu

SEQ ID NO: 567348 - RNA, 22 nt, Human
ugcacauggccugagugccuga

SEQ ID NO: 567349 - RNA, 22 nt, Human
uguguuuuggaaggaacaugca

SEQ ID NO: 567350 - RNA, 22 nt, Human
gcauuuaaauuugaacuucaga

SEQ ID NO: 567351 - RNA, 22 nt, Human
uuuccacacucacugcacucau

SEQ ID NO: 567352 - RNA, 22 nt, Human
gauccacagcugcgguaggaga

SEQ ID NO: 567353 - RNA, 22 nt, Human
cgcagcuucagggccaggaggg

SEQ ID NO: 567354 - RNA, 22 nt, Human
accaguuaaagaauaugaggcc

SEQ ID NO: 567355 - RNA, 22 nt, Human
uaucuuugguagcuuuccuaag

SEQ ID NO: 567356 - RNA, 21 nt, Human
uuggccgugcagaugaacagc

SEQ ID NO: 567357 - RNA, 22 nt, Human
uuuugguaauuaaguagauauu

SEQ ID NO: 567358 - RNA, 22 nt, Human
gcggcgccugggacccgccagc

SEQ ID NO: 567359 - RNA, 22 nt, Human
uugcaguugcuguauuuaagga

SEQ ID NO: 567360 - RNA, 19 nt, Human
aaauccaagcucaggccuc

SEQ ID NO: 567361 - RNA, 22 nt, Human
aaugaaacuauauuuagagagg

SEQ ID NO: 567362 - RNA, 22 nt, Human
aagucuucagacuggagagauu

SEQ ID NO: 567363 - RNA, 22 nt, Human
gauuccugcuauucacagggcu

SEQ ID NO: 567364 - RNA, 22 nt, Human
auguauacgugcaggucacagg

SEQ ID NO: 567365 - RNA, 22 nt, Human
uuuuuugucuugaagaaauggu

SEQ ID NO: 567366 - RNA, 22 nt, Human
gugcuuccuguauugauuccau

SEQ ID NO: 567367 - RNA, 22 nt, Human
uugccaggggacaucuggagcc

SEQ ID NO: 567368 - RNA, 22 nt, Human
auucccuuugacgaucccuagg

SEQ ID NO: 567369 - RNA, 22 nt, Human
gagccaagauugugucccugca

SEQ ID NO: 567370 - RNA, 22 nt, Human
auuguuacuggguuaauuugga

SEQ ID NO: 567371 - RNA, 22 nt, Human
gcucugugcaguucagggacac

SEQ ID NO: 567372 - RNA, 22 nt, Human
ggcuuuggggguguccaagaaa

SEQ ID NO: 567373 - RNA, 22 nt, Human
ccuguggccgcgucgggcggcg

SEQ ID NO: 567374 - RNA, 22 nt, Human
ccugugcaugccaggguacacc

SEQ ID NO: 567375 - RNA, 22 nt, Human
acagugauuggcacugauucag

SEQ ID NO: 567376 - RNA, 22 nt, Human
auucagaaauagaaaauuugau

SEQ ID NO: 567377 - RNA, 22 nt, Human
cuccguggcuguggacgcagcc

SEQ ID NO: 567378 - RNA, 22 nt, Human
agagugaaguaauuguuaggau

SEQ ID NO: 567379 - RNA, 22 nt, Human
cagagccaaaccucagggcccg

SEQ ID NO: 567380 - RNA, 22 nt, Human
aaggcacauauuuuagagucac

SEQ ID NO: 567381 - RNA, 22 nt, Human
gucuguggaguugcuugcugga

SEQ ID NO: 567382 - RNA, 22 nt, Human
gagcuuuucccgucuuucucgu

SEQ ID NO: 567383 - RNA, 23 nt, Human
gggaaaucaaaagauauuucuuc

SEQ ID NO: 567384 - RNA, 22 nt, Human
ugcucuguucaguguaucuugu

SEQ ID NO: 567385 - RNA, 22 nt, Human
gagccugagcaaugugauguuu

SEQ ID NO: 567386 - RNA, 22 nt, Human
cacagcuaccugcaugccugcu

SEQ ID NO: 567387 - RNA, 22 nt, Human
ggacagacuuuacagccccggg

SEQ ID NO: 567388 - RNA, 22 nt, Human
guuuuguucaugaacauugggu

SEQ ID NO: 567389 - RNA, 19 nt, Human
gggucccacugcccgucug

SEQ ID NO: 567390 - RNA, 22 nt, Human
ugggcagggagcuggaaccaca

SEQ ID NO: 567391 - RNA, 17 nt, Human
agcuuggagcagcauga

SEQ ID NO: 567392 - RNA, 22 nt, Human
uucucuucacagggaucauccu

SEQ ID NO: 567393 - RNA, 22 nt, Human
aggcuuaacuacaauuuuugcc

SEQ ID NO: 567394 - RNA, 22 nt, Human
caggcucgguccaguggcaccc

SEQ ID NO: 567395 - RNA, 22 nt, Human
uccucuucaaaauagcucugaa

SEQ ID NO: 567396 - RNA, 22 nt, Human
gcugcuccgcagagugugugug

SEQ ID NO: 567397 - RNA, 22 nt, Human
gagcugcagcggcugacgcaac

SEQ ID NO: 567398 - RNA, 22 nt, Human
aauuagaagcuguuagcaaaau

SEQ ID NO: 567399 - RNA, 22 nt, Human
uguuugcucugacuaucuugcg

SEQ ID NO: 567400 - RNA, 22 nt, Human
auguuguugaacucuuugcaug

SEQ ID NO: 567401 - RNA, 18 nt, Human
ucugaaggaaugauucca

SEQ ID NO: 567402 - RNA, 22 nt, Human
uugucgggcuuacgcagggcca

SEQ ID NO: 567403 - RNA, 22 nt, Human
cgaggaggaaacgcggagaacu

SEQ ID NO: 567404 - RNA, 22 nt, Human
aguacuuuuuguucaauugugc

SEQ ID NO: 567405 - RNA, 22 nt, Human
acguagcacugagagaugcagg

SEQ ID NO: 567406 - RNA, 22 nt, Human
ggugcggagacuccaugaggcc

SEQ ID NO: 567407 - RNA, 22 nt, Human
acuaauugaaaugagacuggug

SEQ ID NO: 567408 - RNA, 22 nt, Human
caguuuuucaaaauuacaugau

SEQ ID NO: 567409 - RNA, 22 nt, Human
uuuggcaagcgaguacuuucug

SEQ ID NO: 567410 - RNA, 22 nt, Human
caguuuuacccaagcuuauuuu

SEQ ID NO: 567411 - RNA, 22 nt, Human
gugggugucaguaucuuuaacg

SEQ ID NO: 567412 - RNA, 22 nt, Human
gggacuggaguagaggccggug

SEQ ID NO: 567413 - RNA, 22 nt, Human
caaacuuacuguguuuaaagag

SEQ ID NO: 567414 - RNA, 22 nt, Human
ucaccggcagacguggccugau

SEQ ID NO: 567415 - RNA, 22 nt, Human
cugccuuggcccuaguucaugg

SEQ ID NO: 567416 - RNA, 22 nt, Human
caggccacagcuaaagaggauu

SEQ ID NO: 567417 - RNA, 22 nt, Human
aucucuguaaaccauaaauuga

SEQ ID NO: 567418 - RNA, 22 nt, Human
agcuggguacacguugucacaa

SEQ ID NO: 567419 - RNA, 22 nt, Human
cugucaccucugcccuuugccc

SEQ ID NO: 567420 - RNA, 22 nt, Human
gaguuucuucauggugcagagg

SEQ ID NO: 567421 - RNA, 22 nt, Human
acagagacacggaagcuaaaga

SEQ ID NO: 567422 - RNA, 22 nt, Human
uaaaccuuauuugaauaccaac

SEQ ID NO: 567423 - RNA, 22 nt, Human
uugacuauacucuggcggaaaa

SEQ ID NO: 567424 - RNA, 22 nt, Human
ccaggacaagccagagggacag

SEQ ID NO: 567425 - RNA, 22 nt, Human
uggauguuugaaguugcaugug

SEQ ID NO: 567426 - RNA, 22 nt, Human
uuuuccuuaacagagggagaaa

SEQ ID NO: 567427 - RNA, 22 nt, Human
aacagauuguaaccugauagcc

SEQ ID NO: 567428 - RNA, 20 nt, Human
aaaaacaguaaugcugaaga

SEQ ID NO: 567429 - RNA, 22 nt, Human
cugagggagcugcuggccuugg

SEQ ID NO: 567430 - RNA, 22 nt, Human
cugcauaucaaauuacuccugg

SEQ ID NO: 567431 - RNA, 22 nt, Human
uuggaaaugcauuuguuauuau

SEQ ID NO: 567432 - RNA, 22 nt, Human
acugauuucagggaugagaaga

SEQ ID NO: 567433 - RNA, 22 nt, Human
cuuccucuguggccagagugua

SEQ ID NO: 567434 - RNA, 22 nt, Human
uacaucucaucugugcucuccg

SEQ ID NO: 567435 - RNA, 22 nt, Human
gaauguuaaugcacuucuagcu

SEQ ID NO: 567436 - RNA, 22 nt, Human
gaaacacucaauuuaguaauuc

SEQ ID NO: 567437 - RNA, 22 nt, Human
cuauuuucccauaugguugaca

SEQ ID NO: 567438 - RNA, 22 nt, Human
uuuucuaacaucuaguaauuug

SEQ ID NO: 567439 - RNA, 22 nt, Human
agaaaagaggcuuucuaagcau

SEQ ID NO: 567440 - RNA, 22 nt, Human
agaacagaggccuuauguuuca

SEQ ID NO: 567441 - RNA, 19 nt, Human
uuacaugacauaugaagga

SEQ ID NO: 567442 - RNA, 22 nt, Human
ucugaggcugaauggacuccgu

SEQ ID NO: 567443 - RNA, 17 nt, Human
auucaugaacauguccu

SEQ ID NO: 567444 - RNA, 22 nt, Human
uguguccuucugggagucccag

SEQ ID NO: 567445 - RNA, 22 nt, Human
gauguauagcuuuaacugaccc

SEQ ID NO: 567446 - RNA, 22 nt, Human
gagcaaggaugggucuauagua

SEQ ID NO: 567447 - RNA, 22 nt, Human
ucauuacuuauuaaaagccuug

SEQ ID NO: 567448 - RNA, 22 nt, Human
gccugugcuuaacugacgugag

SEQ ID NO: 567449 - RNA, 22 nt, Human
uaaaguauaagcauuggaguau

SEQ ID NO: 567450 - RNA, 23 nt, Human
uuguucuuggaucuuccugaagc

SEQ ID NO: 567451 - RNA, 19 nt, Human
uccugcccaccagccaggg

SEQ ID NO: 567452 - RNA, 22 nt, Human
uggaaaauauuuaggugaauga

SEQ ID NO: 567453 - RNA, 22 nt, Human
uggcaggaaaaagggccagagg

SEQ ID NO: 567454 - RNA, 20 nt, Human
ucugugugccaucaccuaac

SEQ ID NO: 567455 - RNA, 22 nt, Human
uucaguuuugcuuuuaaucaug

SEQ ID NO: 567456 - RNA, 22 nt, Human
ucuguuauaaaucacacugcau

SEQ ID NO: 567457 - RNA, 22 nt, Human
agcaguuuauccucauaaugga

SEQ ID NO: 567458 - RNA, 22 nt, Human
uaacaaaguauuguuuguguau

SEQ ID NO: 567459 - RNA, 22 nt, Human
aaucgguugaacccaggaagug

SEQ ID NO: 567460 - RNA, 22 nt, Human
uaagaaacauuuuuaugacagu

SEQ ID NO: 567461 - RNA, 22 nt, Human
ugcacgugugagcauucacaug

SEQ ID NO: 567462 - RNA, 23 nt, Human
auaauaacgucugucuugucucu

SEQ ID NO: 567463 - RNA, 22 nt, Human
uucugauugcugaugaggccca

SEQ ID NO: 567464 - RNA, 22 nt, Human
auguaugagagauucuuuuauu

SEQ ID NO: 567465 - RNA, 22 nt, Human
uuugcagagugcagaagcaucu

SEQ ID NO: 567466 - RNA, 22 nt, Human
agaauaagccugacgaaaccua

SEQ ID NO: 567467 - RNA, 22 nt, Human
uuugugcaagagggccaccuua

SEQ ID NO: 567468 - RNA, 22 nt, Human
guaugucuuaggguucaguaac

SEQ ID NO: 567469 - RNA, 22 nt, Human
uucagucuuguugaaaacuugg

SEQ ID NO: 567470 - RNA, 22 nt, Human
ucuaauuuuggcauuuuaaccu

SEQ ID NO: 567471 - RNA, 22 nt, Human
cggcagagcccugagucagccu

SEQ ID NO: 567472 - RNA, 20 nt, Human
ucucuggcaagaagcugcag

SEQ ID NO: 567473 - RNA, 22 nt, Human
ucuaaagcuccuuccacuaaaa

SEQ ID NO: 567474 - RNA, 22 nt, Human
aucauccauggcugaucauaaa

SEQ ID NO: 567475 - RNA, 22 nt, Human
ugagcaccaggcaccacagcuc

SEQ ID NO: 567476 - RNA, 19 nt, Human
uuugauagggcauaauaua

SEQ ID NO: 567477 - RNA, 22 nt, Human
gcgacgcaggcacgacguguug

SEQ ID NO: 567478 - RNA, 18 nt, Human
aaacauggcuuaaaggcu

SEQ ID NO: 567479 - RNA, 22 nt, Human
uugucaggaacuaugauuaugc

SEQ ID NO: 567480 - RNA, 22 nt, Human
cuccaaaggauaaaagcagagu

SEQ ID NO: 567481 - RNA, 22 nt, Human
agaaaucugacugcugugcaca

SEQ ID NO: 567482 - RNA, 22 nt, Human
cuguauaugugcauacacacac

SEQ ID NO: 567483 - RNA, 22 nt, Human
uuauuuaaaagugguaagauuc

SEQ ID NO: 567484 - RNA, 22 nt, Human
agggugugcuguugggucuuuc

SEQ ID NO: 567485 - RNA, 22 nt, Human
aauugcuuuacaagccguuuaa

SEQ ID NO: 567486 - RNA, 22 nt, Human
cuccaggacaugacuuucuugc

SEQ ID NO: 567487 - RNA, 22 nt, Human
aaagccauaucuauucuauucu

SEQ ID NO: 567488 - RNA, 22 nt, Human
gugcauauguguguauacaaac

SEQ ID NO: 567489 - RNA, 22 nt, Human
acagccaggaauucuggagaag

SEQ ID NO: 567490 - RNA, 19 nt, Human
cuucuggauccgcagggcc

SEQ ID NO: 567491 - RNA, 20 nt, Human
uguauuuaaugaaggcuuuu

SEQ ID NO: 567492 - RNA, 22 nt, Human
ggcagaggagcuggaaacaugg

SEQ ID NO: 567493 - RNA, 22 nt, Human
gacauuuauuggauuuuacgag

SEQ ID NO: 567494 - RNA, 22 nt, Human
aggacagcagugcuggcacuug

SEQ ID NO: 567495 - RNA, 22 nt, Human
aacagaaugcaggggaugcugc

SEQ ID NO: 567496 - RNA, 22 nt, Human
uuuaauuauaucugggcaguua

SEQ ID NO: 567497 - RNA, 21 nt, Human
gccaucaccaagcucuucccc

SEQ ID NO: 567498 - RNA, 22 nt, Human
ucuugccgcgcaggcgcaguuc

SEQ ID NO: 567499 - RNA, 22 nt, Human
uaaaguuggaccugauuuuauu

SEQ ID NO: 567500 - RNA, 22 nt, Human
cucgccccggcacaguguccgu

SEQ ID NO: 567501 - RNA, 22 nt, Human
acauuucuccuacuuguuauuu

SEQ ID NO: 567502 - RNA, 22 nt, Human
acagauccugguuacagccauu

SEQ ID NO: 567503 - RNA, 22 nt, Human
gaacugcauugugguauauguu

SEQ ID NO: 567504 - RNA, 21 nt, Human
ugcuggguuugcccaucaggc

SEQ ID NO: 567505 - RNA, 22 nt, Human
acugcacuccagcccgagcaac

SEQ ID NO: 567506 - RNA, 22 nt, Human
cgggaagguggagguugcagug

SEQ ID NO: 567507 - RNA, 22 nt, Human
gucaaaacaaaguuaagaauuc

SEQ ID NO: 567508 - RNA, 22 nt, Human
ggaaugugcugacacgcgagag

SEQ ID NO: 567509 - RNA, 22 nt, Human
cgauuuccgcuugaucugaucu

SEQ ID NO: 567510 - RNA, 22 nt, Human
ugcuuucaaugaauuguauacu

SEQ ID NO: 567511 - RNA, 22 nt, Human
acagagacaauauuuguaaagu

SEQ ID NO: 567512 - RNA, 22 nt, Human
uccagagaacgaugaaagcugg

SEQ ID NO: 567513 - RNA, 23 nt, Human
ucugaccucguuugcuguguucu

SEQ ID NO: 567514 - RNA, 22 nt, Human
uucagguuuuuaaguucugccu

SEQ ID NO: 567515 - RNA, 22 nt, Human
cugggaguugacgaggcuugua

SEQ ID NO: 567516 - RNA, 18 nt, Human
augggcagguaagaucca

SEQ ID NO: 567517 - RNA, 22 nt, Human
ccucuuccacugggccccaucc

SEQ ID NO: 567518 - RNA, 22 nt, Human
augggaggcagacacuaaguuc

SEQ ID NO: 567519 - RNA, 22 nt, Human
aaagcuauuuuauugcagcucu

SEQ ID NO: 567520 - RNA, 22 nt, Human
ucuauuaaugauucaauagugu

SEQ ID NO: 567521 - RNA, 22 nt, Human
agaauaaccaguguuucacagu

SEQ ID NO: 567522 - RNA, 22 nt, Human
auggcuucugucuuggaaauuu

SEQ ID NO: 567523 - RNA, 22 nt, Human
gauggugcaggugaagugcugg

SEQ ID NO: 567524 - RNA, 22 nt, Human
gcagacaucaagcacaggccca

SEQ ID NO: 567525 - RNA, 22 nt, Human
uucaaaccuaucuaagaaauag

SEQ ID NO: 567526 - RNA, 22 nt, Human
aucagugacuucuuccaaaguu

SEQ ID NO: 567527 - RNA, 19 nt, Human
cagcaaacacuguaaaugg

SEQ ID NO: 567528 - RNA, 22 nt, Human
cagguagaggcugccaucagcu

SEQ ID NO: 567529 - RNA, 22 nt, Human
uguaaagaaagacgcagaguua

SEQ ID NO: 567530 - RNA, 19 nt, Human
cauaauacaguggaucuga

SEQ ID NO: 567531 - RNA, 22 nt, Human
cccaggaacagcacagaacagc

SEQ ID NO: 567532 - RNA, 22 nt, Human
ccggcgucucuuccacuuccua

SEQ ID NO: 567533 - RNA, 22 nt, Human
auuguauacaagcuuaauuguu

SEQ ID NO: 567534 - RNA, 22 nt, Human
aaacccaggguuuugucuuccc

SEQ ID NO: 567535 - RNA, 22 nt, Human
cucuguccugguuuauacuggc

SEQ ID NO: 567536 - RNA, 22 nt, Human
gagcagcagcugggccagguuc

SEQ ID NO: 567537 - RNA, 22 nt, Human
cuugucuaguuccuggugaugu

SEQ ID NO: 567538 - RNA, 22 nt, Human
cuuucuuucgaagacgugauua

SEQ ID NO: 567539 - RNA, 22 nt, Human
ucaggccaggagaucagauuga

SEQ ID NO: 567540 - RNA, 22 nt, Human
ucacacaucucagguguuuaau

SEQ ID NO: 567541 - RNA, 22 nt, Human
cagaggccuggcuuggacaccu

SEQ ID NO: 567542 - RNA, 22 nt, Human
agcaaauaauugucuuugaggg

SEQ ID NO: 567543 - RNA, 22 nt, Human
uuuacagcuacuguccuauuuc

SEQ ID NO: 567544 - RNA, 22 nt, Human
caacauuucaaggucuuuagga

SEQ ID NO: 567545 - RNA, 22 nt, Human
aagcaccuggguuauaucuuag

SEQ ID NO: 567546 - RNA, 22 nt, Human
uggcuuccagaacugagcaaca

SEQ ID NO: 567547 - RNA, 22 nt, Human
aagcaaaagguuacacuucugg

SEQ ID NO: 567548 - RNA, 23 nt, Human
gacagguaaggguugggagaauc

SEQ ID NO: 567549 - RNA, 22 nt, Human
uuuugucagugagaacagaguu

SEQ ID NO: 567550 - RNA, 22 nt, Human
acaacuuuaauggguuucagcu

SEQ ID NO: 567551 - RNA, 22 nt, Human
uguucuuagguauuugacaguc

SEQ ID NO: 567552 - RNA, 20 nt, Human
ugagccugcuguaggaggcc

SEQ ID NO: 567553 - RNA, 22 nt, Human
aggacagagggaccagagccca

SEQ ID NO: 567554 - RNA, 22 nt, Human
uuccuguucaggaaaguugugu

SEQ ID NO: 567555 - RNA, 22 nt, Human
uuugaaauguaucaguauaggu

SEQ ID NO: 567556 - RNA, 22 nt, Human
ccgcguggcacccuccuggagg

SEQ ID NO: 567557 - RNA, 22 nt, Human
uacauguuauuucacuauuggu

SEQ ID NO: 567558 - RNA, 22 nt, Human
gagguccacugaggcaacaggg

SEQ ID NO: 567559 - RNA, 22 nt, Human
aucaacuuguccuugauguuaa

SEQ ID NO: 567560 - RNA, 18 nt, Human
gaacagcaauuucauguu

SEQ ID NO: 567561 - RNA, 22 nt, Human
acaugcacccaguuacacucuc

SEQ ID NO: 567562 - RNA, 22 nt, Human
acaaacugggauaggauccugu

SEQ ID NO: 567563 - RNA, 22 nt, Human
agguggcagacuaacagaagga

SEQ ID NO: 567564 - RNA, 22 nt, Human
agaugacuaacauaguauugcu

SEQ ID NO: 567565 - RNA, 22 nt, Human
uucacagcucauacuguucuca

SEQ ID NO: 567566 - RNA, 18 nt, Human
cugccuguugcugagagg

SEQ ID NO: 567567 - RNA, 22 nt, Human
uguggguccuccugugugcccg

SEQ ID NO: 567568 - RNA, 22 nt, Human
ucaucuccauacggucucgcag

SEQ ID NO: 567569 - RNA, 22 nt, Human
uggggugugcucagagcagggg

SEQ ID NO: 567570 - RNA, 21 nt, Human
acuguauuguuuucaaggauc

SEQ ID NO: 567571 - RNA, 22 nt, Human
gaucuguccuggcaguuaacac

SEQ ID NO: 567572 - RNA, 21 nt, Human
uuccuccucuggagaagaaga

SEQ ID NO: 567573 - RNA, 22 nt, Human
ugggugccaaccucugguggcc

SEQ ID NO: 567574 - RNA, 22 nt, Human
uuggaauuugagaccaagaaaa

SEQ ID NO: 567575 - RNA, 22 nt, Human
ugauuccugugcuuauuccagu

SEQ ID NO: 567576 - RNA, 22 nt, Human
ggccucugccccgcggggcucg

SEQ ID NO: 567577 - RNA, 22 nt, Human
uuuaaacuaacaguacacguug

SEQ ID NO: 567578 - RNA, 22 nt, Human
cuuauuggucccaggaggagaa

SEQ ID NO: 567579 - RNA, 22 nt, Human
cauuuacauuuaagguuaauau

SEQ ID NO: 567580 - RNA, 21 nt, Human
acaaauuguuuauauaggaag

SEQ ID NO: 567581 - RNA, 22 nt, Human
caagcagauauuuuagucaaga

SEQ ID NO: 567582 - RNA, 22 nt, Human
ucccacugcuuugcucugcuca

SEQ ID NO: 567583 - RNA, 22 nt, Human
ucccuguccugggcaaucccag

SEQ ID NO: 567584 - RNA, 22 nt, Human
ucggugcgcgaggcgcgguccc

SEQ ID NO: 567585 - RNA, 22 nt, Human
ccugcagacacuuguccagcaa

SEQ ID NO: 567586 - RNA, 22 nt, Human
uuguauuaaaauguguuucugu

SEQ ID NO: 567587 - RNA, 22 nt, Human
gcaguaaauugagagucauguu

SEQ ID NO: 567588 - RNA, 22 nt, Human
ucugccaucaagaugcucuggc

SEQ ID NO: 567589 - RNA, 18 nt, Human
cagaaaguuauuuacucu

SEQ ID NO: 567590 - RNA, 22 nt, Human
gcuuacagauaaugaggagacu

SEQ ID NO: 567591 - RNA, 22 nt, Human
gacagguaaagaugguggcagg

SEQ ID NO: 567592 - RNA, 22 nt, Human
ucuuuuaucuguuguguaacaa

SEQ ID NO: 567593 - RNA, 22 nt, Human
acuucccacugcagugacugag

SEQ ID NO: 567594 - RNA, 22 nt, Human
uugguuaccuucagaaaugagu

SEQ ID NO: 567595 - RNA, 22 nt, Human
auacaggaugcugaacaucucu

SEQ ID NO: 567596 - RNA, 22 nt, Human
uucaccugugacagguagaguu

SEQ ID NO: 567597 - RNA, 22 nt, Human
uucaaacacugcuuugagaggg

SEQ ID NO: 567598 - RNA, 22 nt, Human
auugaagcauggagaugaggca

SEQ ID NO: 567599 - RNA, 18 nt, Human
agcucacagaucuguuuu

SEQ ID NO: 567600 - RNA, 22 nt, Human
guuaaaugcagauucugacuca

SEQ ID NO: 567601 - RNA, 22 nt, Human
gugcaggacagcacaucuccug

SEQ ID NO: 567602 - RNA, 22 nt, Human
uuagaaaaaggcuguggucuua

SEQ ID NO: 567603 - RNA, 22 nt, Human
aauaguguauuuuucaaaauua

SEQ ID NO: 567604 - RNA, 22 nt, Human
cagcagcaacaacggaagccuu

SEQ ID NO: 567605 - RNA, 22 nt, Human
ucauacauguuguguucaaaug

SEQ ID NO: 567606 - RNA, 20 nt, Human
ucacuguaauugccuacauu

SEQ ID NO: 567607 - RNA, 22 nt, Human
cuguggccagagcgccguugac

SEQ ID NO: 567608 - RNA, 22 nt, Human
uuccggaauggcaggguagcuc

SEQ ID NO: 567609 - RNA, 23 nt, Human
auuuccuaaaagauaaucauuac

SEQ ID NO: 567610 - RNA, 22 nt, Human
cagugcagccaaggacaggcac

SEQ ID NO: 567611 - RNA, 22 nt, Human
gagggugguggcuuaaggugcu

SEQ ID NO: 567612 - RNA, 22 nt, Human
auggcuguguuguuccucugaa

SEQ ID NO: 567613 - RNA, 22 nt, Human
gcagagucagguccaaggacug

SEQ ID NO: 567614 - RNA, 22 nt, Human
gcuuuuauuucuucacaaaagu

SEQ ID NO: 567615 - RNA, 22 nt, Human
gcgagaaacuaagugcccuuug

SEQ ID NO: 567616 - RNA, 22 nt, Human
uagauuaucccugauuugucca

SEQ ID NO: 567617 - RNA, 22 nt, Human
guucuucaaagugacaacuaaa

SEQ ID NO: 567618 - RNA, 22 nt, Human
uuucauguuggauacuguuuca

SEQ ID NO: 567619 - RNA, 22 nt, Human
agugugaguuacaaagugugaa

SEQ ID NO: 567620 - RNA, 22 nt, Human
auacaacagaaaaugauuauuc

SEQ ID NO: 567621 - RNA, 22 nt, Human
uucauuacauucaaaaggcauu

SEQ ID NO: 567622 - RNA, 22 nt, Human
aaccccgcucaggcugggugag

SEQ ID NO: 567623 - RNA, 22 nt, Human
uguucauucugugaccugguuc

SEQ ID NO: 567624 - RNA, 22 nt, Human
uacauuuauaaggcuucucugu

SEQ ID NO: 567625 - RNA, 22 nt, Human
uucuuuuaauuucugucugcag

SEQ ID NO: 567626 - RNA, 22 nt, Human
ugcaaauucuuuacucugugau

SEQ ID NO: 567627 - RNA, 22 nt, Human
ucuucagacuguuguucuuuug

SEQ ID NO: 567628 - RNA, 18 nt, Human
gcugaaauucuaaacaaa

SEQ ID NO: 567629 - RNA, 22 nt, Human
gucaggaugagggaugaggagu

SEQ ID NO: 567630 - RNA, 22 nt, Human
uaugcgugccucugucugucug

SEQ ID NO: 567631 - RNA, 22 nt, Human
ccacuguuuccuuucugcuggc

SEQ ID NO: 567632 - RNA, 22 nt, Human
accaggcccuccagcugcgugg

SEQ ID NO: 567633 - RNA, 22 nt, Human
ucauugagcgguucuuaaccca

SEQ ID NO: 567634 - RNA, 22 nt, Human
uucccagauuggagggcagggg

SEQ ID NO: 567635 - RNA, 22 nt, Human
caucuuuguuuuggauauaauc

SEQ ID NO: 567636 - RNA, 22 nt, Human
agcuuucuauauaugaguugcu

SEQ ID NO: 567637 - RNA, 20 nt, Human
ucuggggaugaggucuagga

SEQ ID NO: 567638 - RNA, 22 nt, Human
ugagacaaagcagcugacagaa

SEQ ID NO: 567639 - RNA, 22 nt, Human
uauuuguuucuaguggcagcaa

SEQ ID NO: 567640 - RNA, 22 nt, Human
ugcagcaccuauggacacuugu

SEQ ID NO: 567641 - RNA, 22 nt, Human
cuuuaguucuagaaagugaaac

SEQ ID NO: 567642 - RNA, 22 nt, Human
ucacuguuaauaaauagcaaag

SEQ ID NO: 567643 - RNA, 22 nt, Human
cacgcacgcuggguggaggcgc

SEQ ID NO: 567644 - RNA, 22 nt, Human
uuugcuugauuaggauauggaa

SEQ ID NO: 567645 - RNA, 22 nt, Human
uacagugaguggcagagccaga

SEQ ID NO: 567646 - RNA, 22 nt, Human
uucucaggaacucagugucagc

SEQ ID NO: 567647 - RNA, 22 nt, Human
cugcaccgugucucgggcugcc

SEQ ID NO: 567648 - RNA, 22 nt, Human
ucugcucagccgaucugcuccg

SEQ ID NO: 567649 - RNA, 22 nt, Human
cugaaacuauggggaggggagc

SEQ ID NO: 567650 - RNA, 22 nt, Human
cugccaggauucugugaacccc

SEQ ID NO: 567651 - RNA, 22 nt, Human
ugcgcaugcguggcucuccggc

SEQ ID NO: 567652 - RNA, 22 nt, Human
cuucauuaaugucuauaaguuu

SEQ ID NO: 567653 - RNA, 22 nt, Human
ccucuaaauuguuugaaguugg

SEQ ID NO: 567654 - RNA, 22 nt, Human
uagucaccuguugugugaugcc

SEQ ID NO: 567655 - RNA, 20 nt, Human
gaacagucuucugagccaca

SEQ ID NO: 567656 - RNA, 22 nt, Human
acauuuaaugauccuacuguga

SEQ ID NO: 567657 - RNA, 22 nt, Human
aaauacaguggcagcagauaau

SEQ ID NO: 567658 - RNA, 22 nt, Human
uuugaagauaaauauggagaaa

SEQ ID NO: 567659 - RNA, 22 nt, Human
cugguggaauggcagagggaac

SEQ ID NO: 567660 - RNA, 22 nt, Human
uccguuuucacacugcuauaaa

SEQ ID NO: 567661 - RNA, 22 nt, Human
ccagcuggcccagcugugcucc

SEQ ID NO: 567662 - RNA, 22 nt, Human
guaaaucagugucauuuuagaa

SEQ ID NO: 567663 - RNA, 22 nt, Human
aucuaaagugucauaaguagcu

SEQ ID NO: 567664 - RNA, 22 nt, Human
aaugacaguggcacagucacuu

SEQ ID NO: 567665 - RNA, 22 nt, Human
uugauguaauacuuugcaacca

SEQ ID NO: 567666 - RNA, 22 nt, Human
ggugcaauaaaguuguagaacc

SEQ ID NO: 567667 - RNA, 22 nt, Human
aagcaauucacaguucacuuaa

SEQ ID NO: 567668 - RNA, 22 nt, Human
ucucauaauuguuucccagcua

SEQ ID NO: 567669 - RNA, 22 nt, Human
ccacugugcccagccucauggg

SEQ ID NO: 567670 - RNA, 18 nt, Human
ucuuccaacacugacacc

SEQ ID NO: 567671 - RNA, 19 nt, Human
guuggcacugaaaauggcu

SEQ ID NO: 567672 - RNA, 20 nt, Human
uuacagaaaugauguuauuu

SEQ ID NO: 567673 - RNA, 22 nt, Human
ggcuucaguggccagagaugau

SEQ ID NO: 567674 - RNA, 22 nt, Human
ugucggccacgagggagccgcg

SEQ ID NO: 567675 - RNA, 22 nt, Human
gccagcuggcugcaggucccag

SEQ ID NO: 567676 - RNA, 22 nt, Human
auuguugacuugauuacucaac

SEQ ID NO: 567677 - RNA, 22 nt, Human
aaguuacaggagaaagagauca

SEQ ID NO: 567678 - RNA, 22 nt, Human
uagcauuucacugaucuucacu

SEQ ID NO: 567679 - RNA, 22 nt, Human
ugcauaaacuucucugguguga

SEQ ID NO: 567680 - RNA, 22 nt, Human
ugcaaauauuccaugcuguuca

SEQ ID NO: 567681 - RNA, 22 nt, Human
cauugcaacuucaaacuccugg

SEQ ID NO: 567682 - RNA, 22 nt, Human
aaugaacacuuagccuuucuau

SEQ ID NO: 567683 - RNA, 22 nt, Human
auuacugaggcaaaguaguuuu

SEQ ID NO: 567684 - RNA, 22 nt, Human
auauuuguuuggcagaguucag

SEQ ID NO: 567685 - RNA, 22 nt, Human
ugcuccguucuucugcuucuug

SEQ ID NO: 567686 - RNA, 22 nt, Human
ccucucauagucuguauccuuu

SEQ ID NO: 567687 - RNA, 22 nt, Human
guggcagagagcaagugucuga

SEQ ID NO: 567688 - RNA, 17 nt, Human
ucugccaguuuuagaau

SEQ ID NO: 567689 - RNA, 22 nt, Human
ucaguguagcagacuuguagcc

SEQ ID NO: 567690 - RNA, 18 nt, Human
gacaaaaguacagacaga

SEQ ID NO: 567691 - RNA, 22 nt, Human
aucuguucuucaaaauauuaca

SEQ ID NO: 567692 - RNA, 22 nt, Human
uauagugucucuagaucaaaga

SEQ ID NO: 567693 - RNA, 22 nt, Human
acaaacagaguugaaaaauagg

SEQ ID NO: 567694 - RNA, 22 nt, Human
ucaagaaagggcuucaccagga

SEQ ID NO: 567695 - RNA, 22 nt, Human
guuuauuggguauuguggagcc

SEQ ID NO: 567696 - RNA, 22 nt, Human
augcacacguacccuacaaggc

SEQ ID NO: 567697 - RNA, 22 nt, Human
uaauuuugucacagugacaugc

SEQ ID NO: 567698 - RNA, 22 nt, Human
guuuccuuuuggaauuagagcu

SEQ ID NO: 567699 - RNA, 22 nt, Human
gagucacauacuauguaauaga

SEQ ID NO: 567700 - RNA, 22 nt, Human
uuggcgcccaggacgccgccgc

SEQ ID NO: 567701 - RNA, 21 nt, Human
guuaagccuugaggugauugu

SEQ ID NO: 567702 - RNA, 22 nt, Human
cuugcuuuaucugguuucucau

SEQ ID NO: 567703 - RNA, 22 nt, Human
aaacacaucauucaugucguca

SEQ ID NO: 567704 - RNA, 22 nt, Human
uuuguucaccuagcaaacuuuu

SEQ ID NO: 567705 - RNA, 22 nt, Human
gacagucccccagcagcaaacc

SEQ ID NO: 567706 - RNA, 22 nt, Human
cuguuccuccaccucaacaaac

SEQ ID NO: 567707 - RNA, 22 nt, Human
ucacauguguggcagugcaagu

SEQ ID NO: 567708 - RNA, 22 nt, Human
ucgcuuuaauggucuucacagc

SEQ ID NO: 567709 - RNA, 22 nt, Human
auccucagagaacgaacacaau

SEQ ID NO: 567710 - RNA, 18 nt, Human
ucugugggaucagugagg

SEQ ID NO: 567711 - RNA, 22 nt, Human
ugucuuuagccacuugccucuu

SEQ ID NO: 567712 - RNA, 22 nt, Human
gaagagguucaacguggucauc

SEQ ID NO: 567713 - RNA, 21 nt, Human
ugcuccaggagggggcagucc

SEQ ID NO: 567714 - RNA, 22 nt, Human
ggaaacugcuuacacuagaggg

SEQ ID NO: 567715 - RNA, 22 nt, Human
gcacagcuaugagcugaauugu

SEQ ID NO: 567716 - RNA, 22 nt, Human
aucuucaaagcacaucguuugu

SEQ ID NO: 567717 - RNA, 22 nt, Human
cauggcaggugcagauucugug

SEQ ID NO: 567718 - RNA, 22 nt, Human
uccagguccuacuggcccauag

SEQ ID NO: 567719 - RNA, 22 nt, Human
gccacaggaaagcacccuggag

SEQ ID NO: 567720 - RNA, 22 nt, Human
ucuuugcauggacauguguuuu

SEQ ID NO: 567721 - RNA, 22 nt, Human
uucaacaacuugguucaaaugg

SEQ ID NO: 567722 - RNA, 22 nt, Human
uagaugaacagaaagccacugu

SEQ ID NO: 567723 - RNA, 22 nt, Human
ugcuuuggcccaacauugaugc

SEQ ID NO: 567724 - RNA, 22 nt, Human
uaaugccuuucuguacuauaug

SEQ ID NO: 567725 - RNA, 22 nt, Human
uugcacagaugcacaugguugc

SEQ ID NO: 567726 - RNA, 22 nt, Human
uguuaccauaggucagaacguu

SEQ ID NO: 567727 - RNA, 18 nt, Human
cgauguguaugugauuug

SEQ ID NO: 567728 - RNA, 22 nt, Human
gaguuugugggaauggaguauu

SEQ ID NO: 567729 - RNA, 22 nt, Human
gagaauguuaauguugaaguau

SEQ ID NO: 567730 - RNA, 22 nt, Human
ggaggugacuggaucaugggca

SEQ ID NO: 567731 - RNA, 22 nt, Human
uaagccugcaugaaccaugaga

SEQ ID NO: 567732 - RNA, 22 nt, Human
aaugcugugauuuauuaaguau

SEQ ID NO: 567733 - RNA, 22 nt, Human
ggugcccaaggaagguugccgu

SEQ ID NO: 567734 - RNA, 22 nt, Human
ugcuuguauucauaucacagcu

SEQ ID NO: 567735 - RNA, 22 nt, Human
cuucauuucaggcugaagaaua

SEQ ID NO: 567736 - RNA, 22 nt, Human
ugugaacuggcagguggacggg

SEQ ID NO: 567737 - RNA, 21 nt, Human
gcucuguguuacaaguugggg

SEQ ID NO: 567738 - RNA, 22 nt, Human
augguuuuguccucuuugguuc

SEQ ID NO: 567739 - RNA, 22 nt, Human
ugauuugaauuuuaaaacacug

SEQ ID NO: 567740 - RNA, 19 nt, Human
uucacuaggucacaagguc

SEQ ID NO: 567741 - RNA, 22 nt, Human
ucccacugucuucucgugcucg

SEQ ID NO: 567742 - RNA, 22 nt, Human
uuacaauuacuugaucucagcu

SEQ ID NO: 567743 - RNA, 22 nt, Human
cucugccagccaaagucaucac

SEQ ID NO: 567744 - RNA, 22 nt, Human
aucaucaucuaaauugugucgc

SEQ ID NO: 567745 - RNA, 22 nt, Human
caaauacaaauacgggcagcuu

SEQ ID NO: 567746 - RNA, 22 nt, Human
ucugagagccacugaacagcaa

SEQ ID NO: 567747 - RNA, 22 nt, Human
agugucugcgggcagaggagcg

SEQ ID NO: 567748 - RNA, 23 nt, Human
ugcaaaauuugcagaguucgaug

SEQ ID NO: 567749 - RNA, 22 nt, Human
cuuugcagagggggugggagcu

SEQ ID NO: 567750 - RNA, 22 nt, Human
cugaaggacacgugaggagcca

SEQ ID NO: 567751 - RNA, 21 nt, Human
cuuuggcaagggagaagucac

SEQ ID NO: 567752 - RNA, 21 nt, Human
acugaacuuguguucuagagg

SEQ ID NO: 567753 - RNA, 22 nt, Human
cauugcugugggcauuugcugc

SEQ ID NO: 567754 - RNA, 22 nt, Human
guuuccaagucucucaacaccc

SEQ ID NO: 567755 - RNA, 22 nt, Human
uugcucuauguuuguaaacaga

SEQ ID NO: 567756 - RNA, 22 nt, Human
aauucaaggaucuguuaaaucu

SEQ ID NO: 567757 - RNA, 22 nt, Human
uaauuucagugcaagcucacgg

SEQ ID NO: 567758 - RNA, 22 nt, Human
uugcugugucauuuguuuaauc

SEQ ID NO: 567759 - RNA, 22 nt, Human
ccuggccauagggcccaggaaa

SEQ ID NO: 567760 - RNA, 22 nt, Human
agugaaaaccuaaucaugcagu

SEQ ID NO: 567761 - RNA, 22 nt, Human
aauguuacgaucaacaacacau

SEQ ID NO: 567762 - RNA, 22 nt, Human
uguuggcagugcuacagucagu

SEQ ID NO: 567763 - RNA, 22 nt, Human
auguucaaguaccuuugugucu

SEQ ID NO: 567764 - RNA, 22 nt, Human
cucggaauggaacaacagcggu

SEQ ID NO: 567765 - RNA, 22 nt, Human
aacacuaaaggucaguuagaag

SEQ ID NO: 567766 - RNA, 22 nt, Human herpesvirus 6
agacugggaaccgcggcagcau

SEQ ID NO: 567767 - RNA, 22 nt, Human herpesvirus 6
acauuuaaucacgagucuccuu

SEQ ID NO: 567768 - RNA, 22 nt, Human herpesvirus 6
uuucaacagccugucuagaaau

SEQ ID NO: 567769 - RNA, 22 nt, Human herpesvirus 6
uaucagaugacgcaucaacuuu

SEQ ID NO: 567770 - RNA, 22 nt, Human herpesvirus 6
gaagaucacuuuguuucugaac

SEQ ID NO: 567771 - RNA, 22 nt, Human herpesvirus 6
auuuacuacaggauaaaacuuc

SEQ ID NO: 567772 - RNA, 22 nt, Human herpesvirus 6
gauuuucucagcaauuuggaaa

SEQ ID NO: 567773 - RNA, 22 nt, Human herpesvirus 6
ucuacaaaauagaauuuaacga

SEQ ID NO: 567774 - RNA, 22 nt, Human herpesvirus 6
ugagacaucgagauucuuuaaa

SEQ ID NO: 567775 - RNA, 22 nt, Human herpesvirus 6
ugcagaauaucaaaaacucaug

SEQ ID NO: 567776 - RNA, 22 nt, Human herpesvirus 6
ucuacaaaauagaauuuaacga

SEQ ID NO: 567777 - RNA, 22 nt, Human herpesvirus 6
ucucaucguaaucuuuguaggc

SEQ ID NO: 567778 - RNA, 22 nt, Human herpesvirus 6
ucuauuagauggcgauuugaag

SEQ ID NO: 567779 - RNA, 22 nt, Human herpesvirus 6
uccgagaacucgagccauaguu

SEQ ID NO: 567780 - RNA, 22 nt, Human herpesvirus 6
ucaguuuauaucuucguaaugg

SEQ ID NO: 567781 - RNA, 22 nt, Human herpesvirus 6
uauaucgaauuaucuuugaagc

SEQ ID NO: 567782 - RNA, 22 nt, Human herpesvirus 6
uaugacuagggguauggcuagg

SEQ ID NO: 567783 - RNA, 23 nt, Human herpesvirus 6
gagaaaaguaacacaggucuccc

SEQ ID NO: 567784 - RNA, 22 nt, Human herpesvirus 6
gaggugugauuuuagaagguag

SEQ ID NO: 567785 - RNA, 22 nt, Human herpesvirus 6
gaguaaaucgaacgauacuuac

SEQ ID NO: 567786 - RNA, 22 nt, Human herpesvirus 6
gauucucauuauaacgcagaca

SEQ ID NO: 567787 - RNA, 22 nt, Human herpesvirus 6
gauugauaaguuuccgacaugc

SEQ ID NO: 567788 - RNA, 22 nt, Human herpesvirus 6
gauuuucucagcaauuuggaaa

SEQ ID NO: 567789 - RNA, 20 nt, Human herpesvirus 6
cgcguguuugcaucagugac

SEQ ID NO: 567790 - RNA, 22 nt, Human herpesvirus 6
cgcguuucucuccacaucuccg

SEQ ID NO: 567791 - RNA, 22 nt, Human herpesvirus 6
cggcgaggcggccggagagccg

SEQ ID NO: 567792 - RNA, 22 nt, Human herpesvirus 6
cggcggauggagcccgcucggu

SEQ ID NO: 567793 - RNA, 22 nt, Human herpesvirus 6
cggcgguugccuguauaggcag

SEQ ID NO: 567794 - RNA, 22 nt, Human herpesvirus 6
cggugguuaguuuuuggguaga

SEQ ID NO: 567795 - RNA, 22 nt, Human herpesvirus 6
cggugugucauuggagaaauac

SEQ ID NO: 567796 - RNA, 22 nt, Human herpesvirus 6
ugcgagaccgagcgggcuccau

SEQ ID NO: 567797 - RNA, 22 nt, Human herpesvirus 6
ugcuuugccaguauaacuguuu

SEQ ID NO: 567798 - RNA, 22 nt, Human herpesvirus 6
uggaaugaugaacgguaagcga

SEQ ID NO: 567799 - RNA, 22 nt, Human herpesvirus 6
aaucuggguuccugcuuaguua

SEQ ID NO: 567800 - RNA, 22 nt, Human herpesvirus 6
acaaauucgguguuuuuaaugu

SEQ ID NO: 567801 - RNA, 22 nt, Human herpesvirus 6
aauguuaugaagaaguuaacua

SEQ ID NO: 567802 - RNA, 22 nt, Human herpesvirus 6
acauuuaaucacgagucuccuu

SEQ ID NO: 567803 - RNA, 22 nt, Human herpesvirus 6
acacgucgugcguuuugucuuc

SEQ ID NO: 567804 - RNA, 22 nt, Human herpesvirus 6
ugccaauuuugagcaauauaag

SEQ ID NO: 567805 - RNA, 22 nt, Human herpesvirus 6
accguuucguugcaaaugacuu

SEQ ID NO: 567806 - RNA, 22 nt, Human herpesvirus 6
uuuaaaucuaauauucaucggc

SEQ ID NO: 567807 - RNA, 22 nt, Human herpesvirus 6
uuuaagucguugugucaugauu

SEQ ID NO: 567808 - RNA, 22 nt, Human herpesvirus 6
uuuaccgguaauuggcaguuuu

SEQ ID NO: 567809 - RNA, 22 nt, Human herpesvirus 6
uuuagaauuaaggaauugguau

SEQ ID NO: 567810 - RNA, 18 nt, Human herpesvirus 6
uuucaacagccugucuag

SEQ ID NO: 567811 - RNA, 22 nt, Human herpesvirus 6
ccguggugcgucucuccgauag

SEQ ID NO: 567812 - RNA, 22 nt, Human herpesvirus 6
uguuguuuagcguggagauguu

SEQ ID NO: 567813 - RNA, 22 nt, Human herpesvirus 6
uuccgauagggaaacucuauuc

SEQ ID NO: 567814 - RNA, 19 nt, Human herpesvirus 6
uucauuucugacgucugaa

SEQ ID NO: 567815 - RNA, 22 nt, Human herpesvirus 6
uuaggauucuauguggagccgu

SEQ ID NO: 567816 - RNA, 22 nt, Human herpesvirus 6
uuaucguugguguuagaguuag

SEQ ID NO: 567817 - RNA, 22 nt, Human herpesvirus 6
uuccuggacauggugaaacuug

SEQ ID NO: 567818 - RNA, 22 nt, Human herpesvirus 6
uucguuaacaauaauacgcagu

SEQ ID NO: 567819 - RNA, 22 nt, Human herpesvirus 6
uuccuuuucaguauagacauuu

SEQ ID NO: 567820 - RNA, 22 nt, Human herpesvirus 6
uucucgguaaaaauuuggucca

SEQ ID NO: 567821 - RNA, 22 nt, Human herpesvirus 6
aucgagucuuuauauuuucggu

SEQ ID NO: 567822 - RNA, 22 nt, Human herpesvirus 6
aucgauaauccucgggccaggg

SEQ ID NO: 567823 - RNA, 18 nt, Human herpesvirus 6
aucgcaaaauugauacaa

SEQ ID NO: 567824 - RNA, 21 nt, Human herpesvirus 6
aucgcaaaauugauacaaacg

SEQ ID NO: 567825 - RNA, 22 nt, Human herpesvirus 6
aucgcaaaauugauacaaacgu

SEQ ID NO: 567826 - RNA, 22 nt, Human herpesvirus 6
aguaaauauuuaucugcaugua

SEQ ID NO: 567827 - RNA, 21 nt, Human herpesvirus 6
auggugucguuuaauuucaca

SEQ ID NO: 567828 - RNA, 22 nt, Human herpesvirus 6
augcuuuaccucuuuagugacu

SEQ ID NO: 567829 - RNA, 22 nt, Human herpesvirus 6
gucgcucaugcggacagucaaa

SEQ ID NO: 567830 - RNA, 22 nt, Human herpesvirus 6
gugacggugcuccgaucagggg

SEQ ID NO: 567831 - RNA, 22 nt, Human herpesvirus 6
guccgugugaacuggcacgagu

SEQ ID NO: 567832 - RNA, 22 nt, Human herpesvirus 6
gugccuauugcugcuaugccug

SEQ ID NO: 567833 - RNA, 21 nt, Human herpesvirus 6
guuucgugucaguucuguggu

SEQ ID NO: 567834 - RNA, 18 nt, Human herpesvirus 6
guuauggaacguauguag

SEQ ID NO: 567835 - RNA, 22 nt, Human herpesvirus 6
uaagcagccgcgaacucguuaa

SEQ ID NO: 567836 - RNA, 22 nt, Human herpesvirus 6
uaccuuuguuuugcagagaaaa

SEQ ID NO: 567837 - RNA, 22 nt, Human herpesvirus 6
uagcuguguguuauaaggaaga

SEQ ID NO: 567838 - RNA, 23 nt, Human herpesvirus 6
gguggcacgucgcgcgcgauguc

SEQ ID NO: 567839 - RNA, 22 nt, Human herpesvirus 6
gggugucuaaacgagucuggag

SEQ ID NO: 567840 - RNA, 22 nt, Human herpesvirus 6
guacaaaugauuuaauuucgcu

SEQ ID NO: 567841 - RNA, 22 nt, Human herpesvirus 6
uccguccucgucuguuaaugua

SEQ ID NO: 567842 - RNA, 22 nt, Human herpesvirus 6
ucgccguuuacuauuguaaaau

SEQ ID NO: 567843 - RNA, 23 nt, Human herpesvirus 6
ucgaaaucgcggaugaauugcgg

SEQ ID NO: 567844 - RNA, 22 nt, Human herpesvirus 6
ggcaccgugccaggccaccgug

SEQ ID NO: 567845 - RNA, 22 nt, Human herpesvirus 6
gcgagcauaguuuaguggguau

SEQ ID NO: 567846 - RNA, 22 nt, Human herpesvirus 6
aaggacuaucugagacagucca

SEQ ID NO: 567847 - RNA, 22 nt, Human herpesvirus 6
aagcuguuaaauguaaauggaa

SEQ ID NO: 567848 - RNA, 23 nt, Human herpesvirus 6
aaagucaccuguauagauuuauu

SEQ ID NO: 567849 - RNA, 23 nt, Human herpesvirus 6
aagaaaaacaggaacugcgguug

SEQ ID NO: 567850 - RNA, 22 nt, Human herpesvirus 6
aaccgcgguacccacugaucuu

SEQ ID NO: 567851 - RNA, 22 nt, Human herpesvirus 6
aacugauacuguucaaguccuu

SEQ ID NO: 567852 - RNA, 22 nt, Human herpesvirus 6
gcgcgugggccagucucgccuc

SEQ ID NO: 567853 - RNA, 22 nt, Human herpesvirus 6
aaaaauaaggcaacgcccacca

SEQ ID NO: 567854 - RNA, 22 nt, Human herpesvirus 6
uguccauuucguaucgaaugaa

SEQ ID NO: 567855 - RNA, 22 nt, Human herpesvirus 6
caaauaguuguguuauaaaagg

SEQ ID NO: 567856 - RNA, 22 nt, Human herpesvirus 6
auuuacuacaggauaaaacuuc

SEQ ID NO: 567857 - RNA, 22 nt, Human herpesvirus 6
auuacuagaugguaaagcguug

SEQ ID NO: 567858 - RNA, 22 nt, Human herpesvirus 6
auuccguuugcguggcuagauc

SEQ ID NO: 567859 - RNA, 22 nt, Human herpesvirus 6
auucucauuugaaagcgauaga

SEQ ID NO: 567860 - RNA, 21 nt, Human herpesvirus 6
auucucucacagcaugaugac

SEQ ID NO: 567861 - RNA, 22 nt, Human herpesvirus 6
auugcgaggagacggagacgga

SEQ ID NO: 567862 - RNA, 22 nt, Human herpesvirus 6
cacacacggcgugagacgccgc

SEQ ID NO: 567863 - RNA, 22 nt, Human herpesvirus 6
cagcgacaguaacggcggcggc

SEQ ID NO: 567864 - RNA, 22 nt, Human herpesvirus 6
caggucggcaggguguacgcgg

SEQ ID NO: 567865 - RNA, 22 nt, Human herpesvirus 6
cgacagaugugugucuuccgau

SEQ ID NO: 567866 - RNA, 22 nt, Human herpesvirus 6
cgacgcggcgucuccgacgagu

SEQ ID NO: 567867 - RNA, 16 nt, Human herpesvirus 6
ccuggcgauuuucgau

SEQ ID NO: 567868 - RNA, 22 nt, Human herpesvirus 6
ccuuuuuaauuucgaguauugu

SEQ ID NO: 567869 - RNA, 22 nt, Human herpesvirus 6
uuucaacagccugucuagaaau

SEQ ID NO: 567870 - RNA, 22 nt, Human herpesvirus 6
uuucacgugcacgagaucuguu

SEQ ID NO: 567871 - RNA, 22 nt, Human herpesvirus 6
uuuggcgacuguuugaaauauu

SEQ ID NO: 567872 - RNA, 22 nt, Human herpesvirus 6
acggcaccauuaauauguucgc

SEQ ID NO: 567873 - RNA, 23 nt, Human herpesvirus 6
acuuguuuuuaucggggcggauc

SEQ ID NO: 567874 - RNA, 21 nt, Human herpesvirus 6
acuuagcagauauucuagauu

SEQ ID NO: 567875 - RNA, 22 nt, Human herpesvirus 6
acggagcccgcuggguaucgcg

SEQ ID NO: 567876 - RNA, 22 nt, Human herpesvirus 6
agccgaugacggccuccggccc

SEQ ID NO: 567877 - RNA, 22 nt, Human herpesvirus 6
agcggaaacuguaacggccacg

SEQ ID NO: 567878 - RNA, 22 nt, Human herpesvirus 6
agcugggugucgauacauauau

SEQ ID NO: 567879 - RNA, 22 nt, Human herpesvirus 6
acuuuuuguccgaucacaucuu

SEQ ID NO: 567880 - RNA, 22 nt, Human herpesvirus 6
acguagaaaaucgucaauggug

SEQ ID NO: 567881 - RNA, 22 nt, Human herpesvirus 6
gggcggauaguaggaguggguc

SEQ ID NO: 567882 - RNA, 22 nt, Human herpesvirus 6
gccgcagaguugcaagaaaugu

SEQ ID NO: 567883 - RNA, 22 nt, Human herpesvirus 6
gcauucgacacauggaauuuac

SEQ ID NO: 567884 - RNA, 22 nt, Human herpesvirus 6
gcuucccaacacuuuaagauaa

SEQ ID NO: 567885 - RNA, 22 nt, Human herpesvirus 6
gcuaauaauuccauaaauguca

SEQ ID NO: 567886 - RNA, 22 nt, Human herpesvirus 6
gcuaucuucggcaaaaaguuuu

SEQ ID NO: 567887 - RNA, 22 nt, Human herpesvirus 6
cugauguagauauuuuaaaaau

SEQ ID NO: 567888 - RNA, 22 nt, Human herpesvirus 6
cucuguuuggagacauacugua

SEQ ID NO: 567889 - RNA, 22 nt, Human herpesvirus 6
cuauauaugcaagccaugacaa

SEQ ID NO: 567890 - RNA, 22 nt, Human herpesvirus 6
cgugugcgugcgccggacucug

SEQ ID NO: 567891 - RNA, 22 nt, Human herpesvirus 6
gaauaucaucccuaccgaugaa

SEQ ID NO: 567892 - RNA, 22 nt, Human herpesvirus 6
gaauguuugggagaacugagga

SEQ ID NO: 567893 - RNA, 22 nt, Human herpesvirus 6
ggcgucucacgccgugugugcg

SEQ ID NO: 567894 - RNA, 22 nt, Human
aaacugaaacaucaucauguug

SEQ ID NO: 567895 - RNA, 22 nt, Human
gacccuguuucuacaaauaauu

SEQ ID NO: 567896 - RNA, 22 nt, Human
cuuuggaauaauuuccuggagu

SEQ ID NO: 567897 - RNA, 22 nt, Human
acaggccucaagacacccaggu

SEQ ID NO: 567898 - RNA, 22 nt, Human
uuucuauucuggaucuguggca

SEQ ID NO: 567899 - RNA, 22 nt, Human
agacucugauaagcaacucuug

SEQ ID NO: 567900 - RNA, 22 nt, Human
auacuaagcucauuacauuuug

SEQ ID NO: 567901 - RNA, 22 nt, Human
acuguacacgugucauuuacag

SEQ ID NO: 567902 - RNA, 22 nt, Human
ccagguggaaggucugugcucu

SEQ ID NO: 567903 - RNA, 21 nt, Human
uuuguucaggggcaaaguuaa

SEQ ID NO: 567904 - RNA, 22 nt, Human
uggacaacauagugagaccuca

SEQ ID NO: 567905 - RNA, 19 nt, Human
uaaaaacugaaggaagcag

SEQ ID NO: 567906 - RNA, 22 nt, Human
ucuuuuauuaggcugaaauggg

SEQ ID NO: 567907 - RNA, 22 nt, Human
acacuacaaucucagaacuaua

SEQ ID NO: 567908 - RNA, 22 nt, Human
cacuuggaggcccccugugccc

SEQ ID NO: 567909 - RNA, 22 nt, Human
uuuugauaucaugaugaacaga

SEQ ID NO: 567910 - RNA, 22 nt, Human
gaaauccaguucccuacucuua

SEQ ID NO: 567911 - RNA, 22 nt, Human
uaaggaaagugccaugauuucu

SEQ ID NO: 567912 - RNA, 22 nt, Human
acauuucucauucuccccuaac

SEQ ID NO: 567913 - RNA, 22 nt, Human
agacuguaauuuguggccuccu

SEQ ID NO: 567914 - RNA, 22 nt, Human
uuucuauuggcgucacuguugu

SEQ ID NO: 567915 - RNA, 22 nt, Human
gguuccaccuggcgagggguau

SEQ ID NO: 567916 - RNA, 22 nt, Human
uccauuuuagagaugaagaaac

SEQ ID NO: 567917 - RNA, 22 nt, Human
cuaguucuuaacuguuaugauu

SEQ ID NO: 567918 - RNA, 22 nt, Human
ucaugaaaauagaucagaaauu

SEQ ID NO: 567919 - RNA, 22 nt, Human
augcagaaggagccaugcuugc

SEQ ID NO: 567920 - RNA, 22 nt, Human
aggcagaggagaaugaucuucc

SEQ ID NO: 567921 - RNA, 22 nt, Human
cuccagcuuuuucccaguuggc

SEQ ID NO: 567922 - RNA, 22 nt, Human
acauuucuuccacaugcugcug

SEQ ID NO: 567923 - RNA, 18 nt, Human
aagaacugagguccuaga

SEQ ID NO: 567924 - RNA, 22 nt, Human
agucucuuggcauucugaaaca

SEQ ID NO: 567925 - RNA, 22 nt, Human
cagguccugcagggagaguaaa

SEQ ID NO: 567926 - RNA, 22 nt, Human
acauuucugcauguaggguaau

SEQ ID NO: 567927 - RNA, 22 nt, Human
uuucuacauuuguaaccagauu

SEQ ID NO: 567928 - RNA, 22 nt, Human
uucaucuugauggcuuccuaau

SEQ ID NO: 567929 - RNA, 22 nt, Human
guccaagagucaagaagggggc

SEQ ID NO: 567930 - RNA, 20 nt, Human
acuggacacugaggugagcu

SEQ ID NO: 567931 - RNA, 22 nt, Human
uaauccaauggcacaauguaug

SEQ ID NO: 567932 - RNA, 22 nt, Human
acuguucauuuguccuguaucu

SEQ ID NO: 567933 - RNA, 22 nt, Human
caguuucucucauacauauuug

SEQ ID NO: 567934 - RNA, 22 nt, Human
cuauuuaucuauuucugaauga

SEQ ID NO: 567935 - RNA, 22 nt, Human
caaagacugcauaacacaugaa

SEQ ID NO: 567936 - RNA, 22 nt, Human
uacuguacugucuuuuuugcug

SEQ ID NO: 567937 - RNA, 22 nt, Human
acaaaaagcuccauuacugucc

SEQ ID NO: 567938 - RNA, 22 nt, Human
auagcagaaaccaagcuucuuc

SEQ ID NO: 567939 - RNA, 22 nt, Human
agcauaaaggucaacguuuuag

SEQ ID NO: 567940 - RNA, 22 nt, Human
cauuucuagggaucauaaagua

SEQ ID NO: 567941 - RNA, 22 nt, Human
agugcaauagcaaagaacaaca

SEQ ID NO: 567942 - RNA, 22 nt, Human
uauggaaaguguuuucuucugu

SEQ ID NO: 567943 - RNA, 22 nt, Human
auaccuguguauccacaagcgu

SEQ ID NO: 567944 - RNA, 22 nt, Human
aauacagauauucagugguacu

SEQ ID NO: 567945 - RNA, 22 nt, Human
auuucuacaguacacaugcauu

SEQ ID NO: 567946 - RNA, 22 nt, Human
aauguacaucucaguguaguac

SEQ ID NO: 567947 - RNA, 22 nt, Human
acagguccuuauaagagcacuc

SEQ ID NO: 567948 - RNA, 22 nt, Human
gccagccugugcuuggccaggc

SEQ ID NO: 567949 - RNA, 22 nt, Human
ucauuucuccgaccugcugucc

SEQ ID NO: 567950 - RNA, 22 nt, Human
aaauauguaagauuagcacuag

SEQ ID NO: 567951 - RNA, 22 nt, Human
cucaggagagucuuauaucucc

SEQ ID NO: 567952 - RNA, 22 nt, Human
uccagcucaggguuggcucaag

SEQ ID NO: 567953 - RNA, 22 nt, Human
accagacacugugaagacaggc

SEQ ID NO: 567954 - RNA, 22 nt, Human
acauuucuccuugcaggaguca

SEQ ID NO: 567955 - RNA, 22 nt, Human
acauguguggacaugaaucuac

SEQ ID NO: 567956 - RNA, 22 nt, Human
acuuuggggaacuuuucuccuc

SEQ ID NO: 567957 - RNA, 22 nt, Human
cugugacagagcuugagugaga

SEQ ID NO: 567958 - RNA, 22 nt, Human
ucccagcacgucugcuguuucu

SEQ ID NO: 567959 - RNA, 22 nt, Human
uauauguguggauucuuguaga

SEQ ID NO: 567960 - RNA, 22 nt, Human
agggaaauuaaugugagcaaug

SEQ ID NO: 567961 - RNA, 22 nt, Human
acauuguauaaugauuaucaca

SEQ ID NO: 567962 - RNA, 22 nt, Human
cugucuuuucauacuuucccuc

SEQ ID NO: 567963 - RNA, 22 nt, Human
agcaaacagugugcuaagaaau

SEQ ID NO: 567964 - RNA, 22 nt, Human
cacaguccuacagagaucagag

SEQ ID NO: 567965 - RNA, 22 nt, Human
cucccacuccuggcucaccaca

SEQ ID NO: 567966 - RNA, 20 nt, Human
gaaauucucguauuaguuua

SEQ ID NO: 567967 - RNA, 22 nt, Human
aaaaaccuuucccauacuaaga

SEQ ID NO: 567968 - RNA, 22 nt, Human
uacaagacgagggaaguucuuu

SEQ ID NO: 567969 - RNA, 22 nt, Human
uaggaaaagcacaggauguucu

SEQ ID NO: 567970 - RNA, 22 nt, Human
aaacacuagcaggaagcacuga

SEQ ID NO: 567971 - RNA, 22 nt, Human
cuguuauuuagaacauggaauc

SEQ ID NO: 567972 - RNA, 22 nt, Human
aaaauuuccaccaucuuugugu

SEQ ID NO: 567973 - RNA, 22 nt, Human
caauaguaaauuacggaggaga

SEQ ID NO: 567974 - RNA, 22 nt, Human
aaagacugggacugcagcaggc

SEQ ID NO: 567975 - RNA, 22 nt, Human
cacuguacagcauuaacaaggc

SEQ ID NO: 567976 - RNA, 22 nt, Human
aaacaacuucugcacuaugggu

SEQ ID NO: 567977 - RNA, 22 nt, Human
auacaagaucacuccagaaaau

SEQ ID NO: 567978 - RNA, 22 nt, Human
uaacagcuggcguuauaggaau

SEQ ID NO: 567979 - RNA, 22 nt, Human
aacuguacgauaauaaauuugu

SEQ ID NO: 567980 - RNA, 22 nt, Human
ugagaugaauaacuccugcuaa

SEQ ID NO: 567981 - RNA, 22 nt, Human
acugaguguaggacuuugaguu

SEQ ID NO: 567982 - RNA, 22 nt, Human
uuuuucugccauucaaagagga

SEQ ID NO: 567983 - RNA, 22 nt, Human
aggcagagcuggguuuugaaau

SEQ ID NO: 567984 - RNA, 22 nt, Human
uucuaguugagggagacaaaua

SEQ ID NO: 567985 - RNA, 22 nt, Human
caagucaaagacuagaacuagu

SEQ ID NO: 567986 - RNA, 22 nt, Human
aucuggaagccagauacucagu

SEQ ID NO: 567987 - RNA, 22 nt, Human
uuauuauagauuaugcaagauu

SEQ ID NO: 567988 - RNA, 22 nt, Human
acugcagacucuacaguuauaa

SEQ ID NO: 567989 - RNA, 22 nt, Human
cauuuacuuaaaucuuuacaag

SEQ ID NO: 567990 - RNA, 22 nt, Human
aggaaacagugaacuuggcagg

SEQ ID NO: 567991 - RNA, 22 nt, Human
uccaauaacaucuaaaaacuua

SEQ ID NO: 567992 - RNA, 22 nt, Human
ggcagaggaggggugaauuugc

SEQ ID NO: 567993 - RNA, 22 nt, Human
augucuuucuuauggucuguug

SEQ ID NO: 567994 - RNA, 22 nt, Human
aaauucuaugucaauguuuauu

SEQ ID NO: 567995 - RNA, 22 nt, Human
acauuucuuagccuaguuccag

SEQ ID NO: 567996 - RNA, 22 nt, Human
uuuguucauuuugagcucauca

SEQ ID NO: 567997 - RNA, 22 nt, Human
cuguacagaguucugaguguac

SEQ ID NO: 567998 - RNA, 22 nt, Human
acauuucucuugaugucucuau

SEQ ID NO: 567999 - RNA, 22 nt, Human
uuauacuaaaacgcauugaauu

SEQ ID NO: 568000 - RNA, 22 nt, Human
cagaaacuauguaagaaaguga

SEQ ID NO: 568001 - RNA, 22 nt, Human
auguaacaaaugguauacaugu

SEQ ID NO: 568002 - RNA, 20 nt, Human
ccugucuggagacaaagaga

SEQ ID NO: 568003 - RNA, 22 nt, Human
ggcagaggugacagugucuuuu

SEQ ID NO: 568004 - RNA, 22 nt, Human
gagauuuccauauuuuguaaca

SEQ ID NO: 568005 - RNA, 22 nt, Human
gaaaucuuuauggaaauaacaa

SEQ ID NO: 568006 - RNA, 22 nt, Human
ucuguacauuuggggaccccag

SEQ ID NO: 568007 - RNA, 22 nt, Human
ccugcuuaacauugccaugaca

SEQ ID NO: 568008 - RNA, 22 nt, Human
accaucuuaguggccagcucuc

SEQ ID NO: 568009 - RNA, 22 nt, Human
gacaagacugguuuauuuaagg

SEQ ID NO: 568010 - RNA, 22 nt, Human
acauuucucaucuaguagagua

SEQ ID NO: 568011 - RNA, 22 nt, Human
gcuguacauucugcacaggccc

SEQ ID NO: 568012 - RNA, 22 nt, Human
aagaaacuguugcgugacagcg

SEQ ID NO: 568013 - RNA, 22 nt, Human
cugagaaaggaccucaaacagg

SEQ ID NO: 568014 - RNA, 22 nt, Human
aacaugaaacccaaacagaaua

SEQ ID NO: 568015 - RNA, 22 nt, Human
ucugucuuuagaggccugugcu

SEQ ID NO: 568016 - RNA, 22 nt, Human
cagcuccuauuagacacugaau

SEQ ID NO: 568017 - RNA, 22 nt, Human
aacauuaauuacagucaaacau

SEQ ID NO: 568018 - RNA, 23 nt, Human
aucaagucaucagcaaaauacau

SEQ ID NO: 568019 - RNA, 22 nt, Human
aucuggaauccuuguggacaau

SEQ ID NO: 568020 - RNA, 23 nt, Human
ucuguacacaucagcaucuccca

SEQ ID NO: 568021 - RNA, 22 nt, Human
ucuauuugcugguugcuucugu

SEQ ID NO: 568022 - RNA, 22 nt, Human
uucucaggugaggcugaggcug

SEQ ID NO: 568023 - RNA, 22 nt, Human
ucagucuucccuccagugcaac

SEQ ID NO: 568024 - RNA, 22 nt, Human
uguugauuugugggcugcaaaa

SEQ ID NO: 568025 - RNA, 22 nt, Human
uggucaacaggcagggaugaaa

SEQ ID NO: 568026 - RNA, 22 nt, Human
uugucuuuggaaauuuaauguu

SEQ ID NO: 568027 - RNA, 22 nt, Human
aaagaacuuauccuagaauuug

SEQ ID NO: 568028 - RNA, 17 nt, Human
ucugucuugacugucac

SEQ ID NO: 568029 - RNA, 22 nt, Human
acauuucuuucuauucaguagc

SEQ ID NO: 568030 - RNA, 22 nt, Human
aggaccugagaguuggaaaucc

SEQ ID NO: 568031 - RNA, 22 nt, Human
uccagcuggggacaugggcuuc

SEQ ID NO: 568032 - RNA, 22 nt, Human
ucuguacaacaaagggaugaga

SEQ ID NO: 568033 - RNA, 23 nt, Human
uggcuccaugaaaauuacgagga

SEQ ID NO: 568034 - RNA, 22 nt, Human
uuucuacaugucaauccaaacc

SEQ ID NO: 568035 - RNA, 22 nt, Human
acuuucuuaggcuguauaaaug

SEQ ID NO: 568036 - RNA, 22 nt, Human
aagacugugucuauggcuacuc

SEQ ID NO: 568037 - RNA, 22 nt, Human
acagcaaaggacgaacacucug

SEQ ID NO: 568038 - RNA, 23 nt, Human
uucuuauuuacuuuggaaucucc

SEQ ID NO: 568039 - RNA, 22 nt, Human
acauuucuuugcuagacagcag

SEQ ID NO: 568040 - RNA, 22 nt, Human
aaauguuccuuuggauuaaacu

SEQ ID NO: 568041 - RNA, 22 nt, Human
gacaaaacacauuaguuuaaaa

SEQ ID NO: 568042 - RNA, 22 nt, Human
gacaagacagcuugcagacaac

SEQ ID NO: 568043 - RNA, 22 nt, Human
uccaucuguuuacuauaaagau

SEQ ID NO: 568044 - RNA, 20 nt, Human
acaugaaaggaaacaggaaa

SEQ ID NO: 568045 - RNA, 22 nt, Human
acaguucccgucuugcacagcu

SEQ ID NO: 568046 - RNA, 22 nt, Human
aucuggaacaaagcuuaggaau

SEQ ID NO: 568047 - RNA, 22 nt, Human
aaaaguguucaggaagaauaau

SEQ ID NO: 568048 - RNA, 22 nt, Human
uagcauuuggcaccaguuauuu

SEQ ID NO: 568049 - RNA, 22 nt, Human
cagcugagaagugauagcugca

SEQ ID NO: 568050 - RNA, 22 nt, Human
cauguacauucuguagauggag

SEQ ID NO: 568051 - RNA, 22 nt, Human
uuucuacaguacugauuucaua

SEQ ID NO: 568052 - RNA, 22 nt, Human
cuuagaugaagucacagaaccc

SEQ ID NO: 568053 - RNA, 22 nt, Human
caaacuguucucugugggauuc

SEQ ID NO: 568054 - RNA, 20 nt, Human
ucuguacacucaucuucugc

SEQ ID NO: 568055 - RNA, 22 nt, Human
augaaacugggauaacuauagc

SEQ ID NO: 568056 - RNA, 19 nt, Human
ccuguacauuauucucccc

SEQ ID NO: 568057 - RNA, 22 nt, Human
aaaauccacaacgcucauuuca

SEQ ID NO: 568058 - RNA, 22 nt, Human
ucuuugcauggacauguguuuu

SEQ ID NO: 568059 - RNA, 21 nt, Human
aagaacuauugagguacacag

SEQ ID NO: 568060 - RNA, 22 nt, Human
acauuucucagguaagucauuu

SEQ ID NO: 568061 - RNA, 22 nt, Human
agcuuuuaguacguuaaaauug

SEQ ID NO: 568062 - RNA, 22 nt, Human
aaagacugguguguuacauaua

SEQ ID NO: 568063 - RNA, 22 nt, Human
gcuuuaaaccucuacucugucc

SEQ ID NO: 568064 - RNA, 22 nt, Human
auguuacaauucaaaaugcugc

SEQ ID NO: 568065 - RNA, 21 nt, Human
ggcuguggagccaugacucac

SEQ ID NO: 568066 - RNA, 22 nt, Human
ccuggcuuuuguuuauaaauuc

SEQ ID NO: 568067 - RNA, 22 nt, Human
aagaaacugaaaguggcuucau

SEQ ID NO: 568068 - RNA, 22 nt, Human
caguccuggggaccaggcugag

SEQ ID NO: 568069 - RNA, 22 nt, Human
auuaagacugcccauguuuuua

SEQ ID NO: 568070 - RNA, 22 nt, Human
cagaaacuucuggugucaaaua

SEQ ID NO: 568071 - RNA, 22 nt, Human
ccacugagaccuuuuggaggag

SEQ ID NO: 568072 - RNA, 19 nt, Human
aggcagaggcuuggcuagc

SEQ ID NO: 568073 - RNA, 22 nt, Human
aggcugugcacagggcaccugc

SEQ ID NO: 568074 - RNA, 22 nt, Human
uucucuugugccaaguuguugc

SEQ ID NO: 568075 - RNA, 21 nt, Human
uucuacaggaugaaugaaaac

SEQ ID NO: 568076 - RNA, 22 nt, Human
uucauaguguuuccuuccagug

SEQ ID NO: 568077 - RNA, 22 nt, Human
aacauguagcagaaacgacuaa

SEQ ID NO: 568078 - RNA, 22 nt, Human
aacuuucuuucacagaaguauc

SEQ ID NO: 568079 - RNA, 22 nt, Human
ccuguacacggucuaugccucc

SEQ ID NO: 568080 - RNA, 22 nt, Human
cucaggagcuuccucagcccau

SEQ ID NO: 568081 - RNA, 22 nt, Human
uuuacacauaccucuuuaaagu

SEQ ID NO: 568082 - RNA, 22 nt, Human
aaaacuguaggaauugggugcc

SEQ ID NO: 568083 - RNA, 22 nt, Human
auuuauuauugugguuacuucu

SEQ ID NO: 568084 - RNA, 22 nt, Human
aucuggaaaacacaguguagac

SEQ ID NO: 568085 - RNA, 22 nt, Human
aacaacuugcguucagagaugu

SEQ ID NO: 568086 - RNA, 22 nt, Human
acuguacacagugguguacugu

SEQ ID NO: 568087 - RNA, 19 nt, Human
agacucugugugagacuuu

SEQ ID NO: 568088 - RNA, 23 nt, Human
cagaggcaucggauucaacauca

SEQ ID NO: 568089 - RNA, 21 nt, Human
agaaaaacacgauauaagccc

SEQ ID NO: 568090 - RNA, 22 nt, Human
auucuacaacccaauaauaauu

SEQ ID NO: 568091 - RNA, 22 nt, Human
uuucuauuuacagugcuaggua

SEQ ID NO: 568092 - RNA, 22 nt, Human
acauuucuaguuguucaucucc

SEQ ID NO: 568093 - RNA, 22 nt, Human
acauuucugucuuagggacugu

SEQ ID NO: 568094 - RNA, 22 nt, Human
ucaagucuugaugagacaaacc

SEQ ID NO: 568095 - RNA, 22 nt, Human
uucuucauggguucuuuuagga

SEQ ID NO: 568096 - RNA, 22 nt, Human
ggcagagguagcuggaaccagg

SEQ ID NO: 568097 - RNA, 22 nt, Human
aguuucuaacauauagcauugg

SEQ ID NO: 568098 - RNA, 22 nt, Human
acuguacauguaaacauuguca

SEQ ID NO: 568099 - RNA, 22 nt, Human
cuacaagauuuuuaaaacugua

SEQ ID NO: 568100 - RNA, 22 nt, Human
ucuguacaugaguugagaauca

SEQ ID NO: 568101 - RNA, 22 nt, Human
uucaaguucauguguagucagu

SEQ ID NO: 568102 - RNA, 21 nt, Human
uaaaacuguaacuuuguccug

SEQ ID NO: 568103 - RNA, 22 nt, Human
cauuucuagacaaguccuggag

SEQ ID NO: 568104 - RNA, 22 nt, Human
ucaggagacuuaugucacagug

SEQ ID NO: 568105 - RNA, 22 nt, Human
ugugccuacugauagagccaag

SEQ ID NO: 568106 - RNA, 22 nt, Human
uaaacaagcugucugauauucu

SEQ ID NO: 568107 - RNA, 22 nt, Human
auugauaucaguuugcugauug

SEQ ID NO: 568108 - RNA, 22 nt, Human
acuguacacauucgucaagacu

SEQ ID NO: 568109 - RNA, 22 nt, Human
ccuguacaucugcucucauugc

SEQ ID NO: 568110 - RNA, 17 nt, Human
gguucaguucugcauuc

SEQ ID NO: 568111 - RNA, 22 nt, Human
cagcugaguuuccaagucugcc

SEQ ID NO: 568112 - RNA, 22 nt, Human
ccuguacauggccaucuuuacc

SEQ ID NO: 568113 - RNA, 22 nt, Human
uaauccaaaacugaaucugugg

SEQ ID NO: 568114 - RNA, 22 nt, Human
cuccagcugccaccagauguuu

SEQ ID NO: 568115 - RNA, 22 nt, Human
auucagaaauagaaaauuugau

SEQ ID NO: 568116 - RNA, 22 nt, Human
uuguauauauucuuaaagaugu

SEQ ID NO: 568117 - RNA, 22 nt, Human
cuacagcagagcuacacuaacu

SEQ ID NO: 568118 - RNA, 22 nt, Human
ugagcuggucacuccuucugaa

SEQ ID NO: 568119 - RNA, 22 nt, Human
uuucauugucaauaaacuguau

SEQ ID NO: 568120 - RNA, 22 nt, Human
gacuguacuugagagaggaacu

SEQ ID NO: 568121 - RNA, 22 nt, Human
auucuucugccuacuuucaucc

SEQ ID NO: 568122 - RNA, 22 nt, Human
aggcagagcugauguucuguga

SEQ ID NO: 568123 - RNA, 22 nt, Human
uccagcuggggcaguggcuggg

SEQ ID NO: 568124 - RNA, 22 nt, Human
cacagcauaaugaaauauacuu

SEQ ID NO: 568125 - RNA, 21 nt, Human
aaacugaagagacaggaacuu

SEQ ID NO: 568126 - RNA, 19 nt, Human
aaaaggaauauucuuuggg

SEQ ID NO: 568127 - RNA, 22 nt, Human
acauuucuuuucaucucuauau

SEQ ID NO: 568128 - RNA, 22 nt, Human
uucugucuucccacugaggagc

SEQ ID NO: 568129 - RNA, 22 nt, Human
acuguacacacuucucugucuu

SEQ ID NO: 568130 - RNA, 21 nt, Human
uuuauuaacaacuguggacgu

SEQ ID NO: 568131 - RNA, 22 nt, Human
aauucuauaggcaagcuauuuu

SEQ ID NO: 568132 - RNA, 22 nt, Human
acauuucugcuagaauagguga

SEQ ID NO: 568133 - RNA, 22 nt, Human
aagauuuaccacuuuauucaag

SEQ ID NO: 568134 - RNA, 22 nt, Human
ucuguacacuucagcaugcauc

SEQ ID NO: 568135 - RNA, 22 nt, Human
uacuguacucaacaugugaguu

SEQ ID NO: 568136 - RNA, 22 nt, Human
ggaggcucgcuggucgcacagc

SEQ ID NO: 568137 - RNA, 22 nt, Human
acaagaauuauuucuaguuaac

SEQ ID NO: 568138 - RNA, 22 nt, Human
ugagcugggaguggugaugagg

SEQ ID NO: 568139 - RNA, 22 nt, Human
gcuguacaguuuacuagguggg

SEQ ID NO: 568140 - RNA, 22 nt, Human
uaaggaaacaacuuguauuuuu

SEQ ID NO: 568141 - RNA, 22 nt, Human
gaaauucaggacaaagacucuu

SEQ ID NO: 568142 - RNA, 21 nt, Human
accaucuuccaugcauuauau

SEQ ID NO: 568143 - RNA, 22 nt, Human
gacaagacauugguaaagauau

SEQ ID NO: 568144 - RNA, 22 nt, Human
ugguuacacagcauguggacuu

SEQ ID NO: 568145 - RNA, 22 nt, Human
uacaggaagcacucaagaaaug

SEQ ID NO: 568146 - RNA, 22 nt, Human
uaaaaaguagugagaauggcgc

SEQ ID NO: 568147 - RNA, 23 nt, Human
gcuguacaggaaccaguuuggag

SEQ ID NO: 568148 - RNA, 22 nt, Human
agccaggauggucucgaucggc

SEQ ID NO: 568149 - RNA, 22 nt, Human
aaacaguagaaguguauuuuau

SEQ ID NO: 568150 - RNA, 21 nt, Human
uccuguaagcuuggguggcuc

SEQ ID NO: 568151 - RNA, 22 nt, Human
ucuuucuacaucauuugcuucu

SEQ ID NO: 568152 - RNA, 22 nt, Human
uuucuaguucucugccaaaaaa

SEQ ID NO: 568153 - RNA, 19 nt, Human
cuggaaugauagagaccuc

SEQ ID NO: 568154 - RNA, 22 nt, Human
aauaacaggcucaucagaugcu

SEQ ID NO: 568155 - RNA, 23 nt, Human
aaaaaaccauguaggcacucagu

SEQ ID NO: 568156 - RNA, 22 nt, Human
ucuuacagaaaauagauaacau

SEQ ID NO: 568157 - RNA, 22 nt, Human
acacuguaaauugagugcguga

SEQ ID NO: 568158 - RNA, 22 nt, Human
guccagcugaucuugacccagc

SEQ ID NO: 568159 - RNA, 22 nt, Human
caguccugcccaggcugacaga

SEQ ID NO: 568160 - RNA, 22 nt, Human
uucaggagaauuccaagaagua

SEQ ID NO: 568161 - RNA, 22 nt, Human
uuucuacagguugauggguuug

SEQ ID NO: 568162 - RNA, 22 nt, Human
aacuguaaugaauuguucauga

SEQ ID NO: 568163 - RNA, 22 nt, Human
ucugaaaauguugacuuuguuu

SEQ ID NO: 568164 - RNA, 20 nt, Human
aagaaacuugaaaguacaag

SEQ ID NO: 568165 - RNA, 19 nt, Human
acaaacugaguacacuugu

SEQ ID NO: 568166 - RNA, 17 nt, Human
gacaagacagaauucau

SEQ ID NO: 568167 - RNA, 22 nt, Human
uacuguacugcaguucugcaaa

SEQ ID NO: 568168 - RNA, 22 nt, Human
aggcagaggaaggguggauuug

SEQ ID NO: 568169 - RNA, 22 nt, Human
uuucuccaauguaucagcacac

SEQ ID NO: 568170 - RNA, 22 nt, Human
gacauaaaauucaauaauuugu

SEQ ID NO: 568171 - RNA, 22 nt, Human
acuguccauaauauuggugaac

SEQ ID NO: 568172 - RNA, 22 nt, Human
ccuuggagcggucagcacuggu

SEQ ID NO: 568173 - RNA, 22 nt, Human
gaaaaagugaccuugguagcua

SEQ ID NO: 568174 - RNA, 20 nt, Human
acagcagauaccacaacuau

SEQ ID NO: 568175 - RNA, 22 nt, Human
uuuccuuugcccaauacauguc

SEQ ID NO: 568176 - RNA, 22 nt, Human
uucaggagaaaguucaguacuu

SEQ ID NO: 568177 - RNA, 22 nt, Human
caaaguucucggcucaaguccu

SEQ ID NO: 568178 - RNA, 22 nt, Human
cucaggaguaguucagcagcug

SEQ ID NO: 568179 - RNA, 23 nt, Human
cuacaagagcaagcauggacaag

SEQ ID NO: 568180 - RNA, 22 nt, Human
cuacagaaaaucagccacaggc

SEQ ID NO: 568181 - RNA, 22 nt, Human
ccuacacaucucaccucacagg

SEQ ID NO: 568182 - RNA, 22 nt, Human
uucgaguuggcuuuauuaaacu

SEQ ID NO: 568183 - RNA, 22 nt, Human
caauuucuaacauuccauggau

SEQ ID NO: 568184 - RNA, 22 nt, Human
aaacagacugaagaguugaagc

SEQ ID NO: 568185 - RNA, 22 nt, Human
gacaagacaugugaugacauca

SEQ ID NO: 568186 - RNA, 22 nt, Human
ugaguccaccuuaguauauggg

SEQ ID NO: 568187 - RNA, 20 nt, Human
uacagucagggcacaggcag

SEQ ID NO: 568188 - RNA, 22 nt, Human
aaacucuuuccacgauuacuuu

SEQ ID NO: 568189 - RNA, 22 nt, Human
uucuaguuuagggcucuucaac

SEQ ID NO: 568190 - RNA, 22 nt, Human
ucucugaguaagugacaguuca

SEQ ID NO: 568191 - RNA, 22 nt, Human
uucuaguuaaaguauguauuag

SEQ ID NO: 568192 - RNA, 22 nt, Human
gcuguacauuuguguacacuug

SEQ ID NO: 568193 - RNA, 22 nt, Human
gaaacuuuuaaaccucaugagu

SEQ ID NO: 568194 - RNA, 22 nt, Human
aggcugugacagggucauggag

SEQ ID NO: 568195 - RNA, 22 nt, Human
cuuuggaacauacugcugagcu

SEQ ID NO: 568196 - RNA, 22 nt, Human
ccuguacaagagccaucuggau

SEQ ID NO: 568197 - RNA, 22 nt, Human
cuccagucuaguagagccugcu

SEQ ID NO: 568198 - RNA, 22 nt, Human
ccagcuuuucuuaucauuauaa

SEQ ID NO: 568199 - RNA, 22 nt, Human
aacauuucagcaaauaagaaca

SEQ ID NO: 568200 - RNA, 22 nt, Human
cauuucuauggcaaugggaaaa

SEQ ID NO: 568201 - RNA, 22 nt, Human
uuuccacugggcacggggccag

SEQ ID NO: 568202 - RNA, 22 nt, Human
gcuuuuauugucuuuacgacga

SEQ ID NO: 568203 - RNA, 21 nt, Human
ucagcuuugcaacugcacauc

SEQ ID NO: 568204 - RNA, 22 nt, Human
aacuguucuucauuuucaguau

SEQ ID NO: 568205 - RNA, 21 nt, Human
cacaagacacauaggguguuu

SEQ ID NO: 568206 - RNA, 22 nt, Human
cacuuggaggaaggccuauuca

SEQ ID NO: 568207 - RNA, 22 nt, Human
gcuuuaaauggcuugcccaagu

SEQ ID NO: 568208 - RNA, 22 nt, Human
acaucacagagcccagauaaag

SEQ ID NO: 568209 - RNA, 22 nt, Human
cuguaaaacugcuuaaguaugc

SEQ ID NO: 568210 - RNA, 22 nt, Human
aagaaaguggguaauaugauuu

SEQ ID NO: 568211 - RNA, 22 nt, Human
cuguacauaaaggaauaggugu

SEQ ID NO: 568212 - RNA, 22 nt, Human
acagacuguuugguucaugucu

SEQ ID NO: 568213 - RNA, 22 nt, Human
uggcuccaucauccaugcaaga

SEQ ID NO: 568214 - RNA, 22 nt, Human
ucaagucuggagaucuggaacu

SEQ ID NO: 568215 - RNA, 22 nt, Human
ucuccacucugagugccuuuca

SEQ ID NO: 568216 - RNA, 22 nt, Human
auaacagaugugaagugcuaau

SEQ ID NO: 568217 - RNA, 22 nt, Human
aaauguucuacuuugauaauua

SEQ ID NO: 568218 - RNA, 22 nt, Human
ucccuagucgcaucuguggaga

SEQ ID NO: 568219 - RNA, 22 nt, Human
agcaauaacagaaaacuuuccu

SEQ ID NO: 568220 - RNA, 21 nt, Human
ucuguacaucauugagucccc

SEQ ID NO: 568221 - RNA, 22 nt, Human
accaucuuaaggggacuucuua

SEQ ID NO: 568222 - RNA, 22 nt, Human
aucuuaaucgaguccaugaaaa

SEQ ID NO: 568223 - RNA, 22 nt, Human
uccacauucucuguuacagaua

SEQ ID NO: 568224 - RNA, 22 nt, Human
ucuguacaaaggcuauuuggag

SEQ ID NO: 568225 - RNA, 22 nt, Human
agaacugguggugaucaguuau

SEQ ID NO: 568226 - RNA, 22 nt, Human
acuguacauauggauucuaaga

SEQ ID NO: 568227 - RNA, 22 nt, Human
uagcauuuggacauugucaccu

SEQ ID NO: 568228 - RNA, 22 nt, Human
gcaaaaaccacaauuacuuuua

SEQ ID NO: 568229 - RNA, 22 nt, Human
auaaaaaugagggcgguagcua

SEQ ID NO: 568230 - RNA, 22 nt, Human
uuuguucacugagcaaugauua

SEQ ID NO: 568231 - RNA, 22 nt, Human
gaaaguuugccucucucuugag

SEQ ID NO: 568232 - RNA, 22 nt, Human
acauuucucuuagaguuggacu

SEQ ID NO: 568233 - RNA, 22 nt, Human
cuuggucauuucuuguccuguu

SEQ ID NO: 568234 - RNA, 22 nt, Human
uucuacuuuggacauaaaggac

SEQ ID NO: 568235 - RNA, 22 nt, Human
ucaggagauguaaccuuagcug

SEQ ID NO: 568236 - RNA, 22 nt, Human
aggcugugauuccaccacucuc

SEQ ID NO: 568237 - RNA, 22 nt, Human
uguaacaaaauaccuuggauug

SEQ ID NO: 568238 - RNA, 22 nt, Human
ccaguccuggccaguaacauga

SEQ ID NO: 568239 - RNA, 22 nt, Human
uucuaguuuugccuuaucaaca

SEQ ID NO: 568240 - RNA, 22 nt, Human
caguccuguguuaaacaagagc

SEQ ID NO: 568241 - RNA, 22 nt, Human
ggaggcuccuaagcugacuuga

SEQ ID NO: 568242 - RNA, 22 nt, Human
aaguucuacagcuucgcaggca

SEQ ID NO: 568243 - RNA, 18 nt, Human
agugucuggauauuuggg

SEQ ID NO: 568244 - RNA, 22 nt, Human
cugaaacauugcaauaacaaag

SEQ ID NO: 568245 - RNA, 22 nt, Human
cuauuaaacacuacugugcacu

SEQ ID NO: 568246 - RNA, 22 nt, Human
gucccacugggcaacuagaaaa

SEQ ID NO: 568247 - RNA, 22 nt, Human
cucuggagggaggcugagcugg

SEQ ID NO: 568248 - RNA, 22 nt, Human
aaaacauguccauacagaaacu

SEQ ID NO: 568249 - RNA, 22 nt, Human
cuguacaggucaaugauaagau

SEQ ID NO: 568250 - RNA, 22 nt, Human
cuggcuuuuagugugaagacuu

SEQ ID NO: 568251 - RNA, 19 nt, Human
agacucugccacucuucuc

SEQ ID NO: 568252 - RNA, 22 nt, Human
uccauauuaacuaaaacuagaa

SEQ ID NO: 568253 - RNA, 22 nt, Human
cauuucuaagaaggcugcacau

SEQ ID NO: 568254 - RNA, 22 nt, Human
aaaacuguaucuucuugggacu

SEQ ID NO: 568255 - RNA, 22 nt, Human
acugauacaucuguggaagugg

SEQ ID NO: 568256 - RNA, 22 nt, Human
aagaauuuuccagcaugucagu

SEQ ID NO: 568257 - RNA, 22 nt, Human
acuguaaauuuugguugcaggu

SEQ ID NO: 568258 - RNA, 22 nt, Human
acugaaaaugaauuagaaacag

SEQ ID NO: 568259 - RNA, 22 nt, Human
guucaaguucauaucucuuaac

SEQ ID NO: 568260 - RNA, 22 nt, Human
auaaaagaaguuuugguacuug

SEQ ID NO: 568261 - RNA, 22 nt, Human
ucacaagauacaguuagaagca

SEQ ID NO: 568262 - RNA, 22 nt, Human
uaggaaaagucuagauugauga

SEQ ID NO: 568263 - RNA, 22 nt, Human
uguaaguaguaauggaaggaca

SEQ ID NO: 568264 - RNA, 22 nt, Human
cacaguccagacuccuggaguu

SEQ ID NO: 568265 - RNA, 22 nt, Human
acaacugucaguaaagaauauu

SEQ ID NO: 568266 - RNA, 22 nt, Human
ugaaacaaaaguauguagcuug

SEQ ID NO: 568267 - RNA, 22 nt, Human
uaaacaaggguuacugagcaug

SEQ ID NO: 568268 - RNA, 20 nt, Human
ucagguagaucuuugagguc

SEQ ID NO: 568269 - RNA, 22 nt, Human
guaaucucagcuacuugggagg

SEQ ID NO: 568270 - RNA, 22 nt, Human
aguuucuguuaccauauuugac

SEQ ID NO: 568271 - RNA, 22 nt, Human
acuuuuuuauaaggaagaagau

SEQ ID NO: 568272 - RNA, 21 nt, Human
aucuggaagaacugguaagug

SEQ ID NO: 568273 - RNA, 22 nt, Human
ggcagcagggucuagauugaug

SEQ ID NO: 568274 - RNA, 22 nt, Human
uucuaccagaccccagacuugu

SEQ ID NO: 568275 - RNA, 17 nt, Human
agcacuaaaaugcuucc

SEQ ID NO: 568276 - RNA, 22 nt, Human
agacuguaauugacaugucagc

SEQ ID NO: 568277 - RNA, 22 nt, Human
uuuauauccaucuuugaaguaa

SEQ ID NO: 568278 - RNA, 22 nt, Human
caaaagaagcucuuggggcuag

SEQ ID NO: 568279 - RNA, 22 nt, Human
cuuuggaaaaauaccuggcaua

SEQ ID NO: 568280 - RNA, 21 nt, Human
agaauucuuaaguauucuaau

SEQ ID NO: 568281 - RNA, 22 nt, Human
gcagaggcucuuuaaugcuuag

SEQ ID NO: 568282 - RNA, 22 nt, Human
uucagucuccucauuuuacaaa

SEQ ID NO: 568283 - RNA, 22 nt, Human
ccuguacacaauuccgaggaua

SEQ ID NO: 568284 - RNA, 22 nt, Human
aauacagaggggucacaauuca

SEQ ID NO: 568285 - RNA, 22 nt, Human
aacuguaaggcuuagaacagca

SEQ ID NO: 568286 - RNA, 22 nt, Human
acuguauaaggcauagguaagc

SEQ ID NO: 568287 - RNA, 22 nt, Human
uuccacuuaguggaagggcaug

SEQ ID NO: 568288 - RNA, 22 nt, Human
aaauguuccauuauuguguaau

SEQ ID NO: 568289 - RNA, 22 nt, Human
uuuuaucagcagggauaacaag

SEQ ID NO: 568290 - RNA, 22 nt, Human
acuauacauugaauguuaaggu

SEQ ID NO: 568291 - RNA, 22 nt, Human
aggcaagaacagacaugggagu

SEQ ID NO: 568292 - RNA, 22 nt, Human
acauuucuaauuuaauguaaca

SEQ ID NO: 568293 - RNA, 22 nt, Human
uuuaccauccucuuuuagaauu

SEQ ID NO: 568294 - RNA, 19 nt, Human
aggcugugagggaggacuc

SEQ ID NO: 568295 - RNA, 22 nt, Human
aaaaacugcaauuacuuuuguc

SEQ ID NO: 568296 - RNA, 22 nt, Human
uuucuacauucaaaaacuacca

SEQ ID NO: 568297 - RNA, 22 nt, Human
ucagaaauagucuuuaaaauga

SEQ ID NO: 568298 - RNA, 22 nt, Human
acauuucuucccuuuagcagaa

SEQ ID NO: 568299 - RNA, 22 nt, Human
ucuauuucgcauauaaguuuug

SEQ ID NO: 568300 - RNA, 23 nt, Human
ucuguacaauugagaagagaaca

SEQ ID NO: 568301 - RNA, 22 nt, Human
gagaaaauagcauguguaguau

SEQ ID NO: 568302 - RNA, 22 nt, Human
aaaaacugguaacuauucccca

SEQ ID NO: 568303 - RNA, 22 nt, Human
uguuuuuccaugugcagaacaa

SEQ ID NO: 568304 - RNA, 22 nt, Human
ucagucuccuuuccucuagaca

SEQ ID NO: 568305 - RNA, 22 nt, Human
guacaaaaguuauugcgguuuu

SEQ ID NO: 568306 - RNA, 22 nt, Human
cuauugcauuugcaucuucauc

SEQ ID NO: 568307 - RNA, 22 nt, Human
ucaggaaaauacugcuuaucca

SEQ ID NO: 568308 - RNA, 22 nt, Human
cuggaaugagcagggcuuaugg

SEQ ID NO: 568309 - RNA, 22 nt, Human
cucaggaggccauucucaaggu

SEQ ID NO: 568310 - RNA, 22 nt, Human
cucaggaggaugacugccuugg

SEQ ID NO: 568311 - RNA, 16 nt, Human
aggcagagauuuaccc

SEQ ID NO: 568312 - RNA, 22 nt, Human
auaaacugaagggaacacugag

SEQ ID NO: 568313 - RNA, 22 nt, Human
acagaacugagaauucucuauc

SEQ ID NO: 568314 - RNA, 22 nt, Human
cugguuccaggauggaucuuuc

SEQ ID NO: 568315 - RNA, 22 nt, Human
acagacaaguaguucagacaag

SEQ ID NO: 568316 - RNA, 22 nt, Human
uacaaaaaauugauacugacga

SEQ ID NO: 568317 - RNA, 22 nt, Human
agacucugugcuccuugcuuuc

SEQ ID NO: 568318 - RNA, 22 nt, Human
aaauguucccaauaugaagcug

SEQ ID NO: 568319 - RNA, 22 nt, Human
guuuaauuuuagguugucaagc

SEQ ID NO: 568320 - RNA, 22 nt, Human
ucuuuugagggccagaggaaga

SEQ ID NO: 568321 - RNA, 19 nt, Human
gcuuuaguuuacucaucua

SEQ ID NO: 568322 - RNA, 22 nt, Human
acuguacaacugcugagcagaa

SEQ ID NO: 568323 - RNA, 22 nt, Human
ugaucaguguugguucuaucua

SEQ ID NO: 568324 - RNA, 22 nt, Human
ugaguccaagagccagugggaa

SEQ ID NO: 568325 - RNA, 21 nt, Human
uacaagaccggauucgggccc

SEQ ID NO: 568326 - RNA, 22 nt, Human
aaacuguaggagggaaaggaag

SEQ ID NO: 568327 - RNA, 22 nt, Human
cucaggagaugacagaagguau

SEQ ID NO: 568328 - RNA, 18 nt, Human
acaguaaagaaaggaauu

SEQ ID NO: 568329 - RNA, 22 nt, Human
uagcauuucccaaaugcauuug

SEQ ID NO: 568330 - RNA, 22 nt, Human
auguaacacccacuuuuauagc

SEQ ID NO: 568331 - RNA, 22 nt, Human
cucaggaggugguagaggcccu

SEQ ID NO: 568332 - RNA, 22 nt, Human
ugcacaucuuucagcaucauac

SEQ ID NO: 568333 - RNA, 22 nt, Human
uucaggaggugagcaagaaggg

SEQ ID NO: 568334 - RNA, 22 nt, Human
aagaauguucauuaaacuguug

SEQ ID NO: 568335 - RNA, 22 nt, Human
caccugagcacuggggccgccc

SEQ ID NO: 568336 - RNA, 22 nt, Human
gaaauucacuguauuucuuggg

SEQ ID NO: 568337 - RNA, 20 nt, Human
uuuuauauguaggguauaug

SEQ ID NO: 568338 - RNA, 22 nt, Human
gaagaacugugacagaagcagu

SEQ ID NO: 568339 - RNA, 22 nt, Human
uaagacaauucuucagucacaa

SEQ ID NO: 568340 - RNA, 20 nt, Human
auucuacaagaauaagcaug

SEQ ID NO: 568341 - RNA, 22 nt, Human
ggaaacagagggcaccugagcc

SEQ ID NO: 568342 - RNA, 22 nt, Human
agacucugauucccucauguca

SEQ ID NO: 568343 - RNA, 22 nt, Human
uaggaaaaauacagaauuauau

SEQ ID NO: 568344 - RNA, 22 nt, Human
caaaauucugcauuucuaauaa

SEQ ID NO: 568345 - RNA, 17 nt, Human
aucuggaagcuagcuga

SEQ ID NO: 568346 - RNA, 21 nt, Human
ccugucuuggacugaggcacc

SEQ ID NO: 568347 - RNA, 21 nt, Human
ucugagaacuucugcugcagc

SEQ ID NO: 568348 - RNA, 22 nt, Human
caggagacuauggcccaaggcc

SEQ ID NO: 568349 - RNA, 21 nt, Human
acuuugggcacuuuccugccc

SEQ ID NO: 568350 - RNA, 22 nt, Human
acagaacugcaggaggaaaagc

SEQ ID NO: 568351 - RNA, 22 nt, Human
ugucucaucucuuaaccccacu

SEQ ID NO: 568352 - RNA, 22 nt, Human
ccagucugaggccuggugaggg

SEQ ID NO: 568353 - RNA, 22 nt, Human
cugagcugcuuugcuuuugggg

SEQ ID NO: 568354 - RNA, 21 nt, Human
uguuuauggaaaagagacaaa

SEQ ID NO: 568355 - RNA, 22 nt, Human
cuacaggucaguaagaccuaga

SEQ ID NO: 568356 - RNA, 22 nt, Human
ugaaggaaaugacggcagaaga

SEQ ID NO: 568357 - RNA, 23 nt, Human
cauguacacacagcuguacagug

SEQ ID NO: 568358 - RNA, 22 nt, Human
aacuguaagacaaaugacuucu

SEQ ID NO: 568359 - RNA, 22 nt, Human
aaaaacuguaauuacuuuugca

SEQ ID NO: 568360 - RNA, 22 nt, Human
ccaguucugacacaagcacagu

SEQ ID NO: 568361 - RNA, 22 nt, Human
uauuucuaagcuguaagucuga

SEQ ID NO: 568362 - RNA, 22 nt, Human
uucuaguucccucuggaaugua

SEQ ID NO: 568363 - RNA, 22 nt, Human
guggaaguagauuugagaaggu

SEQ ID NO: 568364 - RNA, 22 nt, Human
acauaaaggugacuaacaucuu

SEQ ID NO: 568365 - RNA, 22 nt, Human
aagacuguacauuuuccagucu

SEQ ID NO: 568366 - RNA, 22 nt, Human
aaacuagagcaugugaguggga

SEQ ID NO: 568367 - RNA, 22 nt, Human
auacuguaucacuugugaguga

SEQ ID NO: 568368 - RNA, 22 nt, Human
ucugaaaugcaggcaauuugcu

SEQ ID NO: 568369 - RNA, 22 nt, Human
gaaaacugugauuagaaugccu

SEQ ID NO: 568370 - RNA, 22 nt, Human
uggcuugucauguaucugaggc

SEQ ID NO: 568371 - RNA, 21 nt, Human
uuuauuuauauaggacacaug

SEQ ID NO: 568372 - RNA, 23 nt, Human
uuuuccagaaucgacucuguaga

SEQ ID NO: 568373 - RNA, 22 nt, Human
agacuguacuuucugcagcucu

SEQ ID NO: 568374 - RNA, 22 nt, Human
uuuccacuguagagauguugaa

SEQ ID NO: 568375 - RNA, 22 nt, Human
ggagugacucacagcugggaca

SEQ ID NO: 568376 - RNA, 22 nt, Human
ugagacaguucugcagcugggu

SEQ ID NO: 568377 - RNA, 22 nt, Human
ucuuauuauuguuguaaaagca

SEQ ID NO: 568378 - RNA, 22 nt, Human
guuucuuuugugaucaccaacc

SEQ ID NO: 568379 - RNA, 22 nt, Human
caaaaacugcaauuacuuuuac

SEQ ID NO: 568380 - RNA, 22 nt, Human
uuggccacacucacuagagccc

SEQ ID NO: 568381 - RNA, 22 nt, Human
gcuuuuauuucuucacaaaagu

SEQ ID NO: 568382 - RNA, 22 nt, Human
cucuccagaucugcugagccag

SEQ ID NO: 568383 - RNA, 22 nt, Human
aguuucuauuuucaugucuguu

SEQ ID NO: 568384 - RNA, 22 nt, Human
cugagcugguucucuugugaaa

SEQ ID NO: 568385 - RNA, 22 nt, Human
cauuuguacagaacagcuuuau

SEQ ID NO: 568386 - RNA, 22 nt, Human
acuguaaccaguguggugagag

SEQ ID NO: 568387 - RNA, 22 nt, Human
aauguacaaaccuucuuuguag

SEQ ID NO: 568388 - RNA, 22 nt, Human
ugacaaaacugcaauuacuuuu

SEQ ID NO: 568389 - RNA, 22 nt, Human
cagcugaguuacucugaggucu

SEQ ID NO: 568390 - RNA, 18 nt, Human
cugucuuuuuucucucca

SEQ ID NO: 568391 - RNA, 22 nt, Human
aacaugaaaaccuccacagcaa

SEQ ID NO: 568392 - RNA, 22 nt, Human
aaagacugcaaaaacgcacaga

SEQ ID NO: 568393 - RNA, 22 nt, Human
ucugaaaugcaaauuugacuga

SEQ ID NO: 568394 - RNA, 22 nt, Human
ucuguaaucaagauauuugaga

SEQ ID NO: 568395 - RNA, 22 nt, Human
cacuguacugugaauaaggagg

SEQ ID NO: 568396 - RNA, 22 nt, Human
gcuguacaucacaauuugcugu

SEQ ID NO: 568397 - RNA, 22 nt, Human
cugagcugagccaaaucugucu

SEQ ID NO: 568398 - RNA, 22 nt, Human
uauugaaauccauuacguucuu

SEQ ID NO: 568399 - RNA, 22 nt, Human
cucaggaguuggaggcuacagu

SEQ ID NO: 568400 - RNA, 22 nt, Human
auacaaagcuuucugucuggua

SEQ ID NO: 568401 - RNA, 22 nt, Human
uucuaauuguguuugcauaucu

SEQ ID NO: 568402 - RNA, 22 nt, Human
uccagucucuacucugagauaa

SEQ ID NO: 568403 - RNA, 22 nt, Human
aacauuucuucugaaacugagu

SEQ ID NO: 568404 - RNA, 22 nt, Human
acauuucucccugcaugccugc

SEQ ID NO: 568405 - RNA, 23 nt, Human
agaaaaguucauaccuuuuuaac

SEQ ID NO: 568406 - RNA, 22 nt, Human
gacauaaaccuugagauauuaa

SEQ ID NO: 568407 - RNA, 22 nt, Human
uauccaauucaccauugauggg

SEQ ID NO: 568408 - RNA, 22 nt, Human
uucuacacucacccagcuguaa

SEQ ID NO: 568409 - RNA, 22 nt, Human
aagcuuuaaggaauuuuaugga

SEQ ID NO: 568410 - RNA, 22 nt, Human
aggcucuggcaacagcuggugu

SEQ ID NO: 568411 - RNA, 22 nt, Human
ucuaccacuaagugugcuuuga

SEQ ID NO: 568412 - RNA, 22 nt, Human
acauuucugagcagggagcugu

SEQ ID NO: 568413 - RNA, 22 nt, Human
caugaaaaauuuacuguuaaca

SEQ ID NO: 568414 - RNA, 22 nt, Human
cacuguacuggguugaaggacg

SEQ ID NO: 568415 - RNA, 22 nt, Human
aagucaaucacaugcacacuga

SEQ ID NO: 568416 - RNA, 22 nt, Human
agggagaagguuuagcugugag

SEQ ID NO: 568417 - RNA, 22 nt, Human
augucuuucaaauucugccuag

SEQ ID NO: 568418 - RNA, 22 nt, Human
gcuguacaaauuccacaagaga

SEQ ID NO: 568419 - RNA, 22 nt, Human
aagacugucugggacaagauga

SEQ ID NO: 568420 - RNA, 22 nt, Human
ggcagaggaaggaugaauucac

SEQ ID NO: 568421 - RNA, 22 nt, Human
aaacuguaaauacuaguaagug

SEQ ID NO: 568422 - RNA, 22 nt, Human
cagagcuguauuuaucuuucca

SEQ ID NO: 568423 - RNA, 22 nt, Human
ugcuuccagcucucuguaaggu

SEQ ID NO: 568424 - RNA, 22 nt, Human
gaacuguauaggagcaguguuu

SEQ ID NO: 568425 - RNA, 22 nt, Human
aauaagaauuuacuugucaaga

SEQ ID NO: 568426 - RNA, 22 nt, Human
aguuucuauguaagcuacguga

SEQ ID NO: 568427 - RNA, 20 nt, Human
ucauuucuugggguuccaag

SEQ ID NO: 568428 - RNA, 22 nt, Human
aaacuugauuuagaacuaaggc

SEQ ID NO: 568429 - RNA, 22 nt, Human
acauuucucagggaguuuugcu

SEQ ID NO: 568430 - RNA, 22 nt, Human
aucagucuguguuagaaaagag

SEQ ID NO: 568431 - RNA, 22 nt, Human
acuguacuuuucuuggcuagau

SEQ ID NO: 568432 - RNA, 21 nt, Human
ugcaggagucugugagucagg

SEQ ID NO: 568433 - RNA, 22 nt, Human
acccucaacaaauucacucuau

SEQ ID NO: 568434 - RNA, 22 nt, Human
uguauuccaaaaugcugaggau

SEQ ID NO: 568435 - RNA, 22 nt, Human
uggaaacuaagacuagagagac

SEQ ID NO: 568436 - RNA, 22 nt, Human
cagugcuguuguaagcucauug

SEQ ID NO: 568437 - RNA, 19 nt, Human
caaguucuggagauuaggg

SEQ ID NO: 568438 - RNA, 22 nt, Human
aagucaauuaguaaacuuggaa

SEQ ID NO: 568439 - RNA, 22 nt, Human
acaugaaaagacuaucugauua

SEQ ID NO: 568440 - RNA, 22 nt, Human
ucaggaaagaguguauccauca

SEQ ID NO: 568441 - RNA, 22 nt, Human
cucaggaggaggaaguucauug

SEQ ID NO: 568442 - RNA, 22 nt, Human
uaaagccacuucauucuagucu

SEQ ID NO: 568443 - RNA, 22 nt, Human
acaggccugugugcacacgagg

SEQ ID NO: 568444 - RNA, 22 nt, Human
auuguacagaugagguaaguga

SEQ ID NO: 568445 - RNA, 22 nt, Human
agugcaauguguacagaaaaau

SEQ ID NO: 568446 - RNA, 22 nt, Human
uaccacuacauuugcuaauggc

SEQ ID NO: 568447 - RNA, 22 nt, Human
ucuguacaccaggggccauucu

SEQ ID NO: 568448 - RNA, 22 nt, Human
gguuccccaggcggcccuugga

SEQ ID NO: 568449 - RNA, 22 nt, Human
uuccagcuaacucacaucccuu

SEQ ID NO: 568450 - RNA, 22 nt, Human
ucuguacauuuguguugugaau

SEQ ID NO: 568451 - RNA, 22 nt, Human
cugucuuugguccugucuguua

SEQ ID NO: 568452 - RNA, 20 nt, Human
gugcaauggcgcaaucucgg

SEQ ID NO: 568453 - RNA, 22 nt, Human
cucaggagguuuccugucuagg

SEQ ID NO: 568454 - RNA, 22 nt, Human
uuuuauucucaagacaauggga

SEQ ID NO: 568455 - RNA, 22 nt, Human
ucugucuuugagaucucagccu

SEQ ID NO: 568456 - RNA, 22 nt, Human
gacaagacuauguagaaaguau

SEQ ID NO: 568457 - RNA, 22 nt, Human
gcagaggccaucaacuuugcca

SEQ ID NO: 568458 - RNA, 22 nt, Human
ggcagagacuggguuggcagag

SEQ ID NO: 568459 - RNA, 23 nt, Human
aggagaagagauuuccacaugca

SEQ ID NO: 568460 - RNA, 20 nt, Human
uuucauugucagaaucuuau

SEQ ID NO: 568461 - RNA, 22 nt, Human
uaucugcaucugcauguguauu

SEQ ID NO: 568462 - RNA, 22 nt, Human
aagagcugugggugguaguccu

SEQ ID NO: 568463 - RNA, 22 nt, Human
aaacaguauuaucaauauauuu

SEQ ID NO: 568464 - RNA, 22 nt, Human
aaaaguuaccucuguaauauaa

SEQ ID NO: 568465 - RNA, 22 nt, Human
uaaaacugaauacauacugagg

SEQ ID NO: 568466 - RNA, 22 nt, Human
aauuuguuacacagcaauauaa

SEQ ID NO: 568467 - RNA, 22 nt, Human
gguucaguuuacauuaaaaucu

SEQ ID NO: 568468 - RNA, 20 nt, Human
agggcagagggauuacaggc

SEQ ID NO: 568469 - RNA, 22 nt, Human
auguucuaaucccugcuaugua

SEQ ID NO: 568470 - RNA, 22 nt, Human
aaaguucucuaugguguaaaaa

SEQ ID NO: 568471 - RNA, 22 nt, Human
ggcaggagcucuccaguuugcc

SEQ ID NO: 568472 - RNA, 22 nt, Human
cauuucuacagcuucuucagaa

SEQ ID NO: 568473 - RNA, 22 nt, Human
aagaaaacguuuugaggaguuu

SEQ ID NO: 568474 - RNA, 22 nt, Human
aagaagaaguguuauuuuuaga

SEQ ID NO: 568475 - RNA, 22 nt, Human
uugaaaaaauugguagaggaug

SEQ ID NO: 568476 - RNA, 22 nt, Human
gcgguagcucaagcuuguaauc

SEQ ID NO: 568477 - RNA, 22 nt, Human
acaguccuguacaggccauauc

SEQ ID NO: 568478 - RNA, 22 nt, Human
auuuaacaagacagagaacugg

SEQ ID NO: 568479 - RNA, 22 nt, Human
gcagaauguaggccuucagugu

SEQ ID NO: 568480 - RNA, 22 nt, Human
uaacagcucuguguggcuguaa

SEQ ID NO: 568481 - RNA, 22 nt, Human
uucugucugauggugccagaac

SEQ ID NO: 568482 - RNA, 22 nt, Human
acuguacaaccucugccccugu

SEQ ID NO: 568483 - RNA, 22 nt, Human
ucuuuuaucuguuguguaacaa

SEQ ID NO: 568484 - RNA, 22 nt, Human
aaacuguaagagaauaaacuac

SEQ ID NO: 568485 - RNA, 22 nt, Human
gugcaaugugcuucgugccaug

SEQ ID NO: 568486 - RNA, 20 nt, Human
aacacugugcgugguaggug

SEQ ID NO: 568487 - RNA, 22 nt, Human
agaggaaaaugaguuccagaau

SEQ ID NO: 568488 - RNA, 22 nt, Human
gaacauuuaugaugcaauaccu

SEQ ID NO: 568489 - RNA, 22 nt, Human
guguuaaccagcuaaacuuugc

SEQ ID NO: 568490 - RNA, 22 nt, Human
agaaaauuagauuuuacugugu

SEQ ID NO: 568491 - RNA, 21 nt, Human
cauuucuauugaugagaaaag

SEQ ID NO: 568492 - RNA, 19 nt, Human
gcuguacaguaaggagaca

SEQ ID NO: 568493 - RNA, 22 nt, Human
acuaagaccuagauacuagggg

SEQ ID NO: 568494 - RNA, 22 nt, Human
aggcagagcuaggaagaauugu

SEQ ID NO: 568495 - RNA, 22 nt, Human
auacaaaguauuaauccuggau

SEQ ID NO: 568496 - RNA, 22 nt, Human
uuucuaguccucaugcaucauu

SEQ ID NO: 568497 - RNA, 22 nt, Human
auccacccugugguggcuuucu

SEQ ID NO: 568498 - RNA, 22 nt, Human
auggcagagggauugaacagcu

SEQ ID NO: 568499 - RNA, 22 nt, Human
ugagcuggaaucuucuugacug

SEQ ID NO: 568500 - RNA, 22 nt, Human
gcuguacaaggccucugccauc

SEQ ID NO: 568501 - RNA, 22 nt, Human
ugggaaugugagcauucauuca

SEQ ID NO: 568502 - RNA, 20 nt, Human
acuuuggggucuuucucaga

SEQ ID NO: 568503 - RNA, 22 nt, Human
ccuguauuagguagacaacuau

SEQ ID NO: 568504 - RNA, 22 nt, Human
ccuguacagugaaugaauguga

SEQ ID NO: 568505 - RNA, 22 nt, Human
cuuggucauuuggggcugcuau

SEQ ID NO: 568506 - RNA, 22 nt, Human
uuuguucaugccuauauucuca

SEQ ID NO: 568507 - RNA, 22 nt, Human
aaagucaaaaugcucuccuguc

SEQ ID NO: 568508 - RNA, 23 nt, Human
aaagacugcugagaauuuuagga

SEQ ID NO: 568509 - RNA, 22 nt, Human
acuguucauuuggauuucucug

SEQ ID NO: 568510 - RNA, 22 nt, Human
ugaaacaagggaccguccuuuc

SEQ ID NO: 568511 - RNA, 22 nt, Human
uacuguacauuccguuuguugc

SEQ ID NO: 568512 - RNA, 22 nt, Human
caauuucuuguuaauucucagg

SEQ ID NO: 568513 - RNA, 22 nt, Human
cuguaaaacacuguaguaucug

SEQ ID NO: 568514 - RNA, 22 nt, Human
uuauuuauucauucugucuguc

SEQ ID NO: 568515 - RNA, 22 nt, Human
ggagagcugguagcuggcucca

SEQ ID NO: 568516 - RNA, 22 nt, Human
ccagucuggcaggagggggaac

SEQ ID NO: 568517 - RNA, 22 nt, Human
aacuguaaagguugagugguaa

SEQ ID NO: 568518 - RNA, 18 nt, Human
acauuucuaugcuucugg

SEQ ID NO: 568519 - RNA, 22 nt, Human
cugggcaggagggcucuaugga

SEQ ID NO: 568520 - RNA, 22 nt, Human
cugagggagggacuuugagacu

SEQ ID NO: 568521 - RNA, 22 nt, Human
caguauuuucaggauuuggaag

SEQ ID NO: 568522 - RNA, 22 nt, Human
uuuauauagagauuugugcaug

SEQ ID NO: 568523 - RNA, 22 nt, Human
gacaagacaccucucuccaucc

SEQ ID NO: 568524 - RNA, 22 nt, Human
aauguuacgaucaacaacacau

SEQ ID NO: 568525 - RNA, 22 nt, Human
acuguacaaauauugcaaaaua

SEQ ID NO: 568526 - RNA, 22 nt, Human
ccuguacauuagcugugaauug

SEQ ID NO: 568527 - RNA, 22 nt, Human
gcugugagcugccugugucaca

SEQ ID NO: 568528 - RNA, 18 nt, Human
acauuucuaggugaaagc

SEQ ID NO: 568529 - RNA, 22 nt, Human
aggcagagagcaguggccgucu

SEQ ID NO: 568530 - RNA, 22 nt, Human
cugcuuccaugcaauggcaguc

SEQ ID NO: 568531 - RNA, 22 nt, Human
acacuguagcugagggcaugcg

SEQ ID NO: 568532 - RNA, 22 nt, Human
cucaggagacaguguccacaug

SEQ ID NO: 568533 - RNA, 22 nt, Human
aaaguucagugccuucuauaca

SEQ ID NO: 568534 - RNA, 22 nt, Human
uucugucucccugauguagagc

SEQ ID NO: 568535 - RNA, 22 nt, Human
ugcagcugaggccagcuaugcc

SEQ ID NO: 568536 - RNA, 22 nt, Human
ucuguacaguaccagauaguaa

SEQ ID NO: 568537 - RNA, 22 nt, Human
cugcuuccauggucuggagacu

SEQ ID NO: 568538 - RNA, 22 nt, Human
ucagaaugaaauuucuuucaga

SEQ ID NO: 568539 - RNA, 22 nt, Human
acaagauuuuaugacucuuuuu

SEQ ID NO: 568540 - RNA, 22 nt, Human
uaaucacagaaacagacuguuu

SEQ ID NO: 568541 - RNA, 22 nt, Human
cagcugagcaucacuagucugg

SEQ ID NO: 568542 - RNA, 19 nt, Human
ugaaacaaacuuaaaagga

SEQ ID NO: 568543 - RNA, 22 nt, Human
agacuguagggauagaggucuu

SEQ ID NO: 568544 - RNA, 22 nt, Human
ucugaaauguucucuuguuuug

SEQ ID NO: 568545 - RNA, 22 nt, Human
cacaagacuuauuuguguagaa

SEQ ID NO: 568546 - RNA, 22 nt, Human
caaaacugucuagagagagaag

SEQ ID NO: 568547 - RNA, 22 nt, Human
uagcauuucacugaucuucacu

SEQ ID NO: 568548 - RNA, 22 nt, Human
gguuccacgguguuuggaggca

SEQ ID NO: 568549 - RNA, 22 nt, Human
cuauuacaauucugcaaggagu

SEQ ID NO: 568550 - RNA, 22 nt, Human
gcaaaaaccacaauuacuuuug

SEQ ID NO: 568551 - RNA, 22 nt, Human
guuauauauaguauuucucuga

SEQ ID NO: 568552 - RNA, 22 nt, Human
uucuaguucauauucucaaaga

SEQ ID NO: 568553 - RNA, 22 nt, Human
aacuguaauuuuuacauaguaa

SEQ ID NO: 568554 - RNA, 22 nt, Human
auggcagaauuaggauuucaag

SEQ ID NO: 568555 - RNA, 22 nt, Human
uucuaguuuucaguccaccagg

SEQ ID NO: 568556 - RNA, 22 nt, Human
cuggaauguagagacagcuuag

SEQ ID NO: 568557 - RNA, 22 nt, Human
gguuugguuuuggccaucuucc

SEQ ID NO: 568558 - RNA, 17 nt, Human
ccugucuuguuucugcc

SEQ ID NO: 568559 - RNA, 22 nt, Human
uucuaccagcuacucacugaua

SEQ ID NO: 568560 - RNA, 22 nt, Human
auuuuuuagaaccuggccugau

SEQ ID NO: 568561 - RNA, 22 nt, Human
caggaaugacccaacaguuuca

SEQ ID NO: 568562 - RNA, 22 nt, Human
ucauuucuaucuaugcagcuuc

SEQ ID NO: 568563 - RNA, 22 nt, Human
cagguccuggcaucaggcaggu

SEQ ID NO: 568564 - RNA, 22 nt, Human
acagauccugguuacagccauu

SEQ ID NO: 568565 - RNA, 22 nt, Human
gacuguacgucauugaaggcca

SEQ ID NO: 568566 - RNA, 22 nt, Human
aaacuguaaagcaggugaguag

SEQ ID NO: 568567 - RNA, 22 nt, Human
uuaguaauguguuaauaugaau

SEQ ID NO: 568568 - RNA, 22 nt, Human
cuacagguaugugcaugacauc

SEQ ID NO: 568569 - RNA, 22 nt, Human
aacacuguggucuuuucaguaa

SEQ ID NO: 568570 - RNA, 22 nt, Human
gaacauuuccagaaaggaacua

SEQ ID NO: 568571 - RNA, 22 nt, Human
aguuucuagccucacuguuuag

SEQ ID NO: 568572 - RNA, 22 nt, Human
ugcucagugagucugugacagg

SEQ ID NO: 568573 - RNA, 22 nt, Human
ccuguacuagggucucauugcc

SEQ ID NO: 568574 - RNA, 20 nt, Human
aggcagagcgcacuuuuaga

SEQ ID NO: 568575 - RNA, 22 nt, Human
uucugaaaggcagguuguuugc

SEQ ID NO: 568576 - RNA, 23 nt, Human
uugcuuagagaccuccucaucag

SEQ ID NO: 568577 - RNA, 22 nt, Human
ccuguacaagcucuuggugaca

SEQ ID NO: 568578 - RNA, 19 nt, Human
ggcagacacaguugacaug

SEQ ID NO: 568579 - RNA, 19 nt, Human
cucuccagcuccaguagcu

SEQ ID NO: 568580 - RNA, 22 nt, Human
auaauacaugguugaucuuuuc

SEQ ID NO: 568581 - RNA, 22 nt, Human
acuuuggguaagccaggugcua

SEQ ID NO: 568582 - RNA, 22 nt, Human
uuagaucuuaggcaaauguguu

SEQ ID NO: 568583 - RNA, 22 nt, Human
gcuguacaggguuauccuuucc

SEQ ID NO: 568584 - RNA, 22 nt, Human
cugucugucaccaaaacagacu

SEQ ID NO: 568585 - RNA, 20 nt, Human
gucuccacuggggguuaacc

SEQ ID NO: 568586 - RNA, 22 nt, Human
aacacuguacuggaagauggac

SEQ ID NO: 568587 - RNA, 20 nt, Human
gugcaauggcucagucucag

SEQ ID NO: 568588 - RNA, 22 nt, Human
ucuaccacuuauuagcucugug

SEQ ID NO: 568589 - RNA, 22 nt, Human
gaaagacauaguugcaagaugg

SEQ ID NO: 568590 - RNA, 21 nt, Human
acagcagagaucaagacuaag

SEQ ID NO: 568591 - RNA, 22 nt, Human
gcaaaaacugcaauuacuuuug

SEQ ID NO: 568592 - RNA, 22 nt, Human
uucuaccauugggaaaacagcc

SEQ ID NO: 568593 - RNA, 22 nt, Human
gaaauugucagcuucuuucagu

SEQ ID NO: 568594 - RNA, 22 nt, Human
uucuaguucccacauaguugcc

SEQ ID NO: 568595 - RNA, 22 nt, Human
augaaacaaaccucuauggagu

SEQ ID NO: 568596 - RNA, 22 nt, Human
caguuccuaugggcaaaacaca

SEQ ID NO: 568597 - RNA, 22 nt, Human
ggcaggaggaagaguuagcacc

SEQ ID NO: 568598 - RNA, 22 nt, Human
uugacaaaggaccuugcuauuu

SEQ ID NO: 568599 - RNA, 22 nt, Human
ucugucuuagcaucuuugcuca

SEQ ID NO: 568600 - RNA, 22 nt, Human
uucuacuuuagcaugcucauuc

SEQ ID NO: 568601 - RNA, 22 nt, Human
aaacucuuccuuucuuuaaagu

SEQ ID NO: 568602 - RNA, 22 nt, Human
uucuggaaguguuagaaucugg

SEQ ID NO: 568603 - RNA, 22 nt, Human
caguccugagccaaucaugaug

SEQ ID NO: 568604 - RNA, 22 nt, Human
auguaacauugaauuauauagu

SEQ ID NO: 568605 - RNA, 22 nt, Human
cuccagcuucccucagcugugg

SEQ ID NO: 568606 - RNA, 22 nt, Human
cugagcugacaucuuccucuuu

SEQ ID NO: 568607 - RNA, 22 nt, Human
uacaagaugacaggugcaugau

SEQ ID NO: 568608 - RNA, 22 nt, Human
caguucuaauuaauaggaguaa

SEQ ID NO: 568609 - RNA, 22 nt, Human
aagacuguaugagacaauauaa

SEQ ID NO: 568610 - RNA, 22 nt, Human
gaacaaacacaucccagcagug

SEQ ID NO: 568611 - RNA, 22 nt, Human
uaaggaaaguacauguuuugac

SEQ ID NO: 568612 - RNA, 22 nt, Human
ugaaacaaaccaguaauuuugu

SEQ ID NO: 568613 - RNA, 22 nt, Human
uaaaacugcuugguauggucua

SEQ ID NO: 568614 - RNA, 22 nt, Human
auacaagacucagcacagacgg

SEQ ID NO: 568615 - RNA, 22 nt, Human
cacuguacccauuuaaauaaau

SEQ ID NO: 568616 - RNA, 22 nt, Human
uggcacauagcagguacucagu

SEQ ID NO: 568617 - RNA, 22 nt, Human
cagucucugugccagauccugg

SEQ ID NO: 568618 - RNA, 22 nt, Human
acuuugcugcagguuuaaagag

SEQ ID NO: 568619 - RNA, 22 nt, Human
ucauuucuauugcuacugucug

SEQ ID NO: 568620 - RNA, 22 nt, Human
ucauuucucugagucugauaau

SEQ ID NO: 568621 - RNA, 23 nt, Human
aaauauucuuuuuuaguaagugc

SEQ ID NO: 568622 - RNA, 22 nt, Human
gcuguacauucuguggguuugg

SEQ ID NO: 568623 - RNA, 22 nt, Human
uauuucuauuccccaggcaagu

SEQ ID NO: 568624 - RNA, 22 nt, Human
acuaaaaacuacugccaauagc

SEQ ID NO: 568625 - RNA, 22 nt, Human
aaagucaaugauuucuccugga

SEQ ID NO: 568626 - RNA, 22 nt, Human
auuaaacaauguaaaguucuug

SEQ ID NO: 568627 - RNA, 22 nt, Human
aaauuuucucucuaagacuuaa

SEQ ID NO: 568628 - RNA, 22 nt, Human
uuucuauugaucuaauaaacau

SEQ ID NO: 568629 - RNA, 22 nt, Human
ugaaacaaauuuggaaaaucua

SEQ ID NO: 568630 - RNA, 22 nt, Human
aacaaguaaguuuauauauauu

SEQ ID NO: 568631 - RNA, 22 nt, Human
acuguacaugcaucuugucuau

SEQ ID NO: 568632 - RNA, 22 nt, Human
acuuuuaugauaaucaauguuc

SEQ ID NO: 568633 - RNA, 22 nt, Human
aagcaauucacaguucacuuaa

SEQ ID NO: 568634 - RNA, 22 nt, Human
ugacauuugagagagauauaca

SEQ ID NO: 568635 - RNA, 22 nt, Human
ucauccagccucaucaggagcu

SEQ ID NO: 568636 - RNA, 22 nt, Human
auguaacauaugugaucgcauu

SEQ ID NO: 568637 - RNA, 22 nt, Human
uuuggaaaugagaagccaccuu

SEQ ID NO: 568638 - RNA, 20 nt, Human
gcugugccaugacccucgag

SEQ ID NO: 568639 - RNA, 22 nt, Human
uugcaggguugacacugccugc

SEQ ID NO: 568640 - RNA, 22 nt, Human
gaaugcacacgugugugcaugc

SEQ ID NO: 568641 - RNA, 22 nt, Human
uaauccaaaacugaaucugugg

SEQ ID NO: 568642 - RNA, 22 nt, Human
acucgcggcggacggcggccag

SEQ ID NO: 568643 - RNA, 20 nt, Human
caucaacaccuugucagccu

SEQ ID NO: 568644 - RNA, 22 nt, Human
aauuauguuugcuuuagaugga

SEQ ID NO: 568645 - RNA, 22 nt, Human
auguuuguguuucccauucagg

SEQ ID NO: 568646 - RNA, 22 nt, Human
ccucucauagucuguauccuuu

SEQ ID NO: 568647 - RNA, 22 nt, Human
gaguaauuuucuuaaaacauca

SEQ ID NO: 568648 - RNA, 22 nt, Human
auacagaagaccccuccgucau

SEQ ID NO: 568649 - RNA, 22 nt, Human
ugcccacaggaagacaccagcg

SEQ ID NO: 568650 - RNA, 22 nt, Human
cauugcuuugugcauauuuaaa

SEQ ID NO: 568651 - RNA, 22 nt, Human
ugugagauuuuauuugauaugc

SEQ ID NO: 568652 - RNA, 22 nt, Human
auggcuucugucuuggaaauuu

SEQ ID NO: 568653 - RNA, 22 nt, Human
gaggagagaagcuaacggugcu

SEQ ID NO: 568654 - RNA, 22 nt, Human
cccgaccucgcaaagcgcacuc

SEQ ID NO: 568655 - RNA, 22 nt, Human
cugcagaugguauuguucuggu

SEQ ID NO: 568656 - RNA, 22 nt, Human
accagaagcuggagcacaagga

SEQ ID NO: 568657 - RNA, 22 nt, Human
caagcagauauuuuagucaaga

SEQ ID NO: 568658 - RNA, 22 nt, Human
cauccauagauugagagauggu

SEQ ID NO: 568659 - RNA, 22 nt, Human
uuauuuaaaauguagguuggga

SEQ ID NO: 568660 - RNA, 22 nt, Human
aucugucccuccucacagccuc

SEQ ID NO: 568661 - RNA, 22 nt, Human
uggcauuuuguagcuguguauc

SEQ ID NO: 568662 - RNA, 23 nt, Human
ugagagccuggcagccuggguuc

SEQ ID NO: 568663 - RNA, 22 nt, Human
uuugugcaagagggccaccuua

SEQ ID NO: 568664 - RNA, 22 nt, Human
cagccggaccugagggauuccu

SEQ ID NO: 568665 - RNA, 19 nt, Human
ucucccaugccugugucua

SEQ ID NO: 568666 - RNA, 22 nt, Human
ucuguccauucagaauggcccu

SEQ ID NO: 568667 - RNA, 22 nt, Human
ggcuguggucauuaggagguug

SEQ ID NO: 568668 - RNA, 22 nt, Human
acaggacagucuaguaacagua

SEQ ID NO: 568669 - RNA, 22 nt, Human
gaugugugugcccugggccugc

SEQ ID NO: 568670 - RNA, 22 nt, Human
ucugagagccacugaacagcaa

SEQ ID NO: 568671 - RNA, 22 nt, Human
agagcgagucuggggcucggau

SEQ ID NO: 568672 - RNA, 22 nt, Human
augaggagucaaggagucggag

SEQ ID NO: 568673 - RNA, 22 nt, Human
gaaggaagcugucuggaugugu

SEQ ID NO: 568674 - RNA, 22 nt, Human
uuaaguauauccauuugacugg

SEQ ID NO: 568675 - RNA, 22 nt, Human
aucaucaucuaaauugugucgc

SEQ ID NO: 568676 - RNA, 22 nt, Human
uacuuugagaugaugcugaucg

SEQ ID NO: 568677 - RNA, 22 nt, Human
cuagagaaaaagcuuagguacg

SEQ ID NO: 568678 - RNA, 22 nt, Human
ccugugucaucagcuguggcua

SEQ ID NO: 568679 - RNA, 22 nt, Human
gcagaggggaagcugaggaauu

SEQ ID NO: 568680 - RNA, 22 nt, Human
uuugcagagugcagaagcaucu

SEQ ID NO: 568681 - RNA, 22 nt, Human
uaaaccuuauuugaauaccaac

SEQ ID NO: 568682 - RNA, 22 nt, Human
cuaguuuuaagcuccuugaggu

SEQ ID NO: 568683 - RNA, 21 nt, Human
gcaaccagaccacagggcagu

SEQ ID NO: 568684 - RNA, 22 nt, Human
augauugaaaaugacauugcca

SEQ ID NO: 568685 - RNA, 22 nt, Human
cagagcagcagagcuuccaugg

SEQ ID NO: 568686 - RNA, 22 nt, Human
gcggggacagaaggcgguucuc

SEQ ID NO: 568687 - RNA, 22 nt, Human
uuagacagagcuccuugagggc

SEQ ID NO: 568688 - RNA, 22 nt, Human
aaaucccacucacgaguuuugc

SEQ ID NO: 568689 - RNA, 20 nt, Human
gaacagucuucugagccaca

SEQ ID NO: 568690 - RNA, 22 nt, Human
uacugcugagcuggguagaagg

SEQ ID NO: 568691 - RNA, 22 nt, Human
aggacaaaggaccagaucugga

SEQ ID NO: 568692 - RNA, 22 nt, Human
auucagaaauagaaaauuugau

SEQ ID NO: 568693 - RNA, 22 nt, Human
auccauuuuuucagaaugcucu

SEQ ID NO: 568694 - RNA, 22 nt, Human
augauuuguuaacagacuuaau

SEQ ID NO: 568695 - RNA, 22 nt, Human
uucaguuuugcuuuuaaucaug

SEQ ID NO: 568696 - RNA, 22 nt, Human
uguuccucugaacuucuuccaa

SEQ ID NO: 568697 - RNA, 21 nt, Human
cugugauguugccgggguagg

SEQ ID NO: 568698 - RNA, 22 nt, Human
uuguacacacaggaacaaacgu

SEQ ID NO: 568699 - RNA, 22 nt, Human
acagacacaggcguggagucgc

SEQ ID NO: 568700 - RNA, 22 nt, Human
gagaugugucagguccuggggg

SEQ ID NO: 568701 - RNA, 22 nt, Human
cagaguccugcaccagcuccag

SEQ ID NO: 568702 - RNA, 22 nt, Human
agacagcacuuuuguauggggg

SEQ ID NO: 568703 - RNA, 22 nt, Human
uugaacaguccuaagagacccu

SEQ ID NO: 568704 - RNA, 22 nt, Human
cagaggaccauuguauguauug

SEQ ID NO: 568705 - RNA, 22 nt, Human
gaaauguuggacacuugaaauu

SEQ ID NO: 568706 - RNA, 22 nt, Human
uucucuucacagggaucauccu

SEQ ID NO: 568707 - RNA, 22 nt, Human
gggagggcuuggacccagaugu

SEQ ID NO: 568708 - RNA, 22 nt, Human
gucuguccacuuggaagcuccc

SEQ ID NO: 568709 - RNA, 22 nt, Human
ccugucugaaggcagggggaug

SEQ ID NO: 568710 - RNA, 22 nt, Human
agcaggaggagagccuggcggu

SEQ ID NO: 568711 - RNA, 22 nt, Human
ugucuagaaaugcugagucuca

SEQ ID NO: 568712 - RNA, 22 nt, Human
gaaacauuuguugaguacuugc

SEQ ID NO: 568713 - RNA, 20 nt, Human
ggucacuguggcugcaggau

SEQ ID NO: 568714 - RNA, 22 nt, Human
caugugaauuccaaagcuaggu

SEQ ID NO: 568715 - RNA, 22 nt, Human
aggcaguggcuuuuguuguguu

SEQ ID NO: 568716 - RNA, 22 nt, Human
aucacuagaguuacauugccag

SEQ ID NO: 568717 - RNA, 20 nt, Human
aaaaacaguaaugcugaaga

SEQ ID NO: 568718 - RNA, 22 nt, Human
uggcggugacggcggcgccugg

SEQ ID NO: 568719 - RNA, 22 nt, Human
cugacagcgagagaguugcccc

SEQ ID NO: 568720 - RNA, 22 nt, Human
ccacuguuuccuuucugcuggc

SEQ ID NO: 568721 - RNA, 23 nt, Human
cagcacaguacauuuccugucuc

SEQ ID NO: 568722 - RNA, 22 nt, Human
gcagagcacccugcagugguau

SEQ ID NO: 568723 - RNA, 22 nt, Human
ucugagugggaacucucaugac

SEQ ID NO: 568724 - RNA, 22 nt, Human
agagcagaggcauggccguggg

SEQ ID NO: 568725 - RNA, 22 nt, Human
uuccuuuucuucuaccacaugu

SEQ ID NO: 568726 - RNA, 22 nt, Human
auugucgucaauggacacauag

SEQ ID NO: 568727 - RNA, 22 nt, Human
aaacccaggguuuugucuuccc

SEQ ID NO: 568728 - RNA, 22 nt, Human
aaucuguuuuaaaguuugugcc

SEQ ID NO: 568729 - RNA, 22 nt, Human
cuccacagccccuccaguggca

SEQ ID NO: 568730 - RNA, 22 nt, Human
ggcagcaggguagccauuucuc

SEQ ID NO: 568731 - RNA, 19 nt, Human
ugcucucuggugcuucaug

SEQ ID NO: 568732 - RNA, 22 nt, Human
uguagggaggaaggguuggaaa

SEQ ID NO: 568733 - RNA, 22 nt, Human
guuugagauggguuauugcucu

SEQ ID NO: 568734 - RNA, 22 nt, Human
ucuuuuccuugaugguuaaaua

SEQ ID NO: 568735 - RNA, 22 nt, Human
ugcucagaauugcgcuggugga

SEQ ID NO: 568736 - RNA, 22 nt, Human
uuagaaaaaggcuguggucuua

SEQ ID NO: 568737 - RNA, 22 nt, Human
gugggaguggagcucagcaugu

SEQ ID NO: 568738 - RNA, 22 nt, Human
agcacguucuucauuacuucac

SEQ ID NO: 568739 - RNA, 22 nt, Human
uuacaauuacuugaucucagcu

SEQ ID NO: 568740 - RNA, 22 nt, Human
agacacuguguacagaaaaaga

SEQ ID NO: 568741 - RNA, 22 nt, Human
ucucugguuauuaacuaacucc

SEQ ID NO: 568742 - RNA, 22 nt, Human
ccaggcuccccaggaggcccuu

SEQ ID NO: 568743 - RNA, 22 nt, Human
ggcagaggagcuggaaacaugg

SEQ ID NO: 568744 - RNA, 22 nt, Human
gcucagguagaugggguugucc

SEQ ID NO: 568745 - RNA, 22 nt, Human
ugcuugucacccugccugagug

SEQ ID NO: 568746 - RNA, 22 nt, Human
ggccuugggauguggcugcagc

SEQ ID NO: 568747 - RNA, 22 nt, Human
ccaaggcuggagggcuuaugua

SEQ ID NO: 568748 - RNA, 22 nt, Human
aagcagaaaaacugagcuccaa

SEQ ID NO: 568749 - RNA, 22 nt, Human
caauguuuuuccuuccuuaaua

SEQ ID NO: 568750 - RNA, 22 nt, Human
gcggggccauguccaacggccu

SEQ ID NO: 568751 - RNA, 22 nt, Human
ccuccugggccuugcucuguga

SEQ ID NO: 568752 - RNA, 19 nt, Human
gggaaugauggaagacuuc

SEQ ID NO: 568753 - RNA, 22 nt, Human
gcagggaaguuguaauguaaug

SEQ ID NO: 568754 - RNA, 22 nt, Human
caagccaggaaggauccagcac

SEQ ID NO: 568755 - RNA, 20 nt, Human
cuuguuaaauaugcagguag

SEQ ID NO: 568756 - RNA, 22 nt, Human
gcgagucgccgcugcagcccua

SEQ ID NO: 568757 - RNA, 22 nt, Human
gcccuguguguuugcacugauu

SEQ ID NO: 568758 - RNA, 22 nt, Human
ugccuggauggcucugagcagg

SEQ ID NO: 568759 - RNA, 22 nt, Human
uuucuacauuuguaaccagauu

SEQ ID NO: 568760 - RNA, 22 nt, Human
agugcuuuauguuguugugcaa

SEQ ID NO: 568761 - RNA, 22 nt, Human
auucaugcaggauugucuccaa

SEQ ID NO: 568762 - RNA, 19 nt, Human
ugcagcuguaugagcuuaa

SEQ ID NO: 568763 - RNA, 22 nt, Human
guggcauuugggagaugcgugg

SEQ ID NO: 568764 - RNA, 23 nt, Human
ugaaagcaaugggucuauaguau

SEQ ID NO: 568765 - RNA, 22 nt, Human
ucuucacaguccuggucagugg

SEQ ID NO: 568766 - RNA, 22 nt, Human
uaacuucucugagccucauucc

SEQ ID NO: 568767 - RNA, 22 nt, Human
cagagaauaaaagggcauuccu

SEQ ID NO: 568768 - RNA, 22 nt, Human
gcucgguggccagccugaggcc

SEQ ID NO: 568769 - RNA, 22 nt, Human
ucagagccccuccgcuguccca

SEQ ID NO: 568770 - RNA, 22 nt, Human
ugcacauggccugagugccuga

SEQ ID NO: 568771 - RNA, 22 nt, Human
caaauguuugguggcauuuugu

SEQ ID NO: 568772 - RNA, 22 nt, Human
gauggaggagauggcagggugc

SEQ ID NO: 568773 - RNA, 22 nt, Human
ucuccccaguauggauucucug

SEQ ID NO: 568774 - RNA, 22 nt, Human
uaaagcaaugaaaguuuugcag

SEQ ID NO: 568775 - RNA, 22 nt, Human
uuucucagccuccuugcuggag

SEQ ID NO: 568776 - RNA, 22 nt, Human
gagcugcuggccuccugcggga

SEQ ID NO: 568777 - RNA, 22 nt, Human
aacagauuguaaccugauagcc

SEQ ID NO: 568778 - RNA, 22 nt, Human
ugcacacaguucucaggaaaga

SEQ ID NO: 568779 - RNA, 22 nt, Human
ggacagacuuuacagccccggg

SEQ ID NO: 568780 - RNA, 22 nt, Human
uguuugcucugacuaucuugcg

SEQ ID NO: 568781 - RNA, 22 nt, Human
ucauuuacacuucacaaaugga

SEQ ID NO: 568782 - RNA, 22 nt, Human
cuuuacagauggauaauuguuu

SEQ ID NO: 568783 - RNA, 20 nt, Human
gcuccccuucucugggccuc

SEQ ID NO: 568784 - RNA, 22 nt, Human
cccugacccuaucagagggcca

SEQ ID NO: 568785 - RNA, 22 nt, Human
aagcauuucagguagagauauu

SEQ ID NO: 568786 - RNA, 22 nt, Human
ucguuagccucgagaucuuugu

SEQ ID NO: 568787 - RNA, 22 nt, Human
acauuuaaugauccuacuguga

SEQ ID NO: 568788 - RNA, 22 nt, Human
agaaaucugacugcugugcaca

SEQ ID NO: 568789 - RNA, 22 nt, Human
uccuucagaggacggcagccag

SEQ ID NO: 568790 - RNA, 22 nt, Human
ggggugaagguuuucugaaagc

SEQ ID NO: 568791 - RNA, 22 nt, Human
uaucauuuuacugugacauuuu

SEQ ID NO: 568792 - RNA, 22 nt, Human
gaaacacucaauuuaguaauuc

SEQ ID NO: 568793 - RNA, 22 nt, Human
gaagaaguguaagucuguuuca

SEQ ID NO: 568794 - RNA, 22 nt, Human
gcuuggccagcagccgggaugc

SEQ ID NO: 568795 - RNA, 21 nt, Human
uaagcuaaacauucaguuaac

SEQ ID NO: 568796 - RNA, 22 nt, Human
uaguggggaaggaggacaagaa

SEQ ID NO: 568797 - RNA, 22 nt, Human
auguucaaguaccuuugugucu

SEQ ID NO: 568798 - RNA, 22 nt, Human
aauguuaaguuuagauuauaac

SEQ ID NO: 568799 - RNA, 22 nt, Human
uuuacuuuugguaaggucauuu

SEQ ID NO: 568800 - RNA, 22 nt, Human
cagcuauuguucuguauaauga

SEQ ID NO: 568801 - RNA, 22 nt, Human
aucaugugacuagguuuggcca

SEQ ID NO: 568802 - RNA, 22 nt, Human
cucaucuggcuucaguaacagu

SEQ ID NO: 568803 - RNA, 22 nt, Human
auucuugauauagauaguuaau

SEQ ID NO: 568804 - RNA, 22 nt, Human
cucucagugccugcccuaggcu

SEQ ID NO: 568805 - RNA, 22 nt, Human
uuuacaaggcaguuauuuuccu

SEQ ID NO: 568806 - RNA, 22 nt, Human
cccacugcaugaguugguauua

SEQ ID NO: 568807 - RNA, 22 nt, Human
gccuggggaacuugauccuguc

SEQ ID NO: 568808 - RNA, 22 nt, Human
ccugcagacacuuguccagcaa

SEQ ID NO: 568809 - RNA, 22 nt, Human
uuauuuaaaagugguaagauuc

SEQ ID NO: 568810 - RNA, 17 nt, Human
gcguguccccgcgucuc

SEQ ID NO: 568811 - RNA, 22 nt, Human
aggaagagcuggaccagaggac

SEQ ID NO: 568812 - RNA, 22 nt, Human
aaucuguugucaggaauccaca

SEQ ID NO: 568813 - RNA, 22 nt, Human
aucauugaguaaaaugaauaca

SEQ ID NO: 568814 - RNA, 22 nt, Human
acaugcuuucuagguccuucug

SEQ ID NO: 568815 - RNA, 22 nt, Human
aagggaaacuuucacaaugucc

SEQ ID NO: 568816 - RNA, 22 nt, Human
ugugucuuuggcgaugucugga

SEQ ID NO: 568817 - RNA, 22 nt, Human
cgcagcugcugcucugaaacag

SEQ ID NO: 568818 - RNA, 22 nt, Human
ugaagcuagaauguccauauuu

SEQ ID NO: 568819 - RNA, 22 nt, Human
ugcagcugccuagggcuggcuu

SEQ ID NO: 568820 - RNA, 18 nt, Human
guagauccuugagcuacc

SEQ ID NO: 568821 - RNA, 22 nt, Human
caggaacagcaccaggagcuag

SEQ ID NO: 568822 - RNA, 22 nt, Human
aaauugcaaaaguacuuuuagg

SEQ ID NO: 568823 - RNA, 22 nt, Human
uauaagaaacaaggcaaauuuu

SEQ ID NO: 568824 - RNA, 22 nt, Human
gccggacugcugcagcugcuag

SEQ ID NO: 568825 - RNA, 22 nt, Human
aaagucuuaauguaaguuuagu

SEQ ID NO: 568826 - RNA, 22 nt, Human
ucccgggcaggucgagcgagcc

SEQ ID NO: 568827 - RNA, 22 nt, Human
gagcuguucugugauugaucua

SEQ ID NO: 568828 - RNA, 22 nt, Human
aggcagaugggagcuggaaguu

SEQ ID NO: 568829 - RNA, 22 nt, Human
uuaagguucagaaaucaauacc

SEQ ID NO: 568830 - RNA, 22 nt, Human
ugugacagugccagcuucauag

SEQ ID NO: 568831 - RNA, 22 nt, Human
ccacuguuggcccgaagggguc

SEQ ID NO: 568832 - RNA, 23 nt, Human
uuguucuuggaucuuccugaagc

SEQ ID NO: 568833 - RNA, 19 nt, Human
acacaccagugccugugac

SEQ ID NO: 568834 - RNA, 20 nt, Human
agugauuuguuaguacauug

SEQ ID NO: 568835 - RNA, 22 nt, Human
ucaucuccauacggucucgcag

SEQ ID NO: 568836 - RNA, 22 nt, Human
agugaaauaugcccauugcugu

SEQ ID NO: 568837 - RNA, 22 nt, Human
uucagaaagugaaucuuguuau

SEQ ID NO: 568838 - RNA, 22 nt, Human
accaaucuccuauuuuguuuca

SEQ ID NO: 568839 - RNA, 22 nt, Human
cggagccugcuuguugcagcug

SEQ ID NO: 568840 - RNA, 22 nt, Human
cagaaacacuguauuuagggaa

SEQ ID NO: 568841 - RNA, 22 nt, Human
gauacuugaggagaucaccaca

SEQ ID NO: 568842 - RNA, 22 nt, Human
ggucccugcccaaagcccuugg

SEQ ID NO: 568843 - RNA, 22 nt, Human
cucaugucggcaggacucgccc

SEQ ID NO: 568844 - RNA, 22 nt, Human
auagucuuagaaucuugagugu

SEQ ID NO: 568845 - RNA, 22 nt, Human
uuuacgaauggggugacaacuu

SEQ ID NO: 568846 - RNA, 22 nt, Human
gggagagcgcgcuagggccgag

SEQ ID NO: 568847 - RNA, 22 nt, Human
gagcaacacauugaaugaggau

SEQ ID NO: 568848 - RNA, 22 nt, Human
cccguguggaugcgcuggugcu

SEQ ID NO: 568849 - RNA, 22 nt, Human
agugagaguauuaaugugaacu

SEQ ID NO: 568850 - RNA, 22 nt, Human
uugaguuuccugacagcgaagg

SEQ ID NO: 568851 - RNA, 22 nt, Human
gcagcuuuggagguggaacucu

SEQ ID NO: 568852 - RNA, 23 nt, Human
uuaacaggaucucgggcaagagg

SEQ ID NO: 568853 - RNA, 23 nt, Human
uagauccuuccaacuacucuuac

SEQ ID NO: 568854 - RNA, 22 nt, Human
cagcucugguuccugggcccag

SEQ ID NO: 568855 - RNA, 22 nt, Human
ugaaaacacuuuaguuuagguc

SEQ ID NO: 568856 - RNA, 22 nt, Human
cuacauuauguuuauugggacu

SEQ ID NO: 568857 - RNA, 22 nt, Human
gucaucaucaggcagaugcugc

SEQ ID NO: 568858 - RNA, 22 nt, Human
gaucucaaagcaguguggguug

SEQ ID NO: 568859 - RNA, 22 nt, Human
agucauguguucaucuuucauu

SEQ ID NO: 568860 - RNA, 22 nt, Human
gggagcugaaggagccggcggg

SEQ ID NO: 568861 - RNA, 22 nt, Human
uccucagcaaacacuucacucu

SEQ ID NO: 568862 - RNA, 22 nt, Human
ccaccagaccaccaagagcaac

SEQ ID NO: 568863 - RNA, 22 nt, Human
gaaacuguauguaguuuuuggg

SEQ ID NO: 568864 - RNA, 22 nt, Human
gcaggggcugagcaccagcggg

SEQ ID NO: 568865 - RNA, 22 nt, Human
cucuguccugguuuauacuggc

SEQ ID NO: 568866 - RNA, 22 nt, Human
uuaguuuccuguggugugaagu

SEQ ID NO: 568867 - RNA, 22 nt, Human
auuuggcauaggcagaggccca

SEQ ID NO: 568868 - RNA, 22 nt, Human
uucucuaguuuugacgaggauu

SEQ ID NO: 568869 - RNA, 18 nt, Human
agguauaugaaucucuuu

SEQ ID NO: 568870 - RNA, 22 nt, Human
ccaagaggggaagggccgcagc

SEQ ID NO: 568871 - RNA, 22 nt, Human
cuggagcucuguguguuccuga

SEQ ID NO: 568872 - RNA, 22 nt, Human
auugaagacuugguauccgugg

SEQ ID NO: 568873 - RNA, 22 nt, Human
gcacagagagcagugggggaca

SEQ ID NO: 568874 - RNA, 22 nt, Human
uguuaccauaggucagaacguu

SEQ ID NO: 568875 - RNA, 22 nt, Human
uuauuccauagaagucaaggaa

SEQ ID NO: 568876 - RNA, 22 nt, Human
uuuuaauccucuugguaucuua

SEQ ID NO: 568877 - RNA, 22 nt, Human
uagcaggaggcaguuccucgcu

SEQ ID NO: 568878 - RNA, 22 nt, Human
gggagcugagcuggaagagaau

SEQ ID NO: 568879 - RNA, 22 nt, Human
uccuuggcaugccgucuucucc

SEQ ID NO: 568880 - RNA, 22 nt, Human
ucccuguccugggcaaucccag

SEQ ID NO: 568881 - RNA, 22 nt, Human
cuuugcuaauguugcauuuuca

SEQ ID NO: 568882 - RNA, 22 nt, Human
caggaugccuuugaacucugga

SEQ ID NO: 568883 - RNA, 20 nt, Human
aauagcacagcucaaacauu

SEQ ID NO: 568884 - RNA, 21 nt, Human
cuguccccagugagcaccccc

SEQ ID NO: 568885 - RNA, 22 nt, Human
ugcacagagggaggcauaaaau

SEQ ID NO: 568886 - RNA, 17 nt, Human
acuuguauugugcuuua

SEQ ID NO: 568887 - RNA, 22 nt, Human
ccugguccccaucggcccagcg

SEQ ID NO: 568888 - RNA, 22 nt, Human
cuucuccgacaaccgacgccgg

SEQ ID NO: 568889 - RNA, 22 nt, Human
aaugaacacuuagccuuucuau

SEQ ID NO: 568890 - RNA, 22 nt, Human
auaucuaggcugaauguaaaau

SEQ ID NO: 568891 - RNA, 22 nt, Human
agaauguaagaaugcaaagauu

SEQ ID NO: 568892 - RNA, 22 nt, Human
uggcuuccagaacugagcaaca

SEQ ID NO: 568893 - RNA, 22 nt, Human
agacuucucuaacuugaggacc

SEQ ID NO: 568894 - RNA, 22 nt, Human
cuguccagcgacuaggggaugg

SEQ ID NO: 568895 - RNA, 22 nt, Human
agcuuucuauauaugaguugcu

SEQ ID NO: 568896 - RNA, 22 nt, Human
auucuagaguuucaauccaagg

SEQ ID NO: 568897 - RNA, 22 nt, Human
uagcaucuguacugacauaauc

SEQ ID NO: 568898 - RNA, 22 nt, Human
cucuaaauguggucugcagaua

SEQ ID NO: 568899 - RNA, 22 nt, Human
uagcaggagagaaguuuuaagu

SEQ ID NO: 568900 - RNA, 22 nt, Human
cugagcagaagggugcacgugc

SEQ ID NO: 568901 - RNA, 22 nt, Human
uuuccaaagguggcaggaacaa

SEQ ID NO: 568902 - RNA, 17 nt, Human
aguuuuuggaccugugu

SEQ ID NO: 568903 - RNA, 22 nt, Human
auuauguagcuaaaaauugugu

SEQ ID NO: 568904 - RNA, 22 nt, Human
uccgcgcucucacccgcucccg

SEQ ID NO: 568905 - RNA, 22 nt, Human
gggaugagagcugggacagaag

SEQ ID NO: 568906 - RNA, 22 nt, Human
auggaguguggccaggcaguaa

SEQ ID NO: 568907 - RNA, 17 nt, Human
uaaguccuaguuauuuu

SEQ ID NO: 568908 - RNA, 22 nt, Human
uuacccagugaagccgaggcag

SEQ ID NO: 568909 - RNA, 22 nt, Human
gugcucuagaaauugucagugg

SEQ ID NO: 568910 - RNA, 18 nt, Human
auuugcaggcaugcaggc

SEQ ID NO: 568911 - RNA, 22 nt, Human
agauguuuauaacucaugagug

SEQ ID NO: 568912 - RNA, 22 nt, Human
auugcacaucugcacuacagcc

SEQ ID NO: 568913 - RNA, 22 nt, Human
guuuccuuuuggaauuagagcu

SEQ ID NO: 568914 - RNA, 22 nt, Human
uuauuuuguagcucugaucuuu

SEQ ID NO: 568915 - RNA, 22 nt, Human
gguggcagaggugcaucagccc

SEQ ID NO: 568916 - RNA, 22 nt, Human
agagaagagucuugucaaauua

SEQ ID NO: 568917 - RNA, 18 nt, Human
uauaaacacacuuagguu

SEQ ID NO: 568918 - RNA, 23 nt, Human
aucauagucuuugugacuggccc

SEQ ID NO: 568919 - RNA, 22 nt, Human
aagaaaagguaaccgcuuaucu

SEQ ID NO: 568920 - RNA, 22 nt, Human
agcaggggcaggguuuugugcu

SEQ ID NO: 568921 - RNA, 22 nt, Human
ucugaauucuuagaauuaaagg

SEQ ID NO: 568922 - RNA, 22 nt, Human
auucugcugccuaguuuaugaa

SEQ ID NO: 568923 - RNA, 22 nt, Human
cuccuuagugccucugcacgag

SEQ ID NO: 568924 - RNA, 22 nt, Human
cugguuuuuagugcuuaggagu

SEQ ID NO: 568925 - RNA, 22 nt, Human
cuugucugcuauaaaaauccag

SEQ ID NO: 568926 - RNA, 22 nt, Human
auacaugacucacacauucugc

SEQ ID NO: 568927 - RNA, 22 nt, Human
cuggagaggcugggaacagguu

SEQ ID NO: 568928 - RNA, 22 nt, Human
ugcaaauauuccaugcuguuca

SEQ ID NO: 568929 - RNA, 22 nt, Human
aguguauucugcaugggagacu

SEQ ID NO: 568930 - RNA, 22 nt, Human
uaagaaacauuuuuaugacagu

SEQ ID NO: 568931 - RNA, 20 nt, Human
aucggcuugccuggaaacaa

SEQ ID NO: 568932 - RNA, 22 nt, Human
ucugaaauuuuaguuauagaaa

SEQ ID NO: 568933 - RNA, 22 nt, Human
gcagccuccgcacugcgagucc

SEQ ID NO: 568934 - RNA, 22 nt, Human
uaucugucgggagucuuccgga

SEQ ID NO: 568935 - RNA, 17 nt, Human
gccuggcccagccuggc

SEQ ID NO: 568936 - RNA, 22 nt, Human
uuugaacuucuaccugucauau

SEQ ID NO: 568937 - RNA, 22 nt, Human
gagugcucgggccucugccugc

SEQ ID NO: 568938 - RNA, 22 nt, Human
uuggaaaugcauuuguuauuau

SEQ ID NO: 568939 - RNA, 22 nt, Human
aggggagccagggcugcgaguu

SEQ ID NO: 568940 - RNA, 22 nt, Human
cuagaaguuuggguccauuaag

SEQ ID NO: 568941 - RNA, 22 nt, Human
aacacauggcaagagcaggaaa

SEQ ID NO: 568942 - RNA, 22 nt, Human
gcgcuccucccggcccuggugg

SEQ ID NO: 568943 - RNA, 22 nt, Human
ugagauucuguucagaaaaaug

SEQ ID NO: 568944 - RNA, 22 nt, Human
aaaugcaugugcuauagaugug

SEQ ID NO: 568945 - RNA, 23 nt, Human
aacugcaagguugcugggaagua

SEQ ID NO: 568946 - RNA, 21 nt, Human
uuuguucaggggcaaaguuaa

SEQ ID NO: 568947 - RNA, 22 nt, Human
ggggagaguauuuuauucaagu

SEQ ID NO: 568948 - RNA, 22 nt, Human
cagcccuugcgacacccuggcu

SEQ ID NO: 568949 - RNA, 22 nt, Human
cagaguggugcaagggcagugu

SEQ ID NO: 568950 - RNA, 22 nt, Human
ccuguacuuguauuaaaggucc

SEQ ID NO: 568951 - RNA, 22 nt, Human
uaucuuugguagcuuuccuaag

SEQ ID NO: 568952 - RNA, 22 nt, Human
cgggaagguggagguugcagug

SEQ ID NO: 568953 - RNA, 22 nt, Human
cucaaaauccauaaaaucaggu

SEQ ID NO: 568954 - RNA, 22 nt, Human
caggccagcagggccuccgugg

SEQ ID NO: 568955 - RNA, 22 nt, Human
ugggaugggaucucgcuguguc

SEQ ID NO: 568956 - RNA, 22 nt, Human
uuuugguaauuaaguagauauu

SEQ ID NO: 568957 - RNA, 22 nt, Human
caggacccaaccucccugcucu

SEQ ID NO: 568958 - RNA, 22 nt, Human
cucagaguccauaguuuacagu

SEQ ID NO: 568959 - RNA, 22 nt, Human
auauaguuggguuucauucuac

SEQ ID NO: 568960 - RNA, 23 nt, Human
guguggccccagggccuccucgc

SEQ ID NO: 568961 - RNA, 22 nt, Human
uuuagcaaaaaagcucugcgua

SEQ ID NO: 568962 - RNA, 22 nt, Human
aauguuugaacuuugcauauuu

SEQ ID NO: 568963 - RNA, 22 nt, Human
uugcaaucagcaguguuuucac

SEQ ID NO: 568964 - RNA, 22 nt, Human
cugacucccaaagaggacgcgu

SEQ ID NO: 568965 - RNA, 22 nt, Human
gcggggggcagcagucgcucag

SEQ ID NO: 568966 - RNA, 22 nt, Human
guuuacaacaucuuguccuuca

SEQ ID NO: 568967 - RNA, 22 nt, Human
uggccugauuuugcuaagagaa

SEQ ID NO: 568968 - RNA, 22 nt, Human
cugcuguguggauucaauggcu

SEQ ID NO: 568969 - RNA, 22 nt, Human
acucccuugguggagaaugcaa

SEQ ID NO: 568970 - RNA, 22 nt, Human
ggaaccuuaguguucuuuuacc

SEQ ID NO: 568971 - RNA, 22 nt, Human
gaagcgugcagguccguauacu

SEQ ID NO: 568972 - RNA, 22 nt, Human
uauucauguguuggaaaggaac

SEQ ID NO: 568973 - RNA, 22 nt, Human
gcuucugcagagccguccugag

SEQ ID NO: 568974 - RNA, 23 nt, Human
agugaugucacccacagacaagg

SEQ ID NO: 568975 - RNA, 22 nt, Human
uucccuucuaguuuugagagac

SEQ ID NO: 568976 - RNA, 22 nt, Human
ggauguuuauccuaucuuaguu

SEQ ID NO: 568977 - RNA, 22 nt, Human
augaauuguccgauguugugca

SEQ ID NO: 568978 - RNA, 22 nt, Human
cugcacagccugucugggggcc

SEQ ID NO: 568979 - RNA, 22 nt, Human
aauguuacgaucaacaacacau

SEQ ID NO: 568980 - RNA, 20 nt, Human
auuugcuuaccuuguuucua

SEQ ID NO: 568981 - RNA, 22 nt, Human
ggcagguguggugaccagagau

SEQ ID NO: 568982 - RNA, 19 nt, Human
ugguggaggugcaccugac

SEQ ID NO: 568983 - RNA, 22 nt, Human
aguucacagcaaaguggggacc

SEQ ID NO: 568984 - RNA, 22 nt, Human
acagugcugaucuagacugacc

SEQ ID NO: 568985 - RNA, 22 nt, Human
uuaaaagaauccuguuauccuc

SEQ ID NO: 568986 - RNA, 22 nt, Human
uacucuggaguugagaugcgag

SEQ ID NO: 568987 - RNA, 22 nt, Human
guggauggagcuggaagccauu

SEQ ID NO: 568988 - RNA, 22 nt, Human
aaaucaugguggaagaaacaga

SEQ ID NO: 568989 - RNA, 22 nt, Human
uggaaggggccaggcgcggagu

SEQ ID NO: 568990 - RNA, 22 nt, Human
cuucagggguguuaguuuugug

SEQ ID NO: 568991 - RNA, 22 nt, Human
cggagaggugggggcagcaucu

SEQ ID NO: 568992 - RNA, 22 nt, Human
uaccuugugagcuuucuaacau

SEQ ID NO: 568993 - RNA, 22 nt, Human
uuacuguagcuugacauauguc

SEQ ID NO: 568994 - RNA, 22 nt, Human
aucauuuaguggggcauuggaa

SEQ ID NO: 568995 - RNA, 22 nt, Human
aaugcugugauuuauuaaguau

SEQ ID NO: 568996 - RNA, 22 nt, Human
ugcaaauucuuuacucugugau

SEQ ID NO: 568997 - RNA, 18 nt, Human
uacagcuugaguugacug

SEQ ID NO: 568998 - RNA, 22 nt, Human
uucaaacacugcuuugagaggg

SEQ ID NO: 568999 - RNA, 22 nt, Human
ugaaagcucugucaucauuccu

SEQ ID NO: 569000 - RNA, 20 nt, Human
uuacagaaaugauguuauuu

SEQ ID NO: 569001 - RNA, 22 nt, Human
agcugccgaugcccagcugcau

SEQ ID NO: 569002 - RNA, 22 nt, Human
agggaugcaguaaaaacuguag

SEQ ID NO: 569003 - RNA, 22 nt, Human
gccugaucagguccucggcaua

SEQ ID NO: 569004 - RNA, 23 nt, Human
ugacacccucauugugugucgca

SEQ ID NO: 569005 - RNA, 22 nt, Human
aagcacagggacucaggaccgg

SEQ ID NO: 569006 - RNA, 22 nt, Human
accuccuccaaggagccauagg

SEQ ID NO: 569007 - RNA, 22 nt, Human
ggaaacugcuuacacuagaggg

SEQ ID NO: 569008 - RNA, 22 nt, Human
caugucaagacugaagauccag

SEQ ID NO: 569009 - RNA, 17 nt, Human
agccugcugaucucaca

SEQ ID NO: 569010 - RNA, 22 nt, Human
cuugcuacuaugccuggcuaau

SEQ ID NO: 569011 - RNA, 22 nt, Human
cucuggcaauugcugcugacuc

SEQ ID NO: 569012 - RNA, 22 nt, Human
guuuccaagucucucaacaccc

SEQ ID NO: 569013 - RNA, 22 nt, Human
cuucauuaaugucuauaaguuu

SEQ ID NO: 569014 - RNA, 22 nt, Human
ggcucucuuaacuggccauccu

SEQ ID NO: 569015 - RNA, 18 nt, Human
aaacauggcuuaaaggcu

SEQ ID NO: 569016 - RNA, 22 nt, Human
cagacagagucuucccaucagu

SEQ ID NO: 569017 - RNA, 22 nt, Human
caucucccacuuccuugggggu

SEQ ID NO: 569018 - RNA, 22 nt, Human
uuccuuaguuauuugguccccu

SEQ ID NO: 569019 - RNA, 22 nt, Human
aacacuaaaggucaguuagaag

SEQ ID NO: 569020 - RNA, 22 nt, Human
cucccucaggccuuagcccugc

SEQ ID NO: 569021 - RNA, 22 nt, Human
caugaaaugauauuuggguggg

SEQ ID NO: 569022 - RNA, 21 nt, Human
cugcacugugauuuaaaaugu

SEQ ID NO: 569023 - RNA, 22 nt, Human
guucucucagcgauagugaugg

SEQ ID NO: 569024 - RNA, 22 nt, Human
gugauuucaaauauagagugag

SEQ ID NO: 569025 - RNA, 22 nt, Human
acaugacagugacuuuauaaga

SEQ ID NO: 569026 - RNA, 22 nt, Human
guaauucugugugaaucuauua

SEQ ID NO: 569027 - RNA, 22 nt, Human
acagaauugggguucuugggga

SEQ ID NO: 569028 - RNA, 19 nt, Human
uuugauagggcauaauaua

SEQ ID NO: 569029 - RNA, 22 nt, Human
ugugugcucgauggcccugcag

SEQ ID NO: 569030 - RNA, 22 nt, Human
gagccauacaaccuauaaagug

SEQ ID NO: 569031 - RNA, 22 nt, Human
gaauguuuaaaaggugcaguuu

SEQ ID NO: 569032 - RNA, 22 nt, Human
aguaucagaugugauuaaaggg

SEQ ID NO: 569033 - RNA, 21 nt, Human
uaaacauaaccuuguauggcu

SEQ ID NO: 569034 - RNA, 22 nt, Human
uccaaauagcuggaugauggug

SEQ ID NO: 569035 - RNA, 22 nt, Human
aggauugugccuccagucagaa

SEQ ID NO: 569036 - RNA, 22 nt, Human
agaaacaucgcuuaguccucau

SEQ ID NO: 569037 - RNA, 22 nt, Human
gcuugcugaacaggaaccuggc

SEQ ID NO: 569038 - RNA, 22 nt, Human
caauaauugcuuuccagaguua

SEQ ID NO: 569039 - RNA, 22 nt, Human
ucacuacaaccgcuaccugaca

SEQ ID NO: 569040 - RNA, 22 nt, Human
guuaacaacacugugagugcug

SEQ ID NO: 569041 - RNA, 22 nt, Human
acaauuucuaauauagaucuua

SEQ ID NO: 569042 - RNA, 22 nt, Human
ucaggccaggagaucagauuga

SEQ ID NO: 569043 - RNA, 22 nt, Human
ucugcgcccugucgccugcucc

SEQ ID NO: 569044 - RNA, 22 nt, Human
uucacugugauguuuaagagaa

SEQ ID NO: 569045 - RNA, 22 nt, Human
ugcaugguuauauacuacuagu

SEQ ID NO: 569046 - RNA, 22 nt, Human
uucagucuuguugaaaacuugg

SEQ ID NO: 569047 - RNA, 22 nt, Human
aggaaauuuugaaucagugucu

SEQ ID NO: 569048 - RNA, 22 nt, Human
ucccacagcuucgugcuucccc

SEQ ID NO: 569049 - RNA, 22 nt, Human
augaaaacagccuccugugaua

SEQ ID NO: 569050 - RNA, 22 nt, Human
uuuaauuuucugggcccagcag

SEQ ID NO: 569051 - RNA, 22 nt, Human
auuacugaggcaaaguaguuuu

SEQ ID NO: 569052 - RNA, 22 nt, Human
caggaacacaaugagucucaaa

SEQ ID NO: 569053 - RNA, 22 nt, Human
acaggaaaugaaaugguaucua

SEQ ID NO: 569054 - RNA, 22 nt, Human
acacaagcagcuuuugagcgga

SEQ ID NO: 569055 - RNA, 22 nt, Human
guauuucuuuacauaugcucau

SEQ ID NO: 569056 - RNA, 22 nt, Human
uauaaacuccucuugcauuccu

SEQ ID NO: 569057 - RNA, 22 nt, Human
caugcaugccgggcugacagag

SEQ ID NO: 569058 - RNA, 17 nt, Human
uuagagcuacauguuga

SEQ ID NO: 569059 - RNA, 22 nt, Human
ucaggaugagucaucaagcugc

SEQ ID NO: 569060 - RNA, 22 nt, Human
acucacagggccucaguuuucc

SEQ ID NO: 569061 - RNA, 22 nt, Human
uaaguauuggccuauagcuaga

SEQ ID NO: 569062 - RNA, 22 nt, Human
cuaaauguuuuaucuuccuggc

SEQ ID NO: 569063 - RNA, 17 nt, Human
aacaguuaaugggggaa

SEQ ID NO: 569064 - RNA, 22 nt, Human
cugcggcuggggacagcuguug

SEQ ID NO: 569065 - RNA, 22 nt, Human
guucuucaaagugacaacuaaa

SEQ ID NO: 569066 - RNA, 17 nt, Human
ucugccaguuuuagaau

SEQ ID NO: 569067 - RNA, 22 nt, Human
gcggcgccugggacccgccagc

SEQ ID NO: 569068 - RNA, 22 nt, Human
gcugucucauacaaggcccugc

SEQ ID NO: 569069 - RNA, 22 nt, Human
uauagcagcaugauuuauaguc

SEQ ID NO: 569070 - RNA, 22 nt, Human
aucuucccaggcuggggagagg

SEQ ID NO: 569071 - RNA, 22 nt, Human
cagguagaggcugccaucagcu

SEQ ID NO: 569072 - RNA, 22 nt, Human
ugaagcuaguauuaacucagau

SEQ ID NO: 569073 - RNA, 22 nt, Human
aacagaaugcaggggaugcugc

SEQ ID NO: 569074 - RNA, 21 nt, Human
auucaaagaagaggaaggccc

SEQ ID NO: 569075 - RNA, 22 nt, Human
uaguggauguucagagauuuga

SEQ ID NO: 569076 - RNA, 22 nt, Human
uuuaauuauaucugggcaguua

SEQ ID NO: 569077 - RNA, 22 nt, Human
gauccacaggaaccaaaacgca

SEQ ID NO: 569078 - RNA, 22 nt, Human
aaauugaauuugggaaacauug

SEQ ID NO: 569079 - RNA, 22 nt, Human
uugcacagaugcacaugguugc

SEQ ID NO: 569080 - RNA, 17 nt, Human
ucugcagggggccgugu

SEQ ID NO: 569081 - RNA, 22 nt, Human
aaaacuuucagggauacagaaa

SEQ ID NO: 569082 - RNA, 22 nt, Human
uuagaaaucaccucugaagauc

SEQ ID NO: 569083 - RNA, 22 nt, Human
aagcagggugucuugacccaug

SEQ ID NO: 569084 - RNA, 22 nt, Human
ucuguucagaagaggugaaagu

SEQ ID NO: 569085 - RNA, 22 nt, Human
ugagcuucuuuauuuggccaga

SEQ ID NO: 569086 - RNA, 22 nt, Human
gaggagaggcuggacgcgguga

SEQ ID NO: 569087 - RNA, 21 nt, Human
agggaaaaggcugagugaggg

SEQ ID NO: 569088 - RNA, 22 nt, Human
guggccuccuccguccgccucu

SEQ ID NO: 569089 - RNA, 22 nt, Human
ggugcggagacuccaugaggcc

SEQ ID NO: 569090 - RNA, 23 nt, Human
gggugcugccuguagucaugcug

SEQ ID NO: 569091 - RNA, 22 nt, Human
aucuuacaauuacaagacacuc

SEQ ID NO: 569092 - RNA, 22 nt, Human
gcuaggaguggugggucaagga

SEQ ID NO: 569093 - RNA, 22 nt, Human
agcugacagugcauggagggac

SEQ ID NO: 569094 - RNA, 22 nt, Human
aacuagaaagaacauauuucca

SEQ ID NO: 569095 - RNA, 22 nt, Human
aaacacaucauucaugucguca

SEQ ID NO: 569096 - RNA, 22 nt, Human
uguucuuagguauuugacaguc

SEQ ID NO: 569097 - RNA, 22 nt, Human
gcucuaugaaccugaaucucac

SEQ ID NO: 569098 - RNA, 22 nt, Human
gaaagagaaccugggccuagau

SEQ ID NO: 569099 - RNA, 22 nt, Human
aaugaguuuguucuauuauuug

SEQ ID NO: 569100 - RNA, 22 nt, Human
cugagcugguucucuugugaaa

SEQ ID NO: 569101 - RNA, 22 nt, Human
uggccgggaagggacagugugg

SEQ ID NO: 569102 - RNA, 22 nt, Human
cuuucugaggagacgggcuuug

SEQ ID NO: 569103 - RNA, 18 nt, Human
ccucagggagagagacgc

SEQ ID NO: 569104 - RNA, 22 nt, Human
ggccgcggauuuucccgcuggc

SEQ ID NO: 569105 - RNA, 22 nt, Human
aaaccuguuaauagagcgaugc

SEQ ID NO: 569106 - RNA, 22 nt, Human
aauucauacucuauauugcuuu

SEQ ID NO: 569107 - RNA, 22 nt, Human
ugagccuggccugcagagacca

SEQ ID NO: 569108 - RNA, 21 nt, Human
gcuccuggugcugcguggcgc

SEQ ID NO: 569109 - RNA, 22 nt, Human
ucuuuugagggccagaggaaga

SEQ ID NO: 569110 - RNA, 22 nt, Human
auuccaaagccugaauaaugga

SEQ ID NO: 569111 - RNA, 22 nt, Human
gcuuccaaugcuucuaucacau

SEQ ID NO: 569112 - RNA, 22 nt, Human
gacggagcugguugcugcggcu

SEQ ID NO: 569113 - RNA, 22 nt, Human
ugguccugagcaccagccugac

SEQ ID NO: 569114 - RNA, 18 nt, Human
uccauccucugcucuuca

SEQ ID NO: 569115 - RNA, 21 nt, Human
cccuugccugcacuccucggc

SEQ ID NO: 569116 - RNA, 22 nt, Human
gaguggggcccacugcugggug

SEQ ID NO: 569117 - RNA, 21 nt, Human
uugauuuagcagaucuagcug

SEQ ID NO: 569118 - RNA, 22 nt, Human
uauccaaaggaacaaucacagc

SEQ ID NO: 569119 - RNA, 22 nt, Human
uagaggaugauccuuccuugcc

SEQ ID NO: 569120 - RNA, 17 nt, Human
auucaugaacauguccu

SEQ ID NO: 569121 - RNA, 22 nt, Human
auguggcuuucugcguuuucuc

SEQ ID NO: 569122 - RNA, 22 nt, Human
cacggccacugcagcaccccag

SEQ ID NO: 569123 - RNA, 22 nt, Human
gggagccccaccucggugcccg

SEQ ID NO: 569124 - RNA, 22 nt, Human
gcagcugccgugagcucacgcc

SEQ ID NO: 569125 - RNA, 22 nt, Human
uacagccuggcacuacccuggg

SEQ ID NO: 569126 - RNA, 20 nt, Human
uuucacuggcuugauaaggu

SEQ ID NO: 569127 - RNA, 22 nt, Human
uuggccguuucacugggcaguu

SEQ ID NO: 569128 - RNA, 22 nt, Human
ugugaagaauuaaugugaauca

SEQ ID NO: 569129 - RNA, 22 nt, Human
augcuacauuuugguuuauaaa

SEQ ID NO: 569130 - RNA, 22 nt, Human
uccucauucuuggugcaucaaa

SEQ ID NO: 569131 - RNA, 22 nt, Human
uuuucuuggaguggcuguccuu

SEQ ID NO: 569132 - RNA, 23 nt, Human
aacucuggcuagcauagaauaga

SEQ ID NO: 569133 - RNA, 22 nt, Human
ugcccguggccuggggcagcuu

SEQ ID NO: 569134 - RNA, 22 nt, Human
caguguuuagcacagugcuugg

SEQ ID NO: 569135 - RNA, 22 nt, Human
ccgcuguccuggagcugcugcu

SEQ ID NO: 569136 - RNA, 22 nt, Human
ccuguggcacaugcagggauuc

SEQ ID NO: 569137 - RNA, 22 nt, Human
ucauuguuucugcuuuucauga

SEQ ID NO: 569138 - RNA, 22 nt, Human
cugucucugauaagcucgaggg

SEQ ID NO: 569139 - RNA, 22 nt, Human
guucaaccaugauuaggaacug

SEQ ID NO: 569140 - RNA, 22 nt, Human
uucaaugcaagggaggucugaa

SEQ ID NO: 569141 - RNA, 22 nt, Human
uaucuguauucugacagucacu

SEQ ID NO: 569142 - RNA, 21 nt, Human
agaaggcaaaagcagacaucu

SEQ ID NO: 569143 - RNA, 22 nt, Human
ucuuauugugaugaugaagaac

SEQ ID NO: 569144 - RNA, 22 nt, Human
uuggcagugacugcgggccccg

SEQ ID NO: 569145 - RNA, 22 nt, Human
cuuuacagugaacuugcuuguc

SEQ ID NO: 569146 - RNA, 22 nt, Human
uucacguuguugaagaaaauac

SEQ ID NO: 569147 - RNA, 22 nt, Human
ucaguaaaugagcaaaaauuuc

SEQ ID NO: 569148 - RNA, 22 nt, Human
agaugguucagaauuauaaaga

SEQ ID NO: 569149 - RNA, 22 nt, Human
guagcagagggcccagguaacu

SEQ ID NO: 569150 - RNA, 22 nt, Human
uuguuuguaaggcucuuagaau

SEQ ID NO: 569151 - RNA, 22 nt, Human
augcuugcccauguuucugaag

SEQ ID NO: 569152 - RNA, 22 nt, Human
cuucucuuggguguggugucuu

SEQ ID NO: 569153 - RNA, 19 nt, Human
ccuggcccugcugcgcggg

SEQ ID NO: 569154 - RNA, 18 nt, Human
cuacauucauaggaaagg

SEQ ID NO: 569155 - RNA, 22 nt, Human
uuucgggaaaaacugguaagac

SEQ ID NO: 569156 - RNA, 22 nt, Human
ucaugcagauaagaauaaguaa

SEQ ID NO: 569157 - RNA, 22 nt, Human
uguguuucugagaaucccaccu

SEQ ID NO: 569158 - RNA, 22 nt, Human
cucucuccuuagcugcagacca

SEQ ID NO: 569159 - RNA, 22 nt, Human
cccaggucgucagcaguguggu

SEQ ID NO: 569160 - RNA, 22 nt, Human
ucuacaacgugguuuuguugua

SEQ ID NO: 569161 - RNA, 22 nt, Human
uugagauagguggaaucucuuu

SEQ ID NO: 569162 - RNA, 22 nt, Human
cacaauuuccauugagcagcag

SEQ ID NO: 569163 - RNA, 22 nt, Human
cugcuucacccugccugagaac

SEQ ID NO: 569164 - RNA, 22 nt, Human
agaauaaccaguguuucacagu

SEQ ID NO: 569165 - RNA, 22 nt, Human
uuccggacgcccgucuuccagc

SEQ ID NO: 569166 - RNA, 22 nt, Human
uagauucugacccucuuuuuac

SEQ ID NO: 569167 - RNA, 21 nt, Human
acauguccccuaugcuuaagg

SEQ ID NO: 569168 - RNA, 22 nt, Human
gauuugucuauauucaaauaug

SEQ ID NO: 569169 - RNA, 22 nt, Human
agauuucaauggauauugcaag

SEQ ID NO: 569170 - RNA, 22 nt, Human
uuugaauauacuucaaacaaag

SEQ ID NO: 569171 - RNA, 22 nt, Human
uugcucuauguuuguaaacaga

SEQ ID NO: 569172 - RNA, 22 nt, Human
gugcagcugugguggagccagg

SEQ ID NO: 569173 - RNA, 22 nt, Human
cugcucucuguuccccuggauc

SEQ ID NO: 569174 - RNA, 22 nt, Human
acaguucuguccuagacuucgu

SEQ ID NO: 569175 - RNA, 22 nt, Human
uaggugucuggacaacuuugua

SEQ ID NO: 569176 - RNA, 22 nt, Human
ugcuggcugggcugcuggagac

SEQ ID NO: 569177 - RNA, 19 nt, Human
ugguucuccuuccacaguc

SEQ ID NO: 569178 - RNA, 22 nt, Human
gagcugcauagcugggauccuc

SEQ ID NO: 569179 - RNA, 22 nt, Human
guugguccuuugagcaagaucc

SEQ ID NO: 569180 - RNA, 22 nt, Human
aagucuucagacuggagagauu

SEQ ID NO: 569181 - RNA, 22 nt, Human
ucucaggcuuccuggugcugug

SEQ ID NO: 569182 - RNA, 23 nt, Human
cucaccaagcgccgccgcugugu

SEQ ID NO: 569183 - RNA, 22 nt, Human
aaggggggcaccugcaugcccg

SEQ ID NO: 569184 - RNA, 22 nt, Human
cacacuguccccuucuccccag

SEQ ID NO: 569185 - RNA, 22 nt, Human
gccacguagaagugccgcgaga

SEQ ID NO: 569186 - RNA, 22 nt, Human
uccaagaagcuuacaaucuaau

SEQ ID NO: 569187 - RNA, 22 nt, Human
gagccacaguggauugauucca

SEQ ID NO: 569188 - RNA, 22 nt, Human
uccuuucugucuuuacucugga

SEQ ID NO: 569189 - RNA, 22 nt, Human
agagcuauuucuuaaaagcugu

SEQ ID NO: 569190 - RNA, 22 nt, Human
acagacuccccagguuaucuca

SEQ ID NO: 569191 - RNA, 22 nt, Human
ucugcuguuuacugugugauau

SEQ ID NO: 569192 - RNA, 21 nt, Human
acucugaaaauuaauaguuau

SEQ ID NO: 569193 - RNA, 22 nt, Human
uuuuuugucuugaagaaauggu

SEQ ID NO: 569194 - RNA, 22 nt, Human
gaggugggaugugugugcuacu

SEQ ID NO: 569195 - RNA, 22 nt, Human
augguuuuguccucuuugguuc

SEQ ID NO: 569196 - RNA, 22 nt, Human
ugcagugaugcuucuggcucag

SEQ ID NO: 569197 - RNA, 22 nt, Human
aggugcugccccgagaaggaug

SEQ ID NO: 569198 - RNA, 22 nt, Human
uaacaaaguauuguuuguguau

SEQ ID NO: 569199 - RNA, 22 nt, Human
uggcaggaaaaagggccagagg

SEQ ID NO: 569200 - RNA, 21 nt, Human
cuuuggcaagggagaagucac

SEQ ID NO: 569201 - RNA, 22 nt, Human
gccagugccugcugcucagggc

SEQ ID NO: 569202 - RNA, 22 nt, Human
cgucauuuguaaaugaucaaga

SEQ ID NO: 569203 - RNA, 22 nt, Human
cauaaauuguacccauuccaac

SEQ ID NO: 569204 - RNA, 22 nt, Human
cucacagcugcuucaggaucca

SEQ ID NO: 569205 - RNA, 22 nt, Human
cugccguugugaagcucuuaga

SEQ ID NO: 569206 - RNA, 22 nt, Human
uucucugaguacguuucagugu

SEQ ID NO: 569207 - RNA, 20 nt, Human
gacuucaauuucuaucuuuu

SEQ ID NO: 569208 - RNA, 22 nt, Human
uacuuugucauucuaaccuucc

SEQ ID NO: 569209 - RNA, 22 nt, Human
uuucugugauaggcugcgacgc

SEQ ID NO: 569210 - RNA, 22 nt, Human
agcugcugcaaguggugcuaac

SEQ ID NO: 569211 - RNA, 22 nt, Human
uuggggaagcuuugaaauacuu

SEQ ID NO: 569212 - RNA, 22 nt, Human
uaauuuugucacagugacaugc

SEQ ID NO: 569213 - RNA, 22 nt, Human
caggaggaaaguuccacucaac

SEQ ID NO: 569214 - RNA, 22 nt, Human
gccuuugcugugacaaugcugg

SEQ ID NO: 569215 - RNA, 22 nt, Human
ucccugccuccuggcagugcca

SEQ ID NO: 569216 - RNA, 22 nt, Human
guuuauuggguauuguggagcc

SEQ ID NO: 569217 - RNA, 22 nt, Human
ucuggauggucagcucuuccug

SEQ ID NO: 569218 - RNA, 22 nt, Human
gccgugcgugcgcaggugcugu

SEQ ID NO: 569219 - RNA, 22 nt, Human
aacuuucugaaaagcuugauca

SEQ ID NO: 569220 - RNA, 22 nt, Human
agguggucuuguggaugccgca

SEQ ID NO: 569221 - RNA, 18 nt, Human
ggugagggagcuggaagc

SEQ ID NO: 569222 - RNA, 22 nt, Human
uucaaacaguguagaauauaug

SEQ ID NO: 569223 - RNA, 22 nt, Human
uuuuccuucugauacuccauuu

SEQ ID NO: 569224 - RNA, 22 nt, Human
auuuccagcagcauauuugucu

SEQ ID NO: 569225 - RNA, 22 nt, Human
uugcugugucauuuguuuaauc

SEQ ID NO: 569226 - RNA, 22 nt, Human
ugagcauuaccugaggccacug

SEQ ID NO: 569227 - RNA, 22 nt, Human
caagagcuuuagaaaugcucau

SEQ ID NO: 569228 - RNA, 22 nt, Human
auuauugcaagcagugaaggga

SEQ ID NO: 569229 - RNA, 22 nt, Human
acagggcugaggcuggcuucuu

SEQ ID NO: 569230 - RNA, 22 nt, Human
auccuucaaaaggaauagcagg

SEQ ID NO: 569231 - RNA, 22 nt, Human
aaugacaguggcacagucacuu

SEQ ID NO: 569232 - RNA, 22 nt, Human
uaauuucagugcaagcucacgg

SEQ ID NO: 569233 - RNA, 22 nt, Human
ucuguggcaaacacagugacca

SEQ ID NO: 569234 - RNA, 22 nt, Human
acuggaaaguauucuuucacug

SEQ ID NO: 569235 - RNA, 20 nt, Human
cagagccaggguuuuguuuu

SEQ ID NO: 569236 - RNA, 22 nt, Human
acagcagguuauuguuauggca

SEQ ID NO: 569237 - RNA, 22 nt, Human
acaccacaaguaacucuuuucc

SEQ ID NO: 569238 - RNA, 22 nt, Human
gagcccuuuuccuagauacugu

SEQ ID NO: 569239 - RNA, 22 nt, Human
uguuggcagugcuacagucagu

SEQ ID NO: 569240 - RNA, 21 nt, Human
ugagcaccagcugcaugcccc

SEQ ID NO: 569241 - RNA, 22 nt, Human
agccuugcaugauuucauucau

SEQ ID NO: 569242 - RNA, 22 nt, Human
gaauguuaaugcacuucuagcu

SEQ ID NO: 569243 - RNA, 22 nt, Human
ugcauaaauauuguugggagua

SEQ ID NO: 569244 - RNA, 22 nt, Human
guucuucagauuccauuucagu

SEQ ID NO: 569245 - RNA, 22 nt, Human
uucagaaaggcugugccagcca

SEQ ID NO: 569246 - RNA, 22 nt, Human
cuaguagcccauuuuggauacc

SEQ ID NO: 569247 - RNA, 22 nt, Human
guggaaauuuuaggaucaucuu

SEQ ID NO: 569248 - RNA, 22 nt, Human
aaacucuacauggucgcaaaaa

SEQ ID NO: 569249 - RNA, 22 nt, Human
aauaucuagccuuuagcagcuu

SEQ ID NO: 569250 - RNA, 23 nt, Human
cauuugauccucacaauaaaugg

SEQ ID NO: 569251 - RNA, 22 nt, Human
ugagacaaagcagcugacagaa

SEQ ID NO: 569252 - RNA, 22 nt, Human
uuuguguuguacuucugugcau

SEQ ID NO: 569253 - RNA, 22 nt, Human
uggagcugguucuggggaagcu

SEQ ID NO: 569254 - RNA, 22 nt, Human
cacugguugccucuuucuguuc

SEQ ID NO: 569255 - RNA, 21 nt, Human
uggcccuggccacggcugcca

SEQ ID NO: 569256 - RNA, 22 nt, Human
ccgggagguggagauugcggug

SEQ ID NO: 569257 - RNA, 22 nt, Human
ccugaggcccuggcugugcuga

SEQ ID NO: 569258 - RNA, 22 nt, Human
gcuucauagcauucauugccug

SEQ ID NO: 569259 - RNA, 23 nt, Human
ugcaaaauuugcagaguucgaug

SEQ ID NO: 569260 - RNA, 22 nt, Human
ucuggcuucaacuuuacugaaa

SEQ ID NO: 569261 - RNA, 22 nt, Human
aagucaauuaguaaacuuggaa

SEQ ID NO: 569262 - RNA, 22 nt, Human
acauucucuuuuagaaagcugu

SEQ ID NO: 569263 - RNA, 22 nt, Human
agacauauuggcuugcuuuaau

SEQ ID NO: 569264 - RNA, 22 nt, Human
agguagcuggugcugggcuccu

SEQ ID NO: 569265 - RNA, 22 nt, Human
uaacuugagcucucagugcuau

SEQ ID NO: 569266 - RNA, 22 nt, Human
acaccuuuuauucgccaggcac

SEQ ID NO: 569267 - RNA, 22 nt, Human
agaacagaggccuuauguuuca

SEQ ID NO: 569268 - RNA, 19 nt, Human
aggucuaaucauaagacaa

SEQ ID NO: 569269 - RNA, 22 nt, Human
cugccaucugagccaaaagugc

SEQ ID NO: 569270 - RNA, 22 nt, Human
cagcaguacuucucagagguau

SEQ ID NO: 569271 - RNA, 22 nt, Human
agccccaguucccuggaagucu

SEQ ID NO: 569272 - RNA, 22 nt, Human
ucaaagaucagaugguuguagg

SEQ ID NO: 569273 - RNA, 22 nt, Human
augacagcucuagcacacagua

SEQ ID NO: 569274 - RNA, 22 nt, Human
caaagaagagauuuacagagcu

SEQ ID NO: 569275 - RNA, 22 nt, Human
ccuggaaaaugccacuuucaca

SEQ ID NO: 569276 - RNA, 22 nt, Human
uucucacguuauuggcugagag

SEQ ID NO: 569277 - RNA, 22 nt, Human
aauuauugagcaucuacugugu

SEQ ID NO: 569278 - RNA, 22 nt, Human
gcugccuggaauaacggcuggc

SEQ ID NO: 569279 - RNA, 22 nt, Human
ucaauucugccucuaaauauuu

SEQ ID NO: 569280 - RNA, 22 nt, Human
aauaucaucucucuuuucugca

SEQ ID NO: 569281 - RNA, 22 nt, Human
acgccucugcagcugccgggcc

SEQ ID NO: 569282 - RNA, 22 nt, Human
aaaauuaagugucugggaagcc

SEQ ID NO: 569283 - RNA, 22 nt, Human
caggcgaccccuaggagcaaca

SEQ ID NO: 569284 - RNA, 23 nt, Human
agcaacagugggugaguguugcu

SEQ ID NO: 569285 - RNA, 22 nt, Human
gagcuguguaugcaucauucug

SEQ ID NO: 569286 - RNA, 18 nt, Human
ucuuccaacacugacacc

SEQ ID NO: 569287 - RNA, 22 nt, Human
gagugugucggucagcguggcg

SEQ ID NO: 569288 - RNA, 22 nt, Human
gcuggccugcgagggcaggcug

SEQ ID NO: 569289 - RNA, 22 nt, Human
cugucaaauggaaacuuauccu

SEQ ID NO: 569290 - RNA, 22 nt, Human
cucugguuucgcaggaaauaga

SEQ ID NO: 569291 - RNA, 21 nt, Human
ugcuaagugucacaugucugc

SEQ ID NO: 569292 - RNA, 22 nt, Human
uuuugaauaauucagaaacagc

SEQ ID NO: 569293 - RNA, 22 nt, Human
uucaccugugacagguagaguu

SEQ ID NO: 569294 - RNA, 22 nt, Human
acggccgaugacuccagcaugg

SEQ ID NO: 569295 - RNA, 22 nt, Human
agacaagagcugaggacauauu

SEQ ID NO: 569296 - RNA, 21 nt, Human
aaguccaauaccuaaggcucc

SEQ ID NO: 569297 - RNA, 22 nt, Human
aucuaugugggaaucauaauag

SEQ ID NO: 569298 - RNA, 22 nt, Human
ugucuggauagagccuaggccc

SEQ ID NO: 569299 - RNA, 22 nt, Human
cgggagccucugggucacacug

SEQ ID NO: 569300 - RNA, 22 nt, Human
ucucagggaugggaggccccag

SEQ ID NO: 569301 - RNA, 22 nt, Human
aggaauuugggguuacaugaug

SEQ ID NO: 569302 - RNA, 22 nt, Human
cuagcagaagcuccuugagggu

SEQ ID NO: 569303 - RNA, 22 nt, Human
guuauucuauuaaugugauugu

SEQ ID NO: 569304 - RNA, 22 nt, Human
agcuuuggcaucugacuagccg

SEQ ID NO: 569305 - RNA, 22 nt, Human
aguuuccacuggagacacugug

SEQ ID NO: 569306 - RNA, 22 nt, Human
gcgcugccucugcucuccccac

SEQ ID NO: 569307 - RNA, 22 nt, Human
agacgcgguggugcaugccugu

SEQ ID NO: 569308 - RNA, 22 nt, Human
cugaaggacacgugaggagcca

SEQ ID NO: 569309 - RNA, 22 nt, Human
uggcacuugauauuugauuugc

SEQ ID NO: 569310 - RNA, 23 nt, Human
agacagaggcugaggcuggccgc

SEQ ID NO: 569311 - RNA, 22 nt, Human
auuucagagugagagugcucaa

SEQ ID NO: 569312 - RNA, 22 nt, Human
uuuaaaccuaucuaagaaauag

SEQ ID NO: 569313 - RNA, 23 nt, Human
aggcagguuugggcucuucuugu

SEQ ID NO: 569314 - RNA, 22 nt, Human
ugcauguuuuauaccaaagcuu

SEQ ID NO: 569315 - RNA, 22 nt, Human
cauuaacacuuuggauuuagac

SEQ ID NO: 569316 - RNA, 22 nt, Human
cuacagaauucaacaaaugguu

SEQ ID NO: 569317 - RNA, 22 nt, Human
uuuguucaccuagcaaacuuuu

SEQ ID NO: 569318 - RNA, 22 nt, Human
caauuuuuaaacuaugaaguug

SEQ ID NO: 569319 - RNA, 19 nt, Human
acucaggcuuccucugagg

SEQ ID NO: 569320 - RNA, 20 nt, Human
caauaauuuacuucccuauu

SEQ ID NO: 569321 - RNA, 22 nt, Human
uaaaaucaugacagauugacau

SEQ ID NO: 569322 - RNA, 22 nt, Human
uacaaagugauuuuggaauuga

SEQ ID NO: 569323 - RNA, 22 nt, Human
uuucgagggauuagcuaggacu

SEQ ID NO: 569324 - RNA, 22 nt, Human
uugcaaauaauagccugaaacu

SEQ ID NO: 569325 - RNA, 22 nt, Human
cagcugccuaugaccuagccuc

SEQ ID NO: 569326 - RNA, 22 nt, Human
caaaugaugcauggcuagugag

SEQ ID NO: 569327 - RNA, 22 nt, Human
aggcuuaacuacaauuuuugcc

SEQ ID NO: 569328 - RNA, 22 nt, Human
ccuaugaaagacaggagaugcg

SEQ ID NO: 569329 - RNA, 22 nt, Human
uacaguaaccagucuacuuaga

SEQ ID NO: 569330 - RNA, 22 nt, Human
agaagugaguugugacuauggg

SEQ ID NO: 569331 - RNA, 20 nt, Human
uugcaaagugaauagcaauu

SEQ ID NO: 569332 - RNA, 22 nt, Human
gcucccugguauugcugccacu

SEQ ID NO: 569333 - RNA, 22 nt, Human
ucuguggcauguugcacuugua

SEQ ID NO: 569334 - RNA, 22 nt, Human
uagaagaugccuuaaaguugaa

SEQ ID NO: 569335 - RNA, 22 nt, Human
cuguuuauucucaucuaaaaug

SEQ ID NO: 569336 - RNA, 22 nt, Human
gcggggggcaggcaguacguug

SEQ ID NO: 569337 - RNA, 22 nt, Human
uauaugcagauuuucaucaucg

SEQ ID NO: 569338 - RNA, 22 nt, Human
ggcuuccuccuuccugcuguca

SEQ ID NO: 569339 - RNA, 22 nt, Human
acucauuugcaugaugugcuau

SEQ ID NO: 569340 - RNA, 22 nt, Human
uggguaaacugggucuggagag

SEQ ID NO: 569341 - RNA, 22 nt, Human
gagauuuccauauuuuguaaca

SEQ ID NO: 569342 - RNA, 23 nt, Human
ccccacuaccgugaugugcgagg

SEQ ID NO: 569343 - RNA, 22 nt, Human
aaguguguauuuuucuucagug

SEQ ID NO: 569344 - RNA, 22 nt, Human
aggccagggcacugcucuuuag

SEQ ID NO: 569345 - RNA, 22 nt, Human
gccuggcgccgggcugccuguc

SEQ ID NO: 569346 - RNA, 22 nt, Human
ucuguggcaugguaucuggagg

SEQ ID NO: 569347 - RNA, 22 nt, Human
aaauugcuugagauuagucucc

SEQ ID NO: 569348 - RNA, 22 nt, Human
uaucuguuuuuacagugucuuu

SEQ ID NO: 569349 - RNA, 22 nt, Human
aaugaaacuaguagaaucuuug

SEQ ID NO: 569350 - RNA, 17 nt, Human
aaaugguccuagggauu

SEQ ID NO: 569351 - RNA, 21 nt, Human
ugucagcaacaauacuuucuc

SEQ ID NO: 569352 - RNA, 22 nt, Human
guuaaaugcagauucugacuca

SEQ ID NO: 569353 - RNA, 22 nt, Human
gccuggcucugaguuucucucc

SEQ ID NO: 569354 - RNA, 19 nt, Human
ugccuggcaccagcuccac

SEQ ID NO: 569355 - RNA, 22 nt, Human
uggaaacacccacgcaugcaua

SEQ ID NO: 569356 - RNA, 22 nt, Human
uuuccagaaauaccauuuggug

SEQ ID NO: 569357 - RNA, 22 nt, Human
gucagaggggcagcugccaggc

SEQ ID NO: 569358 - RNA, 22 nt, Human
cacuuuuaacaggagaauuccc

SEQ ID NO: 569359 - RNA, 22 nt, Human
cauuuuacgacauagggcaggc

SEQ ID NO: 569360 - RNA, 22 nt, Human
caugcauuucuaccaaggaaua

SEQ ID NO: 569361 - RNA, 22 nt, Human
uugggagaaauaguugauccgc

SEQ ID NO: 569362 - RNA, 22 nt, Human
gccagcuggcugcaggucccag

SEQ ID NO: 569363 - RNA, 22 nt, Human
cuuguuuucuucugcagucuau

SEQ ID NO: 569364 - RNA, 22 nt, Human
agcuuugggcagaagaggauuc

SEQ ID NO: 569365 - RNA, 22 nt, Human
uuucccaggcuggaaugcagug

SEQ ID NO: 569366 - RNA, 22 nt, Human
uuuuccuuaacagagggagaaa

SEQ ID NO: 569367 - RNA, 22 nt, Human
ucaaaaugccgagugcccaggu

SEQ ID NO: 569368 - RNA, 22 nt, Human
agauaaaguccaaacuguguag

SEQ ID NO: 569369 - RNA, 22 nt, Human
ccucuaaauuguuugaaguugg

SEQ ID NO: 569370 - RNA, 22 nt, Human
gucuccuuguggaucucaagga

SEQ ID NO: 569371 - RNA, 22 nt, Human
acugguuuuggaaaucaguaca

SEQ ID NO: 569372 - RNA, 22 nt, Human
uacccacugucauauucagggu

SEQ ID NO: 569373 - RNA, 22 nt, Human
ugaauaaucuuggguauuaaua

SEQ ID NO: 569374 - RNA, 22 nt, Human
aggcuguagaucuagacaugua

SEQ ID NO: 569375 - RNA, 22 nt, Human
uacauguacaugcauagguaga

SEQ ID NO: 569376 - RNA, 22 nt, Human
uuuugucagugagaacagaguu

SEQ ID NO: 569377 - RNA, 22 nt, Human
augugaaagagguguucagugg

SEQ ID NO: 569378 - RNA, 22 nt, Human
aagugauuucugccugcauguu

SEQ ID NO: 569379 - RNA, 22 nt, Human
uuuaaacuaacaguacacguug

SEQ ID NO: 569380 - RNA, 22 nt, Human
ggcuuucugucugcgucugugu

SEQ ID NO: 569381 - RNA, 20 nt, Human
uaugauaauuacaaaauagu

SEQ ID NO: 569382 - RNA, 21 nt, Human
uggagagugauuucagugugg

SEQ ID NO: 569383 - RNA, 22 nt, Human
caaugcagauaccuuccagaga

SEQ ID NO: 569384 - RNA, 22 nt, Human
ugcccuccacaguggcuccacc

SEQ ID NO: 569385 - RNA, 22 nt, Human
cauuuuccucugcugguguuca

SEQ ID NO: 569386 - RNA, 22 nt, Human
uaucaguccaggguuuugugac

SEQ ID NO: 569387 - RNA, 22 nt, Human
guguaucaacauguuuuuugug

SEQ ID NO: 569388 - RNA, 22 nt, Human
acaaguuucauuguuuagaacc

SEQ ID NO: 569389 - RNA, 22 nt, Human
agcuccugaaaagcgcuugcuu

SEQ ID NO: 569390 - RNA, 22 nt, Human
caggugggagccacagcguaca

SEQ ID NO: 569391 - RNA, 22 nt, Human
ccaaacauuucaaauuuagaga

SEQ ID NO: 569392 - RNA, 22 nt, Human
cacaguuuuaucuuauacugau

SEQ ID NO: 569393 - RNA, 22 nt, Human
agccacagucuguagccagcuu

SEQ ID NO: 569394 - RNA, 22 nt, Human
caucuuuguuuuggauauaauc

SEQ ID NO: 569395 - RNA, 22 nt, Human
caaucaaugcugcuaguuccuu

SEQ ID NO: 569396 - RNA, 22 nt, Human
aacuuucuuugcaucuaaguuu

SEQ ID NO: 569397 - RNA, 22 nt, Human
ugcuuuggcccaacauugaugc

SEQ ID NO: 569398 - RNA, 22 nt, Human
uuucaugauuaacuuagugaau

SEQ ID NO: 569399 - RNA, 22 nt, Human
cuccuucacgcaggcugccaug

SEQ ID NO: 569400 - RNA, 22 nt, Human
cugacagaucuggaucugaacu

SEQ ID NO: 569401 - RNA, 22 nt, Human
cacaucauguuaauucauuaca

SEQ ID NO: 569402 - RNA, 22 nt, Human
aggcuuuugcucuggcuccucu

SEQ ID NO: 569403 - RNA, 22 nt, Human
augcuuuauuggagacagucau

SEQ ID NO: 569404 - RNA, 22 nt, Human
cuucauuucaggcugaagaaua

SEQ ID NO: 569405 - RNA, 22 nt, Human
gucucuaucauagcugaacccu

SEQ ID NO: 569406 - RNA, 22 nt, Human
ggcuuuggggguguccaagaaa

SEQ ID NO: 569407 - RNA, 22 nt, Human
gcagcagugugggcugaaccua

SEQ ID NO: 569408 - RNA, 22 nt, Human
ccagcagcucccucaggguccg

SEQ ID NO: 569409 - RNA, 22 nt, Human
gcacaaaagguacuucauguag

SEQ ID NO: 569410 - RNA, 21 nt, Human
cuuuucuagucccagccccgc

SEQ ID NO: 569411 - RNA, 22 nt, Human
ggacaucuguugugguagagga

SEQ ID NO: 569412 - RNA, 22 nt, Human
uccagccauaucuuguagcccu

SEQ ID NO: 569413 - RNA, 22 nt, Human
aaaugcacaauaaaguaaaggc

SEQ ID NO: 569414 - RNA, 22 nt, Human
gugcaggacagcacaucuccug

SEQ ID NO: 569415 - RNA, 21 nt, Human
gcugcucgagauccagugcuu

SEQ ID NO: 569416 - RNA, 22 nt, Human
uucuccacccacucuuuuguug

SEQ ID NO: 569417 - RNA, 22 nt, Human
ggacauugaagcuggaaaggga

SEQ ID NO: 569418 - RNA, 22 nt, Human
gugcaugucuuuggaggccucc

SEQ ID NO: 569419 - RNA, 22 nt, Human
uggaucugcucuaugaacugcu

SEQ ID NO: 569420 - RNA, 22 nt, Human
uaaugccuuucuguacuauaug

SEQ ID NO: 569421 - RNA, 22 nt, Human
cgaguaauuggaaauuugcuau

SEQ ID NO: 569422 - RNA, 22 nt, Human
acugugugccaggcgcuggucu

SEQ ID NO: 569423 - RNA, 22 nt, Human
cucucugggcccaguuggcacc

SEQ ID NO: 569424 - RNA, 22 nt, Human
uucuucauucccuuacuuccga

SEQ ID NO: 569425 - RNA, 22 nt, Human
uauacuacgcaccaaacaaagg

SEQ ID NO: 569426 - RNA, 22 nt, Human
cucugcguggcugggcccaggg

SEQ ID NO: 569427 - RNA, 22 nt, Human
aagucauugguagcuugauagg

SEQ ID NO: 569428 - RNA, 22 nt, Human
ugagcagacuugaugaggcagc

SEQ ID NO: 569429 - RNA, 22 nt, Human
uugaggagucaggggcacggaa

SEQ ID NO: 569430 - RNA, 22 nt, Human
uccaggcugacgcagcuauuua

SEQ ID NO: 569431 - RNA, 22 nt, Human
agagauuccuuuggggaaagca

SEQ ID NO: 569432 - RNA, 22 nt, Human
cuuccucuguggccagagugua

SEQ ID NO: 569433 - RNA, 22 nt, Human
agcugaacgugcuucugcagca

SEQ ID NO: 569434 - RNA, 22 nt, Human
uagaagaacaugucaaacuaua

SEQ ID NO: 569435 - RNA, 22 nt, Human
ucucagcucauggcagccuuga

SEQ ID NO: 569436 - RNA, 22 nt, Human
acauauuuugaaagcuuucuaa

SEQ ID NO: 569437 - RNA, 22 nt, Human
gaucuguccuggcaguuaacac

SEQ ID NO: 569438 - RNA, 22 nt, Human
uagcugcacaggaaguaagauu

SEQ ID NO: 569439 - RNA, 22 nt, Human
ugaaauguggagaugguaagua

SEQ ID NO: 569440 - RNA, 22 nt, Human
ucucugucucccguguguccgg

SEQ ID NO: 569441 - RNA, 19 nt, Human
uuuaaugugugcugcaauc

SEQ ID NO: 569442 - RNA, 22 nt, Human
acaagucuguuaugcaccugga

SEQ ID NO: 569443 - RNA, 20 nt, Human
aaagauacuuuuuguaaugg

SEQ ID NO: 569444 - RNA, 22 nt, Human
uuuguaguuguggaugcugaag

SEQ ID NO: 569445 - RNA, 22 nt, Human
caagggcagaggcagggccccg

SEQ ID NO: 569446 - RNA, 22 nt, Human
uggauaaaaugacauuaccuga

SEQ ID NO: 569447 - RNA, 22 nt, Human
gaugcgggcccgcuccacugcc

SEQ ID NO: 569448 - RNA, 22 nt, Human
uccucuccaggugagccgaaau

SEQ ID NO: 569449 - RNA, 22 nt, Human
ccugucucugcagggcccugcc

SEQ ID NO: 569450 - RNA, 18 nt, Human
cgauguguaugugauuug

SEQ ID NO: 569451 - RNA, 22 nt, Human
agcaggaacucagggaguucuc

SEQ ID NO: 569452 - RNA, 22 nt, Human
uuagcaaacaucuucgugugag

SEQ ID NO: 569453 - RNA, 22 nt, Human
uccucuucaaaauagcucugaa

SEQ ID NO: 569454 - RNA, 22 nt, Human
ucagucucuggggcuucuguuu

SEQ ID NO: 569455 - RNA, 22 nt, Human
uuucuuggucuucccgaccugg

SEQ ID NO: 569456 - RNA, 22 nt, Human
uucucaaagugugcucccugga

SEQ ID NO: 569457 - RNA, 22 nt, Human
uacauguuauuucacuauuggu

SEQ ID NO: 569458 - RNA, 22 nt, Human
cggcgcaggcagaccgcgggcu

SEQ ID NO: 569459 - RNA, 22 nt, Human
gaccaaggaagaggggagccag

SEQ ID NO: 569460 - RNA, 22 nt, Human
ugcugcuuguuuuguaaauaaa

SEQ ID NO: 569461 - RNA, 22 nt, Human
agcaaauaauugucuuugaggg

SEQ ID NO: 569462 - RNA, 22 nt, Human
cacucucacaugcccugucagu

SEQ ID NO: 569463 - RNA, 22 nt, Human
uugcauauccuccaacacaugg

SEQ ID NO: 569464 - RNA, 22 nt, Human
uccaggagugauaaggccacug

SEQ ID NO: 569465 - RNA, 22 nt, Human
gucccugauaagagccaucgau

SEQ ID NO: 569466 - RNA, 22 nt, Human
ucugcucagccgaucugcuccg

SEQ ID NO: 569467 - RNA, 22 nt, Human
uaacacauagauauuuuaacuu

SEQ ID NO: 569468 - RNA, 22 nt, Human
acucuguuugcagguagcucag

SEQ ID NO: 569469 - RNA, 23 nt, Human
uggaaacauucugaauguccauc

SEQ ID NO: 569470 - RNA, 22 nt, Human
uucucugguuugcuguuucuga

SEQ ID NO: 569471 - RNA, 22 nt, Human
cagcuuugccaaguaaggucuu

SEQ ID NO: 569472 - RNA, 22 nt, Human
augcggagccccaagcuugaag

SEQ ID NO: 569473 - RNA, 22 nt, Human
auuguugacuugauuacucaac

SEQ ID NO: 569474 - RNA, 22 nt, Human
ccugaggaugccagcaugggug

SEQ ID NO: 569475 - RNA, 22 nt, Human
ccaagaggggcagagggcugca

SEQ ID NO: 569476 - RNA, 22 nt, Human
cccacugcugcucuccauggca

SEQ ID NO: 569477 - RNA, 22 nt, Human
aguaacagguguacagacuauc

SEQ ID NO: 569478 - RNA, 21 nt, Human
auucugaguugucagucuuca

SEQ ID NO: 569479 - RNA, 22 nt, Human
ggagacagugacuuagagacug

SEQ ID NO: 569480 - RNA, 22 nt, Human
ccaguucuuucugugugcaaca

SEQ ID NO: 569481 - RNA, 22 nt, Human
agccacugugugaccagcuguc

SEQ ID NO: 569482 - RNA, 22 nt, Human
uuucauguuggauacuguuuca

SEQ ID NO: 569483 - RNA, 22 nt, Human
ccuuuuaagggagacuagagau

SEQ ID NO: 569484 - RNA, 18 nt, Human
uccaccgcgugcaccucu

SEQ ID NO: 569485 - RNA, 22 nt, Human
augcacacguacccuacaaggc

SEQ ID NO: 569486 - RNA, 18 nt, Human
ucaugcaaacgcuucaua

SEQ ID NO: 569487 - RNA, 22 nt, Human
auguuugaaauuguaaguauau

SEQ ID NO: 569488 - RNA, 21 nt, Human
ucucugacccaggaagagggc

SEQ ID NO: 569489 - RNA, 22 nt, Human
augcaggaagagcccuggagcu

SEQ ID NO: 569490 - RNA, 22 nt, Human
gaaguauuucugaguugcccag

SEQ ID NO: 569491 - RNA, 22 nt, Human
cucucuguuaugcuuucaugaa

SEQ ID NO: 569492 - RNA, 22 nt, Human
aagcaaaagguuacacuucugg

SEQ ID NO: 569493 - RNA, 22 nt, Human
gcugccgacccacagggguuaa

SEQ ID NO: 569494 - RNA, 22 nt, Human
auauaaguguguggcuguuagu

SEQ ID NO: 569495 - RNA, 22 nt, Human
aaauccaucaaaucuucuagaa

SEQ ID NO: 569496 - RNA, 22 nt, Human
gccucugcaccaguacugugcc

SEQ ID NO: 569497 - RNA, 22 nt, Human
gaagaccccagagcgagguaag

SEQ ID NO: 569498 - RNA, 20 nt, Human
ucagugggaaagugagagug

SEQ ID NO: 569499 - RNA, 22 nt, Human
uaaagcauguuucaguaagguu

SEQ ID NO: 569500 - RNA, 22 nt, Human
cgccguccccuaggaaagagcu

SEQ ID NO: 569501 - RNA, 22 nt, Human
gaguuucuucauggugcagagg

SEQ ID NO: 569502 - RNA, 22 nt, Human
caagucuagcuuggucacuugg

SEQ ID NO: 569503 - RNA, 22 nt, Human
ccagcaugcucagucuaaauug

SEQ ID NO: 569504 - RNA, 22 nt, Human
caugagaucugcagggaugggc

SEQ ID NO: 569505 - RNA, 22 nt, Human
ugagaugaagugauguaaaaca

SEQ ID NO: 569506 - RNA, 22 nt, Human
uuuacagcuacuguccuauuuc

SEQ ID NO: 569507 - RNA, 20 nt, Human
cucuuuucacucucaguggu

SEQ ID NO: 569508 - RNA, 22 nt, Human
gcccagcgagcagagguggacg

SEQ ID NO: 569509 - RNA, 22 nt, Human
uuagacaucaagaagccaaugu

SEQ ID NO: 569510 - RNA, 22 nt, Human
ucacaugcucaccuaagccaca

SEQ ID NO: 569511 - RNA, 22 nt, Human
aaauugcauuuuaaagguagau

SEQ ID NO: 569512 - RNA, 22 nt, Human
ggggaagaaauagaacauuuug

SEQ ID NO: 569513 - RNA, 22 nt, Human
uuucugaggaauuaauacagaa

SEQ ID NO: 569514 - RNA, 22 nt, Human
gccaggucgucuccauguccaa

SEQ ID NO: 569515 - RNA, 22 nt, Human
ugcucuguucaguguaucuugu

SEQ ID NO: 569516 - RNA, 22 nt, Human
ugcagguggcagcggggcacca

SEQ ID NO: 569517 - RNA, 22 nt, Human
gaacugcauugugguauauguu

SEQ ID NO: 569518 - RNA, 22 nt, Human
uucacauaaucugcagcaagcg

SEQ ID NO: 569519 - RNA, 22 nt, Human
gcaguaaauugagagucauguu

SEQ ID NO: 569520 - RNA, 22 nt, Human
aucccugugacgagcaucccua

SEQ ID NO: 569521 - RNA, 18 nt, Human
ucagacaaguuagacagg

SEQ ID NO: 569522 - RNA, 23 nt, Human
ggaggcacuuaggcagagcagag

SEQ ID NO: 569523 - RNA, 22 nt, Human
gucugcccugcagacaugccuc

SEQ ID NO: 569524 - RNA, 22 nt, Human
accccagaggcggaggcugcag

SEQ ID NO: 569525 - RNA, 21 nt, Human
aaacugaccuugccugagaca

SEQ ID NO: 569526 - RNA, 22 nt, Human
ucggugcgcgaggcgcgguccc

SEQ ID NO: 569527 - RNA, 22 nt, Human
uuucauuauaaaaaguuggcuu

SEQ ID NO: 569528 - RNA, 22 nt, Human
aacaucuagguucucaucgaua

SEQ ID NO: 569529 - RNA, 22 nt, Human
cacuguuuuacauguuauuuaa

SEQ ID NO: 569530 - RNA, 19 nt, Human
augggaagcggccagcgga

SEQ ID NO: 569531 - RNA, 22 nt, Human
gugcugucguggaacugggcug

SEQ ID NO: 569532 - RNA, 22 nt, Human
uccuuggagaaucuuguuuuac

SEQ ID NO: 569533 - RNA, 22 nt, Human
acaagucaguggaauuaauauu

SEQ ID NO: 569534 - RNA, 22 nt, Human
ccaagagcuucccauagcuucu

SEQ ID NO: 569535 - RNA, 22 nt, Human
gucaaaacaaaguuaagaauuc

SEQ ID NO: 569536 - RNA, 22 nt, Human
ugcucccaggcauucucuguug

SEQ ID NO: 569537 - RNA, 22 nt, Human
auuuacugagguaaauaaacug

SEQ ID NO: 569538 - RNA, 22 nt, Human
aagcaccuggguuauaucuuag

SEQ ID NO: 569539 - RNA, 22 nt, Human
gguucaguggaauguguugacc

SEQ ID NO: 569540 - RNA, 22 nt, Human
ggcaagagggcagauggagugc

SEQ ID NO: 569541 - RNA, 22 nt, Human
cuugaaagucagcagaguggau

SEQ ID NO: 569542 - RNA, 22 nt, Human
aucauccauggcugaucauaaa

SEQ ID NO: 569543 - RNA, 22 nt, Human
cacauuuaaagguugaagcuga

SEQ ID NO: 569544 - RNA, 22 nt, Human
uauuuguuucuaguggcagcaa

SEQ ID NO: 569545 - RNA, 22 nt, Human
caggccgggcacugcgcuaggu

SEQ ID NO: 569546 - RNA, 20 nt, Human
uuuuccacuccucaaaacag

SEQ ID NO: 569547 - RNA, 22 nt, Human
acaguguuucacuuaaccguuu

SEQ ID NO: 569548 - RNA, 22 nt, Human
cccacucccugcacgccugccg

SEQ ID NO: 569549 - RNA, 22 nt, Human
cuucuucagaggccagccucug

SEQ ID NO: 569550 - RNA, 22 nt, Human
gcuuucuuuucaagaauguauu

SEQ ID NO: 569551 - RNA, 22 nt, Human
guauuaugaaugccgaggcggc

SEQ ID NO: 569552 - RNA, 22 nt, Human
uaucuagagccuggaagucuug

SEQ ID NO: 569553 - RNA, 22 nt, Human
ugggugaagaggcuaugcuacu

SEQ ID NO: 569554 - RNA, 22 nt, Human
uguccagcugaaggcagccuca

SEQ ID NO: 569555 - RNA, 22 nt, Human
cuccuuaaagggagcagcagcu

SEQ ID NO: 569556 - RNA, 22 nt, Human
gucccucugccugugguucucu

SEQ ID NO: 569557 - RNA, 22 nt, Human
ccuguauggcuauuccuuggac

SEQ ID NO: 569558 - RNA, 22 nt, Human
aguggcaguagaugagcugguu

SEQ ID NO: 569559 - RNA, 22 nt, Human
uguccugugcacuguagcaugu

SEQ ID NO: 569560 - RNA, 22 nt, Human
cuuauuagaaagaaaagacaug

SEQ ID NO: 569561 - RNA, 21 nt, Human
aggcaugagcccugcauggac

SEQ ID NO: 569562 - RNA, 22 nt, Human
cagugcagccaaggacaggcac

SEQ ID NO: 569563 - RNA, 22 nt, Human
uaguauuuccuguaagcuauag

SEQ ID NO: 569564 - RNA, 22 nt, Human
aaagcuauuuuauugcagcucu

SEQ ID NO: 569565 - RNA, 22 nt, Human
gauuuucauuauagcuaguuuc

SEQ ID NO: 569566 - RNA, 22 nt, Human
gcugaaguugccuauuuuaaua

SEQ ID NO: 569567 - RNA, 22 nt, Human
gcacagucaacacuuauucacc

SEQ ID NO: 569568 - RNA, 22 nt, Human
ucucugguuaugucauuaagca

SEQ ID NO: 569569 - RNA, 22 nt, Human
uuguagucuaggauagauuuuu

SEQ ID NO: 569570 - RNA, 22 nt, Human
acauuguugagccucuuguuca

SEQ ID NO: 569571 - RNA, 22 nt, Human
uaguguguggucucucccuugu

SEQ ID NO: 569572 - RNA, 22 nt, Human
cagacguuggaggaaauauacc

SEQ ID NO: 569573 - RNA, 22 nt, Human
uccugugccuccaccugcuccg

SEQ ID NO: 569574 - RNA, 22 nt, Human
auuucagaguagaucguuauuu

SEQ ID NO: 569575 - RNA, 21 nt, Human
uaggugggagccccaguaugc

SEQ ID NO: 569576 - RNA, 22 nt, Human
cugcaucaguggauaugauggu

SEQ ID NO: 569577 - RNA, 22 nt, Human
uggaaagaggaagugcccagca

SEQ ID NO: 569578 - RNA, 22 nt, Human
uguuuuaagggucaacugucac

SEQ ID NO: 569579 - RNA, 22 nt, Human
cuucucaaaguugugaaucagg

SEQ ID NO: 569580 - RNA, 22 nt, Human
agaaagcacccugcacuuucug

SEQ ID NO: 569581 - RNA, 22 nt, Human
uacugaaagagugguggacucu

SEQ ID NO: 569582 - RNA, 22 nt, Human
guagcccaccuggggagggcga

SEQ ID NO: 569583 - RNA, 22 nt, Human
gccuggaaugcaaugugacgaa

SEQ ID NO: 569584 - RNA, 22 nt, Human
ggugagagaaaagaaacacugu

SEQ ID NO: 569585 - RNA, 22 nt, Human
ugggugcucugcgaccguaggg

SEQ ID NO: 569586 - RNA, 22 nt, Human
ccaggcccugccugugguuccu

SEQ ID NO: 569587 - RNA, 22 nt, Human
ggcaaucauuggcauucucugg

SEQ ID NO: 569588 - RNA, 22 nt, Human
acagcuucgaggaucucauccc

SEQ ID NO: 569589 - RNA, 22 nt, Human
auucauucugaccucaagagaa

SEQ ID NO: 569590 - RNA, 22 nt, Human
uucucaggaacucagugucagc

SEQ ID NO: 569591 - RNA, 22 nt, Human
caacuuuagaccccaaguagcu

SEQ ID NO: 569592 - RNA, 22 nt, Human
cucacaggguucuaucgaagag

SEQ ID NO: 569593 - RNA, 22 nt, Human
uuugcacuuaaauuuacaacac

SEQ ID NO: 569594 - RNA, 22 nt, Human
auacaggaugcugaacaucucu

SEQ ID NO: 569595 - RNA, 22 nt, Human
caacauuucaaggucuuuagga

SEQ ID NO: 569596 - RNA, 22 nt, Human
cagaaagcaguugucaaugggc

SEQ ID NO: 569597 - RNA, 22 nt, Human
gugauuucagguuuuucauacu

SEQ ID NO: 569598 - RNA, 21 nt, Human
agagacugucacugcaguacc

SEQ ID NO: 569599 - RNA, 22 nt, Human
uucucucaguuaaacuuuguga

SEQ ID NO: 569600 - RNA, 22 nt, Human
cuguuccuccaccucaacaaac

SEQ ID NO: 569601 - RNA, 17 nt, Human
ucugagaacuugaagca

SEQ ID NO: 569602 - RNA, 22 nt, Human
ucaucagcuccaugagguacuc

SEQ ID NO: 569603 - RNA, 23 nt, Human
aacauuuguaaggugauuuuguu

SEQ ID NO: 569604 - RNA, 22 nt, Human
uuaccacagugccugucuaaug

SEQ ID NO: 569605 - RNA, 21 nt, Human
gccaucaccaagcucuucccc

SEQ ID NO: 569606 - RNA, 22 nt, Human
ccuguggccgcgucgggcggcg

SEQ ID NO: 569607 - RNA, 21 nt, Human
aauuucagacccauuuugccu

SEQ ID NO: 569608 - RNA, 21 nt, Human
cccgugccuucagcaguccug

SEQ ID NO: 569609 - RNA, 17 nt, Human
cauucuguaaucuuucu

SEQ ID NO: 569610 - RNA, 22 nt, Human
ucacuguuaauaaauagcaaag

SEQ ID NO: 569611 - RNA, 22 nt, Human
cugugcuggcagaccuggaguu

SEQ ID NO: 569612 - RNA, 22 nt, Human
uucuguaauucuguuaguuuca

SEQ ID NO: 569613 - RNA, 22 nt, Human
ggaggaggggugacugaaugcu

SEQ ID NO: 569614 - RNA, 20 nt, Human
ccuguucacugcgcaguuuc

SEQ ID NO: 569615 - RNA, 22 nt, Human
gaaaccuuugccgauggggucc

SEQ ID NO: 569616 - RNA, 22 nt, Human
ggacucucaggcugucggcuuc

SEQ ID NO: 569617 - RNA, 22 nt, Human
uaaucuuagacauguauuuuuc

SEQ ID NO: 569618 - RNA, 23 nt, Human
auuuccuaaaagauaaucauuac

SEQ ID NO: 569619 - RNA, 22 nt, Human
aggcuuucgaugaacgcuugcu

SEQ ID NO: 569620 - RNA, 19 nt, Human
gggugaggaagagcguugc

SEQ ID NO: 569621 - RNA, 22 nt, Human
gcccagccccuggguggacgug

SEQ ID NO: 569622 - RNA, 22 nt, Human
ggcuggacuugguccuguuuug

SEQ ID NO: 569623 - RNA, 22 nt, Human
uaaaugcaguacaaauuguucu

SEQ ID NO: 569624 - RNA, 22 nt, Human
cuuauuggucccaggaggagaa

SEQ ID NO: 569625 - RNA, 20 nt, Human
uugaggagauauugaauacu

SEQ ID NO: 569626 - RNA, 22 nt, Human
ucuccacaccagaaggagcuga

SEQ ID NO: 569627 - RNA, 18 nt, Human
ggaggcucugugguuucc

SEQ ID NO: 569628 - RNA, 22 nt, Human
cacagaaucugugacuccaaga

SEQ ID NO: 569629 - RNA, 22 nt, Human
aaucugagggaacuugaacucc

SEQ ID NO: 569630 - RNA, 22 nt, Human
ggaagaggcugaggccaugcug

SEQ ID NO: 569631 - RNA, 22 nt, Human
gugcgccagcucaaggggaggc

SEQ ID NO: 569632 - RNA, 18 nt, Human
uccaggcuccaggcuaac

SEQ ID NO: 569633 - RNA, 17 nt, Human
ucugagaaugcuggagg

SEQ ID NO: 569634 - RNA, 19 nt, Human
gaacugaggucugaggcuu

SEQ ID NO: 569635 - RNA, 22 nt, Human
ggagggaguuucauuccugccc

SEQ ID NO: 569636 - RNA, 22 nt, Human
guguuuugugaggccuucuuuc

SEQ ID NO: 569637 - RNA, 18 nt, Human
agggagagaccgcggguc

SEQ ID NO: 569638 - RNA, 22 nt, Human
aauucagguuauauuugcaacu

SEQ ID NO: 569639 - RNA, 22 nt, Human
gagguggcugcuugcugggaaa

SEQ ID NO: 569640 - RNA, 22 nt, Human
agcaauguuggccuauauaccu

SEQ ID NO: 569641 - RNA, 22 nt, Human
ggucccagucccuuuccaccgu

SEQ ID NO: 569642 - RNA, 22 nt, Human
cauuuacauuuaagguuaauau

SEQ ID NO: 569643 - RNA, 22 nt, Human
uuggaauuugagaccaagaaaa

SEQ ID NO: 569644 - RNA, 22 nt, Human
cccucucccugcagaauguggc

SEQ ID NO: 569645 - RNA, 20 nt, Human
cagagcagugcccaggcggc

SEQ ID NO: 569646 - RNA, 22 nt, Human
uccucacagcugguucauucag

SEQ ID NO: 569647 - RNA, 22 nt, Human
auuaauaucccccgccguucug

SEQ ID NO: 569648 - RNA, 22 nt, Human
ucacaauacucacucaauggcu

SEQ ID NO: 569649 - RNA, 22 nt, Human
gcugucugcugggucgcucagg

SEQ ID NO: 569650 - RNA, 19 nt, Human
ucaaagucugagucacuuu

SEQ ID NO: 569651 - RNA, 22 nt, Human
cucacucaguuuuuaguucauc

SEQ ID NO: 569652 - RNA, 22 nt, Human
gcugccaccguggagaugagug

SEQ ID NO: 569653 - RNA, 22 nt, Human
uggcuccguuguacaggcugga

SEQ ID NO: 569654 - RNA, 22 nt, Human
gagccugagcaaugugauguuu

SEQ ID NO: 569655 - RNA, 22 nt, Human
acagugugcaagaaauggggga

SEQ ID NO: 569656 - RNA, 22 nt, Human
uucguuuaguccacaaaugcau

SEQ ID NO: 569657 - RNA, 22 nt, Human
cauggccagauucuuucuucuc

SEQ ID NO: 569658 - RNA, 22 nt, Human
uugaagcauuugcuauagcauu

SEQ ID NO: 569659 - RNA, 22 nt, Human
aaugucaacacaagagaaaugc

SEQ ID NO: 569660 - RNA, 22 nt, Human
auccuugaaugacucugcccuc

SEQ ID NO: 569661 - RNA, 22 nt, Human
uuuauacuccacucugcaagcg

SEQ ID NO: 569662 - RNA, 22 nt, Human
aaauucuguccugaaugccauu

SEQ ID NO: 569663 - RNA, 22 nt, Human
acaggcgcacaugagggccgug

SEQ ID NO: 569664 - RNA, 22 nt, Human
cagcuugcacacauauuagacg

SEQ ID NO: 569665 - RNA, 22 nt, Human
uugcuggaagguggcuggaauc

SEQ ID NO: 569666 - RNA, 22 nt, Human
cuguggccagagcgccguugac

SEQ ID NO: 569667 - RNA, 22 nt, Human
aucacaguuuuaccauuuggua

SEQ ID NO: 569668 - RNA, 22 nt, Human
uuugacaugugcuuauaacuuu

SEQ ID NO: 569669 - RNA, 22 nt, Human
uuguacuuaaauaugcaaauag

SEQ ID NO: 569670 - RNA, 19 nt, Human
uaugaaguugauaaaaguu

SEQ ID NO: 569671 - RNA, 22 nt, Human
acuguucacccagcacuagcag

SEQ ID NO: 569672 - RNA, 22 nt, Human
guguggucgaaguucucccgga

SEQ ID NO: 569673 - RNA, 23 nt, Human
aauagcugguaaugauagcacaa

SEQ ID NO: 569674 - RNA, 22 nt, Human
auuagccuguugcauuuucacu

SEQ ID NO: 569675 - RNA, 22 nt, Human
uuuuuaagagucuggaaauagu

SEQ ID NO: 569676 - RNA, 22 nt, Human
ugcgcaugcguggcucuccggc

SEQ ID NO: 569677 - RNA, 22 nt, Human
ucaccgccuugcccggccgggc

SEQ ID NO: 569678 - RNA, 22 nt, Human
ucugagaaugguggauguggug

SEQ ID NO: 569679 - RNA, 22 nt, Human
aucuguucuucaaaauauuaca

SEQ ID NO: 569680 - RNA, 22 nt, Human
auacuucuuuagcauauugaac

SEQ ID NO: 569681 - RNA, 22 nt, Human
ugggagagauaggcuucuggac

SEQ ID NO: 569682 - RNA, 22 nt, Human
ggaaacauuccaagaguugaaa

SEQ ID NO: 569683 - RNA, 22 nt, Human
acauucaugcaccuuccuaucc

SEQ ID NO: 569684 - RNA, 22 nt, Human
uguguuuuggaaggaacaugca

SEQ ID NO: 569685 - RNA, 22 nt, Human
guucuucagcccucagguccua

SEQ ID NO: 569686 - RNA, 22 nt, Human
ucucuacagcacccgcaugcua

SEQ ID NO: 569687 - RNA, 22 nt, Human
gcagcucucuggccugcccugg

SEQ ID NO: 569688 - RNA, 22 nt, Human
acagagacacggaagcuaaaga

SEQ ID NO: 569689 - RNA, 22 nt, Human
gauguaucugagcugcuuaggu

SEQ ID NO: 569690 - RNA, 22 nt, Human
acgucuucguuggcagagauuu

SEQ ID NO: 569691 - RNA, 22 nt, Human
auauacacuguuucaguugaag

SEQ ID NO: 569692 - RNA, 22 nt, Human
aacaguaugugagauuuacaca

SEQ ID NO: 569693 - RNA, 22 nt, Human
uauuacaguucgaguuucuagg

SEQ ID NO: 569694 - RNA, 22 nt, Human
aaaucugagaaauauuguccag

SEQ ID NO: 569695 - RNA, 22 nt, Human
ugaagacaguuuuacucaugag

SEQ ID NO: 569696 - RNA, 21 nt, Human
uucugagacucauuugaacuc

SEQ ID NO: 569697 - RNA, 22 nt, Human
gcugcuuugucuguaaaaugga

SEQ ID NO: 569698 - RNA, 22 nt, Human
cacgugcaggucuuaggagaca

SEQ ID NO: 569699 - RNA, 22 nt, Human
gggggcuggacuuucccacaca

SEQ ID NO: 569700 - RNA, 22 nt, Human
ccaggagaaugggauuacccua

SEQ ID NO: 569701 - RNA, 22 nt, Human
guuguacauaugaggauaaguu

SEQ ID NO: 569702 - RNA, 16 nt, Human
ucucugcuucauaggu

SEQ ID NO: 569703 - RNA, 22 nt, Human
uccuucccaggugucgccgccu

SEQ ID NO: 569704 - RNA, 22 nt, Human
cugcucaauuccggcacgcugg

SEQ ID NO: 569705 - RNA, 22 nt, Human
agucaacauuugagaugcaaug

SEQ ID NO: 569706 - RNA, 22 nt, Human
uguucugcaaugcugccuccuu

SEQ ID NO: 569707 - RNA, 22 nt, Human
cuccaaaggauaaaagcagagu

SEQ ID NO: 569708 - RNA, 22 nt, Human
uaaagacaauuucgagcuguag

SEQ ID NO: 569709 - RNA, 22 nt, Human
aggcaguguggagggcuguugc

SEQ ID NO: 569710 - RNA, 21 nt, Human
acaaauuguuuauauaggaag

SEQ ID NO: 569711 - RNA, 22 nt, Human
auuucagcagcccauguuugga

SEQ ID NO: 569712 - RNA, 22 nt, Human
uuccaggcgcacgucggccuua

SEQ ID NO: 569713 - RNA, 22 nt, Human
ggaguugacggccgacacccag

SEQ ID NO: 569714 - RNA, 22 nt, Human
ugaggaaugugacaaaaccaag

SEQ ID NO: 569715 - RNA, 22 nt, Human
aucaacuuguccuugauguuaa

SEQ ID NO: 569716 - RNA, 22 nt, Human
cucucuuuuucgugugccgaag

SEQ ID NO: 569717 - RNA, 22 nt, Human
gcggagaggcagagacuccgcg

SEQ ID NO: 569718 - RNA, 21 nt, Human
cagaggggcuagccuggcugc

SEQ ID NO: 569719 - RNA, 18 nt, Human
cagaaaguuauuuacucu

SEQ ID NO: 569720 - RNA, 22 nt, Human
gucuuuuuuacaccuuacauca

SEQ ID NO: 569721 - RNA, 21 nt, Human
uucacaguggauaacuuucug

SEQ ID NO: 569722 - RNA, 22 nt, Human
ucacccagacugucugacucuu

SEQ ID NO: 569723 - RNA, 22 nt, Human
cugcugucuuuauuucacugcu

SEQ ID NO: 569724 - RNA, 22 nt, Human
gaacaguuucccuguagaaaau

SEQ ID NO: 569725 - RNA, 22 nt, Human
gaacuuuaauuagcuuuugucu

SEQ ID NO: 569726 - RNA, 22 nt, Human
agucaguaugacuuauaguucu

SEQ ID NO: 569727 - RNA, 21 nt, Human
agcgucaauaucgucaacagg

SEQ ID NO: 569728 - RNA, 22 nt, Human
gccuucugaucgcuggacugac

SEQ ID NO: 569729 - RNA, 22 nt, Human
agugaauuagccuauuuguaaa

SEQ ID NO: 569730 - RNA, 22 nt, Human
uaucuguagucucaugguuccu

SEQ ID NO: 569731 - RNA, 22 nt, Human
agcuaauguauguugaaagcac

SEQ ID NO: 569732 - RNA, 22 nt, Human
gccaugaacucgggcauggaga

SEQ ID NO: 569733 - RNA, 22 nt, Human
gccuucugauugcuggacugac

SEQ ID NO: 569734 - RNA, 22 nt, Human
ccaggagagcucucguucagug

SEQ ID NO: 569735 - RNA, 22 nt, Human
ucaauuuauguggcuauucauu

SEQ ID NO: 569736 - RNA, 22 nt, Human
ucucuguaagcugccuucucgu

SEQ ID NO: 569737 - RNA, 19 nt, Human
acugcagggaggaggugug

SEQ ID NO: 569738 - RNA, 22 nt, Human
acaguguuacuugauaguguau

SEQ ID NO: 569739 - RNA, 23 nt, Human
uggagaauucagucuuuguuuug

SEQ ID NO: 569740 - RNA, 22 nt, Human
uuccaggaagcucucggccucu

SEQ ID NO: 569741 - RNA, 22 nt, Human
gcgagaaacuaagugcccuuug

SEQ ID NO: 569742 - RNA, 22 nt, Human
uccaagacaagcacauuccugc

SEQ ID NO: 569743 - RNA, 22 nt, Human
gucauggaggauugugaguggu

SEQ ID NO: 569744 - RNA, 22 nt, Human
uggcuuuugaaaaggugaugua

SEQ ID NO: 569745 - RNA, 22 nt, Human
uucagauaagucaaguuaguau

SEQ ID NO: 569746 - RNA, 22 nt, Human
gcacguguucuguggcaugggu

SEQ ID NO: 569747 - RNA, 22 nt, Human
gggacagcuguagugcuuggcu

SEQ ID NO: 569748 - RNA, 22 nt, Human
uccagcucugcugugcgccggu

SEQ ID NO: 569749 - RNA, 22 nt, Human
cccuggaacccauggccagugu

SEQ ID NO: 569750 - RNA, 19 nt, Human
aaauccaagcucaggccuc

SEQ ID NO: 569751 - RNA, 22 nt, Human
ugcccauggcaggauuucugaa

SEQ ID NO: 569752 - RNA, 22 nt, Human
gcaagcagcccagaacagcucu

SEQ ID NO: 569753 - RNA, 22 nt, Human
guucugucugagcaccacagga

SEQ ID NO: 569754 - RNA, 22 nt, Human
ugcugcucuucaccauggccuc

SEQ ID NO: 569755 - RNA, 22 nt, Human
gagacagagagguacucaacau

SEQ ID NO: 569756 - RNA, 22 nt, Human
uagcccuugaugcugcggccag

SEQ ID NO: 569757 - RNA, 22 nt, Human
caguuaaacagauugaguguua

SEQ ID NO: 569758 - RNA, 22 nt, Human
agagaauuaacauuccauggcu

SEQ ID NO: 569759 - RNA, 22 nt, Human
gagaauguuaauguugaaguau

SEQ ID NO: 569760 - RNA, 22 nt, Human
gcagagucagguccaaggacug

SEQ ID NO: 569761 - RNA, 22 nt, Human
ucacuaugcccagaauacaguu

SEQ ID NO: 569762 - RNA, 22 nt, Human
gacuacaggugugugccaccau

SEQ ID NO: 569763 - RNA, 23 nt, Human
aaauugucguaagguggagaugu

SEQ ID NO: 569764 - RNA, 22 nt, Human
gaaggagaggauugugaggcug

SEQ ID NO: 569765 - RNA, 22 nt, Human
gggcugagggguaucucauggg

SEQ ID NO: 569766 - RNA, 22 nt, Human
uuccaauaaaauguuauuugca

SEQ ID NO: 569767 - RNA, 22 nt, Human
uuucuucucacccaggacagag

SEQ ID NO: 569768 - RNA, 22 nt, Human
uuugacaacugugcaguuugua

SEQ ID NO: 569769 - RNA, 20 nt, Human
agcuuugguuaagccagugg

SEQ ID NO: 569770 - RNA, 22 nt, Human
augaucaagaauuuuguauucc

SEQ ID NO: 569771 - RNA, 22 nt, Human
gaaccuguccugagugaggagu

SEQ ID NO: 569772 - RNA, 22 nt, Human
auuggccagacuuauccuucag

SEQ ID NO: 569773 - RNA, 22 nt, Human
cugcccugcagcuccacggacu

SEQ ID NO: 569774 - RNA, 17 nt, Human
gugcuggccuggggcuc

SEQ ID NO: 569775 - RNA, 22 nt, Human
uuguuuaaagaacuucugacuu

SEQ ID NO: 569776 - RNA, 22 nt, Human
cuccagcagaaagggcgagugg

SEQ ID NO: 569777 - RNA, 22 nt, Human
cuucacaaaauauuucauuaua

SEQ ID NO: 569778 - RNA, 22 nt, Human
caaacugaacacgaaagucuuu

SEQ ID NO: 569779 - RNA, 22 nt, Human
cuacuguaguuaaaguuuugua

SEQ ID NO: 569780 - RNA, 22 nt, Human
ugugucuaaugacuauuucuuc

SEQ ID NO: 569781 - RNA, 22 nt, Human
aaguuacaggagaaagagauca

SEQ ID NO: 569782 - RNA, 22 nt, Human
gcuuccuucuaccacaucaugc

SEQ ID NO: 569783 - RNA, 22 nt, Human
ugcaagagcccaaacuauauac

SEQ ID NO: 569784 - RNA, 22 nt, Human
ucuccucuccuuucauguuguu

SEQ ID NO: 569785 - RNA, 22 nt, Human
cucagcaacagcgacuuaaggg

SEQ ID NO: 569786 - RNA, 22 nt, Human
uccuggggaggucgaggcugag

SEQ ID NO: 569787 - RNA, 22 nt, Human
aaaagagccacuuaugaccuca

SEQ ID NO: 569788 - RNA, 22 nt, Human
gugcuaugauuggacagaauag

SEQ ID NO: 569789 - RNA, 22 nt, Human
ggagggaaccuuggcuggauug

SEQ ID NO: 569790 - RNA, 22 nt, Human
auacaccaccuuggaucuuuca

SEQ ID NO: 569791 - RNA, 18 nt, Human
ucaguccuccauagagcu

SEQ ID NO: 569792 - RNA, 22 nt, Human
cggucguaguucuucagcaggu

SEQ ID NO: 569793 - RNA, 22 nt, Human
auagcaaaggacaauagucagu

SEQ ID NO: 569794 - RNA, 22 nt, Human
aucucccaaauuagccucuuga

SEQ ID NO: 569795 - RNA, 22 nt, Human
cauaacauccuugcuacuuuga

SEQ ID NO: 569796 - RNA, 22 nt, Human
ucuuuuaucuguuguguaacaa

SEQ ID NO: 569797 - RNA, 22 nt, Human
agaguguggaaauguucagagu

SEQ ID NO: 569798 - RNA, 22 nt, Human
aauuagaagcuguuagcaaaau

SEQ ID NO: 569799 - RNA, 22 nt, Human
uaccaaaaccaagccauuaucu

SEQ ID NO: 569800 - RNA, 22 nt, Human
ucacuugaaccugggaggcaga

SEQ ID NO: 569801 - RNA, 22 nt, Human
acacacagaaggaagccccacu

SEQ ID NO: 569802 - RNA, 22 nt, Human
gagcagcaggccagguugcagg

SEQ ID NO: 569803 - RNA, 22 nt, Human
auuuacagccuugccaucuaua

SEQ ID NO: 569804 - RNA, 22 nt, Human
cacaggaagcaagccuggggcc

SEQ ID NO: 569805 - RNA, 22 nt, Human
uaucacauacuucucauccagg

SEQ ID NO: 569806 - RNA, 22 nt, Human
cugcaguucuucuccucaaggc

SEQ ID NO: 569807 - RNA, 22 nt, Human
cauuucaaacaguuacagcugc

SEQ ID NO: 569808 - RNA, 22 nt, Human
gcugucccgaaccccugguaau

SEQ ID NO: 569809 - RNA, 22 nt, Human
ugcacccacuuagcugaaguuc

SEQ ID NO: 569810 - RNA, 22 nt, Human
gcugcuggcuuccugcuguuuu

SEQ ID NO: 569811 - RNA, 22 nt, Human
cugaaacuauggggaggggagc

SEQ ID NO: 569812 - RNA, 22 nt, Human
aacugguucuggaggcugcagg

SEQ ID NO: 569813 - RNA, 22 nt, Human
ucaaagcacuggggaaagccug

SEQ ID NO: 569814 - RNA, 22 nt, Human
ggaaggggagcuggaaagggua

SEQ ID NO: 569815 - RNA, 22 nt, Human
cccucuggcucuucucaggccg

SEQ ID NO: 569816 - RNA, 22 nt, Human
uaacauuucggugacaguggga

SEQ ID NO: 569817 - RNA, 22 nt, Human
guccacauaggaacccagcuuc

SEQ ID NO: 569818 - RNA, 22 nt, Human
ugacuuuggacuagugauuuaa

SEQ ID NO: 569819 - RNA, 22 nt, Human
agaguguguggggcugagguca

SEQ ID NO: 569820 - RNA, 22 nt, Human
acaaucagcacugaguuuaucu

SEQ ID NO: 569821 - RNA, 20 nt, Human
ccuggagccuggaaggaguc

SEQ ID NO: 569822 - RNA, 18 nt, Human
ucugugggaucagugagg

SEQ ID NO: 569823 - RNA, 22 nt, Human
cuuuaguucuagaaagugaaac

SEQ ID NO: 569824 - RNA, 22 nt, Human
agaaguaucaggaagauucuca

SEQ ID NO: 569825 - RNA, 22 nt, Human
ugaaacagucuccagacuugga

SEQ ID NO: 569826 - RNA, 22 nt, Human
aggagggagcuuaagccaggca

SEQ ID NO: 569827 - RNA, 17 nt, Human
ucuggaugucauggaag

SEQ ID NO: 569828 - RNA, 22 nt, Human
agcuccugaaaauccagacugg

SEQ ID NO: 569829 - RNA, 22 nt, Human
caucugcaggggaagccaguuu

SEQ ID NO: 569830 - RNA, 22 nt, Human
augaugaagcaugguuacacug

SEQ ID NO: 569831 - RNA, 22 nt, Human
uuugaagauaaauauggagaaa

SEQ ID NO: 569832 - RNA, 19 nt, Human
cuccacagggauugugauu

SEQ ID NO: 569833 - RNA, 22 nt, Human
ucuccucuauuucuguauguau

SEQ ID NO: 569834 - RNA, 22 nt, Human
ucuuugcauggacauguguuuu

SEQ ID NO: 569835 - RNA, 22 nt, Human
cuccgcuuguguauaccuccaa

SEQ ID NO: 569836 - RNA, 22 nt, Human
uccacagugguggaauuguuca

SEQ ID NO: 569837 - RNA, 22 nt, Human
cgcuuuggagucccugcuuuac

SEQ ID NO: 569838 - RNA, 22 nt, Human
uuuacagagaauguacauaaag

SEQ ID NO: 569839 - RNA, 19 nt, Human
uggugcgcuguuccugagc

SEQ ID NO: 569840 - RNA, 22 nt, Human
uagcagaacaauagucaaugau

SEQ ID NO: 569841 - RNA, 22 nt, Human
gugugcgccgacacagccaggu

SEQ ID NO: 569842 - RNA, 22 nt, Human
cuauuuucccauaugguugaca

SEQ ID NO: 569843 - RNA, 22 nt, Human
gucuccugaggcauccauugaa

SEQ ID NO: 569844 - RNA, 22 nt, Human
uggcuggcuguccagcugggca

SEQ ID NO: 569845 - RNA, 22 nt, Human
aaggcuauaucucaauacuauu

SEQ ID NO: 569846 - RNA, 22 nt, Human
cauugcaacuucaaacuccugg

SEQ ID NO: 569847 - RNA, 22 nt, Human
gcacuagauucugaagcagcag

SEQ ID NO: 569848 - RNA, 22 nt, Human
ggcggcgcguagccggagacuu

SEQ ID NO: 569849 - RNA, 22 nt, Human
acagcaucccugaagauaacca

SEQ ID NO: 569850 - RNA, 22 nt, Human
aggccaagcucccagagaagcu

SEQ ID NO: 569851 - RNA, 22 nt, Human
ucaggagaguguucaguggagg

SEQ ID NO: 569852 - RNA, 22 nt, Human
gucuugcacuuaccuaagaacu

SEQ ID NO: 569853 - RNA, 22 nt, Human
ucuugccgcgcaggcgcaguuc

SEQ ID NO: 569854 - RNA, 22 nt, Human
acugagaacuuggggacagagg

SEQ ID NO: 569855 - RNA, 22 nt, Human
caagacuucaccgcucugugcu

SEQ ID NO: 569856 - RNA, 22 nt, Human
aaauacaguggcagcagauaau

SEQ ID NO: 569857 - RNA, 22 nt, Human
uguaucauauggggaagcuuca

SEQ ID NO: 569858 - RNA, 22 nt, Human
gaaaugucaagauauguuugga

SEQ ID NO: 569859 - RNA, 22 nt, Human
gcauucuugguggagugcuaaa

SEQ ID NO: 569860 - RNA, 22 nt, Human
ccugugggagggagcggcugga

SEQ ID NO: 569861 - RNA, 22 nt, Human
guaaagcaaaauguagagauug

SEQ ID NO: 569862 - RNA, 22 nt, Human
ucagccagaggcuucuugguuu

SEQ ID NO: 569863 - RNA, 22 nt, Human
aaacaucuucucuugauucuuu

SEQ ID NO: 569864 - RNA, 22 nt, Human
gagcagcagcugggccagguuc

SEQ ID NO: 569865 - RNA, 22 nt, Human
gcagaagucagaccaucugaau

SEQ ID NO: 569866 - RNA, 23 nt, Human
auaauaacgucugucuugucucu

SEQ ID NO: 569867 - RNA, 22 nt, Human
agcugcaaguccaaaggaauua

SEQ ID NO: 569868 - RNA, 22 nt, Human
gagaauacaaccagaagcugag

SEQ ID NO: 569869 - RNA, 22 nt, Human
ucucgugcaggccuugcucgga

SEQ ID NO: 569870 - RNA, 22 nt, Human
cucuagcucccagggagcgucu

SEQ ID NO: 569871 - RNA, 22 nt, Human
uuccuucuucauuguguuacag

SEQ ID NO: 569872 - RNA, 22 nt, Human
auugagaaggagauuggcaucu

SEQ ID NO: 569873 - RNA, 22 nt, Human
ggagugggaacaaugacauggu

SEQ ID NO: 569874 - RNA, 22 nt, Human
uuguaacaguagcugucagcuc

SEQ ID NO: 569875 - RNA, 21 nt, Human
aguuagcagauuucugucucc

SEQ ID NO: 569876 - RNA, 21 nt, Human
guucaauagcucuuugaaugc

SEQ ID NO: 569877 - RNA, 23 nt, Human
ucucaggguggcugggcccaucc

SEQ ID NO: 569878 - RNA, 22 nt, Human
agugggagcggcagucggggac

SEQ ID NO: 569879 - RNA, 22 nt, Human
agccugugcuguguuugcucca

SEQ ID NO: 569880 - RNA, 22 nt, Human
aaucccuccccaggcaaguccu

SEQ ID NO: 569881 - RNA, 23 nt, Human
gcacagagcaguuaggggaagau

SEQ ID NO: 569882 - RNA, 22 nt, Human
ggucuuucuuugauaguggaga

SEQ ID NO: 569883 - RNA, 22 nt, Human
uucuaagaaauggaaaacgauu

SEQ ID NO: 569884 - RNA, 22 nt, Human
agugggaauuuucucccaggga

SEQ ID NO: 569885 - RNA, 22 nt, Human
aaagaugucauacacauuaaga

SEQ ID NO: 569886 - RNA, 22 nt, Human
uacugcaaaccauuuacaguag

SEQ ID NO: 569887 - RNA, 19 nt, Human
cuggcuucaagcaguccuc

SEQ ID NO: 569888 - RNA, 18 nt, Human
augcucuagucuuuccug

SEQ ID NO: 569889 - RNA, 22 nt, Human
ccaaaauauuagugcuuaagua

SEQ ID NO: 569890 - RNA, 22 nt, Human
ugggggagccuucacaguagcu

SEQ ID NO: 569891 - RNA, 22 nt, Human
gggacuggaguagaggccggug

SEQ ID NO: 569892 - RNA, 22 nt, Human
uuguccagcgaccaggcucugu

SEQ ID NO: 569893 - RNA, 18 nt, Human
uucggcagauacgcuugg

SEQ ID NO: 569894 - RNA, 22 nt, Human
caggccacacggcggcucccug

SEQ ID NO: 569895 - RNA, 22 nt, Human
caguuuuucaaaauuacaugau

SEQ ID NO: 569896 - RNA, 22 nt, Human
uugaaguccuagccccugguaa

SEQ ID NO: 569897 - RNA, 21 nt, Human
ucuuggggaggagggcugcac

SEQ ID NO: 569898 - RNA, 22 nt, Human
ucuauuaaugauucaauagugu

SEQ ID NO: 569899 - RNA, 22 nt, Human
ugcaauuagcguauuaguuuau

SEQ ID NO: 569900 - RNA, 22 nt, Human
auguacaaucuaucacaagaag

SEQ ID NO: 569901 - RNA, 22 nt, Human
aacagaaaucauuuagggcucu

SEQ ID NO: 569902 - RNA, 22 nt, Human
gccucugcacuguggcacacca

SEQ ID NO: 569903 - RNA, 22 nt, Human
uucuccccgucucucugaggcc

SEQ ID NO: 569904 - RNA, 22 nt, Human
augcacaagguagauuauuauu

SEQ ID NO: 569905 - RNA, 22 nt, Human
gcugcaagugcauguugcaacu

SEQ ID NO: 569906 - RNA, 22 nt, Human
uccaggagcucauccacgucaa

SEQ ID NO: 569907 - RNA, 22 nt, Human
ccuuuuggccaggucagugcag

SEQ ID NO: 569908 - RNA, 22 nt, Human
uacauuuauaaggcuucucugu

SEQ ID NO: 569909 - RNA, 21 nt, Human
uuggccgugcagaugaacagc

SEQ ID NO: 569910 - RNA, 22 nt, Human
cccuguccugcuaggcccuggu

SEQ ID NO: 569911 - RNA, 22 nt, Human
acccugccucugcuuccuguag

SEQ ID NO: 569912 - RNA, 22 nt, Human
uaaaugaaaggguuuaauuuau

SEQ ID NO: 569913 - RNA, 22 nt, Human
auacacauguuauuguggaagc

SEQ ID NO: 569914 - RNA, 21 nt, Human
ucacuagugccuucugucauu

SEQ ID NO: 569915 - RNA, 22 nt, Human
gggccccaagaaccuccuccug

SEQ ID NO: 569916 - RNA, 22 nt, Human
ugcaucauuaagguacaguugg

SEQ ID NO: 569917 - RNA, 22 nt, Human
cugaacaucccgcagugcacga

SEQ ID NO: 569918 - RNA, 22 nt, Human
aagcacuaauauuuuggcaccu

SEQ ID NO: 569919 - RNA, 20 nt, Human
gggugugugcagggccuggu

SEQ ID NO: 569920 - RNA, 22 nt, Human
caauguacaaaauaauuacaca

SEQ ID NO: 569921 - RNA, 22 nt, Human
uugcaucagcaggcauaauugg

SEQ ID NO: 569922 - RNA, 22 nt, Human
aguuuacccacuguugaaauua

SEQ ID NO: 569923 - RNA, 22 nt, Human
uuuccaguuguucuagaaagcu

SEQ ID NO: 569924 - RNA, 22 nt, Human
auuuccuauacaguuguccaua

SEQ ID NO: 569925 - RNA, 22 nt, Human
aucuucaaggaaaaaauacagu

SEQ ID NO: 569926 - RNA, 22 nt, Human
guugcaaaugggaagaugguua

SEQ ID NO: 569927 - RNA, 22 nt, Human
gucugcugacagagcauggacc

SEQ ID NO: 569928 - RNA, 22 nt, Human
gugcauauguguguauacaaac

SEQ ID NO: 569929 - RNA, 22 nt, Human
accaagaguccaagugagguug

SEQ ID NO: 569930 - RNA, 22 nt, Human
ggcagaggaagcuggaaguggg

SEQ ID NO: 569931 - RNA, 22 nt, Human
auucucuguacagaagguaccg

SEQ ID NO: 569932 - RNA, 20 nt, Human
uuucacaaugaacaugucuc

SEQ ID NO: 569933 - RNA, 22 nt, Human
gcugcugcuugaaggcucggag

SEQ ID NO: 569934 - RNA, 22 nt, Human
aacugcuaacugguuugauacu

SEQ ID NO: 569935 - RNA, 22 nt, Human
acugcauuaucaccaagaugua

SEQ ID NO: 569936 - RNA, 22 nt, Human
ggagccuggaguuucugauggg

SEQ ID NO: 569937 - RNA, 22 nt, Human
aggggcuuguggaguugcuggu

SEQ ID NO: 569938 - RNA, 22 nt, Human
cuucuuaaaguugucacagcug

SEQ ID NO: 569939 - RNA, 22 nt, Human
ucuccagaguaaccuuggagca

SEQ ID NO: 569940 - RNA, 22 nt, Human
ucaucuguuaugggaguuuuug

SEQ ID NO: 569941 - RNA, 22 nt, Human
agggaaauuaaugugagcaaug

SEQ ID NO: 569942 - RNA, 22 nt, Human
auauuuguuuggcagaguucag

SEQ ID NO: 569943 - RNA, 22 nt, Human
gcgacgcaggcacgacguguug

SEQ ID NO: 569944 - RNA, 22 nt, Human
ugcaaaaagagcgaggagcccu

SEQ ID NO: 569945 - RNA, 22 nt, Human
uuuacuucugcauuuccccuag

SEQ ID NO: 569946 - RNA, 22 nt, Human
gagcucauccccaugguccguc

SEQ ID NO: 569947 - RNA, 16 nt, Human
ucauugaagacaguac

SEQ ID NO: 569948 - RNA, 22 nt, Human
ucgcagcacuagcccugcauug

SEQ ID NO: 569949 - RNA, 22 nt, Human
gccaggaugacuauacaacagc

SEQ ID NO: 569950 - RNA, 22 nt, Human
augccaucaaugacagaguuag

SEQ ID NO: 569951 - RNA, 22 nt, Human
gggcggggcuuccguccuccac

SEQ ID NO: 569952 - RNA, 22 nt, Human
ucagaacauccugguuuaaaau

SEQ ID NO: 569953 - RNA, 22 nt, Human
ugagucauguaauaaugcugcu

SEQ ID NO: 569954 - RNA, 22 nt, Human
cagggccucugugggcucucuc

SEQ ID NO: 569955 - RNA, 22 nt, Human
uaaggagagaauuuagagguuu

SEQ ID NO: 569956 - RNA, 23 nt, Human
uggcucuguggaucccucaggag

SEQ ID NO: 569957 - RNA, 22 nt, Human
acaggauuaauaaaaaauugua

SEQ ID NO: 569958 - RNA, 22 nt, Human
acaaaugcuuaguucaccaaaa

SEQ ID NO: 569959 - RNA, 22 nt, Human
cggcagagcccugagucagccu

SEQ ID NO: 569960 - RNA, 23 nt, Human
uguguucagucaaggaucagagu

SEQ ID NO: 569961 - RNA, 22 nt, Human
agaguuuacagaaauaagcugu

SEQ ID NO: 569962 - RNA, 22 nt, Human
uacugucuuuuccuaaaugggu

SEQ ID NO: 569963 - RNA, 22 nt, Human
ccuggccugugaaucugagagc

SEQ ID NO: 569964 - RNA, 22 nt, Human
ucuguaaacacccguaagcuuu

SEQ ID NO: 569965 - RNA, 22 nt, Human
uuuucuaacaucuaguaauuug

SEQ ID NO: 569966 - RNA, 22 nt, Human
uggcacugucaccaaugcuguc

SEQ ID NO: 569967 - RNA, 22 nt, Human
uugaacaguuuugucagguuca

SEQ ID NO: 569968 - RNA, 22 nt, Human
ccugcgcgucugggucugucuc

SEQ ID NO: 569969 - RNA, 18 nt, Human
ggaaaaggagugucuagc

SEQ ID NO: 569970 - RNA, 22 nt, Human
aucuucaaagcacaucguuugu

SEQ ID NO: 569971 - RNA, 22 nt, Human
gguccccguggaggcuggagcg

SEQ ID NO: 569972 - RNA, 22 nt, Human
ggaaugcacuagacugugaaac

SEQ ID NO: 569973 - RNA, 20 nt, Human
cccuuuucacgaaaaggaga

SEQ ID NO: 569974 - RNA, 22 nt, Human
ugcagaauauucuggugacaau

SEQ ID NO: 569975 - RNA, 21 nt, Human
uaagaacauuaucuucuuccu

SEQ ID NO: 569976 - RNA, 22 nt, Human
uacagcgaaaauuuagcuugau

SEQ ID NO: 569977 - RNA, 17 nt, Human
ccuuucuucccagaggg

SEQ ID NO: 569978 - RNA, 22 nt, Human
agugaaaaccuaaucaugcagu

SEQ ID NO: 569979 - RNA, 22 nt, Human
auuucauccauuaagaguacuc

SEQ ID NO: 569980 - RNA, 22 nt, Human
uuucucggcagagaugaugggc

SEQ ID NO: 569981 - RNA, 22 nt, Human
ucuguuauaaaucacacugcau

SEQ ID NO: 569982 - RNA, 22 nt, Human
aguguauuugccuauaaaaaug

SEQ ID NO: 569983 - RNA, 22 nt, Human
ugaguguuguaaccauaugauu

SEQ ID NO: 569984 - RNA, 22 nt, Human
ugcuuucaaugaauuguauacu

SEQ ID NO: 569985 - RNA, 22 nt, Human
ugcccugcagacccugcagugu

SEQ ID NO: 569986 - RNA, 22 nt, Human
aacuuucagaauccuaugcauu

SEQ ID NO: 569987 - RNA, 22 nt, Human
uaaguauguuagaaaaucaagu

SEQ ID NO: 569988 - RNA, 22 nt, Human
acuagaaacuaauggauuauua

SEQ ID NO: 569989 - RNA, 22 nt, Human
ugcauuaagaauuucugaggau

SEQ ID NO: 569990 - RNA, 22 nt, Human
ugucuucauuccccaugaaguc

SEQ ID NO: 569991 - RNA, 22 nt, Human
ucaagaaagggcuucaccagga

SEQ ID NO: 569992 - RNA, 22 nt, Human
guuucuccucugugucuuguuu

SEQ ID NO: 569993 - RNA, 22 nt, Human
gagcugagggucuaggaggguu

SEQ ID NO: 569994 - RNA, 22 nt, Human
aagacacuuucuaaauagaagu

SEQ ID NO: 569995 - RNA, 22 nt, Human
cugugaauguuauaucucaaug

SEQ ID NO: 569996 - RNA, 22 nt, Human
aggugggacccguggggugcga

SEQ ID NO: 569997 - RNA, 22 nt, Human
guucuccaggggcuguucaucu

SEQ ID NO: 569998 - RNA, 22 nt, Human
agcaaggcagcuuucacugcuu

SEQ ID NO: 569999 - RNA, 22 nt, Human
cacagcuucuccccgcugcggc

SEQ ID NO: 570000 - RNA, 22 nt, Human
gggaggugauuaggaccaugua

SEQ ID NO: 570001 - RNA, 22 nt, Human
aggccgugugagcaugugugag

SEQ ID NO: 570002 - RNA, 22 nt, Human
guguuucccuggcacaagaacc

SEQ ID NO: 570003 - RNA, 22 nt, Human
cuaguucugccauucaguguca

SEQ ID NO: 570004 - RNA, 22 nt, Human
uucuuucugggguccuucggcu

SEQ ID NO: 570005 - RNA, 22 nt, Human
cagguugaaaguggaggagcua

SEQ ID NO: 570006 - RNA, 22 nt, Human
uaucaguagaacaauggacauu

SEQ ID NO: 570007 - RNA, 22 nt, Human
aauacagugaaagugagcaagg

SEQ ID NO: 570008 - RNA, 22 nt, Human
ugcugcgggacccacugugggc

SEQ ID NO: 570009 - RNA, 22 nt, Human
cuugucuaguuccuggugaugu

SEQ ID NO: 570010 - RNA, 22 nt, Human
auacaacagaaaaugauuauuc

SEQ ID NO: 570011 - RNA, 22 nt, Human
uaaggacagcagcuacuuuucc

SEQ ID NO: 570012 - RNA, 22 nt, Human
aaagcacauuacaagcucaguc

SEQ ID NO: 570013 - RNA, 22 nt, Human
aagauuuaccacuuuauucaag

SEQ ID NO: 570014 - RNA, 22 nt, Human
aaugagaauguaagugaagaga

SEQ ID NO: 570015 - RNA, 23 nt, Human
augcaacauugccaguaugggca

SEQ ID NO: 570016 - RNA, 19 nt, Human
auucuucucuuccugcugu

SEQ ID NO: 570017 - RNA, 22 nt, Human
aguguucuagcgcugugcuugu

SEQ ID NO: 570018 - RNA, 22 nt, Human
ugucuuaugcugcauagacuau

SEQ ID NO: 570019 - RNA, 22 nt, Human
uuuggagagaugaaguucugug

SEQ ID NO: 570020 - RNA, 17 nt, Human
caguuucuucccccucu

SEQ ID NO: 570021 - RNA, 22 nt, Human
ucaaaggcuugugguucuggga

SEQ ID NO: 570022 - RNA, 22 nt, Human
auacaugugugugcauacaugu

SEQ ID NO: 570023 - RNA, 22 nt, Human
uggucccugaagagagaccuug

SEQ ID NO: 570024 - RNA, 22 nt, Human
ugcuccugaacacagcccuaug

SEQ ID NO: 570025 - RNA, 22 nt, Human
aaugguaauauuucauaguugu

SEQ ID NO: 570026 - RNA, 22 nt, Human
ugcauggacgugacuuggccaa

SEQ ID NO: 570027 - RNA, 22 nt, Human
uucauuacauucaaaaggcauu

SEQ ID NO: 570028 - RNA, 22 nt, Human
auggggagcucaccaccuguuu

SEQ ID NO: 570029 - RNA, 22 nt, Human
agugacagauuaccggcagagc

SEQ ID NO: 570030 - RNA, 22 nt, Human
uggcccugccgccacgacgucu

SEQ ID NO: 570031 - RNA, 22 nt, Human
uucuguuuauaauuugcaguug

SEQ ID NO: 570032 - RNA, 18 nt, Human
gacaaaaguacagacaga

SEQ ID NO: 570033 - RNA, 22 nt, Human
ucuuugcagaauuuaacuuugc

SEQ ID NO: 570034 - RNA, 20 nt, Human
ucaggguuucccauucuugg

SEQ ID NO: 570035 - RNA, 22 nt, Human
cagucauuaugggaguuaaucc

SEQ ID NO: 570036 - RNA, 22 nt, Human
auuuuagagaaacaaacguagg

SEQ ID NO: 570037 - RNA, 22 nt, Human
aaaacauuuuacugccaucuca

SEQ ID NO: 570038 - RNA, 22 nt, Human
ggggaggaagcuggaacacggg

SEQ ID NO: 570039 - RNA, 22 nt, Human
ccucuucagcaaaguucggccc

SEQ ID NO: 570040 - RNA, 22 nt, Human
guuaaugcaaagcagagggcaa

SEQ ID NO: 570041 - RNA, 22 nt, Human
uuugcuugauuaggauauggaa

SEQ ID NO: 570042 - RNA, 22 nt, Human
acagugucuccugguacccagu

SEQ ID NO: 570043 - RNA, 22 nt, Human
augaauaaaacauuuuaaucag

SEQ ID NO: 570044 - RNA, 22 nt, Human
gaggaggcuuccgggaggcacg

SEQ ID NO: 570045 - RNA, 22 nt, Human
aagcccuuggcgcacaccgggc

SEQ ID NO: 570046 - RNA, 22 nt, Human
gacauuuauuggauuuuacgag

SEQ ID NO: 570047 - RNA, 22 nt, Human
gcucguacaccagcguggaggu

SEQ ID NO: 570048 - RNA, 22 nt, Human
augcacuaugaugagcuagucu

SEQ ID NO: 570049 - RNA, 22 nt, Human
acaaaggugagcagaagacaca

SEQ ID NO: 570050 - RNA, 22 nt, Human
gugaagaugccucaggugaccc

SEQ ID NO: 570051 - RNA, 22 nt, Human
auguaguauuuggaaauguaaa

SEQ ID NO: 570052 - RNA, 22 nt, Human
cacaccuuaggccugagcgcuu

SEQ ID NO: 570053 - RNA, 22 nt, Human
cugggaggcccacguugggaag

SEQ ID NO: 570054 - RNA, 22 nt, Human
cugggguaucugccacaacucu

SEQ ID NO: 570055 - RNA, 22 nt, Human
auuaaauuggacgcugggggaa

SEQ ID NO: 570056 - RNA, 22 nt, Human
cagacucuugagcugauuguau

SEQ ID NO: 570057 - RNA, 22 nt, Human
ggagcugcucagagccaguccc

SEQ ID NO: 570058 - RNA, 22 nt, Human
uagcauuucacugaucuucacu

SEQ ID NO: 570059 - RNA, 22 nt, Human
acaguaaucugggaacuuguua

SEQ ID NO: 570060 - RNA, 22 nt, Human
caauaguaaauuacggaggaga

SEQ ID NO: 570061 - RNA, 21 nt, Human
uuccuccucuggagaagaaga

SEQ ID NO: 570062 - RNA, 20 nt, Human
ugcuggaggcgccggcgcuc

SEQ ID NO: 570063 - RNA, 22 nt, Human
uucccuuucuuaaagaguuagg

SEQ ID NO: 570064 - RNA, 21 nt, Human
caggaacauucuuuacauuua

SEQ ID NO: 570065 - RNA, 22 nt, Human
ugccgcugucgccaccauggcu

SEQ ID NO: 570066 - RNA, 22 nt, Human
aaugaaacuauauuuagagagg

SEQ ID NO: 570067 - RNA, 22 nt, Human
uuguacaaauaggaaccucuga

SEQ ID NO: 570068 - RNA, 22 nt, Human
cuuugcagagggggugggagcu

SEQ ID NO: 570069 - RNA, 22 nt, Human
ggagugacucucggggccacua

SEQ ID NO: 570070 - RNA, 22 nt, Human
ccagcugcgggcaucgagaguu

SEQ ID NO: 570071 - RNA, 22 nt, Human
auuuacagacguggauuagugc

SEQ ID NO: 570072 - RNA, 22 nt, Human
gaugcugauuuuacuguuuucu

SEQ ID NO: 570073 - RNA, 22 nt, Human
gauguggcugcucuaaagccca

SEQ ID NO: 570074 - RNA, 22 nt, Human
ggccacuguuuccugggcaguu

SEQ ID NO: 570075 - RNA, 22 nt, Human
gaaaauaguucaucacaaugau

SEQ ID NO: 570076 - RNA, 22 nt, Human
ccaggaugacccccacuuuccu

SEQ ID NO: 570077 - RNA, 22 nt, Human
gcuucucauguuuauuuuuaca

SEQ ID NO: 570078 - RNA, 22 nt, Human
uuuuucaagacaaccugcaugu

SEQ ID NO: 570079 - RNA, 17 nt, Human
aggucugagaguaucug

SEQ ID NO: 570080 - RNA, 21 nt, Human
agcaucugaggcaguuuccua

SEQ ID NO: 570081 - RNA, 22 nt, Human
uaaaguauaagcauuggaguau

SEQ ID NO: 570082 - RNA, 22 nt, Human
ugucuuacagcaaucuguucug

SEQ ID NO: 570083 - RNA, 22 nt, Human
ugcauguuucuguauguuaaug

SEQ ID NO: 570084 - RNA, 22 nt, Human
uucuguucccuaggaccugggg

SEQ ID NO: 570085 - RNA, 22 nt, Human
acggagcccgugucagguggga

SEQ ID NO: 570086 - RNA, 22 nt, Human
augaaacucuagcuuucagcac

SEQ ID NO: 570087 - RNA, 22 nt, Human
gcggcccgagcaggacgggugg

SEQ ID NO: 570088 - RNA, 22 nt, Human
aaauuaacuaucacuuuuguga

SEQ ID NO: 570089 - RNA, 22 nt, Human
cgaggaggaaacgcggagaacu

SEQ ID NO: 570090 - RNA, 22 nt, Human
aguguuaaggcugguugcuaua

SEQ ID NO: 570091 - RNA, 22 nt, Human
auaguagcgagaucucagcuca

SEQ ID NO: 570092 - RNA, 22 nt, Human
ucacaggagcccaggggagcug

SEQ ID NO: 570093 - RNA, 22 nt, Human
uuuccacacucacugcacucau

SEQ ID NO: 570094 - RNA, 22 nt, Human
aagcauuuuagauaaagcauca

SEQ ID NO: 570095 - RNA, 22 nt, Human
caaacauuuguuggaaccccug

SEQ ID NO: 570096 - RNA, 22 nt, Human
uucaguaugcugaaugauuuuu

SEQ ID NO: 570097 - RNA, 22 nt, Human
ucuuauaccccuaaacugcagc

SEQ ID NO: 570098 - RNA, 22 nt, Human
ucguuauagaacauucuugggu

SEQ ID NO: 570099 - RNA, 22 nt, Human
cuucauuuggcaggcuggccuc

SEQ ID NO: 570100 - RNA, 22 nt, Human
uuggaggacuaguuaagagacc

SEQ ID NO: 570101 - RNA, 22 nt, Human
cgcgcugcagacagcggaggcc

SEQ ID NO: 570102 - RNA, 22 nt, Human
accuuguuguagguacaaaaga

SEQ ID NO: 570103 - RNA, 22 nt, Human
acguagcacugagagaugcagg

SEQ ID NO: 570104 - RNA, 22 nt, Human
gcagagcuggaacugguacuca

SEQ ID NO: 570105 - RNA, 22 nt, Human
cuuggcauguucaucugcuugg

SEQ ID NO: 570106 - RNA, 22 nt, Human
cauuuugugcuagacacuaugg

SEQ ID NO: 570107 - RNA, 22 nt, Human
uaggcagggauuaggguugauu

SEQ ID NO: 570108 - RNA, 22 nt, Human
aaaugcacugaauauuccaaau

SEQ ID NO: 570109 - RNA, 22 nt, Human
uuguaagacuguagaaugcaaa

SEQ ID NO: 570110 - RNA, 22 nt, Human
ucacacaucucagguguuuaau

SEQ ID NO: 570111 - RNA, 22 nt, Human
uaaaaguuagcuaggacaaagu

SEQ ID NO: 570112 - RNA, 23 nt, Human
guuauugcuggugcuggccagcc

SEQ ID NO: 570113 - RNA, 22 nt, Human
uuguauuaaaauguguuucugu

SEQ ID NO: 570114 - RNA, 23 nt, Human
uaucauuucagcucucugccugg

SEQ ID NO: 570115 - RNA, 22 nt, Human
cugagcaucauggcagaaucuu

SEQ ID NO: 570116 - RNA, 22 nt, Human
ucugccaucaagaugcucuggc

SEQ ID NO: 570117 - RNA, 22 nt, Human
agcaccauugcaaauauggcag

SEQ ID NO: 570118 - RNA, 22 nt, Human
cucugaauggacacuccagugu

SEQ ID NO: 570119 - RNA, 22 nt, Human
agcacauucccaccuguacuuc

SEQ ID NO: 570120 - RNA, 22 nt, Human
agcauucuguggucuucuaugg

SEQ ID NO: 570121 - RNA, 22 nt, Human
gacggggcagccagcugguggc

SEQ ID NO: 570122 - RNA, 22 nt, Human
ugcuccaucuagagcucugcag

SEQ ID NO: 570123 - RNA, 22 nt, Human
uuaccuuguaaaacauauuccu

SEQ ID NO: 570124 - RNA, 22 nt, Human
ucauaggaguagcagugagagg

SEQ ID NO: 570125 - RNA, 22 nt, Human
guucuucaggcugugcucuaga

SEQ ID NO: 570126 - RNA, 22 nt, Human
aacagguagggacucuaacuug

SEQ ID NO: 570127 - RNA, 22 nt, Human
ugcauaaacuucucugguguga

SEQ ID NO: 570128 - RNA, 22 nt, Human
acauuuuuggguugaugucuga

SEQ ID NO: 570129 - RNA, 22 nt, Human
ggagcggagggagggccacugu

SEQ ID NO: 570130 - RNA, 22 nt, Human
ggagaggguagggguccugccc

SEQ ID NO: 570131 - RNA, 22 nt, Human
ucaccggugacccucggcucgc

SEQ ID NO: 570132 - RNA, 22 nt, Human
ccucuuccacugggccccaucc

SEQ ID NO: 570133 - RNA, 22 nt, Human
uuuauucucuaguuggucagau

SEQ ID NO: 570134 - RNA, 22 nt, Human
ucauacauguuguguucaaaug

SEQ ID NO: 570135 - RNA, 22 nt, Human
ggugauuuccuuuugcaaaguc

SEQ ID NO: 570136 - RNA, 22 nt, Human
ugcucccaaaccugacaggcuc

SEQ ID NO: 570137 - RNA, 22 nt, Human
uuuucaguuccaucucugcucu

SEQ ID NO: 570138 - RNA, 22 nt, Human
auguaagagcuuugcagggaaa

SEQ ID NO: 570139 - RNA, 22 nt, Human
cuacauuuacacaguuaggcuu

SEQ ID NO: 570140 - RNA, 22 nt, Human
augaaacaacagacuuggucaa

SEQ ID NO: 570141 - RNA, 22 nt, Human
ucugagagcuguagaagccuau

SEQ ID NO: 570142 - RNA, 22 nt, Human
cuggccuggcaggggaccucua

SEQ ID NO: 570143 - RNA, 22 nt, Human
uggaauuaucugaagugauuug

SEQ ID NO: 570144 - RNA, 22 nt, Human
ggccgugcuccaaagucaucgu

SEQ ID NO: 570145 - RNA, 22 nt, Human
acuuuuaaggggccuugauuua

SEQ ID NO: 570146 - RNA, 22 nt, Human
uucuuugcccauguuuccuaag

SEQ ID NO: 570147 - RNA, 22 nt, Human
ggcaauuacguauuagucaugu

SEQ ID NO: 570148 - RNA, 22 nt, Human
uuauguauggauggcugaaagu

SEQ ID NO: 570149 - RNA, 22 nt, Human
aguacuuuuuguucaauugugc

SEQ ID NO: 570150 - RNA, 22 nt, Human
gugccuccaggcucgacuaguc

SEQ ID NO: 570151 - RNA, 22 nt, Human
gaauguuauugaacuacgagcu

SEQ ID NO: 570152 - RNA, 22 nt, Human
ugcuugucucucugugcccacu

SEQ ID NO: 570153 - RNA, 22 nt, Human
ggagaagggaacugaguuuuug

SEQ ID NO: 570154 - RNA, 22 nt, Human
ucuaaacuuguaaacaagcaua

SEQ ID NO: 570155 - RNA, 22 nt, Human
uaaacagagaugccugggucug

SEQ ID NO: 570156 - RNA, 22 nt, Human
uucacagugguaaggguuguga

SEQ ID NO: 570157 - RNA, 19 nt, Human
uaugacaaguacuaguucu

SEQ ID NO: 570158 - RNA, 23 nt, Human
aaacuacauuuauaguuuuucuc

SEQ ID NO: 570159 - RNA, 22 nt, Human
aguaaaaucaccaucucuuugu

SEQ ID NO: 570160 - RNA, 22 nt, Human
uagaucuuucacuacuguguag

SEQ ID NO: 570161 - RNA, 22 nt, Human
acugauuucagggaugagaaga

SEQ ID NO: 570162 - RNA, 21 nt, Human
ucucuccucaagcucgacccc

SEQ ID NO: 570163 - RNA, 22 nt, Human
uuauugagcacauaguaugugg

SEQ ID NO: 570164 - RNA, 22 nt, Human
cugaucuuaaguaacauuauuu

SEQ ID NO: 570165 - RNA, 22 nt, Human
gcuguaacuuuuucauuuucaa

SEQ ID NO: 570166 - RNA, 22 nt, Human
gcuguggcuccaauggugagcc

SEQ ID NO: 570167 - RNA, 21 nt, Human
ucuccucccggggagaggccg

SEQ ID NO: 570168 - RNA, 22 nt, Human
cacauuuaugggcugggaggca

SEQ ID NO: 570169 - RNA, 22 nt, Human
uagcagcacuauuuguuguagu

SEQ ID NO: 570170 - RNA, 22 nt, Human
auguccagaguaaagcacauuc

SEQ ID NO: 570171 - RNA, 22 nt, Human
gccccgucguggggccagggau

SEQ ID NO: 570172 - RNA, 22 nt, Human
cuucagagugacucagcaucuu

SEQ ID NO: 570173 - RNA, 22 nt, Human
cccaggaggcagaaguugcagu

SEQ ID NO: 570174 - RNA, 22 nt, Human
agacugugagaagauggcugcg

SEQ ID NO: 570175 - RNA, 22 nt, Human
uacuacauacagaauuuagaga

SEQ ID NO: 570176 - RNA, 22 nt, Human
uguaaagaaagacgcagaguua

SEQ ID NO: 570177 - RNA, 22 nt, Human
agauaucuuacacuuugaaguu

SEQ ID NO: 570178 - RNA, 22 nt, Human
gcaggaguguggugggacaucc

SEQ ID NO: 570179 - RNA, 19 nt, Human
auacacguguauacauaca

SEQ ID NO: 570180 - RNA, 22 nt, Human
caguaaauguccucgcagggaa

SEQ ID NO: 570181 - RNA, 22 nt, Human
gcucaugggcccagagcagccc

SEQ ID NO: 570182 - RNA, 22 nt, Human
accauccaaacugcuuucugug

SEQ ID NO: 570183 - RNA, 22 nt, Human
uuugaaauguaucaguauaggu

SEQ ID NO: 570184 - RNA, 20 nt, Human
ucauaugugguuguauacaa

SEQ ID NO: 570185 - RNA, 22 nt, Human
ugagaacaaaguugaaaguuug

SEQ ID NO: 570186 - RNA, 21 nt, Human
ugcaaugcauugacagcagca

SEQ ID NO: 570187 - RNA, 22 nt, Human
cuugcuuuaucugguuucucau

SEQ ID NO: 570188 - RNA, 22 nt, Human
uaccauuucaguaaaaacuuag

SEQ ID NO: 570189 - RNA, 22 nt, Human
cauucauaggaggagaugauua

SEQ ID NO: 570190 - RNA, 22 nt, Human
acaugcacccaguuacacucuc

SEQ ID NO: 570191 - RNA, 22 nt, Human
guaugucuuaggguucaguaac

SEQ ID NO: 570192 - RNA, 22 nt, Human
acauuucuccuacuuguuauuu

SEQ ID NO: 570193 - RNA, 22 nt, Human
uuaaccagguccuuugaaaaca

SEQ ID NO: 570194 - RNA, 22 nt, Human
gucauuuuugacuuugaaguga

SEQ ID NO: 570195 - RNA, 22 nt, Human
accaggcccuccagcugcgugg

SEQ ID NO: 570196 - RNA, 22 nt, Human
cugggagggguagccaauccua

SEQ ID NO: 570197 - RNA, 22 nt, Human
ggugagaggcagugcuguggaa

SEQ ID NO: 570198 - RNA, 22 nt, Human
guuuugaauacuacuagaacuu

SEQ ID NO: 570199 - RNA, 22 nt, Human
gagagaagggggauaugagccu

SEQ ID NO: 570200 - RNA, 22 nt, Human
agaaaagaggcuuucuaagcau

SEQ ID NO: 570201 - RNA, 22 nt, Human
uucuacauugugaaguucuuua

SEQ ID NO: 570202 - RNA, 22 nt, Human
cuggcuuugaucagagugaccu

SEQ ID NO: 570203 - RNA, 22 nt, Human
gcgaaucucagcuggugcugcg

SEQ ID NO: 570204 - RNA, 19 nt, Human
cagcaaacacuguaaaugg

SEQ ID NO: 570205 - RNA, 22 nt, Human
acugugacugugucuucugggc

SEQ ID NO: 570206 - RNA, 21 nt, Human
uccugccuuaguccagagcag

SEQ ID NO: 570207 - RNA, 22 nt, Human
guuauacuuaugugcaaaaaua

SEQ ID NO: 570208 - RNA, 21 nt, Human
acagaaguggcuuggucucag

SEQ ID NO: 570209 - RNA, 22 nt, Human
acaggaucgcccuguugcccag

SEQ ID NO: 570210 - RNA, 22 nt, Human
ggugggugagcccugggagcug

SEQ ID NO: 570211 - RNA, 22 nt, Human
gcggcccggguccccagcagca

SEQ ID NO: 570212 - RNA, 19 nt, Human
aacuacagcgcacuguccu

SEQ ID NO: 570213 - RNA, 22 nt, Human
uuucacauacaguguauaguag

SEQ ID NO: 570214 - RNA, 22 nt, Human
aucagaagaaauggaugugacu

SEQ ID NO: 570215 - RNA, 22 nt, Human
gagaggaagccuucuguacuug

SEQ ID NO: 570216 - RNA, 22 nt, Human
aucucaguucaggcuccacugu

SEQ ID NO: 570217 - RNA, 22 nt, Human
uguacacauuaagcucuuuaga

SEQ ID NO: 570218 - RNA, 22 nt, Human
ccccacaccugccgggcagcag

SEQ ID NO: 570219 - RNA, 22 nt, Human
auaggcauaacacugauguccu

SEQ ID NO: 570220 - RNA, 21 nt, Human
ugcauauauaagugcauacac

SEQ ID NO: 570221 - RNA, 22 nt, Human
aauacagauggcaugugaagau

SEQ ID NO: 570222 - RNA, 22 nt, Human
cuucagggaggagcauggguuc

SEQ ID NO: 570223 - RNA, 22 nt, Human
auuuacucgugcuucauugaau

SEQ ID NO: 570224 - RNA, 22 nt, Human
gggcuguuugcauauguuuaua

SEQ ID NO: 570225 - RNA, 22 nt, Human
ugaauaugugacuuugauuuca

SEQ ID NO: 570226 - RNA, 22 nt, Human
aagacagugacagucacaauug

SEQ ID NO: 570227 - RNA, 22 nt, Human
ggcggugguugagaggacggcg

SEQ ID NO: 570228 - RNA, 22 nt, Human herpesvirus 6B
aggcagggagggauacggucac

SEQ ID NO: 570229 - RNA, 22 nt, Human herpesvirus 6B
aaucuauuuugagaaaaguuac

SEQ ID NO: 570230 - RNA, 23 nt, Human herpesvirus 6B
agaaaaacaggaacugcgguugc

SEQ ID NO: 570231 - RNA, 22 nt, Human herpesvirus 6B
auguuauugggagcauuggaaa

SEQ ID NO: 570232 - RNA, 22 nt, Human herpesvirus 6B
acauuucugaagaugaucuccu

SEQ ID NO: 570233 - RNA, 22 nt, Human herpesvirus 6B
aaagaacuggaaagaagcaucc

SEQ ID NO: 570234 - RNA, 22 nt, Human herpesvirus 6B
gguggcgcgucgcgaagucccg

SEQ ID NO: 570235 - RNA, 19 nt, Human herpesvirus 6B
gguuccacuugugcacggu

SEQ ID NO: 570236 - RNA, 22 nt, Human herpesvirus 6B
uuuuuacaagucgaucuuuggu

SEQ ID NO: 570237 - RNA, 19 nt, Human herpesvirus 6B
auucucauuaguguuauuc

SEQ ID NO: 570238 - RNA, 22 nt, Human herpesvirus 6B
cuguaguucauggauuaccaau

SEQ ID NO: 570239 - RNA, 21 nt, Human herpesvirus 6B
cuaugcuuuuguacucgcuua

SEQ ID NO: 570240 - RNA, 22 nt, Human herpesvirus 6B
ucuuugaaggacuaucugagac

SEQ ID NO: 570241 - RNA, 22 nt, Human herpesvirus 6B
ugacuguguacauucgccgauu

SEQ ID NO: 570242 - RNA, 22 nt, Human herpesvirus 6B
uaugugugacguccgcaucaug

SEQ ID NO: 570243 - RNA, 22 nt, Human herpesvirus 6B
uaguaaacauuugauucagugg

SEQ ID NO: 570244 - RNA, 23 nt, Human herpesvirus 6B
ucagcggugguggcggaggcggu

SEQ ID NO: 570245 - RNA, 22 nt, Human herpesvirus 6B
ucccgcccucgucuguugcugu

SEQ ID NO: 570246 - RNA, 22 nt, Human herpesvirus 6B
ucugaauguuuucauguaauuu

SEQ ID NO: 570247 - RNA, 22 nt, Human herpesvirus 6B
ugaaaauggcugaauaauauua

SEQ ID NO: 570248 - RNA, 22 nt, Human herpesvirus 6B
ucuuugaaggacuaucugagac

SEQ ID NO: 570249 - RNA, 22 nt, Human herpesvirus 6B
ugaaugucaucgagauaaucgu

SEQ ID NO: 570250 - RNA, 22 nt, Human herpesvirus 6B
ucugcuggaggcucugcuggag

SEQ ID NO: 570251 - RNA, 22 nt, Human herpesvirus 6B
gaguggccaagcguccccgggg

SEQ ID NO: 570252 - RNA, 22 nt, Human herpesvirus 6B
gaucccgcucggagcucucuca

SEQ ID NO: 570253 - RNA, 22 nt, Human herpesvirus 6B
gagaagauuggaaaaauaucca

SEQ ID NO: 570254 - RNA, 22 nt, Human herpesvirus 6B
acaucuaucgccgcucagaauu

SEQ ID NO: 570255 - RNA, 22 nt, Human herpesvirus 6B
aauucucauuuaaaagcgauag

SEQ ID NO: 570256 - RNA, 22 nt, Human herpesvirus 6B
aaucuauuuugagaaaaguuac

SEQ ID NO: 570257 - RNA, 17 nt, Human herpesvirus 6B
uaaugaaugugcuuugg

SEQ ID NO: 570258 - RNA, 22 nt, Human herpesvirus 6B
uaagaauuggugucauucgugg

SEQ ID NO: 570259 - RNA, 22 nt, Human herpesvirus 6B
uaaccgcgguacacacugaccu

SEQ ID NO: 570260 - RNA, 22 nt, Human herpesvirus 6B
gucgaaaucgcggaugaauugc

SEQ ID NO: 570261 - RNA, 18 nt, Human herpesvirus 6B
uuuauggccacuuuaucu

SEQ ID NO: 570262 - RNA, 22 nt, Human herpesvirus 6B
uugaaacggagggcggaaagcg

SEQ ID NO: 570263 - RNA, 22 nt, Human herpesvirus 6B
uugcacagcagacaauguaaua

SEQ ID NO: 570264 - RNA, 22 nt, Human herpesvirus 6B
ccucuuccuucucguaccccgg

SEQ ID NO: 570265 - RNA, 22 nt, Human herpesvirus 6B
cccggagaucuaaugggggaga

SEQ ID NO: 570266 - RNA, 21 nt, Human herpesvirus 6B
aguuggccaaaggagggccgg

SEQ ID NO: 570267 - RNA, 22 nt, Human herpesvirus 6B
agugucguucuaucuacucggg

SEQ ID NO: 570268 - RNA, 21 nt, Human herpesvirus 6B
auacgucucccaguucguuaa

SEQ ID NO: 570269 - RNA, 22 nt, Human herpesvirus 6B
aguugcauggugauguguuagc

SEQ ID NO: 570270 - RNA, 22 nt, Human herpesvirus 6B
ucgaacaacgcguuggcgaaau

SEQ ID NO: 570271 - RNA, 20 nt, Human herpesvirus 6B
ucgcaaauaccgaucaguuc

SEQ ID NO: 570272 - RNA, 22 nt, Human herpesvirus 6B
ucgcguuggcaucgggcgcugc

SEQ ID NO: 570273 - RNA, 22 nt, Human herpesvirus 6B
ucguaauacaacagaagcaaau

SEQ ID NO: 570274 - RNA, 22 nt, Human herpesvirus 6B
guacaaaugauuuaauuucgcu

SEQ ID NO: 570275 - RNA, 22 nt, Human herpesvirus 6B
guaucacguaucucugguaaau

SEQ ID NO: 570276 - RNA, 22 nt, Human herpesvirus 6B
gggugucuaaaugagucuggag

SEQ ID NO: 570277 - RNA, 22 nt, Human herpesvirus 6B
ggaugacaccggcuauaaaagc

SEQ ID NO: 570278 - RNA, 22 nt, Human herpesvirus 6B
ggcauucgaggccgcccucuau

SEQ ID NO: 570279 - RNA, 22 nt, Human herpesvirus 6B
ggcgaacaauuggauuuucaga

SEQ ID NO: 570280 - RNA, 22 nt, Human herpesvirus 6B
ggagggauacggucacgcgcac

SEQ ID NO: 570281 - RNA, 22 nt, Human herpesvirus 6B
aaacgaucucgauucugugcag

SEQ ID NO: 570282 - RNA, 22 nt, Human herpesvirus 6B
aagcuguuaaauguaaauggaa

SEQ ID NO: 570283 - RNA, 22 nt, Human herpesvirus 6B
ugguuuuauaagcucaagaggg

SEQ ID NO: 570284 - RNA, 22 nt, Human herpesvirus 6B
cauguaugcauuaacucugggu

SEQ ID NO: 570285 - RNA, 21 nt, Human herpesvirus 6B
uggcgccgacccugccgcggc

SEQ ID NO: 570286 - RNA, 22 nt, Human herpesvirus 6B
uggcgccgacccugccgcggca

SEQ ID NO: 570287 - RNA, 22 nt, Human herpesvirus 6B
caacgcggcagagucggcgcca

SEQ ID NO: 570288 - RNA, 22 nt, Human herpesvirus 6B
caagcagucccgaucuaugcga

SEQ ID NO: 570289 - RNA, 19 nt, Human herpesvirus 6B
auucucauuaguguuauuc

SEQ ID NO: 570290 - RNA, 22 nt, Human herpesvirus 6B
auuugguuggcaaacacugagc

SEQ ID NO: 570291 - RNA, 22 nt, Human herpesvirus 6B
uuucggaaaaagaggaggguau

SEQ ID NO: 570292 - RNA, 18 nt, Human herpesvirus 6B
uuucaacagccugucuag

SEQ ID NO: 570293 - RNA, 22 nt, Human herpesvirus 6B
uuugcucggagucccggagauc

SEQ ID NO: 570294 - RNA, 19 nt, Human herpesvirus 6B
uuuugcguuuauguuucaa

SEQ ID NO: 570295 - RNA, 22 nt, Human herpesvirus 6B
uuuuuacaagucgaucuuuggu

SEQ ID NO: 570296 - RNA, 22 nt, Human herpesvirus 6B
aggcagggagggauacggucac

SEQ ID NO: 570297 - RNA, 22 nt, Human herpesvirus 6B
agcaucgguuguguuagcuucg

SEQ ID NO: 570298 - RNA, 23 nt, Human herpesvirus 6B
agaaaaacaggaacugcgguugc

SEQ ID NO: 570299 - RNA, 21 nt, Human herpesvirus 6B
acuuucacacgcauagauggg

SEQ ID NO: 570300 - RNA, 22 nt, Human herpesvirus 6B
acugcgaggacacguugcgcga

SEQ ID NO: 570301 - RNA, 22 nt, Human herpesvirus 6B
acggcuguuuuugcucucugua

SEQ ID NO: 570302 - RNA, 22 nt, Human herpesvirus 6B
gggcuccggcuuccucuccguc

SEQ ID NO: 570303 - RNA, 22 nt, Human herpesvirus 6B
gcuccgcuugguuuuccguguc

SEQ ID NO: 570304 - RNA, 21 nt, Human herpesvirus 6B
gcauucgacauauggaauuua

SEQ ID NO: 570305 - RNA, 22 nt, Human herpesvirus 6B
gcaggaagagggaguccaacaa

SEQ ID NO: 570306 - RNA, 22 nt, Human herpesvirus 6B
gaaguuuaccuagagauuacaa

SEQ ID NO: 570307 - RNA, 22 nt, Human herpesvirus 6B
gaaucugaagcguuuucacgau

SEQ ID NO: 570308 - RNA, 22 nt, Human herpesvirus 6B
gaagugcgggaguuucgccgag

SEQ ID NO: 570309 - RNA, 22 nt, Human herpesvirus 6B
cuuuauagaaaaugucucacga

SEQ ID NO: 570310 - RNA, 22 nt, Human herpesvirus 6B
cuucccuuugcguuucucacgg

SEQ ID NO: 570311 - RNA, 22 nt, Human herpesvirus 6B
cuguaguucauggauuaccaau

SEQ ID NO: 570312 - RNA, 22 nt, Human herpesvirus 6B
cugccaaaugcugaucugucuc

SEQ ID NO: 570313 - RNA, 22 nt, Human herpesvirus 6B
ggcuuuuuguucaguugauuau

SEQ ID NO: 570314 - RNA, 22 nt, Human
uguuuaugcaucguuaauacca

SEQ ID NO: 570315 - RNA, 17 nt, Human
gcuucuggagcuucugu

SEQ ID NO: 570316 - RNA, 22 nt, Human
agccuguggaaacugggugcag

SEQ ID NO: 570317 - RNA, 21 nt, Human
ucaaaucauguacugaccaca

SEQ ID NO: 570318 - RNA, 22 nt, Human
uaccagcucacacaaucuuugu

SEQ ID NO: 570319 - RNA, 22 nt, Human
uucaguuuauaccuguugauua

SEQ ID NO: 570320 - RNA, 22 nt, Human
guauuuuauggccuggggccua

SEQ ID NO: 570321 - RNA, 22 nt, Human
cuuucuuaauuuuuaaggacac

SEQ ID NO: 570322 - RNA, 22 nt, Human
ucucccaggcugcccuguggac

SEQ ID NO: 570323 - RNA, 22 nt, Human
gaucugaaaaugcucuucuucu

SEQ ID NO: 570324 - RNA, 22 nt, Human
ccagccucaucauauuccugcu

SEQ ID NO: 570325 - RNA, 22 nt, Human
acacauucaugagugcaugcac

SEQ ID NO: 570326 - RNA, 21 nt, Human
caggaacauucuuuacauuua

SEQ ID NO: 570327 - RNA, 22 nt, Human
ucccagagugagccaggggcag

SEQ ID NO: 570328 - RNA, 19 nt, Human
ucccaggaaccuuuuauuu

SEQ ID NO: 570329 - RNA, 22 nt, Human
ggugaggggcgccucugcccgg

SEQ ID NO: 570330 - RNA, 22 nt, Human
uggcacaggagcacugcccugg

SEQ ID NO: 570331 - RNA, 22 nt, Human
ucaaaacaacacucagguguaa

SEQ ID NO: 570332 - RNA, 22 nt, Human
caagucaaugauuauaagaguc

SEQ ID NO: 570333 - RNA, 22 nt, Human
auuccaauuguacuugcuuuua

SEQ ID NO: 570334 - RNA, 22 nt, Human
cugggccuggcguuccaggcug

SEQ ID NO: 570335 - RNA, 23 nt, Human
aggcacugaaugugucagugagu

SEQ ID NO: 570336 - RNA, 22 nt, Human
caggugagcucuaucuagggag

SEQ ID NO: 570337 - RNA, 23 nt, Human
auuauuaaggacauggacuuugu

SEQ ID NO: 570338 - RNA, 22 nt, Human
gugugcaguagagaaagagcag

SEQ ID NO: 570339 - RNA, 22 nt, Human
aaggaggaauaaagagguggug

SEQ ID NO: 570340 - RNA, 22 nt, Human
uagaagcacugacagaguuuga

SEQ ID NO: 570341 - RNA, 22 nt, Human
gcaggagcuggaaagugauguu

SEQ ID NO: 570342 - RNA, 22 nt, Human
uggguaggaaucgaguguaugg

SEQ ID NO: 570343 - RNA, 22 nt, Human
uucucucuguggucccauuuug

SEQ ID NO: 570344 - RNA, 22 nt, Human
cucccaagggguaagggagcug

SEQ ID NO: 570345 - RNA, 22 nt, Human
aaugagauuccaauagcuccug

SEQ ID NO: 570346 - RNA, 22 nt, Human
ccacuuuugggaacagugagua

SEQ ID NO: 570347 - RNA, 22 nt, Human
cugggcucagaugagaggaagg

SEQ ID NO: 570348 - RNA, 22 nt, Human
agcccaggcagagggaugcuug

SEQ ID NO: 570349 - RNA, 22 nt, Human
agaagccauauuuagggaggag

SEQ ID NO: 570350 - RNA, 22 nt, Human
uucagagaugacaccugguguu

SEQ ID NO: 570351 - RNA, 23 nt, Human
cccugcagucagggugagauggu

SEQ ID NO: 570352 - RNA, 22 nt, Human
ggucaacacugugaccaacagg

SEQ ID NO: 570353 - RNA, 22 nt, Human
uguuaugaacuucuagaaaaca

SEQ ID NO: 570354 - RNA, 22 nt, Human
gcaggcugagaguccaagaagg

SEQ ID NO: 570355 - RNA, 22 nt, Human
agacccugcaccucucgugggc

SEQ ID NO: 570356 - RNA, 22 nt, Human
uucaacagcuuccaaagugugu

SEQ ID NO: 570357 - RNA, 22 nt, Human
uuuggcucuaguaaauauaacc

SEQ ID NO: 570358 - RNA, 22 nt, Human
ugcagaggagucagccugggca

SEQ ID NO: 570359 - RNA, 22 nt, Human
gaaucuuaugugguguuuucua

SEQ ID NO: 570360 - RNA, 20 nt, Human
ugagccaggcuaggaagggc

SEQ ID NO: 570361 - RNA, 22 nt, Human
uuuggggagacauggccagcug

SEQ ID NO: 570362 - RNA, 22 nt, Human
auuagcuuauuguaaggugaaa

SEQ ID NO: 570363 - RNA, 21 nt, Human
uccuggcuuuaugcuaccucu

SEQ ID NO: 570364 - RNA, 17 nt, Human
ugcuccuguggcagccu

SEQ ID NO: 570365 - RNA, 22 nt, Human
ccuuugccaugacauggcacaa

SEQ ID NO: 570366 - RNA, 22 nt, Human
aaaaucugguaauuugaaugug

SEQ ID NO: 570367 - RNA, 22 nt, Human
aggcacugauucuguuuuccau

SEQ ID NO: 570368 - RNA, 22 nt, Human
auuauaaaccuuugaggguggg

SEQ ID NO: 570369 - RNA, 22 nt, Human
guuggcuaugagagcuuuagug

SEQ ID NO: 570370 - RNA, 22 nt, Human
cccagagaauuccacauagagg

SEQ ID NO: 570371 - RNA, 22 nt, Human
ugucuucaucuccaugcacaga

SEQ ID NO: 570372 - RNA, 22 nt, Human
cauacauacugaguggacugau

SEQ ID NO: 570373 - RNA, 22 nt, Human
cagacagcaggccuggaugugu

SEQ ID NO: 570374 - RNA, 22 nt, Human
cccagccucuguuugcuccucu

SEQ ID NO: 570375 - RNA, 22 nt, Human
gggcuccaggcaggcaggaaau

SEQ ID NO: 570376 - RNA, 22 nt, Human
uaauagcugugggaaauaaaag

SEQ ID NO: 570377 - RNA, 22 nt, Human
agcugcuugggaaccaucaauu

SEQ ID NO: 570378 - RNA, 22 nt, Human
cuggccucacagaggcuaagcc

SEQ ID NO: 570379 - RNA, 22 nt, Human
augaagauauucuuguuuucug

SEQ ID NO: 570380 - RNA, 22 nt, Human
aaauguauugcauaggauauuu

SEQ ID NO: 570381 - RNA, 22 nt, Human
uuuuuacacuuagcauugagcg

SEQ ID NO: 570382 - RNA, 22 nt, Human
cuccugugcaugcaucucccua

SEQ ID NO: 570383 - RNA, 22 nt, Human
acauauauguaaaguacuuugu

SEQ ID NO: 570384 - RNA, 22 nt, Human
gcaccugggacccagaggcacc

SEQ ID NO: 570385 - RNA, 23 nt, Human
uccaggagaauuccagggcccgg

SEQ ID NO: 570386 - RNA, 19 nt, Human
auuuuucuuccucugugca

SEQ ID NO: 570387 - RNA, 22 nt, Human
ccaggagcuauguacacacuau

SEQ ID NO: 570388 - RNA, 22 nt, Human
cuucagcccugagugccagcag

SEQ ID NO: 570389 - RNA, 22 nt, Human
cucuggaguucuucaagcuacu

SEQ ID NO: 570390 - RNA, 22 nt, Human
aaacaaagccagggaaguuaug

SEQ ID NO: 570391 - RNA, 22 nt, Human
guggcagagggugagcuggacu

SEQ ID NO: 570392 - RNA, 22 nt, Human
aguuuaacuuuggaaaacuaua

SEQ ID NO: 570393 - RNA, 22 nt, Human
uuaauaacauuguguaucaccc

SEQ ID NO: 570394 - RNA, 22 nt, Human
caggguggcacaucacagcauu

SEQ ID NO: 570395 - RNA, 22 nt, Human
agcugcuguuuggugagucuug

SEQ ID NO: 570396 - RNA, 22 nt, Human
cccugagcccauaguugacauu

SEQ ID NO: 570397 - RNA, 22 nt, Human
gcucucuggcuaguccaucggg

SEQ ID NO: 570398 - RNA, 22 nt, Human
agcuguuuguacuuagauagua

SEQ ID NO: 570399 - RNA, 22 nt, Human
gcugagccacaggcagugcacu

SEQ ID NO: 570400 - RNA, 22 nt, Human
augcuuuauuguuaggucaugu

SEQ ID NO: 570401 - RNA, 22 nt, Human
augggaucuugcccugagggcu

SEQ ID NO: 570402 - RNA, 22 nt, Human
ucccaaggcacagggcagggac

SEQ ID NO: 570403 - RNA, 22 nt, Human
aggaagaguguuaccuaugggu

SEQ ID NO: 570404 - RNA, 22 nt, Human
uuugggaaauaguagaaaaugu

SEQ ID NO: 570405 - RNA, 22 nt, Human
cauuucugcagaauugcucuuc

SEQ ID NO: 570406 - RNA, 22 nt, Human
gcuguuuccaguuacguggaua

SEQ ID NO: 570407 - RNA, 22 nt, Human
agccccuugcugcccucuagag

SEQ ID NO: 570408 - RNA, 22 nt, Human
uuaaaugaggcugauguagauu

SEQ ID NO: 570409 - RNA, 22 nt, Human
aguaacacuauuuucauaugua

SEQ ID NO: 570410 - RNA, 23 nt, Human
uuccagugagacugagaggucuu

SEQ ID NO: 570411 - RNA, 20 nt, Human
gggcaguggcgcuaucucag

SEQ ID NO: 570412 - RNA, 22 nt, Human
ucccugccaaugauuggagcaa

SEQ ID NO: 570413 - RNA, 22 nt, Human
gagugccaagagaagaggcugg

SEQ ID NO: 570414 - RNA, 22 nt, Human
gaggagagggcugcgggcccac

SEQ ID NO: 570415 - RNA, 18 nt, Human
uaaaggaagugggagagg

SEQ ID NO: 570416 - RNA, 22 nt, Human
uuugaaaggagcuuuauccaga

SEQ ID NO: 570417 - RNA, 22 nt, Human
cccaggguugccugccucugcu

SEQ ID NO: 570418 - RNA, 22 nt, Human
gagaggccugagaggcugcgga

SEQ ID NO: 570419 - RNA, 22 nt, Human
agcuggugcucaggggcaugga

SEQ ID NO: 570420 - RNA, 23 nt, Human
aguacauuugacccaaauaagcu

SEQ ID NO: 570421 - RNA, 19 nt, Human
acacauguguguuaugugc

SEQ ID NO: 570422 - RNA, 22 nt, Human
cuuuacaaccuaaguugaagcu

SEQ ID NO: 570423 - RNA, 22 nt, Human
ugaggggcggccugcagaggcc

SEQ ID NO: 570424 - RNA, 22 nt, Human
ugcagcaccacaccuggcuaau

SEQ ID NO: 570425 - RNA, 22 nt, Human
auuuccuugcaaguuucuguaa

SEQ ID NO: 570426 - RNA, 22 nt, Human
aguaaacaguuucuuagaagaa

SEQ ID NO: 570427 - RNA, 22 nt, Human
uugaaaggugaacaugaugcac

SEQ ID NO: 570428 - RNA, 22 nt, Human
uacagcuuuagcaaauuaccua

SEQ ID NO: 570429 - RNA, 22 nt, Human
aaaggcuccuucucccaugacc

SEQ ID NO: 570430 - RNA, 17 nt, Human
acaguaacuauguuaug

SEQ ID NO: 570431 - RNA, 22 nt, Human
gggugaggagcugccagucaug

SEQ ID NO: 570432 - RNA, 22 nt, Human
ccagugccugugggcauggugc

SEQ ID NO: 570433 - RNA, 22 nt, Human
ugauucugaucaucaucauggu

SEQ ID NO: 570434 - RNA, 22 nt, Human
agcucaggcucugcagggacua

SEQ ID NO: 570435 - RNA, 22 nt, Human
agggacccauagagagaccagu

SEQ ID NO: 570436 - RNA, 22 nt, Human
cagagcagaaaccugggugauu

SEQ ID NO: 570437 - RNA, 22 nt, Human
acuuucuauuguuuagauucug

SEQ ID NO: 570438 - RNA, 22 nt, Human
gcccaagguauaucagagacag

SEQ ID NO: 570439 - RNA, 22 nt, Human
aagcaagacagaaguuacugcc

SEQ ID NO: 570440 - RNA, 22 nt, Human
ggcugaguugagaggauuacuu

SEQ ID NO: 570441 - RNA, 22 nt, Human
ccagaggagcaggcuggcucca

SEQ ID NO: 570442 - RNA, 22 nt, Human
uucucagagcacugcugacaaa

SEQ ID NO: 570443 - RNA, 22 nt, Human
cugucuuuucauacuuucccuc

SEQ ID NO: 570444 - RNA, 22 nt, Human
auagcauauaaguuauaaaacu

SEQ ID NO: 570445 - RNA, 22 nt, Human
agaagcugccuacaugaccagc

SEQ ID NO: 570446 - RNA, 22 nt, Human
cauggcacugagcagguaugca

SEQ ID NO: 570447 - RNA, 22 nt, Human
aaucaggagugugcacuuugau

SEQ ID NO: 570448 - RNA, 22 nt, Human
uauuaaauauaucuguuaguug

SEQ ID NO: 570449 - RNA, 22 nt, Human
ucuuuggaaugcuagcauucua

SEQ ID NO: 570450 - RNA, 22 nt, Human
ggccacagugggaaauccuggg

SEQ ID NO: 570451 - RNA, 22 nt, Human
cagcagcaaaucuagaagagga

SEQ ID NO: 570452 - RNA, 22 nt, Human
cacaaaugguuguagacauuaa

SEQ ID NO: 570453 - RNA, 22 nt, Human
aacuucauuuauaaugucauua

SEQ ID NO: 570454 - RNA, 22 nt, Human
uuuucugaccuaucuacauuua

SEQ ID NO: 570455 - RNA, 22 nt, Human
cuucuucagaggccagccucug

SEQ ID NO: 570456 - RNA, 22 nt, Human
uuggagguuucccaacuguggg

SEQ ID NO: 570457 - RNA, 22 nt, Human
ccucacagcaaggauuucagug

SEQ ID NO: 570458 - RNA, 17 nt, Human
gagauuuucguccugaa

SEQ ID NO: 570459 - RNA, 22 nt, Human
uuguuuauguguugucuauggc

SEQ ID NO: 570460 - RNA, 22 nt, Human
ccagaggaauugggaaacaugu

SEQ ID NO: 570461 - RNA, 22 nt, Human
ccagcugggauuaagggaaaau

SEQ ID NO: 570462 - RNA, 22 nt, Human
uccauuauacuucugauucaaa

SEQ ID NO: 570463 - RNA, 22 nt, Human
ugguccugaucaccgcugggca

SEQ ID NO: 570464 - RNA, 22 nt, Human
cccaggaggcagagguugcagu

SEQ ID NO: 570465 - RNA, 22 nt, Human
cugaggcucugagaaagccaaa

SEQ ID NO: 570466 - RNA, 22 nt, Human
agcaggcaccagggcucguccu

SEQ ID NO: 570467 - RNA, 22 nt, Human
uacuuagagcgauaauuuauac

SEQ ID NO: 570468 - RNA, 22 nt, Human
ugaguccaccuuaguauauggg

SEQ ID NO: 570469 - RNA, 22 nt, Human
acagugucaugucguguucccc

SEQ ID NO: 570470 - RNA, 22 nt, Human
ccaggaggcucugacuggaccc

SEQ ID NO: 570471 - RNA, 22 nt, Human
aagucacagaacccauuguaac

SEQ ID NO: 570472 - RNA, 22 nt, Human
aaucagaaucaguugacacagc

SEQ ID NO: 570473 - RNA, 22 nt, Human
ucuuucaaaugcuugaauugga

SEQ ID NO: 570474 - RNA, 22 nt, Human
aauaacuggcacauaucacaua

SEQ ID NO: 570475 - RNA, 22 nt, Human
uuucucuguucucuaacuguaa

SEQ ID NO: 570476 - RNA, 23 nt, Human
gccagccagaauuucuccacugu

SEQ ID NO: 570477 - RNA, 22 nt, Human
aagcuguguaaguugcuugguu

SEQ ID NO: 570478 - RNA, 19 nt, Human
cccuggaggaguguuggcu

SEQ ID NO: 570479 - RNA, 23 nt, Human
uacaaugcaaacuuggcccaugg

SEQ ID NO: 570480 - RNA, 22 nt, Human
ugccugcugccacugcuguuac

SEQ ID NO: 570481 - RNA, 22 nt, Human
gcuaugaauauccaugaucagc

SEQ ID NO: 570482 - RNA, 22 nt, Human
ggcuguugacagacauagguuu

SEQ ID NO: 570483 - RNA, 22 nt, Human
cugggcaggagaggugguugga

SEQ ID NO: 570484 - RNA, 22 nt, Human
uguuuuguccuuuucuauauac

SEQ ID NO: 570485 - RNA, 22 nt, Human
gucauaaagcuuguugcauuua

SEQ ID NO: 570486 - RNA, 22 nt, Human
gagcagugguugaacagaggca

SEQ ID NO: 570487 - RNA, 22 nt, Human
cuucccaguucugcuugagggg

SEQ ID NO: 570488 - RNA, 22 nt, Human
guuaaagugagcuacuuuaggu

SEQ ID NO: 570489 - RNA, 22 nt, Human
gauuuccuagacauggggcaga

SEQ ID NO: 570490 - RNA, 22 nt, Human
ucgggguagacgccagcucgga

SEQ ID NO: 570491 - RNA, 21 nt, Human
aggaggggucuuucccacuga

SEQ ID NO: 570492 - RNA, 22 nt, Human
ggauacaacuagaagauggcag

SEQ ID NO: 570493 - RNA, 20 nt, Human
acagaauaugcugguugugg

SEQ ID NO: 570494 - RNA, 22 nt, Human
ggagauggcucugcaaggucua

SEQ ID NO: 570495 - RNA, 20 nt, Human
ugguggacuuuggcauggcu

SEQ ID NO: 570496 - RNA, 22 nt, Human
ucucuccuaauuucaggugcuu

SEQ ID NO: 570497 - RNA, 22 nt, Human
aaucuuaagcugaauucucucc

SEQ ID NO: 570498 - RNA, 22 nt, Human
ugggaacauuuugagcugagag

SEQ ID NO: 570499 - RNA, 22 nt, Human
uagucaccuuuggcaccugcaa

SEQ ID NO: 570500 - RNA, 22 nt, Human
ugaggcccaucugagauuuuga

SEQ ID NO: 570501 - RNA, 22 nt, Human
gccuuagccugcacuuccuguu

SEQ ID NO: 570502 - RNA, 22 nt, Human
cugggccagauccagccucaca

SEQ ID NO: 570503 - RNA, 20 nt, Human
ugggcagcacugcuggcugg

SEQ ID NO: 570504 - RNA, 17 nt, Human
ugggccaguagaaggga

SEQ ID NO: 570505 - RNA, 22 nt, Human
auguuuuccccaaaugaucuuc

SEQ ID NO: 570506 - RNA, 22 nt, Human
agugcagagaccuggucaggca

SEQ ID NO: 570507 - RNA, 22 nt, Human
uuuccuuccuaaggugaagcaa

SEQ ID NO: 570508 - RNA, 22 nt, Human
ucuugggcauguguuugauuuc

SEQ ID NO: 570509 - RNA, 22 nt, Human
uaguauuuauaaucaugcuuaa

SEQ ID NO: 570510 - RNA, 22 nt, Human
ugucacauugaauaugauuuau

SEQ ID NO: 570511 - RNA, 22 nt, Human
augccaguguuauaaauagaua

SEQ ID NO: 570512 - RNA, 22 nt, Human
uaaugaacucuuuacuuuggga

SEQ ID NO: 570513 - RNA, 22 nt, Human
ugaagcagcuucuuucugucaa

SEQ ID NO: 570514 - RNA, 22 nt, Human
ggucucuggccuuggagauuga

SEQ ID NO: 570515 - RNA, 22 nt, Human
ugcucuggggagcuccucugcg

SEQ ID NO: 570516 - RNA, 22 nt, Human
ucugucaccgagggcauccaaa

SEQ ID NO: 570517 - RNA, 19 nt, Human
gagaaaccccgucuuuagg

SEQ ID NO: 570518 - RNA, 20 nt, Human
cugagcugagcuccaugggu

SEQ ID NO: 570519 - RNA, 22 nt, Human
gagggccauucugaggggguga

SEQ ID NO: 570520 - RNA, 22 nt, Human
acacagaguauuuagaaggggu

SEQ ID NO: 570521 - RNA, 22 nt, Human
uauuuguauuucaugcaguaaa

SEQ ID NO: 570522 - RNA, 22 nt, Human
aagaacugugcuccaggcucca

SEQ ID NO: 570523 - RNA, 22 nt, Human
uuacaucauugagacauacaua

SEQ ID NO: 570524 - RNA, 22 nt, Human
agagccugucaauuguaaagag

SEQ ID NO: 570525 - RNA, 22 nt, Human
gaagauuuauaaggaccuuauu

SEQ ID NO: 570526 - RNA, 22 nt, Human
aaggcaauuggcuuguauaaga

SEQ ID NO: 570527 - RNA, 23 nt, Human
auaucacacccaguacagucucc

SEQ ID NO: 570528 - RNA, 22 nt, Human
ugacauuucgguguaugugaug

SEQ ID NO: 570529 - RNA, 22 nt, Human
uuucagagguaugcugcuuauc

SEQ ID NO: 570530 - RNA, 22 nt, Human
acccucaguaaucgugcaguuu

SEQ ID NO: 570531 - RNA, 22 nt, Human
gggcuggagagucccacguggg

SEQ ID NO: 570532 - RNA, 22 nt, Human
gcacacaguauaugcucauuaa

SEQ ID NO: 570533 - RNA, 22 nt, Human
ccaggagccacucaggcccaca

SEQ ID NO: 570534 - RNA, 21 nt, Human
ccagaggccucucuuggccac

SEQ ID NO: 570535 - RNA, 22 nt, Human
cccucccuuugucuuuaugaac

SEQ ID NO: 570536 - RNA, 22 nt, Human
ugugccuuucaucaugcuuuug

SEQ ID NO: 570537 - RNA, 22 nt, Human
caaaucugagucuacaauuuua

SEQ ID NO: 570538 - RNA, 22 nt, Human
caaagcuggaaaaggaggcugg

SEQ ID NO: 570539 - RNA, 22 nt, Human
ccagagagaaauggauuugagu

SEQ ID NO: 570540 - RNA, 22 nt, Human
uggguucuuucacuucucaguu

SEQ ID NO: 570541 - RNA, 22 nt, Human
uaguuuguaaugaggagaagua

SEQ ID NO: 570542 - RNA, 22 nt, Human
uuauggaauaaccuuucugaaa

SEQ ID NO: 570543 - RNA, 22 nt, Human
ucacuguuuugccugcacuucc

SEQ ID NO: 570544 - RNA, 22 nt, Human
guaggggugcugagaucuggaa

SEQ ID NO: 570545 - RNA, 22 nt, Human
aaacacuuuagaaagggacuug

SEQ ID NO: 570546 - RNA, 22 nt, Human
agcaucaacaaugaacauaaau

SEQ ID NO: 570547 - RNA, 18 nt, Human
gaaaggagagacaguagg

SEQ ID NO: 570548 - RNA, 22 nt, Human
ggccuugguucugucacagccg

SEQ ID NO: 570549 - RNA, 22 nt, Human
caucaaauggcaagugaaagcu

SEQ ID NO: 570550 - RNA, 22 nt, Human
uugcauaacagccauuaaagua

SEQ ID NO: 570551 - RNA, 22 nt, Human
uccagggaccucccugagagcu

SEQ ID NO: 570552 - RNA, 22 nt, Human
uaucuuuugaguucucaagaug

SEQ ID NO: 570553 - RNA, 19 nt, Human
cacagugcagccauuucuc

SEQ ID NO: 570554 - RNA, 22 nt, Human
cagcuacacaccagaacuauua

SEQ ID NO: 570555 - RNA, 22 nt, Human
cugagcugggacucaguagcaa

SEQ ID NO: 570556 - RNA, 22 nt, Human
auuguuuacacuaacuucauaa

SEQ ID NO: 570557 - RNA, 22 nt, Human
aagcuuuguucuucacagagug

SEQ ID NO: 570558 - RNA, 22 nt, Human
uggccagaaccugcaguaggcc

SEQ ID NO: 570559 - RNA, 22 nt, Human
cugcucuucccacucacuccca

SEQ ID NO: 570560 - RNA, 22 nt, Human
ucuuucuuauuagccauuguuc

SEQ ID NO: 570561 - RNA, 22 nt, Human
uuucucauagucaugccucuua

SEQ ID NO: 570562 - RNA, 22 nt, Human
ggacugggucacuaagauagua

SEQ ID NO: 570563 - RNA, 22 nt, Human
agcauaaacucagggacacaca

SEQ ID NO: 570564 - RNA, 22 nt, Human
agcagggggcauccuugcccuu

SEQ ID NO: 570565 - RNA, 22 nt, Human
gcugaaggcccggaggacaggg

SEQ ID NO: 570566 - RNA, 22 nt, Human
gcugucuucacuuccugguuuc

SEQ ID NO: 570567 - RNA, 19 nt, Human
aaugacugaguacauuguc

SEQ ID NO: 570568 - RNA, 22 nt, Human
uucagagucagggaucucagag

SEQ ID NO: 570569 - RNA, 22 nt, Human
uagcagcaauuacacaguccgu

SEQ ID NO: 570570 - RNA, 22 nt, Human
agccagggucucucgcucuguu

SEQ ID NO: 570571 - RNA, 22 nt, Human
cuaguauuaagugugaguaaaa

SEQ ID NO: 570572 - RNA, 22 nt, Human
uauucacaggcacgaaauauug

SEQ ID NO: 570573 - RNA, 22 nt, Human
uaaacuacccaugacaguuuca

SEQ ID NO: 570574 - RNA, 22 nt, Human
ugcaugcacccagccggguauu

SEQ ID NO: 570575 - RNA, 22 nt, Human
cugccuggaccggcagcccucc

SEQ ID NO: 570576 - RNA, 22 nt, Human
aaagauuuaagaauaauuugug

SEQ ID NO: 570577 - RNA, 22 nt, Human
uaaauccagcuucuaauuuaga

SEQ ID NO: 570578 - RNA, 22 nt, Human
ugugugaagugauuuuaagucu

SEQ ID NO: 570579 - RNA, 22 nt, Human
cagcagccuagaagcucuacca

SEQ ID NO: 570580 - RNA, 22 nt, Human
agcugcagguucagcauuccac

SEQ ID NO: 570581 - RNA, 22 nt, Human
ccagucuguacuuugcucuguu

SEQ ID NO: 570582 - RNA, 22 nt, Human
ucugagguugaacuuugcaaag

SEQ ID NO: 570583 - RNA, 22 nt, Human
ggggccagcuucgcgugcucuu

SEQ ID NO: 570584 - RNA, 22 nt, Human
agaugguagacuauggaacgua

SEQ ID NO: 570585 - RNA, 23 nt, Human
agaaaccacugaagagauccagu

SEQ ID NO: 570586 - RNA, 22 nt, Human
aguguucauuuauucauucacu

SEQ ID NO: 570587 - RNA, 22 nt, Human
uucaauuuugcagaggaaugca

SEQ ID NO: 570588 - RNA, 22 nt, Human
gcugucaggaacaugccuuggu

SEQ ID NO: 570589 - RNA, 22 nt, Human
aggguggagggagucccugagc

SEQ ID NO: 570590 - RNA, 22 nt, Human
auucuggggcugguuauuuuga

SEQ ID NO: 570591 - RNA, 22 nt, Human
gcagcaggcacggucucgacau

SEQ ID NO: 570592 - RNA, 22 nt, Human
cugccccaccccaaccugaggu

SEQ ID NO: 570593 - RNA, 22 nt, Human
guucaaauugagaugguauaaa

SEQ ID NO: 570594 - RNA, 22 nt, Human
cuuucuuucgaagacgugauua

SEQ ID NO: 570595 - RNA, 22 nt, Human
aggggauggagcuggaaggcag

SEQ ID NO: 570596 - RNA, 22 nt, Human
accucccagaaaguuuugcagg

SEQ ID NO: 570597 - RNA, 22 nt, Human
gagaggugaaggcugcccuggg

SEQ ID NO: 570598 - RNA, 22 nt, Human
gucccacugggcaacuagaaaa

SEQ ID NO: 570599 - RNA, 22 nt, Human
agaggcucuggugcagcaugca

SEQ ID NO: 570600 - RNA, 23 nt, Human
aagcaugguucacaguuaguacu

SEQ ID NO: 570601 - RNA, 22 nt, Human
aauguaaaauaucuuguacuug

SEQ ID NO: 570602 - RNA, 22 nt, Human
aagagucuauuggaacuagaca

SEQ ID NO: 570603 - RNA, 22 nt, Human
gagggcaguagccucguacccu

SEQ ID NO: 570604 - RNA, 22 nt, Human
aggcagcagaaaacaaaugguu

SEQ ID NO: 570605 - RNA, 22 nt, Human
ucagaggaugcuguucuuuaau

SEQ ID NO: 570606 - RNA, 22 nt, Human
agcugucuuucauuaccucauu

SEQ ID NO: 570607 - RNA, 22 nt, Human
gagggggaaagucccuggaguc

SEQ ID NO: 570608 - RNA, 22 nt, Human
uuucacauagaaagugauuuac

SEQ ID NO: 570609 - RNA, 22 nt, Human
caccagcuugggcuguggaaau

SEQ ID NO: 570610 - RNA, 22 nt, Human
cacauggaagagauacagugag

SEQ ID NO: 570611 - RNA, 22 nt, Human
gggcuccacagcagugagugga

SEQ ID NO: 570612 - RNA, 22 nt, Human
auucugagacaauugccgucag

SEQ ID NO: 570613 - RNA, 22 nt, Human
ucaagucuugagggacagcauu

SEQ ID NO: 570614 - RNA, 22 nt, Human
cauaacuagagugaaauguuga

SEQ ID NO: 570615 - RNA, 22 nt, Human
cuucaguguugccagggccuag

SEQ ID NO: 570616 - RNA, 22 nt, Human
gagagcaggaggcagcgggacg

SEQ ID NO: 570617 - RNA, 22 nt, Human
uugcagggcuuggggauuacag

SEQ ID NO: 570618 - RNA, 22 nt, Human
cuuagcagaagcuucagcuuca

SEQ ID NO: 570619 - RNA, 22 nt, Human
ugcuaaauaaguggaauagaca

SEQ ID NO: 570620 - RNA, 22 nt, Human
cugcugccccugagcucagccu

SEQ ID NO: 570621 - RNA, 22 nt, Human
cagcugcccauccugggaaaug

SEQ ID NO: 570622 - RNA, 22 nt, Human
cucuguccuccaccugcuuuca

SEQ ID NO: 570623 - RNA, 22 nt, Human
cccuggugcccugggucagccu

SEQ ID NO: 570624 - RNA, 21 nt, Human
ugcaguccuuugacaugauuc

SEQ ID NO: 570625 - RNA, 22 nt, Human
ucuggucaagacauccuaacau

SEQ ID NO: 570626 - RNA, 22 nt, Human
auuguaaauagugccacaauaa

SEQ ID NO: 570627 - RNA, 22 nt, Human
auuuuguugaugguggaguagc

SEQ ID NO: 570628 - RNA, 22 nt, Human
uuucugcagguauugcauaagu

SEQ ID NO: 570629 - RNA, 22 nt, Human
ugacccugagagcugaauggcu

SEQ ID NO: 570630 - RNA, 22 nt, Human
aguggagcuuuuccuaucagag

SEQ ID NO: 570631 - RNA, 22 nt, Human
cagcacaguacaaggcacggau

SEQ ID NO: 570632 - RNA, 22 nt, Human
gaaguuuagaagugacagguuu

SEQ ID NO: 570633 - RNA, 22 nt, Human
ucucugagcccaauguagcaau

SEQ ID NO: 570634 - RNA, 22 nt, Human
gccuggugugcgccgcgcagcu

SEQ ID NO: 570635 - RNA, 22 nt, Human
aggccugggucucgugccuacc

SEQ ID NO: 570636 - RNA, 22 nt, Human
gaaggaaaaauacucuguaagg

SEQ ID NO: 570637 - RNA, 22 nt, Human
ugaggggagguuggggcacauc

SEQ ID NO: 570638 - RNA, 22 nt, Human
uucuaaagugcaaucugacaga

SEQ ID NO: 570639 - RNA, 22 nt, Human
guuuuacacaccuaugaaagac

SEQ ID NO: 570640 - RNA, 22 nt, Human
aaaccaacccuggcuggccuag

SEQ ID NO: 570641 - RNA, 22 nt, Human
ucugugaaacagcucuggcaug

SEQ ID NO: 570642 - RNA, 22 nt, Human
agaagaaaugugaaggccacug

SEQ ID NO: 570643 - RNA, 22 nt, Human
uugcuuuaaugagauuuugcca

SEQ ID NO: 570644 - RNA, 22 nt, Human
aaagcagucuguuuuaaccuga

SEQ ID NO: 570645 - RNA, 23 nt, Human
agaaaagcuuggacacauggccu

SEQ ID NO: 570646 - RNA, 22 nt, Human
uccaggcucagcacuugcuacu

SEQ ID NO: 570647 - RNA, 22 nt, Human
ucacuggggccuuuggucagga

SEQ ID NO: 570648 - RNA, 22 nt, Human
guuauuguccagcacaguuggg

SEQ ID NO: 570649 - RNA, 22 nt, Human
ccuggcagcuguuuggcuuggc

SEQ ID NO: 570650 - RNA, 22 nt, Human
aguguucuucuucaaagcucug

SEQ ID NO: 570651 - RNA, 22 nt, Human
auucaaauuaaguuaauucagc

SEQ ID NO: 570652 - RNA, 18 nt, Human
uccugcagcuucuaugua

SEQ ID NO: 570653 - RNA, 22 nt, Human
uuugaucuaugcgugguuuccc

SEQ ID NO: 570654 - RNA, 22 nt, Human
uuucaucuaacacuacauaggg

SEQ ID NO: 570655 - RNA, 22 nt, Human
cugaaggacuuggugauaguug

SEQ ID NO: 570656 - RNA, 22 nt, Human
cagaggcuuauaccugauuagg

SEQ ID NO: 570657 - RNA, 22 nt, Human
gcugagugauugauauuuuagu

SEQ ID NO: 570658 - RNA, 22 nt, Human
caguaacaugaagagacaugga

SEQ ID NO: 570659 - RNA, 22 nt, Human
ccuggagcaggagcugcagagg

SEQ ID NO: 570660 - RNA, 22 nt, Human
gauaaguuauguaacuugcuca

SEQ ID NO: 570661 - RNA, 21 nt, Human
ugauucuguuuuaucaucagc

SEQ ID NO: 570662 - RNA, 22 nt, Human
gaaucuuagaaagguuaaggaa

SEQ ID NO: 570663 - RNA, 22 nt, Human
ggaggcaggaaagacagguuca

SEQ ID NO: 570664 - RNA, 22 nt, Human
cacugucugggacauguggucu

SEQ ID NO: 570665 - RNA, 22 nt, Human
aaaguuguuuccuaaggucuaa

SEQ ID NO: 570666 - RNA, 17 nt, Human
uggcaagacagcucagg

SEQ ID NO: 570667 - RNA, 23 nt, Human
cuucacagguucaggggauuaag

SEQ ID NO: 570668 - RNA, 22 nt, Human
uguagaugagucagggugcaug

SEQ ID NO: 570669 - RNA, 22 nt, Human
uccugaggacuaacaggaagga

SEQ ID NO: 570670 - RNA, 20 nt, Human
acauugauuauguuuguaga

SEQ ID NO: 570671 - RNA, 22 nt, Human
auucacaaaugcugccccauuc

SEQ ID NO: 570672 - RNA, 22 nt, Human
agcucagaagccuaugcauagu

SEQ ID NO: 570673 - RNA, 23 nt, Human
cugaggucugcaauucuaguagu

SEQ ID NO: 570674 - RNA, 22 nt, Human
gcugagcacaccuaggguagag

SEQ ID NO: 570675 - RNA, 22 nt, Human
uaguuagagaugaauuuugucu

SEQ ID NO: 570676 - RNA, 22 nt, Human
gugguccaucaugcagagcucc

SEQ ID NO: 570677 - RNA, 22 nt, Human
agagccugaggcccugagaggg

SEQ ID NO: 570678 - RNA, 22 nt, Human
cagucaggcugcgcuucucuga

SEQ ID NO: 570679 - RNA, 22 nt, Human
uuagucacuucuuccuucauca

SEQ ID NO: 570680 - RNA, 22 nt, Human
ucauuuuuugcauaccuguguc

SEQ ID NO: 570681 - RNA, 22 nt, Human
uagaaacaaugacaugcuugua

SEQ ID NO: 570682 - RNA, 22 nt, Human
uucauggaucaugccuuuugug

SEQ ID NO: 570683 - RNA, 22 nt, Human
ugaugauuucauuucuagcugu

SEQ ID NO: 570684 - RNA, 22 nt, Human
caguggccugagccaggcuucc

SEQ ID NO: 570685 - RNA, 22 nt, Human
aaacauguaaguucagaucacc

SEQ ID NO: 570686 - RNA, 22 nt, Human
gcaaggcuuugugaauuuuaaa

SEQ ID NO: 570687 - RNA, 22 nt, Human
agcucccaauugacuugaacua

SEQ ID NO: 570688 - RNA, 22 nt, Human
ucacuguagagucuguuuccac

SEQ ID NO: 570689 - RNA, 22 nt, Human
cauucaaaaugggcugaccugu

SEQ ID NO: 570690 - RNA, 20 nt, Human
uaucuuacuuuagucauuug

SEQ ID NO: 570691 - RNA, 22 nt, Human
gugcugagcaucaugaggcacu

SEQ ID NO: 570692 - RNA, 22 nt, Human
cacuaggcgccggguggcugug

SEQ ID NO: 570693 - RNA, 22 nt, Human
ucuccuaggcuggagugcagug

SEQ ID NO: 570694 - RNA, 22 nt, Human
ggacugggccagggguuggacu

SEQ ID NO: 570695 - RNA, 22 nt, Human
uuucaucucucuaaaagacagu

SEQ ID NO: 570696 - RNA, 22 nt, Human
uccugggaggaacauuuaccua

SEQ ID NO: 570697 - RNA, 22 nt, Human
guuuuccuucucagccauugcc

SEQ ID NO: 570698 - RNA, 22 nt, Human
gaacuuuaucaaaaguuguuua

SEQ ID NO: 570699 - RNA, 22 nt, Human
uccuucagucuucugagccaua

SEQ ID NO: 570700 - RNA, 22 nt, Human
gcaguuuuauuaugauggaaau

SEQ ID NO: 570701 - RNA, 22 nt, Human
ccagcuguuggaguuucacugc

SEQ ID NO: 570702 - RNA, 22 nt, Human
uggccaggcauucagauaagac

SEQ ID NO: 570703 - RNA, 22 nt, Human
agguguggcuggggcagaggcc

SEQ ID NO: 570704 - RNA, 22 nt, Human
gugugcagggaugagugcaggu

SEQ ID NO: 570705 - RNA, 22 nt, Human
uuuuuguggugugaguggacau

SEQ ID NO: 570706 - RNA, 22 nt, Human
aggcucugaucagguggcugug

SEQ ID NO: 570707 - RNA, 22 nt, Human
ggcagaggugacagugucuuuu

SEQ ID NO: 570708 - RNA, 22 nt, Human
uaccacuacauuugcuaauggc

SEQ ID NO: 570709 - RNA, 22 nt, Human
ugccaggcccucccacagauua

SEQ ID NO: 570710 - RNA, 22 nt, Human
ugggugagccacaggaguuguc

SEQ ID NO: 570711 - RNA, 22 nt, Human
gugaggcagggaaagaggauaa

SEQ ID NO: 570712 - RNA, 22 nt, Human
ugaagccacacuagcuuguccu

SEQ ID NO: 570713 - RNA, 22 nt, Human
uggcauccagccaugugauuuu

SEQ ID NO: 570714 - RNA, 22 nt, Human
ugcccaggcuggagugcagagg

SEQ ID NO: 570715 - RNA, 22 nt, Human
cugucaccuguucacugcagca

SEQ ID NO: 570716 - RNA, 22 nt, Human
cacagaggcaugacccugcccu

SEQ ID NO: 570717 - RNA, 22 nt, Human
aacagcugcaaaagguugccug

SEQ ID NO: 570718 - RNA, 23 nt, Human
ucugauguucucuuaugcuguag

SEQ ID NO: 570719 - RNA, 14 nt, Human
auugugcaugccau

SEQ ID NO: 570720 - RNA, 22 nt, Human
gguuuucaaagaggcauuucau

SEQ ID NO: 570721 - RNA, 22 nt, Human
gccuggguccacugaucaugcu

SEQ ID NO: 570722 - RNA, 22 nt, Human
cagcuucccuuggcugagcaga

SEQ ID NO: 570723 - RNA, 22 nt, Human
ugucaguuuaguugaagaaaga

SEQ ID NO: 570724 - RNA, 21 nt, Human
agcuguggcgaggggaacaug

SEQ ID NO: 570725 - RNA, 22 nt, Human
augauucucauuuuauaaacuu

SEQ ID NO: 570726 - RNA, 22 nt, Human
gcaccaggcagcugagcaggcc

SEQ ID NO: 570727 - RNA, 22 nt, Human
agcuguugucugcaggagaagc

SEQ ID NO: 570728 - RNA, 22 nt, Human
gcguggggcagcccagggcuuc

SEQ ID NO: 570729 - RNA, 22 nt, Human
ucaaaacacuauuaccuuuaau

SEQ ID NO: 570730 - RNA, 21 nt, Human
ugggagacacagccuugagcu

SEQ ID NO: 570731 - RNA, 22 nt, Human
gcucacagucugcugagugcag

SEQ ID NO: 570732 - RNA, 22 nt, Human
ugcaucuguucagagcugucga

SEQ ID NO: 570733 - RNA, 22 nt, Human
auuuuagagcuccaaguacagc

SEQ ID NO: 570734 - RNA, 16 nt, Human
uagcuuuguguugugg

SEQ ID NO: 570735 - RNA, 22 nt, Human
gcaggcugauagaggauuccau

SEQ ID NO: 570736 - RNA, 22 nt, Human
gguggguauugaauacaggugu

SEQ ID NO: 570737 - RNA, 22 nt, Human
aauaauuauuugagagcagacc

SEQ ID NO: 570738 - RNA, 22 nt, Human
uuuauugcccuguaguacagga

SEQ ID NO: 570739 - RNA, 22 nt, Human
gucugggauugggguaaagaag

SEQ ID NO: 570740 - RNA, 22 nt, Human
ucacagcaggguaacaggaaga

SEQ ID NO: 570741 - RNA, 22 nt, Human
gaggcccuccagcugucagcug

SEQ ID NO: 570742 - RNA, 22 nt, Human
uguucuuuucucuaaacugaua

SEQ ID NO: 570743 - RNA, 15 nt, Human
ggaacauuucuguuu

SEQ ID NO: 570744 - RNA, 22 nt, Human
cugugaauguugaauaaauccu

SEQ ID NO: 570745 - RNA, 22 nt, Human
guggauggcuaguugagaaggg

SEQ ID NO: 570746 - RNA, 22 nt, Human
uacacugugagguuuccaaggg

SEQ ID NO: 570747 - RNA, 22 nt, Human
gugccugguuuggggaguguuc

SEQ ID NO: 570748 - RNA, 22 nt, Human
acacccagcugggccaccucca

SEQ ID NO: 570749 - RNA, 22 nt, Human
caguggagagacuuuuacucuu

SEQ ID NO: 570750 - RNA, 22 nt, Human
uguggggaccuggcugccaccc

SEQ ID NO: 570751 - RNA, 22 nt, Human
ggacaggugugaggcuggcaca

SEQ ID NO: 570752 - RNA, 22 nt, Human
ugcuucugaugugagcagcccc

SEQ ID NO: 570753 - RNA, 22 nt, Human
aucucuggcaaugcagcaucgu

SEQ ID NO: 570754 - RNA, 22 nt, Human
uaauauauuucugcuaagcuca

SEQ ID NO: 570755 - RNA, 22 nt, Human
aucucagagaaauuugaaugca

SEQ ID NO: 570756 - RNA, 22 nt, Human
ucccagagccucugccacucug

SEQ ID NO: 570757 - RNA, 22 nt, Human
cgagaguuagcuaggagucaca

SEQ ID NO: 570758 - RNA, 22 nt, Human
uuauuucauguaaaauuuaugu

SEQ ID NO: 570759 - RNA, 22 nt, Human
cuuuuacacucaucugggaggg

SEQ ID NO: 570760 - RNA, 22 nt, Human
cagccaggagccucugcaacua

SEQ ID NO: 570761 - RNA, 22 nt, Human
ugucaguucaauuauaguaauu

SEQ ID NO: 570762 - RNA, 20 nt, Human
agcuggugaauuaaagacug

SEQ ID NO: 570763 - RNA, 20 nt, Human
aggaggggauagaaucaaag

SEQ ID NO: 570764 - RNA, 22 nt, Human
ucugccagaaguucugagagua

SEQ ID NO: 570765 - RNA, 22 nt, Human
ugccugggugcccucugcuccu

SEQ ID NO: 570766 - RNA, 22 nt, Human
acccagguggcucugacggggg

SEQ ID NO: 570767 - RNA, 18 nt, Human
cuguugagauguggcuga

SEQ ID NO: 570768 - RNA, 22 nt, Human
uaugcagugguaucauuuuaaa

SEQ ID NO: 570769 - RNA, 22 nt, Human
cuccagucuagguccuacuuau

SEQ ID NO: 570770 - RNA, 22 nt, Human
uacaacaauuuccacauuagaa

SEQ ID NO: 570771 - RNA, 22 nt, Human
aaggcccacagaacugucucca

SEQ ID NO: 570772 - RNA, 22 nt, Human
uacauuguguuaaaacagaaga

SEQ ID NO: 570773 - RNA, 22 nt, Human
aagcagagguagggugugcagu

SEQ ID NO: 570774 - RNA, 22 nt, Human
acuugucuuuaauccgaaugua

SEQ ID NO: 570775 - RNA, 22 nt, Human
gcuguacaggguuauccuuucc

SEQ ID NO: 570776 - RNA, 22 nt, Human
ggaaggggucaccuccugauga

SEQ ID NO: 570777 - RNA, 22 nt, Human
aguuagaauggauguugagagc

SEQ ID NO: 570778 - RNA, 22 nt, Human
guuucuuuugugaucaccaacc

SEQ ID NO: 570779 - RNA, 22 nt, Human
ccuuggguguuuaauagauaua

SEQ ID NO: 570780 - RNA, 23 nt, Human
ugauuuccagugagucaguggga

SEQ ID NO: 570781 - RNA, 22 nt, Human
ucaguguuacauuauauagaac

SEQ ID NO: 570782 - RNA, 22 nt, Human
ugugaagaauuaaugugaauca

SEQ ID NO: 570783 - RNA, 22 nt, Human
aggguggaagauggcacuaucu

SEQ ID NO: 570784 - RNA, 23 nt, Human
cagaggugucagugcccaguguc

SEQ ID NO: 570785 - RNA, 22 nt, Human
agcgcgcugucagacuggcucg

SEQ ID NO: 570786 - RNA, 22 nt, Human
gcugagggcauguguggcgacu

SEQ ID NO: 570787 - RNA, 22 nt, Human
ccucucucugcaucuggagggc

SEQ ID NO: 570788 - RNA, 22 nt, Human
acugucaucagaagaugaaaau

SEQ ID NO: 570789 - RNA, 22 nt, Human
uucagugucacaagagcaagcc

SEQ ID NO: 570790 - RNA, 22 nt, Human
ggcagccuccagggcacuggug

SEQ ID NO: 570791 - RNA, 22 nt, Human
ggagggccccuccagugggcag

SEQ ID NO: 570792 - RNA, 22 nt, Human
caggucuguuuucaaggucagu

SEQ ID NO: 570793 - RNA, 22 nt, Human
uggcccuggcugaguuagauuu

SEQ ID NO: 570794 - RNA, 22 nt, Human
ugccacacaauuacugcugcua

SEQ ID NO: 570795 - RNA, 22 nt, Human
uagcccagcaugagcagagcug

SEQ ID NO: 570796 - RNA, 22 nt, Human
ugcuuacaacuuuauugaggaa

SEQ ID NO: 570797 - RNA, 22 nt, Human
gugcaggggccuccccuugcug

SEQ ID NO: 570798 - RNA, 22 nt, Human
uucaguuucccuaaagccaauu

SEQ ID NO: 570799 - RNA, 22 nt, Human
ugaggccagacugaaaccaaca

SEQ ID NO: 570800 - RNA, 20 nt, Human
aggagaccaagccaagugga

SEQ ID NO: 570801 - RNA, 22 nt, Human
aacagaguggagccaaacuuug

SEQ ID NO: 570802 - RNA, 22 nt, Human
uaauacugaaagggaaaugucc

SEQ ID NO: 570803 - RNA, 22 nt, Human
uagcuauuuugcuuggaaauac

SEQ ID NO: 570804 - RNA, 19 nt, Human
ccagcccugucacuucuug

SEQ ID NO: 570805 - RNA, 22 nt, Human
aagaccaucacagagacacuug

SEQ ID NO: 570806 - RNA, 22 nt, Human
gcuggaauuggacccagggcuc

SEQ ID NO: 570807 - RNA, 22 nt, Human
ugucccuggaacuauggcucca

SEQ ID NO: 570808 - RNA, 22 nt, Human
aaauaugagaguaggaguuugg

SEQ ID NO: 570809 - RNA, 22 nt, Human
aaagagggacaggcgcagacac

SEQ ID NO: 570810 - RNA, 22 nt, Human
ucugagguucuguuuucaacug

SEQ ID NO: 570811 - RNA, 23 nt, Human
uugauacagaagaaucaguuugu

SEQ ID NO: 570812 - RNA, 22 nt, Human
ucuccuggucaccucagaaguc

SEQ ID NO: 570813 - RNA, 22 nt, Human
agggaugggaacuccuccagca

SEQ ID NO: 570814 - RNA, 22 nt, Human
gaauuucacaaggugaggauaa

SEQ ID NO: 570815 - RNA, 22 nt, Human
acaauguuucucuuuagucauu

SEQ ID NO: 570816 - RNA, 22 nt, Human
cccagcugcaccucuauggccu

SEQ ID NO: 570817 - RNA, 22 nt, Human
uaagauuacagugagaaauaaa

SEQ ID NO: 570818 - RNA, 22 nt, Human
cagaggucagguuggacauuau

SEQ ID NO: 570819 - RNA, 21 nt, Human
agaagccuggguggagguggg

SEQ ID NO: 570820 - RNA, 22 nt, Human
acagugaggacagggacugugu

SEQ ID NO: 570821 - RNA, 22 nt, Human
ccaguaaaaagcgacaggaagu

SEQ ID NO: 570822 - RNA, 22 nt, Human
ggcagugaaaaaguauguuucc

SEQ ID NO: 570823 - RNA, 22 nt, Human
gagggcugcugccagauaugcc

SEQ ID NO: 570824 - RNA, 22 nt, Human
gagcugccugugugccaugaug

SEQ ID NO: 570825 - RNA, 22 nt, Human
acaggugaaguauuacacuaag

SEQ ID NO: 570826 - RNA, 22 nt, Human
auggcagauggcuggagcaggu

SEQ ID NO: 570827 - RNA, 22 nt, Human
caaguucacguugcuuuuugag

SEQ ID NO: 570828 - RNA, 22 nt, Human
caggacagagcccagacugugu

SEQ ID NO: 570829 - RNA, 22 nt, Human
aaauuuaaggaggugcucacuu

SEQ ID NO: 570830 - RNA, 21 nt, Human
agagccugagaucuuccagca

SEQ ID NO: 570831 - RNA, 22 nt, Human
aggggagcaacauagucacucu

SEQ ID NO: 570832 - RNA, 22 nt, Human
cagaggcaaaagagguggaggu

SEQ ID NO: 570833 - RNA, 20 nt, Human
ggcugcugugggcagagagg

SEQ ID NO: 570834 - RNA, 22 nt, Human
ucuuucaaugugaaaccaugua

SEQ ID NO: 570835 - RNA, 22 nt, Human
ggccacagagggcgggaugcug

SEQ ID NO: 570836 - RNA, 22 nt, Human
uggcucucagcucccagcagcc

SEQ ID NO: 570837 - RNA, 22 nt, Human
gccagaggaacgcugcgcgccc

SEQ ID NO: 570838 - RNA, 21 nt, Human
acuuuaauauacaugaggagg

SEQ ID NO: 570839 - RNA, 22 nt, Human
caucuguaaaguaggaauauug

SEQ ID NO: 570840 - RNA, 22 nt, Human
gcuggggaggcagcagagaaca

SEQ ID NO: 570841 - RNA, 22 nt, Human
uggaggccgcguagucugagca

SEQ ID NO: 570842 - RNA, 22 nt, Human
cauagauagagguuccuaauag

SEQ ID NO: 570843 - RNA, 22 nt, Human
caagcugggugcgggcaguaua

SEQ ID NO: 570844 - RNA, 22 nt, Human
uaauuuaauuccauggauucua

SEQ ID NO: 570845 - RNA, 22 nt, Human
gagcucagcaaaggucugugug

SEQ ID NO: 570846 - RNA, 22 nt, Human
aucauucuagcuguuguguuga

SEQ ID NO: 570847 - RNA, 22 nt, Human
uagagaugcccuagcugaagua

SEQ ID NO: 570848 - RNA, 22 nt, Human
aaaaggaggacaugguuacaga

SEQ ID NO: 570849 - RNA, 22 nt, Human
ugccugucuucaggagugucac

SEQ ID NO: 570850 - RNA, 22 nt, Human
auuuugcacacuaugcagcuuu

SEQ ID NO: 570851 - RNA, 22 nt, Human
gggcaaggcagaagaguuggag

SEQ ID NO: 570852 - RNA, 22 nt, Human
cuagaauugcauucuaugaaua

SEQ ID NO: 570853 - RNA, 22 nt, Human
ucagccaagcagccaucaucug

SEQ ID NO: 570854 - RNA, 20 nt, Human
uucuucucuaguuaucuuca

SEQ ID NO: 570855 - RNA, 22 nt, Human
aaguccuuuaauaucacauagu

SEQ ID NO: 570856 - RNA, 22 nt, Human
uugaccuauguuucuucaucug

SEQ ID NO: 570857 - RNA, 22 nt, Human
augcagucuaagcauguaaggg

SEQ ID NO: 570858 - RNA, 22 nt, Human
gccaggcucucagugacugccc

SEQ ID NO: 570859 - RNA, 22 nt, Human
uuuauuauguacaggcacuaua

SEQ ID NO: 570860 - RNA, 22 nt, Human
cacagcugccauggcugcacuu

SEQ ID NO: 570861 - RNA, 22 nt, Human
cuggagcuccagggucuccucu

SEQ ID NO: 570862 - RNA, 22 nt, Human
aagcauguguauaagcugggca

SEQ ID NO: 570863 - RNA, 22 nt, Human
ccuccuggugacaaggcaaagc

SEQ ID NO: 570864 - RNA, 20 nt, Human
acuggacacugaggugagcu

SEQ ID NO: 570865 - RNA, 22 nt, Human
uaagcuucaaagaacauauugg

SEQ ID NO: 570866 - RNA, 22 nt, Human
uaucacuacacuaagauacaga

SEQ ID NO: 570867 - RNA, 22 nt, Human
gcucucugcaagucagcagccu

SEQ ID NO: 570868 - RNA, 22 nt, Human
uacccaggagaaacagcagggc

SEQ ID NO: 570869 - RNA, 22 nt, Human
ugcuauaagaauuauauuacuc

SEQ ID NO: 570870 - RNA, 21 nt, Human
agcugcuucaccuggacaaca

SEQ ID NO: 570871 - RNA, 22 nt, Human
auuuuaucugcuuacuuucagg

SEQ ID NO: 570872 - RNA, 22 nt, Human
ucucuggguucucacucagcac

SEQ ID NO: 570873 - RNA, 22 nt, Human
uagaaugaccuccucuuagcuu

SEQ ID NO: 570874 - RNA, 22 nt, Human
gaagccacccuccuuccagccc

SEQ ID NO: 570875 - RNA, 22 nt, Human
gcucuucucagauuguacacuc

SEQ ID NO: 570876 - RNA, 22 nt, Human
agggauggagcccagcuguucu

SEQ ID NO: 570877 - RNA, 22 nt, Human
uauuuuguuaauaauccagucc

SEQ ID NO: 570878 - RNA, 22 nt, Human
acuggccaggcagcaguagcuu

SEQ ID NO: 570879 - RNA, 22 nt, Human
acugccaccuggugguccugga

SEQ ID NO: 570880 - RNA, 22 nt, Human
acaguggcucaugccugucauc

SEQ ID NO: 570881 - RNA, 22 nt, Human
ggcuccaguuugugccuucagc

SEQ ID NO: 570882 - RNA, 22 nt, Human
cucugaggaagucaaguagcca

SEQ ID NO: 570883 - RNA, 22 nt, Human
ccagagcuugacgugcaacgga

SEQ ID NO: 570884 - RNA, 22 nt, Human
acuguuuugugccuuaguuucc

SEQ ID NO: 570885 - RNA, 22 nt, Human
gugagauuugaguggggauaca

SEQ ID NO: 570886 - RNA, 22 nt, Human
uucucauguaaaugccaucauc

SEQ ID NO: 570887 - RNA, 22 nt, Human
cucugggcaaagaugccucauc

SEQ ID NO: 570888 - RNA, 19 nt, Human
ggacagggggagcuuuuau

SEQ ID NO: 570889 - RNA, 22 nt, Human
cugcagggcauuguaacucuuu

SEQ ID NO: 570890 - RNA, 22 nt, Human
acaauguuuugaaacaucuagg

SEQ ID NO: 570891 - RNA, 22 nt, Human
uuccaugccucuauuuagaauu

SEQ ID NO: 570892 - RNA, 22 nt, Human
cugugggaugggaccucagcug

SEQ ID NO: 570893 - RNA, 22 nt, Human
aaugcucucugccauagcuaac

SEQ ID NO: 570894 - RNA, 22 nt, Human
gaaaucuuugccuuagcugugu

SEQ ID NO: 570895 - RNA, 22 nt, Human
uaaacauggauucugaucacag

SEQ ID NO: 570896 - RNA, 22 nt, Human
gcucccagcauugcuucccagg

SEQ ID NO: 570897 - RNA, 22 nt, Human
uacaauuacucagcucugcugu

SEQ ID NO: 570898 - RNA, 22 nt, Human
gguccaugauaggaaguuccga

SEQ ID NO: 570899 - RNA, 22 nt, Human
aaguguucuacacuuugaccuu

SEQ ID NO: 570900 - RNA, 22 nt, Human
uagcuuaaaaucucuagauucu

SEQ ID NO: 570901 - RNA, 22 nt, Human
acccgggaggcaggagucauag

SEQ ID NO: 570902 - RNA, 22 nt, Human
cuguuuguccaacuugucccga

SEQ ID NO: 570903 - RNA, 22 nt, Human
uuuucucagcugcacuguauua

SEQ ID NO: 570904 - RNA, 22 nt, Human
uggcacaguuaaaguuguagaa

SEQ ID NO: 570905 - RNA, 22 nt, Human
uagcuuuguguccugauuuagc

SEQ ID NO: 570906 - RNA, 22 nt, Human
uaggcagcugcaaacuucgguc

SEQ ID NO: 570907 - RNA, 22 nt, Human
cucagccaugucaugccuaccu

SEQ ID NO: 570908 - RNA, 22 nt, Human
ugaagugucauuuacauuucua

SEQ ID NO: 570909 - RNA, 22 nt, Human
cgaacacacuugggaguucuga

SEQ ID NO: 570910 - RNA, 22 nt, Human
uuaacaaagcucuguuccuuuu

SEQ ID NO: 570911 - RNA, 22 nt, Human
cuuuacauuaauuucuacugau

SEQ ID NO: 570912 - RNA, 22 nt, Human
ugauuuaugcauuauacuguug

SEQ ID NO: 570913 - RNA, 22 nt, Human
agcagguuaccauugauuuccu

SEQ ID NO: 570914 - RNA, 22 nt, Human
auguucuuguucaaaugucagu

SEQ ID NO: 570915 - RNA, 22 nt, Human
gcugaguauacagacuauguua

SEQ ID NO: 570916 - RNA, 22 nt, Human
ugggugguuuaugaguggguuu

SEQ ID NO: 570917 - RNA, 22 nt, Human
uggucuuagcuggaaggaggga

SEQ ID NO: 570918 - RNA, 22 nt, Human
agugcacuggcaccaucucagc

SEQ ID NO: 570919 - RNA, 22 nt, Human
ucaauuucuugguuugauaaua

SEQ ID NO: 570920 - RNA, 22 nt, Human
gcuguccaccuccagagccuua

SEQ ID NO: 570921 - RNA, 22 nt, Human
caugcagaguuuauuaccaucu

SEQ ID NO: 570922 - RNA, 22 nt, Human
gggcagcagcaggaggucucug

SEQ ID NO: 570923 - RNA, 22 nt, Human
aaggcuggaccuggaugaaucu

SEQ ID NO: 570924 - RNA, 22 nt, Human
aaagccagaauucguccagccu

SEQ ID NO: 570925 - RNA, 22 nt, Human
ggauaagaaaauuguaauaacu

SEQ ID NO: 570926 - RNA, 22 nt, Human
cugguuggaagugcagacucuc

SEQ ID NO: 570927 - RNA, 21 nt, Human
agcuccaggcuccugggguuc

SEQ ID NO: 570928 - RNA, 22 nt, Human
gugagaagauaaguauugcaaa

SEQ ID NO: 570929 - RNA, 19 nt, Human
uucuugaacauguuucuca

SEQ ID NO: 570930 - RNA, 22 nt, Human
gagcccagcccagagccauaug

SEQ ID NO: 570931 - RNA, 22 nt, Human
cacugacuccaaaaauaaagaa

SEQ ID NO: 570932 - RNA, 22 nt, Human
auugaaauugaugaaauucuug

SEQ ID NO: 570933 - RNA, 22 nt, Human
uccuuagcaacacuguuauaau

SEQ ID NO: 570934 - RNA, 22 nt, Human
guuuccuauggcugcugcagga

SEQ ID NO: 570935 - RNA, 22 nt, Human
gaggggaguguccuccgggccc

SEQ ID NO: 570936 - RNA, 22 nt, Human
ggcugugcagggcagagucuca

SEQ ID NO: 570937 - RNA, 22 nt, Human
uucucagauccaucagaagucc

SEQ ID NO: 570938 - RNA, 22 nt, Human
ugucagugguagacccagaggu

SEQ ID NO: 570939 - RNA, 21 nt, Human
ggccuuggcgggggccgaauu

SEQ ID NO: 570940 - RNA, 22 nt, Human
uuaacgaauugugcauaauucc

SEQ ID NO: 570941 - RNA, 22 nt, Human
ucaguguuaaucagugguaccu

SEQ ID NO: 570942 - RNA, 22 nt, Human
caggguggaaaagcuaguugga

SEQ ID NO: 570943 - RNA, 22 nt, Human
cagugcuguguuugcugccugg

SEQ ID NO: 570944 - RNA, 22 nt, Human
aaccuaggacuauagauaucau

SEQ ID NO: 570945 - RNA, 22 nt, Human
gcagacagggcuacagagguac

SEQ ID NO: 570946 - RNA, 22 nt, Human
ccagaggagggcucugaugagg

SEQ ID NO: 570947 - RNA, 20 nt, Human
agggcucugccuugcugaug

SEQ ID NO: 570948 - RNA, 22 nt, Human
ggccagcugccaccagcccuau

SEQ ID NO: 570949 - RNA, 22 nt, Human
ucacauuuguguuuuauuagag

SEQ ID NO: 570950 - RNA, 22 nt, Human
ucaucugaaauuguauauguag

SEQ ID NO: 570951 - RNA, 22 nt, Human
ugcaggaguuccccucugccug

SEQ ID NO: 570952 - RNA, 22 nt, Human
ccaggccuggacggguggccug

SEQ ID NO: 570953 - RNA, 22 nt, Human
aggagacccagaauguugcugu

SEQ ID NO: 570954 - RNA, 22 nt, Human
cagcuccccucuguggggcagu

SEQ ID NO: 570955 - RNA, 22 nt, Human
uaaguaaauuuauaaugugauu

SEQ ID NO: 570956 - RNA, 21 nt, Human
uucucagaucgaguagugaga

SEQ ID NO: 570957 - RNA, 22 nt, Human
agggggugcccagaugaaggau

SEQ ID NO: 570958 - RNA, 22 nt, Human
aauccauguugauguauauuuu

SEQ ID NO: 570959 - RNA, 22 nt, Human
cccucagcuucucccugcagcu

SEQ ID NO: 570960 - RNA, 21 nt, Human
ugcuuucagacucuuacagaa

SEQ ID NO: 570961 - RNA, 22 nt, Human
aggaguggaauuacuggguucu

SEQ ID NO: 570962 - RNA, 22 nt, Human
cugugucuucugcuuacagucu

SEQ ID NO: 570963 - RNA, 22 nt, Human
aagacauuggacaauccagagg

SEQ ID NO: 570964 - RNA, 22 nt, Human
uccugaggcacaauccuagaau

SEQ ID NO: 570965 - RNA, 19 nt, Human
ggugaccaccuggucagug

SEQ ID NO: 570966 - RNA, 22 nt, Human
gugcucuggcuggucucccggu

SEQ ID NO: 570967 - RNA, 22 nt, Human
cuggugcuggcaacagaguagg

SEQ ID NO: 570968 - RNA, 22 nt, Human
ucacccagccuuggcggguuug

SEQ ID NO: 570969 - RNA, 22 nt, Human
aacagcaucaccccauaacauu

SEQ ID NO: 570970 - RNA, 22 nt, Human
agcuuugaaucugguguuugca

SEQ ID NO: 570971 - RNA, 22 nt, Human
ggucugaauuccagccccucug

SEQ ID NO: 570972 - RNA, 22 nt, Human
ugaaaauuguuguacuugauaa

SEQ ID NO: 570973 - RNA, 22 nt, Human
uaaaucuucuacaucaucauaa

SEQ ID NO: 570974 - RNA, 22 nt, Human
ucagaaucuaaauaggcuccag

SEQ ID NO: 570975 - RNA, 22 nt, Human
aaggagucugggccauucagag

SEQ ID NO: 570976 - RNA, 22 nt, Human
gggcagcaaaucugagucuggu

SEQ ID NO: 570977 - RNA, 22 nt, Human
ucacaggaaggguaaauauuua

SEQ ID NO: 570978 - RNA, 22 nt, Human
aauagcauguucaugauaaaau

SEQ ID NO: 570979 - RNA, 22 nt, Human
cugcuuuagguggaauguucua

SEQ ID NO: 570980 - RNA, 22 nt, Human
acauccaucuuaugagauaggu

SEQ ID NO: 570981 - RNA, 22 nt, Human
uagaucugauacaauucaucug

SEQ ID NO: 570982 - RNA, 22 nt, Human
cucugcuugugucaggcaugcu

SEQ ID NO: 570983 - RNA, 22 nt, Human
aggcacuguacuagguacaggg

SEQ ID NO: 570984 - RNA, 22 nt, Human
aggagcugaaacuucucauaug

SEQ ID NO: 570985 - RNA, 22 nt, Human
aaucacacaaaggcaacuuuug

SEQ ID NO: 570986 - RNA, 23 nt, Human
ggccacugaauuuucugcaucuu

SEQ ID NO: 570987 - RNA, 22 nt, Human
uguuuacacaauagucucucuc

SEQ ID NO: 570988 - RNA, 22 nt, Human
uuguccugcaaccucacauggc

SEQ ID NO: 570989 - RNA, 22 nt, Human
gcuaaucaauguuaaggcugug

SEQ ID NO: 570990 - RNA, 22 nt, Human
ucuuuauuucugaaucccccau

SEQ ID NO: 570991 - RNA, 22 nt, Human
uuagcaaacucuguuagauucu

SEQ ID NO: 570992 - RNA, 20 nt, Human
ucuuacaaucguuacaucca

SEQ ID NO: 570993 - RNA, 22 nt, Human
gacuacagauagccaauuaagu

SEQ ID NO: 570994 - RNA, 22 nt, Human
uauuuuguuuuguauccacugu

SEQ ID NO: 570995 - RNA, 22 nt, Human
ugggccagcugaagugccgccc

SEQ ID NO: 570996 - RNA, 22 nt, Human
ggccucagagaaggcugugcgg

SEQ ID NO: 570997 - RNA, 22 nt, Human
ugcauuuggggcagacuagcag

SEQ ID NO: 570998 - RNA, 22 nt, Human
acacccagauuaugcacacaaa

SEQ ID NO: 570999 - RNA, 22 nt, Human
agagcuggcagcagcuucuccu

SEQ ID NO: 571000 - RNA, 23 nt, Human
ccugugugcccuuaauucacagc

SEQ ID NO: 571001 - RNA, 22 nt, Human
aaaaaauuccauucugugccuu

SEQ ID NO: 571002 - RNA, 22 nt, Human
uuucuucucgacaccuuauccc

SEQ ID NO: 571003 - RNA, 22 nt, Human
gcucagggucccuuggugcugg

SEQ ID NO: 571004 - RNA, 22 nt, Human
agccacaggccaugagauacca

SEQ ID NO: 571005 - RNA, 22 nt, Human
uuuaaucuauucccuaaacacc

SEQ ID NO: 571006 - RNA, 22 nt, Human
acagaccaaguuuccagcaggu

SEQ ID NO: 571007 - RNA, 22 nt, Human
caugaaauguuagaauuagaca

SEQ ID NO: 571008 - RNA, 22 nt, Human
agugucuuacaugaauugauuu

SEQ ID NO: 571009 - RNA, 22 nt, Human
uugugggauggcucuucccaaa

SEQ ID NO: 571010 - RNA, 18 nt, Human
cagcucuucuccaguaac

SEQ ID NO: 571011 - RNA, 22 nt, Human
ccuccaggaggaaauggaacac

SEQ ID NO: 571012 - RNA, 23 nt, Human
cugcagucgccggccugggugcc

SEQ ID NO: 571013 - RNA, 22 nt, Human
aaucugaauauuuauguguauu

SEQ ID NO: 571014 - RNA, 22 nt, Human
uuuagugccugggccaguucca

SEQ ID NO: 571015 - RNA, 20 nt, Human
gggaggcgagggcugagcag

SEQ ID NO: 571016 - RNA, 21 nt, Human
ucagaacaauuccaugccucc

SEQ ID NO: 571017 - RNA, 22 nt, Human
uacauaguuccauuuacaggaa

SEQ ID NO: 571018 - RNA, 20 nt, Human
cacagcuugccuuuuaugac

SEQ ID NO: 571019 - RNA, 22 nt, Human
uagaugugagcccaggcugcuu

SEQ ID NO: 571020 - RNA, 22 nt, Human
gggcagcuccuguggaauccac

SEQ ID NO: 571021 - RNA, 22 nt, Human
cauuuauucaugaucuguagcu

SEQ ID NO: 571022 - RNA, 22 nt, Human
uugacuguacaaccuuuuguag

SEQ ID NO: 571023 - RNA, 22 nt, Human
gcacacugcggugaugugaguc

SEQ ID NO: 571024 - RNA, 22 nt, Human
cugccugugccaccgccucauu

SEQ ID NO: 571025 - RNA, 22 nt, Human
agcgagugggucagcguugcag

SEQ ID NO: 571026 - RNA, 22 nt, Human
cugggagaucuguugggacugg

SEQ ID NO: 571027 - RNA, 22 nt, Human
aaggagacauuugcagagcacc

SEQ ID NO: 571028 - RNA, 22 nt, Human
uccaucuguuuacuauaaagau

SEQ ID NO: 571029 - RNA, 22 nt, Human
acuguaaauuuugguugcaggu

SEQ ID NO: 571030 - RNA, 22 nt, Human
uguuuuaagcucuagaagggga

SEQ ID NO: 571031 - RNA, 19 nt, Human
gcuuuaguuuacucaucua

SEQ ID NO: 571032 - RNA, 22 nt, Human
uugaucaagugggaaauaguaa

SEQ ID NO: 571033 - RNA, 22 nt, Human
ugcugaggcagaugucugugac

SEQ ID NO: 571034 - RNA, 18 nt, Human
agcaagcaguuuucaugu

SEQ ID NO: 571035 - RNA, 22 nt, Human
augagcaguagguucauggcug

SEQ ID NO: 571036 - RNA, 22 nt, Human
uugauauuuugcacgcuuggua

SEQ ID NO: 571037 - RNA, 22 nt, Human
gcuauuguuuauuuugaaucua

SEQ ID NO: 571038 - RNA, 22 nt, Human
uggcucaggcuugaaaauagau

SEQ ID NO: 571039 - RNA, 22 nt, Human
uccagccaagggagguuacuag

SEQ ID NO: 571040 - RNA, 22 nt, Human
ugcaguuuucucacccccacaa

SEQ ID NO: 571041 - RNA, 22 nt, Human
cagggauucagcugaaggaggc

SEQ ID NO: 571042 - RNA, 22 nt, Human
acuuccuguaaauagaauucca

SEQ ID NO: 571043 - RNA, 22 nt, Human
aaauuuaaaaagcagcauugca

SEQ ID NO: 571044 - RNA, 19 nt, Human
aaacucauagacucauauu

SEQ ID NO: 571045 - RNA, 22 nt, Human
gcuucuggcagugcagccacca

SEQ ID NO: 571046 - RNA, 22 nt, Human
ccagaugggccagggguuuguu

SEQ ID NO: 571047 - RNA, 22 nt, Human
ugauucuuugaccaaaaaauug

SEQ ID NO: 571048 - RNA, 22 nt, Human
gugcaaaaguaauuacaguuuu

SEQ ID NO: 571049 - RNA, 22 nt, Human
cccagcucccauguucuccaau

SEQ ID NO: 571050 - RNA, 22 nt, Human
ugccaggcccagcuccagagcu

SEQ ID NO: 571051 - RNA, 22 nt, Human
ccugagugccaugagagcaccc

SEQ ID NO: 571052 - RNA, 18 nt, Human
caggugggucuccugccc

SEQ ID NO: 571053 - RNA, 22 nt, Human
cuauucuagauuacaguauaaa

SEQ ID NO: 571054 - RNA, 22 nt, Human
cauucauuuaugaaauaucuau

SEQ ID NO: 571055 - RNA, 22 nt, Human
aagcugccuagaguugaauguc

SEQ ID NO: 571056 - RNA, 22 nt, Human
uguggcugacuccuggucccca

SEQ ID NO: 571057 - RNA, 22 nt, Human
ucuuccucccuacagagcucag

SEQ ID NO: 571058 - RNA, 22 nt, Human
uucuagaggggagauacuagua

SEQ ID NO: 571059 - RNA, 22 nt, Human
uaauuuuaauaguauguggcau

SEQ ID NO: 571060 - RNA, 21 nt, Human
ggcaacagauauuuugcuuag

SEQ ID NO: 571061 - RNA, 22 nt, Human
gacuuuauuuuaacggagauuc

SEQ ID NO: 571062 - RNA, 23 nt, Human
cagcccuggagaugugggaggca

SEQ ID NO: 571063 - RNA, 22 nt, Human
ucuggguucuugaugcuaccuu

SEQ ID NO: 571064 - RNA, 22 nt, Human
uuuuacaccucagaugagcaga

SEQ ID NO: 571065 - RNA, 22 nt, Human
uucuuaguucaacuaaaauuua

SEQ ID NO: 571066 - RNA, 22 nt, Human
cugaggccuaagacaugaauga

SEQ ID NO: 571067 - RNA, 22 nt, Human
cagcuucucagaaagcugaggu

SEQ ID NO: 571068 - RNA, 22 nt, Human
aggggcugacuggaaagugcca

SEQ ID NO: 571069 - RNA, 22 nt, Human
cuaagacaugcccugcaugaua

SEQ ID NO: 571070 - RNA, 22 nt, Human
uucuuuucuuggcaggaguaga

SEQ ID NO: 571071 - RNA, 22 nt, Human
aggugggcaaugaggccugagu

SEQ ID NO: 571072 - RNA, 22 nt, Human
uucucugaaggccaugcucacu

SEQ ID NO: 571073 - RNA, 18 nt, Human
aggcaggcggaucacaag

SEQ ID NO: 571074 - RNA, 22 nt, Human
auauccaagaaacaauuaauuc

SEQ ID NO: 571075 - RNA, 22 nt, Human
uuuucacacaaggugauaaguu

SEQ ID NO: 571076 - RNA, 22 nt, Human
cuggguggcagagccugcagug

SEQ ID NO: 571077 - RNA, 22 nt, Human
ggugugugguuuugauacaguc

SEQ ID NO: 571078 - RNA, 21 nt, Human
cagagggccggcauguggucu

SEQ ID NO: 571079 - RNA, 22 nt, Human
aagcuuacaguuccacguagca

SEQ ID NO: 571080 - RNA, 22 nt, Human
ccugagguggcugcagcacugc

SEQ ID NO: 571081 - RNA, 22 nt, Human
cugagccacugcuuguucagug

SEQ ID NO: 571082 - RNA, 23 nt, Human
aguucucauucaucacggccuau

SEQ ID NO: 571083 - RNA, 22 nt, Human
uaccagcuuccuucaagaugug

SEQ ID NO: 571084 - RNA, 22 nt, Human
agcaaagcuaccaauuauugag

SEQ ID NO: 571085 - RNA, 22 nt, Human
ggaaugauggugccuagauuau

SEQ ID NO: 571086 - RNA, 20 nt, Human
aucugcugagaaugaaaggc

SEQ ID NO: 571087 - RNA, 21 nt, Human
agauccuguggcugagaagua

SEQ ID NO: 571088 - RNA, 22 nt, Human
ucccuccagaauggugaggaag

SEQ ID NO: 571089 - RNA, 22 nt, Human
caaauugaucugucuuuaugaa

SEQ ID NO: 571090 - RNA, 22 nt, Human
ucccgauaggcagggcucuggc

SEQ ID NO: 571091 - RNA, 22 nt, Human
aaaucacuguuauugaucuuaa

SEQ ID NO: 571092 - RNA, 22 nt, Human
ccucugugugugcaugcaugcg

SEQ ID NO: 571093 - RNA, 22 nt, Human
ugugaacucuggaacaaaacua

SEQ ID NO: 571094 - RNA, 21 nt, Human
gccugagcaugucuucagguc

SEQ ID NO: 571095 - RNA, 22 nt, Human
ugcuccaggcugcugaagaucu

SEQ ID NO: 571096 - RNA, 22 nt, Human
ccagcucccauucuucaccugu

SEQ ID NO: 571097 - RNA, 22 nt, Human
uggaacacaucuaaggaagcag

SEQ ID NO: 571098 - RNA, 22 nt, Human
uuguaacaaucugucauaaaug

SEQ ID NO: 571099 - RNA, 22 nt, Human
ucuuuccucugagcuccuguag

SEQ ID NO: 571100 - RNA, 22 nt, Human
auagaauuugcacuaaaucugc

SEQ ID NO: 571101 - RNA, 22 nt, Human
ggcaaauuugucuuaagacacc

SEQ ID NO: 571102 - RNA, 22 nt, Human
ccaggaggucugaguguggaca

SEQ ID NO: 571103 - RNA, 22 nt, Human
uuuagaauuggcuagugggaau

SEQ ID NO: 571104 - RNA, 22 nt, Human
ugaccaaaggugguuuauuugg

SEQ ID NO: 571105 - RNA, 22 nt, Human
agaccacaggcaugcacagagc

SEQ ID NO: 571106 - RNA, 22 nt, Human
ucucuguguucccuguuuucuc

SEQ ID NO: 571107 - RNA, 20 nt, Human
aggcccugccagggacggag

SEQ ID NO: 571108 - RNA, 22 nt, Human
aaauuauaggugccaccuugga

SEQ ID NO: 571109 - RNA, 22 nt, Human
cagaggcagaggucaucucugg

SEQ ID NO: 571110 - RNA, 19 nt, Human
uggcagaggacaaggacuu

SEQ ID NO: 571111 - RNA, 20 nt, Human
aggacuuguuugggcagagu

SEQ ID NO: 571112 - RNA, 22 nt, Human
ccugccugguguaagucuaagg

SEQ ID NO: 571113 - RNA, 22 nt, Human
cugggcuuugguacugugauua

SEQ ID NO: 571114 - RNA, 22 nt, Human
guuacaaagcacuucaagugaa

SEQ ID NO: 571115 - RNA, 22 nt, Human
cagcccuugcgacacccuggcu

SEQ ID NO: 571116 - RNA, 22 nt, Human
uuucaaacauaucuucauuacu

SEQ ID NO: 571117 - RNA, 22 nt, Human
aggcuguggugcugaaggaggg

SEQ ID NO: 571118 - RNA, 22 nt, Human
gcagggcagcuuagucccuguc

SEQ ID NO: 571119 - RNA, 22 nt, Human
gcacugggagcugccugccggu

SEQ ID NO: 571120 - RNA, 22 nt, Human
uguuauugauaucuaaugcucu

SEQ ID NO: 571121 - RNA, 22 nt, Human
gacugaggcuccccuaggcuca

SEQ ID NO: 571122 - RNA, 22 nt, Human
caccuugcauucuuuuaauuua

SEQ ID NO: 571123 - RNA, 22 nt, Human
cccugcaggggaccugcagccu

SEQ ID NO: 571124 - RNA, 22 nt, Human
ucugacuuggcgcucuugucuu

SEQ ID NO: 571125 - RNA, 22 nt, Human
agcuggagaauguggaugaucc

SEQ ID NO: 571126 - RNA, 23 nt, Human
uugucugugcuuuuccaguugcu

SEQ ID NO: 571127 - RNA, 22 nt, Human
uaauaucuggcauucaaacaug

SEQ ID NO: 571128 - RNA, 22 nt, Human
gugcauuuggugacucucaccc

SEQ ID NO: 571129 - RNA, 22 nt, Human
gccucaggugcaucucucauuc

SEQ ID NO: 571130 - RNA, 22 nt, Human
auagcagcauuucuuccaagga

SEQ ID NO: 571131 - RNA, 22 nt, Human
uacuuugucauucuaaccuucc

SEQ ID NO: 571132 - RNA, 22 nt, Human
uuagccuuagaagcuuagcaaa

SEQ ID NO: 571133 - RNA, 22 nt, Human
uccuggguggugguaggagcag

SEQ ID NO: 571134 - RNA, 22 nt, Human
aguuguauuagagaacacaaac

SEQ ID NO: 571135 - RNA, 22 nt, Human
acaaagagaccaugagccaaac

SEQ ID NO: 571136 - RNA, 22 nt, Human
ccuccaguacuccaguccagcg

SEQ ID NO: 571137 - RNA, 22 nt, Human
cacccaggacaggccagaugug

SEQ ID NO: 571138 - RNA, 22 nt, Human
aagcuucacauugaacuugggu

SEQ ID NO: 571139 - RNA, 21 nt, Human
gcacucagucacuacucaaga

SEQ ID NO: 571140 - RNA, 22 nt, Human
uagggguggagcuaagaguccc

SEQ ID NO: 571141 - RNA, 22 nt, Human
cugcccacuauguugucauggg

SEQ ID NO: 571142 - RNA, 22 nt, Human
caguggcugguuagggacagga

SEQ ID NO: 571143 - RNA, 22 nt, Human
gagagcuguuuaucuucuucaa

SEQ ID NO: 571144 - RNA, 22 nt, Human
cucuggagaugguucucaauug

SEQ ID NO: 571145 - RNA, 22 nt, Human
uuaaaaucuaaagcaguugucu

SEQ ID NO: 571146 - RNA, 22 nt, Human
acacccaggcuggcgugcagug

SEQ ID NO: 571147 - RNA, 22 nt, Human
uaucuacuccucuuucagaugc

SEQ ID NO: 571148 - RNA, 22 nt, Human
cugaugauagugauuuauugag

SEQ ID NO: 571149 - RNA, 22 nt, Human
cugcugggucuaugcaagugga

SEQ ID NO: 571150 - RNA, 22 nt, Human
aggauccuccuuagaaaagacc

SEQ ID NO: 571151 - RNA, 22 nt, Human
uuugaugaugaugauaaaguuu

SEQ ID NO: 571152 - RNA, 22 nt, Human
agaaagcacccugcacuuucug

SEQ ID NO: 571153 - RNA, 22 nt, Human
ucuggauggucagcucuuccug

SEQ ID NO: 571154 - RNA, 22 nt, Human
ugugggagaaggaagcaagcug

SEQ ID NO: 571155 - RNA, 19 nt, Human
aggagaaguagcagaaauu

SEQ ID NO: 571156 - RNA, 22 nt, Human
aucauuuuuaagagacucuucu

SEQ ID NO: 571157 - RNA, 22 nt, Human
ucagaacauauauuuugugaug

SEQ ID NO: 571158 - RNA, 22 nt, Human
ucucugagcccagugucccccu

SEQ ID NO: 571159 - RNA, 22 nt, Human
agaguggggaagguguugagaa

SEQ ID NO: 571160 - RNA, 22 nt, Human
gcccaggacucagggugucgcg

SEQ ID NO: 571161 - RNA, 22 nt, Human
gagagucuagugcaccuaguuu

SEQ ID NO: 571162 - RNA, 21 nt, Human
gugugaguagcaugugucuca

SEQ ID NO: 571163 - RNA, 20 nt, Human
uccuggucauguggcugggc

SEQ ID NO: 571164 - RNA, 22 nt, Human
cugaggcuaguauaaagagcau

SEQ ID NO: 571165 - RNA, 22 nt, Human
agcacuagagccaaaauuuggg

SEQ ID NO: 571166 - RNA, 17 nt, Human
ugaaggccaugaccacg

SEQ ID NO: 571167 - RNA, 22 nt, Human
uaugaauauaccacaauuuagg

SEQ ID NO: 571168 - RNA, 22 nt, Human
ucugggcacacaccaugcccac

SEQ ID NO: 571169 - RNA, 22 nt, Human
cucuggaggcagcaccagccag

SEQ ID NO: 571170 - RNA, 22 nt, Human
uuuuauguaauccuuacugucg

SEQ ID NO: 571171 - RNA, 22 nt, Human
gcucuggcccaaacccuuucua

SEQ ID NO: 571172 - RNA, 22 nt, Human
ucugggaggucacauuggucuu

SEQ ID NO: 571173 - RNA, 22 nt, Human
augucuuucuugugucccaaga

SEQ ID NO: 571174 - RNA, 22 nt, Human
cccagagaucuuguccuuucca

SEQ ID NO: 571175 - RNA, 22 nt, Human
uccuuuuugguccaaggugacc

SEQ ID NO: 571176 - RNA, 22 nt, Human
cagauauaguggcuugccuggg

SEQ ID NO: 571177 - RNA, 21 nt, Human
cuccucaggaccagccacagg

SEQ ID NO: 571178 - RNA, 22 nt, Human
uucucagaugauucagauaaac

SEQ ID NO: 571179 - RNA, 22 nt, Human
uguguucauuuaacuguucuuu

SEQ ID NO: 571180 - RNA, 22 nt, Human
uucaugaagggugaauauaguc

SEQ ID NO: 571181 - RNA, 19 nt, Human
cucuuacagaauagacaca

SEQ ID NO: 571182 - RNA, 22 nt, Human
gcaggcugggguagccccacuu

SEQ ID NO: 571183 - RNA, 22 nt, Human
caugcuuauauggaaaggaaga

SEQ ID NO: 571184 - RNA, 22 nt, Human
ucuaugucagcaucuuucuacc

SEQ ID NO: 571185 - RNA, 22 nt, Human
aaagaagcuguggcucugggag

SEQ ID NO: 571186 - RNA, 20 nt, Human
agugucuggugcagggccuc

SEQ ID NO: 571187 - RNA, 22 nt, Human
acuguaaaacagguuucaucau

SEQ ID NO: 571188 - RNA, 22 nt, Human
uggcaacaccuggaagacaugg

SEQ ID NO: 571189 - RNA, 22 nt, Human
agagaaacccuucaguguuuug

SEQ ID NO: 571190 - RNA, 22 nt, Human
ucuuauuauuguuguaaaagca

SEQ ID NO: 571191 - RNA, 22 nt, Human
agaggccaccagagguggugcc

SEQ ID NO: 571192 - RNA, 22 nt, Human
aggcagcauuugaauccagguc

SEQ ID NO: 571193 - RNA, 22 nt, Human
ugacaagaggcagaaucagcug

SEQ ID NO: 571194 - RNA, 22 nt, Human
cagcuucuaccaucaggaaauu

SEQ ID NO: 571195 - RNA, 21 nt, Human
guggcccugccgcagugucca

SEQ ID NO: 571196 - RNA, 22 nt, Human
aagccagcauuuucccauuccu

SEQ ID NO: 571197 - RNA, 22 nt, Human
ugaagugaccuggggcagugua

SEQ ID NO: 571198 - RNA, 22 nt, Human
aaagauaauguuuccuuauucu

SEQ ID NO: 571199 - RNA, 22 nt, Human
cuggccccuguggcuaaaauca

SEQ ID NO: 571200 - RNA, 22 nt, Human
aaccuugagggaugagguagug

SEQ ID NO: 571201 - RNA, 22 nt, Human
auucuaaauguaauuuagaauu

SEQ ID NO: 571202 - RNA, 19 nt, Human
gcucagagacaccuguugc

SEQ ID NO: 571203 - RNA, 22 nt, Human
gcuuccagcaccagcagagggg

SEQ ID NO: 571204 - RNA, 19 nt, Human
auuucaagagguuuauugg

SEQ ID NO: 571205 - RNA, 22 nt, Human
cugaggccuggugaggugguga

SEQ ID NO: 571206 - RNA, 22 nt, Human
agaacaucugaagauacaaagu

SEQ ID NO: 571207 - RNA, 20 nt, Human
ucccuccugcagauagagaa

SEQ ID NO: 571208 - RNA, 22 nt, Human
uuuuguuuaaaauccuggaugg

SEQ ID NO: 571209 - RNA, 22 nt, Human
ggggcugguggugguuucucca

SEQ ID NO: 571210 - RNA, 22 nt, Human
caguggccuuuccugcugcuca

SEQ ID NO: 571211 - RNA, 22 nt, Human
gggcagcuguaucugagcuuau

SEQ ID NO: 571212 - RNA, 22 nt, Human
gucuauaagcaggggaaaacuu

SEQ ID NO: 571213 - RNA, 22 nt, Human
cccugcuuugcacccaggcugg

SEQ ID NO: 571214 - RNA, 18 nt, Human
uguacaguuaugagcauu

SEQ ID NO: 571215 - RNA, 22 nt, Human
uggggcuggggaucuugagccu

SEQ ID NO: 571216 - RNA, 22 nt, Human
uaucaguauggauucauggauu

SEQ ID NO: 571217 - RNA, 22 nt, Human
cugaaggagaaggccacuguuc

SEQ ID NO: 571218 - RNA, 22 nt, Human
ugaauaagaauuauuauaauga

SEQ ID NO: 571219 - RNA, 22 nt, Human
auaugaagaauuccaauuugga

SEQ ID NO: 571220 - RNA, 22 nt, Human
gcuaggcucggaagcagcaggg

SEQ ID NO: 571221 - RNA, 22 nt, Human
aggcuccaugcaaaggcuguuu

SEQ ID NO: 571222 - RNA, 22 nt, Human
cagauaaaauuaauauuaccaa

SEQ ID NO: 571223 - RNA, 20 nt, Human
gaaauguacacauuaccaca

SEQ ID NO: 571224 - RNA, 22 nt, Human
cagagccacugucugccaggca

SEQ ID NO: 571225 - RNA, 22 nt, Human
agauuccucagucaugaagccu

SEQ ID NO: 571226 - RNA, 19 nt, Human
aguggcagaucuggaagua

SEQ ID NO: 571227 - RNA, 21 nt, Human
ugaauuucgguauggcuauaa

SEQ ID NO: 571228 - RNA, 22 nt, Human
cagcaggcguugggagaaagac

SEQ ID NO: 571229 - RNA, 22 nt, Human
agaaagcaucuccauuguaggu

SEQ ID NO: 571230 - RNA, 22 nt, Human
ggccugucucacccccgggugc

SEQ ID NO: 571231 - RNA, 22 nt, Human
cugaggcuucucuaguucagcu

SEQ ID NO: 571232 - RNA, 22 nt, Human
uuuccuucaucaucugagagcu

SEQ ID NO: 571233 - RNA, 22 nt, Human
uuccagaggccugggcacacuc

SEQ ID NO: 571234 - RNA, 22 nt, Human
agggaagcugcuggguccaccu

SEQ ID NO: 571235 - RNA, 22 nt, Human
gguguaagaugucagcugagca

SEQ ID NO: 571236 - RNA, 22 nt, Human
gaaaguuucuucauuaagaugu

SEQ ID NO: 571237 - RNA, 18 nt, Human
ugggaagaaauucuucuc

SEQ ID NO: 571238 - RNA, 22 nt, Human
acugaaaaugaauuagaaacag

SEQ ID NO: 571239 - RNA, 22 nt, Human
cugagccccaucugaggugccc

SEQ ID NO: 571240 - RNA, 22 nt, Human
aagacagaccacgugacagggc

SEQ ID NO: 571241 - RNA, 22 nt, Human
guguggggccaggaucagggcu

SEQ ID NO: 571242 - RNA, 22 nt, Human
ccaguguuuucauccucccuug

SEQ ID NO: 571243 - RNA, 22 nt, Human
agggguggagaguguugccagu

SEQ ID NO: 571244 - RNA, 22 nt, Human
ccuccaggauaagucagggccu

SEQ ID NO: 571245 - RNA, 22 nt, Human
ugcugccagagagacagggacu

SEQ ID NO: 571246 - RNA, 22 nt, Human
gacagacacuguguccucacuu

SEQ ID NO: 571247 - RNA, 19 nt, Human
uuuuaaguccucucuauuc

SEQ ID NO: 571248 - RNA, 22 nt, Human
gccugucucuuggaacuuggua

SEQ ID NO: 571249 - RNA, 22 nt, Human
aagacugugucuauggcuacuc

SEQ ID NO: 571250 - RNA, 22 nt, Human
ugggaagaagcagagaacugga

SEQ ID NO: 571251 - RNA, 22 nt, Human
uauacaaguaaugcugaaugau

SEQ ID NO: 571252 - RNA, 22 nt, Human
gagaggcauggaacagauucuu

SEQ ID NO: 571253 - RNA, 22 nt, Human
uagaaacauauguuugagacau

SEQ ID NO: 571254 - RNA, 22 nt, Human
agaguuuagggcugagagcuug

SEQ ID NO: 571255 - RNA, 19 nt, Human
ucuaguuuugagagacuuc

SEQ ID NO: 571256 - RNA, 22 nt, Human
cuuaauuacccaaugugguagg

SEQ ID NO: 571257 - RNA, 22 nt, Human
cagcagaguuuggcuucuaaug

SEQ ID NO: 571258 - RNA, 22 nt, Human
cuuaagacaggcucaaagauua

SEQ ID NO: 571259 - RNA, 22 nt, Human
cggagggguuugaacagaggag

SEQ ID NO: 571260 - RNA, 22 nt, Human
ucauuuuugucuccgguuugug

SEQ ID NO: 571261 - RNA, 22 nt, Human
aagccuuauggggacaguuuug

SEQ ID NO: 571262 - RNA, 22 nt, Human
gauuuuauuagcccaaacuuug

SEQ ID NO: 571263 - RNA, 22 nt, Human
augaacuuucuuuacaguuuug

SEQ ID NO: 571264 - RNA, 22 nt, Human
ugagccagugugguaaagcuga

SEQ ID NO: 571265 - RNA, 22 nt, Human
gacuuuauucguuaacuguuaa

SEQ ID NO: 571266 - RNA, 22 nt, Human
guggcacagugggagagcccca

SEQ ID NO: 571267 - RNA, 22 nt, Human
ccagguggugaaagugggcccu

SEQ ID NO: 571268 - RNA, 22 nt, Human
acauucccuuggcuugaagcag

SEQ ID NO: 571269 - RNA, 22 nt, Human
aguauacuccccauccuagaaa

SEQ ID NO: 571270 - RNA, 21 nt, Human
ggcagagaagcuggaaguugg

SEQ ID NO: 571271 - RNA, 23 nt, Human
agcuugcuuuucccaguacugca

SEQ ID NO: 571272 - RNA, 22 nt, Human
uuauuguuagugagacuguaga

SEQ ID NO: 571273 - RNA, 23 nt, Human
uuguuaacuuuccugccccuaca

SEQ ID NO: 571274 - RNA, 21 nt, Human
ccuccaggagcagagcccuga

SEQ ID NO: 571275 - RNA, 22 nt, Human
ugauauuugcugacugcauugu

SEQ ID NO: 571276 - RNA, 22 nt, Human
caaauauuccagguacaucccu

SEQ ID NO: 571277 - RNA, 22 nt, Human
guggguggacggugcuuuuguu

SEQ ID NO: 571278 - RNA, 22 nt, Human
ggagggggacugacacugauuu

SEQ ID NO: 571279 - RNA, 22 nt, Human
uggagagcaagucgcagacaug

SEQ ID NO: 571280 - RNA, 22 nt, Human
auacauguugagaaaauaucug

SEQ ID NO: 571281 - RNA, 19 nt, Human
ccagucccauacaggagau

SEQ ID NO: 571282 - RNA, 22 nt, Human
ucuggaguugcauguuuuggcu

SEQ ID NO: 571283 - RNA, 22 nt, Human
cucucuccuuagcugcagacca

SEQ ID NO: 571284 - RNA, 22 nt, Human
aggaagaaaugugacuucaaac

SEQ ID NO: 571285 - RNA, 20 nt, Human
acagcagauaccacaacuau

SEQ ID NO: 571286 - RNA, 22 nt, Human
uguuuauugcugcaauugugcc

SEQ ID NO: 571287 - RNA, 18 nt, Human
aagcaggguccauugugc

SEQ ID NO: 571288 - RNA, 22 nt, Human
cagggcaguaccgcccucuggc

SEQ ID NO: 571289 - RNA, 21 nt, Human
aggggcccuugccaggacgcc

SEQ ID NO: 571290 - RNA, 22 nt, Human
acaacauucuuaaauacacuga

SEQ ID NO: 571291 - RNA, 22 nt, Human
gcuuccuccuggaggucacuca

SEQ ID NO: 571292 - RNA, 22 nt, Human
cugaggagggaaguccccaaag

SEQ ID NO: 571293 - RNA, 22 nt, Human
agaucaaggugucagcaggcuu

SEQ ID NO: 571294 - RNA, 22 nt, Human
caggaggagcuggccgccucau

SEQ ID NO: 571295 - RNA, 22 nt, Human
aggcacugacucaagggagcca

SEQ ID NO: 571296 - RNA, 22 nt, Human
caggagcuggaucuccuugcgg

SEQ ID NO: 571297 - RNA, 22 nt, Human
gccugagcccaggugugcagag

SEQ ID NO: 571298 - RNA, 22 nt, Human
uuuuaauugcaauuaugguccc

SEQ ID NO: 571299 - RNA, 22 nt, Human
uggcaggcugaguuggccuggu

SEQ ID NO: 571300 - RNA, 22 nt, Human
ucagcugccccgggcacugccc

SEQ ID NO: 571301 - RNA, 22 nt, Human
uagcuuugaacuucugggcuca

SEQ ID NO: 571302 - RNA, 22 nt, Human
gggaggaaaugugcagcgaauu

SEQ ID NO: 571303 - RNA, 22 nt, Human
ugaucccaaucuuuccugcucc

SEQ ID NO: 571304 - RNA, 22 nt, Human
auaagugauauuuagcuauaga

SEQ ID NO: 571305 - RNA, 22 nt, Human
aaugaagcaguccaucugcucu

SEQ ID NO: 571306 - RNA, 22 nt, Human
aauauuuuaggcuuuccaggcu

SEQ ID NO: 571307 - RNA, 22 nt, Human
ucucagcugccugcccugcucc

SEQ ID NO: 571308 - RNA, 22 nt, Human
gugggugcugucaggcagggaa

SEQ ID NO: 571309 - RNA, 22 nt, Human
ucugggaacauggcuuggaauc

SEQ ID NO: 571310 - RNA, 21 nt, Human
uuacaacauuuguguucuaug

SEQ ID NO: 571311 - RNA, 22 nt, Human
ggcuuccugggcauguguucua

SEQ ID NO: 571312 - RNA, 22 nt, Human
guuuccuuuuggaauuagagcu

SEQ ID NO: 571313 - RNA, 22 nt, Human
aagagcauuuggugagauuuga

SEQ ID NO: 571314 - RNA, 20 nt, Human
ugcauuaaguggcauugagc

SEQ ID NO: 571315 - RNA, 22 nt, Human
cacagagagcuacgugcagcgu

SEQ ID NO: 571316 - RNA, 22 nt, Human
auguacaaucuaucacaagaag

SEQ ID NO: 571317 - RNA, 22 nt, Human
aucuguaaagauaaucauaugu

SEQ ID NO: 571318 - RNA, 22 nt, Human
aaaagcaaguugccuagguuga

SEQ ID NO: 571319 - RNA, 22 nt, Human
ugaagccaucaggaagccagca

SEQ ID NO: 571320 - RNA, 22 nt, Human
acaguguuuucuuaaggagaaa

SEQ ID NO: 571321 - RNA, 22 nt, Human
cuggugucauuuuagccucagg

SEQ ID NO: 571322 - RNA, 22 nt, Human
gauaacauuauaaguucacugu

SEQ ID NO: 571323 - RNA, 22 nt, Human
uagagucuaguguauacaaagu

SEQ ID NO: 571324 - RNA, 22 nt, Human
ugugaauaccuugaauucauca

SEQ ID NO: 571325 - RNA, 22 nt, Human
ggaaggagggcggcaaugauga

SEQ ID NO: 571326 - RNA, 22 nt, Human
aaucagcuaaauaaacuaguca

SEQ ID NO: 571327 - RNA, 22 nt, Human
cuuauucagauacagacucuug

SEQ ID NO: 571328 - RNA, 22 nt, Human
accaucaagaccuuaucuaguu

SEQ ID NO: 571329 - RNA, 18 nt, Human
ggacaggagacaugggug

SEQ ID NO: 571330 - RNA, 22 nt, Human
uucagaauauuuguuuuacaug

SEQ ID NO: 571331 - RNA, 22 nt, Human
ugcaaauuuaaugaaacuaugu

SEQ ID NO: 571332 - RNA, 22 nt, Human
aaucagaacuccuaccacagag

SEQ ID NO: 571333 - RNA, 22 nt, Human
acacaguauuacaauaggugcu

SEQ ID NO: 571334 - RNA, 22 nt, Human
gaggccagcuacccaaggguca

SEQ ID NO: 571335 - RNA, 22 nt, Human
gucucauugguucugccagagu

SEQ ID NO: 571336 - RNA, 22 nt, Human
aaacuguaaacacagcaguaca

SEQ ID NO: 571337 - RNA, 21 nt, Human
aaggcugagacaacucaggag

SEQ ID NO: 571338 - RNA, 22 nt, Human
uccuucaggccucauucucaua

SEQ ID NO: 571339 - RNA, 17 nt, Human
agcacuaaaaugcuucc

SEQ ID NO: 571340 - RNA, 22 nt, Human
auguguucaguugacaggagca

SEQ ID NO: 571341 - RNA, 22 nt, Human
ugucuccucauacugucauauu

SEQ ID NO: 571342 - RNA, 22 nt, Human
aaucgcaauuacuuuugcacca

SEQ ID NO: 571343 - RNA, 22 nt, Human
cuggacagaaagggcugcugug

SEQ ID NO: 571344 - RNA, 22 nt, Human
agcagccagagaaugaugcagu

SEQ ID NO: 571345 - RNA, 22 nt, Human
ggcauccaaauaccaagaugua

SEQ ID NO: 571346 - RNA, 23 nt, Human
ugagaagccaggggagcgugagg

SEQ ID NO: 571347 - RNA, 22 nt, Human
ggagagcuagugccugccagua

SEQ ID NO: 571348 - RNA, 22 nt, Human
caguuacauauuuaguagguua

SEQ ID NO: 571349 - RNA, 22 nt, Human
augacauaaagcuaugcuaggu

SEQ ID NO: 571350 - RNA, 22 nt, Human
uugcccagaguccacagcguac

SEQ ID NO: 571351 - RNA, 22 nt, Human
cuucuccucugaguccugggag

SEQ ID NO: 571352 - RNA, 22 nt, Human
ccaggaagccugugucucugga

SEQ ID NO: 571353 - RNA, 22 nt, Human
caguuucucaggccucucccag

SEQ ID NO: 571354 - RNA, 22 nt, Human
uacuuacauaaaaacugaaugu

SEQ ID NO: 571355 - RNA, 22 nt, Human
ugcaggugcugugucaagagag

SEQ ID NO: 571356 - RNA, 22 nt, Human
gaggagggccuggugucccuuc

SEQ ID NO: 571357 - RNA, 22 nt, Human
cugggagcccgcguccuggugg

SEQ ID NO: 571358 - RNA, 22 nt, Human
cuuuggaaaaauaccuggcaua

SEQ ID NO: 571359 - RNA, 22 nt, Human
aucuuacacgauaacuguuagu

SEQ ID NO: 571360 - RNA, 22 nt, Human
auugacaaauggauguugacau

SEQ ID NO: 571361 - RNA, 22 nt, Human
ccuucagucccauguuucucuu

SEQ ID NO: 571362 - RNA, 19 nt, Human
uggaagaggaagggaaaua

SEQ ID NO: 571363 - RNA, 22 nt, Human
cugaggcaggagaauugcugga

SEQ ID NO: 571364 - RNA, 22 nt, Human
cuggcucaggaaaguugcugcu

SEQ ID NO: 571365 - RNA, 22 nt, Human
cuuuaaauaauacaagguccag

SEQ ID NO: 571366 - RNA, 19 nt, Human
ugaggcacuagucuggucc

SEQ ID NO: 571367 - RNA, 20 nt, Human
uuugacauauacaguucagg

SEQ ID NO: 571368 - RNA, 20 nt, Human
gggugaggauggagaauuug

SEQ ID NO: 571369 - RNA, 22 nt, Human
cagugcagguggcagaggacag

SEQ ID NO: 571370 - RNA, 22 nt, Human
uugacaaauacccauuagacca

SEQ ID NO: 571371 - RNA, 22 nt, Human
aggcugugauuccaccacucuc

SEQ ID NO: 571372 - RNA, 22 nt, Human
ucugaaauggcgauggccguug

SEQ ID NO: 571373 - RNA, 22 nt, Human
aagacauugcaugauaaugcug

SEQ ID NO: 571374 - RNA, 22 nt, Human
ucugggcagcagcagcuaguag

SEQ ID NO: 571375 - RNA, 23 nt, Human
ugggguugaauuguagcugugcc

SEQ ID NO: 571376 - RNA, 22 nt, Human
augauauauguguugagcuugc

SEQ ID NO: 571377 - RNA, 22 nt, Human
uauaauuuuagaagagauggaa

SEQ ID NO: 571378 - RNA, 22 nt, Human
cuaaacuucauauguugcuuua

SEQ ID NO: 571379 - RNA, 22 nt, Human
ucucauucauacccuacaugcu

SEQ ID NO: 571380 - RNA, 22 nt, Human
ucuaaaaugcagaucuacuggu

SEQ ID NO: 571381 - RNA, 22 nt, Human
ugccacagaggugaagcccacu

SEQ ID NO: 571382 - RNA, 23 nt, Human
ugugacagugacaauacugacuu

SEQ ID NO: 571383 - RNA, 22 nt, Human
ucaauacagaaaggauauuuug

SEQ ID NO: 571384 - RNA, 22 nt, Human
gagacugauggggcucccagaa

SEQ ID NO: 571385 - RNA, 22 nt, Human
ucugggagcacacgcagugauc

SEQ ID NO: 571386 - RNA, 22 nt, Human
aacaaacaaacauuuugucauc

SEQ ID NO: 571387 - RNA, 22 nt, Human
cccaggagguguagcugcgugg

SEQ ID NO: 571388 - RNA, 16 nt, Human
cagcuuugucuccucg

SEQ ID NO: 571389 - RNA, 21 nt, Human
auuguuaucauugugcugugu

SEQ ID NO: 571390 - RNA, 22 nt, Human
gauggcaaacugggaccagagg

SEQ ID NO: 571391 - RNA, 22 nt, Human
agcagaccaggagugcacaggu

SEQ ID NO: 571392 - RNA, 19 nt, Human
aguuuauuauaggugauuc

SEQ ID NO: 571393 - RNA, 22 nt, Human
gaggcacucucgacaagggugg

SEQ ID NO: 571394 - RNA, 22 nt, Human
ugcuccaggcaagcugagaguu

SEQ ID NO: 571395 - RNA, 22 nt, Human
aagagguuauuguucccagcuu

SEQ ID NO: 571396 - RNA, 22 nt, Human
uacugucuggaguugccaaagg

SEQ ID NO: 571397 - RNA, 22 nt, Human
acauucuaaagcaugcucagga

SEQ ID NO: 571398 - RNA, 22 nt, Human
agggcuggaggguacuaguuua

SEQ ID NO: 571399 - RNA, 20 nt, Human
uuuauugagcacguacugug

SEQ ID NO: 571400 - RNA, 22 nt, Human
aaacaauguacauuuauaaugc

SEQ ID NO: 571401 - RNA, 22 nt, Human
cagguggcuuauuagggucagu

SEQ ID NO: 571402 - RNA, 22 nt, Human
agcaggugggaucaagcuggca

SEQ ID NO: 571403 - RNA, 22 nt, Human
ugugacugagcugcagaguguc

SEQ ID NO: 571404 - RNA, 22 nt, Human
uaaaauagcuuaugucuuuuga

SEQ ID NO: 571405 - RNA, 22 nt, Human
agccuggcacugaggcagggcg

SEQ ID NO: 571406 - RNA, 22 nt, Human
gugcauuugugcaugcacaugu

SEQ ID NO: 571407 - RNA, 22 nt, Human
gaaugaacaaggauguucaucc

SEQ ID NO: 571408 - RNA, 22 nt, Human
ugcuugcaagagaugcaaugac

SEQ ID NO: 571409 - RNA, 22 nt, Human
ucucuccuuaucauuguguuua

SEQ ID NO: 571410 - RNA, 22 nt, Human
cagggcuggauuucauuucuag

SEQ ID NO: 571411 - RNA, 22 nt, Human
gaguuacagagaggauuauggu

SEQ ID NO: 571412 - RNA, 22 nt, Human
ugacuuccugcacucaggugau

SEQ ID NO: 571413 - RNA, 22 nt, Human
gagacacacccaagguuaugag

SEQ ID NO: 571414 - RNA, 22 nt, Human
agaaaggucaaaaucgugacau

SEQ ID NO: 571415 - RNA, 22 nt, Human
cacaguuugguuuugcuguaau

SEQ ID NO: 571416 - RNA, 22 nt, Human
augauggaugucacagucugua

SEQ ID NO: 571417 - RNA, 22 nt, Human
ugaagccacagagcaucugccu

SEQ ID NO: 571418 - RNA, 22 nt, Human
acucuuauuuugaaguaauaau

SEQ ID NO: 571419 - RNA, 22 nt, Human
agacaaauugggacauuguguu

SEQ ID NO: 571420 - RNA, 20 nt, Human
cagcugccuggcucugggau

SEQ ID NO: 571421 - RNA, 22 nt, Human
aagaugauguuguguuuucacu

SEQ ID NO: 571422 - RNA, 22 nt, Human
uuugugaacacugcgcagaacu

SEQ ID NO: 571423 - RNA, 22 nt, Human
auuuauuaugggauuuggcaca

SEQ ID NO: 571424 - RNA, 22 nt, Human
agcugcuuguugaaauccaaac

SEQ ID NO: 571425 - RNA, 22 nt, Human
ugaaugauuucuuaggcaauug

SEQ ID NO: 571426 - RNA, 22 nt, Human
ccagggcucuaugaggguggag

SEQ ID NO: 571427 - RNA, 22 nt, Human
auuuccauuaucaugacaaauu

SEQ ID NO: 571428 - RNA, 22 nt, Human
cccagagcucagugugcaaggu

SEQ ID NO: 571429 - RNA, 22 nt, Human
agccugccuugggcugcuugag

SEQ ID NO: 571430 - RNA, 22 nt, Human
gcugccaauccagcugugggag

SEQ ID NO: 571431 - RNA, 17 nt, Human
uaguaaaugaguagagc

SEQ ID NO: 571432 - RNA, 22 nt, Human
ugucaagugauuagccauaaug

SEQ ID NO: 571433 - RNA, 22 nt, Human
augcaucuuaucaaaaauuaua

SEQ ID NO: 571434 - RNA, 22 nt, Human
cacugcagaucagaggcugaga

SEQ ID NO: 571435 - RNA, 22 nt, Human
uuuaugcagccucaguaucaga

SEQ ID NO: 571436 - RNA, 22 nt, Human
ucccccucauuaccucauucaa

SEQ ID NO: 571437 - RNA, 22 nt, Human
aauguucauugauuaaaugaau

SEQ ID NO: 571438 - RNA, 19 nt, Human
aggcagcaggccagggaug

SEQ ID NO: 571439 - RNA, 22 nt, Human
gucugaggcgaggccugagaac

SEQ ID NO: 571440 - RNA, 22 nt, Human
cugggccauggaagucucugcc

SEQ ID NO: 571441 - RNA, 22 nt, Human
caagaaggcuauaugggccagg

SEQ ID NO: 571442 - RNA, 22 nt, Human
cauuuguucaaccauucucgcu

SEQ ID NO: 571443 - RNA, 22 nt, Human
gguuauuuuugauucuguggau

SEQ ID NO: 571444 - RNA, 22 nt, Human
aacaaauguguuuuguaauuaa

SEQ ID NO: 571445 - RNA, 22 nt, Human
ugaagcaggaaacuucuuguuu

SEQ ID NO: 571446 - RNA, 22 nt, Human
gcuggaguaucuggggaaggag

SEQ ID NO: 571447 - RNA, 22 nt, Human
cuuucccagaguaguugaugcu

SEQ ID NO: 571448 - RNA, 20 nt, Human
gcuacugugggaaaauugug

SEQ ID NO: 571449 - RNA, 22 nt, Human
agcuuuaugcuuccuacaagcu

SEQ ID NO: 571450 - RNA, 22 nt, Human
uguguguauaauaaugucugca

SEQ ID NO: 571451 - RNA, 23 nt, Human
aguacauucgaaaaauucuguga

SEQ ID NO: 571452 - RNA, 22 nt, Human
augauucuuuuggauagaugau

SEQ ID NO: 571453 - RNA, 22 nt, Human
agaacagcagcacgucaagcug

SEQ ID NO: 571454 - RNA, 21 nt, Human
uuggauguauuuauguuuuag

SEQ ID NO: 571455 - RNA, 22 nt, Human
ccaauuuuauucuucugcaagu

SEQ ID NO: 571456 - RNA, 22 nt, Human
gggcuggauguuugaugacgaa

SEQ ID NO: 571457 - RNA, 22 nt, Human
gaacaauacaggcuuuauuccu

SEQ ID NO: 571458 - RNA, 21 nt, Human
uuuguucaggcaaguuacagu

SEQ ID NO: 571459 - RNA, 22 nt, Human
aauguuguguuucaguucaaga

SEQ ID NO: 571460 - RNA, 22 nt, Human
uuugugcaagagggccaccuua

SEQ ID NO: 571461 - RNA, 22 nt, Human
acaggcugccacuugcauccaa

SEQ ID NO: 571462 - RNA, 17 nt, Human
agucagaggaguaucug

SEQ ID NO: 571463 - RNA, 22 nt, Human
uaaacaagcuggacugauaagu

SEQ ID NO: 571464 - RNA, 22 nt, Human
ccagggagccuggugugucagc

SEQ ID NO: 571465 - RNA, 22 nt, Human
ucaucaaagucaaagaaugacu

SEQ ID NO: 571466 - RNA, 22 nt, Human
gggcugagugggccucuuacuu

SEQ ID NO: 571467 - RNA, 22 nt, Human
uaaagguuauugcacuggaguu

SEQ ID NO: 571468 - RNA, 22 nt, Human
cccagcaguaaccaguggaaau

SEQ ID NO: 571469 - RNA, 22 nt, Human
auuagaagcgugaauccuuuca

SEQ ID NO: 571470 - RNA, 22 nt, Human
agaagagaaauagugccacugu

SEQ ID NO: 571471 - RNA, 22 nt, Human
ccaggaccuggagcucuaugaa

SEQ ID NO: 571472 - RNA, 22 nt, Human
augaagcaacagcccuccuauu

SEQ ID NO: 571473 - RNA, 22 nt, Human
ggucugaguggugcugacucag

SEQ ID NO: 571474 - RNA, 22 nt, Human
ugggaagguguagaaagaacaa

SEQ ID NO: 571475 - RNA, 22 nt, Human
auuuaauuuucucaacagugcu

SEQ ID NO: 571476 - RNA, 19 nt, Human
uagggcuggccgggcggug

SEQ ID NO: 571477 - RNA, 22 nt, Human
gcuggcagagagcuggugagga

SEQ ID NO: 571478 - RNA, 22 nt, Human
augaauaugagacugagagccu

SEQ ID NO: 571479 - RNA, 22 nt, Human
aagcaaaacgugcucuaggagg

SEQ ID NO: 571480 - RNA, 22 nt, Human
agugauggcauauauagaugug

SEQ ID NO: 571481 - RNA, 22 nt, Human
uuacauacuuacuagaucuaug

SEQ ID NO: 571482 - RNA, 22 nt, Human
uucagcagugcagacacccagu

SEQ ID NO: 571483 - RNA, 22 nt, Human
agcuucagggacuuguggcaga

SEQ ID NO: 571484 - RNA, 17 nt, Human
cagugaggccuuuccuc

SEQ ID NO: 571485 - RNA, 22 nt, Human
gcucugucaacagcuagcugug

SEQ ID NO: 571486 - RNA, 19 nt, Human
ccuguacauuauucucccc

SEQ ID NO: 571487 - RNA, 22 nt, Human
caagguuuacauugggcuauca

SEQ ID NO: 571488 - RNA, 22 nt, Human
ggcugguggggaaagaggacca

SEQ ID NO: 571489 - RNA, 22 nt, Human
aguuucuauguaagcuacguga

SEQ ID NO: 571490 - RNA, 22 nt, Human
acauggcuaaagcaagucuaga

SEQ ID NO: 571491 - RNA, 22 nt, Human
gcacccagcccagggcgugaug

SEQ ID NO: 571492 - RNA, 22 nt, Human
ucugagcucuaucugugggaau

SEQ ID NO: 571493 - RNA, 22 nt, Human
uuuaaauuuguguuuagagggu

SEQ ID NO: 571494 - RNA, 22 nt, Human
acaggggcaggcaggacccuuu

SEQ ID NO: 571495 - RNA, 20 nt, Human
aguaggggaaugcaagagca

SEQ ID NO: 571496 - RNA, 22 nt, Human
ucucaaauguaaagcaugauuu

SEQ ID NO: 571497 - RNA, 23 nt, Human
aguccccuacauaguuccugggg

SEQ ID NO: 571498 - RNA, 23 nt, Human
augcaggguuacagggcugacuu

SEQ ID NO: 571499 - RNA, 22 nt, Human
ucccugcagcaggugaucaaug

SEQ ID NO: 571500 - RNA, 22 nt, Human
aggcacugcuucuaaguaggaa

SEQ ID NO: 571501 - RNA, 18 nt, Human
auuguuaauagaguacuu

SEQ ID NO: 571502 - RNA, 22 nt, Human
uaguuaaugugaggcaccuagu

SEQ ID NO: 571503 - RNA, 22 nt, Human
cucugugucagcugggugugca

SEQ ID NO: 571504 - RNA, 19 nt, Human
aacaucauggcucuuucca

SEQ ID NO: 571505 - RNA, 22 nt, Human
gcacacaggcaguuuccagcca

SEQ ID NO: 571506 - RNA, 22 nt, Human
ucccaaagaacugaauaguaau

SEQ ID NO: 571507 - RNA, 22 nt, Human
ugugugaauggauuauucuauu

SEQ ID NO: 571508 - RNA, 22 nt, Human
ggcaggcauggggucugccauu

SEQ ID NO: 571509 - RNA, 21 nt, Human
gucugaugcuugaugcaguug

SEQ ID NO: 571510 - RNA, 22 nt, Human
agggcugcuccuccuucaggcc

SEQ ID NO: 571511 - RNA, 22 nt, Human
aaaucagaugcuuccuaguugg

SEQ ID NO: 571512 - RNA, 22 nt, Human
gaagaugugggaacugcugaaa

SEQ ID NO: 571513 - RNA, 22 nt, Human
ccaggcccugcuccucacacca

SEQ ID NO: 571514 - RNA, 22 nt, Human
cugaagcaggccuacuucauug

SEQ ID NO: 571515 - RNA, 22 nt, Human
uagcugccagaccauucuuacu

SEQ ID NO: 571516 - RNA, 22 nt, Human
cuuguacaggaauccaugguau

SEQ ID NO: 571517 - RNA, 22 nt, Human
aguaaaguaccaaagugugagu

SEQ ID NO: 571518 - RNA, 22 nt, Human
ucuggguacuugcaagauuuuc

SEQ ID NO: 571519 - RNA, 23 nt, Human
cuuuuaaccggcaugggagggca

SEQ ID NO: 571520 - RNA, 22 nt, Human
auauuaaaacuaugguuuucag

SEQ ID NO: 571521 - RNA, 22 nt, Human
uccuguguucuagguauggucu

SEQ ID NO: 571522 - RNA, 22 nt, Human
aguuuauuguauaugguaguuu

SEQ ID NO: 571523 - RNA, 22 nt, Human
agguggcagaugggggugcucg

SEQ ID NO: 571524 - RNA, 22 nt, Human
gucucugugucugagagagccc

SEQ ID NO: 571525 - RNA, 22 nt, Human
ugggaagcuacucaugcaggca

SEQ ID NO: 571526 - RNA, 22 nt, Human
ucugcaagcuaaggaagcaucu

SEQ ID NO: 571527 - RNA, 22 nt, Human
caauucuuccuguuggauaugc

SEQ ID NO: 571528 - RNA, 22 nt, Human
auuaggcauucaugcagcuccu

SEQ ID NO: 571529 - RNA, 22 nt, Human
uuacaggucaguuugacugaau

SEQ ID NO: 571530 - RNA, 22 nt, Human
aggaagcugggaaacugacauu

SEQ ID NO: 571531 - RNA, 22 nt, Human
gcuucucuggcuggucugccac

SEQ ID NO: 571532 - RNA, 22 nt, Human
gcucuugggggacagauggagu

SEQ ID NO: 571533 - RNA, 22 nt, Human
agauacuaagcauuuccagcac

SEQ ID NO: 571534 - RNA, 22 nt, Human
uuugggaagaaguugcaaauuu

SEQ ID NO: 571535 - RNA, 22 nt, Human
ggcugaggguuaagaucagaca

SEQ ID NO: 571536 - RNA, 22 nt, Human
gccagcugguaggcaccuagcc

SEQ ID NO: 571537 - RNA, 22 nt, Human
aguggcagagugcacucaggca

SEQ ID NO: 571538 - RNA, 22 nt, Human
ucuuuucuugcauuauugcacu

SEQ ID NO: 571539 - RNA, 22 nt, Human
agggcagcccuucugggagggc

SEQ ID NO: 571540 - RNA, 17 nt, Human
ucaggcugggugcagug

SEQ ID NO: 571541 - RNA, 22 nt, Human
ucccaggauuuuaggcucucag

SEQ ID NO: 571542 - RNA, 22 nt, Human
cugaggcaucauggagaacagu

SEQ ID NO: 571543 - RNA, 22 nt, Human
accacugcccauggugaaaacu

SEQ ID NO: 571544 - RNA, 20 nt, Human
aggagggaccuggauuggcg

SEQ ID NO: 571545 - RNA, 22 nt, Human
agccaagcaccacuggcacucg

SEQ ID NO: 571546 - RNA, 22 nt, Human
ugggcaugaagaaggaaguggg

SEQ ID NO: 571547 - RNA, 22 nt, Human
uuccugcuccauuugcugagcu

SEQ ID NO: 571548 - RNA, 21 nt, Human
guuuuaagggagaaaaccuag

SEQ ID NO: 571549 - RNA, 22 nt, Human
ccagcucucugcagaaaggacu

SEQ ID NO: 571550 - RNA, 22 nt, Human
aucugcuuuugagaauuuacuu

SEQ ID NO: 571551 - RNA, 22 nt, Human
uggcacugggaugcuacuguua

SEQ ID NO: 571552 - RNA, 22 nt, Human
ggcuggagguagaagaacacuu

SEQ ID NO: 571553 - RNA, 22 nt, Human
ucucugagcgcauuccuccggc

SEQ ID NO: 571554 - RNA, 22 nt, Human
uuauucugucaaacuuauacau

SEQ ID NO: 571555 - RNA, 22 nt, Human
caaauacuggguaaguuaauuu

SEQ ID NO: 571556 - RNA, 22 nt, Human
auaugagaguaaaugccgaucu

SEQ ID NO: 571557 - RNA, 22 nt, Human
ccaugcccuaaaggacuggcag

SEQ ID NO: 571558 - RNA, 22 nt, Human
acauggcaaaagggacuuuaca

SEQ ID NO: 571559 - RNA, 22 nt, Human
acauuuuacaccaagacuucuu

SEQ ID NO: 571560 - RNA, 22 nt, Human
aaguuauugcagcaauccaagu

SEQ ID NO: 571561 - RNA, 22 nt, Human
uuuucucuacaaaauaaccagc

SEQ ID NO: 571562 - RNA, 22 nt, Human
gaggcccugaagacagcugggg

SEQ ID NO: 571563 - RNA, 22 nt, Human
ucugggaagcaaauauguaaga

SEQ ID NO: 571564 - RNA, 22 nt, Human
uaauuuugcugugaccauugaa

SEQ ID NO: 571565 - RNA, 22 nt, Human
agaacauuaaugcgagguauua

SEQ ID NO: 571566 - RNA, 22 nt, Human
uaaaugguauccuugcugugcu

SEQ ID NO: 571567 - RNA, 22 nt, Human
aaguuccuuagccuuagggcuu

SEQ ID NO: 571568 - RNA, 22 nt, Human
gcuggaccaggugugcacaggc

SEQ ID NO: 571569 - RNA, 16 nt, Human
ccaggaacacacagcu

SEQ ID NO: 571570 - RNA, 22 nt, Human
ugcugccuucuaggcgugcccu

SEQ ID NO: 571571 - RNA, 22 nt, Human
cuguggaauugaugcuuagugu

SEQ ID NO: 571572 - RNA, 23 nt, Human
ccacuagcaccuguucaacuucu

SEQ ID NO: 571573 - RNA, 22 nt, Human
aaguuuuugguagagaaaagua

SEQ ID NO: 571574 - RNA, 22 nt, Human
uccgcuggagagggggcugcca

SEQ ID NO: 571575 - RNA, 22 nt, Human
ggcugccucccaggagaaucug

SEQ ID NO: 571576 - RNA, 22 nt, Human
gugaaugacauauuuuguacug

SEQ ID NO: 571577 - RNA, 23 nt, Human
acaugggagggacauggaggcug

SEQ ID NO: 571578 - RNA, 22 nt, Human
gcuccacuuccuucugcccuca

SEQ ID NO: 571579 - RNA, 23 nt, Human
agggaacaagcaagcugcuaguc

SEQ ID NO: 571580 - RNA, 19 nt, Human
agcuccugauugugccucg

SEQ ID NO: 571581 - RNA, 22 nt, Human
ccugucagaugaaguaauugug

SEQ ID NO: 571582 - RNA, 22 nt, Human
uuccucaggcuucccuuugucc

SEQ ID NO: 571583 - RNA, 22 nt, Human
caaaaguagugaaguuguacau

SEQ ID NO: 571584 - RNA, 22 nt, Human
gugacauuuacgaaucuuaucc

SEQ ID NO: 571585 - RNA, 22 nt, Human
gaacagcucugaagcaguaaau

SEQ ID NO: 571586 - RNA, 22 nt, Human
aacucuuaaaauuuuggcuugc

SEQ ID NO: 571587 - RNA, 22 nt, Human
gaggcugguucccuugaucuuu

SEQ ID NO: 571588 - RNA, 20 nt, Human
uggggccuguuucugugguu

SEQ ID NO: 571589 - RNA, 22 nt, Human
aaacucuuccuuucuuuaaagu

SEQ ID NO: 571590 - RNA, 22 nt, Human
agggagcaaagguuucaggguu

SEQ ID NO: 571591 - RNA, 22 nt, Human
ugggagcagcagggagaugcgg

SEQ ID NO: 571592 - RNA, 19 nt, Human
caagugaagccugggaugg

SEQ ID NO: 571593 - RNA, 22 nt, Human
uggauugauaagagacaaguga

SEQ ID NO: 571594 - RNA, 22 nt, Human
cccaggagguggagguugcggu

SEQ ID NO: 571595 - RNA, 22 nt, Human
uguagauauagaaaaagacuga

SEQ ID NO: 571596 - RNA, 22 nt, Human
agggucuucccaccauuccugc

SEQ ID NO: 571597 - RNA, 22 nt, Human
agagugcaaccgaaacaagcag

SEQ ID NO: 571598 - RNA, 22 nt, Human
gugucacaggcccagcucuuca

SEQ ID NO: 571599 - RNA, 22 nt, Human
gggcagguggcagggucucugg

SEQ ID NO: 571600 - RNA, 22 nt, Human
ucugaagagucuugcaagaaag

SEQ ID NO: 571601 - RNA, 22 nt, Human
uaguuacagagaaaugauuuga

SEQ ID NO: 571602 - RNA, 22 nt, Human
aucuuacacuguuggguuucuc

SEQ ID NO: 571603 - RNA, 22 nt, Human
aguggcuaugcaugacuggaau

SEQ ID NO: 571604 - RNA, 22 nt, Human
uuucucuuugacaggaaucaga

SEQ ID NO: 571605 - RNA, 22 nt, Human
acaaugcaccagcaucuucacc

SEQ ID NO: 571606 - RNA, 21 nt, Human
ucacugcaaugcuaggagaaa

SEQ ID NO: 571607 - RNA, 22 nt, Human
acuucccugugggcagguagug

SEQ ID NO: 571608 - RNA, 22 nt, Human
uccaagaggagacacugggaug

SEQ ID NO: 571609 - RNA, 21 nt, Human
ccagaagcugcuugcaggcua

SEQ ID NO: 571610 - RNA, 22 nt, Human
caggguggaacaggcaauacuu

SEQ ID NO: 571611 - RNA, 22 nt, Human
aaugcuuucuuauaaccacugc

SEQ ID NO: 571612 - RNA, 22 nt, Human
cacagcuucugucugacccaug

SEQ ID NO: 571613 - RNA, 22 nt, Human
aucacacuggacauuggauacu

SEQ ID NO: 571614 - RNA, 22 nt, Human
gagggccaaugugucccugagc

SEQ ID NO: 571615 - RNA, 20 nt, Human
ucuuuguuaauuuuaucucc

SEQ ID NO: 571616 - RNA, 22 nt, Human
uuagcauuucauuucaagagga

SEQ ID NO: 571617 - RNA, 22 nt, Human
ccaggucuuuggccuuggcacu

SEQ ID NO: 571618 - RNA, 22 nt, Human
ugcuuuauaacuuaguuuaugg

SEQ ID NO: 571619 - RNA, 22 nt, Human
gaggugguucagguagagccca

SEQ ID NO: 571620 - RNA, 22 nt, Human
auacuucccuguuuuuuccuga

SEQ ID NO: 571621 - RNA, 22 nt, Human
gagacagugguugcagaagcuc

SEQ ID NO: 571622 - RNA, 22 nt, Human
aaauuccaguucuuuuaccugc

SEQ ID NO: 571623 - RNA, 22 nt, Human
cccaaagaaaacaguaccucag

SEQ ID NO: 571624 - RNA, 22 nt, Human
aggugggggcuguguccuugac

SEQ ID NO: 571625 - RNA, 22 nt, Human
acauuucuaguuguucaucucc

SEQ ID NO: 571626 - RNA, 22 nt, Human
aggaauguuaaagauuaagagc

SEQ ID NO: 571627 - RNA, 22 nt, Human
gaggcauuaaagggaaucuucu

SEQ ID NO: 571628 - RNA, 21 nt, Human
uggauugaggugacagugugc

SEQ ID NO: 571629 - RNA, 17 nt, Human
uguuuucauucauugcu

SEQ ID NO: 571630 - RNA, 22 nt, Human
cuuucaaaacgcucuguaugca

SEQ ID NO: 571631 - RNA, 22 nt, Human
ugcauuuucuuccaccaauauc

SEQ ID NO: 571632 - RNA, 22 nt, Human
uggaacaaauuacaauuaacuu

SEQ ID NO: 571633 - RNA, 22 nt, Human
ggugaggguaaauauaggcaaa

SEQ ID NO: 571634 - RNA, 22 nt, Human
uccugagauccuuuuagggauc

SEQ ID NO: 571635 - RNA, 22 nt, Human
ucuucaguauuuggauaacauu

SEQ ID NO: 571636 - RNA, 22 nt, Human
ugucaaaaccuuggaggcaagg

SEQ ID NO: 571637 - RNA, 22 nt, Human
gaagauaauuccuacuuauaac

SEQ ID NO: 571638 - RNA, 22 nt, Human
augguauagagccacauguauu

SEQ ID NO: 571639 - RNA, 22 nt, Human
uugugccuggcuuguauucaca

SEQ ID NO: 571640 - RNA, 22 nt, Human
ggcucuggcaaggggaggcuac

SEQ ID NO: 571641 - RNA, 22 nt, Human
ugcccugcggcuaucuagauga

SEQ ID NO: 571642 - RNA, 22 nt, Human
uggcugcccucaugggccugau

SEQ ID NO: 571643 - RNA, 22 nt, Human
gcacagguugcaaaaguucaca

SEQ ID NO: 571644 - RNA, 22 nt, Human
ugaggcagguaagcaaguuuug

SEQ ID NO: 571645 - RNA, 22 nt, Human
ggcucuagagacucuagagaaa

SEQ ID NO: 571646 - RNA, 22 nt, Human
gcugccugauguccagcaggac

SEQ ID NO: 571647 - RNA, 22 nt, Human
ccacagaaagccugggaagugg

SEQ ID NO: 571648 - RNA, 22 nt, Human
aaugcuuugacuauaucuauaa

SEQ ID NO: 571649 - RNA, 22 nt, Human
ccaggagcgcgugaacaggcug

SEQ ID NO: 571650 - RNA, 22 nt, Human
ucagggcacguuucugcaaugc

SEQ ID NO: 571651 - RNA, 23 nt, Human
uaggcucuguagguagagauggg

SEQ ID NO: 571652 - RNA, 22 nt, Human
acccuccccaagaggucgugcc

SEQ ID NO: 571653 - RNA, 22 nt, Human
uggggaaggaucaccacaaucu

SEQ ID NO: 571654 - RNA, 22 nt, Human
aagcagaugcagcuaauaaagc

SEQ ID NO: 571655 - RNA, 21 nt, Human
uggcauuuguacagggacuuu

SEQ ID NO: 571656 - RNA, 22 nt, Human
gugguccuggcaaccaugguga

SEQ ID NO: 571657 - RNA, 22 nt, Human
gcaccugggcaaggauucagag

SEQ ID NO: 571658 - RNA, 22 nt, Human
uggcaggaaaaagggccagagg

SEQ ID NO: 571659 - RNA, 22 nt, Human
gggcaagcucuucagaagcucu

SEQ ID NO: 571660 - RNA, 22 nt, Human
uucagaaagguuaaucuggauu

SEQ ID NO: 571661 - RNA, 22 nt, Human
uggaagcucaaggcagggugag

SEQ ID NO: 571662 - RNA, 22 nt, Human
ucccuugguuaaauauguagga

SEQ ID NO: 571663 - RNA, 22 nt, Human
cagguuucauuggcagcuucau

SEQ ID NO: 571664 - RNA, 22 nt, Human
guggcagcaaaauccugcauuc

SEQ ID NO: 571665 - RNA, 22 nt, Human
ugacagaaagaauaugucaauc

SEQ ID NO: 571666 - RNA, 22 nt, Human
cagcaaaguaagcugacaugua

SEQ ID NO: 571667 - RNA, 22 nt, Human
ugauaauguucgagaaugaaga

SEQ ID NO: 571668 - RNA, 22 nt, Human
cugaggcugcccagggccaggu

SEQ ID NO: 571669 - RNA, 22 nt, Human
aucacaguguagaccuuuuaaa

SEQ ID NO: 571670 - RNA, 22 nt, Human
acagcaguggguugccaguggg

SEQ ID NO: 571671 - RNA, 22 nt, Human
gccuucaggugcugccaggcua

SEQ ID NO: 571672 - RNA, 22 nt, Human
aaaucagacuugaauuuucauc

SEQ ID NO: 571673 - RNA, 22 nt, Human
gcacacugugaauuugcauaug

SEQ ID NO: 571674 - RNA, 22 nt, Human
cugccugcgccaccaccacguc

SEQ ID NO: 571675 - RNA, 22 nt, Human
aaauggcacuuugacagccugc

SEQ ID NO: 571676 - RNA, 22 nt, Human
ucaggcuuggugcuccagugcc

SEQ ID NO: 571677 - RNA, 22 nt, Human
gaauuucaagcagugcaauguu

SEQ ID NO: 571678 - RNA, 22 nt, Human
cgcagcagccccgugguaggug

SEQ ID NO: 571679 - RNA, 22 nt, Human
uuccgcuguuuaguugaaguuu

SEQ ID NO: 571680 - RNA, 22 nt, Human
auuguaaaguacuguguacaau

SEQ ID NO: 571681 - RNA, 22 nt, Human
augccugccauuuagaagucuu

SEQ ID NO: 571682 - RNA, 22 nt, Human
uauggcaagaugacauguucuc

SEQ ID NO: 571683 - RNA, 22 nt, Human
uagguuuuccuaaaauucuggu

SEQ ID NO: 571684 - RNA, 17 nt, Human
aagaacacucaauagca

SEQ ID NO: 571685 - RNA, 21 nt, Human
gguuaaaagacacaucuguuu

SEQ ID NO: 571686 - RNA, 22 nt, Human
uggggagcacgguagggaaaug

SEQ ID NO: 571687 - RNA, 22 nt, Human
uagcaaaggaugacuauguacc

SEQ ID NO: 571688 - RNA, 22 nt, Human
uggcagagguaauucaaauccc

SEQ ID NO: 571689 - RNA, 22 nt, Human
gggccagagcacagaggauguu

SEQ ID NO: 571690 - RNA, 22 nt, Human
agggccagaguggcaaaagccu

SEQ ID NO: 571691 - RNA, 19 nt, Human
ccugcugcccacccucugc

SEQ ID NO: 571692 - RNA, 22 nt, Human
ggacagggcucuuggcacuccu

SEQ ID NO: 571693 - RNA, 22 nt, Human
uguauauauuucuuucauucua

SEQ ID NO: 571694 - RNA, 22 nt, Human
ucuguccaugcuuuucucucac

SEQ ID NO: 571695 - RNA, 16 nt, Human
gagcagccugggccuu

SEQ ID NO: 571696 - RNA, 22 nt, Human
cugcauccuggaaauagcuaag

SEQ ID NO: 571697 - RNA, 22 nt, Human
uucaggcuauagaccaauuugg

SEQ ID NO: 571698 - RNA, 22 nt, Human
aaugacuaauaaguuuuacugu

SEQ ID NO: 571699 - RNA, 22 nt, Human
gugacaaaaacacugauuauuu

SEQ ID NO: 571700 - RNA, 22 nt, Human
acaucuuuuuggaaacggcuga

SEQ ID NO: 571701 - RNA, 22 nt, Human
caggcugggacugaccccugcu

SEQ ID NO: 571702 - RNA, 22 nt, Human
gacaaaacacauuaguuuaaaa

SEQ ID NO: 571703 - RNA, 22 nt, Human
guggccuagaggugcaaggaac

SEQ ID NO: 571704 - RNA, 22 nt, Human
ggcucuggaaaguguccuugau

SEQ ID NO: 571705 - RNA, 22 nt, Human
uggccaccuuauggcuauugga

SEQ ID NO: 571706 - RNA, 22 nt, Human
ggcgagggagcagugcgguggg

SEQ ID NO: 571707 - RNA, 22 nt, Human
cuucagaggggacucaaaguca

SEQ ID NO: 571708 - RNA, 22 nt, Human
guguaauguugucagcaucauc

SEQ ID NO: 571709 - RNA, 22 nt, Human
aauugcauaaaauucaacucug

SEQ ID NO: 571710 - RNA, 22 nt, Human
ccagggcaucacauccaguguu

SEQ ID NO: 571711 - RNA, 22 nt, Human
ucccagcagagccagcaagccg

SEQ ID NO: 571712 - RNA, 22 nt, Human
agggaaauggagaguguaguuu

SEQ ID NO: 571713 - RNA, 22 nt, Human
uuaggaacuucugucucagugu

SEQ ID NO: 571714 - RNA, 22 nt, Human
gccaguggucacugaggaagaa

SEQ ID NO: 571715 - RNA, 22 nt, Human
uaaucuaucaagcaacaaagug

SEQ ID NO: 571716 - RNA, 22 nt, Human
acccagagcugggcuuggcaaa

SEQ ID NO: 571717 - RNA, 22 nt, Human
uucaagaagguacauuuacauc

SEQ ID NO: 571718 - RNA, 22 nt, Human
agcuccagaaagguacacacag

SEQ ID NO: 571719 - RNA, 22 nt, Human
caggcacccagcccagucgcac

SEQ ID NO: 571720 - RNA, 22 nt, Human
agacaauggagagcagaguacu

SEQ ID NO: 571721 - RNA, 22 nt, Human
ucagaagccuugauuaucuaga

SEQ ID NO: 571722 - RNA, 22 nt, Human
gaguaacaaauacuucaguagu

SEQ ID NO: 571723 - RNA, 22 nt, Human
auucaucuaugacucuaaugug

SEQ ID NO: 571724 - RNA, 23 nt, Human
cuucucugagcuaggaaugcucu

SEQ ID NO: 571725 - RNA, 22 nt, Human
auugugcaaaaccucaggccuc

SEQ ID NO: 571726 - RNA, 21 nt, Human
gggugcuguggucaugcagga

SEQ ID NO: 571727 - RNA, 22 nt, Human
aagagcuggaugaagaaaucaa

SEQ ID NO: 571728 - RNA, 22 nt, Human
gggcugggaauggcuaaguaug

SEQ ID NO: 571729 - RNA, 22 nt, Human
ugggcugaguguggaacuaguu

SEQ ID NO: 571730 - RNA, 22 nt, Human
uuuacuuucucaaguauauagg

SEQ ID NO: 571731 - RNA, 22 nt, Human
cugcccugagggccuguguguu

SEQ ID NO: 571732 - RNA, 22 nt, Human
gcugucacaucaaggcacuaaa

SEQ ID NO: 571733 - RNA, 22 nt, Human
auauuguacuaggguuacaugu

SEQ ID NO: 571734 - RNA, 22 nt, Human
ucauggcucuaaagacauagau

SEQ ID NO: 571735 - RNA, 20 nt, Human
uccagggcuagggagcucau

SEQ ID NO: 571736 - RNA, 22 nt, Human
acaguguuuugucuggcagggc

SEQ ID NO: 571737 - RNA, 23 nt, Human
cucaccaagcgccgccgcugugu

SEQ ID NO: 571738 - RNA, 22 nt, Human
uuccuggggggauagauuucac

SEQ ID NO: 571739 - RNA, 22 nt, Human
gcagaaggucuggcacuucagg

SEQ ID NO: 571740 - RNA, 22 nt, Human
gagcccugaacaacagcaggaa

SEQ ID NO: 571741 - RNA, 22 nt, Human
uauaugcuugggaaaugguaga

SEQ ID NO: 571742 - RNA, 22 nt, Human
uuggcucaggaccccugugacu

SEQ ID NO: 571743 - RNA, 18 nt, Human
gccagagguacuacugau

SEQ ID NO: 571744 - RNA, 22 nt, Human
gaaauauugggacucagagcuu

SEQ ID NO: 571745 - RNA, 22 nt, Human
ugccaggccaaugaaggcaggg

SEQ ID NO: 571746 - RNA, 22 nt, Human
ggaggcugaggccccucacagg

SEQ ID NO: 571747 - RNA, 22 nt, Human
caagccagucagcucaguagau

SEQ ID NO: 571748 - RNA, 22 nt, Human
agcagcugccacuggaauagga

SEQ ID NO: 571749 - RNA, 22 nt, Human
uuuguguuuaugaaguuauucu

SEQ ID NO: 571750 - RNA, 22 nt, Human
ucucuuggaacacuugcucuua

SEQ ID NO: 571751 - RNA, 22 nt, Human
ucuccagguaaauggcauccug

SEQ ID NO: 571752 - RNA, 22 nt, Human
cagccugccgucagccagguag

SEQ ID NO: 571753 - RNA, 22 nt, Human
agguuuguuuuggaaagaucau

SEQ ID NO: 571754 - RNA, 22 nt, Human
ccugcaagagcggagaagccag

SEQ ID NO: 571755 - RNA, 22 nt, Human
ucugccugagggagcugaggaa

SEQ ID NO: 571756 - RNA, 22 nt, Human
uggccuguggcuuaaggucugu

SEQ ID NO: 571757 - RNA, 22 nt, Human
gugacagaguuuuagaucucau

SEQ ID NO: 571758 - RNA, 22 nt, Human
ucuccugggcuugguugaaguu

SEQ ID NO: 571759 - RNA, 22 nt, Human
uaacuagaauggcuauuuugag

SEQ ID NO: 571760 - RNA, 22 nt, Human
caguuuauagcucuagcagcuu

SEQ ID NO: 571761 - RNA, 22 nt, Human
gagagacagcacacaguguggg

SEQ ID NO: 571762 - RNA, 22 nt, Human
ucaucaguccuuuucauuauga

SEQ ID NO: 571763 - RNA, 22 nt, Human
acugccugcauccuuaggguag

SEQ ID NO: 571764 - RNA, 22 nt, Human
agucaggauuuaaacucagaca

SEQ ID NO: 571765 - RNA, 22 nt, Human
uuuugcuuuuguaacacagugu

SEQ ID NO: 571766 - RNA, 22 nt, Human
ggcagcuucggacggcuuauaa

SEQ ID NO: 571767 - RNA, 22 nt, Human
ggcagguggaaguuggcagagc

SEQ ID NO: 571768 - RNA, 23 nt, Human
agccagggcacugguggagauug

SEQ ID NO: 571769 - RNA, 22 nt, Human
ugaggaaguuguuucucuucua

SEQ ID NO: 571770 - RNA, 22 nt, Human
uguuuacuugagguggaaacaa

SEQ ID NO: 571771 - RNA, 22 nt, Human
cccaggggagguccucagggaa

SEQ ID NO: 571772 - RNA, 15 nt, Human
aaucagaaguguggc

SEQ ID NO: 571773 - RNA, 22 nt, Human
guggccagggcccacaggauga

SEQ ID NO: 571774 - RNA, 22 nt, Human
ucuggaagugauguucauagug

SEQ ID NO: 571775 - RNA, 22 nt, Human
gcuuucucuucacugauguuca

SEQ ID NO: 571776 - RNA, 22 nt, Human
acugcaccuugcgguccugugg

SEQ ID NO: 571777 - RNA, 22 nt, Human
uggagauggccucaggcccuca

SEQ ID NO: 571778 - RNA, 19 nt, Human
ggaccuggcaaucugcauu

SEQ ID NO: 571779 - RNA, 23 nt, Human
aggaacugcuucauuuuugaaag

SEQ ID NO: 571780 - RNA, 22 nt, Human
cugguguggacuccgcgcggag

SEQ ID NO: 571781 - RNA, 22 nt, Human
uugaggucaaguaaccacugga

SEQ ID NO: 571782 - RNA, 22 nt, Human
ccagcuccgggaguugcugcug

SEQ ID NO: 571783 - RNA, 22 nt, Human
aaacagcucaagaaguuacucu

SEQ ID NO: 571784 - RNA, 22 nt, Human
cuccagggcagcauggcagugg

SEQ ID NO: 571785 - RNA, 19 nt, Human
uccugggcugcgucuugcc

SEQ ID NO: 571786 - RNA, 22 nt, Human
auugacaagcaguaugucuuag

SEQ ID NO: 571787 - RNA, 22 nt, Human
uagggcaggugaagaaaagcua

SEQ ID NO: 571788 - RNA, 22 nt, Human
aagguagguuaaccugcaggag

SEQ ID NO: 571789 - RNA, 22 nt, Human
acauuucuuagccuaguuccag

SEQ ID NO: 571790 - RNA, 22 nt, Human
ucauuuuugaccauggguagga

SEQ ID NO: 571791 - RNA, 22 nt, Human
gucuggagacuugggucaucaa

SEQ ID NO: 571792 - RNA, 22 nt, Human
uacagcuugacccauaaugucu

SEQ ID NO: 571793 - RNA, 22 nt, Human
ggcaaacuacauuuuugaaaua

SEQ ID NO: 571794 - RNA, 22 nt, Human
cugcagcuguagaggacagugg

SEQ ID NO: 571795 - RNA, 22 nt, Human
ccugggaggcugugggucugcu

SEQ ID NO: 571796 - RNA, 18 nt, Human
cagucccaaaccuuagga

SEQ ID NO: 571797 - RNA, 22 nt, Human
cagaggcuggauggacuugccu

SEQ ID NO: 571798 - RNA, 21 nt, Human
aaggcagaagcauggaaugag

SEQ ID NO: 571799 - RNA, 22 nt, Human
agaagccaaaugccagugaccu

SEQ ID NO: 571800 - RNA, 22 nt, Human
cagcuguugugcugggcaguua

SEQ ID NO: 571801 - RNA, 22 nt, Human
uguuaagagaagcucucucuga

SEQ ID NO: 571802 - RNA, 22 nt, Human
gauuauggauggacaguggagc

SEQ ID NO: 571803 - RNA, 22 nt, Human
aacaagaagagagggacguaau

SEQ ID NO: 571804 - RNA, 22 nt, Human
caccagcuucucauugcggguc

SEQ ID NO: 571805 - RNA, 22 nt, Human
cugaaccacuaauauuuugauu

SEQ ID NO: 571806 - RNA, 22 nt, Human
auuccagagagguucuggaggu

SEQ ID NO: 571807 - RNA, 22 nt, Human
acagagggggccuuggagugca

SEQ ID NO: 571808 - RNA, 21 nt, Human
ugggccagaucugaguuucua

SEQ ID NO: 571809 - RNA, 22 nt, Human
cacccuggaaagaaggucuggg

SEQ ID NO: 571810 - RNA, 22 nt, Human
ugggauggccuuugaaagccag

SEQ ID NO: 571811 - RNA, 22 nt, Human
caggguugauuccuucugaggg

SEQ ID NO: 571812 - RNA, 22 nt, Human
uucaaugcauauagauauagaa

SEQ ID NO: 571813 - RNA, 22 nt, Human
gaggccacgugcuuauguuucu

SEQ ID NO: 571814 - RNA, 22 nt, Human
uaaaagauuuuauaggaacaag

SEQ ID NO: 571815 - RNA, 22 nt, Human
gccagccaagauugagaaggua

SEQ ID NO: 571816 - RNA, 22 nt, Human
aggugcuggaguagaagaaaaa

SEQ ID NO: 571817 - RNA, 22 nt, Human
uacuaaaugauuaagcaggaau

SEQ ID NO: 571818 - RNA, 22 nt, Human
ugcauauuauguguaucugucu

SEQ ID NO: 571819 - RNA, 18 nt, Human
acaguaaagaaaggaauu

SEQ ID NO: 571820 - RNA, 20 nt, Human
uggagcugugguaaggagca

SEQ ID NO: 571821 - RNA, 22 nt, Human
aaacugaggaguuagacuaggg

SEQ ID NO: 571822 - RNA, 22 nt, Human
uaaaguguggacaguaucuaua

SEQ ID NO: 571823 - RNA, 22 nt, Human
ucugccugcgcucacggggccg

SEQ ID NO: 571824 - RNA, 22 nt, Human
gagcuggggcagcuuaggagug

SEQ ID NO: 571825 - RNA, 22 nt, Human
ccuggcuccugccucugcaggg

SEQ ID NO: 571826 - RNA, 22 nt, Human
ggaggcggagcuugcagugagc

SEQ ID NO: 571827 - RNA, 22 nt, Human
cuugccucugcuaaugguuucu

SEQ ID NO: 571828 - RNA, 22 nt, Human
gcuuccagggcucagucacugc

SEQ ID NO: 571829 - RNA, 23 nt, Human
ucacuuugauguaauugaaaagc

SEQ ID NO: 571830 - RNA, 22 nt, Human
agccaagcugaucuccugcuga

SEQ ID NO: 571831 - RNA, 22 nt, Human
uagacauuauuucuacccacaa

SEQ ID NO: 571832 - RNA, 22 nt, Human
gggaggcucugcucagcccccg

SEQ ID NO: 571833 - RNA, 22 nt, Human
gcagugcuuuagucuguccuuu

SEQ ID NO: 571834 - RNA, 23 nt, Human
ugcugaaguguuggcccugccca

SEQ ID NO: 571835 - RNA, 22 nt, Human
uccugaagaugaaaagagaggu

SEQ ID NO: 571836 - RNA, 22 nt, Human
cuggaagaggacacacgaauca

SEQ ID NO: 571837 - RNA, 18 nt, Human
aggggcagcuugugugga

SEQ ID NO: 571838 - RNA, 22 nt, Human
gcagaggcucuuuaaugcuuag

SEQ ID NO: 571839 - RNA, 22 nt, Human
uccugggagacccagcugugga

SEQ ID NO: 571840 - RNA, 22 nt, Human
ggucucagcuggaguccuuggu

SEQ ID NO: 571841 - RNA, 22 nt, Human
gagcuuugugcugguagguggu

SEQ ID NO: 571842 - RNA, 22 nt, Human
cagugcucccgcugccgcugug

SEQ ID NO: 571843 - RNA, 22 nt, Human
gugcauauguguguauacaaac

SEQ ID NO: 571844 - RNA, 22 nt, Human
uuuguucauuuugagcucauca

SEQ ID NO: 571845 - RNA, 22 nt, Human
agugcuggcccauagcugcugg

SEQ ID NO: 571846 - RNA, 23 nt, Human
acaguucucugauggguuuaaca

SEQ ID NO: 571847 - RNA, 22 nt, Human
ucugaaauggggcugaagcacu

SEQ ID NO: 571848 - RNA, 19 nt, Human
cagcugcaccgugaccauc

SEQ ID NO: 571849 - RNA, 22 nt, Human
aauauuaauagaagggguucua

SEQ ID NO: 571850 - RNA, 22 nt, Human
uaccugaaccaagcccagcucu

SEQ ID NO: 571851 - RNA, 20 nt, Human
ucccagucagccagagugag

SEQ ID NO: 571852 - RNA, 22 nt, Human
agugcuaaugugcaauauagag

SEQ ID NO: 571853 - RNA, 22 nt, Human
aggcucuguaugaagguuuggg

SEQ ID NO: 571854 - RNA, 22 nt, Human
aagcugugagcuggaugcucca

SEQ ID NO: 571855 - RNA, 22 nt, Human
cccuggaguagcacugggucgc

SEQ ID NO: 571856 - RNA, 21 nt, Human
cccuaacucuaaaggauccau

SEQ ID NO: 571857 - RNA, 22 nt, Human
uggaaacagaucauaacuaagc

SEQ ID NO: 571858 - RNA, 22 nt, Human
ugggauguggccaugguucucu

SEQ ID NO: 571859 - RNA, 22 nt, Human
cagaggccauauuucuucacuc

SEQ ID NO: 571860 - RNA, 22 nt, Human
gauuaguauccuuauuaagaga

SEQ ID NO: 571861 - RNA, 22 nt, Human
ucaugcaaaagacuugaacuuu

SEQ ID NO: 571862 - RNA, 22 nt, Human
uauuaguugcaaaacauugacu

SEQ ID NO: 571863 - RNA, 22 nt, Human
ucugggaaccauugguggggau

SEQ ID NO: 571864 - RNA, 22 nt, Human
aaacaaguguaaacuagucugu

SEQ ID NO: 571865 - RNA, 22 nt, Human
gaggcccaggguacaggccgcu

SEQ ID NO: 571866 - RNA, 22 nt, Human
auacaaugaaguauagaugaaa

SEQ ID NO: 571867 - RNA, 22 nt, Human
guuccuugggaacaacgcugaa

SEQ ID NO: 571868 - RNA, 22 nt, Human
acaccagggauaugaggaagga

SEQ ID NO: 571869 - RNA, 22 nt, Human
cagcucccaguggcagcuccuu

SEQ ID NO: 571870 - RNA, 22 nt, Human
acagccugagaguggagcuggc

SEQ ID NO: 571871 - RNA, 22 nt, Human
cuucccugagcuuucucaggcu

SEQ ID NO: 571872 - RNA, 22 nt, Human
aaugaucaccugguaaagagag

SEQ ID NO: 571873 - RNA, 22 nt, Human
cagacagguagggacagaacau

SEQ ID NO: 571874 - RNA, 22 nt, Human
gccaggagugucccacucauuu

SEQ ID NO: 571875 - RNA, 22 nt, Human
ggcagccuucucucauagguga

SEQ ID NO: 571876 - RNA, 22 nt, Human
uaaaccuuauuugaauaccaac

SEQ ID NO: 571877 - RNA, 19 nt, Human
cucuggagcagacacugga

SEQ ID NO: 571878 - RNA, 22 nt, Human
auuuuucucuccacuccauuaa

SEQ ID NO: 571879 - RNA, 20 nt, Human
ugaagauuuuguguuuagaa

SEQ ID NO: 571880 - RNA, 22 nt, Human
cucugcuuuuuagggagccuag

SEQ ID NO: 571881 - RNA, 22 nt, Human
guuaauuugcagcuuucgagcu

SEQ ID NO: 571882 - RNA, 22 nt, Human
uaauuauagccgcuauuuugcu

SEQ ID NO: 571883 - RNA, 22 nt, Human
ggcugagcaauuuugaugacau

SEQ ID NO: 571884 - RNA, 22 nt, Human
agcuuaaacucuuugaaguuau

SEQ ID NO: 571885 - RNA, 22 nt, Human
gucugucaucugagauggagug

SEQ ID NO: 571886 - RNA, 22 nt, Human
aggguucugccagugucuugag

SEQ ID NO: 571887 - RNA, 18 nt, Human
ggcaugugagugcugagg

SEQ ID NO: 571888 - RNA, 22 nt, Human
ugugaugguucacugggcauga

SEQ ID NO: 571889 - RNA, 22 nt, Human
aggccagcuuccagaggggcag

SEQ ID NO: 571890 - RNA, 22 nt, Human
aggacagguguagugggcucug

SEQ ID NO: 571891 - RNA, 22 nt, Human
gccagggcucgcggucccucgu

SEQ ID NO: 571892 - RNA, 22 nt, Human
aggauauuugcuuaagauagcu

SEQ ID NO: 571893 - RNA, 22 nt, Human
acaguaaaucaacagaauaucu

SEQ ID NO: 571894 - RNA, 20 nt, Human
ugucauuuauuuaucaaaug

SEQ ID NO: 571895 - RNA, 21 nt, Human
agcaggugaaccuccaguaca

SEQ ID NO: 571896 - RNA, 23 nt, Human
ucacacuggauacacaugcaaga

SEQ ID NO: 571897 - RNA, 22 nt, Human
gggugggagaaaugaguaucua

SEQ ID NO: 571898 - RNA, 21 nt, Human
acaguucugccggcaucuuuc

SEQ ID NO: 571899 - RNA, 23 nt, Human
caugugugacaguaucacuguuu

SEQ ID NO: 571900 - RNA, 22 nt, Human
gcagaggucuagcaccaagaau

SEQ ID NO: 571901 - RNA, 22 nt, Human
gggcgaggacugacucugggca

SEQ ID NO: 571902 - RNA, 22 nt, Human
agcuucaaagcuaggaagaucu

SEQ ID NO: 571903 - RNA, 22 nt, Human
ugcaggaauagcuacagagcug

SEQ ID NO: 571904 - RNA, 22 nt, Human
uuuauguaaguggaaugaugcc

SEQ ID NO: 571905 - RNA, 22 nt, Human
uccugagguauaugcuuugcag

SEQ ID NO: 571906 - RNA, 22 nt, Human
ggggaagaaugcucucuagaga

SEQ ID NO: 571907 - RNA, 22 nt, Human
aggcucagcccaagguggagag

SEQ ID NO: 571908 - RNA, 22 nt, Human
accugcccagacucagauccua

SEQ ID NO: 571909 - RNA, 22 nt, Human
cagaggccaccuguggccacug

SEQ ID NO: 571910 - RNA, 22 nt, Human
uguuauuuaucugagcauuuau

SEQ ID NO: 571911 - RNA, 19 nt, Human
aaguucucagaguucaaag

SEQ ID NO: 571912 - RNA, 22 nt, Human
gggaggaaggcuugggugagua

SEQ ID NO: 571913 - RNA, 22 nt, Human
cuacauuucccagcugccuucc

SEQ ID NO: 571914 - RNA, 22 nt, Human
cccaggagagaggggauaaagc

SEQ ID NO: 571915 - RNA, 22 nt, Human
guuguuuuaaaauacuccagaa

SEQ ID NO: 571916 - RNA, 22 nt, Human
acccaggacaugggcacccgug

SEQ ID NO: 571917 - RNA, 22 nt, Human
uaugaacauuauuuuugucuag

SEQ ID NO: 571918 - RNA, 22 nt, Human
ucacagcuaagcuuggucacug

SEQ ID NO: 571919 - RNA, 22 nt, Human
cagcccaggcucagauguuggg

SEQ ID NO: 571920 - RNA, 22 nt, Human
aaugucugaggcucaucugagg

SEQ ID NO: 571921 - RNA, 22 nt, Human
gccugagccgccugagcggcgg

SEQ ID NO: 571922 - RNA, 22 nt, Human
ucaucaaaggauugcaugauuu

SEQ ID NO: 571923 - RNA, 22 nt, Human
uagacacuguaugagcugggug

SEQ ID NO: 571924 - RNA, 22 nt, Human
aacaguuuaucaaguuuuuaca

SEQ ID NO: 571925 - RNA, 22 nt, Human
ggaguguggagaggacaugggu

SEQ ID NO: 571926 - RNA, 22 nt, Human
acaucuguuuaacgaaggcauu

SEQ ID NO: 571927 - RNA, 17 nt, Human
cuggccaguguacuugg

SEQ ID NO: 571928 - RNA, 22 nt, Human
uagcacuauauguuagcuauua

SEQ ID NO: 571929 - RNA, 22 nt, Human
ugcagagaagaggacaguucua

SEQ ID NO: 571930 - RNA, 22 nt, Human
gccagcucagugccaggccccu

SEQ ID NO: 571931 - RNA, 22 nt, Human
ugugcucacucuaaauuaagau

SEQ ID NO: 571932 - RNA, 22 nt, Human
acauaugucuauuucauguaaa

SEQ ID NO: 571933 - RNA, 22 nt, Human
ucacagcagaauuuaggaggca

SEQ ID NO: 571934 - RNA, 22 nt, Human
ucaguggauauuucuguggcug

SEQ ID NO: 571935 - RNA, 19 nt, Human
gcugaaaucaaauuuggaa

SEQ ID NO: 571936 - RNA, 22 nt, Human
ccugucccccaggccuguacca

SEQ ID NO: 571937 - RNA, 22 nt, Human
gggagccaaggagagaggccuu

SEQ ID NO: 571938 - RNA, 22 nt, Human
uuauguaccugaauuaguaaag

SEQ ID NO: 571939 - RNA, 22 nt, Human
ggaggguccacugugaggcaga

SEQ ID NO: 571940 - RNA, 22 nt, Human
guguucaaaauguagguagauu

SEQ ID NO: 571941 - RNA, 22 nt, Human
ggaaggggagcuggaaagggua

SEQ ID NO: 571942 - RNA, 22 nt, Human
agugggcugguggcagggagaa

SEQ ID NO: 571943 - RNA, 22 nt, Human
uuuaaggaugaugugauauaua

SEQ ID NO: 571944 - RNA, 17 nt, Human
gcugagaggcagcacag

SEQ ID NO: 571945 - RNA, 22 nt, Human
cugcugaaguuguuggucuuuu

SEQ ID NO: 571946 - RNA, 22 nt, Human
aaccagugaaacaccaggcaag

SEQ ID NO: 571947 - RNA, 22 nt, Human
cuccuguggucaagggugggac

SEQ ID NO: 571948 - RNA, 20 nt, Human
cugcugagagccuggcuugc

SEQ ID NO: 571949 - RNA, 22 nt, Human
cagagguagccgagugcaaucg

SEQ ID NO: 571950 - RNA, 22 nt, Human
acugcugauuaugaaagugaca

SEQ ID NO: 571951 - RNA, 22 nt, Human
ggggaagauggcccuccaugug

SEQ ID NO: 571952 - RNA, 21 nt, Human
agauucauaaucuguaaaaug

SEQ ID NO: 571953 - RNA, 22 nt, Human
uccuguaguugcuaaguuuguu

SEQ ID NO: 571954 - RNA, 22 nt, Human
gagcucagggcauugagcaaga

SEQ ID NO: 571955 - RNA, 22 nt, Human
cugggcagcugugcaaacaaua

SEQ ID NO: 571956 - RNA, 22 nt, Human
aaaucacuuaaauggcuuauuu

SEQ ID NO: 571957 - RNA, 22 nt, Human
aacacugaguaucagaguuggg

SEQ ID NO: 571958 - RNA, 20 nt, Human
auucuacaagaauaagcaug

SEQ ID NO: 571959 - RNA, 22 nt, Human
uuucuuccuaaauaugauuucc

SEQ ID NO: 571960 - RNA, 22 nt, Human
gacaggugaaacagcaagguaa

SEQ ID NO: 571961 - RNA, 22 nt, Human
gcaaggagccuggaggugagug

SEQ ID NO: 571962 - RNA, 22 nt, Human
cuagcaggucaaaccagcugau

SEQ ID NO: 571963 - RNA, 22 nt, Human
uaaauuauguuccauguccuuu

SEQ ID NO: 571964 - RNA, 22 nt, Human
aagcauguacaaugagugucuc

SEQ ID NO: 571965 - RNA, 20 nt, Human
aauaaacuacugagagaugu

SEQ ID NO: 571966 - RNA, 22 nt, Human
cugucucaagacugcaggcacu

SEQ ID NO: 571967 - RNA, 22 nt, Human
ugagaaaagguugagaugauaa

SEQ ID NO: 571968 - RNA, 22 nt, Human
aguucuuuguaaaaggucucua

SEQ ID NO: 571969 - RNA, 22 nt, Human
ccaggccuggccaggggaugcc

SEQ ID NO: 571970 - RNA, 17 nt, Human
gaggacagggaaguagg

SEQ ID NO: 571971 - RNA, 22 nt, Human
ugcugaggagguggcugugcuu

SEQ ID NO: 571972 - RNA, 22 nt, Human
uacuuuuagccuauuugauucu

SEQ ID NO: 571973 - RNA, 22 nt, Human
cuggguguagauggaaguuugg

SEQ ID NO: 571974 - RNA, 22 nt, Human
uaguuuugaggauuauauguga

SEQ ID NO: 571975 - RNA, 22 nt, Human
aggcaguguauugcuagcggcu

SEQ ID NO: 571976 - RNA, 22 nt, Human
ugagacuugugaguccuucuag

SEQ ID NO: 571977 - RNA, 22 nt, Human
agcaccagcgugggggccguug

SEQ ID NO: 571978 - RNA, 22 nt, Human
gagguaggcugugaaagggggu

SEQ ID NO: 571979 - RNA, 22 nt, Human
agcugggccugauuugcagggg

SEQ ID NO: 571980 - RNA, 22 nt, Human
ugagguaguagauuuuugucca

SEQ ID NO: 571981 - RNA, 22 nt, Human
gcugaagguguguggagagagg

SEQ ID NO: 571982 - RNA, 22 nt, Human
ggccuugagagccagugcaggc

SEQ ID NO: 571983 - RNA, 22 nt, Human
agcuucuguucaucuuccaggc

SEQ ID NO: 571984 - RNA, 22 nt, Human
gcagggaugcugaggcucagug

SEQ ID NO: 571985 - RNA, 22 nt, Human
gggaugagagcugggacagaag

SEQ ID NO: 571986 - RNA, 23 nt, Human
ucagccucuuaggacuucucacc

SEQ ID NO: 571987 - RNA, 22 nt, Human
agcugccccucauuuucaccac

SEQ ID NO: 571988 - RNA, 22 nt, Human
auucacaaagaagggaaguaca

SEQ ID NO: 571989 - RNA, 22 nt, Human
ggccauggucaugggugagcuu

SEQ ID NO: 571990 - RNA, 22 nt, Human
ggagguggccugaaaauguggc

SEQ ID NO: 571991 - RNA, 22 nt, Human
auauuuugguagcucucaauga

SEQ ID NO: 571992 - RNA, 22 nt, Human
uuguagaacaugcagcacaaug

SEQ ID NO: 571993 - RNA, 22 nt, Human
agcaccuugcucuuggccuucc

SEQ ID NO: 571994 - RNA, 22 nt, Human
guccccucagccacccaugggg

SEQ ID NO: 571995 - RNA, 18 nt, Human
cccagcccaccauuucuc

SEQ ID NO: 571996 - RNA, 22 nt, Human
ugcugugacccaaaaaagaccu

SEQ ID NO: 571997 - RNA, 19 nt, Human
uucuaugauuaacaugaga

SEQ ID NO: 571998 - RNA, 22 nt, Human
uuggccucauggacagcucauc

SEQ ID NO: 571999 - RNA, 19 nt, Human
ugugugcugacugccagag

SEQ ID NO: 572000 - RNA, 22 nt, Human
uacagcuugauguuuguguguu

SEQ ID NO: 572001 - RNA, 22 nt, Human
uugcaggguuaaaguaagguag

SEQ ID NO: 572002 - RNA, 22 nt, Human
ccacccagaccagggaucuggg

SEQ ID NO: 572003 - RNA, 22 nt, Human
uuauuauguggaugaaagaugu

SEQ ID NO: 572004 - RNA, 22 nt, Human
uuggcugccuucaccccuggcc

SEQ ID NO: 572005 - RNA, 22 nt, Human
agagggcuucccuaggagugag

SEQ ID NO: 572006 - RNA, 22 nt, Human
agcucucauuacuuuacagaug

SEQ ID NO: 572007 - RNA, 22 nt, Human
gcugaggcggaaggauugcuag

SEQ ID NO: 572008 - RNA, 22 nt, Human
ccccaaagccucagccugccug

SEQ ID NO: 572009 - RNA, 22 nt, Human
uuucuucucaucccugaaauca

SEQ ID NO: 572010 - RNA, 22 nt, Human
ugucuccugagagcuggacaga

SEQ ID NO: 572011 - RNA, 22 nt, Human
auuugccuuuuaaacucacaau

SEQ ID NO: 572012 - RNA, 22 nt, Human
aaauaauugaguuggucaauau

SEQ ID NO: 572013 - RNA, 22 nt, Human
ugugcucugccccugacuguuu

SEQ ID NO: 572014 - RNA, 22 nt, Human
ccaaggcuggagggcuuaugua

SEQ ID NO: 572015 - RNA, 22 nt, Human
ggacagcacagcucuugacaac

SEQ ID NO: 572016 - RNA, 22 nt, Human
acagcagguuacaguggcacag

SEQ ID NO: 572017 - RNA, 22 nt, Human
augaugaaacuaggaacuagag

SEQ ID NO: 572018 - RNA, 22 nt, Human
cuuagcuuuaaaagugagaucu

SEQ ID NO: 572019 - RNA, 22 nt, Human
cuguguccugucuccuaaggug

SEQ ID NO: 572020 - RNA, 22 nt, Human
ucucauuuacuuccacaggcug

SEQ ID NO: 572021 - RNA, 21 nt, Human
aacaaagggaugcucaucuuu

SEQ ID NO: 572022 - RNA, 22 nt, Human
uuuucaaagacuggaggcugau

SEQ ID NO: 572023 - RNA, 22 nt, Human
uggccugggugcugcugacauc

SEQ ID NO: 572024 - RNA, 22 nt, Human
cagcccagcagucuuagccugc

SEQ ID NO: 572025 - RNA, 22 nt, Human
cuacagucuggcaggaauguua

SEQ ID NO: 572026 - RNA, 22 nt, Human
aacgaauagggauuuuucuaac

SEQ ID NO: 572027 - RNA, 22 nt, Human
acauuuaaccaaacuguuuaau

SEQ ID NO: 572028 - RNA, 22 nt, Human
uagcagggauacaaggucgccu

SEQ ID NO: 572029 - RNA, 22 nt, Human
gagagcugcaagguagggcggg

SEQ ID NO: 572030 - RNA, 22 nt, Human
ucucacuggguauaaaugagua

SEQ ID NO: 572031 - RNA, 22 nt, Human
agcugaggaggaaugaugggua

SEQ ID NO: 572032 - RNA, 22 nt, Human
uucuaguuaauguagcaucuug

SEQ ID NO: 572033 - RNA, 22 nt, Human
agucugcaggcugugauuuuuu

SEQ ID NO: 572034 - RNA, 22 nt, Human
aaauaaguuaaacuagaaugau

SEQ ID NO: 572035 - RNA, 22 nt, Human
ggcagaggaagcuggaaguggg

SEQ ID NO: 572036 - RNA, 22 nt, Human
agaggacagguuuuccaugggc

SEQ ID NO: 572037 - RNA, 22 nt, Human
ugaauaauuaugggaguccuaa

SEQ ID NO: 572038 - RNA, 23 nt, Human
agaggccagccuuuggagacacc

SEQ ID NO: 572039 - RNA, 21 nt, Human
agcagaggggacauguuugau

SEQ ID NO: 572040 - RNA, 22 nt, Human
agaagccagauuguagugggac

SEQ ID NO: 572041 - RNA, 22 nt, Human
uagagguauuuuugauggucau

SEQ ID NO: 572042 - RNA, 22 nt, Human
ugccugcugauuggaguugaau

SEQ ID NO: 572043 - RNA, 22 nt, Human
ucuaaucuacaaaaggaaauuc

SEQ ID NO: 572044 - RNA, 22 nt, Human
acaggacaggcugggcuagacu

SEQ ID NO: 572045 - RNA, 22 nt, Human
augugcuugacuacucucuauu

SEQ ID NO: 572046 - RNA, 22 nt, Human
uggagcuggaauuucugggccu

SEQ ID NO: 572047 - RNA, 22 nt, Human
acaggauuaguggauuugucuu

SEQ ID NO: 572048 - RNA, 22 nt, Human
gaaggcaacaccaggaugcacu

SEQ ID NO: 572049 - RNA, 22 nt, Human
ggaggagcugcugugggggccc

SEQ ID NO: 572050 - RNA, 22 nt, Human
cuguggugagcaacugacugaa

SEQ ID NO: 572051 - RNA, 22 nt, Human
cugagagaucaagccacaggau

SEQ ID NO: 572052 - RNA, 22 nt, Human
agcuucuuuuacagcucaugcu

SEQ ID NO: 572053 - RNA, 22 nt, Human
gccagcugcuggaacagcgcga

SEQ ID NO: 572054 - RNA, 22 nt, Human
uuucaaagguggaagagugaau

SEQ ID NO: 572055 - RNA, 22 nt, Human
aaacagcuacuucuguauaaug

SEQ ID NO: 572056 - RNA, 22 nt, Human
aagcugccaccagcccagggca

SEQ ID NO: 572057 - RNA, 22 nt, Human
ggaacauucuagaguguuguga

SEQ ID NO: 572058 - RNA, 22 nt, Human
ucaguguagcagacuuguagcc

SEQ ID NO: 572059 - RNA, 22 nt, Human
agaugcugugaggaagcuagga

SEQ ID NO: 572060 - RNA, 22 nt, Human
cuucuaauucuuauguaagcuu

SEQ ID NO: 572061 - RNA, 22 nt, Human
gugucccagccccacaggccug

SEQ ID NO: 572062 - RNA, 22 nt, Human
aaacauugaugggaaguuuaau

SEQ ID NO: 572063 - RNA, 22 nt, Human
ucugggaaggcucugcagauau

SEQ ID NO: 572064 - RNA, 22 nt, Human
uuuguuaaaaugcagauucugu

SEQ ID NO: 572065 - RNA, 22 nt, Human
uuuccuucccuggaugagaagu

SEQ ID NO: 572066 - RNA, 22 nt, Human
ucauuuacaugucuuucucuga

SEQ ID NO: 572067 - RNA, 22 nt, Human
aaauacuguugaaugaaguaag

SEQ ID NO: 572068 - RNA, 22 nt, Human
cuuggguguuuuaaaacuagau

SEQ ID NO: 572069 - RNA, 22 nt, Human
caggaaaggugugucaugaugg

SEQ ID NO: 572070 - RNA, 22 nt, Human
gagaggcuccgccacugcucag

SEQ ID NO: 572071 - RNA, 22 nt, Human
cugucuccuccuuuguucuuaa

SEQ ID NO: 572072 - RNA, 22 nt, Human
guuacauuaggauaauuugcug

SEQ ID NO: 572073 - RNA, 22 nt, Human
ccuggagcucacugggagccgg

SEQ ID NO: 572074 - RNA, 22 nt, Human
uuugaagaagcugaccuauuuu

SEQ ID NO: 572075 - RNA, 19 nt, Human
ccucccacggauuccuucc

SEQ ID NO: 572076 - RNA, 22 nt, Human
ccuuccccaggugcucacuguc

SEQ ID NO: 572077 - RNA, 22 nt, Human
gggcagguuauuggaguaggga

SEQ ID NO: 572078 - RNA, 22 nt, Human
aggcccugcaggaguggggaca

SEQ ID NO: 572079 - RNA, 22 nt, Human
cugguauaguauaaauuaaugu

SEQ ID NO: 572080 - RNA, 22 nt, Human
ugaggcucagagaacagugacu

SEQ ID NO: 572081 - RNA, 18 nt, Human
ucagaggagauaccuaaa

SEQ ID NO: 572082 - RNA, 21 nt, Human
uauuucuuugacucucucccu

SEQ ID NO: 572083 - RNA, 22 nt, Human
ggaguugauuuuggauauauua

SEQ ID NO: 572084 - RNA, 23 nt, Human
cuggcucuguagguggcauccuu

SEQ ID NO: 572085 - RNA, 22 nt, Human
acaauauuugggggcaguuugu

SEQ ID NO: 572086 - RNA, 22 nt, Human
uucacagggccacuggcaggag

SEQ ID NO: 572087 - RNA, 22 nt, Human
ugccaggcugucaauucaccca

SEQ ID NO: 572088 - RNA, 22 nt, Human
aguacuuugcacuuugcucaga

SEQ ID NO: 572089 - RNA, 22 nt, Human
ucauuucacuucucuagggaga

SEQ ID NO: 572090 - RNA, 22 nt, Human
acugggcauuuugaacguucuu

SEQ ID NO: 572091 - RNA, 22 nt, Human
ucaucuaagagucuuacauuua

SEQ ID NO: 572092 - RNA, 22 nt, Human
cggggcagagggucuucuccag

SEQ ID NO: 572093 - RNA, 22 nt, Human
aaggaggagcggaggcuuguug

SEQ ID NO: 572094 - RNA, 20 nt, Human
uaugauaauuacaaaauagu

SEQ ID NO: 572095 - RNA, 23 nt, Human
ccaggcaguagcuauugaaguga

SEQ ID NO: 572096 - RNA, 22 nt, Human
ucaguguuggcuacaucugccu

SEQ ID NO: 572097 - RNA, 22 nt, Human
gagggcgcuucagagagaugaa

SEQ ID NO: 572098 - RNA, 22 nt, Human
uucaaaauccgggaggcgcccc

SEQ ID NO: 572099 - RNA, 22 nt, Human
uccuccagucuuggugagguug

SEQ ID NO: 572100 - RNA, 22 nt, Human
gagcucuggcagggcaggucug

SEQ ID NO: 572101 - RNA, 23 nt, Human
agcuccagggaacaggcaguagg

SEQ ID NO: 572102 - RNA, 22 nt, Human
auuucuuccucugucaguaacu

SEQ ID NO: 572103 - RNA, 19 nt, Human
cccaggggacccagcccua

SEQ ID NO: 572104 - RNA, 22 nt, Human
uauuauugacuauucagaaugu

SEQ ID NO: 572105 - RNA, 22 nt, Human
cagaagcauugacuccuugcuc

SEQ ID NO: 572106 - RNA, 22 nt, Human
cagcugcagaaagcaagcaggu

SEQ ID NO: 572107 - RNA, 23 nt, Human
cccagcugagacuuccugaacuc

SEQ ID NO: 572108 - RNA, 22 nt, Human
aagauacaucauucaggaguga

SEQ ID NO: 572109 - RNA, 22 nt, Human
gccuggggucccuuguuggcac

SEQ ID NO: 572110 - RNA, 22 nt, Human
gcaugugggagggucuucccac

SEQ ID NO: 572111 - RNA, 22 nt, Human
ucucacugauuugagaccaagg

SEQ ID NO: 572112 - RNA, 22 nt, Human
uguuaaauguuccuuuacugga

SEQ ID NO: 572113 - RNA, 22 nt, Human
uuuuuagccaagccauaggucu

SEQ ID NO: 572114 - RNA, 22 nt, Human
ccuuucucuuggauaccgauug

SEQ ID NO: 572115 - RNA, 22 nt, Human
ugcugcugacauuuggggcuug

SEQ ID NO: 572116 - RNA, 22 nt, Human
ugccucugguuaucugguaccu

SEQ ID NO: 572117 - RNA, 22 nt, Human
uuuuuuacagaaucauuaauca

SEQ ID NO: 572118 - RNA, 23 nt, Human
cagagcuggcucagagcugccug

SEQ ID NO: 572119 - RNA, 22 nt, Human
agucuucacucuucacuacuau

SEQ ID NO: 572120 - RNA, 22 nt, Human
ggccuugggcagacacgucaca

SEQ ID NO: 572121 - RNA, 23 nt, Human
gcagaggagcaagcuggacacca

SEQ ID NO: 572122 - RNA, 22 nt, Human
gacccaggguuucugcacaggg

SEQ ID NO: 572123 - RNA, 22 nt, Human
cuaguaaagcuaugauucugcc

SEQ ID NO: 572124 - RNA, 22 nt, Human
uagcagagaggggacaguggca

SEQ ID NO: 572125 - RNA, 22 nt, Human
uugcugaauugaauccuuuggu

SEQ ID NO: 572126 - RNA, 22 nt, Human
ucuggcuugagcuucgaccagu

SEQ ID NO: 572127 - RNA, 22 nt, Human
uucuccuugaaaagcugcaucu

SEQ ID NO: 572128 - RNA, 22 nt, Human
cagaggcugcucuggguggcau

SEQ ID NO: 572129 - RNA, 22 nt, Human
ugcuggcuuccugugcacagca

SEQ ID NO: 572130 - RNA, 22 nt, Human
ugucccaggcugaaguacagug

SEQ ID NO: 572131 - RNA, 22 nt, Human
gugcauauaugcacauaugugu

SEQ ID NO: 572132 - RNA, 22 nt, Human
aaaugucugagacuucugaacu

SEQ ID NO: 572133 - RNA, 19 nt, Human
uaagguuuaccagcaaaau

SEQ ID NO: 572134 - RNA, 22 nt, Human
cuuaaucucaccugcaaagucc

SEQ ID NO: 572135 - RNA, 22 nt, Human
ucacaagacagaaaacauuuag

SEQ ID NO: 572136 - RNA, 22 nt, Human
agacaggaugcauacucuuggu

SEQ ID NO: 572137 - RNA, 22 nt, Human
uacuuacauuagcaaacaaggu

SEQ ID NO: 572138 - RNA, 23 nt, Human
cccagcuggaaguuagaggacca

SEQ ID NO: 572139 - RNA, 22 nt, Human
aaaggugccucuuacaaggcuu

SEQ ID NO: 572140 - RNA, 22 nt, Human
ugagagcuguccaccuguggga

SEQ ID NO: 572141 - RNA, 22 nt, Human
acaguggagaaggcaugaggcu

SEQ ID NO: 572142 - RNA, 22 nt, Human
gagccaaucuuugggcucuugg

SEQ ID NO: 572143 - RNA, 22 nt, Human
ugcugaggucaccuugcugcua

SEQ ID NO: 572144 - RNA, 22 nt, Human
agcccccaaaagugcuuaugau

SEQ ID NO: 572145 - RNA, 22 nt, Human
agugcaugaaagcauacaaggc

SEQ ID NO: 572146 - RNA, 19 nt, Human
ugggcagguucaguaaugg

SEQ ID NO: 572147 - RNA, 22 nt, Human
acaggaacgaauguacauuguu

SEQ ID NO: 572148 - RNA, 22 nt, Human
cagaccucaaagcugcagugcu

SEQ ID NO: 572149 - RNA, 22 nt, Human
ugaggcccuagggcaugggaga

SEQ ID NO: 572150 - RNA, 22 nt, Human
ugugaaagcaagucuaguucuc

SEQ ID NO: 572151 - RNA, 22 nt, Human
ugagcaagagaaacugacugua

SEQ ID NO: 572152 - RNA, 22 nt, Human
cuacauuuugugauuaugaaau

SEQ ID NO: 572153 - RNA, 22 nt, Human
aaauggcauucagcaaccuuuc

SEQ ID NO: 572154 - RNA, 22 nt, Human
uagacauuuucucaacaucucu

SEQ ID NO: 572155 - RNA, 22 nt, Human
cugcugagagccccagcugaga

SEQ ID NO: 572156 - RNA, 22 nt, Human
ucuguggcauguugcacuugua

SEQ ID NO: 572157 - RNA, 22 nt, Human
cugggccagcaacugcaaugga

SEQ ID NO: 572158 - RNA, 22 nt, Human
acagugcuucugauaugaugcc

SEQ ID NO: 572159 - RNA, 21 nt, Human
acugggcuagccugacuucug

SEQ ID NO: 572160 - RNA, 22 nt, Human
uagggagaaacaccaauuuauu

SEQ ID NO: 572161 - RNA, 22 nt, Human
gcagcuuuggagguggaacucu

SEQ ID NO: 572162 - RNA, 21 nt, Human
uccugggaagcacuggggugg

SEQ ID NO: 572163 - RNA, 20 nt, Human
uguggcaggaugagggcgga

SEQ ID NO: 572164 - RNA, 22 nt, Human
aguacuuagaaaguuaauauaa

SEQ ID NO: 572165 - RNA, 22 nt, Human
uggaagcuguggcauaacugag

SEQ ID NO: 572166 - RNA, 20 nt, Human
uggcacagaacccuugccua

SEQ ID NO: 572167 - RNA, 22 nt, Human
gugcggaucgguguccuccaaa

SEQ ID NO: 572168 - RNA, 22 nt, Human
cacuuggaggaaggccuauuca

SEQ ID NO: 572169 - RNA, 22 nt, Human
ucuccgaucacagguuuucaau

SEQ ID NO: 572170 - RNA, 22 nt, Human
aagauuuacuagcauaauagcu

SEQ ID NO: 572171 - RNA, 22 nt, Human
aaacagcugucauuguuuuaaa

SEQ ID NO: 572172 - RNA, 22 nt, Human
guggcaaggagcaugaaaaguc

SEQ ID NO: 572173 - RNA, 21 nt, Human
uuacuuuugcaccaaccuaau

SEQ ID NO: 572174 - RNA, 22 nt, Human
cugccagcacugccuccugagg

SEQ ID NO: 572175 - RNA, 22 nt, Human
uugcugaaaacaguggguauug

SEQ ID NO: 572176 - RNA, 17 nt, Human
caguuucuucccccucu

SEQ ID NO: 572177 - RNA, 22 nt, Human
uaaguacauuugggaccaccug

SEQ ID NO: 572178 - RNA, 19 nt, Human
aaucagaaauaucgaggcc

SEQ ID NO: 572179 - RNA, 19 nt, Human
cucucagccugucuccuug

SEQ ID NO: 572180 - RNA, 17 nt, Human
gacaagacagaauucau

SEQ ID NO: 572181 - RNA, 22 nt, Human
ccuccuggcuuuucccauugaa

SEQ ID NO: 572182 - RNA, 22 nt, Human
cugaagagcaaaccaacuggac

SEQ ID NO: 572183 - RNA, 22 nt, Human
aacugcuuaucuuugguagaug

SEQ ID NO: 572184 - RNA, 22 nt, Human
cugcaggagcaagccugggaga

SEQ ID NO: 572185 - RNA, 22 nt, Human
uuucuucuugaguaaccagauu

SEQ ID NO: 572186 - RNA, 23 nt, Human
uuuuuaguuacaccucugccacc

SEQ ID NO: 572187 - RNA, 19 nt, Human
ugugggcaagggauggcag

SEQ ID NO: 572188 - RNA, 22 nt, Human
ggaaagagcccagcagugcuug

SEQ ID NO: 572189 - RNA, 20 nt, Human
cuccugggacugcugguuau

SEQ ID NO: 572190 - RNA, 22 nt, Human
aauguacaucucaguguaguac

SEQ ID NO: 572191 - RNA, 22 nt, Human
gaauagauccucauuuauugau

SEQ ID NO: 572192 - RNA, 22 nt, Human
cagcaacauauaugaaacugug

SEQ ID NO: 572193 - RNA, 22 nt, Human
uuggcagaggucucguuguggc

SEQ ID NO: 572194 - RNA, 22 nt, Human
ggagcuguguuauccauuccca

SEQ ID NO: 572195 - RNA, 17 nt, Human
ucaggcugugccuggua

SEQ ID NO: 572196 - RNA, 22 nt, Human
ucugagguccugugauuucucu

SEQ ID NO: 572197 - RNA, 20 nt, Human
gggugggagagucugagggu

SEQ ID NO: 572198 - RNA, 22 nt, Human
gagguggguguaucacagguca

SEQ ID NO: 572199 - RNA, 22 nt, Human
cgagcagaagccugguggucug

SEQ ID NO: 572200 - RNA, 22 nt, Human
cccagcuccuuguuugcaucuc

SEQ ID NO: 572201 - RNA, 22 nt, Human
agcugccagggacugggcaugg

SEQ ID NO: 572202 - RNA, 22 nt, Human
aucagcacaacguacagagaaa

SEQ ID NO: 572203 - RNA, 22 nt, Human
auguacaaaauguuuugaaaug

SEQ ID NO: 572204 - RNA, 22 nt, Human
agcagcauguugggaugugaaa

SEQ ID NO: 572205 - RNA, 22 nt, Human
guguuugucucuuggccuaccu

SEQ ID NO: 572206 - RNA, 22 nt, Human
ugggacagguuggagagaagca

SEQ ID NO: 572207 - RNA, 22 nt, Human
ucugggaacacuuugugagcuc

SEQ ID NO: 572208 - RNA, 22 nt, Human
uauuagaaaggcuauugcauag

SEQ ID NO: 572209 - RNA, 22 nt, Human
agauucauuauuaaugugaucu

SEQ ID NO: 572210 - RNA, 22 nt, Human
cuuccugcaggacagccaucug

SEQ ID NO: 572211 - RNA, 22 nt, Human
uuugaacaugcugcaugauaau

SEQ ID NO: 572212 - RNA, 22 nt, Human
uuauuuaaugugaucugaagag

SEQ ID NO: 572213 - RNA, 17 nt, Human
gcuuuccuugccccucc

SEQ ID NO: 572214 - RNA, 22 nt, Human
ugccccagaccuacugaauggg

SEQ ID NO: 572215 - RNA, 22 nt, Human
gccugggaacucugaucuccug

SEQ ID NO: 572216 - RNA, 22 nt, Human
cugggcuuucaggcccuaaggc

SEQ ID NO: 572217 - RNA, 22 nt, Human
agaaagguggaugcucuggaau

SEQ ID NO: 572218 - RNA, 22 nt, Human
gcaguccucauccuuuagcagu

SEQ ID NO: 572219 - RNA, 22 nt, Human
auugacaaaucugaacauacgg

SEQ ID NO: 572220 - RNA, 23 nt, Human
agcaggcaucuguggcacaaggc

SEQ ID NO: 572221 - RNA, 22 nt, Human
uuugauuuacuggauauucuca

SEQ ID NO: 572222 - RNA, 22 nt, Human
ccccagggaagcuuugcuuacu

SEQ ID NO: 572223 - RNA, 22 nt, Human
uggcacuguagccacuacugcc

SEQ ID NO: 572224 - RNA, 22 nt, Human
ccuuuuucaauauagaauugca

SEQ ID NO: 572225 - RNA, 22 nt, Human
cagggcucgcucgcucgcucgc

SEQ ID NO: 572226 - RNA, 22 nt, Human
acagagcaacuuuauuucaugg

SEQ ID NO: 572227 - RNA, 21 nt, Human
ugggugggcagagucucuuca

SEQ ID NO: 572228 - RNA, 22 nt, Human
aaaaguuuaagacucauucuag

SEQ ID NO: 572229 - RNA, 22 nt, Human
caugaacaauuugcucacugau

SEQ ID NO: 572230 - RNA, 19 nt, Human
caucuggaugauucuccug

SEQ ID NO: 572231 - RNA, 17 nt, Human
gcaguggagggguaguu

SEQ ID NO: 572232 - RNA, 22 nt, Human
guguggggcucagugggaaugu

SEQ ID NO: 572233 - RNA, 22 nt, Human
uaagguuucuucagauacuagu

SEQ ID NO: 572234 - RNA, 22 nt, Human
ucucagccucaccucuauggag

SEQ ID NO: 572235 - RNA, 22 nt, Human
ugaggcagggaguuuaauuguc

SEQ ID NO: 572236 - RNA, 22 nt, Human
uccuugagaggacagagccaua

SEQ ID NO: 572237 - RNA, 22 nt, Human
uucagaaacagagugagugagu

SEQ ID NO: 572238 - RNA, 22 nt, Human
acauacacaugaauauauuuuu

SEQ ID NO: 572239 - RNA, 22 nt, Human
ucuucuguauuguuaacucagg

SEQ ID NO: 572240 - RNA, 22 nt, Human
aaaucagagucugauuuuaagg

SEQ ID NO: 572241 - RNA, 22 nt, Human
ugaaaugucaguguuuuauaag

SEQ ID NO: 572242 - RNA, 22 nt, Human
cagaggcagugggguugcuccu

SEQ ID NO: 572243 - RNA, 22 nt, Human
aagacacuuucuaaauagaagu

SEQ ID NO: 572244 - RNA, 22 nt, Human
gugcagcugugguggagccagg

SEQ ID NO: 572245 - RNA, 22 nt, Human
cugggccuuaugaguaccugga

SEQ ID NO: 572246 - RNA, 22 nt, Human
gaaggcacugaacuccuucugg

SEQ ID NO: 572247 - RNA, 22 nt, Human
uguaaguaguaauggaaggaca

SEQ ID NO: 572248 - RNA, 22 nt, Human
aaacucaugccauuaauccuuu

SEQ ID NO: 572249 - RNA, 22 nt, Human
cacaagggagcuuagaaaacau

SEQ ID NO: 572250 - RNA, 22 nt, Human
ggugcucaagagggcauccucu

SEQ ID NO: 572251 - RNA, 22 nt, Human
ucaggcagaaaaaucacuaauu

SEQ ID NO: 572252 - RNA, 22 nt, Human
uugaggucuucaggaucaggcu

SEQ ID NO: 572253 - RNA, 22 nt, Human
uucuccucuacauagacugugc

SEQ ID NO: 572254 - RNA, 22 nt, Human
uuguuuuaaugagggagguuga

SEQ ID NO: 572255 - RNA, 22 nt, Human
guuucuccucugugucuuguuu

SEQ ID NO: 572256 - RNA, 22 nt, Human
uggggcagaguaggauuuuggc

SEQ ID NO: 572257 - RNA, 22 nt, Human
uaaggaggcagucauuaucagg

SEQ ID NO: 572258 - RNA, 19 nt, Human
acauggcaucccaggaggu

SEQ ID NO: 572259 - RNA, 22 nt, Human
uguuaaaaccacaggugaggac

SEQ ID NO: 572260 - RNA, 22 nt, Human
ugaaagcauuagucuaagguag

SEQ ID NO: 572261 - RNA, 22 nt, Human
agagccugugauugucaucacc

SEQ ID NO: 572262 - RNA, 18 nt, Human
cccagugcucacugccuc

SEQ ID NO: 572263 - RNA, 22 nt, Human
gagggagcuaugaauagaagaa

SEQ ID NO: 572264 - RNA, 22 nt, Human
acagagguaggacaugagauau

SEQ ID NO: 572265 - RNA, 23 nt, Human
acugcuuuauucaugaggcucuc

SEQ ID NO: 572266 - RNA, 22 nt, Human
cccaggaggcggagguuguggu

SEQ ID NO: 572267 - RNA, 22 nt, Human
agguuuguuuauguaucauugg

SEQ ID NO: 572268 - RNA, 22 nt, Human
agaagauguugcaguugaugcg

SEQ ID NO: 572269 - RNA, 22 nt, Human
ucagugcagaauagugaugcau

SEQ ID NO: 572270 - RNA, 22 nt, Human
agacucugaggagcccugagac

SEQ ID NO: 572271 - RNA, 22 nt, Human
gugguguaggucacaguuagga

SEQ ID NO: 572272 - RNA, 22 nt, Human
cugggccuagcaacagaggagu

SEQ ID NO: 572273 - RNA, 22 nt, Human
caaacuguucucugugggauuc

SEQ ID NO: 572274 - RNA, 22 nt, Human
uuucuagucagccauaucuagu

SEQ ID NO: 572275 - RNA, 20 nt, Human
gaugucuuggucacaguggc

SEQ ID NO: 572276 - RNA, 22 nt, Human
uugucugaauucuucuaggcag

SEQ ID NO: 572277 - RNA, 19 nt, Human
agccagaguggcccagggg

SEQ ID NO: 572278 - RNA, 22 nt, Human
ucaguaacuuacuuauucaccu

SEQ ID NO: 572279 - RNA, 22 nt, Human
aggccaggcaacauucugaagu

SEQ ID NO: 572280 - RNA, 19 nt, Human
aguguuucaugugcuuuua

SEQ ID NO: 572281 - RNA, 22 nt, Human
ucauauuaggguaaugauaaga

SEQ ID NO: 572282 - RNA, 22 nt, Human
ucuugggauugcccugcaguuc

SEQ ID NO: 572283 - RNA, 22 nt, Human
cacagcagaaaguguaggagga

SEQ ID NO: 572284 - RNA, 22 nt, Human
cacaugcccagaacuucucauu

SEQ ID NO: 572285 - RNA, 22 nt, Human
aaagucuuuauuuuguaucuuu

SEQ ID NO: 572286 - RNA, 22 nt, Human
uaucuauuccaaauaucagcgu

SEQ ID NO: 572287 - RNA, 22 nt, Human
cuauuaaacacuacugugcacu

SEQ ID NO: 572288 - RNA, 22 nt, Human
cagcauggggcuuggagucagc

SEQ ID NO: 572289 - RNA, 22 nt, Human
caaaugaagggagcugaagucu

SEQ ID NO: 572290 - RNA, 22 nt, Human
agcuuuuauuggcugucauuug

SEQ ID NO: 572291 - RNA, 22 nt, Human
guucuccuuguggcugcagcag

SEQ ID NO: 572292 - RNA, 22 nt, Human
aggaaggguucuuugugaaaga

SEQ ID NO: 572293 - RNA, 22 nt, Human
uauuucuuucagguauguguug

SEQ ID NO: 572294 - RNA, 22 nt, Human
ucugucacccagagugcagugg

SEQ ID NO: 572295 - RNA, 22 nt, Human
guccuuauuucacuuaaacgua

SEQ ID NO: 572296 - RNA, 22 nt, Human
agcuucuucuuggucuuuccca

SEQ ID NO: 572297 - RNA, 22 nt, Human
ggagugaaguggcgcgaucucg

SEQ ID NO: 572298 - RNA, 22 nt, Human
aagauucacagagugaaugaaa

SEQ ID NO: 572299 - RNA, 22 nt, Human
aagcuuuggagaggcgggcagg

SEQ ID NO: 572300 - RNA, 22 nt, Human
gaggaccacagaugagccugca

SEQ ID NO: 572301 - RNA, 22 nt, Human
gcccccuugaccuaaucaccuu

SEQ ID NO: 572302 - RNA, 22 nt, Human
caggagguuguaagagcaggcc

SEQ ID NO: 572303 - RNA, 20 nt, Human
aaaugcuuuugacacauauu

SEQ ID NO: 572304 - RNA, 22 nt, Human
uugcauagugcugagguucggg

SEQ ID NO: 572305 - RNA, 22 nt, Human
gcaggaagaugagcucagguaa

SEQ ID NO: 572306 - RNA, 22 nt, Human
ugggcuccuugggagcaaguga

SEQ ID NO: 572307 - RNA, 22 nt, Human
ggucccagaauugguuagcaca

SEQ ID NO: 572308 - RNA, 22 nt, Human
aggugcugggcagcagucauug

SEQ ID NO: 572309 - RNA, 22 nt, Human
uggagcagagaugguggccuuc

SEQ ID NO: 572310 - RNA, 22 nt, Human
gggccugcuccccaucgcugcu

SEQ ID NO: 572311 - RNA, 23 nt, Human
agacacuguaaagaauugcaguu

SEQ ID NO: 572312 - RNA, 19 nt, Human
gccugcagaaaaggcaggg

SEQ ID NO: 572313 - RNA, 22 nt, Human
aacagugucaggauuacagaua

SEQ ID NO: 572314 - RNA, 22 nt, Human
ucugaaauauugguaauacuuu

SEQ ID NO: 572315 - RNA, 22 nt, Human
uccccaggaaauucugauucuu

SEQ ID NO: 572316 - RNA, 22 nt, Human
ggcacauguaugugggagugug

SEQ ID NO: 572317 - RNA, 22 nt, Human
auuuuagcaguucucuaauuuc

SEQ ID NO: 572318 - RNA, 23 nt, Human
uggagggcagaauaacagacuac

SEQ ID NO: 572319 - RNA, 22 nt, Human
caggacaguauaggcuuuagga

SEQ ID NO: 572320 - RNA, 22 nt, Human
cugggacuugaugaaaugacug

SEQ ID NO: 572321 - RNA, 22 nt, Human
augcuaaauucagacaggguua

SEQ ID NO: 572322 - RNA, 22 nt, Human
aaggccuucucuugugucugug

SEQ ID NO: 572323 - RNA, 22 nt, Human
agaugcugcuccacaggccagg

SEQ ID NO: 572324 - RNA, 17 nt, Human
aaccagcuguccccucc

SEQ ID NO: 572325 - RNA, 17 nt, Human
cagaggagcuuuggggg

SEQ ID NO: 572326 - RNA, 22 nt, Human
acuggccaggagcuggaaauac

SEQ ID NO: 572327 - RNA, 22 nt, Human
ucagcagggagaggagaaugca

SEQ ID NO: 572328 - RNA, 22 nt, Human
cuggccaauauagggaaaucuu

SEQ ID NO: 572329 - RNA, 22 nt, Human
uaagacauccguugcuuauaau

SEQ ID NO: 572330 - RNA, 22 nt, Human
ggcuccuggaggcaccacuggu

SEQ ID NO: 572331 - RNA, 22 nt, Human
ucugcugaggugguuuuagaga

SEQ ID NO: 572332 - RNA, 22 nt, Human
ggagauggccaaaaacacaaau

SEQ ID NO: 572333 - RNA, 22 nt, Human
gcuugccuaucugguggucguu

SEQ ID NO: 572334 - RNA, 21 nt, Human
gagaaucuguuuucuugucuu

SEQ ID NO: 572335 - RNA, 22 nt, Human
agccuaggguucugaugucacu

SEQ ID NO: 572336 - RNA, 22 nt, Human
ucccaggaaaacacucgaggac

SEQ ID NO: 572337 - RNA, 22 nt, Human
ugcuccagcaccaagagcucca

SEQ ID NO: 572338 - RNA, 22 nt, Human
agggcuccgggcaggcgaugga

SEQ ID NO: 572339 - RNA, 22 nt, Human
ugugaagauuuggcaugcagaa

SEQ ID NO: 572340 - RNA, 22 nt, Human
gcuccuggcucuggccaaggga

SEQ ID NO: 572341 - RNA, 22 nt, Human
cccugcccaucggggcggccug

SEQ ID NO: 572342 - RNA, 22 nt, Human
cugggccagucucggccgcucu

SEQ ID NO: 572343 - RNA, 22 nt, Human
cagcaccucugggucuugucuu

SEQ ID NO: 572344 - RNA, 22 nt, Human
uucuuacuaguauguuucagca

SEQ ID NO: 572345 - RNA, 22 nt, Human
ggagccuggcccggcccuuggc

SEQ ID NO: 572346 - RNA, 22 nt, Human
acauuuaaauaugccuuauauu

SEQ ID NO: 572347 - RNA, 22 nt, Human
cucaggagguuuccugucuagg

SEQ ID NO: 572348 - RNA, 22 nt, Human
gaggagcuggcagcgucuccgc

SEQ ID NO: 572349 - RNA, 22 nt, Human
uccuggaggggacagcaugggc

SEQ ID NO: 572350 - RNA, 22 nt, Human
aaggccaggcagggagcuguga

SEQ ID NO: 572351 - RNA, 22 nt, Human
ccagcucaagcacugugugaag

SEQ ID NO: 572352 - RNA, 22 nt, Human
gucauugagucgucagagucuu

SEQ ID NO: 572353 - RNA, 22 nt, Human
uucacugugauggugcagaggc

SEQ ID NO: 572354 - RNA, 22 nt, Human
ucauaaagcuugccugcagugu

SEQ ID NO: 572355 - RNA, 22 nt, Human
ugggccugacucaccugccucc

SEQ ID NO: 572356 - RNA, 22 nt, Human
ugaucuccugaccuuguaaucc

SEQ ID NO: 572357 - RNA, 19 nt, Human
gccugccuggguuucugag

SEQ ID NO: 572358 - RNA, 22 nt, Human
cuggccugggagcugcuagcgu

SEQ ID NO: 572359 - RNA, 22 nt, Human
aaauucuaaggucacaauguug

SEQ ID NO: 572360 - RNA, 22 nt, Human
ugaaauguguccauguuauuuc

SEQ ID NO: 572361 - RNA, 22 nt, Human
acaucuuugcucuuauagagcu

SEQ ID NO: 572362 - RNA, 18 nt, Human
uuuauauggauagagacc

SEQ ID NO: 572363 - RNA, 22 nt, Human
cacagcagaaauaugaaggcag

SEQ ID NO: 572364 - RNA, 22 nt, Human
guucagcaagaauguuucuauu

SEQ ID NO: 572365 - RNA, 22 nt, Human
gaagacaauucuggguggagga

SEQ ID NO: 572366 - RNA, 22 nt, Human
ucuccugguacccuuccuagca

SEQ ID NO: 572367 - RNA, 22 nt, Human
cggggagggcagaggcucccuc

SEQ ID NO: 572368 - RNA, 22 nt, Human
ucagauggcacacagagccugc

SEQ ID NO: 572369 - RNA, 22 nt, Human
acagagucauucacugaugaag

SEQ ID NO: 572370 - RNA, 22 nt, Human
cauacauuaccuaacuuaaugc

SEQ ID NO: 572371 - RNA, 22 nt, Human
aggacacacuucugaggucuuu

SEQ ID NO: 572372 - RNA, 22 nt, Human
ugugaaaugcuauuuccaugag

SEQ ID NO: 572373 - RNA, 22 nt, Human
aagaaauuaaggaaugcaacga

SEQ ID NO: 572374 - RNA, 22 nt, Human
aucagaaucuucugaacagugg

SEQ ID NO: 572375 - RNA, 22 nt, Human
auuaggauguguauauuguguu

SEQ ID NO: 572376 - RNA, 23 nt, Human
cagcucagaguguguccuguuuc

SEQ ID NO: 572377 - RNA, 22 nt, Human
ucugcagacuugccuaagugug

SEQ ID NO: 572378 - RNA, 22 nt, Human
cuggagagggagcuguuggaag

SEQ ID NO: 572379 - RNA, 22 nt, Human
auuuauuaugggauuuggcuca

SEQ ID NO: 572380 - RNA, 21 nt, Human
uggcucugcucagagcagucc

SEQ ID NO: 572381 - RNA, 22 nt, Human
caguggcuucuuccuagagcca

SEQ ID NO: 572382 - RNA, 22 nt, Human
cagcugcacugaagcagguuug

SEQ ID NO: 572383 - RNA, 22 nt, Human
uaacaauggaguuuugagaaag

SEQ ID NO: 572384 - RNA, 22 nt, Human
uaaugcuuccuauauagcacuc

SEQ ID NO: 572385 - RNA, 22 nt, Human
ugcuuaaauuucagcagcuuaa

SEQ ID NO: 572386 - RNA, 22 nt, Human
caguuaaauucuccaguuacca

SEQ ID NO: 572387 - RNA, 22 nt, Human
ggccuuggaguccuccacugga

SEQ ID NO: 572388 - RNA, 22 nt, Human
uggggccugagguggagcugca

SEQ ID NO: 572389 - RNA, 22 nt, Human
aggaagccaugguggacgucua

SEQ ID NO: 572390 - RNA, 22 nt, Human
acccagggcuuaaggcggugca

SEQ ID NO: 572391 - RNA, 22 nt, Human
uccagcucuaacaugcugggcc

SEQ ID NO: 572392 - RNA, 22 nt, Human
ggaggggcaggucccaaguugu

SEQ ID NO: 572393 - RNA, 21 nt, Human
uguucacauggagcagaaugu

SEQ ID NO: 572394 - RNA, 22 nt, Human
uuacauucagaaagauuugagu

SEQ ID NO: 572395 - RNA, 22 nt, Human
gugcccugcaugccccggguau

SEQ ID NO: 572396 - RNA, 23 nt, Human
ugucccagagggagggauaggcu

SEQ ID NO: 572397 - RNA, 22 nt, Human
uuuuauacuuaagacagaguuu

SEQ ID NO: 572398 - RNA, 22 nt, Human
gcacuggaaauaccuagaugaa

SEQ ID NO: 572399 - RNA, 20 nt, Human
augggcugguuaggaagugu

SEQ ID NO: 572400 - RNA, 22 nt, Human
agagaagagcaaugauaaauuu

SEQ ID NO: 572401 - RNA, 22 nt, Human
agcagacaacccagaugaccca

SEQ ID NO: 572402 - RNA, 22 nt, Human
caggagugcagguggugaggca

SEQ ID NO: 572403 - RNA, 22 nt, Human
ccugugggagguucugugaguc

SEQ ID NO: 572404 - RNA, 22 nt, Human
ucagaggagggacucagaccca

SEQ ID NO: 572405 - RNA, 22 nt, Human
gccaggcagagccccgugcagc

SEQ ID NO: 572406 - RNA, 22 nt, Human
ggcugccauaacugauaccaua

SEQ ID NO: 572407 - RNA, 22 nt, Human
cugugcugagugaugugacuua

SEQ ID NO: 572408 - RNA, 22 nt, Human
ggccagugugcaggucagagau

SEQ ID NO: 572409 - RNA, 20 nt, Human
cugggaggucuuccaaauca

SEQ ID NO: 572410 - RNA, 22 nt, Human
cuggagggacaagguaugcauu

SEQ ID NO: 572411 - RNA, 22 nt, Human
ucucugcccaaguuucucaagu

SEQ ID NO: 572412 - RNA, 22 nt, Human
aaugucauugugaguuaggcuu

SEQ ID NO: 572413 - RNA, 22 nt, Human
cauaaucagauguguacauaag

SEQ ID NO: 572414 - RNA, 20 nt, Human
cccugcagccaugggagugg

SEQ ID NO: 572415 - RNA, 22 nt, Human
uuggcugagagcugcucugcag

SEQ ID NO: 572416 - RNA, 18 nt, Human
uagaggggaagaccuuua

SEQ ID NO: 572417 - RNA, 22 nt, Human
ugacauaaaucuaaaggaaagg

SEQ ID NO: 572418 - RNA, 23 nt, Human
gaggcagcuccugcagugcccug

SEQ ID NO: 572419 - RNA, 22 nt, Human
gcagagccaggcuggggcaggu

SEQ ID NO: 572420 - RNA, 22 nt, Human
cugugcccuggccaggccucuc

SEQ ID NO: 572421 - RNA, 22 nt, Human
ggcagcuguaagaugagugaau

SEQ ID NO: 572422 - RNA, 22 nt, Human
aaagcacuauagccaaauagcc

SEQ ID NO: 572423 - RNA, 22 nt, Human
uuucucaacagaguaugcccuu

SEQ ID NO: 572424 - RNA, 22 nt, Human
aagauguaucaguuaagucuuc

SEQ ID NO: 572425 - RNA, 22 nt, Human
agggcacagccuaaagccuaug

SEQ ID NO: 572426 - RNA, 22 nt, Human
auucugcaugguggugucucug

SEQ ID NO: 572427 - RNA, 22 nt, Human
agaagcauuggaccaggggccc

SEQ ID NO: 572428 - RNA, 22 nt, Human
cuguauaaacauauuuucaagu

SEQ ID NO: 572429 - RNA, 22 nt, Human
guguuuuauggagucauaacgu

SEQ ID NO: 572430 - RNA, 21 nt, Human
uagcuuccagcucaagcugag

SEQ ID NO: 572431 - RNA, 22 nt, Human
gcuguggcuccaauggugagcc

SEQ ID NO: 572432 - RNA, 22 nt, Human
aaacuguaaauacuaguaagug

SEQ ID NO: 572433 - RNA, 22 nt, Human
ccucccauggagcucuguccau

SEQ ID NO: 572434 - RNA, 20 nt, Human
auccaggauguugauuugaa

SEQ ID NO: 572435 - RNA, 22 nt, Human
agcaagcacacuucaugugaac

SEQ ID NO: 572436 - RNA, 22 nt, Human
uaaagcuaugcuuaauuuauca

SEQ ID NO: 572437 - RNA, 22 nt, Human
gggcuggucuggcuuagucagg

SEQ ID NO: 572438 - RNA, 22 nt, Human
uguauuuucugaagauaaucaa

SEQ ID NO: 572439 - RNA, 22 nt, Human
uguuccuguuucugcguaguuu

SEQ ID NO: 572440 - RNA, 22 nt, Human
ccucuggcaagugauuuaucau

SEQ ID NO: 572441 - RNA, 22 nt, Human
aggguagggccguagggccaug

SEQ ID NO: 572442 - RNA, 21 nt, Human
ccagugcuacagcugccugac

SEQ ID NO: 572443 - RNA, 22 nt, Human
aacacuguggucuuuucaguaa

SEQ ID NO: 572444 - RNA, 19 nt, Human
ugagacagaagaugagccu

SEQ ID NO: 572445 - RNA, 22 nt, Human
cagagguauugcaaaagccuag

SEQ ID NO: 572446 - RNA, 22 nt, Human
cuggcuuugaaaugcauuucag

SEQ ID NO: 572447 - RNA, 22 nt, Human
ucugaggaauucugcagugaga

SEQ ID NO: 572448 - RNA, 22 nt, Human
aauuacagucggagcagcacug

SEQ ID NO: 572449 - RNA, 22 nt, Human
agaaagacaaaaugcaguggcu

SEQ ID NO: 572450 - RNA, 22 nt, Human
aaaugacacuaggcuuuuugca

SEQ ID NO: 572451 - RNA, 22 nt, Human
gaugggauuuuuuauguguuca

SEQ ID NO: 572452 - RNA, 22 nt, Human
uacacugaaagagaggauugaa

SEQ ID NO: 572453 - RNA, 22 nt, Human
gucccuuccucauuccacuuua

SEQ ID NO: 572454 - RNA, 22 nt, Human
gagcaggacagcagcuuccugg

SEQ ID NO: 572455 - RNA, 22 nt, Human
uacaucauaauaauacuuagaa

SEQ ID NO: 572456 - RNA, 22 nt, Human
ucaugugucugccaguguuuau

SEQ ID NO: 572457 - RNA, 22 nt, Human
cugagaguguggcuuccaggcc

SEQ ID NO: 572458 - RNA, 22 nt, Human
ucuguggcugucuuuccagagg

SEQ ID NO: 572459 - RNA, 22 nt, Human
aggggagguguccccaaaucuc

SEQ ID NO: 572460 - RNA, 22 nt, Human
auagaauuacaguguguuugga

SEQ ID NO: 572461 - RNA, 22 nt, Human
cagcagcagagauacugguuuc

SEQ ID NO: 572462 - RNA, 20 nt, Human
acaaagacuggaaaagcaag

SEQ ID NO: 572463 - RNA, 22 nt, Human
cccacugagccuauacaaacag

SEQ ID NO: 572464 - RNA, 22 nt, Human
uguuuucauuugauguaacaaa

SEQ ID NO: 572465 - RNA, 22 nt, Human
uggagcugacucacaccagcua

SEQ ID NO: 572466 - RNA, 22 nt, Human
cacuguccaauagauacauaau

SEQ ID NO: 572467 - RNA, 22 nt, Human
ggagccuggccuggcucugugu

SEQ ID NO: 572468 - RNA, 22 nt, Human
uucuggaauauuugacacaauu

SEQ ID NO: 572469 - RNA, 22 nt, Human
ggaagccagagugcugggcagg

SEQ ID NO: 572470 - RNA, 22 nt, Human
aaugagcuagaccugcuuccuc

SEQ ID NO: 572471 - RNA, 23 nt, Human
uugggcucaguggcaggaagagu

SEQ ID NO: 572472 - RNA, 22 nt, Human
uggcucagagagggagugugga

SEQ ID NO: 572473 - RNA, 22 nt, Human
aaccagcuaacauguggaauga

SEQ ID NO: 572474 - RNA, 22 nt, Human
gcccaggaucugcucagaucau

SEQ ID NO: 572475 - RNA, 19 nt, Human
ccccaggguaggcuagggg

SEQ ID NO: 572476 - RNA, 17 nt, Human
ucugucuugacugucac

SEQ ID NO: 572477 - RNA, 22 nt, Human
uaguuucuagucaaucuucuuu

SEQ ID NO: 572478 - RNA, 22 nt, Human
aggcgcugcgcuggggccagaa

SEQ ID NO: 572479 - RNA, 22 nt, Human
cuuuaauucucaggugcacaua

SEQ ID NO: 572480 - RNA, 22 nt, Human
uguguucaguaugacauucaca

SEQ ID NO: 572481 - RNA, 22 nt, Human
augcacugggugaggaaggaga

SEQ ID NO: 572482 - RNA, 22 nt, Human
auuuuguuauagaacucuguga

SEQ ID NO: 572483 - RNA, 22 nt, Human
auuuccuugcaacuuaggcaug

SEQ ID NO: 572484 - RNA, 20 nt, Human
uccaggcuccuccacuuagu

SEQ ID NO: 572485 - RNA, 22 nt, Human
gggcagcugccccucucugggc

SEQ ID NO: 572486 - RNA, 22 nt, Human
aagucagagcaacugagacauu

SEQ ID NO: 572487 - RNA, 23 nt, Human
agcuucgccuuccuuucucugca

SEQ ID NO: 572488 - RNA, 22 nt, Human
ccugggcucaagugauccuccu

SEQ ID NO: 572489 - RNA, 22 nt, Human
gcuccuggauguucaagucggc

SEQ ID NO: 572490 - RNA, 22 nt, Human
caggcuggagugcaguugugca

SEQ ID NO: 572491 - RNA, 22 nt, Human
cccugaggaccaggaaggaggg

SEQ ID NO: 572492 - RNA, 22 nt, Human
cuccagguagcuaaguccuggg

SEQ ID NO: 572493 - RNA, 18 nt, Human
cucuuucuuuggcacaaa

SEQ ID NO: 572494 - RNA, 22 nt, Human
cccuggccccucacuccgaggc

SEQ ID NO: 572495 - RNA, 22 nt, Human
cuggccucagagggucauggug

SEQ ID NO: 572496 - RNA, 22 nt, Human
ucaggcucaggaauguguuuau

SEQ ID NO: 572497 - RNA, 22 nt, Human
cuauacaucccaauuucagaga

SEQ ID NO: 572498 - RNA, 22 nt, Human
uaaaugcaguuaguacuugcca

SEQ ID NO: 572499 - RNA, 22 nt, Human
aagcagaaaaacugagcuccaa

SEQ ID NO: 572500 - RNA, 22 nt, Human
auuagaaugaaguauaggauuu

SEQ ID NO: 572501 - RNA, 22 nt, Human
gugggcagguaggcaccagcua

SEQ ID NO: 572502 - RNA, 20 nt, Human
ugggcugaggaucaggugcc

SEQ ID NO: 572503 - RNA, 17 nt, Human
uuucuccuuccaucuca

SEQ ID NO: 572504 - RNA, 20 nt, Human
gaauuuuaugaacacuacca

SEQ ID NO: 572505 - RNA, 22 nt, Human
auguagauuugcuucuccugcc

SEQ ID NO: 572506 - RNA, 22 nt, Human
gagugggggguccgucucagug

SEQ ID NO: 572507 - RNA, 22 nt, Human
agcuccagaagccugcaaggua

SEQ ID NO: 572508 - RNA, 22 nt, Human
ucuggcuugcuggcuugguccc

SEQ ID NO: 572509 - RNA, 22 nt, Human
uaaagcuagaauuguuccagca

SEQ ID NO: 572510 - RNA, 22 nt, Human
uuaugggagcaauuggggaggu

SEQ ID NO: 572511 - RNA, 22 nt, Human
agcaggcuccuuccuucucugg

SEQ ID NO: 572512 - RNA, 22 nt, Human
acacuagcuaaaugcugauuaa

SEQ ID NO: 572513 - RNA, 22 nt, Human
ugccaggcuaaguggaggacuu

SEQ ID NO: 572514 - RNA, 18 nt, Human
auguauguacauauuuau

SEQ ID NO: 572515 - RNA, 18 nt, Human
auuuugaacugggaauau

SEQ ID NO: 572516 - RNA, 22 nt, Human
caggaccuaacucaccugucuc

SEQ ID NO: 572517 - RNA, 22 nt, Human
ccagcugcgggcaucgagaguu

SEQ ID NO: 572518 - RNA, 22 nt, Human
gaggaaagagucaaaucugaag

SEQ ID NO: 572519 - RNA, 22 nt, Human
uuauguuugaguauaugacuca

SEQ ID NO: 572520 - RNA, 22 nt, Human
ccaggaggcagagguuguagug

SEQ ID NO: 572521 - RNA, 22 nt, Human
auucucauuuuuauagaugaga

SEQ ID NO: 572522 - RNA, 22 nt, Human
gagaggcuggguuggagaucga

SEQ ID NO: 572523 - RNA, 22 nt, Human
uccuacaaugcacagaauagcc

SEQ ID NO: 572524 - RNA, 22 nt, Human
augcaugugugagagcaagagg

SEQ ID NO: 572525 - RNA, 22 nt, Human
caggccucuauggucagcugag

SEQ ID NO: 572526 - RNA, 22 nt, Human
auuugcaugaccuuugcaagug

SEQ ID NO: 572527 - RNA, 22 nt, Human
auucagcacaucuuuguacagc

SEQ ID NO: 572528 - RNA, 22 nt, Human
auaucauaaaucggugcaugaa

SEQ ID NO: 572529 - RNA, 22 nt, Human
gcuaaggccuuaacucauggag

SEQ ID NO: 572530 - RNA, 22 nt, Human
ucuggggaugagguccagugau

SEQ ID NO: 572531 - RNA, 22 nt, Human
ggugccagccuagugcaguggu

SEQ ID NO: 572532 - RNA, 22 nt, Human
aaggccacugaagaaaucacaa

SEQ ID NO: 572533 - RNA, 22 nt, Human
ccaggacagggagacgggagcc

SEQ ID NO: 572534 - RNA, 22 nt, Human
uuuggacaaguuacugguuucc

SEQ ID NO: 572535 - RNA, 22 nt, Human
acauuuuuauucaucaaagcag

SEQ ID NO: 572536 - RNA, 22 nt, Human
ccucugaggucauggacuuggc

SEQ ID NO: 572537 - RNA, 22 nt, Human
auguacaguggaaacuaacaaa

SEQ ID NO: 572538 - RNA, 20 nt, Human
gcuggaagggcuagagggcu

SEQ ID NO: 572539 - RNA, 22 nt, Human
ccagggcagcagaauuggggca

SEQ ID NO: 572540 - RNA, 22 nt, Human
gggucuccugagagaagaugcu

SEQ ID NO: 572541 - RNA, 22 nt, Human
uguguacaggccuugcuagacu

SEQ ID NO: 572542 - RNA, 22 nt, Human
uccacauucucuguuacagaua

SEQ ID NO: 572543 - RNA, 22 nt, Human
cugagcugcaguccuggcucug

SEQ ID NO: 572544 - RNA, 22 nt, Human
gguacagggcuuccuggacaag

SEQ ID NO: 572545 - RNA, 22 nt, Human
cccaagaucuuucgugcacuaa

SEQ ID NO: 572546 - RNA, 22 nt, Human
auuugcugaucaucuagcuaau

SEQ ID NO: 572547 - RNA, 22 nt, Human
uuucaaauggagucgugaaaug

SEQ ID NO: 572548 - RNA, 22 nt, Human
aagacaauccuggacagucagc

SEQ ID NO: 572549 - RNA, 22 nt, Human
aaguuuaacuugaauucuuucu

SEQ ID NO: 572550 - RNA, 22 nt, Human
cacaggcugcccgcagcuggga

SEQ ID NO: 572551 - RNA, 22 nt, Human
aguguuuccugaguguuaucau

SEQ ID NO: 572552 - RNA, 22 nt, Human
uggucaacaggcagggaugaaa

SEQ ID NO: 572553 - RNA, 22 nt, Human
ggccucagugggccgcugcagg

SEQ ID NO: 572554 - RNA, 22 nt, Human
ugcuuaaaguaguggauuguua

SEQ ID NO: 572555 - RNA, 22 nt, Human
cagcugugauaugccugccuga

SEQ ID NO: 572556 - RNA, 22 nt, Human
ccagcccuguaaggaugaggca

SEQ ID NO: 572557 - RNA, 22 nt, Human
gccuggcucugaguuucucucc

SEQ ID NO: 572558 - RNA, 22 nt, Human
cucagggaagcuauggugaggg

SEQ ID NO: 572559 - RNA, 21 nt, Human
cgcuccaccccacccacuggc

SEQ ID NO: 572560 - RNA, 22 nt, Human
aucuuuguugcucucauuucug

SEQ ID NO: 572561 - RNA, 23 nt, Human
uuucuucucgaagagggagcuua

SEQ ID NO: 572562 - RNA, 22 nt, Human
guuauugagguggagucucacu

SEQ ID NO: 572563 - RNA, 23 nt, Human
uccaggagcaugcuggcuggcga

SEQ ID NO: 572564 - RNA, 22 nt, Human
guccugggagaugggacccuga

SEQ ID NO: 572565 - RNA, 22 nt, Human
auuguacaugcagugagucauc

SEQ ID NO: 572566 - RNA, 22 nt, Human
augauauagagaguagauuaaa

SEQ ID NO: 572567 - RNA, 22 nt, Human
gacccugagcaaaagcaguucu

SEQ ID NO: 572568 - RNA, 22 nt, Human
gccugcagggccugggccuacc

SEQ ID NO: 572569 - RNA, 22 nt, Human
agcagcuauuucuuccagagag

SEQ ID NO: 572570 - RNA, 22 nt, Human
uagaauaguguuuucauuaugg

SEQ ID NO: 572571 - RNA, 22 nt, Human
ggagggccaucuugggugugau

SEQ ID NO: 572572 - RNA, 22 nt, Human
cccuggugguacggcacuggca

SEQ ID NO: 572573 - RNA, 22 nt, Human
agugucugaaccaccggggcau

SEQ ID NO: 572574 - RNA, 22 nt, Human
ucccagauuguugauggcuuaa

SEQ ID NO: 572575 - RNA, 22 nt, Human
aaauacuguuuuauuccaugau

SEQ ID NO: 572576 - RNA, 22 nt, Human
ugcacacauguuuacaagcauc

SEQ ID NO: 572577 - RNA, 22 nt, Human
cugagcugguggaagcaugcag

SEQ ID NO: 572578 - RNA, 22 nt, Human
uuuacucuugcuacacaacugu

SEQ ID NO: 572579 - RNA, 22 nt, Human
aacuaaaacugguuuguucucu

SEQ ID NO: 572580 - RNA, 22 nt, Human
ucuccugauaucugcagaccua

SEQ ID NO: 572581 - RNA, 23 nt, Human
gccugggacugguagugugaccu

SEQ ID NO: 572582 - RNA, 22 nt, Human
uuuuauauugagugagaguucc

SEQ ID NO: 572583 - RNA, 21 nt, Human
ucuggagcccuaagcugagaa

SEQ ID NO: 572584 - RNA, 22 nt, Human
augcauguuaagcucuuaaaau

SEQ ID NO: 572585 - RNA, 22 nt, Human
cggaggcaaacucaccuggcuc

SEQ ID NO: 572586 - RNA, 22 nt, Human
cugcugucaaaggaaauauuug

SEQ ID NO: 572587 - RNA, 22 nt, Human
guugugcagaagugccucagua

SEQ ID NO: 572588 - RNA, 22 nt, Human
cagcucuuaacacagcuuguau

SEQ ID NO: 572589 - RNA, 22 nt, Human
auauuacauaaacaugagugaa

SEQ ID NO: 572590 - RNA, 22 nt, Human
agguagaagagcaaggaauaac

SEQ ID NO: 572591 - RNA, 22 nt, Human
aggcccuguccauggugcugaa

SEQ ID NO: 572592 - RNA, 22 nt, Human
uccauccauguaggaagauggu

SEQ ID NO: 572593 - RNA, 22 nt, Human
uccgauaagcaauucuugugcu

SEQ ID NO: 572594 - RNA, 22 nt, Human
gccugccuggagcuugagguga

SEQ ID NO: 572595 - RNA, 22 nt, Human
cagaaaugacaaaguaagagga

SEQ ID NO: 572596 - RNA, 22 nt, Human
agcugcugagccaggcugaugu

SEQ ID NO: 572597 - RNA, 22 nt, Human
cugagcuguuacucuguccucg

SEQ ID NO: 572598 - RNA, 22 nt, Human
ucuuagaaacuguaucgauuag

SEQ ID NO: 572599 - RNA, 22 nt, Human
ucaggacagggaucacaucauc

SEQ ID NO: 572600 - RNA, 22 nt, Human
gucuuucugccaugugaagaga

SEQ ID NO: 572601 - RNA, 22 nt, Human
ugaguucucaugaaaucuaguu

SEQ ID NO: 572602 - RNA, 22 nt, Human
gcuggggccucugugagguuaa

SEQ ID NO: 572603 - RNA, 19 nt, Human
ugcauaaauuauauacuuu

SEQ ID NO: 572604 - RNA, 22 nt, Human
gucuccugaggcauccauugaa

SEQ ID NO: 572605 - RNA, 22 nt, Human
guccucuguagggcugggccac

SEQ ID NO: 572606 - RNA, 22 nt, Human
acuggacagaggaaauauggag

SEQ ID NO: 572607 - RNA, 22 nt, Human
acagcaaaagacaagaacuuaa

SEQ ID NO: 572608 - RNA, 22 nt, Human
ugagaauuuuuggcagaaacaa

SEQ ID NO: 572609 - RNA, 18 nt, Human
ccacagcagaguucuuac

SEQ ID NO: 572610 - RNA, 22 nt, Human
aagacauguuuuaagaauauuu

SEQ ID NO: 572611 - RNA, 18 nt, Human
cagaggagagacauucag

SEQ ID NO: 572612 - RNA, 22 nt, Human
ugugccuacugauagagccaag

SEQ ID NO: 572613 - RNA, 22 nt, Human
auaugcacauacauacauaggu

SEQ ID NO: 572614 - RNA, 22 nt, Human
ugggccaguuucucauugaaau

SEQ ID NO: 572615 - RNA, 23 nt, Human
gggagaugggaaaugaaggcucu

SEQ ID NO: 572616 - RNA, 22 nt, Human
auauacuuuucacuaauggcua

SEQ ID NO: 572617 - RNA, 22 nt, Human
aggcugaggaucguacuuucca

SEQ ID NO: 572618 - RNA, 22 nt, Human
gcaggaagaggcucgaagcccc

SEQ ID NO: 572619 - RNA, 22 nt, Human
aacuccuaugacccacugaacu

SEQ ID NO: 572620 - RNA, 22 nt, Human
ucccagccuuucuuuucugcug

SEQ ID NO: 572621 - RNA, 23 nt, Human
auuuccuacuauaaaagagguaa

SEQ ID NO: 572622 - RNA, 22 nt, Human
agagagcccgggccagggcaca

SEQ ID NO: 572623 - RNA, 22 nt, Human
uuaauuuauguccaaaccagau

SEQ ID NO: 572624 - RNA, 22 nt, Human
ugaaugauguauaauauugaga

SEQ ID NO: 572625 - RNA, 22 nt, Human
gaauucuucugucuuuaacuga

SEQ ID NO: 572626 - RNA, 22 nt, Human
auaaauagugugucauaaaguc

SEQ ID NO: 572627 - RNA, 21 nt, Human
ccuggagacaaagacagggug

SEQ ID NO: 572628 - RNA, 22 nt, Human
augcauauggcuugagggaaua

SEQ ID NO: 572629 - RNA, 22 nt, Human
acacuuuaguaugaagagguag

SEQ ID NO: 572630 - RNA, 22 nt, Human
cuggcuuugaaggucuuuccua

SEQ ID NO: 572631 - RNA, 22 nt, Human
cugugccuggggggcagagcug

SEQ ID NO: 572632 - RNA, 22 nt, Human
ccaggcugcagucaaggggcau

SEQ ID NO: 572633 - RNA, 22 nt, Human
ugcagggcacacgcacgggugu

SEQ ID NO: 572634 - RNA, 22 nt, Human
cagggccuuuuagcaucuucuc

SEQ ID NO: 572635 - RNA, 22 nt, Human
cuagggaguggcagagcuggga

SEQ ID NO: 572636 - RNA, 22 nt, Human
uuaugacagaaaugaaaagcug

SEQ ID NO: 572637 - RNA, 22 nt, Human
cugucccagauguucucagcac

SEQ ID NO: 572638 - RNA, 22 nt, Human
cucuuuguggaacggcaguguc

SEQ ID NO: 572639 - RNA, 22 nt, Human
aggucacacuuggaucauagaa

SEQ ID NO: 572640 - RNA, 22 nt, Human
cuggcagcauuaacagagagca

SEQ ID NO: 572641 - RNA, 22 nt, Human
ucucauaauuagguaagucaga

SEQ ID NO: 572642 - RNA, 22 nt, Human
uggaaugucagcuacaagaggg

SEQ ID NO: 572643 - RNA, 22 nt, Human
uggaggagaccauuccacucag

SEQ ID NO: 572644 - RNA, 22 nt, Human
cagagcugguaagugguagagg

SEQ ID NO: 572645 - RNA, 22 nt, Human
ucugagggaauagcuauuguag

SEQ ID NO: 572646 - RNA, 20 nt, Human
accuugaacccgccagccau

SEQ ID NO: 572647 - RNA, 22 nt, Human
ucucuuuaaaaauagugaaaua

SEQ ID NO: 572648 - RNA, 22 nt, Human
guuccuaaauuugaaggacuuu

SEQ ID NO: 572649 - RNA, 22 nt, Human
agcuccaggaucugaaaguucg

SEQ ID NO: 572650 - RNA, 22 nt, Human
gggcagguggccucuuguacua

SEQ ID NO: 572651 - RNA, 22 nt, Human
gccaggcauuuguuaggugcug

SEQ ID NO: 572652 - RNA, 22 nt, Human
ucaggcuguauaucuugcacuc

SEQ ID NO: 572653 - RNA, 22 nt, Human
gcccugggauuggguggaggcu

SEQ ID NO: 572654 - RNA, 22 nt, Human
guauaaacauggagugcauucu

SEQ ID NO: 572655 - RNA, 22 nt, Human
aagguacagggaaggagcaaga

SEQ ID NO: 572656 - RNA, 22 nt, Human
ucuccugguauguaugcaccug

SEQ ID NO: 572657 - RNA, 22 nt, Human
gucaccagcaccaaugccacau

SEQ ID NO: 572658 - RNA, 20 nt, Human
ugcagcugguuucacaggga

SEQ ID NO: 572659 - RNA, 22 nt, Human
aauaauagcagaguuuacaauc

SEQ ID NO: 572660 - RNA, 22 nt, Human
uagcagugcccuguggaauaag

SEQ ID NO: 572661 - RNA, 22 nt, Human
uccuccuuguuuugucucugcu

SEQ ID NO: 572662 - RNA, 22 nt, Human
ggaguucacugugcaggcucug

SEQ ID NO: 572663 - RNA, 20 nt, Human
agugugcauuuagagucugc

SEQ ID NO: 572664 - RNA, 22 nt, Human
aaauagacaggcuuaaauagga

SEQ ID NO: 572665 - RNA, 22 nt, Human
gcaguguuccuucuacuggggc

SEQ ID NO: 572666 - RNA, 22 nt, Human
aguccuuaugugguggagagag

SEQ ID NO: 572667 - RNA, 21 nt, Human
uaauacugaaagugacaucug

SEQ ID NO: 572668 - RNA, 21 nt, Human
gugaagacuuugccuuuaaga

SEQ ID NO: 572669 - RNA, 22 nt, Human
caggcccagugaucagggcucu

SEQ ID NO: 572670 - RNA, 22 nt, Human
ucauacauaacuuguacaguga

SEQ ID NO: 572671 - RNA, 22 nt, Human
aagccagaucaaaguguccagg

SEQ ID NO: 572672 - RNA, 22 nt, Human
uuauucuuuaaacauauauguu

SEQ ID NO: 572673 - RNA, 22 nt, Human
aucuucccaggcuggggagagg

SEQ ID NO: 572674 - RNA, 22 nt, Human
cauaauuauaaacgcaaguuca

SEQ ID NO: 572675 - RNA, 22 nt, Human
uaggaacauaugcagugcuuuu

SEQ ID NO: 572676 - RNA, 22 nt, Human
aacugguucucuuuugcuugug

SEQ ID NO: 572677 - RNA, 22 nt, Human
aauaaacaaaucuuuccugugg

SEQ ID NO: 572678 - RNA, 22 nt, Human
cucugugcuuaugcuccauggg

SEQ ID NO: 572679 - RNA, 22 nt, Human
cccagagccgguggugcucaca

SEQ ID NO: 572680 - RNA, 22 nt, Human
ccugccugucaucgccugcgcc

SEQ ID NO: 572681 - RNA, 22 nt, Human
ugucuccuacugccuguggauc

SEQ ID NO: 572682 - RNA, 22 nt, Human
uuccagugaccauagaguaugg

SEQ ID NO: 572683 - RNA, 22 nt, Human
aguuuuaugcaguguucugaua

SEQ ID NO: 572684 - RNA, 22 nt, Human
agugcagaguacauuuguggca

SEQ ID NO: 572685 - RNA, 22 nt, Human
ugggagcaccuugagggcagaa

SEQ ID NO: 572686 - RNA, 22 nt, Human
ggcugagaaggagugggugagg

SEQ ID NO: 572687 - RNA, 22 nt, Human
cagucucugugccagauccugg

SEQ ID NO: 572688 - RNA, 22 nt, Human
ucagcacugaaauucuucacau

SEQ ID NO: 572689 - RNA, 20 nt, Human
uggacaggggcauagguugc

SEQ ID NO: 572690 - RNA, 22 nt, Human
acuucccacacccuguuuucuc

SEQ ID NO: 572691 - RNA, 22 nt, Human
auaugugugcacauauguauuu

SEQ ID NO: 572692 - RNA, 22 nt, Human
cagcuuugucugauuccucuuu

SEQ ID NO: 572693 - RNA, 22 nt, Human
gaagauaacuuuaaaaaguggc

SEQ ID NO: 572694 - RNA, 22 nt, Human
uucugaaggcuccucaggaaag

SEQ ID NO: 572695 - RNA, 22 nt, Human
acauuucucauucuccccuaac

SEQ ID NO: 572696 - RNA, 22 nt, Human
guacuuuaagacuccaguagca

SEQ ID NO: 572697 - RNA, 22 nt, Human
gauuucuaaggaggcugaacuu

SEQ ID NO: 572698 - RNA, 22 nt, Human
cuuucucuucagcacccagccc

SEQ ID NO: 572699 - RNA, 22 nt, Human
gccuccugacuuacacugagcu

SEQ ID NO: 572700 - RNA, 22 nt, Human
ccuggagaggcgcugcagagga

SEQ ID NO: 572701 - RNA, 22 nt, Human
uugaugcacuauguaacuuaca

SEQ ID NO: 572702 - RNA, 22 nt, Human
auauguuuuucacagguuuaag

SEQ ID NO: 572703 - RNA, 22 nt, Human
uaaauuauggcuggcagagcag

SEQ ID NO: 572704 - RNA, 22 nt, Human
ggcucugggccagaguuggcuu

SEQ ID NO: 572705 - RNA, 22 nt, Human
gugccaggcccagggagcgggg

SEQ ID NO: 572706 - RNA, 22 nt, Human
uagcagggccaggcugggaacc

SEQ ID NO: 572707 - RNA, 22 nt, Human
aggaugugaguggacacagucc

SEQ ID NO: 572708 - RNA, 22 nt, Human
augaggccauggcugucacuaa

SEQ ID NO: 572709 - RNA, 22 nt, Human
ccugcagccguccuguuugucu

SEQ ID NO: 572710 - RNA, 22 nt, Human
gcagauggaaagugcuugaggg

SEQ ID NO: 572711 - RNA, 22 nt, Human
uuuuagaaauacugauuuagug

SEQ ID NO: 572712 - RNA, 22 nt, Human
uuccuaacuggccuuuauggau

SEQ ID NO: 572713 - RNA, 21 nt, Human
auuuacaaaacagucccuucc

SEQ ID NO: 572714 - RNA, 22 nt, Human
agcaagcauugcugguuagguc

SEQ ID NO: 572715 - RNA, 22 nt, Human
uaggccagcccuuaguccuguc

SEQ ID NO: 572716 - RNA, 22 nt, Human
aagcugccaaugguaagcugcu

SEQ ID NO: 572717 - RNA, 22 nt, Human
uagcuuaacagcaaaacuguug

SEQ ID NO: 572718 - RNA, 23 nt, Human
uugaaagguagcuggcagcuaga

SEQ ID NO: 572719 - RNA, 22 nt, Human
cagugcagaggccagggaggau

SEQ ID NO: 572720 - RNA, 22 nt, Human
agcuuacaguucaaugacaaag

SEQ ID NO: 572721 - RNA, 22 nt, Human
aagacaucagugaugacauuug

SEQ ID NO: 572722 - RNA, 22 nt, Human
ggacauuuuucuuccuacaaug

SEQ ID NO: 572723 - RNA, 22 nt, Human
ugagguagaaaaagcuuguagu

SEQ ID NO: 572724 - RNA, 19 nt, Human
ugaaggagggggauggcca

SEQ ID NO: 572725 - RNA, 22 nt, Human
ucccggcgcugggagguggguc

SEQ ID NO: 572726 - RNA, 22 nt, Human
cccagcucaucaggagccgccc

SEQ ID NO: 572727 - RNA, 22 nt, Human
uuucuuauacuauauugucauc

SEQ ID NO: 572728 - RNA, 22 nt, Human
gaaaaugagccucagcuacauu

SEQ ID NO: 572729 - RNA, 22 nt, Human
cugaggugcuauggaggauacg

SEQ ID NO: 572730 - RNA, 22 nt, Human
gcguggugcugcccugcacaca

SEQ ID NO: 572731 - RNA, 22 nt, Human
ggcugugcccucacauggggca

SEQ ID NO: 572732 - RNA, 22 nt, Human
agcccugggcuguagauaagca

SEQ ID NO: 572733 - RNA, 22 nt, Human
acagcagccugcagcccugugu

SEQ ID NO: 572734 - RNA, 20 nt, Human
uucugaaagcagcagaggga

SEQ ID NO: 572735 - RNA, 22 nt, Human
uaucauuuguuauuauuagugg

SEQ ID NO: 572736 - RNA, 22 nt, Human
agcaaacagugugcuaagaaau

SEQ ID NO: 572737 - RNA, 22 nt, Human
guuuguaagcagucugcuugug

SEQ ID NO: 572738 - RNA, 22 nt, Human
caaugauucugcaacugugugc

SEQ ID NO: 572739 - RNA, 22 nt, Human
uugaaaaaauugguagaggaug

SEQ ID NO: 572740 - RNA, 19 nt, Human
agagaaggauccuaugguu

SEQ ID NO: 572741 - RNA, 22 nt, Human
gugagcaguuguauaaagacuu

SEQ ID NO: 572742 - RNA, 19 nt, Human
uaguggagugacaaguucu

SEQ ID NO: 572743 - RNA, 22 nt, Human
gcagagcaccaaagugaaagau

SEQ ID NO: 572744 - RNA, 20 nt, Human
gcagcugaaaguaugacacc

SEQ ID NO: 572745 - RNA, 19 nt, Human
gcugugugaccuugggcaa

SEQ ID NO: 572746 - RNA, 22 nt, Human
aucaccaggcaaaaugucagag

SEQ ID NO: 572747 - RNA, 22 nt, Human
uauauuaaacccucucuguagg

SEQ ID NO: 572748 - RNA, 22 nt, Human
aaaguuacaguaauucagugua

SEQ ID NO: 572749 - RNA, 22 nt, Human
acacauguacagauuaguauuu

SEQ ID NO: 572750 - RNA, 22 nt, Human
aguucucuuggaaguuauguga

SEQ ID NO: 572751 - RNA, 22 nt, Human
ggagaaagaagacgaacauugu

SEQ ID NO: 572752 - RNA, 21 nt, Human
aggaauguguauauauacaau

SEQ ID NO: 572753 - RNA, 23 nt, Human
ucucagaaaggagaaguaauuug

SEQ ID NO: 572754 - RNA, 22 nt, Human
aauggcaccuucaagaagaaaa

SEQ ID NO: 572755 - RNA, 22 nt, Human
gggagcuguaagggacagguag

SEQ ID NO: 572756 - RNA, 22 nt, Human
gggaauguugacugagagcagg

SEQ ID NO: 572757 - RNA, 22 nt, Human
cucagggagguccugugcugaa

SEQ ID NO: 572758 - RNA, 23 nt, Human
uuacuuuugcaccaaccuaauau

SEQ ID NO: 572759 - RNA, 22 nt, Human
ggguccagacacuccagaggaa

SEQ ID NO: 572760 - RNA, 21 nt, Human
augauucugcaaaugaguagu

SEQ ID NO: 572761 - RNA, 22 nt, Human
auuaaauuagcaaacugugaaa

SEQ ID NO: 572762 - RNA, 20 nt, Human
auguuaaauagcauuuagag

SEQ ID NO: 572763 - RNA, 22 nt, Human
uggggcagcuccaucuauucca

SEQ ID NO: 572764 - RNA, 22 nt, Human
ucuuagaaaugaaguucuuucu

SEQ ID NO: 572765 - RNA, 22 nt, Human
ucagugcuaaaagagcuggugu

SEQ ID NO: 572766 - RNA, 22 nt, Human
uuuauucugugcuacaugaaga

SEQ ID NO: 572767 - RNA, 22 nt, Human
acuuaaaaagaaucuuuucacg

SEQ ID NO: 572768 - RNA, 22 nt, Human
uggcaaggaagagccuggugca

SEQ ID NO: 572769 - RNA, 23 nt, Human
uguaggcuguaguuuguaggucc

SEQ ID NO: 572770 - RNA, 22 nt, Human
uggcaggaaauacccugccuag

SEQ ID NO: 572771 - RNA, 22 nt, Human
aaaggaauauucaaaacaguca

SEQ ID NO: 572772 - RNA, 22 nt, Human
gaauaucugucugguugaggaa

SEQ ID NO: 572773 - RNA, 22 nt, Human
ugucccagcagcuggguucucu

SEQ ID NO: 572774 - RNA, 22 nt, Human
gcugucuccauagcuguguguc

SEQ ID NO: 572775 - RNA, 22 nt, Human
uacugugugauuccauuuacgu

SEQ ID NO: 572776 - RNA, 22 nt, Human
augggcuggcagccugaacagc

SEQ ID NO: 572777 - RNA, 22 nt, Human
agugacagcugggaaggugaaa

SEQ ID NO: 572778 - RNA, 22 nt, Human
ggaccaucucuagccagagcuu

SEQ ID NO: 572779 - RNA, 22 nt, Human
gcaguggcuaggagucuggcgu

SEQ ID NO: 572780 - RNA, 22 nt, Human
aaauauccucagggcagaggug

SEQ ID NO: 572781 - RNA, 22 nt, Human
uuauugaagcaagcuuuucuga

SEQ ID NO: 572782 - RNA, 21 nt, Human
acuccaaacaaguuaagcugu

SEQ ID NO: 572783 - RNA, 22 nt, Human
aaacaguauuaucaauauauuu

SEQ ID NO: 572784 - RNA, 22 nt, Human
uuucauaauacuguacaugaaa

SEQ ID NO: 572785 - RNA, 22 nt, Human
aagaaagugcuuuguaaauuau

SEQ ID NO: 572786 - RNA, 22 nt, Human
uucauuccuucuguaccuugcc

SEQ ID NO: 572787 - RNA, 22 nt, Human
caggagugucgggucacuaggu

SEQ ID NO: 572788 - RNA, 22 nt, Human
agaagccaaucagcucucugcu

SEQ ID NO: 572789 - RNA, 22 nt, Human
aagcaagaggaaauguggaccu

SEQ ID NO: 572790 - RNA, 22 nt, Human
agcaauuucccaucucuucugc

SEQ ID NO: 572791 - RNA, 22 nt, Human
gccagcagggcccaaaugcugg

SEQ ID NO: 572792 - RNA, 22 nt, Human
aaggcagcaccgccuccugaaa

SEQ ID NO: 572793 - RNA, 22 nt, Human
aacaaaguacuuuucagugcuu

SEQ ID NO: 572794 - RNA, 22 nt, Human
gcuguacauuuguguacacuug

SEQ ID NO: 572795 - RNA, 22 nt, Human
ucucaaacuaacaaugauuaua

SEQ ID NO: 572796 - RNA, 22 nt, Human
uggcccugugacugaguucuag

SEQ ID NO: 572797 - RNA, 22 nt, Human
uaugcuuugcaauuggaaaagg

SEQ ID NO: 572798 - RNA, 22 nt, Human
cccaggcuggccuccgcagugc

SEQ ID NO: 572799 - RNA, 22 nt, Human
augccaggagauggagcagagu

SEQ ID NO: 572800 - RNA, 22 nt, Human
cagucucuuuucagcuccaucc

SEQ ID NO: 572801 - RNA, 22 nt, Human
aaaaugaauaaguuaacccagg

SEQ ID NO: 572802 - RNA, 22 nt, Human
aggcugagccacggggcuggcu

SEQ ID NO: 572803 - RNA, 22 nt, Human
aucaauaucagaucagacagga

SEQ ID NO: 572804 - RNA, 22 nt, Human
agagcuuuucuguaauaacauc

SEQ ID NO: 572805 - RNA, 22 nt, Human
aggcacagggaugcggagccag

SEQ ID NO: 572806 - RNA, 22 nt, Human
cugauucuaggcguuccucuca

SEQ ID NO: 572807 - RNA, 22 nt, Human
uguucuuucaguuagacacagu

SEQ ID NO: 572808 - RNA, 22 nt, Human
aaugaacagugggugagguacc

SEQ ID NO: 572809 - RNA, 22 nt, Human
aagcagaggaccgacggaggga

SEQ ID NO: 572810 - RNA, 22 nt, Human
uacaaaacagugcucugguccu

SEQ ID NO: 572811 - RNA, 22 nt, Human
ggguaggaugguagaagggacc

SEQ ID NO: 572812 - RNA, 22 nt, Human
uguuacaauauuaucaacugag

SEQ ID NO: 572813 - RNA, 22 nt, Human
uccuugaaaaucuugguuuaga

SEQ ID NO: 572814 - RNA, 22 nt, Human
agcuaaggaacucuguaacacc

SEQ ID NO: 572815 - RNA, 22 nt, Human
gcagcaggcuuuucauaccuug

SEQ ID NO: 572816 - RNA, 21 nt, Human
agcccuuaggacauaagagag

SEQ ID NO: 572817 - RNA, 22 nt, Human
cugcaguugggugacccaauau

SEQ ID NO: 572818 - RNA, 22 nt, Human
aagccaggccauucucugguuc

SEQ ID NO: 572819 - RNA, 22 nt, Human
agcauuaagccuggcucagagg

SEQ ID NO: 572820 - RNA, 22 nt, Human
auuguuaauaacuauuacauug

SEQ ID NO: 572821 - RNA, 22 nt, Human
ucuguacauuuggggaccccag

SEQ ID NO: 572822 - RNA, 22 nt, Human
aauaaacuuccacuguguuuuu

SEQ ID NO: 572823 - RNA, 22 nt, Human
cagggucugaugguccucacuu

SEQ ID NO: 572824 - RNA, 20 nt, Human
aggaaaaggguggugguaga

SEQ ID NO: 572825 - RNA, 22 nt, Human
acagcaaugaguaacuccuugg

SEQ ID NO: 572826 - RNA, 22 nt, Human
aagcaacuguugaauuggacua

SEQ ID NO: 572827 - RNA, 22 nt, Human
cugggaugugaggagcgccucu

SEQ ID NO: 572828 - RNA, 22 nt, Human
ucccagagcaguacuccaggag

SEQ ID NO: 572829 - RNA, 22 nt, Human
gcaccaggcuuagagccccagg

SEQ ID NO: 572830 - RNA, 22 nt, Human
gcuguauuccugcacuguauag

SEQ ID NO: 572831 - RNA, 22 nt, Human
gccucugcaucaucacuccagc

SEQ ID NO: 572832 - RNA, 22 nt, Human
accaggcuguugggcccagugu

SEQ ID NO: 572833 - RNA, 22 nt, Human
ggaggaagcacacggcuuguau

SEQ ID NO: 572834 - RNA, 22 nt, Human
cucugugguuagacuauggcug

SEQ ID NO: 572835 - RNA, 22 nt, Human
accugucuauaaaagugaauac

SEQ ID NO: 572836 - RNA, 22 nt, Human
uugucugucccagcuugugcau

SEQ ID NO: 572837 - RNA, 22 nt, Human
gguggcagcauggucccagugu

SEQ ID NO: 572838 - RNA, 22 nt, Human
ggcuucucucuucacauggcuu

SEQ ID NO: 572839 - RNA, 21 nt, Human
uccagcuccugccacuccuua

SEQ ID NO: 572840 - RNA, 22 nt, Human
ucacauuugauaaugcccauug

SEQ ID NO: 572841 - RNA, 22 nt, Human
uuacaaguuucuggcuucaucc

SEQ ID NO: 572842 - RNA, 22 nt, Human
aagggagaggagggucuuguug

SEQ ID NO: 572843 - RNA, 22 nt, Human
gaauagauaagugacuauuugg

SEQ ID NO: 572844 - RNA, 22 nt, Human
agcuucucaggagucugaggca

SEQ ID NO: 572845 - RNA, 22 nt, Human
uguccccaagguucagcccaca

SEQ ID NO: 572846 - RNA, 22 nt, Human
aaacuagagcaugugaguggga

SEQ ID NO: 572847 - RNA, 22 nt, Human
uacuguacugcaguucugcaaa

SEQ ID NO: 572848 - RNA, 22 nt, Human
cuccugggaggaugcggacccg

SEQ ID NO: 572849 - RNA, 22 nt, Human
cucaaagacaaaaaucugaggu

SEQ ID NO: 572850 - RNA, 22 nt, Human
caguccuugcucaaagucuaca

SEQ ID NO: 572851 - RNA, 22 nt, Human
acuaaauaguuuugacagaaca

SEQ ID NO: 572852 - RNA, 22 nt, Human
ugggagcuccuggagggcagga

SEQ ID NO: 572853 - RNA, 22 nt, Human
ugcccugccaagaccaaguggu

SEQ ID NO: 572854 - RNA, 20 nt, Human
uccagcauauaaacuccucu

SEQ ID NO: 572855 - RNA, 22 nt, Human
aggaaugucgucauaaacauga

SEQ ID NO: 572856 - RNA, 22 nt, Human
cuggccagguuuugaacaguug

SEQ ID NO: 572857 - RNA, 22 nt, Human
ccaguguuccauggagugauua

SEQ ID NO: 572858 - RNA, 22 nt, Human
ucucucuucaugcuuuuagaau

SEQ ID NO: 572859 - RNA, 22 nt, Human
aacagcuuugugcucagauuug

SEQ ID NO: 572860 - RNA, 22 nt, Human
ucugggcuggugcucaugaauu

SEQ ID NO: 572861 - RNA, 22 nt, Human
uuauugacuuguuuguccuggu

SEQ ID NO: 572862 - RNA, 22 nt, Human
uaaagacacugguuuuaaucau

SEQ ID NO: 572863 - RNA, 22 nt, Human
auauuauucuaguaacagugau

SEQ ID NO: 572864 - RNA, 22 nt, Human
aaugguuacagaaaugaaagua

SEQ ID NO: 572865 - RNA, 22 nt, Human
agaauauugaaaguucuugaca

SEQ ID NO: 572866 - RNA, 19 nt, Human
cagugcccgacgcaggucu

SEQ ID NO: 572867 - RNA, 22 nt, Human
cucuuagcugcuguucuuugag

SEQ ID NO: 572868 - RNA, 22 nt, Human
ggugaaauguagucuugugaga

SEQ ID NO: 572869 - RNA, 22 nt, Human
gcauuccugagaaugcagagug

SEQ ID NO: 572870 - RNA, 22 nt, Human
cugggacuuguagucucggcgc

SEQ ID NO: 572871 - RNA, 22 nt, Human
aacaacagcugcuaaagaguug

SEQ ID NO: 572872 - RNA, 22 nt, Human
uggcgcaguuucucugcugccu

SEQ ID NO: 572873 - RNA, 22 nt, Human
augaaaacggaccagagcuauu

SEQ ID NO: 572874 - RNA, 22 nt, Human
augcugacagacuauuaacuau

SEQ ID NO: 572875 - RNA, 22 nt, Human
gagcugcagcggcugacgcaac

SEQ ID NO: 572876 - RNA, 22 nt, Human
cuucucccuggcuucugcacac

SEQ ID NO: 572877 - RNA, 22 nt, Human
ggcccacacugacagcugagcu

SEQ ID NO: 572878 - RNA, 22 nt, Human
agcagguguauauaaggcugag

SEQ ID NO: 572879 - RNA, 20 nt, Human
cugaaagacguaacagugca

SEQ ID NO: 572880 - RNA, 22 nt, Human
cagcagcugguuauaccugugg

SEQ ID NO: 572881 - RNA, 22 nt, Human
agauggcugggagcucuguuug

SEQ ID NO: 572882 - RNA, 22 nt, Human
aagggggcggcagccaguggaa

SEQ ID NO: 572883 - RNA, 22 nt, Human
ucugucaccccuguuucuggcu

SEQ ID NO: 572884 - RNA, 22 nt, Human
agcauguguggagaaauauuuu

SEQ ID NO: 572885 - RNA, 22 nt, Human
auguuugucaggauuguaauua

SEQ ID NO: 572886 - RNA, 22 nt, Human
uuauuguuuggguauaauuuga

SEQ ID NO: 572887 - RNA, 21 nt, Human
gaggacugcacacucugauug

SEQ ID NO: 572888 - RNA, 22 nt, Human
ugugcaaaguguacaaauuaau

SEQ ID NO: 572889 - RNA, 22 nt, Human
ggagacacuggaaaguauuaca

SEQ ID NO: 572890 - RNA, 22 nt, Human
gcccagagagaugaagugaugg

SEQ ID NO: 572891 - RNA, 22 nt, Human
ugacauaaguugguagaaagga

SEQ ID NO: 572892 - RNA, 22 nt, Human
cccuggagugugacgaggcauu

SEQ ID NO: 572893 - RNA, 22 nt, Human
ccaacagguguucuguuuuuca

SEQ ID NO: 572894 - RNA, 22 nt, Human
cuagguggugguggguugacau

SEQ ID NO: 572895 - RNA, 22 nt, Human
ggccccagcagugcuuguuuau

SEQ ID NO: 572896 - RNA, 22 nt, Human
uggagcagccaugaugacagag

SEQ ID NO: 572897 - RNA, 22 nt, Human
acagcuggcaggggggcaugaa

SEQ ID NO: 572898 - RNA, 22 nt, Human
gucccucacuggaccauaugaa

SEQ ID NO: 572899 - RNA, 19 nt, Human
cagaacaggaccaggggcc

SEQ ID NO: 572900 - RNA, 22 nt, Human
uaaagcaauuugagcaaguucu

SEQ ID NO: 572901 - RNA, 22 nt, Human
gcacuuuguggauuguauuucc

SEQ ID NO: 572902 - RNA, 22 nt, Human
uuacaaugggagcccuuggacu

SEQ ID NO: 572903 - RNA, 22 nt, Human
uuuauuguuuagaagggggcug

SEQ ID NO: 572904 - RNA, 22 nt, Human
gcuguggaguacagagcugguu

SEQ ID NO: 572905 - RNA, 22 nt, Human
uuccuaacacaguguaagcaag

SEQ ID NO: 572906 - RNA, 22 nt, Human
gcagcugauggaaguccuauug

SEQ ID NO: 572907 - RNA, 22 nt, Human
uucccagagauaagacgucuua

SEQ ID NO: 572908 - RNA, 23 nt, Human
uuauggagugccagacauuuggc

SEQ ID NO: 572909 - RNA, 22 nt, Human
gaaaugcauggaucuuggcaga

SEQ ID NO: 572910 - RNA, 22 nt, Human
ucugcaggaggcuggcugcagg

SEQ ID NO: 572911 - RNA, 22 nt, Human
ugcagaaggccugacauugcac

SEQ ID NO: 572912 - RNA, 22 nt, Human
agcacagguaauacagaguaac

SEQ ID NO: 572913 - RNA, 22 nt, Human
ucuaguucuagaucccugagga

SEQ ID NO: 572914 - RNA, 22 nt, Human
acaguguucacuuaacaaugga

SEQ ID NO: 572915 - RNA, 22 nt, Human
cauccacuagaaugacagaguu

SEQ ID NO: 572916 - RNA, 22 nt, Human
acaauauuguacccagaaguuu

SEQ ID NO: 572917 - RNA, 22 nt, Human
ucagacagugugaucagucucu

SEQ ID NO: 572918 - RNA, 22 nt, Human
cuccugggcucaagugauccuc

SEQ ID NO: 572919 - RNA, 22 nt, Human
uucuaguucauauucucaaaga

SEQ ID NO: 572920 - RNA, 20 nt, Human
auguaaaagacagggaguag

SEQ ID NO: 572921 - RNA, 22 nt, Human
uacagugcuugguaucuaguaa

SEQ ID NO: 572922 - RNA, 22 nt, Human
uaaugacugccgucucucuuca

SEQ ID NO: 572923 - RNA, 22 nt, Human
aaguuccuauauccaaauacag

SEQ ID NO: 572924 - RNA, 22 nt, Human
aguuuacaguucucaucgcaac

SEQ ID NO: 572925 - RNA, 22 nt, Human
ggguggcauagggugauggcuu

SEQ ID NO: 572926 - RNA, 22 nt, Human
agaaaacauaggagacaggaaa

SEQ ID NO: 572927 - RNA, 19 nt, Human
gauuuaaacguggcucuau

SEQ ID NO: 572928 - RNA, 22 nt, Human
uauaaaacagaaagcacuaccu

SEQ ID NO: 572929 - RNA, 22 nt, Human
ccugagguugaaguauaaauug

SEQ ID NO: 572930 - RNA, 22 nt, Human
agcuguccuggcucaggcugug

SEQ ID NO: 572931 - RNA, 22 nt, Human
ccugggagggcaagugcugaug

SEQ ID NO: 572932 - RNA, 22 nt, Human
uaugaagauugcggucuggaau

SEQ ID NO: 572933 - RNA, 22 nt, Human
uccccugagaccccucagcacu

SEQ ID NO: 572934 - RNA, 22 nt, Human
aaggagagagcuuugcuggaac

SEQ ID NO: 572935 - RNA, 22 nt, Human
aguggcagagccaagauaugau

SEQ ID NO: 572936 - RNA, 22 nt, Human
cacacuguugaggacgagaugu

SEQ ID NO: 572937 - RNA, 22 nt, Human
uuucaguuuuugcucgauguau

SEQ ID NO: 572938 - RNA, 22 nt, Human
gcuuccuguauccuccuguacc

SEQ ID NO: 572939 - RNA, 22 nt, Human
uccucacagcaugaccaggcag

SEQ ID NO: 572940 - RNA, 22 nt, Human
cgugcuaacguuuaagguuaug

SEQ ID NO: 572941 - RNA, 22 nt, Human
ugagggaguuggguguauagga

SEQ ID NO: 572942 - RNA, 22 nt, Human
uauacacauuuuuaccuauagu

SEQ ID NO: 572943 - RNA, 22 nt, Human
ucacccagacagcuugcacuga

SEQ ID NO: 572944 - RNA, 22 nt, Human
aaagucaggcuguguaccuaac

SEQ ID NO: 572945 - RNA, 22 nt, Human
acaggugguaaaauggacuguc

SEQ ID NO: 572946 - RNA, 22 nt, Human
gcaaggcaguccuggggcccug

SEQ ID NO: 572947 - RNA, 22 nt, Human
caaggcaggcaguucacuugag

SEQ ID NO: 572948 - RNA, 22 nt, Human
aagcugccagauucagucugcu

SEQ ID NO: 572949 - RNA, 22 nt, Human
cagagccucugcccugggcacu

SEQ ID NO: 572950 - RNA, 22 nt, Human
cuauuuuaacuugauuaccucu

SEQ ID NO: 572951 - RNA, 22 nt, Human
guaucuugacuccaugccucag

SEQ ID NO: 572952 - RNA, 22 nt, Human
augacuaauggaaaauacaaug

SEQ ID NO: 572953 - RNA, 22 nt, Human
agcuguguggugucugacagcu

SEQ ID NO: 572954 - RNA, 22 nt, Human
aaagacauggcaagagaugggg

SEQ ID NO: 572955 - RNA, 22 nt, Human
uuguucauaaagacaguucaga

SEQ ID NO: 572956 - RNA, 22 nt, Human
aggcagaaaauagucauccaaa

SEQ ID NO: 572957 - RNA, 22 nt, Human
ugccagucucacccuggguccu

SEQ ID NO: 572958 - RNA, 22 nt, Human
cagaggcugagcagucaguuug

SEQ ID NO: 572959 - RNA, 22 nt, Human
acagagguggaccucagcaggc

SEQ ID NO: 572960 - RNA, 22 nt, Human
uggagggcgcuuagauggaggg

SEQ ID NO: 572961 - RNA, 22 nt, Human
cucaggcucuguacucccuuug

SEQ ID NO: 572962 - RNA, 22 nt, Human
auacuguuggcagcagaccaga

SEQ ID NO: 572963 - RNA, 22 nt, Human
ugccucauaacacuccuggagu

SEQ ID NO: 572964 - RNA, 22 nt, Human
guguggaaacagagagggcaac

SEQ ID NO: 572965 - RNA, 18 nt, Human
ggcagccuggacaugcuc

SEQ ID NO: 572966 - RNA, 22 nt, Human
uaugcuaagugagaaaagacag

SEQ ID NO: 572967 - RNA, 22 nt, Human
cuauuauuauguuaacuggacu

SEQ ID NO: 572968 - RNA, 19 nt, Human
caggaugaucccaugacac

SEQ ID NO: 572969 - RNA, 22 nt, Human
aggcuucuccacauaaaguuac

SEQ ID NO: 572970 - RNA, 22 nt, Human
uuggccacacucacuagagccc

SEQ ID NO: 572971 - RNA, 23 nt, Human
acucguggaauucucugcgaucg

SEQ ID NO: 572972 - RNA, 21 nt, Human
ucugucugguuuuagaguggc

SEQ ID NO: 572973 - RNA, 22 nt, Human
uauugaagauuuugugguugcu

SEQ ID NO: 572974 - RNA, 22 nt, Human
uaugagaacaagaacaaucucc

SEQ ID NO: 572975 - RNA, 22 nt, Human
ggaaacugcuuacacuagaggg

SEQ ID NO: 572976 - RNA, 22 nt, Human
ugcaggagcaccagcucacccu

SEQ ID NO: 572977 - RNA, 22 nt, Human
cauuauauuuuacugcauggga

SEQ ID NO: 572978 - RNA, 22 nt, Human
guggcagagccaaggcuggagc

SEQ ID NO: 572979 - RNA, 22 nt, Human
cuuccagucuuuucaguggagu

SEQ ID NO: 572980 - RNA, 22 nt, Human
guuuggggucugcagagcggcg

SEQ ID NO: 572981 - RNA, 22 nt, Human
gagaauuucccagucugugcug

SEQ ID NO: 572982 - RNA, 22 nt, Human
uacugcuucacccuugagucuu

SEQ ID NO: 572983 - RNA, 22 nt, Human
ggaggcagaauagagugugggu

SEQ ID NO: 572984 - RNA, 22 nt, Human
cauguuaaugaauuuuugcagu

SEQ ID NO: 572985 - RNA, 22 nt, Human
gggcuggaggugagcaggacag

SEQ ID NO: 572986 - RNA, 22 nt, Human
uggcaucucaaacaggcagauu

SEQ ID NO: 572987 - RNA, 22 nt, Human
aagaguuuucuauaaucuuggc

SEQ ID NO: 572988 - RNA, 22 nt, Human
gcagacuggucuucagccuugg

SEQ ID NO: 572989 - RNA, 22 nt, Human
uggcagugugggaggaagguac

SEQ ID NO: 572990 - RNA, 22 nt, Human
uuauuaagugcguacuguaugc

SEQ ID NO: 572991 - RNA, 22 nt, Human
cauacuuugggauaagagugga

SEQ ID NO: 572992 - RNA, 22 nt, Human
cagcccagcagggucuggcccu

SEQ ID NO: 572993 - RNA, 22 nt, Human
aggccaggaauccuugucccag

SEQ ID NO: 572994 - RNA, 22 nt, Human
cuaggccaguuaggaagagaag

SEQ ID NO: 572995 - RNA, 22 nt, Human
agcugcagucaagcugggccac

SEQ ID NO: 572996 - RNA, 22 nt, Human
aucaugcagguuucuccuuucu

SEQ ID NO: 572997 - RNA, 22 nt, Human
ugaugucugccaggguccuggg

SEQ ID NO: 572998 - RNA, 22 nt, Human
cucuccagaucugcugagccag

SEQ ID NO: 572999 - RNA, 22 nt, Human
gaaauccaguucccuacucuua

SEQ ID NO: 573000 - RNA, 22 nt, Human
caaauggucauuucucuuuugu

SEQ ID NO: 573001 - RNA, 22 nt, Human
uguuuguggaauauucuuuaag

SEQ ID NO: 573002 - RNA, 22 nt, Human
aaugaauaacaauccucuggag

SEQ ID NO: 573003 - RNA, 22 nt, Human
caaaaguaauugcgguuuuugc

SEQ ID NO: 573004 - RNA, 22 nt, Human
uccuucaguucaauuaguccgu

SEQ ID NO: 573005 - RNA, 22 nt, Human
uggagcagaguucagcggggag

SEQ ID NO: 573006 - RNA, 22 nt, Human
uacuuccagcaaucugcauauu

SEQ ID NO: 573007 - RNA, 22 nt, Human
aggaggcagaugcuuggcugua

SEQ ID NO: 573008 - RNA, 22 nt, Human
aaugcaaccugcugaucugaca

SEQ ID NO: 573009 - RNA, 22 nt, Human
gcagugcuaaguagcuggccca

SEQ ID NO: 573010 - RNA, 22 nt, Human
ugcugaggcauuuggacagagu

SEQ ID NO: 573011 - RNA, 22 nt, Human
aagggcagcugacagaugcuua

SEQ ID NO: 573012 - RNA, 22 nt, Human
gcaucuaauccaguccagcauc

SEQ ID NO: 573013 - RNA, 22 nt, Human
uauugccaaaugucugcuggaa

SEQ ID NO: 573014 - RNA, 22 nt, Human
accagggcugggauaggucagg

SEQ ID NO: 573015 - RNA, 22 nt, Human
ugacagcagccaccucucaccc

SEQ ID NO: 573016 - RNA, 22 nt, Human
cuucugaggcagcuauucaguu

SEQ ID NO: 573017 - RNA, 22 nt, Human
acagaaugcguagugcauguug

SEQ ID NO: 573018 - RNA, 22 nt, Human
agugucugccagcugccaggug

SEQ ID NO: 573019 - RNA, 22 nt, Human
aguaaauggcccaggguuauca

SEQ ID NO: 573020 - RNA, 22 nt, Human
ccaguguuuaggaauaaaaugu

SEQ ID NO: 573021 - RNA, 22 nt, Human
uuuacagcuucuauacuaugug

SEQ ID NO: 573022 - RNA, 22 nt, Human
uuuacauguaauguuauacaaa

SEQ ID NO: 573023 - RNA, 22 nt, Human
gcacaauaacagccaagguuau

SEQ ID NO: 573024 - RNA, 22 nt, Human
ucccuguggauaucugcagcug

SEQ ID NO: 573025 - RNA, 22 nt, Human
ugcagggcaguggagguugagu

SEQ ID NO: 573026 - RNA, 22 nt, Human
uacuuacagagcuuauaaguua

SEQ ID NO: 573027 - RNA, 22 nt, Human
uauacacaaacaagggguuaag

SEQ ID NO: 573028 - RNA, 22 nt, Human
gcuucucucaggagcaucagcc

SEQ ID NO: 573029 - RNA, 22 nt, Human
gggcacugcuuugcucugucac

SEQ ID NO: 573030 - RNA, 22 nt, Human
aggcugagcggggucccagagc

SEQ ID NO: 573031 - RNA, 23 nt, Human
agaguuuguuucuaaugagugag

SEQ ID NO: 573032 - RNA, 22 nt, Human
acucacaggacucugcauauag

SEQ ID NO: 573033 - RNA, 22 nt, Human
ugcagcugacccacuccagucc

SEQ ID NO: 573034 - RNA, 22 nt, Human
ucauggaugauagcuucauugc

SEQ ID NO: 573035 - RNA, 22 nt, Human
ggcuuccagcugggccuuggag

SEQ ID NO: 573036 - RNA, 22 nt, Human
ugcucuguccagugcaccauca

SEQ ID NO: 573037 - RNA, 22 nt, Human
uggccaggcuggucuggaacgc

SEQ ID NO: 573038 - RNA, 22 nt, Human
cugaaagggagaacaccaagag

SEQ ID NO: 573039 - RNA, 22 nt, Human
ccuuggcccuagccucaggcaa

SEQ ID NO: 573040 - RNA, 19 nt, Human
acacugggagaagacugcu

SEQ ID NO: 573041 - RNA, 22 nt, Human
gacugaggagguaagguuugaa

SEQ ID NO: 573042 - RNA, 22 nt, Human
aauuuauuauauccuaggggaa

SEQ ID NO: 573043 - RNA, 22 nt, Human
aacauuuaugguagucauugca

SEQ ID NO: 573044 - RNA, 22 nt, Human
cagccugggcuccagagucccu

SEQ ID NO: 573045 - RNA, 21 nt, Human
agggagcauguuagcuuucga

SEQ ID NO: 573046 - RNA, 22 nt, Human
aagaaugagcucaaagaucuua

SEQ ID NO: 573047 - RNA, 22 nt, Human
cccucaggaugcaguggaagug

SEQ ID NO: 573048 - RNA, 22 nt, Human
ggagaaggaagaaagcuacuau

SEQ ID NO: 573049 - RNA, 22 nt, Human
uuacacagugguuaagucuggg

SEQ ID NO: 573050 - RNA, 22 nt, Human
accaguccgcggagcuccgggg

SEQ ID NO: 573051 - RNA, 22 nt, Human
gggcuucucugggaguccuggu

SEQ ID NO: 573052 - RNA, 20 nt, Human
uccaggcagacagcuauggg

SEQ ID NO: 573053 - RNA, 23 nt, Human
ugcccucccaaugcuucggucac

SEQ ID NO: 573054 - RNA, 22 nt, Human
ugcaaacuagcaucaacuagua

SEQ ID NO: 573055 - RNA, 22 nt, Human
aauauuaucaaaagcuuuuuca

SEQ ID NO: 573056 - RNA, 22 nt, Human
cugaagcaaaggaucgagcuaa

SEQ ID NO: 573057 - RNA, 23 nt, Human
gcccugcccuuagcacacucaca

SEQ ID NO: 573058 - RNA, 22 nt, Human
uguuuucacaaugaugucagau

SEQ ID NO: 573059 - RNA, 22 nt, Human
gucuuuaguugaaacauguggu

SEQ ID NO: 573060 - RNA, 22 nt, Human
gcagaggacacaggagggcaag

SEQ ID NO: 573061 - RNA, 22 nt, Human
acugagguaauugugaggauua

SEQ ID NO: 573062 - RNA, 22 nt, Human
ggaagccaggccaaugagaaca

SEQ ID NO: 573063 - RNA, 22 nt, Human
ucucuuuaaagacucagagauu

SEQ ID NO: 573064 - RNA, 22 nt, Human
ggcaggcaguguggugugaaac

SEQ ID NO: 573065 - RNA, 22 nt, Human
caggaaggcgcggcugugccug

SEQ ID NO: 573066 - RNA, 23 nt, Human
gcagagacagccccagcgcgaug

SEQ ID NO: 573067 - RNA, 21 nt, Human
gcuggcuggcugaccggccuu

SEQ ID NO: 573068 - RNA, 22 nt, Human
uaacacuaagaaucuaaauuua

SEQ ID NO: 573069 - RNA, 22 nt, Human
auguggcugaucgcagagcucu

SEQ ID NO: 573070 - RNA, 22 nt, Human
aagggcugggucugguuaaccc

SEQ ID NO: 573071 - RNA, 22 nt, Human
ucaggagcugcacugggcccac

SEQ ID NO: 573072 - RNA, 22 nt, Human
cugaauaauuuucuguuguaug

SEQ ID NO: 573073 - RNA, 22 nt, Human
ugaggugguuacuguggugcuc

SEQ ID NO: 573074 - RNA, 22 nt, Human
gucuccagggcugcuggcgccu

SEQ ID NO: 573075 - RNA, 22 nt, Human
guuuuauuggaacacagccaug

SEQ ID NO: 573076 - RNA, 22 nt, Human
ugucccaguucccaggguugcu

SEQ ID NO: 573077 - RNA, 22 nt, Human
auagaaacagggaagcaaagca

SEQ ID NO: 573078 - RNA, 20 nt, Human
cagaccugcacccacuucga

SEQ ID NO: 573079 - RNA, 22 nt, Human
agaguuugggguaugauuguuu

SEQ ID NO: 573080 - RNA, 22 nt, Human
acauuguuugagaauacagaug

SEQ ID NO: 573081 - RNA, 22 nt, Human
gcucugugagccacuugaugua

SEQ ID NO: 573082 - RNA, 22 nt, Human
uuagggaaacaaacauuuucuu

SEQ ID NO: 573083 - RNA, 22 nt, Human
ggcaagggacggccgugagaca

SEQ ID NO: 573084 - RNA, 21 nt, Human
ccagccucagaucagggagcu

SEQ ID NO: 573085 - RNA, 22 nt, Human
auuauuauaaagugcaugaccu

SEQ ID NO: 573086 - RNA, 22 nt, Human
gccucaguugaucugugugagc

SEQ ID NO: 573087 - RNA, 21 nt, Human
cagugcucaaucugacagugg

SEQ ID NO: 573088 - RNA, 22 nt, Human
acaugcauaagccuagccauca

SEQ ID NO: 573089 - RNA, 22 nt, Human
agcaagaugcaaacauccgucc

SEQ ID NO: 573090 - RNA, 22 nt, Human
ggcagagacaccgaaugacucu

SEQ ID NO: 573091 - RNA, 22 nt, Human
ucaccaggauuccuaucaguag

SEQ ID NO: 573092 - RNA, 22 nt, Human
auaccauuuccauguuacauua

SEQ ID NO: 573093 - RNA, 22 nt, Human
caggauuaaggugaggggagua

SEQ ID NO: 573094 - RNA, 23 nt, Human
gugagcagcccacuaggaaugcc

SEQ ID NO: 573095 - RNA, 22 nt, Human
cugaggcugggcugaggguaua

SEQ ID NO: 573096 - RNA, 20 nt, Human
caggaggcaaggucaagguc

SEQ ID NO: 573097 - RNA, 20 nt, Human
caggacagcgcaaucggagg

SEQ ID NO: 573098 - RNA, 22 nt, Human
agagcccucucauuggcuuauu

SEQ ID NO: 573099 - RNA, 22 nt, Human
gagaacacuuauggauuauucu

SEQ ID NO: 573100 - RNA, 22 nt, Human
uuuauuauagugguggggacug

SEQ ID NO: 573101 - RNA, 22 nt, Human
ugagggucuggaaucugggcuu

SEQ ID NO: 573102 - RNA, 22 nt, Human
ucagccaggcacaauggcagcu

SEQ ID NO: 573103 - RNA, 22 nt, Human
uacuuccuguuuccaugucugu

SEQ ID NO: 573104 - RNA, 22 nt, Human
uuucuucuugauuuaaacaggg

SEQ ID NO: 573105 - RNA, 22 nt, Human
guuccuaaaucuggaggaccuc

SEQ ID NO: 573106 - RNA, 22 nt, Human
auccauuuguaaauguuagagu

SEQ ID NO: 573107 - RNA, 22 nt, Human
cagaauuugaaguaauauucca

SEQ ID NO: 573108 - RNA, 22 nt, Human
uguuauccucagcucaccucua

SEQ ID NO: 573109 - RNA, 22 nt, Human
gagcaugguuccauagguuggu

SEQ ID NO: 573110 - RNA, 22 nt, Human
uuggauccaucucaggcauagg

SEQ ID NO: 573111 - RNA, 22 nt, Human
guguguguauauauacacacac

SEQ ID NO: 573112 - RNA, 17 nt, Human
cgagggcuugcuggcuc

SEQ ID NO: 573113 - RNA, 21 nt, Human
ucuaagaacaugauucucccu

SEQ ID NO: 573114 - RNA, 22 nt, Human
auggcacaggagaggagggcug

SEQ ID NO: 573115 - RNA, 22 nt, Human
agggaagagcuugcaagaaacc

SEQ ID NO: 573116 - RNA, 22 nt, Human
accagcaccugauaggcaguaa

SEQ ID NO: 573117 - RNA, 22 nt, Human
uuucaauugacuuuggaagaaa

SEQ ID NO: 573118 - RNA, 22 nt, Human
auucugaguccaugggggcagg

SEQ ID NO: 573119 - RNA, 22 nt, Human
gcugguccaauuaugaacuguu

SEQ ID NO: 573120 - RNA, 19 nt, Human
agcagccaucgaccaugga

SEQ ID NO: 573121 - RNA, 22 nt, Human
uuucuauaucuuaccuauugua

SEQ ID NO: 573122 - RNA, 20 nt, Human
ucucaguuucuagagucagg

SEQ ID NO: 573123 - RNA, 22 nt, Human
cauuuauugaguggccacagug

SEQ ID NO: 573124 - RNA, 22 nt, Human
uggucagacaaaggagaauguu

SEQ ID NO: 573125 - RNA, 22 nt, Human
cagucaggggugggaucaaggc

SEQ ID NO: 573126 - RNA, 19 nt, Human
aaagaacuuugggcuaggc

SEQ ID NO: 573127 - RNA, 19 nt, Human
aucagcaagguaggaugug

SEQ ID NO: 573128 - RNA, 23 nt, Human
ugcuacucaaaguguggucccag

SEQ ID NO: 573129 - RNA, 22 nt, Human
ggucagagaaaaguaggguguu

SEQ ID NO: 573130 - RNA, 22 nt, Human
uauuucuaagcuguaagucuga

SEQ ID NO: 573131 - RNA, 22 nt, Human
caaggaggcagugggacuugaa

SEQ ID NO: 573132 - RNA, 22 nt, Human
ugagguaggauaagacaaugag

SEQ ID NO: 573133 - RNA, 22 nt, Human
auuguuaugaaaauaagauguu

SEQ ID NO: 573134 - RNA, 18 nt, Human
acuucccagaugagggga

SEQ ID NO: 573135 - RNA, 22 nt, Human
uauuaaauguuauuuggguugu

SEQ ID NO: 573136 - RNA, 22 nt, Human
gagcuccugaaacguuccugcc

SEQ ID NO: 573137 - RNA, 22 nt, Human
uccuggggaggguucuggcucc

SEQ ID NO: 573138 - RNA, 23 nt, Human
ucuccuccuagauacagucaugg

SEQ ID NO: 573139 - RNA, 22 nt, Human
aggggcuccaaggaaguuuggg

SEQ ID NO: 573140 - RNA, 22 nt, Human
gcugaggucaggagcugugggg

SEQ ID NO: 573141 - RNA, 22 nt, Human
auucuuaauugccaugcuguau

SEQ ID NO: 573142 - RNA, 22 nt, Human
ggugcaggaaaauuaccuggag

SEQ ID NO: 573143 - RNA, 21 nt, Human
ucccucagacagggugccuau

SEQ ID NO: 573144 - RNA, 23 nt, Human
gcaggugguucgaacagaaguuu

SEQ ID NO: 573145 - RNA, 22 nt, Human
cuuuuauuuugaauuaagggcu

SEQ ID NO: 573146 - RNA, 22 nt, Human
cuguauaagauaccacacugaa

SEQ ID NO: 573147 - RNA, 22 nt, Human
aaugaagccagguagaagagaa

SEQ ID NO: 573148 - RNA, 22 nt, Human
ggagcuggcagcgcaacccaga

SEQ ID NO: 573149 - RNA, 23 nt, Human
ugcagccacucaggagcucagug

SEQ ID NO: 573150 - RNA, 22 nt, Human
gguuccacgguguuuggaggca

SEQ ID NO: 573151 - RNA, 21 nt, Human
aaaugcaggcucuuuguuuuc

SEQ ID NO: 573152 - RNA, 22 nt, Human
ccucuugccaaucagcuacaga

SEQ ID NO: 573153 - RNA, 22 nt, Human
uaaauucagugaguaauuucug

SEQ ID NO: 573154 - RNA, 22 nt, Human
ugcagaggcuggcucgccgggu

SEQ ID NO: 573155 - RNA, 22 nt, Human
uggagggaacccaggcugcucu

SEQ ID NO: 573156 - RNA, 22 nt, Human
cuggccaggcuugggacagaca

SEQ ID NO: 573157 - RNA, 22 nt, Human
uagagguauaccaaaaaggcau

SEQ ID NO: 573158 - RNA, 22 nt, Human
acaggccuggugcugcugacag

SEQ ID NO: 573159 - RNA, 22 nt, Human
ugagguaguaaagguguuaguu

SEQ ID NO: 573160 - RNA, 22 nt, Human
cuucagcaacuuuggaauguuu

SEQ ID NO: 573161 - RNA, 22 nt, Human
gcagaagcugggcagcgaggug

SEQ ID NO: 573162 - RNA, 22 nt, Human
cacaugcuucuuuugauuauga

SEQ ID NO: 573163 - RNA, 21 nt, Human
auuuucauuuccaggggagga

SEQ ID NO: 573164 - RNA, 22 nt, Human
ggaggugcugaucccagucaac

SEQ ID NO: 573165 - RNA, 22 nt, Human
ggcucugaagggugacagguuu

SEQ ID NO: 573166 - RNA, 22 nt, Human
ggguaugagauauaggugaaua

SEQ ID NO: 573167 - RNA, 22 nt, Human
auucuucucuggguuggguuca

SEQ ID NO: 573168 - RNA, 22 nt, Human
agcaggugggcaugaaagcuga

SEQ ID NO: 573169 - RNA, 22 nt, Human
ucauuauucucuuuaauguucu

SEQ ID NO: 573170 - RNA, 22 nt, Human
ggcuucagaagacuggacaggu

SEQ ID NO: 573171 - RNA, 22 nt, Human
aauucacaggagguauuugucc

SEQ ID NO: 573172 - RNA, 22 nt, Human
aaaugcucucuaauguaauaca

SEQ ID NO: 573173 - RNA, 22 nt, Human
cuggaagacguuugaagccaug

SEQ ID NO: 573174 - RNA, 22 nt, Human
uugugggcuugccuggcucuug

SEQ ID NO: 573175 - RNA, 22 nt, Human
ucucccaggugggugccuggag

SEQ ID NO: 573176 - RNA, 22 nt, Human
acacagaguuugacacauggga

SEQ ID NO: 573177 - RNA, 22 nt, Human
uagcuucccuagcuaaagaggu

SEQ ID NO: 573178 - RNA, 22 nt, Human
gagaggcuaugagguucugugu

SEQ ID NO: 573179 - RNA, 22 nt, Human
cuucugauuagcaaguuuguau

SEQ ID NO: 573180 - RNA, 23 nt, Human
auuguuuuuggcucucagggaau

SEQ ID NO: 573181 - RNA, 22 nt, Human
aggaugacuggaacccaaguga

SEQ ID NO: 573182 - RNA, 21 nt, Human
ucagagaauggccuacucuca

SEQ ID NO: 573183 - RNA, 20 nt, Human
uacagucagggcacaggcag

SEQ ID NO: 573184 - RNA, 22 nt, Human
uucagcacaguucaagauggua

SEQ ID NO: 573185 - RNA, 22 nt, Human
ugagugggauuaaaugagguga

SEQ ID NO: 573186 - RNA, 23 nt, Human
ugggcagcuucugcaugcccacc

SEQ ID NO: 573187 - RNA, 22 nt, Human
cacuggaggucaguggagcacu

SEQ ID NO: 573188 - RNA, 22 nt, Human
ggcuggaaugcaacuguguguu

SEQ ID NO: 573189 - RNA, 22 nt, Human
uccaggcuacuuggauuccugg

SEQ ID NO: 573190 - RNA, 17 nt, Human
ugcuucaucccgauccu

SEQ ID NO: 573191 - RNA, 22 nt, Human
ccaaggcuuccugaccuacaug

SEQ ID NO: 573192 - RNA, 22 nt, Human
uuugguaaccuugcauucuuua

SEQ ID NO: 573193 - RNA, 22 nt, Human
aagggaggaggauuuauuguac

SEQ ID NO: 573194 - RNA, 22 nt, Human
gacaggcuucaugauggcagga

SEQ ID NO: 573195 - RNA, 22 nt, Human
auuaagcucuccaggaaaugua

SEQ ID NO: 573196 - RNA, 22 nt, Human
uuuuuguugcagagaggccacu

SEQ ID NO: 573197 - RNA, 22 nt, Human
ccaggagacuguacugauauuu

SEQ ID NO: 573198 - RNA, 22 nt, Human
uuaaauuagucaagcuucucug

SEQ ID NO: 573199 - RNA, 22 nt, Human
ucaggaaaauacugcuuaucca

SEQ ID NO: 573200 - RNA, 22 nt, Human
cugggucuccggcagccucggg

SEQ ID NO: 573201 - RNA, 22 nt, Human
gugauuucaaauauagagugag

SEQ ID NO: 573202 - RNA, 22 nt, Human
ucacgugagggaccugugucug

SEQ ID NO: 573203 - RNA, 22 nt, Human
gucugugggccaaauacagccc

SEQ ID NO: 573204 - RNA, 22 nt, Human
uagccgggugugguggaacucc

SEQ ID NO: 573205 - RNA, 22 nt, Human
cugugaauguuauaucucaaug

SEQ ID NO: 573206 - RNA, 22 nt, Human
uccuugaaaagaaugucuccau

SEQ ID NO: 573207 - RNA, 22 nt, Human
ucaguguucgcucagggacucc

SEQ ID NO: 573208 - RNA, 22 nt, Human
auggcagacacaggcaggcaga

SEQ ID NO: 573209 - RNA, 21 nt, Human
cagcuucuucugugaccuggu

SEQ ID NO: 573210 - RNA, 22 nt, Human
cugucuuuuuagagaguaggau

SEQ ID NO: 573211 - RNA, 22 nt, Human
cagcccuggugccaagguuccc

SEQ ID NO: 573212 - RNA, 22 nt, Human
cccagcuccuuacagggccgaa

SEQ ID NO: 573213 - RNA, 22 nt, Human
uagauacacacacagucaugug

SEQ ID NO: 573214 - RNA, 20 nt, Human
gagggugggacuuccuaggc

SEQ ID NO: 573215 - RNA, 22 nt, Human
uuuaaccagaaagguacucauc

SEQ ID NO: 573216 - RNA, 22 nt, Human
gaaguuuauuucaaucuauuca

SEQ ID NO: 573217 - RNA, 22 nt, Human
agcaaggggcagugaaagugug

SEQ ID NO: 573218 - RNA, 22 nt, Human
uguuuucaagucaaggccaaau

SEQ ID NO: 573219 - RNA, 22 nt, Human
ccucagaagaaguggaauugau

SEQ ID NO: 573220 - RNA, 22 nt, Human
uauucacaggcuggagugaugu

SEQ ID NO: 573221 - RNA, 23 nt, Human
cccagguguggaggcgguggcag

SEQ ID NO: 573222 - RNA, 22 nt, Human
uauugacauuuuuauagcuuga

SEQ ID NO: 573223 - RNA, 22 nt, Human
ucauaguuauggagauuaagga

SEQ ID NO: 573224 - RNA, 23 nt, Human
gcaguggaaugucucuguuugga

SEQ ID NO: 573225 - RNA, 22 nt, Human
uacuagucuucugcuauucccu

SEQ ID NO: 573226 - RNA, 22 nt, Human
aaacaaguuuagaauaaugaau

SEQ ID NO: 573227 - RNA, 22 nt, Human
uccuccucacgcuguugcuugu

SEQ ID NO: 573228 - RNA, 20 nt, Human
gugcagcacuuggggguagg

SEQ ID NO: 573229 - RNA, 19 nt, Human
acaggggccuuuccagggu

SEQ ID NO: 573230 - RNA, 22 nt, Human
ccagagcaauucucacagaacu

SEQ ID NO: 573231 - RNA, 22 nt, Human
ccaugaguagcgauuucauuuu

SEQ ID NO: 573232 - RNA, 20 nt, Human
aacuuguuuuguuuucuaau

SEQ ID NO: 573233 - RNA, 22 nt, Human
aaauuuuaaggcuggaacuuaa

SEQ ID NO: 573234 - RNA, 22 nt, Human
acaugucuuuuaaagucuaaua

SEQ ID NO: 573235 - RNA, 22 nt, Human
aagauuuccuggauguaauucc

SEQ ID NO: 573236 - RNA, 21 nt, Human
aagcuuccaaacugcuggacu

SEQ ID NO: 573237 - RNA, 22 nt, Human
ccugucuggggacucccugggu

SEQ ID NO: 573238 - RNA, 22 nt, Human
ccagggcugccgcaucccuggu

SEQ ID NO: 573239 - RNA, 22 nt, Human
agcagccaggaaucugcagagc

SEQ ID NO: 573240 - RNA, 22 nt, Human
uuaggaaaagaagacauuucua

SEQ ID NO: 573241 - RNA, 18 nt, Human
uccugccugugccccagg

SEQ ID NO: 573242 - RNA, 22 nt, Human
guggcaggggcgggcuguuccg

SEQ ID NO: 573243 - RNA, 22 nt, Human
ugugaaaagcguguguucuagg

SEQ ID NO: 573244 - RNA, 22 nt, Human
agccuguguccucaucugcagc

SEQ ID NO: 573245 - RNA, 22 nt, Human
caggcugauuaggccucgucca

SEQ ID NO: 573246 - RNA, 21 nt, Human
aaugucuuuguccaugcucug

SEQ ID NO: 573247 - RNA, 22 nt, Human
uaaaucaguagauaugguauag

SEQ ID NO: 573248 - RNA, 22 nt, Human
aggcuggcaaggcagaugugug

SEQ ID NO: 573249 - RNA, 22 nt, Human
uuucauuauacagcuucauaaa

SEQ ID NO: 573250 - RNA, 19 nt, Human
acuucuuuucaacacagga

SEQ ID NO: 573251 - RNA, 22 nt, Human
ggcagaaggccucccagcuccu

SEQ ID NO: 573252 - RNA, 20 nt, Human
acauggcauucccacguggu

SEQ ID NO: 573253 - RNA, 22 nt, Human
uguuaaggagacacaugaaaaa

SEQ ID NO: 573254 - RNA, 22 nt, Human
uaaugccuagauuauucuguuu

SEQ ID NO: 573255 - RNA, 22 nt, Human
uuaggcuguucuuguguuguua

SEQ ID NO: 573256 - RNA, 22 nt, Human
uccaggcuggagugcaguggca

SEQ ID NO: 573257 - RNA, 22 nt, Human
gacaggaacauaaauguaggag

SEQ ID NO: 573258 - RNA, 22 nt, Human
uucucucccaugaagcuucuau

SEQ ID NO: 573259 - RNA, 18 nt, Human
cccuuagccuuuccucuc

SEQ ID NO: 573260 - RNA, 22 nt, Human
ugauuuuuagcuauucugaaga

SEQ ID NO: 573261 - RNA, 22 nt, Human
ugggcucugguuuccuggcugg

SEQ ID NO: 573262 - RNA, 22 nt, Human
ugcagagguguugcugagauaa

SEQ ID NO: 573263 - RNA, 22 nt, Human
ggucugugcucuggagccucug

SEQ ID NO: 573264 - RNA, 22 nt, Human
gcccaggagaggccagggcuga

SEQ ID NO: 573265 - RNA, 22 nt, Human
augcuuuuuaaacuuaauugga

SEQ ID NO: 573266 - RNA, 21 nt, Human
gguagggaagguucgcuggug

SEQ ID NO: 573267 - RNA, 22 nt, Human
aaaagcagagacucuggagcua

SEQ ID NO: 573268 - RNA, 22 nt, Human
uauaaaguuucgaaagauguau

SEQ ID NO: 573269 - RNA, 23 nt, Human
gaggucaaggcugcagugauugc

SEQ ID NO: 573270 - RNA, 19 nt, Human
uuuuaagugcccuuucuuc

SEQ ID NO: 573271 - RNA, 22 nt, Human
accccaggucaucugagagucc

SEQ ID NO: 573272 - RNA, 22 nt, Human
gcaguguuacuugguuugcaga

SEQ ID NO: 573273 - RNA, 22 nt, Human
gggggugaggacaggagcacug

SEQ ID NO: 573274 - RNA, 22 nt, Human
aaugugagccaaugcccguggg

SEQ ID NO: 573275 - RNA, 22 nt, Human
acccaggguuugagcucugcag

SEQ ID NO: 573276 - RNA, 22 nt, Human
ugaaggcauuugaguuggugag

SEQ ID NO: 573277 - RNA, 22 nt, Human
aggcagccaguucagguuucuu

SEQ ID NO: 573278 - RNA, 22 nt, Human
uuccccuugauaaugcaguaag

SEQ ID NO: 573279 - RNA, 20 nt, Human
uuguuuccuggcuguucugc

SEQ ID NO: 573280 - RNA, 22 nt, Human
ugacaagaucacagucaagugu

SEQ ID NO: 573281 - RNA, 22 nt, Human
cccugaggcaguaggagcuuuu

SEQ ID NO: 573282 - RNA, 19 nt, Human
cugcuuuaggccuuaaaag

SEQ ID NO: 573283 - RNA, 22 nt, Human
ggcaggaggaagaguuagcacc

SEQ ID NO: 573284 - RNA, 22 nt, Human
cucauaaugugacuguauuuga

SEQ ID NO: 573285 - RNA, 22 nt, Human
uuaucuugaguauugagauucu

SEQ ID NO: 573286 - RNA, 22 nt, Human
gcacagcaguggcauaaacaau

SEQ ID NO: 573287 - RNA, 22 nt, Human
uuacuuuauagaacacuggggg

SEQ ID NO: 573288 - RNA, 22 nt, Human
uggaaacacugcauguucaccc

SEQ ID NO: 573289 - RNA, 19 nt, Human
gagcugccuuuugaagacc

SEQ ID NO: 573290 - RNA, 22 nt, Human
gagggcugauaacaggaauaca

SEQ ID NO: 573291 - RNA, 22 nt, Human
cacagagaucggaacagaagua

SEQ ID NO: 573292 - RNA, 22 nt, Human
gcagagccaggagagacccuug

SEQ ID NO: 573293 - RNA, 22 nt, Human
agaggaggauuuguaaaggucu

SEQ ID NO: 573294 - RNA, 23 nt, Human
ucuccaggccuuacuccaggccu

SEQ ID NO: 573295 - RNA, 18 nt, Human
ggaagaaaaggaacucag

SEQ ID NO: 573296 - RNA, 22 nt, Human
aaugaugaacucagagggaacc

SEQ ID NO: 573297 - RNA, 22 nt, Human
cgggggcacccacaaaugagga

SEQ ID NO: 573298 - RNA, 22 nt, Human
aauacugugggaugcaguagga

SEQ ID NO: 573299 - RNA, 20 nt, Human
ggcagccaaucagcgugccg

SEQ ID NO: 573300 - RNA, 22 nt, Human
gagcccuguagcaagucauguc

SEQ ID NO: 573301 - RNA, 19 nt, Human
uuucucucccucaucccga

SEQ ID NO: 573302 - RNA, 22 nt, Human
cuuauugugauuccugccucuu

SEQ ID NO: 573303 - RNA, 22 nt, Human
uccagggcuggguuggcucagc

SEQ ID NO: 573304 - RNA, 22 nt, Human
uagaaauggagaacagauuaau

SEQ ID NO: 573305 - RNA, 18 nt, Human
gcugcaggcgccugcggu

SEQ ID NO: 573306 - RNA, 22 nt, Human
ucacaguuacuccuucagauga

SEQ ID NO: 573307 - RNA, 22 nt, Human
caaucuuacuuuugaaaaguga

SEQ ID NO: 573308 - RNA, 22 nt, Human
ugcuuuaacgcugagggucuca

SEQ ID NO: 573309 - RNA, 22 nt, Human
uccugucucaguguauuugcag

SEQ ID NO: 573310 - RNA, 19 nt, Human
gggcccagcauggaggguu

SEQ ID NO: 573311 - RNA, 22 nt, Human
cagcaggcccagaguuucaugg

SEQ ID NO: 573312 - RNA, 22 nt, Human
ucccagaggucucugcugguuc

SEQ ID NO: 573313 - RNA, 22 nt, Human
guuuguuuauacaaaagauccu

SEQ ID NO: 573314 - RNA, 22 nt, Human
gcaggcaccggguugcuccccu

SEQ ID NO: 573315 - RNA, 22 nt, Human
uuuccuaacacaaugcaugaga

SEQ ID NO: 573316 - RNA, 22 nt, Human
cugccuccucacguccacagug

SEQ ID NO: 573317 - RNA, 22 nt, Human
uccaggcucucaggugucagca

SEQ ID NO: 573318 - RNA, 22 nt, Human
accucagagauacaaaccaugg

SEQ ID NO: 573319 - RNA, 22 nt, Human
acagugcugucaaauauguuuu

SEQ ID NO: 573320 - RNA, 22 nt, Human
uacacauguuuggcaaguaugu

SEQ ID NO: 573321 - RNA, 22 nt, Human
auacuuacuuuucuucagacua

SEQ ID NO: 573322 - RNA, 22 nt, Human
agagcagugcugaagaguaggg

SEQ ID NO: 573323 - RNA, 22 nt, Human
cuuagcuuuguuuaacacaggg

SEQ ID NO: 573324 - RNA, 22 nt, Human
cacucugggcucuuguuucaga

SEQ ID NO: 573325 - RNA, 22 nt, Human
agccagagacuuuaccugugca

SEQ ID NO: 573326 - RNA, 22 nt, Human
ggaguggccucuccugugcagg

SEQ ID NO: 573327 - RNA, 22 nt, Human
cccaggccuggucugggccagu

SEQ ID NO: 573328 - RNA, 22 nt, Human
caaugacauggauaaucauauu

SEQ ID NO: 573329 - RNA, 22 nt, Human
ucacaauugagauccucccacc

SEQ ID NO: 573330 - RNA, 22 nt, Human
cacacaguaguaugaggcaaaa

SEQ ID NO: 573331 - RNA, 22 nt, Human
uucuuucugggaagaguucaga

SEQ ID NO: 573332 - RNA, 22 nt, Human
uaaaaucaugacagauugacau

SEQ ID NO: 573333 - RNA, 16 nt, Human
gcugggagggagaggu

SEQ ID NO: 573334 - RNA, 22 nt, Human
uccagcucuggcuuggcuagcu

SEQ ID NO: 573335 - RNA, 22 nt, Human
guuuucuaaguagguagcacca

SEQ ID NO: 573336 - RNA, 22 nt, Human
cagguucccagguccagggcuu

SEQ ID NO: 573337 - RNA, 22 nt, Human
uucuguuuauaauuugcaguug

SEQ ID NO: 573338 - RNA, 22 nt, Human
gaaccacaagauucaaaggggu

SEQ ID NO: 573339 - RNA, 22 nt, Human
acaauagguguccaauuaacaa

SEQ ID NO: 573340 - RNA, 22 nt, Human
gucuuugcugucuuugcucuca

SEQ ID NO: 573341 - RNA, 22 nt, Human
ggcggguguaaguaggacagcg

SEQ ID NO: 573342 - RNA, 22 nt, Human
gcaguguuacuuggaguacuaa

SEQ ID NO: 573343 - RNA, 22 nt, Human
uccagggagauacuggcugcca

SEQ ID NO: 573344 - RNA, 22 nt, Human
cuagagaaacgccgugggagga

SEQ ID NO: 573345 - RNA, 22 nt, Human
gcuccuggucuggagcuucaag

SEQ ID NO: 573346 - RNA, 22 nt, Human
ccugggcucugucagaauuggg

SEQ ID NO: 573347 - RNA, 23 nt, Human
uaaugccagcccugcaguuaagc

SEQ ID NO: 573348 - RNA, 21 nt, Human
ccaccaggucuucugcucggg

SEQ ID NO: 573349 - RNA, 22 nt, Human
gaagcaaucuggcucccagcca

SEQ ID NO: 573350 - RNA, 22 nt, Human
aaugaagauaaaaugggaugga

SEQ ID NO: 573351 - RNA, 22 nt, Human
cucagggaugggcagauguuaa

SEQ ID NO: 573352 - RNA, 22 nt, Human
ugggugguugcugaggcuccuu

SEQ ID NO: 573353 - RNA, 22 nt, Human
caggcagagugagaagcccuug

SEQ ID NO: 573354 - RNA, 22 nt, Human
agcauguugggaugagaaggaa

SEQ ID NO: 573355 - RNA, 22 nt, Human
cugggcagcuccauaccaccca

SEQ ID NO: 573356 - RNA, 22 nt, Human
agccacugugcaggagcagugu

SEQ ID NO: 573357 - RNA, 19 nt, Human
gauauaaagagauggugaa

SEQ ID NO: 573358 - RNA, 19 nt, Human
cucugggcaagucacuuaa

SEQ ID NO: 573359 - RNA, 22 nt, Human
uguccugugccaccuuccugag

SEQ ID NO: 573360 - RNA, 22 nt, Human
gagagaaagccccugcaucccu

SEQ ID NO: 573361 - RNA, 22 nt, Human
ucugaauaguucuauuuuaaag

SEQ ID NO: 573362 - RNA, 22 nt, Human
accaggagccacaggaggagcc

SEQ ID NO: 573363 - RNA, 22 nt, Human
aggacuggcagugugagggguc

SEQ ID NO: 573364 - RNA, 22 nt, Human
aacagcaggcaccaaggcuaug

SEQ ID NO: 573365 - RNA, 19 nt, Human
ucucuggcauagacucaau

SEQ ID NO: 573366 - RNA, 22 nt, Human
uccucccacauaggacaauggg

SEQ ID NO: 573367 - RNA, 22 nt, Human
aggcuuaaaugcucauaucagu

SEQ ID NO: 573368 - RNA, 22 nt, Human
agagcuggcugugggugacuuu

SEQ ID NO: 573369 - RNA, 23 nt, Human
gcugucaguuguuuuugucucua

SEQ ID NO: 573370 - RNA, 22 nt, Human
acugggcaauaaauucagagaa

SEQ ID NO: 573371 - RNA, 22 nt, Human
ugcuucaggaagaaacgccagg

SEQ ID NO: 573372 - RNA, 22 nt, Human
ugagauggguggggagcucagg

SEQ ID NO: 573373 - RNA, 22 nt, Human
gugccagggaguggaggagcuu

SEQ ID NO: 573374 - RNA, 22 nt, Human
aaggaaggaauugaucaugcgc

SEQ ID NO: 573375 - RNA, 22 nt, Human
uugugugucuucuucacugccc

SEQ ID NO: 573376 - RNA, 22 nt, Human
gcagggcuguggacacuuuggu

SEQ ID NO: 573377 - RNA, 22 nt, Human
agaggcucuugcccuucccaca

SEQ ID NO: 573378 - RNA, 22 nt, Human
guguguguaucugccuaucaca

SEQ ID NO: 573379 - RNA, 22 nt, Human
gggcuacauugugagagaaguu

SEQ ID NO: 573380 - RNA, 22 nt, Human
ggaguggcuguuucugccccca

SEQ ID NO: 573381 - RNA, 22 nt, Human
aguggugcugcgcgcggagcuc

SEQ ID NO: 573382 - RNA, 22 nt, Human
uuuucucuuguuaauguacuga

SEQ ID NO: 573383 - RNA, 21 nt, Human
gcagaugggaagagacgaggc

SEQ ID NO: 573384 - RNA, 22 nt, Human
ugagggggguaaucacuggguu

SEQ ID NO: 573385 - RNA, 22 nt, Human
cugggagcgcagcaggcacaac

SEQ ID NO: 573386 - RNA, 22 nt, Human
ugggcacaaacaucugccuguu

SEQ ID NO: 573387 - RNA, 19 nt, Human
ugagacagggauucaggug

SEQ ID NO: 573388 - RNA, 22 nt, Human
uuacaagauaaccugaugcugu

SEQ ID NO: 573389 - RNA, 22 nt, Human
auuugcuucugugaaaucaagu

SEQ ID NO: 573390 - RNA, 22 nt, Human
uagcagaggaaaagagaacauu

SEQ ID NO: 573391 - RNA, 22 nt, Human
aauuaagucacacaccuaaacc

SEQ ID NO: 573392 - RNA, 19 nt, Human
agcaggccacagggccagc

SEQ ID NO: 573393 - RNA, 22 nt, Human
auuauuagugauguuguuacug

SEQ ID NO: 573394 - RNA, 22 nt, Human
uaguuuaugauuuuuuggaagg

SEQ ID NO: 573395 - RNA, 22 nt, Human
cagguccucacgccucacccuu

SEQ ID NO: 573396 - RNA, 22 nt, Human
aacacugaaguagugaauacug

SEQ ID NO: 573397 - RNA, 22 nt, Human
gggcacugaacacccucuucgc

SEQ ID NO: 573398 - RNA, 22 nt, Human
uuucaacagaucugucuucagg

SEQ ID NO: 573399 - RNA, 22 nt, Human
acaauaaguauugggcuuuuga

SEQ ID NO: 573400 - RNA, 19 nt, Human
caugugcaugagcacagga

SEQ ID NO: 573401 - RNA, 22 nt, Human
caggggccuggcugucuaggaa

SEQ ID NO: 573402 - RNA, 22 nt, Human
caggaggaggguacaccaucag

SEQ ID NO: 573403 - RNA, 22 nt, Human
ucagagcuaaggggagagcaaa

SEQ ID NO: 573404 - RNA, 22 nt, Human
cauuaaguauuucaguuacugu

SEQ ID NO: 573405 - RNA, 22 nt, Human
agcagggccucuggcacugguc

SEQ ID NO: 573406 - RNA, 22 nt, Human
aucucuuugauggcuccuguga

SEQ ID NO: 573407 - RNA, 22 nt, Human
ucccagcauaacaaacugcccg

SEQ ID NO: 573408 - RNA, 22 nt, Human
cagcuuucuuccuucugucugu

SEQ ID NO: 573409 - RNA, 17 nt, Human
agcccccacucccaagu

SEQ ID NO: 573410 - RNA, 22 nt, Human
caccuggcccagcuccagugcu

SEQ ID NO: 573411 - RNA, 22 nt, Human
agaccuggugauagcuguccua

SEQ ID NO: 573412 - RNA, 17 nt, Human
ucucuuguucacugcug

SEQ ID NO: 573413 - RNA, 22 nt, Human
uugagaagguggucauuugcaa

SEQ ID NO: 573414 - RNA, 22 nt, Human
uggagaaggccggccaggagug

SEQ ID NO: 573415 - RNA, 22 nt, Human
ggcggagguugcaguaagccga

SEQ ID NO: 573416 - RNA, 22 nt, Human
ugaguccuggcuuugggaugua

SEQ ID NO: 573417 - RNA, 22 nt, Human
cccuggggagcaggcgaaggag

SEQ ID NO: 573418 - RNA, 22 nt, Human
agaacgaaugcuucagcucuag

SEQ ID NO: 573419 - RNA, 23 nt, Human
uggggagaguuacccuggaagcg

SEQ ID NO: 573420 - RNA, 22 nt, Human
uugacuuuacaguuuucuuagg

SEQ ID NO: 573421 - RNA, 22 nt, Human
acccacgaagaugagcggcaug

SEQ ID NO: 573422 - RNA, 22 nt, Human
agcccccacguuuccugggucc

SEQ ID NO: 573423 - RNA, 22 nt, Human
acuugucuaugguuacauccua

SEQ ID NO: 573424 - RNA, 22 nt, Human
gauuucuuugcaagcuguguuc

SEQ ID NO: 573425 - RNA, 22 nt, Human
uacagggacauggaacaggcuc

SEQ ID NO: 573426 - RNA, 22 nt, Human
caggaggcagcgcucucaggac

SEQ ID NO: 573427 - RNA, 20 nt, Human
agacaggagcccccauucag

SEQ ID NO: 573428 - RNA, 22 nt, Human
uugugcuagaaccaguacagaa

SEQ ID NO: 573429 - RNA, 22 nt, Human
agaaggggagaagcuaccagga

SEQ ID NO: 573430 - RNA, 22 nt, Human
acccaggaggugacacagggcu

SEQ ID NO: 573431 - RNA, 19 nt, Human
ugcuggagguugacagggu

SEQ ID NO: 573432 - RNA, 22 nt, Human
uuauuuucuccucagaaagugg

SEQ ID NO: 573433 - RNA, 22 nt, Human
cagcucugcugggaggaugcag

SEQ ID NO: 573434 - RNA, 22 nt, Human
ccugccaggacauugcuugaag

SEQ ID NO: 573435 - RNA, 22 nt, Human
auccuuuauaagacuuguauuc

SEQ ID NO: 573436 - RNA, 22 nt, Human
aaacagaguuugguaaauagcc

SEQ ID NO: 573437 - RNA, 22 nt, Human
auguuucaaugcacuuuagccu

SEQ ID NO: 573438 - RNA, 22 nt, Human
cugggggcaagcagacagcugu

SEQ ID NO: 573439 - RNA, 22 nt, Human
aagcucaggaaagagucugguu

SEQ ID NO: 573440 - RNA, 22 nt, Human
aaagcaguauaguggaagggcu

SEQ ID NO: 573441 - RNA, 22 nt, Human
cacccagcuuuugcauccuccg

SEQ ID NO: 573442 - RNA, 22 nt, Human
cagcuggcuuguuuguucuuga

SEQ ID NO: 573443 - RNA, 22 nt, Human
uagcagaaccagcagucaauuu

SEQ ID NO: 573444 - RNA, 22 nt, Human
cuccugggcugucggcgcucug

SEQ ID NO: 573445 - RNA, 22 nt, Human
cagggccauaucuugugcacca

SEQ ID NO: 573446 - RNA, 22 nt, Human
cuccccagguucaggagguggg

SEQ ID NO: 573447 - RNA, 22 nt, Human
ugaaguuuuacuaggugaauuu

SEQ ID NO: 573448 - RNA, 22 nt, Human
ucauugucucucuuuucauaua

SEQ ID NO: 573449 - RNA, 22 nt, Human
ugucauuuauuuugcugucugu

SEQ ID NO: 573450 - RNA, 22 nt, Human
acacauuaaccuuugaaauucu

SEQ ID NO: 573451 - RNA, 22 nt, Human
ugcagcugaggccagcuaugcc

SEQ ID NO: 573452 - RNA, 22 nt, Human
guccuguuaagaugcagagucc

SEQ ID NO: 573453 - RNA, 22 nt, Human
uuuuuuauaucaacugaagucu

SEQ ID NO: 573454 - RNA, 22 nt, Human
acacuagucucuucuugacuug

SEQ ID NO: 573455 - RNA, 22 nt, Human
uugggcacggacagguggggau

SEQ ID NO: 573456 - RNA, 21 nt, Human
uuacaugguuuaucauaugga

SEQ ID NO: 573457 - RNA, 22 nt, Human
guauacaauacacaaugcucug

SEQ ID NO: 573458 - RNA, 22 nt, Human
acacccagcuuuugaaugcccu

SEQ ID NO: 573459 - RNA, 22 nt, Human
uucuaguuaaaguauguauuag

SEQ ID NO: 573460 - RNA, 22 nt, Human
cacuuugugugggaucaggggu

SEQ ID NO: 573461 - RNA, 23 nt, Human
gcuuccauucuaguuugcugugc

SEQ ID NO: 573462 - RNA, 22 nt, Human
cauuuuaccuagaagcugaaag

SEQ ID NO: 573463 - RNA, 22 nt, Human
ucuuagaugaauaaaaaguuau

SEQ ID NO: 573464 - RNA, 22 nt, Human
agcugugugaccuagggcaagc

SEQ ID NO: 573465 - RNA, 22 nt, Human
aaauugcauucaggaugcagga

SEQ ID NO: 573466 - RNA, 21 nt, Human
caaauacuuagaaacuuaaga

SEQ ID NO: 573467 - RNA, 22 nt, Human
cacaggcagccuuguagaagaa

SEQ ID NO: 573468 - RNA, 22 nt, Human
augggcugcuucuccagcaccu

SEQ ID NO: 573469 - RNA, 23 nt, Human
cuuuuaacuugaucugagaccag

SEQ ID NO: 573470 - RNA, 22 nt, Human
cacaaaaucuuucucgauuauu

SEQ ID NO: 573471 - RNA, 22 nt, Human
ugcagccaucgcagagucugua

SEQ ID NO: 573472 - RNA, 22 nt, Human
gcaguccuguagcgacuuuuuu

SEQ ID NO: 573473 - RNA, 22 nt, Human
cugaggcacccaucuucuccug

SEQ ID NO: 573474 - RNA, 22 nt, Human
uguagcagaguaucucuguuuu

SEQ ID NO: 573475 - RNA, 22 nt, Human
cagcacagugcagaugcugacu

SEQ ID NO: 573476 - RNA, 22 nt, Human
agcugcagggcuuggguuuccc

SEQ ID NO: 573477 - RNA, 22 nt, Human
ucauccaguaugacuggugucu

SEQ ID NO: 573478 - RNA, 22 nt, Human
ugucauuuaucuuauaguaauc

SEQ ID NO: 573479 - RNA, 22 nt, Human
agacucugaaaucuaggugcaa

SEQ ID NO: 573480 - RNA, 22 nt, Human
cagcucuguugccaaagugggc

SEQ ID NO: 573481 - RNA, 22 nt, Human
uguacaaucuuggucccuuuau

SEQ ID NO: 573482 - RNA, 22 nt, Human
gauauucuauguagaaugagcu

SEQ ID NO: 573483 - RNA, 22 nt, Human
caggcucgguccaguggcaccc

SEQ ID NO: 573484 - RNA, 22 nt, Human
aaaguauauuuacuuacuguga

SEQ ID NO: 573485 - RNA, 19 nt, Human
gaaugggaaugggaaagcu

SEQ ID NO: 573486 - RNA, 22 nt, Human
auguuucaggaaaucagcuaga

SEQ ID NO: 573487 - RNA, 22 nt, Human
gauacuuuccauccaaaugcau

SEQ ID NO: 573488 - RNA, 22 nt, Human
cucagcacugacccaggagaug

SEQ ID NO: 573489 - RNA, 22 nt, Human
acacauguaaaacacuuagcaa

SEQ ID NO: 573490 - RNA, 22 nt, Human
uacaacaguaaucaagguuuuu

SEQ ID NO: 573491 - RNA, 22 nt, Human
aucagcugaaaaacaggcagca

SEQ ID NO: 573492 - RNA, 22 nt, Human
aaaauucugucauuaaauugug

SEQ ID NO: 573493 - RNA, 22 nt, Human
ugauaugugaagcuauuaguuc

SEQ ID NO: 573494 - RNA, 22 nt, Human
auugaauagaugcauuauacua

SEQ ID NO: 573495 - RNA, 22 nt, Human
guguguggggccuucggguccu

SEQ ID NO: 573496 - RNA, 22 nt, Human
gacaaaacugagaucacacugu

SEQ ID NO: 573497 - RNA, 22 nt, Human
ugacaggaugaugagcaggggg

SEQ ID NO: 573498 - RNA, 22 nt, Human
gcaggagacuggcugugguagu

SEQ ID NO: 573499 - RNA, 22 nt, Human
auguguuuugguaauuucugcu

SEQ ID NO: 573500 - RNA, 22 nt, Human
gccugccuucggugcgcagcgg

SEQ ID NO: 573501 - RNA, 22 nt, Human
cucugcuuuuaugugccggcgc

SEQ ID NO: 573502 - RNA, 22 nt, Human
ccugcugaggucagccacccaa

SEQ ID NO: 573503 - RNA, 22 nt, Human
cucaggaggaugacugccuugg

SEQ ID NO: 573504 - RNA, 22 nt, Human
acacagaguccuuacugaggua

SEQ ID NO: 573505 - RNA, 22 nt, Human
ugaagaggccaaacuaucauug

SEQ ID NO: 573506 - RNA, 22 nt, Human
cagcugccaagaaucuuuucua

SEQ ID NO: 573507 - RNA, 22 nt, Human
gcagccagguuugaggaccacu

SEQ ID NO: 573508 - RNA, 22 nt, Human
aaagggaauguguaggacaugu

SEQ ID NO: 573509 - RNA, 23 nt, Human
gcucccugugcuccaggagaugc

SEQ ID NO: 573510 - RNA, 22 nt, Human
cagaaauucccauuucagauuc

SEQ ID NO: 573511 - RNA, 22 nt, Human
gucccugcccuccugggacuca

SEQ ID NO: 573512 - RNA, 22 nt, Human
uuaauaaacaggugcagcugaa

SEQ ID NO: 573513 - RNA, 22 nt, Human
aaagcuauuuauuacagagaau

SEQ ID NO: 573514 - RNA, 22 nt, Human
ucugugucuguuacuucacugc

SEQ ID NO: 573515 - RNA, 22 nt, Human
gcuuccaucuaugucuucauca

SEQ ID NO: 573516 - RNA, 22 nt, Human
uggagcauacuaacccacucug

SEQ ID NO: 573517 - RNA, 22 nt, Human
ugcaguccaagagucuccuggu

SEQ ID NO: 573518 - RNA, 22 nt, Human
uguaugaaccuuuaauauagug

SEQ ID NO: 573519 - RNA, 22 nt, Human
caaagcaagggcugaagacucc

SEQ ID NO: 573520 - RNA, 23 nt, Human
ggggaaguggcagugagugaggc

SEQ ID NO: 573521 - RNA, 22 nt, Human
ggccaggagaggagggcacuga

SEQ ID NO: 573522 - RNA, 22 nt, Human
uucuccacccacucuuuuguug

SEQ ID NO: 573523 - RNA, 22 nt, Human
cagcucugggugacaggagggc

SEQ ID NO: 573524 - RNA, 17 nt, Human
uuuucucucuuggauuc

SEQ ID NO: 573525 - RNA, 22 nt, Human
caucugaaaucugccuacaagc

SEQ ID NO: 573526 - RNA, 22 nt, Human
aacauucuaugugcauucagaa

SEQ ID NO: 573527 - RNA, 22 nt, Human
gaaacagugagaacuuuuccug

SEQ ID NO: 573528 - RNA, 22 nt, Human
cccagcucuggaagguggggga

SEQ ID NO: 573529 - RNA, 22 nt, Human
ugcaugcagcauaugaggccuc

SEQ ID NO: 573530 - RNA, 22 nt, Human
agagggccauaggugcauaguu

SEQ ID NO: 573531 - RNA, 22 nt, Human
augcugaagaguucaugauuau

SEQ ID NO: 573532 - RNA, 22 nt, Human
ggcuuccuaauacucccuacac

SEQ ID NO: 573533 - RNA, 22 nt, Human
gggcugaggaacauauuuuguu

SEQ ID NO: 573534 - RNA, 22 nt, Human
aaagccaggggagggauuccca

SEQ ID NO: 573535 - RNA, 22 nt, Human
acuuccugggcaugcagagucc

SEQ ID NO: 573536 - RNA, 22 nt, Human
ggcagccagcaaugagaaguuu

SEQ ID NO: 573537 - RNA, 22 nt, Human
ccuccuggaaaaauucccuggc

SEQ ID NO: 573538 - RNA, 22 nt, Human
uagaaaugugauaauagcuuaa

SEQ ID NO: 573539 - RNA, 22 nt, Human
aaagaguuguuguauaacagga

SEQ ID NO: 573540 - RNA, 22 nt, Human
acuaaaaacuacugccaauagc

SEQ ID NO: 573541 - RNA, 22 nt, Human
cuuagaaaugcagauucucagg

SEQ ID NO: 573542 - RNA, 22 nt, Human
cuguggcauugugaggacugca

SEQ ID NO: 573543 - RNA, 22 nt, Human
ggcugugccucaaggcuacuca

SEQ ID NO: 573544 - RNA, 22 nt, Human
ccuuccagccccaucucaucgu

SEQ ID NO: 573545 - RNA, 22 nt, Human
gcucccugccuacacggaccuu

SEQ ID NO: 573546 - RNA, 22 nt, Human
uggcucagauaauucaaggggc

SEQ ID NO: 573547 - RNA, 22 nt, Human
gaguggagaucgugccacugca

SEQ ID NO: 573548 - RNA, 19 nt, Human
ucagcucuggggucagugg

SEQ ID NO: 573549 - RNA, 22 nt, Human
cucucuggucccagauuccaga

SEQ ID NO: 573550 - RNA, 22 nt, Human
uugcagagaucagcagguuuga

SEQ ID NO: 573551 - RNA, 22 nt, Human
cuuccuggaugaagcccagcau

SEQ ID NO: 573552 - RNA, 22 nt, Human
ggagugaggcauuuguagcuga

SEQ ID NO: 573553 - RNA, 22 nt, Human
ggcagccaggaggguguaguuu

SEQ ID NO: 573554 - RNA, 22 nt, Human
aauuucagaacuaucugggagu

SEQ ID NO: 573555 - RNA, 22 nt, Human
uuacagguggagaaguaaggcu

SEQ ID NO: 573556 - RNA, 23 nt, Human
ugcagaggcaugaucacugcuca

SEQ ID NO: 573557 - RNA, 22 nt, Human
cuuucaacuacauacaggcgau

SEQ ID NO: 573558 - RNA, 20 nt, Human
ggagaugcagcccaggugcc

SEQ ID NO: 573559 - RNA, 20 nt, Human
agcuccugaggguuacuuuc

SEQ ID NO: 573560 - RNA, 22 nt, Human
auuaaaagcuucccaagaguua

SEQ ID NO: 573561 - RNA, 22 nt, Human
aggccacaguugaggccagcaa

SEQ ID NO: 573562 - RNA, 22 nt, Human
uggccaggccggggacagaacu

SEQ ID NO: 573563 - RNA, 19 nt, Human
agucucugaggccuaaguu

SEQ ID NO: 573564 - RNA, 22 nt, Human
uucuaguuuucaguccaccagg

SEQ ID NO: 573565 - RNA, 22 nt, Human
ugauauguaacuacuccuuaua

SEQ ID NO: 573566 - RNA, 22 nt, Human
gcagggcuagauauuugcaagu

SEQ ID NO: 573567 - RNA, 22 nt, Human
aacaguacuggacaaggaguca

SEQ ID NO: 573568 - RNA, 22 nt, Human
acaguggaguugggguagcccu

SEQ ID NO: 573569 - RNA, 22 nt, Human
ucacagcuccagacugcaacuc

SEQ ID NO: 573570 - RNA, 22 nt, Human
auaauccaugucuagaguaaag

SEQ ID NO: 573571 - RNA, 22 nt, Human
uuguugcugcucaaccucuaua

SEQ ID NO: 573572 - RNA, 22 nt, Human
ucuagucauucaugcuaugauu

SEQ ID NO: 573573 - RNA, 20 nt, Human
uaacauaguccagagaacga

SEQ ID NO: 573574 - RNA, 22 nt, Human
aacacaaagaagcugcaggauc

SEQ ID NO: 573575 - RNA, 22 nt, Human
augugagggcucaggcugacug

SEQ ID NO: 573576 - RNA, 22 nt, Human
caggugucaaaauacuaagugg

SEQ ID NO: 573577 - RNA, 22 nt, Human
gaagcaugcuaaggauucucag

SEQ ID NO: 573578 - RNA, 22 nt, Human
uuauaaagugagaagugcuaug

SEQ ID NO: 573579 - RNA, 22 nt, Human
cuccagguugacuucagucaau

SEQ ID NO: 573580 - RNA, 22 nt, Human
ugcugagguaaccauauccugc

SEQ ID NO: 573581 - RNA, 22 nt, Human
uagaggugagauauuuuauuuu

SEQ ID NO: 573582 - RNA, 22 nt, Human
gugccugggcaugagcuuguug

SEQ ID NO: 573583 - RNA, 22 nt, Human
gacauugugguuauuaaauguu

SEQ ID NO: 573584 - RNA, 22 nt, Human
ugggccaggucugugucagcug

SEQ ID NO: 573585 - RNA, 22 nt, Human
agagcuggacgucugagcccua

SEQ ID NO: 573586 - RNA, 22 nt, Human
cccaggaguuugaguucagcau

SEQ ID NO: 573587 - RNA, 22 nt, Human
ugcuggagaugaaagggcccug

SEQ ID NO: 573588 - RNA, 22 nt, Human
ugacacaguaucaaacaugauu

SEQ ID NO: 573589 - RNA, 22 nt, Human
gcuggagaugcuaugcagaggg

SEQ ID NO: 573590 - RNA, 22 nt, Human
auucuucauguugaagcuguca

SEQ ID NO: 573591 - RNA, 22 nt, Human
augcagggagguaagaggugcc

SEQ ID NO: 573592 - RNA, 22 nt, Human
agacaacaccaaaugcuagugu

SEQ ID NO: 573593 - RNA, 22 nt, Human
gcuguggccaacaaaccacuuu

SEQ ID NO: 573594 - RNA, 22 nt, Human
caggggcaggugugagaucauc

SEQ ID NO: 573595 - RNA, 22 nt, Human
agguagaggccuccaggcagca

SEQ ID NO: 573596 - RNA, 22 nt, Human
acagucuuucuacauucugugc

SEQ ID NO: 573597 - RNA, 22 nt, Human
ugugaaagucaaauuaauugaa

SEQ ID NO: 573598 - RNA, 22 nt, Human
uaaaacugcuugguauggucua

SEQ ID NO: 573599 - RNA, 22 nt, Human
uaagacagggucuauucuuagu

SEQ ID NO: 573600 - RNA, 21 nt, Human
cugugacucccugggcaaucc

SEQ ID NO: 573601 - RNA, 22 nt, Human
agaauaaaucaaauguccugag

SEQ ID NO: 573602 - RNA, 22 nt, Human
ugcgcaggagcucugccaggag

SEQ ID NO: 573603 - RNA, 22 nt, Human
uugagucaguaauuccauuucu

SEQ ID NO: 573604 - RNA, 21 nt, Human
acacacugaguuuuccacugu

SEQ ID NO: 573605 - RNA, 22 nt, Human
gguuaaaaucuaaaaugugacu

SEQ ID NO: 573606 - RNA, 22 nt, Human
uuuuccuuaacagagggagaaa

SEQ ID NO: 573607 - RNA, 22 nt, Human
ucaauucugcauacauuucacu

SEQ ID NO: 573608 - RNA, 22 nt, Human
ccuuuugcucucccauccagaa

SEQ ID NO: 573609 - RNA, 19 nt, Human
uaaucuuauugggcagauu

SEQ ID NO: 573610 - RNA, 22 nt, Human
guuuguaugaauguuuuaugcu

SEQ ID NO: 573611 - RNA, 22 nt, Human
uaacugaacagccuaauucuuu

SEQ ID NO: 573612 - RNA, 21 nt, Human
ucagcuuugcaacugcacauc

SEQ ID NO: 573613 - RNA, 22 nt, Human
aggcccuggacacucaagccgg

SEQ ID NO: 573614 - RNA, 22 nt, Human
ugcuccuuucauccaauucuca

SEQ ID NO: 573615 - RNA, 22 nt, Human
cugcaguuugcuaagagacaaa

SEQ ID NO: 573616 - RNA, 22 nt, Human
guuauugacauguauuaagcac

SEQ ID NO: 573617 - RNA, 22 nt, Human
uuaccauuauuagguggacuug

SEQ ID NO: 573618 - RNA, 22 nt, Human
agcuccuguggcagcucuucug

SEQ ID NO: 573619 - RNA, 22 nt, Human
ccaggccuccugugaguggacc

SEQ ID NO: 573620 - RNA, 22 nt, Human
ucaggcaggaagccccugcaca

SEQ ID NO: 573621 - RNA, 22 nt, Human
cuuuuuguuguauaagcccuuu

SEQ ID NO: 573622 - RNA, 22 nt, Human
auauagguuaucauauuugccc

SEQ ID NO: 573623 - RNA, 19 nt, Human
agaguauugaauuugcccu

SEQ ID NO: 573624 - RNA, 22 nt, Human
caauuucucgaacucuaaucca

SEQ ID NO: 573625 - RNA, 22 nt, Human
uuuucucaggugcuuaucuaag

SEQ ID NO: 573626 - RNA, 22 nt, Human
uuguuuuuagagaagcccugaa

SEQ ID NO: 573627 - RNA, 22 nt, Human
aauuucaaagcucacuggcaua

SEQ ID NO: 573628 - RNA, 21 nt, Human
aaauuuucuuggcuguagugu

SEQ ID NO: 573629 - RNA, 22 nt, Human
uaggaaacuaauacagucugga

SEQ ID NO: 573630 - RNA, 22 nt, Human
gacaggugcuaagggaccuggc

SEQ ID NO: 573631 - RNA, 22 nt, Human
auguuuugauugguuaggucug

SEQ ID NO: 573632 - RNA, 22 nt, Human
ccuccugggacaggcuggcaca

SEQ ID NO: 573633 - RNA, 22 nt, Human
uccugaggccucugugauguga

SEQ ID NO: 573634 - RNA, 22 nt, Human
augcacaucuuacagaugcaga

SEQ ID NO: 573635 - RNA, 20 nt, Human
ucacauccucucccaacaug

SEQ ID NO: 573636 - RNA, 22 nt, Human
uucugccuucaguccucugacu

SEQ ID NO: 573637 - RNA, 22 nt, Human
uaaugaacacagaauuucacuu

SEQ ID NO: 573638 - RNA, 19 nt, Human
gcucucccucucaguugag

SEQ ID NO: 573639 - RNA, 22 nt, Human
aaugcauuagcuacauaugucu

SEQ ID NO: 573640 - RNA, 22 nt, Human
gguggcagagaggagguaguuu

SEQ ID NO: 573641 - RNA, 22 nt, Human
ugucuccauagaguagcuugau

SEQ ID NO: 573642 - RNA, 22 nt, Human
ggccacagcagaugcuucagau

SEQ ID NO: 573643 - RNA, 22 nt, Human
uggcagaguuggagguggaaga

SEQ ID NO: 573644 - RNA, 22 nt, Human
aaauauagcaauuaugccuacu

SEQ ID NO: 573645 - RNA, 22 nt, Human
gucacagaucucuugagucaag

SEQ ID NO: 573646 - RNA, 22 nt, Human
uugagcccaggaggccugggug

SEQ ID NO: 573647 - RNA, 22 nt, Human
gagcugugagggacacauugcu

SEQ ID NO: 573648 - RNA, 22 nt, Human
gagugcuccuggauggauuucc

SEQ ID NO: 573649 - RNA, 22 nt, Human
ucucagggcagcaaggaagcau

SEQ ID NO: 573650 - RNA, 22 nt, Human
uugggugguggggagaguucag

SEQ ID NO: 573651 - RNA, 22 nt, Human
gcagggcuggggcugcuccuga

SEQ ID NO: 573652 - RNA, 22 nt, Human
gcugcccuaauaucacauguua

SEQ ID NO: 573653 - RNA, 23 nt, Human
acagagguccaaacaguauaagc

SEQ ID NO: 573654 - RNA, 22 nt, Human
gaagagguucaacguggucauc

SEQ ID NO: 573655 - RNA, 22 nt, Human
uaacuucagcgaguucucuuaa

SEQ ID NO: 573656 - RNA, 20 nt, Human
ccucaagcagacugacagcu

SEQ ID NO: 573657 - RNA, 22 nt, Human
uugagggacagaggugcugucu

SEQ ID NO: 573658 - RNA, 23 nt, Human
aaauagagauaggccagcuuugc

SEQ ID NO: 573659 - RNA, 22 nt, Human
agcagugggugacagagcugag

SEQ ID NO: 573660 - RNA, 23 nt, Human
uucuuucaagaaguucacagugc

SEQ ID NO: 573661 - RNA, 22 nt, Human
aaugaacauggacaaguuaaua

SEQ ID NO: 573662 - RNA, 22 nt, Human
uauuuggaauagcuugcuaaug

SEQ ID NO: 573663 - RNA, 22 nt, Human
gucagcugucuccccagagugg

SEQ ID NO: 573664 - RNA, 22 nt, Human
agccacaccuguccugccagcu

SEQ ID NO: 573665 - RNA, 19 nt, Human
gcuucuguuugggcuuaga

SEQ ID NO: 573666 - RNA, 22 nt, Human
caaaggcaggugcugaauauuc

SEQ ID NO: 573667 - RNA, 22 nt, Human
uuugccuucucugaaccuauuu

SEQ ID NO: 573668 - RNA, 22 nt, Human
agcaaggauuauccugggaagg

SEQ ID NO: 573669 - RNA, 23 nt, Human
uggagcugacagucagagggagg

SEQ ID NO: 573670 - RNA, 22 nt, Human
aggcugugaugagccucaugga

SEQ ID NO: 573671 - RNA, 22 nt, Human
ccagccaggcuggcuguggagg

SEQ ID NO: 573672 - RNA, 22 nt, Human
uacagaaauugccaccagcucu

SEQ ID NO: 573673 - RNA, 22 nt, Human
gugggcagugccugacggauga

SEQ ID NO: 573674 - RNA, 22 nt, Human
aaaagggacuacucucagcucc

SEQ ID NO: 573675 - RNA, 22 nt, Human
auauuagcagugaucaaaaugg

SEQ ID NO: 573676 - RNA, 22 nt, Human
ucuaaggagcgcuccagaaaaa

SEQ ID NO: 573677 - RNA, 22 nt, Human
gcauggcaagaucaggagacca

SEQ ID NO: 573678 - RNA, 22 nt, Human
uuucuaagugugauuuuagauu

SEQ ID NO: 573679 - RNA, 22 nt, Human
acagucugcaggcaaguucuac

SEQ ID NO: 573680 - RNA, 22 nt, Human
ugagauggggucaugcuuuguc

SEQ ID NO: 573681 - RNA, 17 nt, Human
gccaaaggguuccaauc

SEQ ID NO: 573682 - RNA, 22 nt, Human
uucaagcaccaaauuaguaggc

SEQ ID NO: 573683 - RNA, 22 nt, Human
cugggcagcuaccaccacugcu

SEQ ID NO: 573684 - RNA, 22 nt, Human
ugggugagcggcugcacacccg

SEQ ID NO: 573685 - RNA, 22 nt, Human
ucuguacaguaccagauaguaa

SEQ ID NO: 573686 - RNA, 22 nt, Human
cagggagcuggcuggcgugagu

SEQ ID NO: 573687 - RNA, 22 nt, Human
gaucaguaagugaauaaugagu

SEQ ID NO: 573688 - RNA, 22 nt, Human
agcucccagcuccuuugagaga

SEQ ID NO: 573689 - RNA, 18 nt, Human
cagcagagacauucaaaa

SEQ ID NO: 573690 - RNA, 22 nt, Human
uauuuaaaauaagccccagugg

SEQ ID NO: 573691 - RNA, 22 nt, Human
cuucuaggcuucucagggggca

SEQ ID NO: 573692 - RNA, 22 nt, Human
uuuagaggggaaaguggcuggu

SEQ ID NO: 573693 - RNA, 22 nt, Human
ggugauuuauccauuuucuggu

SEQ ID NO: 573694 - RNA, 19 nt, Human
gguggcagaacgugggucc

SEQ ID NO: 573695 - RNA, 22 nt, Human
cuugcuuuugcugaugauuaag

SEQ ID NO: 573696 - RNA, 22 nt, Human
cuguggcauugccgaggcuggc

SEQ ID NO: 573697 - RNA, 22 nt, Human
aggcuggagugcuggagugcug

SEQ ID NO: 573698 - RNA, 22 nt, Human
caggugguugagagcuguaggc

SEQ ID NO: 573699 - RNA, 22 nt, Human
cuugugcaucauaguuugccaa

SEQ ID NO: 573700 - RNA, 22 nt, Human
uugcaguugcuuucuauauuga

SEQ ID NO: 573701 - RNA, 22 nt, Human
aaugaaacuauauuuagagagg

SEQ ID NO: 573702 - RNA, 22 nt, Human
ugcaggagcugcuguccugcuc

SEQ ID NO: 573703 - RNA, 22 nt, Human
uucuccagacccuccugcagac

SEQ ID NO: 573704 - RNA, 23 nt, Human
ggacagggcccugcccuauggcc

SEQ ID NO: 573705 - RNA, 22 nt, Human
ugguccuggucaucugggcugg

SEQ ID NO: 573706 - RNA, 18 nt, Human
acugaagaugcaagaccu

SEQ ID NO: 573707 - RNA, 22 nt, Human
gcaauaaauaacauggaagaca

SEQ ID NO: 573708 - RNA, 22 nt, Human
aaaucuguuucucauaggguag

SEQ ID NO: 573709 - RNA, 22 nt, Human
cuacacagagccuacuucugca

SEQ ID NO: 573710 - RNA, 22 nt, Human
acguuauaucugaaaaaaguga

SEQ ID NO: 573711 - RNA, 22 nt, Human
cacacuuugugcuaaucuauuu

SEQ ID NO: 573712 - RNA, 22 nt, Human
uaaaguuuauuggcaccaccau

SEQ ID NO: 573713 - RNA, 22 nt, Human
cuugcagggcugaugggaagug

SEQ ID NO: 573714 - RNA, 22 nt, Human
ugagccuguccugugcauguga

SEQ ID NO: 573715 - RNA, 22 nt, Human
gccugcuggaggagccucaggg

SEQ ID NO: 573716 - RNA, 22 nt, Human
aagcccagaugugagaacugag

SEQ ID NO: 573717 - RNA, 22 nt, Human
gggcagcaugaggacccucauc

SEQ ID NO: 573718 - RNA, 22 nt, Human
ccaggcucugucuggucagaag

SEQ ID NO: 573719 - RNA, 22 nt, Human
agcccuggcucccagcagcgcu

SEQ ID NO: 573720 - RNA, 22 nt, Human
uggcaguuggggaugaagugag

SEQ ID NO: 573721 - RNA, 16 nt, Human
aacaaugccaauccag

SEQ ID NO: 573722 - RNA, 22 nt, Human
agagcagaggcauggccguggg

SEQ ID NO: 573723 - RNA, 22 nt, Human
uucaguuucaaauccuggaugc

SEQ ID NO: 573724 - RNA, 22 nt, Human
acccaggagacagguugcagug

SEQ ID NO: 573725 - RNA, 21 nt, Human
uggcucaguugcugggcacag

SEQ ID NO: 573726 - RNA, 21 nt, Human
auggaaauuggcaaaugcuac

SEQ ID NO: 573727 - RNA, 22 nt, Human
agugaugugggagaguauagcu

SEQ ID NO: 573728 - RNA, 22 nt, Human
aacaggaaugaggagaaaaggu

SEQ ID NO: 573729 - RNA, 22 nt, Human
agcccagcagaaaguccagccu

SEQ ID NO: 573730 - RNA, 18 nt, Human
cccagcuccacuucccuc

SEQ ID NO: 573731 - RNA, 22 nt, Human
ugaccacacuugaucacucuga

SEQ ID NO: 573732 - RNA, 22 nt, Human
gcacccuagaguugccugagga

SEQ ID NO: 573733 - RNA, 22 nt, Human
agacauuuugcaauggguagcu

SEQ ID NO: 573734 - RNA, 22 nt, Human
aggcacugaagugguaaaugua

SEQ ID NO: 573735 - RNA, 22 nt, Human
cugugagggcagggaccagagg

SEQ ID NO: 573736 - RNA, 22 nt, Human
cauuguuuugagaacaaccuga

SEQ ID NO: 573737 - RNA, 22 nt, Human
ucagaggaucaugucccuacuc

SEQ ID NO: 573738 - RNA, 22 nt, Human
uuugacauuaaggaacauauau

SEQ ID NO: 573739 - RNA, 22 nt, Human
ugagcuggaaucuucuugacug

SEQ ID NO: 573740 - RNA, 22 nt, Human
acuguacacacuucucugucuu

SEQ ID NO: 573741 - RNA, 22 nt, Human
uuauuuccugacacagcugauu

SEQ ID NO: 573742 - RNA, 22 nt, Human
uuaaugcagcucuaccacacag

SEQ ID NO: 573743 - RNA, 22 nt, Human
ucuuccuuucauucauguguua

SEQ ID NO: 573744 - RNA, 22 nt, Human
ccuggccugcucggcucuuaag

SEQ ID NO: 573745 - RNA, 22 nt, Human
ucugugugguaguuucagugaa

SEQ ID NO: 573746 - RNA, 22 nt, Human
ugaacacauuuucuucaguaga

SEQ ID NO: 573747 - RNA, 22 nt, Human
uggaacacuguggaugagaaga

SEQ ID NO: 573748 - RNA, 22 nt, Human
guggggcuaaaaacugugcagu

SEQ ID NO: 573749 - RNA, 22 nt, Human
gcaggcuggaggcuguucuggg

SEQ ID NO: 573750 - RNA, 22 nt, Human
ccugcuggacagggguguucau

SEQ ID NO: 573751 - RNA, 22 nt, Human
cugcuguuuggugagugagaaa

SEQ ID NO: 573752 - RNA, 22 nt, Human
uuuagacaggggcaaaauaagg

SEQ ID NO: 573753 - RNA, 22 nt, Human
gcuguuucggguggagguggag

SEQ ID NO: 573754 - RNA, 22 nt, Human
gaaugaaagauuugcauucuau

SEQ ID NO: 573755 - RNA, 22 nt, Human
ggcugagccuggagcaucuggu

SEQ ID NO: 573756 - RNA, 22 nt, Human
cauugaauccuuccuucagaag

SEQ ID NO: 573757 - RNA, 22 nt, Human
ccugagugaauucccucacugu

SEQ ID NO: 573758 - RNA, 22 nt, Human
ucccagcuacucuagaggcuga

SEQ ID NO: 573759 - RNA, 22 nt, Human
aguuaaugagcauuuuggaaug

SEQ ID NO: 573760 - RNA, 22 nt, Human
uuccugguaacaaucucaaagu

SEQ ID NO: 573761 - RNA, 22 nt, Human
uaaacagccuaaaacuuucuuu

SEQ ID NO: 573762 - RNA, 21 nt, Human
gaaggagaaagcaagugcugc

SEQ ID NO: 573763 - RNA, 22 nt, Human
cugggcucccucaugugucugc

SEQ ID NO: 573764 - RNA, 22 nt, Human
cacuuuauauucuaagacggcc

SEQ ID NO: 573765 - RNA, 22 nt, Human
cugccucuuaaguggauggagu

SEQ ID NO: 573766 - RNA, 22 nt, Human
gggaggugaaaggucaugugug

SEQ ID NO: 573767 - RNA, 22 nt, Human
aucgagggugaguacagcggac

SEQ ID NO: 573768 - RNA, 22 nt, Human
ccuggcagcgccgaagcuggcc

SEQ ID NO: 573769 - RNA, 22 nt, Human
caccuuugcaaaccaaaucuga

SEQ ID NO: 573770 - RNA, 22 nt, Human
aaguaggaauccgaaugaguag

SEQ ID NO: 573771 - RNA, 22 nt, Human
aguggcuguuuauaggugggua

SEQ ID NO: 573772 - RNA, 16 nt, Human
agaugggugggucacu

SEQ ID NO: 573773 - RNA, 22 nt, Human
gugcaaaaguaauugcaguacu

SEQ ID NO: 573774 - RNA, 20 nt, Human
uggagcuguaaucuugucug

SEQ ID NO: 573775 - RNA, 20 nt, Human
agugaggcaguucagugggc

SEQ ID NO: 573776 - RNA, 22 nt, Human
agcugggcaccccgcugcgucu

SEQ ID NO: 573777 - RNA, 22 nt, Human
uugcauaaaagaguauaucuua

SEQ ID NO: 573778 - RNA, 21 nt, Human
gacaggggaagaagcaaggag

SEQ ID NO: 573779 - RNA, 19 nt, Human
cuauuagcuugggcaucau

SEQ ID NO: 573780 - RNA, 22 nt, Human
cuggagagggagcccuggcagu

SEQ ID NO: 573781 - RNA, 20 nt, Human
ucagcucuuagaggucgcuu

SEQ ID NO: 573782 - RNA, 22 nt, Human
ucucuuucuauugcaccaugcu

SEQ ID NO: 573783 - RNA, 22 nt, Human
aggugcaguggcucaugccugu

SEQ ID NO: 573784 - RNA, 16 nt, Human
ucaguguuccagaaua

SEQ ID NO: 573785 - RNA, 19 nt, Human
ucugcagaggaauucuuca

SEQ ID NO: 573786 - RNA, 22 nt, Human
caggcagccugcggucugcaca

SEQ ID NO: 573787 - RNA, 22 nt, Human
aaacauucccuaauguguccgu

SEQ ID NO: 573788 - RNA, 22 nt, Human
ccucccaccauuuagagagagc

SEQ ID NO: 573789 - RNA, 22 nt, Human
aggggaugccugaggaucugua

SEQ ID NO: 573790 - RNA, 22 nt, Human
acaggccugacacacagagggc

SEQ ID NO: 573791 - RNA, 22 nt, Human
uggcacagggcuuggucgcuca

SEQ ID NO: 573792 - RNA, 20 nt, Human
auuaggauuuuaggucauca

SEQ ID NO: 573793 - RNA, 22 nt, Human
uuucagcacuuuaggcagcagg

SEQ ID NO: 573794 - RNA, 22 nt, Human
uccccagauggccagcuacaug

SEQ ID NO: 573795 - RNA, 22 nt, Human
ugaaagcagauagcucuguugu

SEQ ID NO: 573796 - RNA, 22 nt, Human
aaagcagcugcucuggccuuga

SEQ ID NO: 573797 - RNA, 22 nt, Human
gcugugugaaaacugggccugg

SEQ ID NO: 573798 - RNA, 22 nt, Human
uucaguuugcuacaagcaacau

SEQ ID NO: 573799 - RNA, 19 nt, Human
uccuggugcuugacacuga

SEQ ID NO: 573800 - RNA, 19 nt, Human
cugaggcccauguaccaug

SEQ ID NO: 573801 - RNA, 22 nt, Human
aacacuuuggaauagagauagg

SEQ ID NO: 573802 - RNA, 22 nt, Human
gcuggccauggggagugaggag

SEQ ID NO: 573803 - RNA, 22 nt, Human
ccugcaggcugcaggccaguuc

SEQ ID NO: 573804 - RNA, 22 nt, Human
caggagaagucucuagggggug

SEQ ID NO: 573805 - RNA, 22 nt, Human
uuguuucauggggauguuuauu

SEQ ID NO: 573806 - RNA, 22 nt, Human
uuguucuuuauccuggaagccu

SEQ ID NO: 573807 - RNA, 22 nt, Human
aaaguauguuguggcuuuuaaa

SEQ ID NO: 573808 - RNA, 22 nt, Human
ucucccaguggugcagaaagca

SEQ ID NO: 573809 - RNA, 22 nt, Human
ccugaagagugaauguggcagu

SEQ ID NO: 573810 - RNA, 22 nt, Human
agccuggauccuaggcucagcu

SEQ ID NO: 573811 - RNA, 19 nt, Human
aggaauggaauuaauucug

SEQ ID NO: 573812 - RNA, 22 nt, Human
uuugacccuguuauucucccug

SEQ ID NO: 573813 - RNA, 22 nt, Human
auguuccugauccucguucuau

SEQ ID NO: 573814 - RNA, 22 nt, Human
cuuuugcaccuuuuaaguaaug

SEQ ID NO: 573815 - RNA, 22 nt, Human
augccuguaaucccagugcuuu

SEQ ID NO: 573816 - RNA, 22 nt, Human
uuaaagcaggcaucauuccuca

SEQ ID NO: 573817 - RNA, 22 nt, Human
ccagcuuuucuuaucauuauaa

SEQ ID NO: 573818 - RNA, 22 nt, Human
gagucacaaaagaugcccaggg

SEQ ID NO: 573819 - RNA, 22 nt, Human
cuuucucuguggugaggagggu

SEQ ID NO: 573820 - RNA, 22 nt, Human
uuuguacacaggauguuauaau

SEQ ID NO: 573821 - RNA, 22 nt, Human
ugucuccuauuuccugcuaagg

SEQ ID NO: 573822 - RNA, 22 nt, Human
gagaaagcuucuuucccacagg

SEQ ID NO: 573823 - RNA, 22 nt, Human
gaacagaugggcucagauccug

SEQ ID NO: 573824 - RNA, 22 nt, Human
auuaguguacaucucacacgca

SEQ ID NO: 573825 - RNA, 22 nt, Human
agauggcagcagaacaaacagg

SEQ ID NO: 573826 - RNA, 22 nt, Human
cuuguagaccccuggacucacg

SEQ ID NO: 573827 - RNA, 22 nt, Human
uugcauuugaucuuggguucuc

SEQ ID NO: 573828 - RNA, 22 nt, Human
uuuauuuauaagccacuugcug

SEQ ID NO: 573829 - RNA, 22 nt, Human
ucacagacucuugauugucuaa

SEQ ID NO: 573830 - RNA, 22 nt, Human
uggcaguguauagguggcuccu

SEQ ID NO: 573831 - RNA, 22 nt, Human
ccucagcuugauuucugcagag

SEQ ID NO: 573832 - RNA, 22 nt, Human
uuucuaguccucaugcaucauu

SEQ ID NO: 573833 - RNA, 22 nt, Human
uggcagcaaaaccagaaucaga

SEQ ID NO: 573834 - RNA, 22 nt, Human
agcccuggcccggcugugcuuu

SEQ ID NO: 573835 - RNA, 22 nt, Human
cacugaggcugggggagaaggu

SEQ ID NO: 573836 - RNA, 22 nt, Human
aaaaguaauugcaguuuugcca

SEQ ID NO: 573837 - RNA, 22 nt, Human
acaggagacccugcugguucug

SEQ ID NO: 573838 - RNA, 22 nt, Human
ggcagcugagcauggcuaccuu

SEQ ID NO: 573839 - RNA, 16 nt, Human
aagcauuggaauuagg

SEQ ID NO: 573840 - RNA, 22 nt, Human
ugcauuaaaaccaucgaccauc

SEQ ID NO: 573841 - RNA, 22 nt, Human
uccugggauucugcauuucuaa

SEQ ID NO: 573842 - RNA, 22 nt, Human
acugaaaaaguaugauucacug

SEQ ID NO: 573843 - RNA, 22 nt, Human
aucacaaaggcugcuucaugau

SEQ ID NO: 573844 - RNA, 22 nt, Human
guuucucuguaccucuguccca

SEQ ID NO: 573845 - RNA, 22 nt, Human
cugggucuggccacaggaagua

SEQ ID NO: 573846 - RNA, 22 nt, Human
aauauccauugggagcaaaugg

SEQ ID NO: 573847 - RNA, 22 nt, Human
aggcuaggggaacacuagaauc

SEQ ID NO: 573848 - RNA, 22 nt, Human
cacauuuagguuccuauagcca

SEQ ID NO: 573849 - RNA, 22 nt, Human
gagagguaauuugaagugcaaa

SEQ ID NO: 573850 - RNA, 22 nt, Human
uaauacuuugaaugagagcuaa

SEQ ID NO: 573851 - RNA, 22 nt, Human
uuauuacuguauuaauccagag

SEQ ID NO: 573852 - RNA, 22 nt, Human
ugaguucucacccauucuucuu

SEQ ID NO: 573853 - RNA, 22 nt, Human
acuucauuguaauauuauagca

SEQ ID NO: 573854 - RNA, 22 nt, Human
agggagaagguccaugccuguc

SEQ ID NO: 573855 - RNA, 22 nt, Human
ucagagaacugcagcccuuccu

SEQ ID NO: 573856 - RNA, 22 nt, Human
acugccagaggagguaucugaa

SEQ ID NO: 573857 - RNA, 22 nt, Human
uuccuggggcuccagcuaccag

SEQ ID NO: 573858 - RNA, 22 nt, Human
gcugggagccguaccugucacg

SEQ ID NO: 573859 - RNA, 22 nt, Human
auuugcagagcucugaauuuug

SEQ ID NO: 573860 - RNA, 22 nt, Human
uaccaugaucaggcucauccuu

SEQ ID NO: 573861 - RNA, 22 nt, Human
ccaggagccugggccaggcugg

SEQ ID NO: 573862 - RNA, 22 nt, Human
ugccugaaugaucagucagauu

SEQ ID NO: 573863 - RNA, 22 nt, Human
agcccuugguauuuuccgaucc

SEQ ID NO: 573864 - RNA, 23 nt, Human
gugcucugcggucugcuagucug

SEQ ID NO: 573865 - RNA, 22 nt, Human
ugagcucauagcucuuauuaug

SEQ ID NO: 573866 - RNA, 22 nt, Human
agcacagugcucuggacagagu

SEQ ID NO: 573867 - RNA, 22 nt, Human
agcaagcagugaaguugaaugu

SEQ ID NO: 573868 - RNA, 22 nt, Human
acaaaugugauuguuucugaaa

SEQ ID NO: 573869 - RNA, 22 nt, Human
agcuucaguuuucuauuguuaa

SEQ ID NO: 573870 - RNA, 22 nt, Human
uauacacauguguguauucaua

SEQ ID NO: 573871 - RNA, 22 nt, Human
auuucauauguaucaccuagcc

SEQ ID NO: 573872 - RNA, 22 nt, Human
cuuuuacugugaaaagaaacug

SEQ ID NO: 573873 - RNA, 22 nt, Human
uauugcuuaaaaaauaugugag

SEQ ID NO: 573874 - RNA, 22 nt, Human
gcucucagaaguaacuugucca

SEQ ID NO: 573875 - RNA, 22 nt, Human
uucaacauguucuacauaaggg

SEQ ID NO: 573876 - RNA, 22 nt, Human
ggagcugaaggggugggcucag

SEQ ID NO: 573877 - RNA, 22 nt, Human
ggaggcucgcuggucgcacagc

SEQ ID NO: 573878 - RNA, 22 nt, Human
auacagugcacaaccugugcag

SEQ ID NO: 573879 - RNA, 22 nt, Human
cagggccuuguucaggagugaa

SEQ ID NO: 573880 - RNA, 22 nt, Human
gaggaaacauuguagaagcagu

SEQ ID NO: 573881 - RNA, 22 nt, Human
ucccaggccauaaaacucagag

SEQ ID NO: 573882 - RNA, 22 nt, Human
gagcucagaggauucuggggag

SEQ ID NO: 573883 - RNA, 22 nt, Human
ugcugccaugcagagcaacaga

SEQ ID NO: 573884 - RNA, 22 nt, Human
uuuuugugaaaucuccagacau

SEQ ID NO: 573885 - RNA, 22 nt, Human
guguaaagaugccaggaaucuu

SEQ ID NO: 573886 - RNA, 22 nt, Human
ggcagauguugcagugagcaga

SEQ ID NO: 573887 - RNA, 22 nt, Human
agucauuucccauucuucauau

SEQ ID NO: 573888 - RNA, 22 nt, Human
aauaacagauuuucaagcugug

SEQ ID NO: 573889 - RNA, 22 nt, Human
uguuuucagucauauagcaggu

SEQ ID NO: 573890 - RNA, 22 nt, Human
ugugagagcagaagacacauag

SEQ ID NO: 573891 - RNA, 22 nt, Human
uuucccaauugagagguucugu

SEQ ID NO: 573892 - RNA, 22 nt, Human
cuggaaaggguccucauucugu

SEQ ID NO: 573893 - RNA, 22 nt, Human
ggccucggcccacugcugcggu

SEQ ID NO: 573894 - RNA, 22 nt, Human
cuuucucuuacccaaggaucug

SEQ ID NO: 573895 - RNA, 22 nt, Human
aaauacagaguugcuuaaaagc

SEQ ID NO: 573896 - RNA, 22 nt, Human
agagaaacugauguccuuugaa

SEQ ID NO: 573897 - RNA, 22 nt, Human
ucugcauuuuuacaagaucccc

SEQ ID NO: 573898 - RNA, 22 nt, Human
ccagagccucgcccggagccuc

SEQ ID NO: 573899 - RNA, 22 nt, Human
cuuuuacauuuguugaagagua

SEQ ID NO: 573900 - RNA, 22 nt, Human
gauucuuuacucagauuuuguu

SEQ ID NO: 573901 - RNA, 22 nt, Human
agacagcuguuccuucauguuu

SEQ ID NO: 573902 - RNA, 22 nt, Human
ucagccugcgucauggugacac

SEQ ID NO: 573903 - RNA, 22 nt, Human
ugaaaaggguagaucccuaagu

SEQ ID NO: 573904 - RNA, 22 nt, Human
gcuggaguuaggugggcuugaa

SEQ ID NO: 573905 - RNA, 22 nt, Human
uuugaagucaaagauugauucc

SEQ ID NO: 573906 - RNA, 22 nt, Human
uuucuuccccacugcaggcucu

SEQ ID NO: 573907 - RNA, 22 nt, Human
augugaaauauuaagccgagga

SEQ ID NO: 573908 - RNA, 22 nt, Human
augugcuugaagccucagagaa

SEQ ID NO: 573909 - RNA, 22 nt, Human
ggaggagggguuuacauuggaa

SEQ ID NO: 573910 - RNA, 22 nt, Human
uguccuguucuggcgugagugg

SEQ ID NO: 573911 - RNA, 22 nt, Human
auuucucugcaguguucggaau

SEQ ID NO: 573912 - RNA, 22 nt, Human
uccagagcucugggcauagcug

SEQ ID NO: 573913 - RNA, 19 nt, Human
ucuccaggcaggugagcga

SEQ ID NO: 573914 - RNA, 22 nt, Human
uuuauauguuuguacaauuaag

SEQ ID NO: 573915 - RNA, 22 nt, Human
acaggcugguuuguaaaagaug

SEQ ID NO: 573916 - RNA, 22 nt, Human
acugggaaggaaaggaauguaa

SEQ ID NO: 573917 - RNA, 22 nt, Human
auuccacugccgaaugauacau

SEQ ID NO: 573918 - RNA, 22 nt, Human
uuacaucagcaagaguguaugu

SEQ ID NO: 573919 - RNA, 22 nt, Human
ugggggugugccagggaccucc

SEQ ID NO: 573920 - RNA, 22 nt, Human
gggcccaggccuccuuccuucc

SEQ ID NO: 573921 - RNA, 22 nt, Human
ugggagaauauauuuaaaacuu

SEQ ID NO: 573922 - RNA, 22 nt, Human
uggaacaauucuugaagggaau

SEQ ID NO: 573923 - RNA, 22 nt, Human
ugucaccaugccagcuucugcc

SEQ ID NO: 573924 - RNA, 22 nt, Human
gagggugcaggcaagagcaaaa

SEQ ID NO: 573925 - RNA, 22 nt, Human
ccuggagccccucuggccagcc

SEQ ID NO: 573926 - RNA, 22 nt, Human
ucuggugucaguauucuuugaa

SEQ ID NO: 573927 - RNA, 22 nt, Human
agauaauuauuuacuucaaagu

SEQ ID NO: 573928 - RNA, 22 nt, Human
acaguaaaacauuuuuauuagg

SEQ ID NO: 573929 - RNA, 22 nt, Human
cauguaaaaagaagaaucugga

SEQ ID NO: 573930 - RNA, 22 nt, Human
uuaugauuugccacagauuggu

SEQ ID NO: 573931 - RNA, 22 nt, Human
guacauucuguggacuuggaca

SEQ ID NO: 573932 - RNA, 22 nt, Human
gccaggaggcugcuguguaggc

SEQ ID NO: 573933 - RNA, 22 nt, Human
agucaacaaaaauguggagccu

SEQ ID NO: 573934 - RNA, 21 nt, Human
aagcaggacauaugaugcccu

SEQ ID NO: 573935 - RNA, 19 nt, Human
acagagcucucugcuucug

SEQ ID NO: 573936 - RNA, 22 nt, Human
accuccaggaagcucuugguac

SEQ ID NO: 573937 - RNA, 22 nt, Human
uggcucaucuaucagaaagucc

SEQ ID NO: 573938 - RNA, 22 nt, Human
ugcucauuaggacugcaaauuc

SEQ ID NO: 573939 - RNA, 22 nt, Human
ucagggcaagauugguuaauaa

SEQ ID NO: 573940 - RNA, 23 nt, Human
aggcugcuuacugguaucagagc

SEQ ID NO: 573941 - RNA, 21 nt, Human
ggccuaggggcagauggugcu

SEQ ID NO: 573942 - RNA, 22 nt, Human
ugcccugcugugccuggagcca

SEQ ID NO: 573943 - RNA, 22 nt, Human
aaucagagaaguuuccuaugcc

SEQ ID NO: 573944 - RNA, 22 nt, Human
acagaguauuggaaaggcagug

SEQ ID NO: 573945 - RNA, 22 nt, Human
auaugggggggcgugcagagga

SEQ ID NO: 573946 - RNA, 22 nt, Human
auucacaauuagaaguagauaa

SEQ ID NO: 573947 - RNA, 22 nt, Human
ucccagaguuuccuguguccca

SEQ ID NO: 573948 - RNA, 22 nt, Human
uuggcuuccugcacuugaguuu

SEQ ID NO: 573949 - RNA, 22 nt, Human
cagaaguaagauuacugugaga

SEQ ID NO: 573950 - RNA, 19 nt, Human
aggauggagcaggcgguga

SEQ ID NO: 573951 - RNA, 22 nt, Human
ccacaggaccagaggagaucac

SEQ ID NO: 573952 - RNA, 22 nt, Human
ucugucaccauucagcuugaau

SEQ ID NO: 573953 - RNA, 22 nt, Human
agucaguguucuccggagaggc

SEQ ID NO: 573954 - RNA, 22 nt, Human
ucucugagguuguuuccagcac

SEQ ID NO: 573955 - RNA, 20 nt, Human
gggugugggcccggccaggc

SEQ ID NO: 573956 - RNA, 22 nt, Human
uuauucuuuucuccagaauccc

SEQ ID NO: 573957 - RNA, 22 nt, Human
uggggauguaaaugaggugaua

SEQ ID NO: 573958 - RNA, 20 nt, Human
gccuggaggcagagauaaag

SEQ ID NO: 573959 - RNA, 22 nt, Human
gucaggacauuuuaccauccug

SEQ ID NO: 573960 - RNA, 22 nt, Human
acaugcucuccuaaggcccugu

SEQ ID NO: 573961 - RNA, 22 nt, Human
agugacaggggaggcaggugug

SEQ ID NO: 573962 - RNA, 22 nt, Human
uuucauugugaugcuuuuauca

SEQ ID NO: 573963 - RNA, 17 nt, Human
uuccaguuuaguauugu

SEQ ID NO: 573964 - RNA, 22 nt, Human
cacaauuuuccuuuaaguguau

SEQ ID NO: 573965 - RNA, 21 nt, Human
gcagccagccgagaccaugcc

SEQ ID NO: 573966 - RNA, 23 nt, Human
ccagccucugggucuucauccag

SEQ ID NO: 573967 - RNA, 22 nt, Human
agcuucuggaaggcaaggcuug

SEQ ID NO: 573968 - RNA, 22 nt, Human
caaguuguacagauuguauuag

SEQ ID NO: 573969 - RNA, 22 nt, Human
ugucauuuaauagauaugaugg

SEQ ID NO: 573970 - RNA, 22 nt, Human
acacuucuauucccugcacaaa

SEQ ID NO: 573971 - RNA, 22 nt, Human
cauacauugcucauucaguauc

SEQ ID NO: 573972 - RNA, 22 nt, Human
uuucaugcacaaaugagcaagg

SEQ ID NO: 573973 - RNA, 20 nt, Human
cccaggagugagcagcuuua

SEQ ID NO: 573974 - RNA, 22 nt, Human
uuguguaaugaaguuaucaugu

SEQ ID NO: 573975 - RNA, 18 nt, Human
ucagccuguugucugccu

SEQ ID NO: 573976 - RNA, 22 nt, Human
ggagucugggaauuggagagaa

SEQ ID NO: 573977 - RNA, 22 nt, Human
gccacagucacugcugcagggg

SEQ ID NO: 573978 - RNA, 22 nt, Human
agaggccagaucaucauagaug

SEQ ID NO: 573979 - RNA, 22 nt, Human
aaaguguuuugauuuaguggua

SEQ ID NO: 573980 - RNA, 22 nt, Human
acauucuucuugugaauuuacu

SEQ ID NO: 573981 - RNA, 22 nt, Human
aguucucagcuuaguaugcugu

SEQ ID NO: 573982 - RNA, 20 nt, Human
agaaucugacccagagagac

SEQ ID NO: 573983 - RNA, 22 nt, Human
ugcugugggcaguacauaagcu

SEQ ID NO: 573984 - RNA, 22 nt, Human
ucugccugcuucuucauagucu

SEQ ID NO: 573985 - RNA, 22 nt, Human
cacuguucaucaaaacugcucu

SEQ ID NO: 573986 - RNA, 22 nt, Human
gccacagggcagaugcgcagag

SEQ ID NO: 573987 - RNA, 22 nt, Human
agucugggagaaggugagauua

SEQ ID NO: 573988 - RNA, 22 nt, Human
ugccacaguuguuugugcucua

SEQ ID NO: 573989 - RNA, 22 nt, Human
uuaagacuauuguaauagggga

SEQ ID NO: 573990 - RNA, 22 nt, Human
ccugggcaauauagugaggccc

SEQ ID NO: 573991 - RNA, 22 nt, Human
gggcugagugaccucaggccaa

SEQ ID NO: 573992 - RNA, 22 nt, Human
aguuucaauucuuuucacaaag

SEQ ID NO: 573993 - RNA, 22 nt, Human
ucaaagguuaacucuguuguuc

SEQ ID NO: 573994 - RNA, 22 nt, Human
ugugcccauuccacuugaguac

SEQ ID NO: 573995 - RNA, 22 nt, Human
caggguuucuguugagaagucc

SEQ ID NO: 573996 - RNA, 22 nt, Human
ggccagagaagucagacccuug

SEQ ID NO: 573997 - RNA, 22 nt, Human
cagcuuccgaccgggggcugca

SEQ ID NO: 573998 - RNA, 22 nt, Human
acaaggaacaagcauguaguuu

SEQ ID NO: 573999 - RNA, 22 nt, Human
gcucugucuucagcacacagua

SEQ ID NO: 574000 - RNA, 17 nt, Human
gagauggguggaucacc

SEQ ID NO: 574001 - RNA, 22 nt, Human
uuaguuuauaauucauuucugu

SEQ ID NO: 574002 - RNA, 22 nt, Human
uuuacacugacagcacauaagg

SEQ ID NO: 574003 - RNA, 22 nt, Human
agggacagaugaaugacugagu

SEQ ID NO: 574004 - RNA, 19 nt, Human
cuccaggauggcugggcga

SEQ ID NO: 574005 - RNA, 22 nt, Human
uguucauuuugaaguacuucaa

SEQ ID NO: 574006 - RNA, 22 nt, Human
ugcuuaaagcugcucaguugua

SEQ ID NO: 574007 - RNA, 20 nt, Human
ucauacacaugagcaugcag

SEQ ID NO: 574008 - RNA, 22 nt, Human
aguucccaggugaugcugaugu

SEQ ID NO: 574009 - RNA, 22 nt, Human
uaauaauuggcaauguugagca

SEQ ID NO: 574010 - RNA, 22 nt, Human
aggcaggcugcuauggaguaga

SEQ ID NO: 574011 - RNA, 22 nt, Human
uuuagcuucaguucuagcuucu

SEQ ID NO: 574012 - RNA, 22 nt, Human
acagcagcgugaaguguguuau

SEQ ID NO: 574013 - RNA, 22 nt, Human
agcuucucucaggguaucuuuc

SEQ ID NO: 574014 - RNA, 22 nt, Human
ucugcccuggggucagccucca

SEQ ID NO: 574015 - RNA, 19 nt, Human
ucuugaggaaaguaaggca

SEQ ID NO: 574016 - RNA, 22 nt, Human
acaguagacccuggauaaacau

SEQ ID NO: 574017 - RNA, 22 nt, Human
ccugggcuccacuccaagagca

SEQ ID NO: 574018 - RNA, 22 nt, Human
uccuguggucauucuucugccc

SEQ ID NO: 574019 - RNA, 22 nt, Human
ugcaggagauaauggugcuuag

SEQ ID NO: 574020 - RNA, 22 nt, Human
aagggugggcccuggcagccau

SEQ ID NO: 574021 - RNA, 22 nt, Human
uuguuuuaagccagucugccua

SEQ ID NO: 574022 - RNA, 22 nt, Human
uauuagcuuuagccuuuggaug

SEQ ID NO: 574023 - RNA, 22 nt, Human
uccagucucuacucugagauaa

SEQ ID NO: 574024 - RNA, 22 nt, Human
uuucaucuuccuuggcauaggu

SEQ ID NO: 574025 - RNA, 22 nt, Human
ucugggaauacacacugauuua

SEQ ID NO: 574026 - RNA, 19 nt, Human
caauauauagugaguggau

SEQ ID NO: 574027 - RNA, 22 nt, Human
uucauucugcaguucucagcuc

SEQ ID NO: 574028 - RNA, 22 nt, Human
augcagagacagauguggcaug

SEQ ID NO: 574029 - RNA, 22 nt, Human
uuugcugaccccauucugaguc

SEQ ID NO: 574030 - RNA, 22 nt, Human
cagucccagacccagaaggugg

SEQ ID NO: 574031 - RNA, 22 nt, Human
cauuuucaugaguuucuguuca

SEQ ID NO: 574032 - RNA, 22 nt, Human
aggguggcugugaagugcuugg

SEQ ID NO: 574033 - RNA, 22 nt, Human
ccaggugucaugcgugugaccc

SEQ ID NO: 574034 - RNA, 22 nt, Human
gggcagagacucagaaacagaa

SEQ ID NO: 574035 - RNA, 22 nt, Human
uuccugaggugauucuaaugug

SEQ ID NO: 574036 - RNA, 22 nt, Human
ugcccugcaugcagggagcugu

SEQ ID NO: 574037 - RNA, 18 nt, Human
uguugaaacuucagguaa

SEQ ID NO: 574038 - RNA, 21 nt, Human
uucaguuucuuccucaucuau

SEQ ID NO: 574039 - RNA, 22 nt, Human
ugugauuuccagccauuaaaaa

SEQ ID NO: 574040 - RNA, 22 nt, Human
uugcaggggagaggaacaaaca

SEQ ID NO: 574041 - RNA, 21 nt, Human
acaugucucuaaucucaguga

SEQ ID NO: 574042 - RNA, 22 nt, Human
agagccuggacuuuucugagcc

SEQ ID NO: 574043 - RNA, 22 nt, Human
ccuagcagggaagcagugagga

SEQ ID NO: 574044 - RNA, 22 nt, Human
aagcagagccaccagcuuugga

SEQ ID NO: 574045 - RNA, 22 nt, Human
aggccaaguagccgcuguccua

SEQ ID NO: 574046 - RNA, 22 nt, Human
ccacugggggcugcucccaggu

SEQ ID NO: 574047 - RNA, 22 nt, Human
auuagugucugugaauaauucu

SEQ ID NO: 574048 - RNA, 22 nt, Human
aaacaguuucuaaucauggaga

SEQ ID NO: 574049 - RNA, 22 nt, Human
ccacagggucagccacucugca

SEQ ID NO: 574050 - RNA, 22 nt, Human
agagccaggccaggccggggca

SEQ ID NO: 574051 - RNA, 22 nt, Human
aggcugccagaagccuucagga

SEQ ID NO: 574052 - RNA, 22 nt, Human
ucagcucucacagaucucaacc

SEQ ID NO: 574053 - RNA, 22 nt, Human
ucacagcaaaagugugcagagc

SEQ ID NO: 574054 - RNA, 22 nt, Human
uccagcuggggcaguggcuggg

SEQ ID NO: 574055 - RNA, 22 nt, Human
acuggaguaaaggucacuugug

SEQ ID NO: 574056 - RNA, 22 nt, Human
uuuuuaagagucuggaaauagu

SEQ ID NO: 574057 - RNA, 22 nt, Human
aggggagaguuaaugugaaugu

SEQ ID NO: 574058 - RNA, 22 nt, Human
aucacaaaggucucagagcaca

SEQ ID NO: 574059 - RNA, 22 nt, Human
ucaggaggccggcaggauuuga

SEQ ID NO: 574060 - RNA, 22 nt, Human
aguuuacagaugcuacaggagc

SEQ ID NO: 574061 - RNA, 22 nt, Human
cacccaguaagcaugaggcccu

SEQ ID NO: 574062 - RNA, 16 nt, Human
cacauauauuuauaug

SEQ ID NO: 574063 - RNA, 22 nt, Human
ugucugguggguugacaggcag

SEQ ID NO: 574064 - RNA, 22 nt, Human
ucucuuguaauuuaaaaaaucu

SEQ ID NO: 574065 - RNA, 22 nt, Human
ccagaggugguggugucuagaa

SEQ ID NO: 574066 - RNA, 22 nt, Human
uugcagaggcaaaaaugaacuc

SEQ ID NO: 574067 - RNA, 22 nt, Human
gcaaggaggcugguggaggaag

SEQ ID NO: 574068 - RNA, 22 nt, Human
aaucacauugaaucugcuaccu

SEQ ID NO: 574069 - RNA, 23 nt, Human
aacacauugcuaauuacauucaa

SEQ ID NO: 574070 - RNA, 22 nt, Human
ucauuucagccauuuuuaaaug

SEQ ID NO: 574071 - RNA, 22 nt, Human
guuuuccauggaggucugaccu

SEQ ID NO: 574072 - RNA, 22 nt, Human
uuucuguuguauggcuucugca

SEQ ID NO: 574073 - RNA, 22 nt, Human
uggcaggaagacguggggcacc

SEQ ID NO: 574074 - RNA, 22 nt, Human
uggcugagaccaucagggugua

SEQ ID NO: 574075 - RNA, 22 nt, Human
gaguguaaucugaaaacuugaa

SEQ ID NO: 574076 - RNA, 23 nt, Human
ugggauggauucaccagugugcu

SEQ ID NO: 574077 - RNA, 22 nt, Human
uccagaggcucugagggagagu

SEQ ID NO: 574078 - RNA, 22 nt, Human
ucugagaaaucaguggugaaua

SEQ ID NO: 574079 - RNA, 17 nt, Human
uuaagguggaucagcac

SEQ ID NO: 574080 - RNA, 22 nt, Human
cauacuuuuuagaucugccuuc

SEQ ID NO: 574081 - RNA, 22 nt, Human
guuucugauucuagaggcaggc

SEQ ID NO: 574082 - RNA, 22 nt, Human
cugaaaggaauaaggcucuuug

SEQ ID NO: 574083 - RNA, 22 nt, Human
agagcuguuuauugaugucaca

SEQ ID NO: 574084 - RNA, 22 nt, Human
agaauacaauuguucaguaaua

SEQ ID NO: 574085 - RNA, 22 nt, Human
aaacaaacauagguuugaaagu

SEQ ID NO: 574086 - RNA, 22 nt, Human
acuguuauuuguaauccauuau

SEQ ID NO: 574087 - RNA, 22 nt, Human
augcaguuaugugagggcauga

SEQ ID NO: 574088 - RNA, 23 nt, Human
uggggccaagugaggaagggucu

SEQ ID NO: 574089 - RNA, 22 nt, Human
aauggcuuugaguauuuucugg

SEQ ID NO: 574090 - RNA, 22 nt, Human
cccuuagcucacaagcuaaagc

SEQ ID NO: 574091 - RNA, 18 nt, Human
agcuccuggucucaggga

SEQ ID NO: 574092 - RNA, 22 nt, Human
uucugaaauaggagauagcugu

SEQ ID NO: 574093 - RNA, 22 nt, Human
acacaugugauucuaagacagc

SEQ ID NO: 574094 - RNA, 22 nt, Human
ggcaggugcccagagagcacga

SEQ ID NO: 574095 - RNA, 22 nt, Human
ugcaggacucaaggguagcagg

SEQ ID NO: 574096 - RNA, 22 nt, Human
uuuuccucugcagagcaguuag

SEQ ID NO: 574097 - RNA, 23 nt, Human
acuuccaguugcuucagcauaug

SEQ ID NO: 574098 - RNA, 18 nt, Human
caggucagccuggccuca

SEQ ID NO: 574099 - RNA, 22 nt, Human
ccaaguccugcugccacucuac

SEQ ID NO: 574100 - RNA, 22 nt, Human
gcaggcuggucugaccaucccu

SEQ ID NO: 574101 - RNA, 22 nt, Human
ucagaggaggcauuuaaacaga

SEQ ID NO: 574102 - RNA, 22 nt, Human
uucacuguuggcuuugcuuguc

SEQ ID NO: 574103 - RNA, 22 nt, Human
uuauuauggcaguuuucuaggu

SEQ ID NO: 574104 - RNA, 22 nt, Human
agaaagcagcauuuaugaucuc

SEQ ID NO: 574105 - RNA, 22 nt, Human
augaggccacaguuauagauuu

SEQ ID NO: 574106 - RNA, 22 nt, Human
ucugccaccaacugucacuaca

SEQ ID NO: 574107 - RNA, 22 nt, Human
ugcagggccuuguugaugugcu

SEQ ID NO: 574108 - RNA, 22 nt, Human
ccagccccgggccuuaccgugc

SEQ ID NO: 574109 - RNA, 22 nt, Human
auacaaaguauugauccugagu

SEQ ID NO: 574110 - RNA, 22 nt, Human
aacuacagugggcagaggcaau

SEQ ID NO: 574111 - RNA, 22 nt, Human
auggcagcaaaugucuggcugg

SEQ ID NO: 574112 - RNA, 22 nt, Human
agcagcuguuuguugaauuggu

SEQ ID NO: 574113 - RNA, 22 nt, Human
aaacaauguagauuaccauuua

SEQ ID NO: 574114 - RNA, 22 nt, Human
cauggaaggcaaaagacacaga

SEQ ID NO: 574115 - RNA, 22 nt, Human
aagcacuguacaaaugucacuu

SEQ ID NO: 574116 - RNA, 22 nt, Human
guaacauuuacaguuccuagag

SEQ ID NO: 574117 - RNA, 22 nt, Human
uacacuggacaggaguaggaag

SEQ ID NO: 574118 - RNA, 22 nt, Human
uuccaaagaaauugaccaagac

SEQ ID NO: 574119 - RNA, 22 nt, Human
ccagagggcaaaaugaagcuua

SEQ ID NO: 574120 - RNA, 23 nt, Human
acaagauagggauaaaaagauaa

SEQ ID NO: 574121 - RNA, 22 nt, Human
uuuacagaauguugaauuuggg

SEQ ID NO: 574122 - RNA, 22 nt, Human
agaaugauagcuaguauuuacu

SEQ ID NO: 574123 - RNA, 22 nt, Human
gaaacagcuuuaagugauacug

SEQ ID NO: 574124 - RNA, 23 nt, Human
acauuucauauaaaagggaucag

SEQ ID NO: 574125 - RNA, 22 nt, Human
uugaggucuugaguacugggga

SEQ ID NO: 574126 - RNA, 22 nt, Human
cugcuuuaacucugggaagcca

SEQ ID NO: 574127 - RNA, 22 nt, Human
aacaguguguacacaucauagg

SEQ ID NO: 574128 - RNA, 22 nt, Human
gucuggaggcccgucagcccua

SEQ ID NO: 574129 - RNA, 22 nt, Human
gaggagaaugcgcaccacauau

SEQ ID NO: 574130 - RNA, 19 nt, Human
ccuggcugugaagccugca

SEQ ID NO: 574131 - RNA, 22 nt, Human
uccuuagcccacuaauacuuau

SEQ ID NO: 574132 - RNA, 22 nt, Human
gaaugcugagacuaaagagcuu

SEQ ID NO: 574133 - RNA, 22 nt, Human
ugcuugaagauauacuacuucc

SEQ ID NO: 574134 - RNA, 22 nt, Human
aaaacuuucagggauacagaaa

SEQ ID NO: 574135 - RNA, 22 nt, Human
gaagaacaagcagugcuuuccu

SEQ ID NO: 574136 - RNA, 22 nt, Human
caggcugugggagucaggaccc

SEQ ID NO: 574137 - RNA, 22 nt, Human
aagcacaggagacgcacagcca

SEQ ID NO: 574138 - RNA, 22 nt, Human
ugugggcacuaaugacaugcag

SEQ ID NO: 574139 - RNA, 22 nt, Human
uagggcaggggaggaaucugaa

SEQ ID NO: 574140 - RNA, 22 nt, Human
gaguguguuauuaaagauggaa

SEQ ID NO: 574141 - RNA, 16 nt, Human
acuggaguggggaugc

SEQ ID NO: 574142 - RNA, 22 nt, Human
gcaaggagacuguagggccaag

SEQ ID NO: 574143 - RNA, 22 nt, Human
cauuauggaagacaguguggug

SEQ ID NO: 574144 - RNA, 22 nt, Human
uccagcuuuuaccaaaugagca

SEQ ID NO: 574145 - RNA, 16 nt, Human
ggggaaggcaagaggg

SEQ ID NO: 574146 - RNA, 22 nt, Human
uaagcauucaaugcuuagcacu

SEQ ID NO: 574147 - RNA, 22 nt, Human
cagcaguggaacuacccaggga

SEQ ID NO: 574148 - RNA, 22 nt, Human
gaugcugggaccacagaguguu

SEQ ID NO: 574149 - RNA, 22 nt, Human
uuagcaagaaagauugcagcac

SEQ ID NO: 574150 - RNA, 22 nt, Human
uuauuuauggcccucaccugau

SEQ ID NO: 574151 - RNA, 22 nt, Human
ccugggcaaauuauguuacuca

SEQ ID NO: 574152 - RNA, 22 nt, Human
aaauagaauuaacuagcuacug

SEQ ID NO: 574153 - RNA, 22 nt, Human
gccugggugaauuugauccuaa

SEQ ID NO: 574154 - RNA, 22 nt, Human
ccagggcagggaccacgugucu

SEQ ID NO: 574155 - RNA, 16 nt, Human
aaggagggaagagaau

SEQ ID NO: 574156 - RNA, 22 nt, Human
ggaggccaggaagagccgcccu

SEQ ID NO: 574157 - RNA, 22 nt, Human
uaaaugagauuuguucuuuugu

SEQ ID NO: 574158 - RNA, 22 nt, Human
cucaggaaaauauugaagaagu

SEQ ID NO: 574159 - RNA, 22 nt, Human
aaaauacuguggaguguugaaa

SEQ ID NO: 574160 - RNA, 22 nt, Human
aggcuccacccuacagagcucc

SEQ ID NO: 574161 - RNA, 22 nt, Human
cuucugugcaauuguggaggag

SEQ ID NO: 574162 - RNA, 22 nt, Human
ugaacacagggccaaacuugag

SEQ ID NO: 574163 - RNA, 22 nt, Human
ccuguacaagcucuuggugaca

SEQ ID NO: 574164 - RNA, 22 nt, Human
cuggggcugcgguggaggagcc

SEQ ID NO: 574165 - RNA, 18 nt, Human
ggggagcagacugaacuc

SEQ ID NO: 574166 - RNA, 22 nt, Human
aguaucauuuuggcauuaguau

SEQ ID NO: 574167 - RNA, 22 nt, Human
acguuaaacauuuagcauagua

SEQ ID NO: 574168 - RNA, 22 nt, Human
gaggacagugugaucugccagc

SEQ ID NO: 574169 - RNA, 22 nt, Human
ucauaaaaguacucauguucau

SEQ ID NO: 574170 - RNA, 22 nt, Human
auuuagagaauaagacauaaau

SEQ ID NO: 574171 - RNA, 22 nt, Human
caccagcuacuccagggccgug

SEQ ID NO: 574172 - RNA, 22 nt, Human
auauuucagcuuuacuuaggaa

SEQ ID NO: 574173 - RNA, 22 nt, Human
aacacugagggaaaagagauag

SEQ ID NO: 574174 - RNA, 23 nt, Human
ggcucugaggauggagcuggugg

SEQ ID NO: 574175 - RNA, 22 nt, Human
augcauugaggaugacaugagu

SEQ ID NO: 574176 - RNA, 22 nt, Human
gaaugauauuauuucgugcugg

SEQ ID NO: 574177 - RNA, 22 nt, Human
ugcccagcaauaaaccagaaga

SEQ ID NO: 574178 - RNA, 22 nt, Human
uguucauagcuaucauuguguc

SEQ ID NO: 574179 - RNA, 22 nt, Human
uuagaaagcuuuccauagucaa

SEQ ID NO: 574180 - RNA, 22 nt, Human
uauuaucauugguaauaugguc

SEQ ID NO: 574181 - RNA, 23 nt, Human
uuaugcaagcuuccuggucucag

SEQ ID NO: 574182 - RNA, 22 nt, Human
uuuaggauauuaauguucagag

SEQ ID NO: 574183 - RNA, 20 nt, Human
agccccacccuuguccuggc

SEQ ID NO: 574184 - RNA, 22 nt, Human
gcuggccaggugcuuugguucu

SEQ ID NO: 574185 - RNA, 22 nt, Human
acagccagugacugcagacccu

SEQ ID NO: 574186 - RNA, 22 nt, Human
uuacaugguuguuggaaaugcu

SEQ ID NO: 574187 - RNA, 22 nt, Human
aacagaauugcugcugccaaug

SEQ ID NO: 574188 - RNA, 22 nt, Human
cagggugcauacccaugcauac

SEQ ID NO: 574189 - RNA, 22 nt, Human
agcuuuaaagcauauuucuaag

SEQ ID NO: 574190 - RNA, 22 nt, Human
cggcagagugugugcgugcaug

SEQ ID NO: 574191 - RNA, 22 nt, Human
ucccagcuguguggaggagaug

SEQ ID NO: 574192 - RNA, 22 nt, Human
gugcagauucccgggccucucc

SEQ ID NO: 574193 - RNA, 22 nt, Human
uucuuacaaguauuccaggucc

SEQ ID NO: 574194 - RNA, 22 nt, Human
uggcagagugcggcauccccug

SEQ ID NO: 574195 - RNA, 18 nt, Human
ugcucuguuuaaugauuu

SEQ ID NO: 574196 - RNA, 22 nt, Human
cagggcccagucccugcuguca

SEQ ID NO: 574197 - RNA, 21 nt, Human
gccaggaguagauuacauuua

SEQ ID NO: 574198 - RNA, 22 nt, Human
ugcugaaugugcucccuuuuaa

SEQ ID NO: 574199 - RNA, 22 nt, Human
caugggcaccuuaaaaugaggc

SEQ ID NO: 574200 - RNA, 18 nt, Human
aggcagcagcaucuucuc

SEQ ID NO: 574201 - RNA, 22 nt, Human
ugggggcuccaggcuccaggga

SEQ ID NO: 574202 - RNA, 22 nt, Human
gcugcuuuucacagagacaaga

SEQ ID NO: 574203 - RNA, 22 nt, Human
ucccaggacaugggcucugcuc

SEQ ID NO: 574204 - RNA, 22 nt, Human
aucugcaguuuguuuucucuug

SEQ ID NO: 574205 - RNA, 22 nt, Human
cugcaguuucagccuuucuggc

SEQ ID NO: 574206 - RNA, 22 nt, Human
guaacacuagcucugucacuuu

SEQ ID NO: 574207 - RNA, 22 nt, Human
cagagcuggagggaacccuggc

SEQ ID NO: 574208 - RNA, 22 nt, Human
uuugaauagggcuuugcaggga

SEQ ID NO: 574209 - RNA, 22 nt, Human
gccagcugcucgcguaggguag

SEQ ID NO: 574210 - RNA, 22 nt, Human
cuauuucagcugccuuugacug

SEQ ID NO: 574211 - RNA, 22 nt, Human
uucaggagaauuccaagaagua

SEQ ID NO: 574212 - RNA, 22 nt, Human
cugaaucauggucauuaguuua

SEQ ID NO: 574213 - RNA, 18 nt, Human
acauacauucugucugca

SEQ ID NO: 574214 - RNA, 22 nt, Human
uccacuucauccagggucacca

SEQ ID NO: 574215 - RNA, 22 nt, Human
ucucugcuugguguaugugagu

SEQ ID NO: 574216 - RNA, 22 nt, Human
agcuuugaaguauuuggucucc

SEQ ID NO: 574217 - RNA, 22 nt, Human
acugaagaacgcaucagugguu

SEQ ID NO: 574218 - RNA, 22 nt, Human
gugggguguccagcagcgagcu

SEQ ID NO: 574219 - RNA, 22 nt, Human
cagcucucacacuuagcuucua

SEQ ID NO: 574220 - RNA, 23 nt, Human
guuccuucauguggucauugguu

SEQ ID NO: 574221 - RNA, 22 nt, Human
cagggcuguuagcugcugcucu

SEQ ID NO: 574222 - RNA, 22 nt, Human
aggcugcguuagccucacuccc

SEQ ID NO: 574223 - RNA, 22 nt, Human
aagggcuggagaggaaagguug

SEQ ID NO: 574224 - RNA, 22 nt, Human
cagggcugucuccaaaggcccc

SEQ ID NO: 574225 - RNA, 22 nt, Human
auggcucagcccauggaagaaa

SEQ ID NO: 574226 - RNA, 22 nt, Human
ugacaauugcagacacagaagu

SEQ ID NO: 574227 - RNA, 22 nt, Human
ugaaacaaauuuggaaaaucua

SEQ ID NO: 574228 - RNA, 22 nt, Human
gcugagguaggagguugcagug

SEQ ID NO: 574229 - RNA, 22 nt, Human
cuucaguuaguuucaugugagc

SEQ ID NO: 574230 - RNA, 22 nt, Human
cagaagcagaacacuagauuua

SEQ ID NO: 574231 - RNA, 21 nt, Human
gcagaugggagucaucaggcu

SEQ ID NO: 574232 - RNA, 22 nt, Human
ucccucagcuugucuccaugca

SEQ ID NO: 574233 - RNA, 22 nt, Human
uccaggcacgaggcccugugca

SEQ ID NO: 574234 - RNA, 21 nt, Human
ugcugggcugcaggggaugca

SEQ ID NO: 574235 - RNA, 22 nt, Human
uacaaaaaauugauacugacga

SEQ ID NO: 574236 - RNA, 22 nt, Human
uggugcaguagagcugucuggg

SEQ ID NO: 574237 - RNA, 21 nt, Human
gaaaaccauuugcaucaugag

SEQ ID NO: 574238 - RNA, 22 nt, Human
aguccaaggccauacaguugug

SEQ ID NO: 574239 - RNA, 22 nt, Human
uuccagagcaguuuucagauca

SEQ ID NO: 574240 - RNA, 22 nt, Human
caguuucuucuauuuugaacua

SEQ ID NO: 574241 - RNA, 20 nt, Human
uacaacaaguagagacauac

SEQ ID NO: 574242 - RNA, 17 nt, Human
gaugaaaugaugcacac

SEQ ID NO: 574243 - RNA, 22 nt, Human
cauaacuggggacacuucucua

SEQ ID NO: 574244 - RNA, 22 nt, Human
cuuuacuucucaaaauaaagca

SEQ ID NO: 574245 - RNA, 22 nt, Human
uggcucauggaauuagcuauua

SEQ ID NO: 574246 - RNA, 22 nt, Human
cuucuggggauggagcccagaa

SEQ ID NO: 574247 - RNA, 22 nt, Human
ccuuccuggcuguccgccugau

SEQ ID NO: 574248 - RNA, 22 nt, Human
aagaggaguagaugugguuggu

SEQ ID NO: 574249 - RNA, 22 nt, Human
auguauuaugguuuuccuuaag

SEQ ID NO: 574250 - RNA, 22 nt, Human
acagucaggccgagaugggccu

SEQ ID NO: 574251 - RNA, 21 nt, Human
aaguugucucuuuugguuccu

SEQ ID NO: 574252 - RNA, 22 nt, Human
ggaacuccugcuccaagcagcu

SEQ ID NO: 574253 - RNA, 22 nt, Human
acagcucuguguauugucaucu

SEQ ID NO: 574254 - RNA, 22 nt, Human
auuagcuucugaagcccuugaa

SEQ ID NO: 574255 - RNA, 22 nt, Human
agugcaugccuuccuguggaug

SEQ ID NO: 574256 - RNA, 18 nt, Human
uacagcuugaguugacug

SEQ ID NO: 574257 - RNA, 22 nt, Human
uucacaguggcugacaggcugg

SEQ ID NO: 574258 - RNA, 22 nt, Human
ucacaggagggagagacaccca

SEQ ID NO: 574259 - RNA, 22 nt, Human
aaaucucaaaggcuuagcaucu

SEQ ID NO: 574260 - RNA, 22 nt, Human
gggcuucugcucuuuuggugcu

SEQ ID NO: 574261 - RNA, 23 nt, Human
gcugaauguaauguucuuugggu

SEQ ID NO: 574262 - RNA, 22 nt, Human
acuggggcaggaaaguaugcug

SEQ ID NO: 574263 - RNA, 22 nt, Human
auugaaagguuuugagcagaua

SEQ ID NO: 574264 - RNA, 22 nt, Human
acagacauuuuaauuauuaaau

SEQ ID NO: 574265 - RNA, 22 nt, Human
cugaggcucagcgugaggaaag

SEQ ID NO: 574266 - RNA, 22 nt, Human
uggcagugggaagcuggaaguc

SEQ ID NO: 574267 - RNA, 22 nt, Human
accaucuuaguggccagcucuc

SEQ ID NO: 574268 - RNA, 22 nt, Human
gugaacaaggagacuacaacuu

SEQ ID NO: 574269 - RNA, 22 nt, Human
uaaaaagcagcugagauuuucu

SEQ ID NO: 574270 - RNA, 22 nt, Human
ccagggagcccacaggacaaug

SEQ ID NO: 574271 - RNA, 22 nt, Human
aagacuguacauuuuccagucu

SEQ ID NO: 574272 - RNA, 22 nt, Human
cuuauuaauggaauccuaauga

SEQ ID NO: 574273 - RNA, 22 nt, Human
cagugggaagggcagaggcuuu

SEQ ID NO: 574274 - RNA, 20 nt, Human
aggcucagagcaguaguaca

SEQ ID NO: 574275 - RNA, 22 nt, Human
ugcucaguuccaugaguggagu

SEQ ID NO: 574276 - RNA, 22 nt, Human
ccagagcugauuccugggacuu

SEQ ID NO: 574277 - RNA, 22 nt, Human
uccuggggcugcaaggccuguc

SEQ ID NO: 574278 - RNA, 22 nt, Human
uccuuuaucugcucagaaagua

SEQ ID NO: 574279 - RNA, 22 nt, Human
caccaggcugaaccagagggga

SEQ ID NO: 574280 - RNA, 22 nt, Human
caaaggcacacauaccuuucug

SEQ ID NO: 574281 - RNA, 22 nt, Human
agggaggagaauggacuccuuc

SEQ ID NO: 574282 - RNA, 22 nt, Human
uuuggcaagugggaaauuagua

SEQ ID NO: 574283 - RNA, 22 nt, Human
cugcuggggaggcgccucgacg

SEQ ID NO: 574284 - RNA, 22 nt, Human
cauucugggucuggcucaggga

SEQ ID NO: 574285 - RNA, 22 nt, Human
gcugcuguguuggagagggacu

SEQ ID NO: 574286 - RNA, 22 nt, Human
ucucuguggcaagcaugcugcu

SEQ ID NO: 574287 - RNA, 22 nt, Human
aguucucuggcuccuuuccaga

SEQ ID NO: 574288 - RNA, 22 nt, Human
cugaagcaggaacagcgagauu

SEQ ID NO: 574289 - RNA, 22 nt, Human
ccaggacaagccagagggacag

SEQ ID NO: 574290 - RNA, 22 nt, Human
cauugcaggagaguaaauaaaa

SEQ ID NO: 574291 - RNA, 22 nt, Human
uuucaagcugugguaacugaga

SEQ ID NO: 574292 - RNA, 22 nt, Human
ucacuguuucaucccuagcacu

SEQ ID NO: 574293 - RNA, 22 nt, Human
caggaagaaagaggugaggugu

SEQ ID NO: 574294 - RNA, 22 nt, Human
cagagacauuaagugccaugau

SEQ ID NO: 574295 - RNA, 22 nt, Human
ccaagagguugugaggcaggca

SEQ ID NO: 574296 - RNA, 22 nt, Human
uccuggugaucaaaauucauuu

SEQ ID NO: 574297 - RNA, 20 nt, Human
uauugaguaccuacuguaua

SEQ ID NO: 574298 - RNA, 17 nt, Human
uggggaagcucagauuu

SEQ ID NO: 574299 - RNA, 22 nt, Human
auacaaagcuuucugucuggua

SEQ ID NO: 574300 - RNA, 22 nt, Human
ugagaaaauccagaggcuaguu

SEQ ID NO: 574301 - RNA, 22 nt, Human
aaugagauggaauucccgccua

SEQ ID NO: 574302 - RNA, 22 nt, Human
gacccuuagaaugugaucuuau

SEQ ID NO: 574303 - RNA, 21 nt, Human
uuaauuuauucaugauagcua

SEQ ID NO: 574304 - RNA, 22 nt, Human
ggacaggcccggggagccugga

SEQ ID NO: 574305 - RNA, 22 nt, Human
uacuuuaaaaacugauaauuca

SEQ ID NO: 574306 - RNA, 22 nt, Human
cccuuucugggaccccugucuc

SEQ ID NO: 574307 - RNA, 22 nt, Human
ucugaggcuaagagacagaggc

SEQ ID NO: 574308 - RNA, 22 nt, Human
caggcagaguuagugauuuagg

SEQ ID NO: 574309 - RNA, 22 nt, Human
ggggcagcucccgagggcagga

SEQ ID NO: 574310 - RNA, 22 nt, Human
uggcucaucuuuuuagacuuau

SEQ ID NO: 574311 - RNA, 19 nt, Human
uauauuuguugaauaaaaa

SEQ ID NO: 574312 - RNA, 22 nt, Human
guauuucuuggaaauccuuuua

SEQ ID NO: 574313 - RNA, 22 nt, Human
ccagagccuaagaucugauccu

SEQ ID NO: 574314 - RNA, 22 nt, Human
cuuuggaauaauuuccuggagu

SEQ ID NO: 574315 - RNA, 22 nt, Human
ucaucugucugagagacuucug

SEQ ID NO: 574316 - RNA, 22 nt, Human
guccccucaaaauucauauguu

SEQ ID NO: 574317 - RNA, 22 nt, Human
uuguccuguuacuuguuuggau

SEQ ID NO: 574318 - RNA, 22 nt, Human
agaaggaaggaagcauucuguu

SEQ ID NO: 574319 - RNA, 22 nt, Human
cauauauucugguuuucacugg

SEQ ID NO: 574320 - RNA, 22 nt, Human
aagcuuugacuacugccucuug

SEQ ID NO: 574321 - RNA, 22 nt, Human
cauuccagagcugccucugcua

SEQ ID NO: 574322 - RNA, 22 nt, Human
caaauagaacucacagacaaga

SEQ ID NO: 574323 - RNA, 22 nt, Human
ggcugcaggcagaggcugucug

SEQ ID NO: 574324 - RNA, 22 nt, Human
ucauuuguuacagccacauacc

SEQ ID NO: 574325 - RNA, 22 nt, Human
aauguauuugauguauuagccu

SEQ ID NO: 574326 - RNA, 17 nt, Human
auggaggcagacagguc

SEQ ID NO: 574327 - RNA, 22 nt, Human
uucuccaagaugaagcugugua

SEQ ID NO: 574328 - RNA, 22 nt, Human
ucucuuggagguucuuccuguu

SEQ ID NO: 574329 - RNA, 22 nt, Human
uggcuucauucuguaguuaaaa

SEQ ID NO: 574330 - RNA, 22 nt, Human
agaauguuuucaugagaaugaa

SEQ ID NO: 574331 - RNA, 22 nt, Human
acacccagagcgccagugccga

SEQ ID NO: 574332 - RNA, 22 nt, Human
guuuuguucuuguccagggaaa

SEQ ID NO: 574333 - RNA, 22 nt, Human
ccagcucuuuuggcugagugag

SEQ ID NO: 574334 - RNA, 22 nt, Human
uauggaaaaauguaucuuguca

SEQ ID NO: 574335 - RNA, 22 nt, Human
ugaaaaaacaaguuggcccauu

SEQ ID NO: 574336 - RNA, 22 nt, Human
acuguguggaccacucugaggc

SEQ ID NO: 574337 - RNA, 22 nt, Human
gucacacaauaguaaguggucc

SEQ ID NO: 574338 - RNA, 18 nt, Human
ucugccugcagggcaucu

SEQ ID NO: 574339 - RNA, 22 nt, Human
aggcaggaggaucauggaugca

SEQ ID NO: 574340 - RNA, 22 nt, Human
cugggaggcccacguugggaag

SEQ ID NO: 574341 - RNA, 22 nt, Human
cagguggcuucucugcagccuu

SEQ ID NO: 574342 - RNA, 19 nt, Human
gcccugaguaagcuaggag

SEQ ID NO: 574343 - RNA, 22 nt, Human
ucuuuaauguacuuucuuucac

SEQ ID NO: 574344 - RNA, 22 nt, Human
auaagacacgcaaauagguacg

SEQ ID NO: 574345 - RNA, 22 nt, Human
ucuuagaaaaaugguauguuuu

SEQ ID NO: 574346 - RNA, 22 nt, Human
auuuguuucagggccuugguau

SEQ ID NO: 574347 - RNA, 22 nt, Human
gcccagcaggggauggcagcuc

SEQ ID NO: 574348 - RNA, 23 nt, Human
augggccaagcaagacccaugac

SEQ ID NO: 574349 - RNA, 22 nt, Human
acuggcccgggagcagaggccu

SEQ ID NO: 574350 - RNA, 22 nt, Human
ucauuguuucugcuuuucauga

SEQ ID NO: 574351 - RNA, 22 nt, Human
uuucucugugccauuuccauaa

SEQ ID NO: 574352 - RNA, 22 nt, Human
gcagcagaggcccuacucuuug

SEQ ID NO: 574353 - RNA, 22 nt, Human
agagcuggagaugcagguuucg

SEQ ID NO: 574354 - RNA, 22 nt, Human
cuuaucauaucauacauggcua

SEQ ID NO: 574355 - RNA, 22 nt, Human
auuucacuuaguguaaugucuu

SEQ ID NO: 574356 - RNA, 22 nt, Human
ugaggguauauauuguguggag

SEQ ID NO: 574357 - RNA, 23 nt, Human
ucuguggcuccuucaggcugcug

SEQ ID NO: 574358 - RNA, 22 nt, Human
aagugacuauuugaguacauca

SEQ ID NO: 574359 - RNA, 22 nt, Human
cugaagcaugcguuuguaaacu

SEQ ID NO: 574360 - RNA, 22 nt, Human
auacagaaaaugaugcagaguu

SEQ ID NO: 574361 - RNA, 22 nt, Human
uccucagacuucccuuugugua

SEQ ID NO: 574362 - RNA, 22 nt, Human
gccugagggcuccuagcaggcu

SEQ ID NO: 574363 - RNA, 22 nt, Human
ucucuucuauuugagacuauuu

SEQ ID NO: 574364 - RNA, 22 nt, Human
aggcauggggcugcagucaggu

SEQ ID NO: 574365 - RNA, 22 nt, Human
ucugccuggccuggagggcaca

SEQ ID NO: 574366 - RNA, 22 nt, Human
aggucugagcaggggagaacag

SEQ ID NO: 574367 - RNA, 22 nt, Human
accgggaaguccugcacugggc

SEQ ID NO: 574368 - RNA, 20 nt, Human
agaggauuuauguggaugug

SEQ ID NO: 574369 - RNA, 22 nt, Human
gagggguguggagccaucaguu

SEQ ID NO: 574370 - RNA, 22 nt, Human
cugguccuugcuacccagcaag

SEQ ID NO: 574371 - RNA, 22 nt, Human
agcagcucauggaguaggcacu

SEQ ID NO: 574372 - RNA, 22 nt, Human
auugggaugccggcugauaaga

SEQ ID NO: 574373 - RNA, 22 nt, Human
gacuccauccaaucuguguucu

SEQ ID NO: 574374 - RNA, 22 nt, Human
agcuggcuaugcccugugaacc

SEQ ID NO: 574375 - RNA, 22 nt, Human
gcugugagccgcugcugagcau

SEQ ID NO: 574376 - RNA, 22 nt, Human
guuaucuucccuuugaugauuu

SEQ ID NO: 574377 - RNA, 22 nt, Human
aauuaauucaguuuuuaaggga

SEQ ID NO: 574378 - RNA, 17 nt, Human
ugugacauugggacauu

SEQ ID NO: 574379 - RNA, 21 nt, Human
agcaagaaucaggaaggcucu

SEQ ID NO: 574380 - RNA, 22 nt, Human
aagaaaagauguuugguuuuca

SEQ ID NO: 574381 - RNA, 22 nt, Human
ugacacagggaaagcggaucca

SEQ ID NO: 574382 - RNA, 22 nt, Human
acaaugcugcagggaaauuagg

SEQ ID NO: 574383 - RNA, 22 nt, Human
auuguacagaugagguaaguga

SEQ ID NO: 574384 - RNA, 22 nt, Human
guagggacuuguuuuacuagua

SEQ ID NO: 574385 - RNA, 22 nt, Human
acauuuacagugcuagacaauc

SEQ ID NO: 574386 - RNA, 22 nt, Human
uggaauggggacuuugggacau

SEQ ID NO: 574387 - RNA, 22 nt, Human
cagaaacuauguaagaaaguga

SEQ ID NO: 574388 - RNA, 22 nt, Human
cagugggugccaucgugcccuu

SEQ ID NO: 574389 - RNA, 22 nt, Human
uaaauaaguucuucauuguuug

SEQ ID NO: 574390 - RNA, 22 nt, Human
ugugaugcauaguuuuuauugc

SEQ ID NO: 574391 - RNA, 22 nt, Human
ccagcucucagcgggagacuca

SEQ ID NO: 574392 - RNA, 22 nt, Human
ugcaaguaguccagccuuuggg

SEQ ID NO: 574393 - RNA, 22 nt, Human
uuuauacauggagaauuuuugc

SEQ ID NO: 574394 - RNA, 20 nt, Human
uguauuuaaugaaggcuuuu

SEQ ID NO: 574395 - RNA, 22 nt, Human
aauuauggucacuguuccuggg

SEQ ID NO: 574396 - RNA, 22 nt, Human
agguggaguuaagugugaacug

SEQ ID NO: 574397 - RNA, 22 nt, Human
aauucauagcaacaaagaccca

SEQ ID NO: 574398 - RNA, 22 nt, Human
gagguggugguggaggcauagc

SEQ ID NO: 574399 - RNA, 22 nt, Human
cuugagguuuugacucagcuuu

SEQ ID NO: 574400 - RNA, 22 nt, Human
uaugucaaaaaagauuauguuu

SEQ ID NO: 574401 - RNA, 22 nt, Human
cugcugccggcgagccucccuu

SEQ ID NO: 574402 - RNA, 22 nt, Human
ucuuucucucuaaucaagcaca

SEQ ID NO: 574403 - RNA, 22 nt, Human
acugaggucucagguggggaag

SEQ ID NO: 574404 - RNA, 22 nt, Human
accagaggcucugccaccucca

SEQ ID NO: 574405 - RNA, 22 nt, Human
uuacuugaugauguauaaaguc

SEQ ID NO: 574406 - RNA, 22 nt, Human
cuaugagaagaaaacaagauua

SEQ ID NO: 574407 - RNA, 22 nt, Human
ucaauucaauugcauuucugug

SEQ ID NO: 574408 - RNA, 22 nt, Human
cuucagcagaugugcuagagau

SEQ ID NO: 574409 - RNA, 22 nt, Human
gcugcugcuggucuggggccac

SEQ ID NO: 574410 - RNA, 22 nt, Human
aaauuggauuuuaaacuguugg

SEQ ID NO: 574411 - RNA, 22 nt, Human
auaguaacuggcauguuuauga

SEQ ID NO: 574412 - RNA, 22 nt, Human
caggcagaugcugacaagaguu

SEQ ID NO: 574413 - RNA, 22 nt, Human
gcauguggcccaaggaggcugu

SEQ ID NO: 574414 - RNA, 22 nt, Human
ugcucaacagauauguaacaug

SEQ ID NO: 574415 - RNA, 21 nt, Human
uagagaaaagaagcuguuccu

SEQ ID NO: 574416 - RNA, 22 nt, Human
aaucuugagggacucaugaggu

SEQ ID NO: 574417 - RNA, 22 nt, Human
aggcccagagcaggaaaggguu

SEQ ID NO: 574418 - RNA, 22 nt, Human
gguccaccuccaagcuggggac

SEQ ID NO: 574419 - RNA, 22 nt, Human
ucaaacagaggaacaauuguuu

SEQ ID NO: 574420 - RNA, 22 nt, Human
agggccaguucagaggacaugg

SEQ ID NO: 574421 - RNA, 22 nt, Human
gccaggcagcagcgaggauggu

SEQ ID NO: 574422 - RNA, 22 nt, Human
ggcaguggcuguagucucuugg

SEQ ID NO: 574423 - RNA, 22 nt, Human
ugugcaaauuaaguagauuuuc

SEQ ID NO: 574424 - RNA, 20 nt, Human
agaucugccugcacccucuc

SEQ ID NO: 574425 - RNA, 22 nt, Human
uggcagcugcaggccuccugag

SEQ ID NO: 574426 - RNA, 22 nt, Human
uagauuucaggagacaaaaugg

SEQ ID NO: 574427 - RNA, 20 nt, Human
agguggcuccugcugggggu

SEQ ID NO: 574428 - RNA, 22 nt, Human
ugaggccagccacagccacccu

SEQ ID NO: 574429 - RNA, 22 nt, Human
aagugugguuuaggcaucuuuu

SEQ ID NO: 574430 - RNA, 22 nt, Human
uuacuguuuugguaccucauug

SEQ ID NO: 574431 - RNA, 22 nt, Human
ggugggcacccgagacuggauc

SEQ ID NO: 574432 - RNA, 23 nt, Human
acagagacugccaagauauucuc

SEQ ID NO: 574433 - RNA, 22 nt, Human
uugaggucuucagcugacaccu

SEQ ID NO: 574434 - RNA, 22 nt, Human
gggccuggggacaccaccauga

SEQ ID NO: 574435 - RNA, 22 nt, Human
uccagcuuugagauuuuaugga

SEQ ID NO: 574436 - RNA, 22 nt, Human
uccugagagggguggguuuccc

SEQ ID NO: 574437 - RNA, 22 nt, Human
aucuagcaccaaacuagcuuuu

SEQ ID NO: 574438 - RNA, 22 nt, Human
ugugaaaugcuauugugacaaa

SEQ ID NO: 574439 - RNA, 22 nt, Human
cuguguuuugauuaaaaagcaa

SEQ ID NO: 574440 - RNA, 22 nt, Human
gcagaauagugacuuuccuuaa

SEQ ID NO: 574441 - RNA, 20 nt, Human
uccagccacuuccgcugguc

SEQ ID NO: 574442 - RNA, 22 nt, Human
agcuccagccucuucuggaggu

SEQ ID NO: 574443 - RNA, 22 nt, Human
aaugucauagcauuucuucaau

SEQ ID NO: 574444 - RNA, 22 nt, Human
cagugacacccagucuggccca

SEQ ID NO: 574445 - RNA, 22 nt, Human
gguuggacacuagguaggagcg

SEQ ID NO: 574446 - RNA, 22 nt, Human
uucugacauauccagucucagu

SEQ ID NO: 574447 - RNA, 22 nt, Human
uccaagaucuacagcaguuuag

SEQ ID NO: 574448 - RNA, 22 nt, Human
ugcacuuguguuuucagaaucu

SEQ ID NO: 574449 - RNA, 22 nt, Human
ggggccagauaucacuaagguu

SEQ ID NO: 574450 - RNA, 22 nt, Human
uugaaagggauauaucuuucug

SEQ ID NO: 574451 - RNA, 22 nt, Human
augcuuaagcucaguuauauau

SEQ ID NO: 574452 - RNA, 22 nt, Human
aaugccaacuuggauauacauu

SEQ ID NO: 574453 - RNA, 17 nt, Human
ggcaguggaggaagaga

SEQ ID NO: 574454 - RNA, 22 nt, Human
cuggugcaaggcuuuggaaucc

SEQ ID NO: 574455 - RNA, 20 nt, Human
cccugagaccagagagcagc

SEQ ID NO: 574456 - RNA, 22 nt, Human
uuuuauguuccucuuuaugcga

SEQ ID NO: 574457 - RNA, 22 nt, Human
cgugcgguuagacagguaccgg

SEQ ID NO: 574458 - RNA, 22 nt, Human
auacaugcgccauguuggugug

SEQ ID NO: 574459 - RNA, 22 nt, Human
auuauuuuaugugcggccugau

SEQ ID NO: 574460 - RNA, 22 nt, Human
cucuccuggggagcacacacac

SEQ ID NO: 574461 - RNA, 22 nt, Human
cugcagggcccgccugagcccu

SEQ ID NO: 574462 - RNA, 22 nt, Human
ucacugcucucuaagcaucgcc

SEQ ID NO: 574463 - RNA, 22 nt, Human
ugggcaggcaagugaauaccuu

SEQ ID NO: 574464 - RNA, 22 nt, Human
aucaucaucaacaagaaacauu

SEQ ID NO: 574465 - RNA, 22 nt, Human
accaaaaagauauguugaagcc

SEQ ID NO: 574466 - RNA, 23 nt, Human
cccagaggagcagggcgugagau

SEQ ID NO: 574467 - RNA, 22 nt, Human
auuucuccuccagauggugguu

SEQ ID NO: 574468 - RNA, 22 nt, Human
ucuguuauauguuuuuucuaaa

SEQ ID NO: 574469 - RNA, 22 nt, Human
agggagcagggcuccuuugggu

SEQ ID NO: 574470 - RNA, 22 nt, Human
uaccaggaauuauuuuacauuu

SEQ ID NO: 574471 - RNA, 22 nt, Human
ccagggugagaaaaggcuggau

SEQ ID NO: 574472 - RNA, 22 nt, Human
ugauuucucuccguuauuucag

SEQ ID NO: 574473 - RNA, 22 nt, Human
ucccacugugccuguuguaauc

SEQ ID NO: 574474 - RNA, 22 nt, Human
uguguaaauuauuuuuaaugau

SEQ ID NO: 574475 - RNA, 22 nt, Human
gccagugugcaagaggccacca

SEQ ID NO: 574476 - RNA, 22 nt, Human
guggggcaugcacgcugcuccu

SEQ ID NO: 574477 - RNA, 22 nt, Human
caaaugaagagggcaacuucug

SEQ ID NO: 574478 - RNA, 22 nt, Human
cuuccugcaacaccuguguugc

SEQ ID NO: 574479 - RNA, 22 nt, Human
uucagaauauuauuuuaaaggc

SEQ ID NO: 574480 - RNA, 22 nt, Human
aauauccacuucaauacaggca

SEQ ID NO: 574481 - RNA, 22 nt, Human
aagcagguaaauauguuucccu

SEQ ID NO: 574482 - RNA, 22 nt, Human
uauauucaacaggcuaauguca

SEQ ID NO: 574483 - RNA, 22 nt, Human
ugcugaaucauaugguaauucu

SEQ ID NO: 574484 - RNA, 22 nt, Human
gcagcagcucccuauccaggcu

SEQ ID NO: 574485 - RNA, 22 nt, Human
uaggaacaaagagccucacauu

SEQ ID NO: 574486 - RNA, 22 nt, Human
guaaacauuuucaucugugccc

SEQ ID NO: 574487 - RNA, 22 nt, Human
aaauggaaaaugcuguuuuggu

SEQ ID NO: 574488 - RNA, 22 nt, Human
cauuacaugguccaggauauau

SEQ ID NO: 574489 - RNA, 22 nt, Human
ucaggccaggagaucagauuga

SEQ ID NO: 574490 - RNA, 22 nt, Human
cuccagauuccguuuauucagg

SEQ ID NO: 574491 - RNA, 22 nt, Human
cuagagcuguucugugcacuca

SEQ ID NO: 574492 - RNA, 22 nt, Human
ggggugagcugggccugugccu

SEQ ID NO: 574493 - RNA, 22 nt, Human
agaaucugguagaaccaaggau

SEQ ID NO: 574494 - RNA, 22 nt, Human
acacacuuuugcuaaaaauugu

SEQ ID NO: 574495 - RNA, 22 nt, Human
acagaggaaggcugagcugccc

SEQ ID NO: 574496 - RNA, 22 nt, Human
uuaaagcaaccucagcccucuu

SEQ ID NO: 574497 - RNA, 22 nt, Human
gccagccccuccauccuguuca

SEQ ID NO: 574498 - RNA, 22 nt, Human
caggcagcagccacucugguau

SEQ ID NO: 574499 - RNA, 22 nt, Human
auguuuaaaggguugagaaaua

SEQ ID NO: 574500 - RNA, 21 nt, Human
uucucuggcuucuguagcugg

SEQ ID NO: 574501 - RNA, 22 nt, Human
cccuggaggaaaaucugaggcu

SEQ ID NO: 574502 - RNA, 22 nt, Human
uagagguagcaacaggacuaga

SEQ ID NO: 574503 - RNA, 21 nt, Human
cccaggagaagaaaagaugca

SEQ ID NO: 574504 - RNA, 22 nt, Human
uucuuauuucccccuucaucau

SEQ ID NO: 574505 - RNA, 22 nt, Human
cuccaggaaagccugaggcccg

SEQ ID NO: 574506 - RNA, 22 nt, Human
guaccauuguuugaaguacuca

SEQ ID NO: 574507 - RNA, 22 nt, Human
cagugcaggcugggggcccugc

SEQ ID NO: 574508 - RNA, 20 nt, Human
uggagguggucugcuguccu

SEQ ID NO: 574509 - RNA, 22 nt, Human
gaggcugggaaguccaagacca

SEQ ID NO: 574510 - RNA, 22 nt, Human
ggagaguggauuccagcuguau

SEQ ID NO: 574511 - RNA, 22 nt, Human
aaaguucuagaguugcaagaga

SEQ ID NO: 574512 - RNA, 22 nt, Human
uuggaauugaggauuuacauag

SEQ ID NO: 574513 - RNA, 22 nt, Human
auauugcuagccuaugaguuca

SEQ ID NO: 574514 - RNA, 22 nt, Human
cugccaggccucaucccagcca

SEQ ID NO: 574515 - RNA, 22 nt, Human
cugggugaguauaggaaaggga

SEQ ID NO: 574516 - RNA, 19 nt, Human
ggaguuuccaauggguaaa

SEQ ID NO: 574517 - RNA, 22 nt, Human
gucuguggucccugcuggggac

SEQ ID NO: 574518 - RNA, 22 nt, Human
cuguccuccggccaccuacagu

SEQ ID NO: 574519 - RNA, 22 nt, Human
gggcuccaaggaggccagccug

SEQ ID NO: 574520 - RNA, 22 nt, Human
uggcucauucuacucucccugg

SEQ ID NO: 574521 - RNA, 21 nt, Human
agacugccaucuuugggccac

SEQ ID NO: 574522 - RNA, 22 nt, Human
gcugggcuccacccucaacugu

SEQ ID NO: 574523 - RNA, 22 nt, Human
uuugagucugcuuccauuuuca

SEQ ID NO: 574524 - RNA, 22 nt, Human
guacacagagugguggaagaaa

SEQ ID NO: 574525 - RNA, 22 nt, Human
ccucaggcaagucacuuaacau

SEQ ID NO: 574526 - RNA, 22 nt, Human
cugagagaaucaugcugcaggu

SEQ ID NO: 574527 - RNA, 22 nt, Human
uaaaaguauacuuucaaaggag

SEQ ID NO: 574528 - RNA, 22 nt, Human
accagcucucuagcccuggucc

SEQ ID NO: 574529 - RNA, 22 nt, Human
uccugaggaugguugaagugca

SEQ ID NO: 574530 - RNA, 21 nt, Human
acccuuuguuuaugaaucagc

SEQ ID NO: 574531 - RNA, 22 nt, Human
ccugaggcaaggacuugguggc

SEQ ID NO: 574532 - RNA, 22 nt, Human
acccaggacucucuuccaguag

SEQ ID NO: 574533 - RNA, 22 nt, Human
agccucagugucaccaucuacc

SEQ ID NO: 574534 - RNA, 22 nt, Human
gcugucacaaauauuucucagc

SEQ ID NO: 574535 - RNA, 22 nt, Human
aggcacugagaggcuguguugc

SEQ ID NO: 574536 - RNA, 22 nt, Human
aaguguaaauucacagacuuca

SEQ ID NO: 574537 - RNA, 22 nt, Human
aaugauauagcagacauagccu

SEQ ID NO: 574538 - RNA, 22 nt, Human
ugcccugcagugagugcgucug

SEQ ID NO: 574539 - RNA, 22 nt, Human
gaagugggcuuuguggucagcu

SEQ ID NO: 574540 - RNA, 22 nt, Human
ggaguccaacgugcagccagga

SEQ ID NO: 574541 - RNA, 22 nt, Human
ucagaugcuuagagauuagacu

SEQ ID NO: 574542 - RNA, 22 nt, Human
uuugggaauuguagcugucuug

SEQ ID NO: 574543 - RNA, 22 nt, Human
ucucccucauuccugcuuccau

SEQ ID NO: 574544 - RNA, 22 nt, Human
gugccacaugguccauguauca

SEQ ID NO: 574545 - RNA, 22 nt, Human
cgggguggcacucuaaauagaa

SEQ ID NO: 574546 - RNA, 22 nt, Human
gcagaagaccaugguggaaaga

SEQ ID NO: 574547 - RNA, 22 nt, Human
gguguggaucaucugaggucag

SEQ ID NO: 574548 - RNA, 22 nt, Human
gcagaggcagggcccuccucca

SEQ ID NO: 574549 - RNA, 18 nt, Human
ugagcaggggcugaccuu

SEQ ID NO: 574550 - RNA, 22 nt, Human
uucauaaacaacugaugguaau

SEQ ID NO: 574551 - RNA, 22 nt, Human
gcugagggcuguaacagcagag

SEQ ID NO: 574552 - RNA, 22 nt, Human
gagagggcugccuggugugagg

SEQ ID NO: 574553 - RNA, 22 nt, Human
ccagcuugaagaugugcugguu

SEQ ID NO: 574554 - RNA, 22 nt, Human
agaggccauggggcauuuuuca

SEQ ID NO: 574555 - RNA, 22 nt, Human
ugugugugaguccuggcuuucc

SEQ ID NO: 574556 - RNA, 22 nt, Human
agucuucucauuucacaugcuu

SEQ ID NO: 574557 - RNA, 22 nt, Human
gggcuucaaaauuggcacucuu

SEQ ID NO: 574558 - RNA, 22 nt, Human
cagcccugccauggagccuccu

SEQ ID NO: 574559 - RNA, 22 nt, Human
aauuaguauugcgauucauuag

SEQ ID NO: 574560 - RNA, 22 nt, Human
guucuuaaagauucaucaagca

SEQ ID NO: 574561 - RNA, 22 nt, Human
uccagcucaaagugcuccuguc

SEQ ID NO: 574562 - RNA, 22 nt, Human
augcauucuggaaaguagcaau

SEQ ID NO: 574563 - RNA, 22 nt, Human
aaacucuuggucaacaugagga

SEQ ID NO: 574564 - RNA, 22 nt, Human
uguguuucucugaggggucccu

SEQ ID NO: 574565 - RNA, 19 nt, Human
cugcuuccuucccucacug

SEQ ID NO: 574566 - RNA, 22 nt, Human
cauuucaauuauuugcucuucu

SEQ ID NO: 574567 - RNA, 17 nt, Human
ggagcagauccaccauu

SEQ ID NO: 574568 - RNA, 22 nt, Human
agagcuguuugucuagagagug

SEQ ID NO: 574569 - RNA, 22 nt, Human
uccucaucuguaccuuggggua

SEQ ID NO: 574570 - RNA, 22 nt, Human
uuaauucagucaaagaaaccau

SEQ ID NO: 574571 - RNA, 22 nt, Human
gggaguggagagcaauggauga

SEQ ID NO: 574572 - RNA, 20 nt, Human
guuaggagguuggacaugga

SEQ ID NO: 574573 - RNA, 22 nt, Human
ugcuucaaggccaugucaagcu

SEQ ID NO: 574574 - RNA, 22 nt, Human
acacuauaagacagauacagca

SEQ ID NO: 574575 - RNA, 22 nt, Human
ggaaagaccugagauaggaaua

SEQ ID NO: 574576 - RNA, 22 nt, Human
agaagccaauucugugugaguc

SEQ ID NO: 574577 - RNA, 22 nt, Human
uuucuugagugaugcuuagugu

SEQ ID NO: 574578 - RNA, 20 nt, Human
uuugucuguuaaguguuucu

SEQ ID NO: 574579 - RNA, 22 nt, Human
auuguuuuguagaaugacccuu

SEQ ID NO: 574580 - RNA, 22 nt, Human
ucuguacaacaaagggaugaga

SEQ ID NO: 574581 - RNA, 22 nt, Human
uccuacaucagcucucaguagc

SEQ ID NO: 574582 - RNA, 22 nt, Human
guucucucugcuuccaagaugg

SEQ ID NO: 574583 - RNA, 22 nt, Human
uaacuucucugcuaucauagga

SEQ ID NO: 574584 - RNA, 22 nt, Human
uugcugaacccugcccucuaau

SEQ ID NO: 574585 - RNA, 22 nt, Human
aaauagcauaaaauaggaagcu

SEQ ID NO: 574586 - RNA, 22 nt, Human
agaacuauugcaauaacaagaa

SEQ ID NO: 574587 - RNA, 22 nt, Human
aauguuaauguguuugcuuaug

SEQ ID NO: 574588 - RNA, 22 nt, Human
acaguaaauaaugcauguugau

SEQ ID NO: 574589 - RNA, 22 nt, Human
guggaagguaaugcagcuuacu

SEQ ID NO: 574590 - RNA, 21 nt, Human
aaggcuggagaugcaggucug

SEQ ID NO: 574591 - RNA, 19 nt, Human
cugggcugaggucugccuu

SEQ ID NO: 574592 - RNA, 22 nt, Human
acagagcaguucuggagcuggc

SEQ ID NO: 574593 - RNA, 22 nt, Human
ucuguggcauagugcuugggaa

SEQ ID NO: 574594 - RNA, 22 nt, Human
ccacucugauuuuggcuccacu

SEQ ID NO: 574595 - RNA, 22 nt, Human
aggugcuguuugucagcaguuu

SEQ ID NO: 574596 - RNA, 16 nt, Human
caguuuuaaggcccaa

SEQ ID NO: 574597 - RNA, 22 nt, Human
gccagggugagggcugagaggu

SEQ ID NO: 574598 - RNA, 22 nt, Human
uacacuggagcccuuggggucu

SEQ ID NO: 574599 - RNA, 22 nt, Human
augcauaugccguagaauaagu

SEQ ID NO: 574600 - RNA, 22 nt, Human
uuuauugaauuguaacccuauu

SEQ ID NO: 574601 - RNA, 22 nt, Human
auauaauaguuucauaaaggcu

SEQ ID NO: 574602 - RNA, 22 nt, Human
cguguggucccggcaaggcaag

SEQ ID NO: 574603 - RNA, 22 nt, Human
gaggcuggcagaaaagcacagg

SEQ ID NO: 574604 - RNA, 22 nt, Human
cuguaaauaaugacaguugacu

SEQ ID NO: 574605 - RNA, 23 nt, Human
cccaagccugugcccucugacuc

SEQ ID NO: 574606 - RNA, 22 nt, Human
aggcugcagaacagucaggugc

SEQ ID NO: 574607 - RNA, 19 nt, Human
accaggcuuauggucagug

SEQ ID NO: 574608 - RNA, 21 nt, Human
ugcucagucugucuccagcuu

SEQ ID NO: 574609 - RNA, 22 nt, Human
accuuaaaacugacacauggag

SEQ ID NO: 574610 - RNA, 22 nt, Human
aaguguuuggggaucauuuuaa

SEQ ID NO: 574611 - RNA, 22 nt, Human
uauugacacuuuuuguguagcc

SEQ ID NO: 574612 - RNA, 22 nt, Human
uuuaauuuuccucuuccuggag

SEQ ID NO: 574613 - RNA, 22 nt, Human
uggcuucaaaaucuaguggucu

SEQ ID NO: 574614 - RNA, 22 nt, Human
gcuguucugcgucccaggcugg

SEQ ID NO: 574615 - RNA, 22 nt, Human
gagggcucacugagaaagcagu

SEQ ID NO: 574616 - RNA, 20 nt, Human
aggcucugcauuucugagug

SEQ ID NO: 574617 - RNA, 22 nt, Human
caggaacaggggagugaaccug

SEQ ID NO: 574618 - RNA, 22 nt, Human
ucacuuauaaaaugcaagaucu

SEQ ID NO: 574619 - RNA, 22 nt, Human
auguguguacacacgugacucu

SEQ ID NO: 574620 - RNA, 23 nt, Human
gggcagguuuuuauaggcuucag

SEQ ID NO: 574621 - RNA, 22 nt, Human
uggagagaagaggcagugugcu

SEQ ID NO: 574622 - RNA, 22 nt, Human
aacuacaguauguccaaagaau

SEQ ID NO: 574623 - RNA, 22 nt, Human
ucugagaggcaucugcacuucu

SEQ ID NO: 574624 - RNA, 22 nt, Human
uuguauuaguaagucagcugcu

SEQ ID NO: 574625 - RNA, 20 nt, Human
ucuggaguagagcacaggca

SEQ ID NO: 574626 - RNA, 22 nt, Human
ccacugggggcugcaggcacuc

SEQ ID NO: 574627 - RNA, 22 nt, Human
ccaugcucuggggaggucaagc

SEQ ID NO: 574628 - RNA, 22 nt, Human
ugggggagauugugcaucucua

SEQ ID NO: 574629 - RNA, 22 nt, Human
acuggccaggcgaaccacacug

SEQ ID NO: 574630 - RNA, 22 nt, Human
ucuguacaaaggcuauuuggag

SEQ ID NO: 574631 - RNA, 22 nt, Human
ucuuuucuucuuaaugguuaau

SEQ ID NO: 574632 - RNA, 22 nt, Human
agacauuuggaagauacacaua

SEQ ID NO: 574633 - RNA, 22 nt, Human
ggucugaguagagggcuggcga

SEQ ID NO: 574634 - RNA, 22 nt, Human
agcgugaaggcgggcagucggc

SEQ ID NO: 574635 - RNA, 22 nt, Human
uuccagcuaacucacaucccuu

SEQ ID NO: 574636 - RNA, 22 nt, Human
agagaccuuuguuauucuagga

SEQ ID NO: 574637 - RNA, 22 nt, Human
uccaaagaacauugcugagacc

SEQ ID NO: 574638 - RNA, 22 nt, Human
aucucugguccaaauguuaccu

SEQ ID NO: 574639 - RNA, 22 nt, Human
ugcggguugguggcauaugcag

SEQ ID NO: 574640 - RNA, 22 nt, Human
guaaaacugcagaacuuggagg

SEQ ID NO: 574641 - RNA, 22 nt, Human
gccuuagcaucuuaaagcugug

SEQ ID NO: 574642 - RNA, 22 nt, Human
ugcaaacaguuaagaugcaggc

SEQ ID NO: 574643 - RNA, 23 nt, Human
uaaauuucuugauucuuauguga

SEQ ID NO: 574644 - RNA, 22 nt, Human
ucuaagccuguguccucugcag

SEQ ID NO: 574645 - RNA, 22 nt, Human
uggcagcuguguccagguagaa

SEQ ID NO: 574646 - RNA, 22 nt, Human
aggggccucagccuccugguca

SEQ ID NO: 574647 - RNA, 22 nt, Human
gcuucugcuguugaagccacca

SEQ ID NO: 574648 - RNA, 22 nt, Human
ugcaggagggaggguuacaguu

SEQ ID NO: 574649 - RNA, 22 nt, Human
cauguacacucauguaacuaua

SEQ ID NO: 574650 - RNA, 22 nt, Human
gacuacaggugugugccaccau

SEQ ID NO: 574651 - RNA, 22 nt, Human
cccaagagaucgcauguaguug

SEQ ID NO: 574652 - RNA, 22 nt, Human
ggagcccagucgggguguaggu

SEQ ID NO: 574653 - RNA, 22 nt, Human
aagauuuucagcuaauggugca

SEQ ID NO: 574654 - RNA, 22 nt, Human
gacuuuauaaaugagaggcgga

SEQ ID NO: 574655 - RNA, 22 nt, Human
accaggcucugccaguguuuac

SEQ ID NO: 574656 - RNA, 22 nt, Human
auacaugugcuauguuggugua

SEQ ID NO: 574657 - RNA, 22 nt, Human
aguguuaagagaaaauucugcu

SEQ ID NO: 574658 - RNA, 22 nt, Human
uauacacauccuccaaagauag

SEQ ID NO: 574659 - RNA, 22 nt, Human
agguuucuggauuuauuauggc

SEQ ID NO: 574660 - RNA, 22 nt, Human
ccugacuuaagucuccuguugg

SEQ ID NO: 574661 - RNA, 22 nt, Human
ucacagaacacaaaugccacuu

SEQ ID NO: 574662 - RNA, 22 nt, Human
uuguauuaggcccuagggaguu

SEQ ID NO: 574663 - RNA, 22 nt, Human
agauuugauaaaaguagcaguu

SEQ ID NO: 574664 - RNA, 22 nt, Human
ccagagccggcucccucagcuu

SEQ ID NO: 574665 - RNA, 22 nt, Human
aggccaagcucccagagaagcu

SEQ ID NO: 574666 - RNA, 22 nt, Human
uguagugugacauaggugucca

SEQ ID NO: 574667 - RNA, 22 nt, Human
cugccugggccggccacccucu

SEQ ID NO: 574668 - RNA, 22 nt, Human
gcacugccuaugcaaauguacu

SEQ ID NO: 574669 - RNA, 22 nt, Human
ccacugcccaccccgacgucua

SEQ ID NO: 574670 - RNA, 22 nt, Human
caucuucagguucauggucaua

SEQ ID NO: 574671 - RNA, 22 nt, Human
aggugucuucagggugagacag

SEQ ID NO: 574672 - RNA, 22 nt, Human
aaaggcacuagaaguuaccuuu

SEQ ID NO: 574673 - RNA, 22 nt, Human
ugcauauucuccuuuauuuugu

SEQ ID NO: 574674 - RNA, 22 nt, Human
cagugaggugcccagccugccc

SEQ ID NO: 574675 - RNA, 22 nt, Human
cagcucuguugcccuggaaacg

SEQ ID NO: 574676 - RNA, 22 nt, Human
uugcauuuuuagaugcuucugu

SEQ ID NO: 574677 - RNA, 22 nt, Human
aucuguuauuuacccaucucug

SEQ ID NO: 574678 - RNA, 22 nt, Human
agauacaucuugaacuucuaga

SEQ ID NO: 574679 - RNA, 22 nt, Human
uaggccaccaggguuccauuua

SEQ ID NO: 574680 - RNA, 22 nt, Human
uucucuuuucaccaguugcuaa

SEQ ID NO: 574681 - RNA, 22 nt, Human
acaggaaccaggcaggucgauu

SEQ ID NO: 574682 - RNA, 22 nt, Human
aagggaaauccucagcccagga

SEQ ID NO: 574683 - RNA, 22 nt, Human
caguagauuugguaaacuagga

SEQ ID NO: 574684 - RNA, 23 nt, Human
uguguacacaauagaugagguuu

SEQ ID NO: 574685 - RNA, 22 nt, Human
cuacauuuacacaguuaggcuu

SEQ ID NO: 574686 - RNA, 23 nt, Human
uaggggaaaaaucuucugcaauu

SEQ ID NO: 574687 - RNA, 22 nt, Human
ggagggagagugacccuaccaa

SEQ ID NO: 574688 - RNA, 22 nt, Human
cccuugaagacuagaaugagga

SEQ ID NO: 574689 - RNA, 22 nt, Human
uugucauugggguuauuuguua

SEQ ID NO: 574690 - RNA, 22 nt, Human
cugaguggguuucugcuuguca

SEQ ID NO: 574691 - RNA, 22 nt, Human
gagagauuaccacgcuuccuga

SEQ ID NO: 574692 - RNA, 22 nt, Human
gcaggcaggcuuccuugaacug

SEQ ID NO: 574693 - RNA, 22 nt, Human
cccugcuuccgcuguuuucuca

SEQ ID NO: 574694 - RNA, 22 nt, Human
gcauggaucuaagaggucaagg

SEQ ID NO: 574695 - RNA, 22 nt, Human
cuacauuuguucaaauaagcug

SEQ ID NO: 574696 - RNA, 20 nt, Human
gauuucaaagcagaguggcc

SEQ ID NO: 574697 - RNA, 22 nt, Human
accuuuauaugaaagaugacau

SEQ ID NO: 574698 - RNA, 22 nt, Human
agugugggggcuuuggugucac

SEQ ID NO: 574699 - RNA, 22 nt, Human
cugaaugaaaucaaggacugag

SEQ ID NO: 574700 - RNA, 22 nt, Human
cuuggugcauuacucaaucugu

SEQ ID NO: 574701 - RNA, 22 nt, Human
gcuggguuuucuuccgggccua

SEQ ID NO: 574702 - RNA, 22 nt, Human
uuccaagagcuuuaauuguuga

SEQ ID NO: 574703 - RNA, 22 nt, Human
caguuucuacgacuuaagcaca

SEQ ID NO: 574704 - RNA, 20 nt, Human
agagaauucccuuuggagau

SEQ ID NO: 574705 - RNA, 22 nt, Human
cuccagcagaaagggcgagugg

SEQ ID NO: 574706 - RNA, 22 nt, Human
ugaagcuuuaggauggguucau

SEQ ID NO: 574707 - RNA, 22 nt, Human
gcacccaugcucuugucucagg

SEQ ID NO: 574708 - RNA, 22 nt, Human
accugccucagugcagcuggau

SEQ ID NO: 574709 - RNA, 22 nt, Human
gcagcucacagucuccgccauc

SEQ ID NO: 574710 - RNA, 22 nt, Human
cccaggaggguggccucugccc

SEQ ID NO: 574711 - RNA, 22 nt, Human
agcuccuggaggugcgcacucg

SEQ ID NO: 574712 - RNA, 22 nt, Human
uuggccagcgacgaccuucuua

SEQ ID NO: 574713 - RNA, 22 nt, Human
uuucuucuaggacuaauaagag

SEQ ID NO: 574714 - RNA, 22 nt, Human
ccugagggcgccgagcucccag

SEQ ID NO: 574715 - RNA, 22 nt, Human
gcugggaugcgucuucccaggc

SEQ ID NO: 574716 - RNA, 22 nt, Human
aagauucucacugcucaacuuu

SEQ ID NO: 574717 - RNA, 22 nt, Human
uagaaagcaguaucuccauuuu

SEQ ID NO: 574718 - RNA, 22 nt, Human
gccuggugaaaggcagagagcg

SEQ ID NO: 574719 - RNA, 22 nt, Human
augaggucauucuuggauuaca

SEQ ID NO: 574720 - RNA, 22 nt, Human
agcccagcugccugccugcugu

SEQ ID NO: 574721 - RNA, 22 nt, Human
cuggucaauaaucauguaguac

SEQ ID NO: 574722 - RNA, 22 nt, Human
guagaacucccagugguauugu

SEQ ID NO: 574723 - RNA, 22 nt, Human
agagccagcauuugggcccugc

SEQ ID NO: 574724 - RNA, 22 nt, Human
uauguguuugacacccugcaag

SEQ ID NO: 574725 - RNA, 23 nt, Human
ggcuagaguggaggggaacugca

SEQ ID NO: 574726 - RNA, 22 nt, Human
gauucaaaguuaaugaagaugc

SEQ ID NO: 574727 - RNA, 22 nt, Human
gugaggucauauagcgaacucc

SEQ ID NO: 574728 - RNA, 22 nt, Human
agaugcuucaguguuuaauuua

SEQ ID NO: 574729 - RNA, 19 nt, Human
gcaggcagcugggguaucc

SEQ ID NO: 574730 - RNA, 22 nt, Human
ugucacuacaucauaaauauau

SEQ ID NO: 574731 - RNA, 22 nt, Human
gagcuggcaggaggcuccccga

SEQ ID NO: 574732 - RNA, 18 nt, Human
ccagcugcgcugaaccga

SEQ ID NO: 574733 - RNA, 22 nt, Human
gccaggcuguuuuuauuacugu

SEQ ID NO: 574734 - RNA, 22 nt, Human
ucugggccucaccugcugcuca

SEQ ID NO: 574735 - RNA, 22 nt, Human
gagcagugaugggaggacguca

SEQ ID NO: 574736 - RNA, 20 nt, Human
uggaggcagagccagaggga

SEQ ID NO: 574737 - RNA, 22 nt, Human
acaauucugugguugucugugg

SEQ ID NO: 574738 - RNA, 22 nt, Human
ugaaagguguccaauauuucuc

SEQ ID NO: 574739 - RNA, 22 nt, Human
acuguauacuucuguauacaau

SEQ ID NO: 574740 - RNA, 22 nt, Human
agacuguacuuucugcagcucu

SEQ ID NO: 574741 - RNA, 22 nt, Human
uccuucagcugcuaggaaauga

SEQ ID NO: 574742 - RNA, 22 nt, Human
gagauucuuuccagaacuuuga

SEQ ID NO: 574743 - RNA, 22 nt, Human
ugaaagcacucacuucugcucu

SEQ ID NO: 574744 - RNA, 22 nt, Human
auuaguaaaacauuguauaugu

SEQ ID NO: 574745 - RNA, 22 nt, Human
uccugggcuugcuccuccagcu

SEQ ID NO: 574746 - RNA, 22 nt, Human
uccugaggaaaguucaugaaug

SEQ ID NO: 574747 - RNA, 22 nt, Human
gacagacaggaggcauucaggg

SEQ ID NO: 574748 - RNA, 23 nt, Human
agggccuggcguggagugugugc

SEQ ID NO: 574749 - RNA, 22 nt, Human
gugagagaaauuggagggaaug

SEQ ID NO: 574750 - RNA, 21 nt, Human
acaggauaggacaguguuccu

SEQ ID NO: 574751 - RNA, 22 nt, Human
auacauauaugguacuuccugg

SEQ ID NO: 574752 - RNA, 22 nt, Human
auagaauuuguacuuguagaac

SEQ ID NO: 574753 - RNA, 22 nt, Human
auccugggaagcugacauugaa

SEQ ID NO: 574754 - RNA, 22 nt, Human
auuuacagaaacuuaaucauag

SEQ ID NO: 574755 - RNA, 22 nt, Human
gaagagagccgcgggacaucag

SEQ ID NO: 574756 - RNA, 22 nt, Human
ucagggauugcaaaauucaucc

SEQ ID NO: 574757 - RNA, 22 nt, Human
ugggccagcucccugccccugg

SEQ ID NO: 574758 - RNA, 22 nt, Human
agggguuggacauaagacagaa

SEQ ID NO: 574759 - RNA, 22 nt, Human
auauuucuugagcaccugguau

SEQ ID NO: 574760 - RNA, 22 nt, Human
uuauuuccuagggaauuugccu

SEQ ID NO: 574761 - RNA, 22 nt, Human
uaugaaaagguggccaauguag

SEQ ID NO: 574762 - RNA, 22 nt, Human
aauacuugugaauucaaagucu

SEQ ID NO: 574763 - RNA, 22 nt, Human
augcuuuggccaaugagaagug

SEQ ID NO: 574764 - RNA, 21 nt, Human
ucugugccucaacccucaucu

SEQ ID NO: 574765 - RNA, 22 nt, Human
ugggcagaggcucugaagucca

SEQ ID NO: 574766 - RNA, 22 nt, Human
ugccuaggaaaccucaugcuuc

SEQ ID NO: 574767 - RNA, 22 nt, Human
gaaauacaaagccagccauuuu

SEQ ID NO: 574768 - RNA, 21 nt, Human
auaugaacuguggacuuugga

SEQ ID NO: 574769 - RNA, 22 nt, Human
agaggccagggacacugcucaa

SEQ ID NO: 574770 - RNA, 22 nt, Human
aggcuuuaaguggccuacagcu

SEQ ID NO: 574771 - RNA, 22 nt, Human
aggcaguguucuucuaagggca

SEQ ID NO: 574772 - RNA, 23 nt, Human
acagggaaaagucaucaguguga

SEQ ID NO: 574773 - RNA, 22 nt, Human
agcagaugaaucccagauaaag

SEQ ID NO: 574774 - RNA, 22 nt, Human
aaguucuuucauaucuuaauua

SEQ ID NO: 574775 - RNA, 18 nt, Human
agaaggagcuaugggcag

SEQ ID NO: 574776 - RNA, 22 nt, Human
ucugucacccaggcuggagugc

SEQ ID NO: 574777 - RNA, 22 nt, Human
caugaaauguguuaaucucuug

SEQ ID NO: 574778 - RNA, 22 nt, Human
caacagcugaucuuugaugaag

SEQ ID NO: 574779 - RNA, 22 nt, Human
aauagcugcauaaaguauagaa

SEQ ID NO: 574780 - RNA, 22 nt, Human
uccucacugcagugcuccgagc

SEQ ID NO: 574781 - RNA, 20 nt, Human
ucuguacacucaucuucugc

SEQ ID NO: 574782 - RNA, 23 nt, Human
ugagacccuaauuuagcaagugu

SEQ ID NO: 574783 - RNA, 22 nt, Human
ugcugcaguguuugcugaaguu

SEQ ID NO: 574784 - RNA, 22 nt, Human
acagcuuuugaaaaauuacugg

SEQ ID NO: 574785 - RNA, 18 nt, Human
gcaggagauggguggggu

SEQ ID NO: 574786 - RNA, 22 nt, Human
uggcagggccugaaucuuauac

SEQ ID NO: 574787 - RNA, 22 nt, Human
gugggcagauuaauuucucaau

SEQ ID NO: 574788 - RNA, 22 nt, Human
guuauacuuaugugcaaaaaua

SEQ ID NO: 574789 - RNA, 22 nt, Human
uguggcaggaagagcuucugag

SEQ ID NO: 574790 - RNA, 22 nt, Human
aucacauucuuucaaagcaguc

SEQ ID NO: 574791 - RNA, 22 nt, Human
cagucucuaaaucaaucugaau

SEQ ID NO: 574792 - RNA, 22 nt, Human
cagcagcaguggcugcagaaca

SEQ ID NO: 574793 - RNA, 22 nt, Human
uuucacauucuucugaaucuac

SEQ ID NO: 574794 - RNA, 21 nt, Human
cucuggaguuugaaggcuggg

SEQ ID NO: 574795 - RNA, 22 nt, Human
ugagacgaagucuugcucuguu

SEQ ID NO: 574796 - RNA, 22 nt, Human
caucacuuuuaaaggugaucga

SEQ ID NO: 574797 - RNA, 21 nt, Human
cagagagcuagaacuucauga

SEQ ID NO: 574798 - RNA, 22 nt, Human
aggaggaauugacacagaagcc

SEQ ID NO: 574799 - RNA, 22 nt, Human
gugggcaguggggucuucugcc

SEQ ID NO: 574800 - RNA, 22 nt, Human
agcucagggcgaucugucucgg

SEQ ID NO: 574801 - RNA, 22 nt, Human
aguaugaagaauacauagauga

SEQ ID NO: 574802 - RNA, 22 nt, Human
ucugugaaaucacccagguuua

SEQ ID NO: 574803 - RNA, 20 nt, Human
agauggugggcuggaacacc

SEQ ID NO: 574804 - RNA, 22 nt, Human
uuacaaagagugccagagugug

SEQ ID NO: 574805 - RNA, 22 nt, Human
auuugcugagcucaaagaaaag

SEQ ID NO: 574806 - RNA, 22 nt, Human
uugggcuggcagagguggucuu

SEQ ID NO: 574807 - RNA, 22 nt, Human
ggagcagcuugcaugcucaggg

SEQ ID NO: 574808 - RNA, 21 nt, Human
ccuggccaaucugauaggguu

SEQ ID NO: 574809 - RNA, 22 nt, Human
ccagucugugugccagccugcg

SEQ ID NO: 574810 - RNA, 22 nt, Human
cccagcuaccucugcuaggaga

SEQ ID NO: 574811 - RNA, 21 nt, Human
acagccaggaacaugaggggc

SEQ ID NO: 574812 - RNA, 22 nt, Human
agucagcagccuggccaggaga

SEQ ID NO: 574813 - RNA, 22 nt, Human
uuugaagacauauuguuacaua

SEQ ID NO: 574814 - RNA, 22 nt, Human
caguucuggaguuucauucuuu

SEQ ID NO: 574815 - RNA, 22 nt, Human
auuucagugucuucuucucccu

SEQ ID NO: 574816 - RNA, 22 nt, Human
ugcacacauguauguauaugug

SEQ ID NO: 574817 - RNA, 22 nt, Human
uuaccauucaaguucucuccuu

SEQ ID NO: 574818 - RNA, 22 nt, Human
auugcaguguugccuggggccu

SEQ ID NO: 574819 - RNA, 23 nt, Human
gggcuccagucucugcucaguug

SEQ ID NO: 574820 - RNA, 22 nt, Human
cucagaaauuacaaaagggaca

SEQ ID NO: 574821 - RNA, 22 nt, Human
agagccaggcucccauggggca

SEQ ID NO: 574822 - RNA, 22 nt, Human
gcugcuuuuuggauuuggcaca

SEQ ID NO: 574823 - RNA, 22 nt, Human
ucagaacaggacuggcugccau

SEQ ID NO: 574824 - RNA, 22 nt, Human
ucuauacacacaaagaaugcuu

SEQ ID NO: 574825 - RNA, 22 nt, Human
gagcuugguguuauuucugugg

SEQ ID NO: 574826 - RNA, 22 nt, Human
ucacauuuuaucuauuuuaagu

SEQ ID NO: 574827 - RNA, 22 nt, Human
agagcugugcuuugcaccacgu

SEQ ID NO: 574828 - RNA, 22 nt, Human
uuuaccaucugccacagauaug

SEQ ID NO: 574829 - RNA, 22 nt, Human
ccagcacuccugucucaagucu

SEQ ID NO: 574830 - RNA, 22 nt, Human
uuucuucuguuuguaguuacac

SEQ ID NO: 574831 - RNA, 22 nt, Human
agccauuuugguaaugauaaca

SEQ ID NO: 574832 - RNA, 22 nt, Human
ugcugggccucuucccuggaua

SEQ ID NO: 574833 - RNA, 22 nt, Human
agggaagcccuggcugagaccc

SEQ ID NO: 574834 - RNA, 22 nt, Human
acaggccuauguuccauugcag

SEQ ID NO: 574835 - RNA, 19 nt, Human
cugugagucuuguggccuc

SEQ ID NO: 574836 - RNA, 22 nt, Human
ggucacuggucucugcuuccau

SEQ ID NO: 574837 - RNA, 22 nt, Human
gaaguuuucugaggcuguagcu

SEQ ID NO: 574838 - RNA, 22 nt, Human
uagccaggucacacuguguguu

SEQ ID NO: 574839 - RNA, 22 nt, Human
aaggcaguuugggccaccaucu

SEQ ID NO: 574840 - RNA, 21 nt, Human
cucaaaugccaguuuuauuua

SEQ ID NO: 574841 - RNA, 20 nt, Human
gcugcuuucaaaugacacgu

SEQ ID NO: 574842 - RNA, 22 nt, Human
gagggcugcuggaaaaaugcag

SEQ ID NO: 574843 - RNA, 22 nt, Human
cuuaaaaucuggcaguuagcua

SEQ ID NO: 574844 - RNA, 22 nt, Human
augcauauuggauuagcagcca

SEQ ID NO: 574845 - RNA, 20 nt, Human
agagugggugucacaggcug

SEQ ID NO: 574846 - RNA, 17 nt, Human
ccucuuccucucagcug

SEQ ID NO: 574847 - RNA, 22 nt, Human
uccccacucucuccuggagcuu

SEQ ID NO: 574848 - RNA, 22 nt, Human
ccugucagcugauggcuaugua

SEQ ID NO: 574849 - RNA, 22 nt, Human
ccugaagaugcuguggccuggu

SEQ ID NO: 574850 - RNA, 21 nt, Human
ugucugccugcuucuucacuc

SEQ ID NO: 574851 - RNA, 22 nt, Human
gaggggggcgcccugcagugca

SEQ ID NO: 574852 - RNA, 22 nt, Human
caagagcugaggcuggagaggu

SEQ ID NO: 574853 - RNA, 22 nt, Human
ucugucugggugccucgaguac

SEQ ID NO: 574854 - RNA, 22 nt, Human
ugcuucagugcucugagccugu

SEQ ID NO: 574855 - RNA, 22 nt, Human
augcugaggacaaagagaucaa

SEQ ID NO: 574856 - RNA, 22 nt, Human
uagggcugccauuugcuuuucu

SEQ ID NO: 574857 - RNA, 22 nt, Human
ccagaggcuggggaaggauaca

SEQ ID NO: 574858 - RNA, 22 nt, Human
gugcacaucgugcagguuuguu

SEQ ID NO: 574859 - RNA, 22 nt, Human
gagcugagggucuaggaggguu

SEQ ID NO: 574860 - RNA, 22 nt, Human
uggccagccauaaaagaaccca

SEQ ID NO: 574861 - RNA, 22 nt, Human
aaucuuaaagaauauucuacca

SEQ ID NO: 574862 - RNA, 19 nt, Human
gcugugccucucuccugcu

SEQ ID NO: 574863 - RNA, 20 nt, Human
ggacuacaauuugcagugug

SEQ ID NO: 574864 - RNA, 22 nt, Human
uuguuaaaaugaggucauucug

SEQ ID NO: 574865 - RNA, 22 nt, Human
cuguuacuccuuuggcagauua

SEQ ID NO: 574866 - RNA, 22 nt, Human
uaacuucugaauagcaauagua

SEQ ID NO: 574867 - RNA, 22 nt, Human
ucaaggcuaaacuuucagagua

SEQ ID NO: 574868 - RNA, 22 nt, Human
uacauacauuaccucauuuagu

SEQ ID NO: 574869 - RNA, 20 nt, Human
acaguccugcacugguguuu

SEQ ID NO: 574870 - RNA, 22 nt, Human
aagggugggcaccgccagguca

SEQ ID NO: 574871 - RNA, 22 nt, Human
cagauagcaaauggguaagcua

SEQ ID NO: 574872 - RNA, 22 nt, Human
cuccucuagaagcugaccugga

SEQ ID NO: 574873 - RNA, 22 nt, Human
gcagugaauuuaacacucagau

SEQ ID NO: 574874 - RNA, 22 nt, Human
uuugcuucacaaguaugguucu

SEQ ID NO: 574875 - RNA, 22 nt, Human
uggaacaagggcguggcggucg

SEQ ID NO: 574876 - RNA, 22 nt, Human
gacugcuuaaauauaugauguu

SEQ ID NO: 574877 - RNA, 22 nt, Human
cagcucaggaaggaaggccggc

SEQ ID NO: 574878 - RNA, 22 nt, Human
uuucuccugcuagaacaaggag

SEQ ID NO: 574879 - RNA, 22 nt, Human
ucugauguguuuaagaaagaag

SEQ ID NO: 574880 - RNA, 22 nt, Human
cagcuauuuaucuuucaugaua

SEQ ID NO: 574881 - RNA, 22 nt, Human
guaaacauuacugugcuguaua

SEQ ID NO: 574882 - RNA, 22 nt, Human
aacuacauagaaauuaguauuu

SEQ ID NO: 574883 - RNA, 22 nt, Human
uauguuuuucagacguccuaca

SEQ ID NO: 574884 - RNA, 22 nt, Human
uacaaugcagugaccuccuuua

SEQ ID NO: 574885 - RNA, 21 nt, Human
gcucucagcugccugcugguu

SEQ ID NO: 574886 - RNA, 22 nt, Human
gagagcugggaaagccguggag

SEQ ID NO: 574887 - RNA, 22 nt, Human
uguagaaguucuucaggagaau

SEQ ID NO: 574888 - RNA, 22 nt, Human
ucucucuucaacccuuaacuag

SEQ ID NO: 574889 - RNA, 22 nt, Human
uuaggaggucuauggacauccu

SEQ ID NO: 574890 - RNA, 22 nt, Human
ccuucuccugccuuggguucau

SEQ ID NO: 574891 - RNA, 22 nt, Human
guagcuauuuaugauacucaug

SEQ ID NO: 574892 - RNA, 22 nt, Human
agcagcaaagaauaggcccucu

SEQ ID NO: 574893 - RNA, 22 nt, Human
agaaagcuuaugaaugggcaag

SEQ ID NO: 574894 - RNA, 22 nt, Human
cugggcucuaagggagcaccgu

SEQ ID NO: 574895 - RNA, 22 nt, Human
ccuggagggacccuggcccugu

SEQ ID NO: 574896 - RNA, 22 nt, Human
gagauuuccauauuuuguaaca

SEQ ID NO: 574897 - RNA, 22 nt, Human
cugucuucuaccuucaaccucc

SEQ ID NO: 574898 - RNA, 22 nt, Human
gagcugggauuugaaccuggga

SEQ ID NO: 574899 - RNA, 22 nt, Human
caugcuaagucauaaaagagua

SEQ ID NO: 574900 - RNA, 22 nt, Human
ggaccugccagaacucaggcua

SEQ ID NO: 574901 - RNA, 22 nt, Human
cuuccccaaguagagaggggag

SEQ ID NO: 574902 - RNA, 22 nt, Human
auauuucaugggguuccauacu

SEQ ID NO: 574903 - RNA, 22 nt, Human
uaaagguugaaaacugacugcc

SEQ ID NO: 574904 - RNA, 22 nt, Human
agcuugguguugccugcuugag

SEQ ID NO: 574905 - RNA, 22 nt, Human
ggcccugugauggauguauuag

SEQ ID NO: 574906 - RNA, 22 nt, Human
acuggaguugggucaagauucu

SEQ ID NO: 574907 - RNA, 22 nt, Human
auggcugggucaccaucagggu

SEQ ID NO: 574908 - RNA, 22 nt, Human
ucuguccuccggagcucccagu

SEQ ID NO: 574909 - RNA, 22 nt, Human
guggccugggguuuguucugag

SEQ ID NO: 574910 - RNA, 22 nt, Human
agcugcccuucucuugcccuug

SEQ ID NO: 574911 - RNA, 22 nt, Human
ucccagagcagaugugcuaaag

SEQ ID NO: 574912 - RNA, 22 nt, Human
aagaggaggacgguucccagaa

SEQ ID NO: 574913 - RNA, 22 nt, Human
auaagaauaauuaaguuagucc

SEQ ID NO: 574914 - RNA, 22 nt, Human
auauacaaagggcaaccucgcu

SEQ ID NO: 574915 - RNA, 22 nt, Human
acaggccagagguggggcagcc

SEQ ID NO: 574916 - RNA, 22 nt, Human
uaauacuugcuuuggauguaug

SEQ ID NO: 574917 - RNA, 23 nt, Human
ugugacagggucauugaaaaggg

SEQ ID NO: 574918 - RNA, 22 nt, Human
acacaguauugugacuauaacu

SEQ ID NO: 574919 - RNA, 22 nt, Human
ucuucugagacuucucuuuggu

SEQ ID NO: 574920 - RNA, 22 nt, Human
aggguggcuggaggaaucagaa

SEQ ID NO: 574921 - RNA, 22 nt, Human
cuccacagcucaggcucagagu

SEQ ID NO: 574922 - RNA, 22 nt, Human
aaagguaacaguuauaaccagg

SEQ ID NO: 574923 - RNA, 22 nt, Human
aagagcuggcucuugcagcagc

SEQ ID NO: 574924 - RNA, 22 nt, Human
agaaaccagggcuuaccagugc

SEQ ID NO: 574925 - RNA, 22 nt, Human
uagggcuggcgugcucagggaa

SEQ ID NO: 574926 - RNA, 22 nt, Human
guucucucagccuuuguuauua

SEQ ID NO: 574927 - RNA, 22 nt, Human
ggcagggucuggacugaaagcu

SEQ ID NO: 574928 - RNA, 18 nt, Human
auuuaaugaacugaaagc

SEQ ID NO: 574929 - RNA, 22 nt, Human
uccaggcuccugacuuuuuggg

SEQ ID NO: 574930 - RNA, 21 nt, Human
ugacauuuggauucauaguaa

SEQ ID NO: 574931 - RNA, 22 nt, Human
guguguguacucuguauauaaa

SEQ ID NO: 574932 - RNA, 22 nt, Human
acucugagcaucccaagucuua

SEQ ID NO: 574933 - RNA, 22 nt, Human
cuaaggaauucaaauaguuagu

SEQ ID NO: 574934 - RNA, 22 nt, Human
uaaagguagugugacauauugu

SEQ ID NO: 574935 - RNA, 22 nt, Human
gcacugugcuagaagccagggg

SEQ ID NO: 574936 - RNA, 22 nt, Human
uuguuucuccagucuaggaaaa

SEQ ID NO: 574937 - RNA, 22 nt, Human
ccagggccaguaagauuggcau

SEQ ID NO: 574938 - RNA, 22 nt, Human
gaccagcuggugaaaaccaauu

SEQ ID NO: 574939 - RNA, 22 nt, Human
guuuccuuuuucugcccucaau

SEQ ID NO: 574940 - RNA, 22 nt, Human
uaaacacugccuugguggguca

SEQ ID NO: 574941 - RNA, 23 nt, Human
cugucuccugggcuagguggaau

SEQ ID NO: 574942 - RNA, 22 nt, Human
gcagggcugcagagggcacugu

SEQ ID NO: 574943 - RNA, 22 nt, Human
auugcaaaggucccauucaaga

SEQ ID NO: 574944 - RNA, 22 nt, Human
uuaaaauagccagugccccucu

SEQ ID NO: 574945 - RNA, 22 nt, Human
cugaagcaggaggggaggcgcu

SEQ ID NO: 574946 - RNA, 22 nt, Human
caaagguuucacaguagcccau

SEQ ID NO: 574947 - RNA, 22 nt, Human
aauuuagauugauaaacaugga

SEQ ID NO: 574948 - RNA, 22 nt, Human
gccagccuucuguggccugcaa

SEQ ID NO: 574949 - RNA, 22 nt, Human
gacaggcuucauccucagaguu

SEQ ID NO: 574950 - RNA, 22 nt, Human
ugaaagcaggcgggcuacuuua

SEQ ID NO: 574951 - RNA, 22 nt, Human
cagaugcugcucaccugauuau

SEQ ID NO: 574952 - RNA, 22 nt, Human
ugagguagugauuguagaagug

SEQ ID NO: 574953 - RNA, 19 nt, Human
ggcucagggcgcugccgcc

SEQ ID NO: 574954 - RNA, 22 nt, Human
agagucagacuaagccauggug

SEQ ID NO: 574955 - RNA, 22 nt, Human
aguguucuuccuaucugcuguu

SEQ ID NO: 574956 - RNA, 22 nt, Human
ggcugcugcccaccccugcaug

SEQ ID NO: 574957 - RNA, 22 nt, Human
accccaggagcugugccuaguc

SEQ ID NO: 574958 - RNA, 22 nt, Human
augcuauuccagaauguaaauu

SEQ ID NO: 574959 - RNA, 17 nt, Human
aacugcuuuuuuuagcc

SEQ ID NO: 574960 - RNA, 22 nt, Human
ucuuagcauuucauaacaacug

SEQ ID NO: 574961 - RNA, 18 nt, Human
aaugugaauauuuacuuc

SEQ ID NO: 574962 - RNA, 22 nt, Human
agacagcucuggguuccacacu

SEQ ID NO: 574963 - RNA, 22 nt, Human
gaaagcaguaaaugggucccau

SEQ ID NO: 574964 - RNA, 22 nt, Human
ugcuagugcaggguuuucaguu

SEQ ID NO: 574965 - RNA, 22 nt, Human
uuuacacagaggacacugggcu

SEQ ID NO: 574966 - RNA, 22 nt, Human
aaaaguacuauuuuaacaaagu

SEQ ID NO: 574967 - RNA, 22 nt, Human
aagauucagccaaauuguucau

SEQ ID NO: 574968 - RNA, 22 nt, Human
gggucccuggaauuacuugaca

SEQ ID NO: 574969 - RNA, 22 nt, Human
ccuggagacccacuucugccaa

SEQ ID NO: 574970 - RNA, 22 nt, Human
uuaaagcauccugucagucugu

SEQ ID NO: 574971 - RNA, 22 nt, Human
auuuaauuuauagauguggaua

SEQ ID NO: 574972 - RNA, 22 nt, Human
ugagaguuccuccucuuuccac

SEQ ID NO: 574973 - RNA, 22 nt, Human
agagcugaaaaagcugacccgg

SEQ ID NO: 574974 - RNA, 22 nt, Human
caggaacagcugaccugacaau

SEQ ID NO: 574975 - RNA, 22 nt, Human
aggcugcuucagcugcagggag

SEQ ID NO: 574976 - RNA, 22 nt, Human
agagcucuuugauuugcuucuc

SEQ ID NO: 574977 - RNA, 22 nt, Human
auucuauuuuuuaagaaguagu

SEQ ID NO: 574978 - RNA, 22 nt, Human
cccagcucaagcagagagcuaa

SEQ ID NO: 574979 - RNA, 22 nt, Human
guuaaugugucugacacaaugg

SEQ ID NO: 574980 - RNA, 20 nt, Human
ggacacuguagauuucaaac

SEQ ID NO: 574981 - RNA, 22 nt, Human
uugugcauauuagguacaugcu

SEQ ID NO: 574982 - RNA, 22 nt, Human
guuauuguccauuuauuuagca

SEQ ID NO: 574983 - RNA, 22 nt, Human
guccaaaagagccagccgggcg

SEQ ID NO: 574984 - RNA, 22 nt, Human
acagcaggcccauacuggaagg

SEQ ID NO: 574985 - RNA, 22 nt, Human
gauacuuuguggaauccuggau

SEQ ID NO: 574986 - RNA, 20 nt, Human
ugcuuuuauaccuauaauga

SEQ ID NO: 574987 - RNA, 22 nt, Human
ccugccagcugugggccagccu

SEQ ID NO: 574988 - RNA, 22 nt, Human
gcauuuuucaucccucuugggu

SEQ ID NO: 574989 - RNA, 22 nt, Human
gcagaagggaauaaggagcuuu

SEQ ID NO: 574990 - RNA, 18 nt, Human
gcucuaauuuuagaaagg

SEQ ID NO: 574991 - RNA, 22 nt, Human
ucuuggccagguguggugccuc

SEQ ID NO: 574992 - RNA, 20 nt, Human
aggaugcagggagucugcag

SEQ ID NO: 574993 - RNA, 22 nt, Human
ugcaggagccuuggacuugaaa

SEQ ID NO: 574994 - RNA, 22 nt, Human
cccugggaaguauuccagcuau

SEQ ID NO: 574995 - RNA, 21 nt, Human
ugcagccauucagcccuaugc

SEQ ID NO: 574996 - RNA, 22 nt, Human
ugcuccagugagcuggccaucc

SEQ ID NO: 574997 - RNA, 22 nt, Human
cauagaaaucaggugagaaucu

SEQ ID NO: 574998 - RNA, 22 nt, Human
agagagcucuggcugggugacc

SEQ ID NO: 574999 - RNA, 21 nt, Human
uaacaaagacuucuggucagg

SEQ ID NO: 575000 - RNA, 20 nt, Human
cucucccagcacagcuuccu

SEQ ID NO: 575001 - RNA, 22 nt, Human
acacaucuaucucuacacaagg

SEQ ID NO: 575002 - RNA, 22 nt, Human
gacagaguuguugauguaugcu

SEQ ID NO: 575003 - RNA, 23 nt, Human
ugcaggguguuccugccuuugcu

SEQ ID NO: 575004 - RNA, 22 nt, Human
gcucuccaaacccuguggcuuu

SEQ ID NO: 575005 - RNA, 22 nt, Human
gagcagaacaggccggguggga

SEQ ID NO: 575006 - RNA, 22 nt, Human
aacuagucagugauucucagaa

SEQ ID NO: 575007 - RNA, 22 nt, Human
guuuggggaguuccuuuaggcc

SEQ ID NO: 575008 - RNA, 22 nt, Human
ugucuuuagaaagaagcagaca

SEQ ID NO: 575009 - RNA, 20 nt, Human
cuagucucacaucccuggca

SEQ ID NO: 575010 - RNA, 22 nt, Human
aggacaggauuccuugccuugc

SEQ ID NO: 575011 - RNA, 22 nt, Human
auaugcaagcacauagaauacu

SEQ ID NO: 575012 - RNA, 22 nt, Human
gcagagccccucaagccagccu

SEQ ID NO: 575013 - RNA, 22 nt, Human
gacaagacaugugaugacauca

SEQ ID NO: 575014 - RNA, 22 nt, Human
auaguguugauagcaguggagu

SEQ ID NO: 575015 - RNA, 22 nt, Human
auuggccauuugcauguauuau

SEQ ID NO: 575016 - RNA, 22 nt, Human
acagggcuuagaacuuggccuc

SEQ ID NO: 575017 - RNA, 22 nt, Human
aaggaccuauauugucagagga

SEQ ID NO: 575018 - RNA, 22 nt, Human
ccugggcaaaugccagagacaa

SEQ ID NO: 575019 - RNA, 22 nt, Human
accccagggcugccagccuccu

SEQ ID NO: 575020 - RNA, 22 nt, Human
uuuccucuccggggccuccagg

SEQ ID NO: 575021 - RNA, 22 nt, Human
gacaggcacgaaauugggcugg

SEQ ID NO: 575022 - RNA, 22 nt, Human
cuggugcauguggccuugcucu

SEQ ID NO: 575023 - RNA, 22 nt, Human
acauuguugugcaauuauaguu

SEQ ID NO: 575024 - RNA, 21 nt, Human
aguuuuauauuauaagcuaaa

SEQ ID NO: 575025 - RNA, 23 nt, Human
aucugaaaaggcauuuucuuccc

SEQ ID NO: 575026 - RNA, 22 nt, Human
cuggcagcgguuugcagccugg

SEQ ID NO: 575027 - RNA, 22 nt, Human
guuuuuuggguguauaucuucu

SEQ ID NO: 575028 - RNA, 22 nt, Human
uggaggugacggggccucguug

SEQ ID NO: 575029 - RNA, 22 nt, Human
gcugggaggcagcaccuuuagc

SEQ ID NO: 575030 - RNA, 23 nt, Human
gugugccaagcacugugccagga

SEQ ID NO: 575031 - RNA, 22 nt, Human
aaaucaucucugcauccuuagc

SEQ ID NO: 575032 - RNA, 22 nt, Human
gccacuggcgcugugcagagug

SEQ ID NO: 575033 - RNA, 22 nt, Human
auccccaggggcauucaagcuu

SEQ ID NO: 575034 - RNA, 22 nt, Human
gagcucuguucucguccugcug

SEQ ID NO: 575035 - RNA, 22 nt, Human
uuacagguacuugcugcugaaa

SEQ ID NO: 575036 - RNA, 22 nt, Human
gaacugggaaugcugucccauc

SEQ ID NO: 575037 - RNA, 22 nt, Human
gggagggaaggaggcgccgugu

SEQ ID NO: 575038 - RNA, 22 nt, Human
gugggcaggcccuaggcgauuu

SEQ ID NO: 575039 - RNA, 22 nt, Human
auguaauaggguaacauaacau

SEQ ID NO: 575040 - RNA, 22 nt, Human
uuuagcagagcauaugauaucc

SEQ ID NO: 575041 - RNA, 22 nt, Human
uucuaguuuagggcucuucaac

SEQ ID NO: 575042 - RNA, 17 nt, Human
aucuggaagcuagcuga

SEQ ID NO: 575043 - RNA, 22 nt, Human
uacuuuauauuguggcuggcca

SEQ ID NO: 575044 - RNA, 22 nt, Human
agcuccugggcaccucuuucac

SEQ ID NO: 575045 - RNA, 22 nt, Human
ucacccagguccaggcucuggc

SEQ ID NO: 575046 - RNA, 22 nt, Human
agaaucuucgguaacuggaaga

SEQ ID NO: 575047 - RNA, 22 nt, Human
gcauuucuuccuggugugagcc

SEQ ID NO: 575048 - RNA, 21 nt, Human
ucccugugagcagcucuuccu

SEQ ID NO: 575049 - RNA, 22 nt, Human
ucuggcugaagcuuuugcagcu

SEQ ID NO: 575050 - RNA, 22 nt, Human
gagacagaugcugcuggagcau

SEQ ID NO: 575051 - RNA, 22 nt, Human
ggagcugucuguagggcacagg

SEQ ID NO: 575052 - RNA, 22 nt, Human
gugcugagaauugauguccuug

SEQ ID NO: 575053 - RNA, 22 nt, Human
aucuggagaauaaauguccaag

SEQ ID NO: 575054 - RNA, 21 nt, Human
agaggcccucggacugggcgu

SEQ ID NO: 575055 - RNA, 22 nt, Human
uagaaaggaagcuacuuagggg

SEQ ID NO: 575056 - RNA, 22 nt, Human
agugaggggcagcugagugggc

SEQ ID NO: 575057 - RNA, 22 nt, Human
aguggcaggcggagauguagga

SEQ ID NO: 575058 - RNA, 21 nt, Human
ccagcucugccuccaguuggu

SEQ ID NO: 575059 - RNA, 22 nt, Human
ucucccucuuugucugcuuugg

SEQ ID NO: 575060 - RNA, 22 nt, Human
ccugcagguuucccccggacgg

SEQ ID NO: 575061 - RNA, 22 nt, Human
ugcaaacaauuuccuauaaagu

SEQ ID NO: 575062 - RNA, 18 nt, Human
auggcucaggaauggcuu

SEQ ID NO: 575063 - RNA, 22 nt, Human
gugcugaagugaaauucaucaa

SEQ ID NO: 575064 - RNA, 22 nt, Human
ccaggguguagggauuccagau

SEQ ID NO: 575065 - RNA, 22 nt, Human
aaugggauaauagaaguagaau

SEQ ID NO: 575066 - RNA, 22 nt, Human
gaggguggaagagcugcugaga

SEQ ID NO: 575067 - RNA, 22 nt, Human
ucuaagccaggacugagagacg

SEQ ID NO: 575068 - RNA, 22 nt, Human
cuggagauuaaguucucagcca

SEQ ID NO: 575069 - RNA, 22 nt, Human
ggaaccuuaguguucuuuuacc

SEQ ID NO: 575070 - RNA, 22 nt, Human
cacagcuucccgugcauggaga

SEQ ID NO: 575071 - RNA, 22 nt, Human
aggaaacugauguuuuuuacaa

SEQ ID NO: 575072 - RNA, 23 nt, Human
uuugaaaguaucaacucgccuga

SEQ ID NO: 575073 - RNA, 22 nt, Human
ugcauggagauauacuauuuga

SEQ ID NO: 575074 - RNA, 22 nt, Human
acaguaaauauuaagccugagu

SEQ ID NO: 575075 - RNA, 22 nt, Human
aggaaggacugcagcauuuggu

SEQ ID NO: 575076 - RNA, 22 nt, Human
agugcucuggguccacuccaga

SEQ ID NO: 575077 - RNA, 22 nt, Human
gcagccagggagagaaccaggg

SEQ ID NO: 575078 - RNA, 22 nt, Human
cauuuccuuccugcugcuccuc

SEQ ID NO: 575079 - RNA, 22 nt, Human
aauggcaccugcuauauacuga

SEQ ID NO: 575080 - RNA, 22 nt, Human
ucagaugcccuuuguuuuagac

SEQ ID NO: 575081 - RNA, 22 nt, Human
ggaaaucuuccuucacucuuuc

SEQ ID NO: 575082 - RNA, 22 nt, Human
gugggcugcccuugaggucagc

SEQ ID NO: 575083 - RNA, 22 nt, Human
cuggaggagaacuugaggaagg

SEQ ID NO: 575084 - RNA, 22 nt, Human
gcccauggcagaacugugagca

SEQ ID NO: 575085 - RNA, 22 nt, Human
cccugucuguaccgugaugagc

SEQ ID NO: 575086 - RNA, 22 nt, Human
cucagcaccccgacaggacauu

SEQ ID NO: 575087 - RNA, 22 nt, Human
uuugugaacuuaggcaauuagg

SEQ ID NO: 575088 - RNA, 22 nt, Human
gaacaaacagucaggacagucu

SEQ ID NO: 575089 - RNA, 22 nt, Human
uuccuuucccucacagccucgg

SEQ ID NO: 575090 - RNA, 22 nt, Human
ucugacuuauuuguccuuggug

SEQ ID NO: 575091 - RNA, 22 nt, Human
gggccaagggugcguggcagga

SEQ ID NO: 575092 - RNA, 22 nt, Human
ucucugaaggggagcuguuuaa

SEQ ID NO: 575093 - RNA, 22 nt, Human
gggcaggaggcuaauucugcau

SEQ ID NO: 575094 - RNA, 22 nt, Human
ugcuagauggagcagaauagcu

SEQ ID NO: 575095 - RNA, 22 nt, Human
auggcuuaugguaaauauuucu

SEQ ID NO: 575096 - RNA, 22 nt, Human
gauuucuugaccccugucucag

SEQ ID NO: 575097 - RNA, 22 nt, Human
caaccucauagaaagaaaaugu

SEQ ID NO: 575098 - RNA, 22 nt, Human
cugcaguuggcugagacccccc

SEQ ID NO: 575099 - RNA, 22 nt, Human
uaugugacaaaaguaaacugca

SEQ ID NO: 575100 - RNA, 20 nt, Human
gcacaugcaacuuuuauuua

SEQ ID NO: 575101 - RNA, 22 nt, Human
cacagaaauauugugucccuug

SEQ ID NO: 575102 - RNA, 22 nt, Human
auccuucagcugcccuguuacc

SEQ ID NO: 575103 - RNA, 23 nt, Human
ucugugccaguuuccaugucugu

SEQ ID NO: 575104 - RNA, 22 nt, Human
aagauccaggcaaaaguuggaa

SEQ ID NO: 575105 - RNA, 22 nt, Human
agggagugguuaagaaggugca

SEQ ID NO: 575106 - RNA, 22 nt, Human
gcugcucugggucugcccagcu

SEQ ID NO: 575107 - RNA, 22 nt, Human
aagaggagacuucagcaacuug

SEQ ID NO: 575108 - RNA, 19 nt, Human
gguguuucuucauuuucca

SEQ ID NO: 575109 - RNA, 18 nt, Human
ccugccagucuggagcag

SEQ ID NO: 575110 - RNA, 22 nt, Human
ugguuuguuuguucauguaaaa

SEQ ID NO: 575111 - RNA, 22 nt, Human
aguuucauuucuuaguaccagu

SEQ ID NO: 575112 - RNA, 22 nt, Human
gccaccaggagcccaguccaaa

SEQ ID NO: 575113 - RNA, 22 nt, Human
guaaauaacugguaauuggggu

SEQ ID NO: 575114 - RNA, 22 nt, Human
auuagagcaguguauuaugaua

SEQ ID NO: 575115 - RNA, 23 nt, Human
uucuuauuuacuuuggaaucucc

SEQ ID NO: 575116 - RNA, 22 nt, Human
caaagugcuaggauuacaggcc

SEQ ID NO: 575117 - RNA, 22 nt, Human
gggaacuguuuaacagggguuu

SEQ ID NO: 575118 - RNA, 22 nt, Human
caggaagggggauccuuggaag

SEQ ID NO: 575119 - RNA, 22 nt, Human
auggggaagagccagugagcug

SEQ ID NO: 575120 - RNA, 22 nt, Human
ugcuuuaaauaugaauuagcau

SEQ ID NO: 575121 - RNA, 22 nt, Human
ugucuauagaaucaugcaguuu

SEQ ID NO: 575122 - RNA, 22 nt, Human
aaggcugugucagaagcucccu

SEQ ID NO: 575123 - RNA, 22 nt, Human
ugggccagaggcauggagcuau

SEQ ID NO: 575124 - RNA, 22 nt, Human
gcugggagucgcgucuguggcc

SEQ ID NO: 575125 - RNA, 22 nt, Human
ucagcuuuugucagaaauugua

SEQ ID NO: 575126 - RNA, 22 nt, Human
gcucacaggcaguguugggaga

SEQ ID NO: 575127 - RNA, 22 nt, Human
uaagugaauauuuucuucugua

SEQ ID NO: 575128 - RNA, 22 nt, Human
ucugggucuaucccaugccuuu

SEQ ID NO: 575129 - RNA, 22 nt, Human
uuuaagaucauuuguauuaucc

SEQ ID NO: 575130 - RNA, 21 nt, Human
acauacauuaucuuuuuaaaa

SEQ ID NO: 575131 - RNA, 22 nt, Human
aaggccacagagccucagagag

SEQ ID NO: 575132 - RNA, 22 nt, Human
gcugcuccgucugagcucuggu

SEQ ID NO: 575133 - RNA, 22 nt, Human
uggcaguggcucagagugcaga

SEQ ID NO: 575134 - RNA, 20 nt, Human
caguccaggcugcagcaucu

SEQ ID NO: 575135 - RNA, 22 nt, Human
gugaggugacuagcaggugggg

SEQ ID NO: 575136 - RNA, 22 nt, Human
ucccagggugcgccugcccucg

SEQ ID NO: 575137 - RNA, 22 nt, Human
uuagauuuacaagcacuguuua

SEQ ID NO: 575138 - RNA, 22 nt, Human
cagaguacugggagaacagaag

SEQ ID NO: 575139 - RNA, 22 nt, Human
uucuucccuucauuccaccacc

SEQ ID NO: 575140 - RNA, 22 nt, Human
uacaaagagguaauugcauaua

SEQ ID NO: 575141 - RNA, 22 nt, Human
uccuuaaauauuuacuguuaac

SEQ ID NO: 575142 - RNA, 22 nt, Human
uccuggguccauggcagccgaa

SEQ ID NO: 575143 - RNA, 17 nt, Human
uuucaucugggaccacc

SEQ ID NO: 575144 - RNA, 22 nt, Human
ugaaguacccguuuuuauugca

SEQ ID NO: 575145 - RNA, 22 nt, Human
ggagcugggguuggcaucuucc

SEQ ID NO: 575146 - RNA, 22 nt, Human
cuguggagcuuguggcaguggg

SEQ ID NO: 575147 - RNA, 23 nt, Human
ccuggcagcaaacgaggagguua

SEQ ID NO: 575148 - RNA, 22 nt, Human
aucuaauuuucacucauuugcu

SEQ ID NO: 575149 - RNA, 22 nt, Human
uucucuaauggugaugauuaga

SEQ ID NO: 575150 - RNA, 22 nt, Human
ucucugaauucugaugcaagug

SEQ ID NO: 575151 - RNA, 22 nt, Human
cugaggccucguuggcuggaac

SEQ ID NO: 575152 - RNA, 22 nt, Human
uuaucugaaacuuuugggacca

SEQ ID NO: 575153 - RNA, 22 nt, Human
ugggugcucugcgaccguaggg

SEQ ID NO: 575154 - RNA, 22 nt, Human
aaacucuguugagauaauauuu

SEQ ID NO: 575155 - RNA, 22 nt, Human
cugucccacaagcagugugcac

SEQ ID NO: 575156 - RNA, 20 nt, Human
cacaggccccaagaccugua

SEQ ID NO: 575157 - RNA, 20 nt, Human
uguccuaauagacaagcaga

SEQ ID NO: 575158 - RNA, 22 nt, Human
gauauaaauuaaucaagugcaa

SEQ ID NO: 575159 - RNA, 22 nt, Human
cgcugccaggucaccaggggua

SEQ ID NO: 575160 - RNA, 22 nt, Human
agcaguggccuggggcucugug

SEQ ID NO: 575161 - RNA, 22 nt, Human
acagauugggaacugucuccuu

SEQ ID NO: 575162 - RNA, 20 nt, Human
uaaauggugcauuucuuaua

SEQ ID NO: 575163 - RNA, 22 nt, Human
cagggagcuuugucuucucauu

SEQ ID NO: 575164 - RNA, 22 nt, Human
ucugaaaucuaaugcucugugg

SEQ ID NO: 575165 - RNA, 22 nt, Human
gucucuuaugggcaggagcaca

SEQ ID NO: 575166 - RNA, 22 nt, Human
ggggaagaauggcagaaaacau

SEQ ID NO: 575167 - RNA, 22 nt, Human
cuuuaccacaaggacagaacuu

SEQ ID NO: 575168 - RNA, 22 nt, Human
aaaacacacuggaccaauuuaa

SEQ ID NO: 575169 - RNA, 22 nt, Human
uggcccaguauguauaaucuua

SEQ ID NO: 575170 - RNA, 22 nt, Human
caauaguaaauuacggaggaga

SEQ ID NO: 575171 - RNA, 22 nt, Human
acagacaucuauccauuuaauu

SEQ ID NO: 575172 - RNA, 22 nt, Human
gccaggagaaugcuagcagagg

SEQ ID NO: 575173 - RNA, 22 nt, Human
guggaaggugcuagaacaagga

SEQ ID NO: 575174 - RNA, 22 nt, Human
ccaggcaggcgauggugcagug

SEQ ID NO: 575175 - RNA, 22 nt, Human
augacacuguccuaguaaggaa

SEQ ID NO: 575176 - RNA, 22 nt, Human
guugcugaaauuaauauuggag

SEQ ID NO: 575177 - RNA, 22 nt, Human
caaugaacacagcaauuucaua

SEQ ID NO: 575178 - RNA, 22 nt, Human
acagcagacagucggcuuccug

SEQ ID NO: 575179 - RNA, 22 nt, Human
gcugguagaccucacugcacuc

SEQ ID NO: 575180 - RNA, 22 nt, Human
aaacaaauagugcaugggaauu

SEQ ID NO: 575181 - RNA, 22 nt, Human
ugagguagugcuugucauguuu

SEQ ID NO: 575182 - RNA, 22 nt, Human
cauuugcucugguuccuucugg

SEQ ID NO: 575183 - RNA, 22 nt, Human
ucaguaacuucaugaccaagca

SEQ ID NO: 575184 - RNA, 23 nt, Human
gccuucagcucgggaaggcuccc

SEQ ID NO: 575185 - RNA, 22 nt, Human
ggcuccuguggcaagacagcuu

SEQ ID NO: 575186 - RNA, 22 nt, Human
cugggcucuaggaaccauuccu

SEQ ID NO: 575187 - RNA, 22 nt, Human
ggcugcugguagggguaggaag

SEQ ID NO: 575188 - RNA, 22 nt, Human
uauguacauguuaaagggcaaa

SEQ ID NO: 575189 - RNA, 23 nt, Human
cagguggcuccacgagggguggg

SEQ ID NO: 575190 - RNA, 22 nt, Human
uucucuuuuagaggcuccauga

SEQ ID NO: 575191 - RNA, 22 nt, Human
auauguguaaaugcauuuguuu

SEQ ID NO: 575192 - RNA, 22 nt, Human
agccuggcggucgucggucagg

SEQ ID NO: 575193 - RNA, 22 nt, Human
gaagccaacauuccaaguagaa

SEQ ID NO: 575194 - RNA, 19 nt, Human
ugccagcauuaggcugaag

SEQ ID NO: 575195 - RNA, 22 nt, Human
cugggcuugaguuccugcucgu

SEQ ID NO: 575196 - RNA, 22 nt, Human
aagaguuuaugauauaacaugu

SEQ ID NO: 575197 - RNA, 23 nt, Human
uagcagcauuuuuagccucuguc

SEQ ID NO: 575198 - RNA, 22 nt, Human
ugcuccugcugcaugcaucucc

SEQ ID NO: 575199 - RNA, 22 nt, Human
cuuguuaaaaugccgauucuga

SEQ ID NO: 575200 - RNA, 22 nt, Human
gcagaggggaagcugaggaauu

SEQ ID NO: 575201 - RNA, 22 nt, Human
ucuggcuucaagucccagcucu

SEQ ID NO: 575202 - RNA, 22 nt, Human
uccagccacuugcacaguuaaa

SEQ ID NO: 575203 - RNA, 22 nt, Human
ggucugagugccagggagagaa

SEQ ID NO: 575204 - RNA, 21 nt, Human
ucugccagcugaagaggugga

SEQ ID NO: 575205 - RNA, 22 nt, Human
caaagcaggcuugucaaauugc

SEQ ID NO: 575206 - RNA, 22 nt, Human
uucagcacuguuauggauuugc

SEQ ID NO: 575207 - RNA, 22 nt, Human
uuauauguuucuguuuggaggc

SEQ ID NO: 575208 - RNA, 22 nt, Human
ccaaagagcuagaauuauaggc

SEQ ID NO: 575209 - RNA, 22 nt, Human
gaagaacacuucaugauucauu

SEQ ID NO: 575210 - RNA, 22 nt, Human
cugcagagcaaguaacauccuc

SEQ ID NO: 575211 - RNA, 22 nt, Human
gcagugaaaaagugcacccugu

SEQ ID NO: 575212 - RNA, 22 nt, Human
gccuagggguaagaguacuggc

SEQ ID NO: 575213 - RNA, 22 nt, Human
ccagggcuccccagaaguaccc

SEQ ID NO: 575214 - RNA, 22 nt, Human
aauucuaaauguaauuuagaau

SEQ ID NO: 575215 - RNA, 22 nt, Human
gaggagggcuuuguugauguua

SEQ ID NO: 575216 - RNA, 22 nt, Human
uuaagaaugugccuuuugguug

SEQ ID NO: 575217 - RNA, 22 nt, Human
uuacagguauuuuauugagcag

SEQ ID NO: 575218 - RNA, 21 nt, Human
uggcucuggguaggagagugc

SEQ ID NO: 575219 - RNA, 18 nt, Human
ugcccaccagaagaggga

SEQ ID NO: 575220 - RNA, 22 nt, Human
cuacauaaucuggauuugucug

SEQ ID NO: 575221 - RNA, 22 nt, Human
acaacagagcuggacugagagg

SEQ ID NO: 575222 - RNA, 19 nt, Human
gccagcagaaugaugaggc

SEQ ID NO: 575223 - RNA, 21 nt, Human
ugagcaaaauuuagagugaug

SEQ ID NO: 575224 - RNA, 22 nt, Human
acaugcacaccuauauacaugu

SEQ ID NO: 575225 - RNA, 22 nt, Human
ugaggccugaagccuggagccu

SEQ ID NO: 575226 - RNA, 22 nt, Human
uucaacauuugaaaugaaugaa

SEQ ID NO: 575227 - RNA, 22 nt, Human
ugcauggaggaagaugaaugca

SEQ ID NO: 575228 - RNA, 19 nt, Human
ugugucucuguguagccug

SEQ ID NO: 575229 - RNA, 22 nt, Human
aagacaggaaaagcuccaggcc

SEQ ID NO: 575230 - RNA, 22 nt, Human
gagcaggccagcaauggaaggg

SEQ ID NO: 575231 - RNA, 23 nt, Human
uguaaaaugggguaguguuacca

SEQ ID NO: 575232 - RNA, 23 nt, Human
uggcagugcccagggagaugauc

SEQ ID NO: 575233 - RNA, 20 nt, Human
aggaagcugagauguagagg

SEQ ID NO: 575234 - RNA, 22 nt, Human
ggcuguccaccuaccaugccgg

SEQ ID NO: 575235 - RNA, 22 nt, Human
ucacaugcccuaccuaaucuua

SEQ ID NO: 575236 - RNA, 19 nt, Human
cuucagcaucuccggagcu

SEQ ID NO: 575237 - RNA, 22 nt, Human
uuacacagaugguuaguagagg

SEQ ID NO: 575238 - RNA, 22 nt, Human
acacauuaugagcaguugucuu

SEQ ID NO: 575239 - RNA, 22 nt, Human
ugacauccugaguacauaagag

SEQ ID NO: 575240 - RNA, 16 nt, Human
gacaaguggaggggcc

SEQ ID NO: 575241 - RNA, 22 nt, Human
gugugccagacaugaugcuaug

SEQ ID NO: 575242 - RNA, 22 nt, Human
uggcaggaaaaacauuggagau

SEQ ID NO: 575243 - RNA, 22 nt, Human
agccaagagcucaccucgugug

SEQ ID NO: 575244 - RNA, 22 nt, Human
uuaaagaugcagcuuuagagaa

SEQ ID NO: 575245 - RNA, 22 nt, Human
ccagggcagugggagaaggugc

SEQ ID NO: 575246 - RNA, 22 nt, Human
aaauagaaaccaacaaggucag

SEQ ID NO: 575247 - RNA, 22 nt, Human
uauuaugauucggacguggcag

SEQ ID NO: 575248 - RNA, 22 nt, Human
gauuucuucaggagcagaggag

SEQ ID NO: 575249 - RNA, 22 nt, Human
ugaggcaguauuuuagugacuu

SEQ ID NO: 575250 - RNA, 22 nt, Human
gcauugaauccuaucaggcaaa

SEQ ID NO: 575251 - RNA, 18 nt, Human
gccagagcauaucuccag

SEQ ID NO: 575252 - RNA, 22 nt, Human
agcuccugcuugacagaagagg

SEQ ID NO: 575253 - RNA, 22 nt, Human
gcuuggcauuugcugggagcug

SEQ ID NO: 575254 - RNA, 22 nt, Human
agacagacauucuagagccacc

SEQ ID NO: 575255 - RNA, 21 nt, Human
agcagcugcaguuucuaucug

SEQ ID NO: 575256 - RNA, 22 nt, Human
uggcugaggcuuuucuuaaaga

SEQ ID NO: 575257 - RNA, 22 nt, Human
gauauacugucuguauuacaua

SEQ ID NO: 575258 - RNA, 22 nt, Human
gugccugguuuggggaauguuc

SEQ ID NO: 575259 - RNA, 22 nt, Human
gcucccaacucaggccuccucc

SEQ ID NO: 575260 - RNA, 22 nt, Human
ggagggcugagacuggggucug

SEQ ID NO: 575261 - RNA, 22 nt, Human
cucugcagaggcccaaggcuga

SEQ ID NO: 575262 - RNA, 22 nt, Human
uagcuucaguggcccuagacac

SEQ ID NO: 575263 - RNA, 22 nt, Human
ccaaaauguuugaaugcaugug

SEQ ID NO: 575264 - RNA, 22 nt, Human
gcaggugggagccgcugccuga

SEQ ID NO: 575265 - RNA, 22 nt, Human
aauguuauuucugcauaguagu

SEQ ID NO: 575266 - RNA, 22 nt, Human
cuggagccacugggucuuguau

SEQ ID NO: 575267 - RNA, 22 nt, Human
uccuggagaagaggggcuugga

SEQ ID NO: 575268 - RNA, 22 nt, Human
aauauuuccaaggccugucagg

SEQ ID NO: 575269 - RNA, 22 nt, Human
ggaggccaaggugggcggauca

SEQ ID NO: 575270 - RNA, 17 nt, Human
cuguggccaccuggaug

SEQ ID NO: 575271 - RNA, 22 nt, Human
aaagccagcaaggugaguuuca

SEQ ID NO: 575272 - RNA, 22 nt, Human
caggugggaccaugauagggca

SEQ ID NO: 575273 - RNA, 22 nt, Human
cagcuguuccuggaaggagacc

SEQ ID NO: 575274 - RNA, 22 nt, Human
cagucuggcacagcacacugaa

SEQ ID NO: 575275 - RNA, 22 nt, Human
uggcucagagcagggacucugg

SEQ ID NO: 575276 - RNA, 18 nt, Human
cagaugagaugcaaucuc

SEQ ID NO: 575277 - RNA, 22 nt, Human
uucuauugaaugauaaucuaua

SEQ ID NO: 575278 - RNA, 22 nt, Human
aucagaagcuuguagucucucu

SEQ ID NO: 575279 - RNA, 22 nt, Human
uagcauuaucugucuuaucauu

SEQ ID NO: 575280 - RNA, 22 nt, Human
guacacacaaucucuggucagu

SEQ ID NO: 575281 - RNA, 22 nt, Human
aaaacaguuauaaacagaguca

SEQ ID NO: 575282 - RNA, 19 nt, Human
gcagguggauguggucagc

SEQ ID NO: 575283 - RNA, 19 nt, Human
auucuucucaaauauccau

SEQ ID NO: 575284 - RNA, 22 nt, Human
caauuauauuuagaaugauaca

SEQ ID NO: 575285 - RNA, 22 nt, Human
gcuguggcuugcagcuggggcu

SEQ ID NO: 575286 - RNA, 22 nt, Human
aggaagcugcuaagaaacaaug

SEQ ID NO: 575287 - RNA, 22 nt, Human
gggcuggaucuccugcaggcag

SEQ ID NO: 575288 - RNA, 22 nt, Human
gggcacugugcuaggugcugag

SEQ ID NO: 575289 - RNA, 22 nt, Human
augcauaugcauggacacucag

SEQ ID NO: 575290 - RNA, 22 nt, Human
uuugaagaccuuaucucuaaau

SEQ ID NO: 575291 - RNA, 22 nt, Human
uguaaaguccaagaucaaagag

SEQ ID NO: 575292 - RNA, 22 nt, Human
acaguggauauauuaaaugaga

SEQ ID NO: 575293 - RNA, 19 nt, Human
gaaggggaagguggguacc

SEQ ID NO: 575294 - RNA, 22 nt, Human
aauuuaacugagaguacuuuua

SEQ ID NO: 575295 - RNA, 22 nt, Human
ggugggguuuuaggcugcugca

SEQ ID NO: 575296 - RNA, 22 nt, Human
augcauauaaggcacauguauu

SEQ ID NO: 575297 - RNA, 22 nt, Human
ccuggcaggcuggggacagugc

SEQ ID NO: 575298 - RNA, 22 nt, Human
aacaaacucaaauggaagagug

SEQ ID NO: 575299 - RNA, 22 nt, Human
ugccuggguugacucuuagcug

SEQ ID NO: 575300 - RNA, 22 nt, Human
cagcaggaggugaguagcaggu

SEQ ID NO: 575301 - RNA, 22 nt, Human
acuguuaacgguaugaugcucg

SEQ ID NO: 575302 - RNA, 22 nt, Human
gaagggugcauggagggaaguc

SEQ ID NO: 575303 - RNA, 22 nt, Human
ucuuaaugaaagugaaauauca

SEQ ID NO: 575304 - RNA, 22 nt, Human
agcuggugaaccugaggcacag

SEQ ID NO: 575305 - RNA, 22 nt, Human
ugggagccuggcaggccagagg

SEQ ID NO: 575306 - RNA, 22 nt, Human
accuugggcaaccugcuccugc

SEQ ID NO: 575307 - RNA, 22 nt, Human
ccaagaggcagaaugcagagaa

SEQ ID NO: 575308 - RNA, 21 nt, Human
agguggcugcauccucagaag

SEQ ID NO: 575309 - RNA, 20 nt, Human
auuagagcuacauggcuaca

SEQ ID NO: 575310 - RNA, 20 nt, Human
guucacaggcuuccuuucag

SEQ ID NO: 575311 - RNA, 19 nt, Human
cuggagauagggccuuuaa

SEQ ID NO: 575312 - RNA, 22 nt, Human
uacacagaaauuguguagggau

SEQ ID NO: 575313 - RNA, 22 nt, Human
gaacuacaguaagaauugaugu

SEQ ID NO: 575314 - RNA, 22 nt, Human
uaucaauacauguuaucagugu

SEQ ID NO: 575315 - RNA, 22 nt, Human
cuuauugugagguauugagauu

SEQ ID NO: 575316 - RNA, 22 nt, Human
cugggaggugcagcaaaaauca

SEQ ID NO: 575317 - RNA, 22 nt, Human
uuaaaguuucagaaacuugguc

SEQ ID NO: 575318 - RNA, 18 nt, Human
acuggcuuuagcaucaga

SEQ ID NO: 575319 - RNA, 23 nt, Human
aagcuuccuugacuggccccuag

SEQ ID NO: 575320 - RNA, 22 nt, Human
uguagaaagcucuucugaaauc

SEQ ID NO: 575321 - RNA, 22 nt, Human
gcaguggauccaaugguaucuu

SEQ ID NO: 575322 - RNA, 22 nt, Human
uuuuaucuucauuccuaucuac

SEQ ID NO: 575323 - RNA, 22 nt, Human
cauauaaauacaacauguguua

SEQ ID NO: 575324 - RNA, 22 nt, Human
cugucuccuccacugcauggga

SEQ ID NO: 575325 - RNA, 22 nt, Human
uccagagcugggucugugcuca

SEQ ID NO: 575326 - RNA, 22 nt, Human
aaagcacuuugagacugacagg

SEQ ID NO: 575327 - RNA, 22 nt, Human
uugaauaaaugagcagugaauu

SEQ ID NO: 575328 - RNA, 22 nt, Human
ccuguauuagguagacaacuau

SEQ ID NO: 575329 - RNA, 22 nt, Human
agagaauacaaagaagauaugu

SEQ ID NO: 575330 - RNA, 22 nt, Human
agugcagccgagaucaggugcu

SEQ ID NO: 575331 - RNA, 22 nt, Human
uccugaauuccucuuugcaucc

SEQ ID NO: 575332 - RNA, 22 nt, Human
ccaggguugguauucaccugga

SEQ ID NO: 575333 - RNA, 22 nt, Human
aucaacuuaaagaaaagauacu

SEQ ID NO: 575334 - RNA, 22 nt, Human
cuggccccaggcagccugcugg

SEQ ID NO: 575335 - RNA, 22 nt, Human
gacaauaagaaaagaggaggca

SEQ ID NO: 575336 - RNA, 22 nt, Human
cuggcucagugccuucagaagu

SEQ ID NO: 575337 - RNA, 22 nt, Human
gugcaggauguugggaaucagg

SEQ ID NO: 575338 - RNA, 22 nt, Human
cuucuccuguaagaagaucaaa

SEQ ID NO: 575339 - RNA, 22 nt, Human
ugcacugauguuuugccaagga

SEQ ID NO: 575340 - RNA, 22 nt, Human
gaaaaggauugguaaaauaucu

SEQ ID NO: 575341 - RNA, 22 nt, Human
ugacaagaaagcgucuucuuuu

SEQ ID NO: 575342 - RNA, 22 nt, Human
gauuucuugagcaaguugcuua

SEQ ID NO: 575343 - RNA, 22 nt, Human
uuuccagugagcaaauguagaa

SEQ ID NO: 575344 - RNA, 22 nt, Human
aacaucagaaguagaagacuca

SEQ ID NO: 575345 - RNA, 22 nt, Human
caaugacacucugcacagugcu

SEQ ID NO: 575346 - RNA, 22 nt, Human
aggccagaaaugucagggagug

SEQ ID NO: 575347 - RNA, 22 nt, Human
aggcucugugaugugccaggca

SEQ ID NO: 575348 - RNA, 21 nt, Human
ggccacaguuagggcucagga

SEQ ID NO: 575349 - RNA, 22 nt, Human
uuuucuccuuucaagauagcau

SEQ ID NO: 575350 - RNA, 22 nt, Human
uacaugucuacagccaugucug

SEQ ID NO: 575351 - RNA, 22 nt, Human
augcucacuucagagaagauga

SEQ ID NO: 575352 - RNA, 23 nt, Human
cucuccugaaggacaagcugccg

SEQ ID NO: 575353 - RNA, 22 nt, Human
ccucuggcuuacuguuggguuu

SEQ ID NO: 575354 - RNA, 22 nt, Human
auguguuuauaauuacucaauc

SEQ ID NO: 575355 - RNA, 22 nt, Human
ugaggcugagauaucagggagg

SEQ ID NO: 575356 - RNA, 17 nt, Human
uauacacagacagacug

SEQ ID NO: 575357 - RNA, 22 nt, Human
cuggggagaagcgacucggcug

SEQ ID NO: 575358 - RNA, 22 nt, Human
gugcccaggugucccugagaag

SEQ ID NO: 575359 - RNA, 22 nt, Human
auaucacagcucuuucauugcu

SEQ ID NO: 575360 - RNA, 22 nt, Human
uuugcugauauuuugcugauac

SEQ ID NO: 575361 - RNA, 22 nt, Human
aguuuuaaaugauggugguggu

SEQ ID NO: 575362 - RNA, 22 nt, Human
gugcagauccugauugcaguuc

SEQ ID NO: 575363 - RNA, 22 nt, Human
ugagauggcaacaccagcuuug

SEQ ID NO: 575364 - RNA, 22 nt, Human
uugcugaugguauuaugcuagu

SEQ ID NO: 575365 - RNA, 22 nt, Human
aauguguauacuggcaauuaag

SEQ ID NO: 575366 - RNA, 22 nt, Human
gucucuuuuauggugaguugau

SEQ ID NO: 575367 - RNA, 22 nt, Human
ggccagacugagugaggucaag

SEQ ID NO: 575368 - RNA, 19 nt, Human
agcuggggcgguguguguu

SEQ ID NO: 575369 - RNA, 22 nt, Human
agcugccaucagccuuuggaug

SEQ ID NO: 575370 - RNA, 22 nt, Human
uggccagauucaugcauguauc

SEQ ID NO: 575371 - RNA, 22 nt, Human
gcacccauugugugcagcucug

SEQ ID NO: 575372 - RNA, 22 nt, Human
acauguuugauaaauauuuggg

SEQ ID NO: 575373 - RNA, 22 nt, Human
ggaggagacggagugauuagug

SEQ ID NO: 575374 - RNA, 22 nt, Human
acaggaaaugaaaugguaucua

SEQ ID NO: 575375 - RNA, 22 nt, Human
auuagcuuccuauaguaagggg

SEQ ID NO: 575376 - RNA, 22 nt, Human
ucauagaugugcugugcacaaa

SEQ ID NO: 575377 - RNA, 22 nt, Human
uccuggaguuuguggugauaug

SEQ ID NO: 575378 - RNA, 22 nt, Human
gccacagcccgagcaccaugag

SEQ ID NO: 575379 - RNA, 22 nt, Human
cuucagugauauaggcuucucc

SEQ ID NO: 575380 - RNA, 22 nt, Human
gagcuggucaguuucaggagag

SEQ ID NO: 575381 - RNA, 23 nt, Human
ucugccagugugugccaggagcc

SEQ ID NO: 575382 - RNA, 22 nt, Human
ggacagagcagacgagcagcgg

SEQ ID NO: 575383 - RNA, 22 nt, Human
ccaggugcaaacucccagcagg

SEQ ID NO: 575384 - RNA, 22 nt, Human
cagcacaguagaguaguuguaa

SEQ ID NO: 575385 - RNA, 22 nt, Human
auccaggguguggagagagcuc

SEQ ID NO: 575386 - RNA, 22 nt, Human
acaaaacaguguuccugccccu

SEQ ID NO: 575387 - RNA, 22 nt, Human
ggcaugaguaacgugagugagg

SEQ ID NO: 575388 - RNA, 22 nt, Human
cucaacagacucugccaucccu

SEQ ID NO: 575389 - RNA, 21 nt, Human
ugucagaaauaagcaugugau

SEQ ID NO: 575390 - RNA, 22 nt, Human
cugaaacauugcaauaacaaag

SEQ ID NO: 575391 - RNA, 22 nt, Human
ucugagccguauggcuuggcua

SEQ ID NO: 575392 - RNA, 22 nt, Human
ccaggagaugggagcaucuaaa

SEQ ID NO: 575393 - RNA, 22 nt, Human
uaggauuuaggcuuuaacaucu

SEQ ID NO: 575394 - RNA, 22 nt, Human
uccuugaagcaacgugcagaca

SEQ ID NO: 575395 - RNA, 22 nt, Human
aauuaggaaauucagccauuuu

SEQ ID NO: 575396 - RNA, 22 nt, Human
uuguguguguaacuuuaugaga

SEQ ID NO: 575397 - RNA, 22 nt, Human
aggggucuugggaguccuggcu

SEQ ID NO: 575398 - RNA, 22 nt, Human
ugccaggcccugugcuggaugc

SEQ ID NO: 575399 - RNA, 22 nt, Human
ccagcccugccagagagagcug

SEQ ID NO: 575400 - RNA, 22 nt, Human
auggauaaugucucuguuuccc

SEQ ID NO: 575401 - RNA, 22 nt, Human
ucacaaacaaugcuuuggaauu

SEQ ID NO: 575402 - RNA, 22 nt, Human
guggcugggcuccgagcggcuu

SEQ ID NO: 575403 - RNA, 22 nt, Human
ucuccuggguaaaaggguugau

SEQ ID NO: 575404 - RNA, 22 nt, Human
caguggcaaugggacagagcac

SEQ ID NO: 575405 - RNA, 22 nt, Human
ggugguggucccgacuugggag

SEQ ID NO: 575406 - RNA, 17 nt, Human
ucagcaggggccaagcu

SEQ ID NO: 575407 - RNA, 22 nt, Human
aaugggauuaagaaagaucuug

SEQ ID NO: 575408 - RNA, 22 nt, Human
aggcacugaauauccaguaaaa

SEQ ID NO: 575409 - RNA, 22 nt, Human
guucaaaauucaaaugguauac

SEQ ID NO: 575410 - RNA, 22 nt, Human
acacacuggcaggagcuauaaa

SEQ ID NO: 575411 - RNA, 17 nt, Human
cucugcagugcauggcu

SEQ ID NO: 575412 - RNA, 22 nt, Human
uuacaaagcaggucagcugaaa

SEQ ID NO: 575413 - RNA, 22 nt, Human
uugcuuuauucacaucuauauu

SEQ ID NO: 575414 - RNA, 22 nt, Human
aggcugaggcagguggaucauu

SEQ ID NO: 575415 - RNA, 19 nt, Human
ugagcaugcgagcugagaa

SEQ ID NO: 575416 - RNA, 22 nt, Human
ugaaacauuauagaauauuuau

SEQ ID NO: 575417 - RNA, 22 nt, Human
uggcaggagguuuucuccagga

SEQ ID NO: 575418 - RNA, 22 nt, Human
uaaugaacaauauaucaauagc

SEQ ID NO: 575419 - RNA, 22 nt, Human
aagacacugauacucugugauu

SEQ ID NO: 575420 - RNA, 21 nt, Human
cccaggugggaugguugccuc

SEQ ID NO: 575421 - RNA, 22 nt, Human
gcccagcagaucucagugucuc

SEQ ID NO: 575422 - RNA, 22 nt, Human
guggcaugacagugaaugggca

SEQ ID NO: 575423 - RNA, 22 nt, Human
gcuucgggguccaagcgcgugu

SEQ ID NO: 575424 - RNA, 22 nt, Human
augcaguuagcacuacagaaga

SEQ ID NO: 575425 - RNA, 22 nt, Human
uccccaggagcaaugauucagu

SEQ ID NO: 575426 - RNA, 22 nt, Human
agcugguaugaacaggauagga

SEQ ID NO: 575427 - RNA, 22 nt, Human
uuugaagggcacgacaauaguu

SEQ ID NO: 575428 - RNA, 22 nt, Human
gaacauuuaugaugcaauaccu

SEQ ID NO: 575429 - RNA, 22 nt, Human
ugcuccagggcugccagacccu

SEQ ID NO: 575430 - RNA, 22 nt, Human
gaaguggaagccaucggcaguc

SEQ ID NO: 575431 - RNA, 22 nt, Human
uauguuuuaggaauuaauuguu

SEQ ID NO: 575432 - RNA, 22 nt, Human
agcaaugcuuauugcugacuau

SEQ ID NO: 575433 - RNA, 22 nt, Human
aucaucuucgaaaaaagucaga

SEQ ID NO: 575434 - RNA, 22 nt, Human
ggccaagguguucugauaugcc

SEQ ID NO: 575435 - RNA, 22 nt, Human
ucccugcacagccgagccaugc

SEQ ID NO: 575436 - RNA, 22 nt, Human
uccugaaaauaauuucacaaga

SEQ ID NO: 575437 - RNA, 22 nt, Human
gugaggcagcaggagccucugu

SEQ ID NO: 575438 - RNA, 22 nt, Human
auuucaguagaaaaucuugauu

SEQ ID NO: 575439 - RNA, 23 nt, Human
acagggcuggcagcugcaagacc

SEQ ID NO: 575440 - RNA, 19 nt, Human
uuucucugugcaccuuuuc

SEQ ID NO: 575441 - RNA, 22 nt, Human
caggauugaaugcuucucccug

SEQ ID NO: 575442 - RNA, 22 nt, Human
caugcaagacaaucuuuaaaau

SEQ ID NO: 575443 - RNA, 22 nt, Human
aaaugucuacuucccaucugua

SEQ ID NO: 575444 - RNA, 22 nt, Human
gcucagagauggggaaugaaaa

SEQ ID NO: 575445 - RNA, 22 nt, Human
agcugggucuugggccaggaga

SEQ ID NO: 575446 - RNA, 22 nt, Human
ucuggccauggcaagccgagug

SEQ ID NO: 575447 - RNA, 20 nt, Human
aagcauggucaaaacuuaug

SEQ ID NO: 575448 - RNA, 21 nt, Human
cagcaaaucauugggcagacu

SEQ ID NO: 575449 - RNA, 22 nt, Human
uggcugcagaucaagggcaggc

SEQ ID NO: 575450 - RNA, 22 nt, Human
gacaccagcaaggcugugagga

SEQ ID NO: 575451 - RNA, 22 nt, Human
guucuccuggcucccacccugc

SEQ ID NO: 575452 - RNA, 22 nt, Human
acaguguaauaugggagucagu

SEQ ID NO: 575453 - RNA, 22 nt, Human
ucugagccaccugagcccaugg

SEQ ID NO: 575454 - RNA, 22 nt, Human
ucaguaaaggggaggugauggg

SEQ ID NO: 575455 - RNA, 22 nt, Human
uacaugcuccuuaugagaaucu

SEQ ID NO: 575456 - RNA, 22 nt, Human
ucaagagaagugcuccacagua

SEQ ID NO: 575457 - RNA, 22 nt, Human
caccagcugcaacaccaucucc

SEQ ID NO: 575458 - RNA, 22 nt, Human
accuucagacaucaacuaucuc

SEQ ID NO: 575459 - RNA, 22 nt, Human
uuauggaauuugcaaaagguua

SEQ ID NO: 575460 - RNA, 21 nt, Human
gcucuggccuacuguucccuc

SEQ ID NO: 575461 - RNA, 22 nt, Human
cauucaaaugugccacuguccu

SEQ ID NO: 575462 - RNA, 22 nt, Human
gcuuuaaugaagucacgcaaag

SEQ ID NO: 575463 - RNA, 20 nt, Human
cccucccagaugcuucccaa

SEQ ID NO: 575464 - RNA, 22 nt, Human
uuaucaucuccugcugugguua

SEQ ID NO: 575465 - RNA, 22 nt, Human
cuccagugcgcaggacagcccc

SEQ ID NO: 575466 - RNA, 20 nt, Human
aggcucugccugcaggccca

SEQ ID NO: 575467 - RNA, 22 nt, Human
gugcaugugucuuuauaguagc

SEQ ID NO: 575468 - RNA, 22 nt, Human
accuccccucaccaaucugguu

SEQ ID NO: 575469 - RNA, 22 nt, Human
agagucugaggcagcugcagcc

SEQ ID NO: 575470 - RNA, 22 nt, Human
uucacaauagcuggcaucaucu

SEQ ID NO: 575471 - RNA, 22 nt, Human
caauacaauuaccaguuaauca

SEQ ID NO: 575472 - RNA, 17 nt, Human
aguguuuccuuaucauu

SEQ ID NO: 575473 - RNA, 22 nt, Human
gauuauggagaaauaauuagaa

SEQ ID NO: 575474 - RNA, 22 nt, Human
gaaggaggcuccccaaagucug

SEQ ID NO: 575475 - RNA, 22 nt, Human
uggggccuuggccucauuagau

SEQ ID NO: 575476 - RNA, 22 nt, Human
cuccugaguaguagcauuguca

SEQ ID NO: 575477 - RNA, 22 nt, Human
aggaguaucuaauaaucugaga

SEQ ID NO: 575478 - RNA, 22 nt, Human
cuccagagguccccgcggcacu

SEQ ID NO: 575479 - RNA, 22 nt, Human
cugcagaggguuugagcauccu

SEQ ID NO: 575480 - RNA, 23 nt, Human
uguguucucacacagaugcagua

SEQ ID NO: 575481 - RNA, 22 nt, Human
gaggguggggaauagacugcua

SEQ ID NO: 575482 - RNA, 22 nt, Human
cauguacauucuguagauggag

SEQ ID NO: 575483 - RNA, 22 nt, Human
gguguugggagagcugguuuug

SEQ ID NO: 575484 - RNA, 22 nt, Human
cuggaggcacccuuagagaggc

SEQ ID NO: 575485 - RNA, 22 nt, Human
uacauguuugguaaaugauggc

SEQ ID NO: 575486 - RNA, 22 nt, Human
uaacagcucuguguggcuguaa

SEQ ID NO: 575487 - RNA, 22 nt, Human
aaaaguguucaggaagaauaau

SEQ ID NO: 575488 - RNA, 22 nt, Human
uggcuuccuaaacugauuucca

SEQ ID NO: 575489 - RNA, 22 nt, Human
gcaggcaguuauuuaguagaau

SEQ ID NO: 575490 - RNA, 22 nt, Human
ugaggccaggaucccaggcucu

SEQ ID NO: 575491 - RNA, 22 nt, Human
acagagcuuaggaugacuccca

SEQ ID NO: 575492 - RNA, 22 nt, Human
ugaagcaggcauugacugauga

SEQ ID NO: 575493 - RNA, 22 nt, Human
ugucauuuucuaaucuguuguc

SEQ ID NO: 575494 - RNA, 22 nt, Human
acauucaaggccuucugacaca

SEQ ID NO: 575495 - RNA, 22 nt, Human
ucacccagacuugugaaugugu

SEQ ID NO: 575496 - RNA, 20 nt, Human
aauuauauaacuccaacauu

SEQ ID NO: 575497 - RNA, 22 nt, Human
gucuccugccacacucaguccc

SEQ ID NO: 575498 - RNA, 22 nt, Human
acaaugaugcagaugaguaaga

SEQ ID NO: 575499 - RNA, 22 nt, Human
ggcugugaaguagcaggggcag

SEQ ID NO: 575500 - RNA, 22 nt, Human
uggcuucuauugcuguggcauu

SEQ ID NO: 575501 - RNA, 21 nt, Human
cugcuuuacuucagaggaucu

SEQ ID NO: 575502 - RNA, 22 nt, Human
ggagggcugccagguggagcgg

SEQ ID NO: 575503 - RNA, 22 nt, Human
aagcuguucucuaaguuucaug

SEQ ID NO: 575504 - RNA, 22 nt, Human
uuucagaauaucgauucaguga

SEQ ID NO: 575505 - RNA, 23 nt, Human
acagugucugcugcaagauaucu

SEQ ID NO: 575506 - RNA, 18 nt, Human
aagggcuggccuuuggag

SEQ ID NO: 575507 - RNA, 22 nt, Human
guugagcaaggccagagaagcc

SEQ ID NO: 575508 - RNA, 22 nt, Human
agcacaggacguagagcuugga

SEQ ID NO: 575509 - RNA, 20 nt, Human
cagcagaaauggggugggaa

SEQ ID NO: 575510 - RNA, 22 nt, Human
acagggcagagugaaaugcuau

SEQ ID NO: 575511 - RNA, 22 nt, Human
cuggucaggaagguggggacag

SEQ ID NO: 575512 - RNA, 22 nt, Human
uugauuuuaaaauagugacacu

SEQ ID NO: 575513 - RNA, 18 nt, Human
auggaggcagagagcuga

SEQ ID NO: 575514 - RNA, 22 nt, Human
auuauggacguuaauuuuggaa

SEQ ID NO: 575515 - RNA, 22 nt, Human
uuauuuucagcuaggaaagcca

SEQ ID NO: 575516 - RNA, 21 nt, Human
uccuucaguucugcacuuucu

SEQ ID NO: 575517 - RNA, 22 nt, Human
gugggcagaggagagaacauua

SEQ ID NO: 575518 - RNA, 22 nt, Human
uucuuacaucaguuuauuuugu

SEQ ID NO: 575519 - RNA, 22 nt, Human
gacuccagguguccaggccucc

SEQ ID NO: 575520 - RNA, 22 nt, Human
cugaggcagagggcagaccaga

SEQ ID NO: 575521 - RNA, 22 nt, Human
uggggcuggcuauugucucccu

SEQ ID NO: 575522 - RNA, 22 nt, Human
aguaaaugaaagcaauuuuaga

SEQ ID NO: 575523 - RNA, 22 nt, Human
uuuuacuuuggauacaguacuu

SEQ ID NO: 575524 - RNA, 22 nt, Human
cccucucucaggcugacagccu

SEQ ID NO: 575525 - RNA, 22 nt, Human
ugugccuuuaaggggagcugag

SEQ ID NO: 575526 - RNA, 22 nt, Human
cugccaggacugacgucuucag

SEQ ID NO: 575527 - RNA, 21 nt, Human
aaaauguagacuuuucccuga

SEQ ID NO: 575528 - RNA, 22 nt, Human
agugaguugaacauugauaaug

SEQ ID NO: 575529 - RNA, 22 nt, Human
augaaaugugaaugcuuuucau

SEQ ID NO: 575530 - RNA, 22 nt, Human
gcuuccaccuacuaaaugccac

SEQ ID NO: 575531 - RNA, 22 nt, Human
caugcuaauucccaggccccaa

SEQ ID NO: 575532 - RNA, 22 nt, Human
cuuacauacugagaaaauaucc

SEQ ID NO: 575533 - RNA, 22 nt, Human
aaacaugagcauuucuguuuaa

SEQ ID NO: 575534 - RNA, 22 nt, Human
gagcagggagacaacucuggug

SEQ ID NO: 575535 - RNA, 22 nt, Human
ccacagugguuguggcaugugg

SEQ ID NO: 575536 - RNA, 19 nt, Human
caguaucauugcacauagu

SEQ ID NO: 575537 - RNA, 22 nt, Human
ucauuaauuugcuuagacuuau

SEQ ID NO: 575538 - RNA, 22 nt, Human
ccucucuguguggccucuccau

SEQ ID NO: 575539 - RNA, 22 nt, Human
uaguggaggccuguugugugca

SEQ ID NO: 575540 - RNA, 22 nt, Human
auuagcugaccucuaaggagcc

SEQ ID NO: 575541 - RNA, 22 nt, Human
agcucaggccggagcuacaggc

SEQ ID NO: 575542 - RNA, 22 nt, Human
gggagguucuguucgcacuuga

SEQ ID NO: 575543 - RNA, 22 nt, Human
aaaugacuaaugauccugggca

SEQ ID NO: 575544 - RNA, 22 nt, Human
gacagcagcauguuuacaggcc

SEQ ID NO: 575545 - RNA, 22 nt, Human
ugcuggcuggccuggccuggac

SEQ ID NO: 575546 - RNA, 22 nt, Human
ugggaagguacacgggaaagag

SEQ ID NO: 575547 - RNA, 19 nt, Human
cuggugcuugagugaguca

SEQ ID NO: 575548 - RNA, 22 nt, Human
uagguagcuuuggcguuucuug

SEQ ID NO: 575549 - RNA, 22 nt, Human
cucugggccaccgcugguguau

SEQ ID NO: 575550 - RNA, 22 nt, Human
uccuuagguauuuagcaugaau

SEQ ID NO: 575551 - RNA, 19 nt, Human
uccuggggauguggucacc

SEQ ID NO: 575552 - RNA, 22 nt, Human
cagaaguuugaaugagagccug

SEQ ID NO: 575553 - RNA, 22 nt, Human
auacaaugagugagugaauggg

SEQ ID NO: 575554 - RNA, 22 nt, Human
aauauugagaaccagcauguuu

SEQ ID NO: 575555 - RNA, 22 nt, Human
ucaguucuaacaguuuagaaca

SEQ ID NO: 575556 - RNA, 22 nt, Human
auuugcuuugggacagcuuaaa

SEQ ID NO: 575557 - RNA, 20 nt, Human
ugccagggccagcagaggcu

SEQ ID NO: 575558 - RNA, 22 nt, Human
cuauuacaauucugcaaggagu

SEQ ID NO: 575559 - RNA, 22 nt, Human
cuugccagcacuuggccagcug

SEQ ID NO: 575560 - RNA, 22 nt, Human
cuuaacauccugcauuuuucuu

SEQ ID NO: 575561 - RNA, 22 nt, Human
aguggguaggccucuggugccu

SEQ ID NO: 575562 - RNA, 19 nt, Human
cuuauuagagugagagcuu

SEQ ID NO: 575563 - RNA, 19 nt, Human
cucugccucccuccugggu

SEQ ID NO: 575564 - RNA, 22 nt, Human
ccaggguuauaaaugcaucugu

SEQ ID NO: 575565 - RNA, 22 nt, Human
ggcugaggcggcgaugcccuug

SEQ ID NO: 575566 - RNA, 22 nt, Human
uuccaguucuucuguaagcacu

SEQ ID NO: 575567 - RNA, 22 nt, Human
ccagcccucgguagucccauag

SEQ ID NO: 575568 - RNA, 22 nt, Human
uaugcuaacugggggaaaagag

SEQ ID NO: 575569 - RNA, 22 nt, Human
uuaaauagucaaaucaguggca

SEQ ID NO: 575570 - RNA, 22 nt, Human
acagugcucaugugacauggug

SEQ ID NO: 575571 - RNA, 22 nt, Human
agguacugaaaaaauguuugca

SEQ ID NO: 575572 - RNA, 22 nt, Human
guggccugucagaagccguggg

SEQ ID NO: 575573 - RNA, 22 nt, Human
ugagcccagucugucugacaug

SEQ ID NO: 575574 - RNA, 22 nt, Human
augacaaaggcugaaagggaaa

SEQ ID NO: 575575 - RNA, 22 nt, Human
cugccucuugacagaucguggc

SEQ ID NO: 575576 - RNA, 21 nt, Human
acacaggaguuucuucuuucu

SEQ ID NO: 575577 - RNA, 22 nt, Human
caguauaugcucuuucaucaaa

SEQ ID NO: 575578 - RNA, 22 nt, Human
ucugagguggggcuggagcauu

SEQ ID NO: 575579 - RNA, 22 nt, Human
cggcagugggcgccaggucucc

SEQ ID NO: 575580 - RNA, 22 nt, Human
guuacaaacucaggugccaaaa

SEQ ID NO: 575581 - RNA, 22 nt, Human
aggagcuguuuuguucagcaaa

SEQ ID NO: 575582 - RNA, 22 nt, Human
uggagaaaagguugaauccauc

SEQ ID NO: 575583 - RNA, 22 nt, Human
gaaaauaggcugcaucuccuuc

SEQ ID NO: 575584 - RNA, 22 nt, Human
ugaaaugcuugggaccagaagu

SEQ ID NO: 575585 - RNA, 22 nt, Human
auacuguagaggcauagcuagu

SEQ ID NO: 575586 - RNA, 22 nt, Human
uagccauuuuuauuaaugcugg

SEQ ID NO: 575587 - RNA, 22 nt, Human
uacauuauuucaucagucaucu

SEQ ID NO: 575588 - RNA, 22 nt, Human
aaguggcccuaggccaagggga

SEQ ID NO: 575589 - RNA, 19 nt, Human
ugauucaucuaacugccuc

SEQ ID NO: 575590 - RNA, 22 nt, Human
gccagccagagaggcaugguua

SEQ ID NO: 575591 - RNA, 22 nt, Human
uuccugggcucuggcuggccua

SEQ ID NO: 575592 - RNA, 20 nt, Human
agggugagacaugagccucc

SEQ ID NO: 575593 - RNA, 22 nt, Human
uugaaauaucaaguuauuagug

SEQ ID NO: 575594 - RNA, 22 nt, Human
uuccuuuugcaagguccucuag

SEQ ID NO: 575595 - RNA, 22 nt, Human
ggcuggccucaggguccucgcu

SEQ ID NO: 575596 - RNA, 22 nt, Human
ucagcucugcaaggucaccucc

SEQ ID NO: 575597 - RNA, 22 nt, Human
cagucucuggcagcugcuggcc

SEQ ID NO: 575598 - RNA, 22 nt, Human
uggcugccaugacgccugggga

SEQ ID NO: 575599 - RNA, 22 nt, Human
gccaggcagauaugugagcuua

SEQ ID NO: 575600 - RNA, 22 nt, Human
uucucuaggaguucugggauca

SEQ ID NO: 575601 - RNA, 22 nt, Human
ggcagguggaaggucuccauuc

SEQ ID NO: 575602 - RNA, 22 nt, Human
gcgcucaggugccaggccugcg

SEQ ID NO: 575603 - RNA, 22 nt, Human
ggcagggugccuggcuccuguu

SEQ ID NO: 575604 - RNA, 22 nt, Human
auggcagaauuaggauuucaag

SEQ ID NO: 575605 - RNA, 22 nt, Human
cucuuuagucacagggcuucau

SEQ ID NO: 575606 - RNA, 22 nt, Human
ccagggccugccacuuagcaag

SEQ ID NO: 575607 - RNA, 22 nt, Human
gggcccuucagcuuccucugca

SEQ ID NO: 575608 - RNA, 22 nt, Human
uggccugguuauauugcuauca

SEQ ID NO: 575609 - RNA, 22 nt, Human
aucauuuaugccccaauuagau

SEQ ID NO: 575610 - RNA, 22 nt, Human
aaccugagcgcguugcuuucua

SEQ ID NO: 575611 - RNA, 22 nt, Human
uggcaugaagucagcagcuggg

SEQ ID NO: 575612 - RNA, 22 nt, Human
cugcuuccauggucuggagacu

SEQ ID NO: 575613 - RNA, 22 nt, Human
cagugcaauuacaagcuaauuc

SEQ ID NO: 575614 - RNA, 22 nt, Human
ugugugauugcaggagaugugg

SEQ ID NO: 575615 - RNA, 22 nt, Human
agcaagauuuuccuugaauguu

SEQ ID NO: 575616 - RNA, 22 nt, Human
uccagccaugcaugacaaucac

SEQ ID NO: 575617 - RNA, 22 nt, Human
caucagagucagagcucuuucu

SEQ ID NO: 575618 - RNA, 22 nt, Human
aaaugcugggaaccauuggauc

SEQ ID NO: 575619 - RNA, 22 nt, Human
agaggccagcacugcagggaag

SEQ ID NO: 575620 - RNA, 22 nt, Human
uuccuccagccuggagcacuuc

SEQ ID NO: 575621 - RNA, 22 nt, Human
auaacucuguuuuuuucaugca

SEQ ID NO: 575622 - RNA, 22 nt, Human
cucuggagggaggcugagcugg

SEQ ID NO: 575623 - RNA, 22 nt, Human
uccugagauguggagcuccaug

SEQ ID NO: 575624 - RNA, 22 nt, Human
ucacccagauuacauccuguca

SEQ ID NO: 575625 - RNA, 22 nt, Human
aaaguugcagguggugagaggu

SEQ ID NO: 575626 - RNA, 22 nt, Human
ggcacagcccucucuguggaca

SEQ ID NO: 575627 - RNA, 22 nt, Human
cagggaugugaugagcugagcc

SEQ ID NO: 575628 - RNA, 22 nt, Human
gaaauauacauugcaggaagag

SEQ ID NO: 575629 - RNA, 23 nt, Human
cagcaggagggugccugggcugc

SEQ ID NO: 575630 - RNA, 22 nt, Human
aaaugugauacuguucuuuuua

SEQ ID NO: 575631 - RNA, 22 nt, Human
ccagcucuggcuucuugcuggg

SEQ ID NO: 575632 - RNA, 19 nt, Human
acugccugcagguguuggg

SEQ ID NO: 575633 - RNA, 22 nt, Human
ucucugcugagaagggcuggca

SEQ ID NO: 575634 - RNA, 22 nt, Human
gugccuccuuaaauucugcacc

SEQ ID NO: 575635 - RNA, 22 nt, Human
ugggacaguuguccuccacucu

SEQ ID NO: 575636 - RNA, 22 nt, Human
ucccagagcucugacaccagcu

SEQ ID NO: 575637 - RNA, 21 nt, Human
auggcucaggccaucaaugga

SEQ ID NO: 575638 - RNA, 22 nt, Human
agacuaaauugggauguguugu

SEQ ID NO: 575639 - RNA, 22 nt, Human
gaaaggaaauauucuaagcacu

SEQ ID NO: 575640 - RNA, 22 nt, Human
auauuuguaguggguaagaagu

SEQ ID NO: 575641 - RNA, 22 nt, Human
uuggaaggggcagaguggcugc

SEQ ID NO: 575642 - RNA, 22 nt, Human
ggccaagguggagaaggcacug

SEQ ID NO: 575643 - RNA, 22 nt, Human
ugucuuuuauaacugacauaua

SEQ ID NO: 575644 - RNA, 22 nt, Human
uccuuucuccagcuggcauugu

SEQ ID NO: 575645 - RNA, 22 nt, Human
gaaugcuuggaaccugaaguuc

SEQ ID NO: 575646 - RNA, 22 nt, Human
gaggccagaaugagcugaaugc

SEQ ID NO: 575647 - RNA, 22 nt, Human
uccaggaguccugggagugauu

SEQ ID NO: 575648 - RNA, 22 nt, Human
uaucagaaugcagccaugugca

SEQ ID NO: 575649 - RNA, 22 nt, Human
ggcccuuggagccuccacagug

SEQ ID NO: 575650 - RNA, 22 nt, Human
ucugcauuauuggaaaguccuu

SEQ ID NO: 575651 - RNA, 17 nt, Human
uauugaccuuuguaugu

SEQ ID NO: 575652 - RNA, 22 nt, Human
aacaaugcugaacugaggaaag

SEQ ID NO: 575653 - RNA, 22 nt, Human
agaggcuggauugagcauagac

SEQ ID NO: 575654 - RNA, 22 nt, Human
uugacugugaugggcucagcug

SEQ ID NO: 575655 - RNA, 22 nt, Human
cccacaggcaggugcaugggcu

SEQ ID NO: 575656 - RNA, 22 nt, Human
cuuagcuucauuauugguggcc

SEQ ID NO: 575657 - RNA, 22 nt, Human
cucagggaggcccugggacccu

SEQ ID NO: 575658 - RNA, 22 nt, Human
aucuucaaagcacaucguuugu

SEQ ID NO: 575659 - RNA, 20 nt, Human
ugucagugccugaggcacag

SEQ ID NO: 575660 - RNA, 20 nt, Human
agcuggccuguccuaggccu

SEQ ID NO: 575661 - RNA, 22 nt, Human
cagguucugaggauggugccug

SEQ ID NO: 575662 - RNA, 22 nt, Human
cugccugugauuuuucucuagu

SEQ ID NO: 575663 - RNA, 22 nt, Human
gucuuuuuuacaccuuacauca

SEQ ID NO: 575664 - RNA, 18 nt, Human
ggcaggagcaagaauagg

SEQ ID NO: 575665 - RNA, 22 nt, Human
cugaggcaugaaugugggcuuu

SEQ ID NO: 575666 - RNA, 22 nt, Human
auaauccauuaauuaaugacca

SEQ ID NO: 575667 - RNA, 22 nt, Human
ugguggcuguaagggagagaag

SEQ ID NO: 575668 - RNA, 22 nt, Human
aggguaggguaaaugaugcauc

SEQ ID NO: 575669 - RNA, 22 nt, Human
gaucuuggaauggcacagcuga

SEQ ID NO: 575670 - RNA, 22 nt, Human
ugcacuggggucccagcgcacg

SEQ ID NO: 575671 - RNA, 22 nt, Human
ucuaaagagaguggguacaugu

SEQ ID NO: 575672 - RNA, 22 nt, Human
agauuuauguggucacacucag

SEQ ID NO: 575673 - RNA, 22 nt, Human
uagcugucaccagaaauggcca

SEQ ID NO: 575674 - RNA, 22 nt, Human
acugggaggcaucuggagcuga

SEQ ID NO: 575675 - RNA, 20 nt, Human
agugcaagaaagcacagcug

SEQ ID NO: 575676 - RNA, 22 nt, Human
aaugguaauuugcagaaagucc

SEQ ID NO: 575677 - RNA, 22 nt, Human
agggaagggcagggucuaugca

SEQ ID NO: 575678 - RNA, 22 nt, Human
augagugugaaguuagcucagu

SEQ ID NO: 575679 - RNA, 22 nt, Human
cccuggaggcggagcuugcagu

SEQ ID NO: 575680 - RNA, 22 nt, Human
uuaaauuauugagggauuguca

SEQ ID NO: 575681 - RNA, 22 nt, Human
uccagcucugcuucacagucuc

SEQ ID NO: 575682 - RNA, 22 nt, Human
ccucaggugugggccagcuguc

SEQ ID NO: 575683 - RNA, 22 nt, Human
uaccaaguguauuaugcuuugu

SEQ ID NO: 575684 - RNA, 20 nt, Human
uguaaauaggcauuguaguu

SEQ ID NO: 575685 - RNA, 22 nt, Human
uuuugugacagaaagauuaagu

SEQ ID NO: 575686 - RNA, 22 nt, Human
agccucugggggagcugggagc

SEQ ID NO: 575687 - RNA, 22 nt, Human
ugggccagauccauggcaauaa

SEQ ID NO: 575688 - RNA, 22 nt, Human
auucuuacaaagcagagucugu

SEQ ID NO: 575689 - RNA, 22 nt, Human
uaaugcuuugucagccuaaggg

SEQ ID NO: 575690 - RNA, 22 nt, Human
gagugcagaugaacagaagauu

SEQ ID NO: 575691 - RNA, 22 nt, Human
ccaggcucugagaggaauguga

SEQ ID NO: 575692 - RNA, 22 nt, Human
uccagcuuuuauuggaugagga

SEQ ID NO: 575693 - RNA, 22 nt, Human
auuagugcccaggcugccucuu

SEQ ID NO: 575694 - RNA, 20 nt, Human
acaguguuaguuaucaucuc

SEQ ID NO: 575695 - RNA, 21 nt, Human
uuuauguacuucauagaguag

SEQ ID NO: 575696 - RNA, 22 nt, Human
aauggacaaacuugggaaguau

SEQ ID NO: 575697 - RNA, 22 nt, Human
aguauacauagagauggcuguu

SEQ ID NO: 575698 - RNA, 22 nt, Human
ggugcagugguguggcaaaggg

SEQ ID NO: 575699 - RNA, 22 nt, Human
caggcuugggagcagagccacu

SEQ ID NO: 575700 - RNA, 22 nt, Human
cagcccagccgagggccuggcu

SEQ ID NO: 575701 - RNA, 22 nt, Human
cuggcccagucucagaguguca

SEQ ID NO: 575702 - RNA, 22 nt, Human
aguauaaagugguuuucagcac

SEQ ID NO: 575703 - RNA, 21 nt, Human
gcuguugcccgccgccucuuc

SEQ ID NO: 575704 - RNA, 22 nt, Human
gaggcuggaggucaaagaugaa

SEQ ID NO: 575705 - RNA, 22 nt, Human
aucuuucuaugguacuuucucc

SEQ ID NO: 575706 - RNA, 22 nt, Human
gcucccagguucuugggccuug

SEQ ID NO: 575707 - RNA, 20 nt, Human
cuguuccugucccaugaagc

SEQ ID NO: 575708 - RNA, 19 nt, Human
uuucuguuagaaggauaca

SEQ ID NO: 575709 - RNA, 22 nt, Human
gaugauuucuccauucccuucu

SEQ ID NO: 575710 - RNA, 22 nt, Human
acauacauguaaaggaaauuau

SEQ ID NO: 575711 - RNA, 22 nt, Human
cugcucuucacacuacacccgu

SEQ ID NO: 575712 - RNA, 23 nt, Human
cccaggcuacaaauuaugcucug

SEQ ID NO: 575713 - RNA, 22 nt, Human
ugucccagacacaguaugcgcu

SEQ ID NO: 575714 - RNA, 22 nt, Human
ucaggcagcauuaaacuucagc

SEQ ID NO: 575715 - RNA, 22 nt, Human
gcaaacaugugcucauuuugug

SEQ ID NO: 575716 - RNA, 22 nt, Human
gagucagauugcagacagggcu

SEQ ID NO: 575717 - RNA, 22 nt, Human
gcaauaaacauguuugaugcgc

SEQ ID NO: 575718 - RNA, 17 nt, Human
agaggcagauacuugga

SEQ ID NO: 575719 - RNA, 18 nt, Human
aagauucugcuucucucu

SEQ ID NO: 575720 - RNA, 22 nt, Human
ugggcaggggcccugcuuccgu

SEQ ID NO: 575721 - RNA, 22 nt, Human
agcugugugugcuugggauuau

SEQ ID NO: 575722 - RNA, 22 nt, Human
cuucagcagccucuugcauaaa

SEQ ID NO: 575723 - RNA, 22 nt, Human
aggagguggcugaacuugaggg

SEQ ID NO: 575724 - RNA, 22 nt, Human
agcccaagcuaugaggugaccu

SEQ ID NO: 575725 - RNA, 22 nt, Human
ggcuggagaagggugguugaca

SEQ ID NO: 575726 - RNA, 22 nt, Human
cugugccuaagaugcaugucuc

SEQ ID NO: 575727 - RNA, 22 nt, Human
ugcuccagcaugacccucaaug

SEQ ID NO: 575728 - RNA, 22 nt, Human
ucugaaauguucucuuguuuug

SEQ ID NO: 575729 - RNA, 22 nt, Human
aauagcauguuaauaaccagag

SEQ ID NO: 575730 - RNA, 22 nt, Human
gggacgacaggcucugugguag

SEQ ID NO: 575731 - RNA, 17 nt, Human
aggcuggcucacaggga

SEQ ID NO: 575732 - RNA, 22 nt, Human
ggacaagccucagacaaaacuc

SEQ ID NO: 575733 - RNA, 22 nt, Human
cuguauguuucuaugaauguga

SEQ ID NO: 575734 - RNA, 22 nt, Human
augauacauuuaccuauggucu

SEQ ID NO: 575735 - RNA, 22 nt, Human
cucagccccaauuugcccucuu

SEQ ID NO: 575736 - RNA, 22 nt, Human
gcagacuguaucaaugucagua

SEQ ID NO: 575737 - RNA, 22 nt, Human
ucugggcuuggguagaaaucac

SEQ ID NO: 575738 - RNA, 22 nt, Human
ggccagaggaccucucauagcc

SEQ ID NO: 575739 - RNA, 22 nt, Human
acuauacaccaaaauauuaagg

SEQ ID NO: 575740 - RNA, 22 nt, Human
ucccagggugaaaugcaguagg

SEQ ID NO: 575741 - RNA, 22 nt, Human
uuucacagcauauagguguacu

SEQ ID NO: 575742 - RNA, 23 nt, Human
ccucccaccuauuucacuuucuu

SEQ ID NO: 575743 - RNA, 22 nt, Human
aacuggcauaugaacuuguucu

SEQ ID NO: 575744 - RNA, 18 nt, Human
uguuaaaugaagauuugc

SEQ ID NO: 575745 - RNA, 22 nt, Human
ugucugaaacuuaugauauacu

SEQ ID NO: 575746 - RNA, 22 nt, Human
cuuauuguucagauagagauga

SEQ ID NO: 575747 - RNA, 22 nt, Human
agcaugcugggucauuuuugcc

SEQ ID NO: 575748 - RNA, 22 nt, Human
acuuuaaagcagaauggcuaug

SEQ ID NO: 575749 - RNA, 22 nt, Human
ccugggcucgcgcacuucaccc

SEQ ID NO: 575750 - RNA, 22 nt, Human
cucuugguaagacauuagaggu

SEQ ID NO: 575751 - RNA, 22 nt, Human
uuauugacugaaaugagaguga

SEQ ID NO: 575752 - RNA, 22 nt, Human
cuuauuauggcauguaaguggg

SEQ ID NO: 575753 - RNA, 22 nt, Human
ucgcugaggcugcacggcugcc

SEQ ID NO: 575754 - RNA, 22 nt, Human
cacagcuaggaggaaagcagag

SEQ ID NO: 575755 - RNA, 22 nt, Human
aggggagaaaaaugccuucugu

SEQ ID NO: 575756 - RNA, 22 nt, Human
cacagucaccuuaucaggaugu

SEQ ID NO: 575757 - RNA, 22 nt, Human
gcaaggcugugcacuuugcauu

SEQ ID NO: 575758 - RNA, 22 nt, Human
auuacauauguuggcaacauuu

SEQ ID NO: 575759 - RNA, 22 nt, Human
aagacuuucugggguguaaagg

SEQ ID NO: 575760 - RNA, 22 nt, Human
cuuccuggcucggugccucacc

SEQ ID NO: 575761 - RNA, 22 nt, Human
uuccuaacaaacuucagugaau

SEQ ID NO: 575762 - RNA, 22 nt, Human
acagcagggaauaugggaauug

SEQ ID NO: 575763 - RNA, 22 nt, Human
gucuccacagcccagcugccac

SEQ ID NO: 575764 - RNA, 22 nt, Human
augaaucaaacuguacacugag

SEQ ID NO: 575765 - RNA, 22 nt, Human
auccagagacccaaggacagaa

SEQ ID NO: 575766 - RNA, 22 nt, Human
uccuggaggacagaggcaucuc

SEQ ID NO: 575767 - RNA, 22 nt, Human
gcuggggaccagcugucucuga

SEQ ID NO: 575768 - RNA, 22 nt, Human
agugcucccuagaguugugcaa

SEQ ID NO: 575769 - RNA, 22 nt, Human
aggugaguugguaggaaguuug

SEQ ID NO: 575770 - RNA, 22 nt, Human
gagcugagauuugaagcaaguu

SEQ ID NO: 575771 - RNA, 22 nt, Human
caucuuuaaaaugggaacaaca

SEQ ID NO: 575772 - RNA, 22 nt, Human
uuccuuggaguuaagacccugg

SEQ ID NO: 575773 - RNA, 22 nt, Human
uguggcuccacuccacauuaau

SEQ ID NO: 575774 - RNA, 22 nt, Human
acuguguccuauuuccuugaca

SEQ ID NO: 575775 - RNA, 22 nt, Human
uuuuuggguccaggcuguaucu

SEQ ID NO: 575776 - RNA, 22 nt, Human
ucaaggugcugugcugugcuag

SEQ ID NO: 575777 - RNA, 22 nt, Human
gucugaaaauaugauuuugccu

SEQ ID NO: 575778 - RNA, 22 nt, Human
ugaggcagaguaagauacauga

SEQ ID NO: 575779 - RNA, 22 nt, Human
gcccaggaguugguggcugcag

SEQ ID NO: 575780 - RNA, 22 nt, Human
uguuucauguggacauaguugu

SEQ ID NO: 575781 - RNA, 22 nt, Human
ugccuugacaguuguaagaccu

SEQ ID NO: 575782 - RNA, 22 nt, Human
ccuuccaagugcugcuuuuucc

SEQ ID NO: 575783 - RNA, 22 nt, Human
gcaggcaggagcccaacugccu

SEQ ID NO: 575784 - RNA, 22 nt, Human
acaaauucucuaggcaaggaag

SEQ ID NO: 575785 - RNA, 22 nt, Human
ucucacacuaaugcucuaucag

SEQ ID NO: 575786 - RNA, 22 nt, Human
ucauggggugaauuaguaugcu

SEQ ID NO: 575787 - RNA, 21 nt, Human
cuugucugcaguguuuauagc

SEQ ID NO: 575788 - RNA, 22 nt, Human
caugggcaguuggcagggcuca

SEQ ID NO: 575789 - RNA, 22 nt, Human
cuaucaaacagccauuaauaua

SEQ ID NO: 575790 - RNA, 18 nt, Human
gccuucagacugcaugcu

SEQ ID NO: 575791 - RNA, 22 nt, Human
ucccagaguucaaugggaaggu

SEQ ID NO: 575792 - RNA, 22 nt, Human
agcucugggaguaguuccaccu

SEQ ID NO: 575793 - RNA, 22 nt, Human
ccaggcuuuucucauggaguca

SEQ ID NO: 575794 - RNA, 22 nt, Human
acaaugaccaaaauguuuccag

SEQ ID NO: 575795 - RNA, 22 nt, Human
uaaauuaaagauuggagaagga

SEQ ID NO: 575796 - RNA, 22 nt, Human
cuggagggaggaggcugcuauu

SEQ ID NO: 575797 - RNA, 22 nt, Human
aagcauuguaagcagaagaugc

SEQ ID NO: 575798 - RNA, 22 nt, Human
uuccugggaggcuguguacuug

SEQ ID NO: 575799 - RNA, 22 nt, Human
acauaacaaucauaggacauag

SEQ ID NO: 575800 - RNA, 22 nt, Human
acaggccucaagacacccaggu

SEQ ID NO: 575801 - RNA, 22 nt, Human
gagguuguuucaacaguagucu

SEQ ID NO: 575802 - RNA, 22 nt, Human
ugcagauucaaaugaaaugcaa

SEQ ID NO: 575803 - RNA, 22 nt, Human
agguggggugagcugcagacua

SEQ ID NO: 575804 - RNA, 19 nt, Human
aaggcugguaccauagguu

SEQ ID NO: 575805 - RNA, 22 nt, Human
uuaauuuuuauguauagugugu

SEQ ID NO: 575806 - RNA, 22 nt, Human
agagguuucuuaggggcuuccu

SEQ ID NO: 575807 - RNA, 22 nt, Human
aauaacaggcucaucagaugcu

SEQ ID NO: 575808 - RNA, 22 nt, Human
uccugggaagagaccugagcau

SEQ ID NO: 575809 - RNA, 22 nt, Human
ggggcagauggaacagagcaca

SEQ ID NO: 575810 - RNA, 22 nt, Human
agacccaggauuggggcugccg

SEQ ID NO: 575811 - RNA, 22 nt, Human
ccagcuggcaggagagucaggg

SEQ ID NO: 575812 - RNA, 22 nt, Human
uuuauacuccacucugcaagcg

SEQ ID NO: 575813 - RNA, 23 nt, Human
cagaggcaucggauucaacauca

SEQ ID NO: 575814 - RNA, 22 nt, Human
uggaagggguuacgcagcagga

SEQ ID NO: 575815 - RNA, 22 nt, Human
aagcaaaggcaggagcuuguga

SEQ ID NO: 575816 - RNA, 22 nt, Human
agcucucuuccagauccacuug

SEQ ID NO: 575817 - RNA, 21 nt, Human
gggugggguuccagccuuuuc

SEQ ID NO: 575818 - RNA, 22 nt, Human
gcuuagcaucuuacaaugcuga

SEQ ID NO: 575819 - RNA, 22 nt, Human
agaauacaucaaucuauuuucu

SEQ ID NO: 575820 - RNA, 22 nt, Human
agcugaggcucugagagggaag

SEQ ID NO: 575821 - RNA, 22 nt, Human
cucaggaugcaggucacaggac

SEQ ID NO: 575822 - RNA, 21 nt, Human
ugcagaggcacaaacaagccc

SEQ ID NO: 575823 - RNA, 23 nt, Human
aucuccugagaacccacaguggu

SEQ ID NO: 575824 - RNA, 22 nt, Human
cucaucuguauauagugaauga

SEQ ID NO: 575825 - RNA, 22 nt, Human
ccucuggccagagaaaggccag

SEQ ID NO: 575826 - RNA, 18 nt, Human
cggcagagugcuucuagc

SEQ ID NO: 575827 - RNA, 22 nt, Human
ccuggagggcgccgcacagucc

SEQ ID NO: 575828 - RNA, 22 nt, Human
acauacauugccucauugguaa

SEQ ID NO: 575829 - RNA, 21 nt, Human
ggaggucccuucugguuucag

SEQ ID NO: 575830 - RNA, 18 nt, Human
uucaccagugugaugggu

SEQ ID NO: 575831 - RNA, 22 nt, Human
caauuugcccuguuaaauuuuc

SEQ ID NO: 575832 - RNA, 19 nt, Human
uuugaaagaguuuuauugg

SEQ ID NO: 575833 - RNA, 22 nt, Human
aaggccaccaccagcgaggggg

SEQ ID NO: 575834 - RNA, 22 nt, Human
gggccuguguguucaggagccu

SEQ ID NO: 575835 - RNA, 22 nt, Human
uuuguaugugauaagacuauuc

SEQ ID NO: 575836 - RNA, 22 nt, Human
cuuaguuuagguaaacccagca

SEQ ID NO: 575837 - RNA, 22 nt, Human
cucagcacuuuggaaggcugau

SEQ ID NO: 575838 - RNA, 22 nt, Human
ugcuccuguuucaucagcuaua

SEQ ID NO: 575839 - RNA, 22 nt, Human
aacagaaugcaggggaugcugc

SEQ ID NO: 575840 - RNA, 22 nt, Human
ucacugcuauauuggauacuga

SEQ ID NO: 575841 - RNA, 22 nt, Human
ugcaaggcugccucugaggacc

SEQ ID NO: 575842 - RNA, 22 nt, Human
uucuacaugagaaaauguauuu

SEQ ID NO: 575843 - RNA, 19 nt, Human
gacuucugauguccagaug

SEQ ID NO: 575844 - RNA, 22 nt, Human
ucugaacauccuacaacauuuu

SEQ ID NO: 575845 - RNA, 23 nt, Human
aggaggccugaaacugaggcuga

SEQ ID NO: 575846 - RNA, 22 nt, Human
aagcagaugccaagauuuacca

SEQ ID NO: 575847 - RNA, 22 nt, Human
ggagaugguggaagcuggugca

SEQ ID NO: 575848 - RNA, 22 nt, Human
uacauuguuuuuucuugccauc

SEQ ID NO: 575849 - RNA, 22 nt, Human
uuguccugugucuguuuggauu

SEQ ID NO: 575850 - RNA, 22 nt, Human
ugagcaggacucacugcagccu

SEQ ID NO: 575851 - RNA, 22 nt, Human
gaugaggaaaccaaggcucagg

SEQ ID NO: 575852 - RNA, 22 nt, Human
cagggcuccccgcaccgcagcc

SEQ ID NO: 575853 - RNA, 22 nt, Human
uccaggagagguguggggacug

SEQ ID NO: 575854 - RNA, 22 nt, Human
acuguucauuuggauuucucug

SEQ ID NO: 575855 - RNA, 22 nt, Human
ggucuggaagcgucccaaaggu

SEQ ID NO: 575856 - RNA, 22 nt, Human
uuucauaaugucacagucaaaa

SEQ ID NO: 575857 - RNA, 22 nt, Human
auuuguucagcauugaauuugg

SEQ ID NO: 575858 - RNA, 22 nt, Human
uugaggucuucauucuugggca

SEQ ID NO: 575859 - RNA, 21 nt, Human
cucuccagguaggauaaaugu

SEQ ID NO: 575860 - RNA, 19 nt, Human
aguggcugggcagaagcaa

SEQ ID NO: 575861 - RNA, 21 nt, Human
aagcaggcuguaaucaugugg

SEQ ID NO: 575862 - RNA, 22 nt, Human
auacauauccacaggagauaaa

SEQ ID NO: 575863 - RNA, 22 nt, Human
acaaagauaagucagaaaguca

SEQ ID NO: 575864 - RNA, 22 nt, Human
gcucugggaacugacugccuuc

SEQ ID NO: 575865 - RNA, 22 nt, Human
uggcccugaggacccagugugg

SEQ ID NO: 575866 - RNA, 22 nt, Human
ccaggagagcaggcgugcagcu

SEQ ID NO: 575867 - RNA, 22 nt, Human
ucuuaacugacaguuuaauggg

SEQ ID NO: 575868 - RNA, 22 nt, Human
ugcagaaauaacucauauugca

SEQ ID NO: 575869 - RNA, 22 nt, Human
aggcugaggcggguagaucacc

SEQ ID NO: 575870 - RNA, 22 nt, Human
ucuuaguuguuugcugucuaac

SEQ ID NO: 575871 - RNA, 20 nt, Human
acacaugucaagcuaaaggc

SEQ ID NO: 575872 - RNA, 21 nt, Human
ugauuucugccaaguucacua

SEQ ID NO: 575873 - RNA, 22 nt, Human
cugccuagauuugaauccuggc

SEQ ID NO: 575874 - RNA, 22 nt, Human
acccaggggcagccuugcugug

SEQ ID NO: 575875 - RNA, 22 nt, Human
cucuucauuaguuccuguccca

SEQ ID NO: 575876 - RNA, 22 nt, Human
gagcagcagguggggcuggcuu

SEQ ID NO: 575877 - RNA, 22 nt, Human
cacuuucuguguaucuuccauu

SEQ ID NO: 575878 - RNA, 22 nt, Human
ugugauuucaucugaggccagg

SEQ ID NO: 575879 - RNA, 22 nt, Human
auggcagaaagaauagaggcua

SEQ ID NO: 575880 - RNA, 19 nt, Human
auucucccuagaauuuuga

SEQ ID NO: 575881 - RNA, 22 nt, Human
cacaugcuagaauaaaucucca

SEQ ID NO: 575882 - RNA, 22 nt, Human
ucacaaauagcuauauuaagga

SEQ ID NO: 575883 - RNA, 22 nt, Human
aacauguaucgcuuuuuaauau

SEQ ID NO: 575884 - RNA, 22 nt, Human
cugcaggacugaaagaugaggu

SEQ ID NO: 575885 - RNA, 22 nt, Human
uuugugaauagguuggcuucca

SEQ ID NO: 575886 - RNA, 21 nt, Human
gaacaggaaaagcuggcuuca

SEQ ID NO: 575887 - RNA, 22 nt, Human
agcugcugggauacaguaguga

SEQ ID NO: 575888 - RNA, 22 nt, Human
ucucacagugagccugaggucg

SEQ ID NO: 575889 - RNA, 22 nt, Human
uguguucauguauguauacaua

SEQ ID NO: 575890 - RNA, 22 nt, Human
cugugccuuuguagcugugccu

SEQ ID NO: 575891 - RNA, 21 nt, Human
gccucuccaaauccugccuuc

SEQ ID NO: 575892 - RNA, 22 nt, Human
cauuagcagucauuacugugcu

SEQ ID NO: 575893 - RNA, 22 nt, Human
aggcuggaguacaguggcuauu

SEQ ID NO: 575894 - RNA, 19 nt, Human
aucugaaguaggugcagcu

SEQ ID NO: 575895 - RNA, 22 nt, Human
ugacugaaauugcauuuuaaaa

SEQ ID NO: 575896 - RNA, 22 nt, Human
gugcuuuuccuuauuuggugcu

SEQ ID NO: 575897 - RNA, 22 nt, Human
cagcagccuggagggggccacg

SEQ ID NO: 575898 - RNA, 22 nt, Human
uaaagauaagacaucaacugag

SEQ ID NO: 575899 - RNA, 22 nt, Human
auauucacugagcauaaagcca

SEQ ID NO: 575900 - RNA, 22 nt, Human
gcucccagaaccaaggcugggg

SEQ ID NO: 575901 - RNA, 22 nt, Human
cagguggagcugacugagggca

SEQ ID NO: 575902 - RNA, 22 nt, Human
cccaggagauggagguugcagu

SEQ ID NO: 575903 - RNA, 22 nt, Human
ugcagggacacgaagacaaaua

SEQ ID NO: 575904 - RNA, 22 nt, Human
guuuauaaggcccaauauuucu

SEQ ID NO: 575905 - RNA, 22 nt, Human
acugccuggcagagguuugcaa

SEQ ID NO: 575906 - RNA, 19 nt, Human
ucucuggcuugucugccug

SEQ ID NO: 575907 - RNA, 22 nt, Human
cugcugcucgaccagucccagg

SEQ ID NO: 575908 - RNA, 22 nt, Human
ucuguaaaacaauauuguauuc

SEQ ID NO: 575909 - RNA, 21 nt, Human
guucaaauggguagauucaca

SEQ ID NO: 575910 - RNA, 22 nt, Human
agcuccaggcagcauuaauaaa

SEQ ID NO: 575911 - RNA, 22 nt, Human
uucacagaugagaaaauugagg

SEQ ID NO: 575912 - RNA, 22 nt, Human
ccagcagagucuaggaaggagg

SEQ ID NO: 575913 - RNA, 22 nt, Human
gucuggaggggagauuuggguu

SEQ ID NO: 575914 - RNA, 22 nt, Human
aguguagacauaggucuggucu

SEQ ID NO: 575915 - RNA, 19 nt, Human
ccugaggugggguggaagg

SEQ ID NO: 575916 - RNA, 20 nt, Human
agggcccaggaagagaguua

SEQ ID NO: 575917 - RNA, 22 nt, Human
acaggucaacgagagcaggcaa

SEQ ID NO: 575918 - RNA, 22 nt, Human
augucucagaguggucacuggg

SEQ ID NO: 575919 - RNA, 22 nt, Human
cuggagcuaauaauccaucuga

SEQ ID NO: 575920 - RNA, 22 nt, Human
acacuuugauagauaaugcagg

SEQ ID NO: 575921 - RNA, 22 nt, Human
augaggcacguguuacuggccu

SEQ ID NO: 575922 - RNA, 22 nt, Human
ggagggaguuucauuccugccc

SEQ ID NO: 575923 - RNA, 22 nt, Human
uuguguguacugguuaugggca

SEQ ID NO: 575924 - RNA, 22 nt, Human
auagaauuauggaaagcaucuu

SEQ ID NO: 575925 - RNA, 22 nt, Human
acccagggcagccagcggggag

SEQ ID NO: 575926 - RNA, 22 nt, Human
acauucuuaacaguuaaaaacu

SEQ ID NO: 575927 - RNA, 22 nt, Human
ucagaggagaugguuaccaggg

SEQ ID NO: 575928 - RNA, 22 nt, Human
cacagagaaaauguuggugcuu

SEQ ID NO: 575929 - RNA, 22 nt, Human
gcugcaacuguugcucucugca

SEQ ID NO: 575930 - RNA, 22 nt, Human
guggaauugcuggauaauauca

SEQ ID NO: 575931 - RNA, 22 nt, Human
ugucuacuccugugcuagcucc

SEQ ID NO: 575932 - RNA, 22 nt, Human
ccaggagauaagcugaguuuau

SEQ ID NO: 575933 - RNA, 22 nt, Human
aauuuccugggauaaaaagcca

SEQ ID NO: 575934 - RNA, 22 nt, Human
cccaggacucuucacugcagcc

SEQ ID NO: 575935 - RNA, 22 nt, Human
ccuccauguaaagguccccuca

SEQ ID NO: 575936 - RNA, 22 nt, Human
ggcugaaguguaguggcucacu

SEQ ID NO: 575937 - RNA, 22 nt, Human
cccaaggcugcagugagcauga

SEQ ID NO: 575938 - RNA, 22 nt, Human
ccagcagguguagggcucaugg

SEQ ID NO: 575939 - RNA, 22 nt, Human
guugaggaggcacucacuguca

SEQ ID NO: 575940 - RNA, 22 nt, Human
cagggcuggcuguggcaaucuc

SEQ ID NO: 575941 - RNA, 22 nt, Human
ucaugcaggacuuacaagagau

SEQ ID NO: 575942 - RNA, 22 nt, Human
acaggaaauuggcauaucaguu

SEQ ID NO: 575943 - RNA, 22 nt, Human
augcugugucaccuuaggauuu

SEQ ID NO: 575944 - RNA, 22 nt, Human
gauuuuauagucaggaaaaaga

SEQ ID NO: 575945 - RNA, 17 nt, Human
ucuguuucuccuuucuu

SEQ ID NO: 575946 - RNA, 22 nt, Human
ucagcugaguucuagagcacuc

SEQ ID NO: 575947 - RNA, 22 nt, Human
cugauauucauuauggagcucc

SEQ ID NO: 575948 - RNA, 23 nt, Human
aaacuacauuuauaguuuuucuc

SEQ ID NO: 575949 - RNA, 22 nt, Human
cugggaguuucuagagaaagac

SEQ ID NO: 575950 - RNA, 22 nt, Human
aggcacagguggacuucacagu

SEQ ID NO: 575951 - RNA, 22 nt, Human
cucagaaacggagcugccauuu

SEQ ID NO: 575952 - RNA, 22 nt, Human
aucuacaggauaguuuaauauu

SEQ ID NO: 575953 - RNA, 22 nt, Human
augcauauagaacauuugacau

SEQ ID NO: 575954 - RNA, 22 nt, Human
uugcaaaucuuugccagaaggc

SEQ ID NO: 575955 - RNA, 18 nt, Human
agugugugcccuuucagg

SEQ ID NO: 575956 - RNA, 22 nt, Human
ccacaguccgggcuggcaggac

SEQ ID NO: 575957 - RNA, 22 nt, Human
uaugaacauguucauugacuua

SEQ ID NO: 575958 - RNA, 22 nt, Human
aguguugucaaacggcucagca

SEQ ID NO: 575959 - RNA, 22 nt, Human
gaaggaggucugcauucuacag

SEQ ID NO: 575960 - RNA, 22 nt, Human
uugccucaagauuuuuuauuga

SEQ ID NO: 575961 - RNA, 22 nt, Human
acacagguuaaaauaauuggga

SEQ ID NO: 575962 - RNA, 22 nt, Human
aguaaauaacagagaaaauggg

SEQ ID NO: 575963 - RNA, 22 nt, Human
cacucugagaaguacaagcucc

SEQ ID NO: 575964 - RNA, 22 nt, Human
cuucucuugguaguucuuguug

SEQ ID NO: 575965 - RNA, 22 nt, Human
uaguuucuagacaguaagaauu

SEQ ID NO: 575966 - RNA, 23 nt, Human
gccucuggagccccagugcucag

SEQ ID NO: 575967 - RNA, 22 nt, Human
cugaggcugaagagggccuacg

SEQ ID NO: 575968 - RNA, 20 nt, Human
acaugaaaggaaacaggaaa

SEQ ID NO: 575969 - RNA, 22 nt, Human
uccagcucuuguugcccacugc

SEQ ID NO: 575970 - RNA, 22 nt, Human
uaugcauauguguucauuggag

SEQ ID NO: 575971 - RNA, 22 nt, Human
gaagucuuuuagcaaaacgaac

SEQ ID NO: 575972 - RNA, 22 nt, Human
ugggaaaguguugaggugucuu

SEQ ID NO: 575973 - RNA, 22 nt, Human
acagaccaaaaaaggauauugg

SEQ ID NO: 575974 - RNA, 22 nt, Human
caagcuuguuucuccugggggu

SEQ ID NO: 575975 - RNA, 22 nt, Human
caggcagaaaguauucugugua

SEQ ID NO: 575976 - RNA, 20 nt, Human
agguccugguucucugggau

SEQ ID NO: 575977 - RNA, 22 nt, Human
aauuugcaugaugagaacaaua

SEQ ID NO: 575978 - RNA, 22 nt, Human
ucaggugggcaguggguugagc

SEQ ID NO: 575979 - RNA, 22 nt, Human
cuuuuacaguggaccugccauu

SEQ ID NO: 575980 - RNA, 22 nt, Human
ucuaguuagugguugauacugu

SEQ ID NO: 575981 - RNA, 22 nt, Human
aaucauucucaugccaguuucc

SEQ ID NO: 575982 - RNA, 22 nt, Human
aacacugaaacauugauugaca

SEQ ID NO: 575983 - RNA, 22 nt, Human
uacaguaagaugaaauagcaau

SEQ ID NO: 575984 - RNA, 22 nt, Human
ugagguaguucuaauauuaaag

SEQ ID NO: 575985 - RNA, 22 nt, Human
agucccaacagcuuacaaggaa

SEQ ID NO: 575986 - RNA, 20 nt, Human
ucaucagauagguuaguaca

SEQ ID NO: 575987 - RNA, 22 nt, Human
uaccaaaagcuuguuucauaca

SEQ ID NO: 575988 - RNA, 22 nt, Human
cugggcacuugcucacagcucu

SEQ ID NO: 575989 - RNA, 19 nt, Human
ucuuuucacgcauuuugaa

SEQ ID NO: 575990 - RNA, 22 nt, Human
aaggcuggguaaccuguccacu

SEQ ID NO: 575991 - RNA, 22 nt, Human
gcugccugcucacccggccugg

SEQ ID NO: 575992 - RNA, 22 nt, Human
agucucuuuaaucacagugucu

SEQ ID NO: 575993 - RNA, 22 nt, Human
agggcugggcugcuuguuguca

SEQ ID NO: 575994 - RNA, 22 nt, Human
ugagacaguucugcagcugggu

SEQ ID NO: 575995 - RNA, 22 nt, Human
agggccuggcuucacuuucuca

SEQ ID NO: 575996 - RNA, 22 nt, Human
cacacagcucaggggcacugcc

SEQ ID NO: 575997 - RNA, 22 nt, Human
cugguggggaguccuggucucc

SEQ ID NO: 575998 - RNA, 22 nt, Human
acaugaaaacugguuccuucag

SEQ ID NO: 575999 - RNA, 22 nt, Human
ugaucagacaguuaugugcaug

SEQ ID NO: 576000 - RNA, 22 nt, Human
ccccagggucaguguguggagg

SEQ ID NO: 576001 - RNA, 22 nt, Human
ucccccacucuaaaggagccuu

SEQ ID NO: 576002 - RNA, 20 nt, Human
caggugagcagaucugggug

SEQ ID NO: 576003 - RNA, 22 nt, Human
uuuccuucuuagcgguguucuu

SEQ ID NO: 576004 - RNA, 17 nt, Human
uggcaagaauggaaaug

SEQ ID NO: 576005 - RNA, 22 nt, Human
agaugcugucacacacacuguu

SEQ ID NO: 576006 - RNA, 22 nt, Human
agagcagauggagcuggaagag

SEQ ID NO: 576007 - RNA, 22 nt, Human
aaggaucaaguggauuuucuua

SEQ ID NO: 576008 - RNA, 22 nt, Human
ccuguuugguacaaucugccaa

SEQ ID NO: 576009 - RNA, 22 nt, Human
cuuuagguuuugccugagaucu

SEQ ID NO: 576010 - RNA, 20 nt, Human
aaacauaguggauaccacag

SEQ ID NO: 576011 - RNA, 22 nt, Human
aucacauuguuagcauagacug

SEQ ID NO: 576012 - RNA, 22 nt, Human
gugccugcugcagagucgcugu

SEQ ID NO: 576013 - RNA, 22 nt, Human
ucaaaauucuagggagaauggu

SEQ ID NO: 576014 - RNA, 22 nt, Human
ugaaagaugcucaaugaauggu

SEQ ID NO: 576015 - RNA, 19 nt, Human
auuuccaagaauuggagag

SEQ ID NO: 576016 - RNA, 22 nt, Human
cauucuuauauuuacucauuca

SEQ ID NO: 576017 - RNA, 22 nt, Human
gagugcuguaggacugagcccu

SEQ ID NO: 576018 - RNA, 23 nt, Human
agugcugaauugaaagcuccagg

SEQ ID NO: 576019 - RNA, 22 nt, Human
uagaaacagagagauaugcccc

SEQ ID NO: 576020 - RNA, 22 nt, Human
ucugggguggagcccuggaguc

SEQ ID NO: 576021 - RNA, 22 nt, Human
agagauugugcuacucacccaa

SEQ ID NO: 576022 - RNA, 22 nt, Human
uucaaaagacucagauguagcg

SEQ ID NO: 576023 - RNA, 22 nt, Human
gcuggccugagggccgaggcuc

SEQ ID NO: 576024 - RNA, 22 nt, Human
aucaggaagaagaauguguugg

SEQ ID NO: 576025 - RNA, 22 nt, Human
uagcaggguuuugaagaggguu

SEQ ID NO: 576026 - RNA, 22 nt, Human
uuuucuguuuacagagggaccu

SEQ ID NO: 576027 - RNA, 22 nt, Human
cugccagggcauccuguggugg

SEQ ID NO: 576028 - RNA, 22 nt, Human
ucuguucaugucuuuuuaagug

SEQ ID NO: 576029 - RNA, 19 nt, Human
aucacaugucaagagcagg

SEQ ID NO: 576030 - RNA, 22 nt, Human
aggaagugcuaagagaacauca

SEQ ID NO: 576031 - RNA, 22 nt, Human
caggggccaggcugucugcugu

SEQ ID NO: 576032 - RNA, 22 nt, Human
ugccuuuuccaguuucuagggg

SEQ ID NO: 576033 - RNA, 22 nt, Human
gccaggcucuuccauuuggguc

SEQ ID NO: 576034 - RNA, 22 nt, Human
gccaguggucagugggagggug

SEQ ID NO: 576035 - RNA, 19 nt, Human
aaugcuuaggacagugccu

SEQ ID NO: 576036 - RNA, 23 nt, Human
ucuuuccuaaugaaacagugaaa

SEQ ID NO: 576037 - RNA, 22 nt, Human
cagcacagcugaggggcugucu

SEQ ID NO: 576038 - RNA, 22 nt, Human
uccaggcaugguguaauuuugc

SEQ ID NO: 576039 - RNA, 22 nt, Human
gccucccugagucacccaagca

SEQ ID NO: 576040 - RNA, 22 nt, Human
cucaggagaugacagaagguau

SEQ ID NO: 576041 - RNA, 22 nt, Human
cacacugucagguaaauaacac

SEQ ID NO: 576042 - RNA, 18 nt, Human
ugcagcaagugcuaaaua

SEQ ID NO: 576043 - RNA, 22 nt, Human
ucugucacucuagagauggcag

SEQ ID NO: 576044 - RNA, 22 nt, Human
cagaugcuaaguuaucagcagg

SEQ ID NO: 576045 - RNA, 22 nt, Human
gacaaagcagacaagauaauuc

SEQ ID NO: 576046 - RNA, 22 nt, Human
gugagggguggcugagcaguuu

SEQ ID NO: 576047 - RNA, 22 nt, Human
gagaaggcuggucuuaagucga

SEQ ID NO: 576048 - RNA, 22 nt, Human
gacucucaagcacaaguccacc

SEQ ID NO: 576049 - RNA, 22 nt, Human
cauuguuaccaucuuuuaccua

SEQ ID NO: 576050 - RNA, 22 nt, Human
uucuuucaauagcuggcauaug

SEQ ID NO: 576051 - RNA, 22 nt, Human
agcuccuguaguacauauuauu

SEQ ID NO: 576052 - RNA, 22 nt, Human
ggugugccuggggcuuagcugc

SEQ ID NO: 576053 - RNA, 22 nt, Human
cucagaaaucccacucugugua

SEQ ID NO: 576054 - RNA, 22 nt, Human
acuguauaaggcauagguaagc

SEQ ID NO: 576055 - RNA, 22 nt, Human
ucacaauucagaaaccaaguag

SEQ ID NO: 576056 - RNA, 22 nt, Human
auucagcauuggcaccauggau

SEQ ID NO: 576057 - RNA, 22 nt, Human
ugucaauuaugugacacaucuu

SEQ ID NO: 576058 - RNA, 22 nt, Human
agucauuucuguagucauguuu

SEQ ID NO: 576059 - RNA, 22 nt, Human
agauucauugcuuuaggcauug

SEQ ID NO: 576060 - RNA, 22 nt, Human
ucacauuucugauuauaccaaa

SEQ ID NO: 576061 - RNA, 22 nt, Human
cuccagguuuuacaaggucuau

SEQ ID NO: 576062 - RNA, 22 nt, Human
uaagcuauuccugaagaagguu

SEQ ID NO: 576063 - RNA, 22 nt, Human
ccucugcugcuguugagcaccg

SEQ ID NO: 576064 - RNA, 22 nt, Human
ucuuauuguuuaaaaguacaca

SEQ ID NO: 576065 - RNA, 22 nt, Human
ucugggucuggcugcuggugca

SEQ ID NO: 576066 - RNA, 22 nt, Human
ugacacugcauauauugaaguu

SEQ ID NO: 576067 - RNA, 22 nt, Human
gaaggagggagcggcgcggauu

SEQ ID NO: 576068 - RNA, 22 nt, Human
ugcucuguucaguguaucuugu

SEQ ID NO: 576069 - RNA, 22 nt, Human
auuuacuuugcugagauccauc

SEQ ID NO: 576070 - RNA, 22 nt, Human
ugcugccacaaauucagcugcc

SEQ ID NO: 576071 - RNA, 22 nt, Human
uuuguacaccuaccuaauacag

SEQ ID NO: 576072 - RNA, 22 nt, Human
uacagcuuauccagcuugauag

SEQ ID NO: 576073 - RNA, 22 nt, Human
caggccucgaggagacagcuac

SEQ ID NO: 576074 - RNA, 17 nt, Human
gacaggcucagugacga

SEQ ID NO: 576075 - RNA, 22 nt, Human
accuugaacacaagaauuauug

SEQ ID NO: 576076 - RNA, 22 nt, Human
ccuuagcaacugucauagagca

SEQ ID NO: 576077 - RNA, 22 nt, Human
gagucaacaagucagaucucac

SEQ ID NO: 576078 - RNA, 19 nt, Human
caguggccuggaggucucu

SEQ ID NO: 576079 - RNA, 22 nt, Human
agggaugauuucagugucugcc

SEQ ID NO: 576080 - RNA, 22 nt, Human
gagacagaguuucacucuuguu

SEQ ID NO: 576081 - RNA, 22 nt, Human
uggcagcuuccugcucauagga

SEQ ID NO: 576082 - RNA, 22 nt, Human
cugcucugacccuuucaccuuc

SEQ ID NO: 576083 - RNA, 22 nt, Human
guacauguugguuguuuccagu

SEQ ID NO: 576084 - RNA, 23 nt, Human
aaugcuggaaauucaggcaugau

SEQ ID NO: 576085 - RNA, 22 nt, Human
cagcaggggaacugugggccag

SEQ ID NO: 576086 - RNA, 22 nt, Human
ggcccuguccuggcugucuccg

SEQ ID NO: 576087 - RNA, 22 nt, Human
agggcccuggggugcacugaca

SEQ ID NO: 576088 - RNA, 20 nt, Human
gcugccuguuucuguaagua

SEQ ID NO: 576089 - RNA, 22 nt, Human
uuuuuccuagcgauuugucagc

SEQ ID NO: 576090 - RNA, 22 nt, Human
agcugggcugggcugagcugag

SEQ ID NO: 576091 - RNA, 22 nt, Human
aggagguguugauagaagguuu

SEQ ID NO: 576092 - RNA, 22 nt, Human
ucaugcaggcagccuuuaguaa

SEQ ID NO: 576093 - RNA, 22 nt, Human
gacaggcaugcuuucaggacua

SEQ ID NO: 576094 - RNA, 22 nt, Human
gaguucugaacugugaaaugca

SEQ ID NO: 576095 - RNA, 22 nt, Human
caaauaguaugagcaaugauuc

SEQ ID NO: 576096 - RNA, 22 nt, Human
ccaggaggcaauaucaagucca

SEQ ID NO: 576097 - RNA, 22 nt, Human
aaacaagguccuucugugacau

SEQ ID NO: 576098 - RNA, 22 nt, Human
acgcccggucuccauaguuuuu

SEQ ID NO: 576099 - RNA, 22 nt, Human
gcaggagcugcucuccugacga

SEQ ID NO: 576100 - RNA, 22 nt, Human
uacaaugcauucauuuuugagg

SEQ ID NO: 576101 - RNA, 22 nt, Human
uuccuggggugaagauauuuuu

SEQ ID NO: 576102 - RNA, 21 nt, Human
gcucaugguggagaaaagcag

SEQ ID NO: 576103 - RNA, 22 nt, Human
cugugccuuggcgcugugccac

SEQ ID NO: 576104 - RNA, 22 nt, Human
acacuucuuugucaccugcuuc

SEQ ID NO: 576105 - RNA, 17 nt, Human
aauagcugcucagagag

SEQ ID NO: 576106 - RNA, 19 nt, Human
cuccucagucccagagguc

SEQ ID NO: 576107 - RNA, 22 nt, Human
ucuauuugcugguugcuucugu

SEQ ID NO: 576108 - RNA, 22 nt, Human
augagcccuggaggcauuuuuu

SEQ ID NO: 576109 - RNA, 18 nt, Human
uggugaaggguggaggag

SEQ ID NO: 576110 - RNA, 22 nt, Human
agcugcucucacuggacgccug

SEQ ID NO: 576111 - RNA, 22 nt, Human
uggcucagccagcccuaggaac

SEQ ID NO: 576112 - RNA, 22 nt, Human
aauaauauuugaagcuucaaag

SEQ ID NO: 576113 - RNA, 22 nt, Human
aggcucugguucaucaugaugg

SEQ ID NO: 576114 - RNA, 22 nt, Human
aaauaaguuagcagauuccagu

SEQ ID NO: 576115 - RNA, 22 nt, Human
ccaggcuggauuuugcaguuca

SEQ ID NO: 576116 - RNA, 22 nt, Human
uuucuauaacuggacuggauug

SEQ ID NO: 576117 - RNA, 22 nt, Human
cacugcccaggaccugccaccc

SEQ ID NO: 576118 - RNA, 22 nt, Human
agaaaugugagccccuuaucaa

SEQ ID NO: 576119 - RNA, 22 nt, Human
ugagccuggcggaagcagcgug

SEQ ID NO: 576120 - RNA, 23 nt, Human
gucuuuauaguggggcacuuugu

SEQ ID NO: 576121 - RNA, 22 nt, Human
agacagcauggagcugauaaca

SEQ ID NO: 576122 - RNA, 22 nt, Human
gaaauauucuugucuuguuuuc

SEQ ID NO: 576123 - RNA, 22 nt, Human
agacacugccacuucuguuccc

SEQ ID NO: 576124 - RNA, 22 nt, Human
ugucuccaggggcaggccagcc

SEQ ID NO: 576125 - RNA, 22 nt, Human
ggcuuugggauucagcaugaga

SEQ ID NO: 576126 - RNA, 22 nt, Human
aagggcagagggaaucccacau

SEQ ID NO: 576127 - RNA, 23 nt, Human
ugggaagauauguauguucaagg

SEQ ID NO: 576128 - RNA, 22 nt, Human
auugaagauuaaaugcuuccuu

SEQ ID NO: 576129 - RNA, 22 nt, Human
aaagcaugauuagauagaugau

SEQ ID NO: 576130 - RNA, 22 nt, Human
uagaaacauucaguugcagucc

SEQ ID NO: 576131 - RNA, 20 nt, Human
ugccuuuccuguuucaucuu

SEQ ID NO: 576132 - RNA, 19 nt, Human
aggaaagguggccuuagca

SEQ ID NO: 576133 - RNA, 22 nt, Human
uggcugaguaaguugugauaug

SEQ ID NO: 576134 - RNA, 22 nt, Human
gcuccacuugcagcuaggcuug

SEQ ID NO: 576135 - RNA, 22 nt, Human
acacugcuucucuggcagagcc

SEQ ID NO: 576136 - RNA, 21 nt, Human
ggggucaagugaaugguguug

SEQ ID NO: 576137 - RNA, 22 nt, Human
ugcugcugaugcauagucugcu

SEQ ID NO: 576138 - RNA, 22 nt, Human
acauaauagcauuucuaauuug

SEQ ID NO: 576139 - RNA, 22 nt, Human
caguuacauaaaugauaaaaug

SEQ ID NO: 576140 - RNA, 22 nt, Human
uggggugguaauacaccguucu

SEQ ID NO: 576141 - RNA, 22 nt, Human
ggacggggagcuggaaagggga

SEQ ID NO: 576142 - RNA, 22 nt, Human
acuuucuauucccacagagaua

SEQ ID NO: 576143 - RNA, 22 nt, Human
gcaucccucugaggggccaggc

SEQ ID NO: 576144 - RNA, 18 nt, Human
acacaggcugacagcacc

SEQ ID NO: 576145 - RNA, 22 nt, Human
caggcccuccugugaucugccu

SEQ ID NO: 576146 - RNA, 22 nt, Human
ccuggcugcugucacugaccau

SEQ ID NO: 576147 - RNA, 22 nt, Human
uccaggccacgaccuccuggau

SEQ ID NO: 576148 - RNA, 20 nt, Human
gcauugaguauagacagaug

SEQ ID NO: 576149 - RNA, 20 nt, Human
ugagccagucaagcuacauu

SEQ ID NO: 576150 - RNA, 22 nt, Human
ggaggccaguccuggccgggcu

SEQ ID NO: 576151 - RNA, 22 nt, Human
gucugagggguuucccaggaca

SEQ ID NO: 576152 - RNA, 22 nt, Human
ggcuccaggagggccuuggcca

SEQ ID NO: 576153 - RNA, 22 nt, Human
caggaacaugucuccaauuaga

SEQ ID NO: 576154 - RNA, 22 nt, Human
auuuagaagcuaauuuuucaga

SEQ ID NO: 576155 - RNA, 21 nt, Human
aggugggcagguggaguggcc

SEQ ID NO: 576156 - RNA, 22 nt, Human
uuuuaacuuaaaauacauagau

SEQ ID NO: 576157 - RNA, 22 nt, Human
ccccagcugcauacuugccaag

SEQ ID NO: 576158 - RNA, 20 nt, Human
ucuucuguugccuuguucug

SEQ ID NO: 576159 - RNA, 22 nt, Human
ccagcucucuguccuccccaca

SEQ ID NO: 576160 - RNA, 22 nt, Human
guggagcaggacuagcugagaa

SEQ ID NO: 576161 - RNA, 22 nt, Human
gcuuccuacaugugucugcgag

SEQ ID NO: 576162 - RNA, 22 nt, Human
uaagaugagguagguaagacuu

SEQ ID NO: 576163 - RNA, 22 nt, Human
uucuuuaaaugaauucucugua

SEQ ID NO: 576164 - RNA, 22 nt, Human
agaagggccagcuggacaccug

SEQ ID NO: 576165 - RNA, 22 nt, Human
ggaggggagguccagcugaucu

SEQ ID NO: 576166 - RNA, 22 nt, Human
agggaaauuaaugugagcaaug

SEQ ID NO: 576167 - RNA, 22 nt, Human
ugggcagaaugugggauccaga

SEQ ID NO: 576168 - RNA, 22 nt, Human
aaagacaucagaaccagcugag

SEQ ID NO: 576169 - RNA, 22 nt, Human
gcugcuuucuguuaggaauugg

SEQ ID NO: 576170 - RNA, 22 nt, Human
aaagcuuauuuguaugcauguu

SEQ ID NO: 576171 - RNA, 22 nt, Human
cccugggaggcuuccaggcaga

SEQ ID NO: 576172 - RNA, 22 nt, Human
gcagcuggggaggucgugggga

SEQ ID NO: 576173 - RNA, 18 nt, Human
gccucccuggcuacacuu

SEQ ID NO: 576174 - RNA, 22 nt, Human
cagcuucuauuuaucuuugugu

SEQ ID NO: 576175 - RNA, 22 nt, Human
ugugugaacucucugauguaca

SEQ ID NO: 576176 - RNA, 22 nt, Human
aaggagaagucuguugagauug

SEQ ID NO: 576177 - RNA, 21 nt, Human
uuucuuucuggcucucacagu

SEQ ID NO: 576178 - RNA, 22 nt, Human
ucagggcaucucuuaaguggug

SEQ ID NO: 576179 - RNA, 23 nt, Human
uuugugcagaagacaaaguggcc

SEQ ID NO: 576180 - RNA, 22 nt, Human
aaaugcagguaguauuuauuuu

SEQ ID NO: 576181 - RNA, 17 nt, Human
uccagagcacagagcuc

SEQ ID NO: 576182 - RNA, 22 nt, Human
uggcagccaucugagggugggg

SEQ ID NO: 576183 - RNA, 22 nt, Human
gaagaggacuguggcauccuag

SEQ ID NO: 576184 - RNA, 22 nt, Human
cccuccacagacaggacuuguc

SEQ ID NO: 576185 - RNA, 22 nt, Human
gccagcucaguuucaaaguagg

SEQ ID NO: 576186 - RNA, 22 nt, Human
auuucagcccaguaugagcccc

SEQ ID NO: 576187 - RNA, 22 nt, Human
gcuggcucuucaguggagauag

SEQ ID NO: 576188 - RNA, 22 nt, Human
agcagggggaguuagacuagau

SEQ ID NO: 576189 - RNA, 20 nt, Human
ggcagagggccugggagaag

SEQ ID NO: 576190 - RNA, 22 nt, Human
ucaguccuuggcauuuaggagc

SEQ ID NO: 576191 - RNA, 21 nt, Human
cucuacauucccagcaacucu

SEQ ID NO: 576192 - RNA, 22 nt, Human
cauacauaugcauguguguaua

SEQ ID NO: 576193 - RNA, 22 nt, Human
aaaguuaguuucuuauaugucu

SEQ ID NO: 576194 - RNA, 22 nt, Human
cugggcugucaauggcccucug

SEQ ID NO: 576195 - RNA, 22 nt, Human
uuuccucugggcccugccaccc

SEQ ID NO: 576196 - RNA, 22 nt, Human
gcuuccugauauucauacuguu

SEQ ID NO: 576197 - RNA, 22 nt, Human
ucugcagagguaauuuacagau

SEQ ID NO: 576198 - RNA, 22 nt, Human
guggugcauccuugaguaagcu

SEQ ID NO: 576199 - RNA, 22 nt, Human
ggaagagagggcugggccucaa

SEQ ID NO: 576200 - RNA, 22 nt, Human
caaaguauauuucauagucuca

SEQ ID NO: 576201 - RNA, 22 nt, Human
augaggcccaggaaucuguauu

SEQ ID NO: 576202 - RNA, 22 nt, Human
aauuagaaccagaagccauauu

SEQ ID NO: 576203 - RNA, 22 nt, Human
ucuccuggcucaccaggcugga

SEQ ID NO: 576204 - RNA, 22 nt, Human
cugcaggcucgaagacacggau

SEQ ID NO: 576205 - RNA, 22 nt, Human
uuguuuguaaggcucuuagaau

SEQ ID NO: 576206 - RNA, 22 nt, Human
uucuggaaugccuguucuaauu

SEQ ID NO: 576207 - RNA, 22 nt, Human
agcacaguaaagcagugucaca

SEQ ID NO: 576208 - RNA, 22 nt, Human
ccaagggcuauuuacagaacag

SEQ ID NO: 576209 - RNA, 23 nt, Human
aucaaaugauuggccauucagug

SEQ ID NO: 576210 - RNA, 22 nt, Human
agcaccaggauauuguuggaga

SEQ ID NO: 576211 - RNA, 21 nt, Human
ggcugccugggaagaagaaga

SEQ ID NO: 576212 - RNA, 22 nt, Human
cuucuugcaauuuucaucuuau

SEQ ID NO: 576213 - RNA, 22 nt, Human
auuucacauuaauuugaugcuc

SEQ ID NO: 576214 - RNA, 22 nt, Human
uggcccuguggaggucagugag

SEQ ID NO: 576215 - RNA, 22 nt, Human
ccaugcagugcuggagcugauu

SEQ ID NO: 576216 - RNA, 22 nt, Human
ccugucuggaacauggccuguu

SEQ ID NO: 576217 - RNA, 22 nt, Human
ccacaggcugcugcaggucccg

SEQ ID NO: 576218 - RNA, 22 nt, Human
aaaugcauguagaauaauagag

SEQ ID NO: 576219 - RNA, 22 nt, Human
cuugugcauuucauuccucagg

SEQ ID NO: 576220 - RNA, 22 nt, Human
ugcuucaaaaaguuguuagagg

SEQ ID NO: 576221 - RNA, 22 nt, Human
auggcagagaaagcgagccaca

SEQ ID NO: 576222 - RNA, 22 nt, Human
uaccauuuugaaacauuucauc

SEQ ID NO: 576223 - RNA, 22 nt, Human
accucccuggccuucugauucc

SEQ ID NO: 576224 - RNA, 22 nt, Human
cuggcugcgucugcucugacag

SEQ ID NO: 576225 - RNA, 22 nt, Human
uuaagcuaauuaguuccagcau

SEQ ID NO: 576226 - RNA, 22 nt, Human
accagcucuuucuuuucacuau

SEQ ID NO: 576227 - RNA, 22 nt, Human
guugccuucuaugauucucagu

SEQ ID NO: 576228 - RNA, 20 nt, Human
guuuccuauuuaccuccuca

SEQ ID NO: 576229 - RNA, 22 nt, Human
acccugagaugccacagcauga

SEQ ID NO: 576230 - RNA, 22 nt, Human
ugugaagagaguaauaaaguca

SEQ ID NO: 576231 - RNA, 23 nt, Human
aguguguauugcugagggcagcu

SEQ ID NO: 576232 - RNA, 17 nt, Human
agacacugagccaagua

SEQ ID NO: 576233 - RNA, 22 nt, Human
auguuucucacuguuucucuau

SEQ ID NO: 576234 - RNA, 22 nt, Human
uaugcuaaugacacucuagaaa

SEQ ID NO: 576235 - RNA, 22 nt, Human
uaguuucuaaagcuuccuaggu

SEQ ID NO: 576236 - RNA, 22 nt, Human
agacauaagcgagcaucacagg

SEQ ID NO: 576237 - RNA, 22 nt, Human
ccccaggagauuugggagcaca

SEQ ID NO: 576238 - RNA, 22 nt, Human
aacaucauccuuugaguauuua

SEQ ID NO: 576239 - RNA, 22 nt, Human
ugagaagcugcuugugcuguau

SEQ ID NO: 576240 - RNA, 22 nt, Human
ucugcguugcucacgcugggag

SEQ ID NO: 576241 - RNA, 22 nt, Human
cucugagcugaaacaugagcau

SEQ ID NO: 576242 - RNA, 21 nt, Human
caguguggugaccagggucuc

SEQ ID NO: 576243 - RNA, 22 nt, Human
ccagcugcuuuuugucacaugg

SEQ ID NO: 576244 - RNA, 22 nt, Human
agugucaaauuaaauaaucugg

SEQ ID NO: 576245 - RNA, 23 nt, Human
uuguccugccgaucucugagaau

SEQ ID NO: 576246 - RNA, 23 nt, Human
cagaggguuccauggagcauggu

SEQ ID NO: 576247 - RNA, 22 nt, Human
agcaggugacccaagcaggcug

SEQ ID NO: 576248 - RNA, 20 nt, Human
ggcaggugcucgcuuggucu

SEQ ID NO: 576249 - RNA, 22 nt, Human
aaauguggguaaugggacugga

SEQ ID NO: 576250 - RNA, 22 nt, Human
uggguauacaaauaaucucuuu

SEQ ID NO: 576251 - RNA, 22 nt, Human
cauguauagacacucauacagu

SEQ ID NO: 576252 - RNA, 22 nt, Human
acagacagauuuugucugaugu

SEQ ID NO: 576253 - RNA, 22 nt, Human
uuccuucuuccaaacccaucau

SEQ ID NO: 576254 - RNA, 22 nt, Human
uguccccuuucuuuccuucgua

SEQ ID NO: 576255 - RNA, 17 nt, Human
ggaacaaauacuaugca

SEQ ID NO: 576256 - RNA, 22 nt, Human
auggggugagacuaggauuaaa

SEQ ID NO: 576257 - RNA, 22 nt, Human
uguuuacaaggagaauuugagg

SEQ ID NO: 576258 - RNA, 22 nt, Human
uggcuuccuguguaaugaggug

SEQ ID NO: 576259 - RNA, 22 nt, Human
auuucuuucuggccacgguuuu

SEQ ID NO: 576260 - RNA, 20 nt, Human
cugcaggguuagaggcucca

SEQ ID NO: 576261 - RNA, 22 nt, Human
gcauggaugggaguggacagau

SEQ ID NO: 576262 - RNA, 22 nt, Human
cccugagccgccugccgugucc

SEQ ID NO: 576263 - RNA, 22 nt, Human
cacaaacaucaauccuguuuuc

SEQ ID NO: 576264 - RNA, 22 nt, Human
auauauacaacuagauuaaaag

SEQ ID NO: 576265 - RNA, 22 nt, Human
uucuuuucugcagcugguauuu

SEQ ID NO: 576266 - RNA, 22 nt, Human
uugugccauaaccacccugacu

SEQ ID NO: 576267 - RNA, 22 nt, Human
caaauacucuggauguguuugu

SEQ ID NO: 576268 - RNA, 22 nt, Human
gcagggcuaggucuucuagggc

SEQ ID NO: 576269 - RNA, 22 nt, Human
ugcucagacaagcugaacagua

SEQ ID NO: 576270 - RNA, 22 nt, Human
gagaggcuggcagugccagguu

SEQ ID NO: 576271 - RNA, 22 nt, Human
agaccacagucaggcuccuggu

SEQ ID NO: 576272 - RNA, 22 nt, Human
ugccucagaguugucccuacca

SEQ ID NO: 576273 - RNA, 21 nt, Human
uguggcagauguugggaggca

SEQ ID NO: 576274 - RNA, 20 nt, Human
acaggggcagcacaauaaug

SEQ ID NO: 576275 - RNA, 22 nt, Human
augagcugggccauccagugau

SEQ ID NO: 576276 - RNA, 22 nt, Human
cgcaggugaaagaggcugggca

SEQ ID NO: 576277 - RNA, 19 nt, Human
agggccaggauucuggaac

SEQ ID NO: 576278 - RNA, 22 nt, Human
cucuuucuggaaggcagagugg

SEQ ID NO: 576279 - RNA, 22 nt, Human
agaagccagaauauucauggau

SEQ ID NO: 576280 - RNA, 22 nt, Human
ccaggagacaaagaugacugcu

SEQ ID NO: 576281 - RNA, 22 nt, Human
cuguugcuccagggaacacaga

SEQ ID NO: 576282 - RNA, 22 nt, Human
uuuaaagaaauuccucaucuuu

SEQ ID NO: 576283 - RNA, 22 nt, Human
agauccaggguuggauuugcau

SEQ ID NO: 576284 - RNA, 22 nt, Human
uaaacuaucuguguuugaaguu

SEQ ID NO: 576285 - RNA, 21 nt, Human
accagcauuccacacuguccc

SEQ ID NO: 576286 - RNA, 22 nt, Human
uugaaaggcacaggcaccuggg

SEQ ID NO: 576287 - RNA, 22 nt, Human
aaauuaagggugagaagaguug

SEQ ID NO: 576288 - RNA, 22 nt, Human
auuucucaguuccuacuguuua

SEQ ID NO: 576289 - RNA, 22 nt, Human
auugacaauguauuuguaucug

SEQ ID NO: 576290 - RNA, 22 nt, Human
caugacacccaggcauagcacc

SEQ ID NO: 576291 - RNA, 22 nt, Human
cuguuaaguguagauaaugugg

SEQ ID NO: 576292 - RNA, 22 nt, Human
uggggaagcacuuugaacuuaa

SEQ ID NO: 576293 - RNA, 22 nt, Human
caguccucucugugucugcacc

SEQ ID NO: 576294 - RNA, 22 nt, Human
cccugcagggaggauucugaag

SEQ ID NO: 576295 - RNA, 22 nt, Human
uacagcuccaaaaaucacuguu

SEQ ID NO: 576296 - RNA, 22 nt, Human
uggaacaaacauggugauggcu

SEQ ID NO: 576297 - RNA, 22 nt, Human
auguuaggcaaucuuucuuguu

SEQ ID NO: 576298 - RNA, 23 nt, Human
gcaggaguuccuggacuccagga

SEQ ID NO: 576299 - RNA, 22 nt, Human
uucucagauuccccuuuuaaua

SEQ ID NO: 576300 - RNA, 22 nt, Human
cacaauuucaguugcaugcaac

SEQ ID NO: 576301 - RNA, 22 nt, Human
augggcaggcacuggcucucag

SEQ ID NO: 576302 - RNA, 22 nt, Human
uguacaaugccagggaacacca

SEQ ID NO: 576303 - RNA, 22 nt, Human
agcagggcagugcuucagcucu

SEQ ID NO: 576304 - RNA, 22 nt, Human
gguggaguaauucgcagagguu

SEQ ID NO: 576305 - RNA, 22 nt, Human
ucagucuuuaaaagcucaggaa

SEQ ID NO: 576306 - RNA, 22 nt, Human
cucugagguuuccucacaagcu

SEQ ID NO: 576307 - RNA, 22 nt, Human
ggcagaggagcuggaaacaugg

SEQ ID NO: 576308 - RNA, 22 nt, Human
auuucucugccucagcuucugc

SEQ ID NO: 576309 - RNA, 22 nt, Human
cagucaccaccagguggcagua

SEQ ID NO: 576310 - RNA, 22 nt, Human
uggaacaacucccucggagccu

SEQ ID NO: 576311 - RNA, 22 nt, Human
cucuuuggauagaauuacaaag

SEQ ID NO: 576312 - RNA, 22 nt, Human
ugucuuuuaccuaaugagcugg

SEQ ID NO: 576313 - RNA, 22 nt, Human
uuaugaaagacauuucuguugg

SEQ ID NO: 576314 - RNA, 22 nt, Human
ccagccuccauguagauagcug

SEQ ID NO: 576315 - RNA, 22 nt, Human
uggagggcaucuguggucaggc

SEQ ID NO: 576316 - RNA, 22 nt, Human
gucugcccaucuccgggcgggg

SEQ ID NO: 576317 - RNA, 22 nt, Human
uccucaggaugugggguagaau

SEQ ID NO: 576318 - RNA, 20 nt, Human
ggggcccaagcccucuugcc

SEQ ID NO: 576319 - RNA, 22 nt, Human
gugaccaucaucucagcuaguu

SEQ ID NO: 576320 - RNA, 22 nt, Human
aggaaccagagguugagcaacu

SEQ ID NO: 576321 - RNA, 22 nt, Human
aggaagagcccgggugacauaa

SEQ ID NO: 576322 - RNA, 22 nt, Human
agauguggcugcacccaccgcu

SEQ ID NO: 576323 - RNA, 22 nt, Human
ucaguguccuucguucuuguug

SEQ ID NO: 576324 - RNA, 22 nt, Human
augccuggacuguaucccagau

SEQ ID NO: 576325 - RNA, 22 nt, Human
cagcaggcccaggugcugguga

SEQ ID NO: 576326 - RNA, 22 nt, Human
agggagacaaaagcagcugcca

SEQ ID NO: 576327 - RNA, 22 nt, Human
ucuggaguaggaccugaaaaua

SEQ ID NO: 576328 - RNA, 22 nt, Human
ccaggcugggcuacaaguugag

SEQ ID NO: 576329 - RNA, 22 nt, Human
acuuucauuuguaauaaacuuc

SEQ ID NO: 576330 - RNA, 22 nt, Human
cccagcagugguucucaaacuu

SEQ ID NO: 576331 - RNA, 22 nt, Human
acccagagaacugugccuugag

SEQ ID NO: 576332 - RNA, 22 nt, Human
gcucccugcauuucccacccuu

SEQ ID NO: 576333 - RNA, 22 nt, Human
uccugguguuuaugucacauag

SEQ ID NO: 576334 - RNA, 22 nt, Human
uggagaaggacagccugagaaa

SEQ ID NO: 576335 - RNA, 22 nt, Human
cccugagaugccucacccuagu

SEQ ID NO: 576336 - RNA, 22 nt, Human
guuauuucagccacagagugca

SEQ ID NO: 576337 - RNA, 22 nt, Human
aggcagcauccagaggagaaug

SEQ ID NO: 576338 - RNA, 22 nt, Human
agaggcagcagucauacuacag

SEQ ID NO: 576339 - RNA, 22 nt, Human
auuuggaaaugcaucucuugag

SEQ ID NO: 576340 - RNA, 22 nt, Human
aagcuggagaguuaggugaaua

SEQ ID NO: 576341 - RNA, 22 nt, Human
gugaaacuucacauuuugauag

SEQ ID NO: 576342 - RNA, 22 nt, Human
cacuuucucaugaauuuggccc

SEQ ID NO: 576343 - RNA, 16 nt, Human
ucacacauuuguuggu

SEQ ID NO: 576344 - RNA, 16 nt, Human
uggcagagguucagcc

SEQ ID NO: 576345 - RNA, 22 nt, Human
uuauuuaaaauguagguuggga

SEQ ID NO: 576346 - RNA, 22 nt, Human
ggcugccaggagggaggccagu

SEQ ID NO: 576347 - RNA, 22 nt, Human
agcacacaggacuugauucaug

SEQ ID NO: 576348 - RNA, 22 nt, Human
aaccugaaacuacauucuugau

SEQ ID NO: 576349 - RNA, 22 nt, Human
uggaauggaaacaaacugagga

SEQ ID NO: 576350 - RNA, 23 nt, Human
caugcaaacacuauugcauuugg

SEQ ID NO: 576351 - RNA, 22 nt, Human
uguguuucugagaaucccaccu

SEQ ID NO: 576352 - RNA, 22 nt, Human
uaacaggaugacagcagacauu

SEQ ID NO: 576353 - RNA, 18 nt, Human
ugaggcugaauauggggc

SEQ ID NO: 576354 - RNA, 22 nt, Human
aaaaguaauugcaguuuuguca

SEQ ID NO: 576355 - RNA, 22 nt, Human
uaugcuuucauucauaugugag

SEQ ID NO: 576356 - RNA, 22 nt, Human
gcccagcaccucucucaggguu

SEQ ID NO: 576357 - RNA, 22 nt, Human
agagggaaugugauugcaccau

SEQ ID NO: 576358 - RNA, 22 nt, Human
caggagaggcuguacguuucuc

SEQ ID NO: 576359 - RNA, 22 nt, Human
uugggguaaguuugucaagcug

SEQ ID NO: 576360 - RNA, 22 nt, Human
agcagcugagccccagcuguga

SEQ ID NO: 576361 - RNA, 20 nt, Human
caucuccugccuccauguuc

SEQ ID NO: 576362 - RNA, 22 nt, Human
gagcugaggcugaggccucacu

SEQ ID NO: 576363 - RNA, 22 nt, Human
ggagggcucccugggaguggau

SEQ ID NO: 576364 - RNA, 22 nt, Human
ugcccuggcauuggguuggaua

SEQ ID NO: 576365 - RNA, 22 nt, Human
agaaggaguguacaggucaugc

SEQ ID NO: 576366 - RNA, 22 nt, Human
cuguccuguggaccugaggacg

SEQ ID NO: 576367 - RNA, 23 nt, Human
uccaggcugaaggagcagauuuu

SEQ ID NO: 576368 - RNA, 22 nt, Human
ucacccaggauauugaagucag

SEQ ID NO: 576369 - RNA, 22 nt, Human
uacuuuuugucucuuugaaugu

SEQ ID NO: 576370 - RNA, 22 nt, Human
agggccaccucucuggguuccc

SEQ ID NO: 576371 - RNA, 22 nt, Human
cacagggcuuugauggcugagu

SEQ ID NO: 576372 - RNA, 19 nt, Human
acaauagaaaagucuuuug

SEQ ID NO: 576373 - RNA, 21 nt, Human
uacaaugcacaggagagccuc

SEQ ID NO: 576374 - RNA, 22 nt, Human
ugggauagauugauggauagag

SEQ ID NO: 576375 - RNA, 22 nt, Human
uuaggaaaggguuuucuaacag

SEQ ID NO: 576376 - RNA, 22 nt, Human
gaggcaggcacuguuaucagca

SEQ ID NO: 576377 - RNA, 22 nt, Human
agcccuggggcuggucuuggaa

SEQ ID NO: 576378 - RNA, 22 nt, Human
ucucagguaagcuucuuugaug

SEQ ID NO: 576379 - RNA, 22 nt, Human
acaaugcaccuauuuuaaaacu

SEQ ID NO: 576380 - RNA, 21 nt, Human
auacagaacauugauccaaga

SEQ ID NO: 576381 - RNA, 22 nt, Human
cagaggcucaccagccuuucac

SEQ ID NO: 576382 - RNA, 21 nt, Human
ucugccugagacuuugcuggu

SEQ ID NO: 576383 - RNA, 22 nt, Human
ccagagaggccuuggcaagaca

SEQ ID NO: 576384 - RNA, 22 nt, Human
caauagcaggucuacagagaga

SEQ ID NO: 576385 - RNA, 22 nt, Human
acauaaugagcucuuuauaaau

SEQ ID NO: 576386 - RNA, 22 nt, Human
uggucucugcugcagcuucuca

SEQ ID NO: 576387 - RNA, 22 nt, Human
uggcuccagauuuccugcugca

SEQ ID NO: 576388 - RNA, 22 nt, Human
aagagcugcaucuaagccauga

SEQ ID NO: 576389 - RNA, 22 nt, Human
ugagguaguuuuucaaguauuu

SEQ ID NO: 576390 - RNA, 22 nt, Human
uuaguguccuuaugucacaagc

SEQ ID NO: 576391 - RNA, 22 nt, Human
ugguuuguauauguuugugaga

SEQ ID NO: 576392 - RNA, 22 nt, Human
guccucugcuucaugcccugau

SEQ ID NO: 576393 - RNA, 20 nt, Human
gcagagccucacugcaaggg

SEQ ID NO: 576394 - RNA, 22 nt, Human
auuucacucucccugccacuua

SEQ ID NO: 576395 - RNA, 22 nt, Human
cugggcugcaucaaagaggcau

SEQ ID NO: 576396 - RNA, 22 nt, Human
gcaggaugggagcuucacuuug

SEQ ID NO: 576397 - RNA, 22 nt, Human
uaucuaagguauaugaggaauc

SEQ ID NO: 576398 - RNA, 22 nt, Human
aagcugggagggagcccagagu

SEQ ID NO: 576399 - RNA, 22 nt, Human
uagcugguucuccaggagcuag

SEQ ID NO: 576400 - RNA, 19 nt, Human
ccuuccccuucagccucug

SEQ ID NO: 576401 - RNA, 22 nt, Human
uauuucagcaagaagaaugugg

SEQ ID NO: 576402 - RNA, 22 nt, Human
ggaugcaggaguugaagaagga

SEQ ID NO: 576403 - RNA, 22 nt, Human
ggcugaucaggugcaaaugcau

SEQ ID NO: 576404 - RNA, 22 nt, Human
ggcagugaacagaaaugcagaa

SEQ ID NO: 576405 - RNA, 22 nt, Human
ugaggcaggaggauugcaggau

SEQ ID NO: 576406 - RNA, 22 nt, Human
agugcaaaauucagaagcaauu

SEQ ID NO: 576407 - RNA, 22 nt, Human
cccugcccuggagacacuuaaa

SEQ ID NO: 576408 - RNA, 22 nt, Human
ucugcagacaggaagcugaggc

SEQ ID NO: 576409 - RNA, 22 nt, Human
cacaagagagugcgcguugcaa

SEQ ID NO: 576410 - RNA, 23 nt, Human
cuucucaguaguacacacacuau

SEQ ID NO: 576411 - RNA, 19 nt, Human
aagcauuagccaaagcauu

SEQ ID NO: 576412 - RNA, 22 nt, Human
uaagaaacaugauacuuuuccu

SEQ ID NO: 576413 - RNA, 23 nt, Human
acagcugcaccuggccgccuggc

SEQ ID NO: 576414 - RNA, 22 nt, Human
uccagcccuguggcuuccaccc

SEQ ID NO: 576415 - RNA, 22 nt, Human
ucuacagggucagaguuucaug

SEQ ID NO: 576416 - RNA, 22 nt, Human
ugggcagcauccuccacaguca

SEQ ID NO: 576417 - RNA, 22 nt, Human
uggggcacuuaugaugugccac

SEQ ID NO: 576418 - RNA, 22 nt, Human
uucugaaagccaauucauugaa

SEQ ID NO: 576419 - RNA, 22 nt, Human
ucucugguggcuccaucaguag

SEQ ID NO: 576420 - RNA, 22 nt, Human
aacaugauguauuuucuugucu

SEQ ID NO: 576421 - RNA, 22 nt, Human
ggcagccacccugggaggcaga

SEQ ID NO: 576422 - RNA, 18 nt, Human
gggcccuggcguccgccc

SEQ ID NO: 576423 - RNA, 22 nt, Human
caguggcugugaccagggaccu

SEQ ID NO: 576424 - RNA, 22 nt, Human
uuucuucugagaucagggagaa

SEQ ID NO: 576425 - RNA, 22 nt, Human
cccucaugccagacagcaugca

SEQ ID NO: 576426 - RNA, 22 nt, Human
aaggcugccucugccagaggag

SEQ ID NO: 576427 - RNA, 21 nt, Human
ugcaccuguucacugcaguuc

SEQ ID NO: 576428 - RNA, 22 nt, Human
gcucuggcuacuccacccuguu

SEQ ID NO: 576429 - RNA, 22 nt, Human
auugcuuuugagcuagaauuuu

SEQ ID NO: 576430 - RNA, 22 nt, Human
aaguauauuuuuugaagcauau

SEQ ID NO: 576431 - RNA, 22 nt, Human
caaagccauagaguagauaaga

SEQ ID NO: 576432 - RNA, 22 nt, Human
cuuuacagauaggaacuacuca

SEQ ID NO: 576433 - RNA, 22 nt, Human
gguguccucacuauagcaaguc

SEQ ID NO: 576434 - RNA, 22 nt, Human
uuguugcucuuguugccacaug

SEQ ID NO: 576435 - RNA, 22 nt, Human
uucaauaucucuaagaaugagg

SEQ ID NO: 576436 - RNA, 18 nt, Human
agugaguuguugaaagaa

SEQ ID NO: 576437 - RNA, 22 nt, Human
ggcugcuggccagccuaggagu

SEQ ID NO: 576438 - RNA, 22 nt, Human
ccugcccacuccaggagcaacu

SEQ ID NO: 576439 - RNA, 22 nt, Human
agcuggccuccgggugccuggg

SEQ ID NO: 576440 - RNA, 23 nt, Human
auggaaauagcaugugucauuua

SEQ ID NO: 576441 - RNA, 17 nt, Human
gcucccugaggacagcu

SEQ ID NO: 576442 - RNA, 22 nt, Human
aagagguggaacagcaauucgu

SEQ ID NO: 576443 - RNA, 22 nt, Human
ugggcuccggcggccucaggcu

SEQ ID NO: 576444 - RNA, 22 nt, Human
aguuucucuuugacaccaaaau

SEQ ID NO: 576445 - RNA, 22 nt, Human
aaggugugaagagaugggaaga

SEQ ID NO: 576446 - RNA, 22 nt, Human
augucaugaaaugcuacuaacu

SEQ ID NO: 576447 - RNA, 22 nt, Human
ccuuccuugagaagcaauuccu

SEQ ID NO: 576448 - RNA, 22 nt, Human
acaugcagaauucuuagagagc

SEQ ID NO: 576449 - RNA, 22 nt, Human
ucuuccuugcuccuugucacuu

SEQ ID NO: 576450 - RNA, 22 nt, Human
ugcaccagagcagggugcccaa

SEQ ID NO: 576451 - RNA, 22 nt, Human
uggauccugcacugaguggagu

SEQ ID NO: 576452 - RNA, 22 nt, Human
agcacagaaagcacauuugaaa

SEQ ID NO: 576453 - RNA, 22 nt, Human
cauacaaucaaguucuuuauua

SEQ ID NO: 576454 - RNA, 20 nt, Human
caggccagagguuugauggc

SEQ ID NO: 576455 - RNA, 22 nt, Human
guccuucuuuucaucccugguu

SEQ ID NO: 576456 - RNA, 22 nt, Human
uggcagcagggaggccaguguu

SEQ ID NO: 576457 - RNA, 22 nt, Human
guggcagagccgugcagguagg

SEQ ID NO: 576458 - RNA, 22 nt, Human
agaauguguuuuaacaugggaa

SEQ ID NO: 576459 - RNA, 22 nt, Human
uacuacaguauguguguuauac

SEQ ID NO: 576460 - RNA, 22 nt, Human
ccuggagcuuggucacgcugcg

SEQ ID NO: 576461 - RNA, 22 nt, Human
cuguggggccaaauucuccucu

SEQ ID NO: 576462 - RNA, 22 nt, Human
uggcacugucaccaaugcuguc

SEQ ID NO: 576463 - RNA, 22 nt, Human
ucuuaaaugacugauaagagga

SEQ ID NO: 576464 - RNA, 22 nt, Human
aggaugagauuccagggucaau

SEQ ID NO: 576465 - RNA, 22 nt, Human
ggggcugagaauucagucucgg

SEQ ID NO: 576466 - RNA, 22 nt, Human
aggugggcacuccgcucgaggu

SEQ ID NO: 576467 - RNA, 22 nt, Human
ucagcugcgacaggggccugag

SEQ ID NO: 576468 - RNA, 22 nt, Human
acuggccaggcacagcuguggg

SEQ ID NO: 576469 - RNA, 22 nt, Human
agagacagaucugagggaccuc

SEQ ID NO: 576470 - RNA, 22 nt, Human
uuggaaaacuuacacagagcug

SEQ ID NO: 576471 - RNA, 22 nt, Human
aagaagaaguguuauuuuuaga

SEQ ID NO: 576472 - RNA, 22 nt, Human
auggaacagauuaaagugaggg

SEQ ID NO: 576473 - RNA, 22 nt, Human
agucaggaagcuggagcugggg

SEQ ID NO: 576474 - RNA, 22 nt, Human
uaaggaaagugccaugauuucu

SEQ ID NO: 576475 - RNA, 22 nt, Human
aaacagcagcuguuuaauuugc

SEQ ID NO: 576476 - RNA, 18 nt, Human
gagcucugccucccaguc

SEQ ID NO: 576477 - RNA, 22 nt, Human
acccugggugagaggcaaacag

SEQ ID NO: 576478 - RNA, 22 nt, Human
gcugcccuacccgaggcacucu

SEQ ID NO: 576479 - RNA, 22 nt, Human
agccaggcagggcucucgcucu

SEQ ID NO: 576480 - RNA, 22 nt, Human
cucuguagaaacagggcagaag

SEQ ID NO: 576481 - RNA, 22 nt, Human
uuguuuccuuucuauacaggau

SEQ ID NO: 576482 - RNA, 22 nt, Human
augcuacauagauacaaaaaug

SEQ ID NO: 576483 - RNA, 22 nt, Human
gcugcuggggccuucccucggg

SEQ ID NO: 576484 - RNA, 22 nt, Human
auuuccuagccucucuugcagu

SEQ ID NO: 576485 - RNA, 21 nt, Human
guuuucaugauagagucugua

SEQ ID NO: 576486 - RNA, 22 nt, Human
ccuuucuacagaugccucuugc

SEQ ID NO: 576487 - RNA, 22 nt, Human
gggagaaggagcuaguucuuga

SEQ ID NO: 576488 - RNA, 22 nt, Human
acacacuggcccccaguacuga

SEQ ID NO: 576489 - RNA, 22 nt, Human
gagaggcugacuggcuguccug

SEQ ID NO: 576490 - RNA, 22 nt, Human
auguacauuuagaucauuucug

SEQ ID NO: 576491 - RNA, 22 nt, Human
uaaaguguguggguucuaaauu

SEQ ID NO: 576492 - RNA, 22 nt, Human
uugcauauccuccaacacaugg

SEQ ID NO: 576493 - RNA, 22 nt, Human
gcaauguuuuuccuuccauauu

SEQ ID NO: 576494 - RNA, 22 nt, Human
uuuauuuggcauccagggagaa

SEQ ID NO: 576495 - RNA, 21 nt, Human
gcugaagaacucuuuauuuuc

SEQ ID NO: 576496 - RNA, 19 nt, Human
aggcaggugcagagguccc

SEQ ID NO: 576497 - RNA, 22 nt, Human
augcuaaauggccaguaccaaa

SEQ ID NO: 576498 - RNA, 22 nt, Human
uuccucaucugugcaccucacu

SEQ ID NO: 576499 - RNA, 22 nt, Human
uucuacacucacccagcuguaa

SEQ ID NO: 576500 - RNA, 22 nt, Human
ugcaaggaagggacagcugaga

SEQ ID NO: 576501 - RNA, 22 nt, Human
acagagauggcacagagaaggu

SEQ ID NO: 576502 - RNA, 22 nt, Human
ugaagaaacgcagagagguagg

SEQ ID NO: 576503 - RNA, 22 nt, Human
agauggggcugaaaguuccaau

SEQ ID NO: 576504 - RNA, 22 nt, Human
uccugcagaccucagucagguc

SEQ ID NO: 576505 - RNA, 22 nt, Human
ucugggcagccucaggccaggg

SEQ ID NO: 576506 - RNA, 22 nt, Human
cugggcuccacucccacagugu

SEQ ID NO: 576507 - RNA, 22 nt, Human
ucaauguuuguucaugaaaaua

SEQ ID NO: 576508 - RNA, 22 nt, Human
aaaucucaauuugaauuguagc

SEQ ID NO: 576509 - RNA, 22 nt, Human
gcugccuggaauaacggcuggc

SEQ ID NO: 576510 - RNA, 23 nt, Human
cacugcagcguggucuggcagga

SEQ ID NO: 576511 - RNA, 22 nt, Human
cuggggaggaugcuacgaccug

SEQ ID NO: 576512 - RNA, 22 nt, Human
uguggaagaacuucuugcuugg

SEQ ID NO: 576513 - RNA, 22 nt, Human
ccacaggggucucuguagcuga

SEQ ID NO: 576514 - RNA, 22 nt, Human
uccugccuaccuugcggaggug

SEQ ID NO: 576515 - RNA, 22 nt, Human
uuacaaguauuuaagaugcugu

SEQ ID NO: 576516 - RNA, 22 nt, Human
ggcugccacgucgaggguccaa

SEQ ID NO: 576517 - RNA, 22 nt, Human
gcccuccaccuggucucucugg

SEQ ID NO: 576518 - RNA, 22 nt, Human
ugggcccagguccugggagaag

SEQ ID NO: 576519 - RNA, 22 nt, Human
aucuaaacccuacuuucuuucu

SEQ ID NO: 576520 - RNA, 22 nt, Human
aguccuuagaacagugccuggg

SEQ ID NO: 576521 - RNA, 22 nt, Human
uggcagaguuauggguauuuau

SEQ ID NO: 576522 - RNA, 22 nt, Human
ucugagguccuacuauaagugg

SEQ ID NO: 576523 - RNA, 22 nt, Human
agugguggagagaugaggacac

SEQ ID NO: 576524 - RNA, 22 nt, Human
gauaagcuaacccaagcccuuu

SEQ ID NO: 576525 - RNA, 22 nt, Human
uacuggcaauuucauauggugc

SEQ ID NO: 576526 - RNA, 20 nt, Human
ggcagcaggaguuuccucuu

SEQ ID NO: 576527 - RNA, 18 nt, Human
ccucacagacuuccaugu

SEQ ID NO: 576528 - RNA, 22 nt, Human
cucagagggucuccuccagaau

SEQ ID NO: 576529 - RNA, 22 nt, Human
caauuucaucuugugcuucaau

SEQ ID NO: 576530 - RNA, 22 nt, Human
agcuggaggauaacucacuucu

SEQ ID NO: 576531 - RNA, 22 nt, Human
uaaugucaaggucauucuagag

SEQ ID NO: 576532 - RNA, 22 nt, Human
cuguauucaagcuucugcccaa

SEQ ID NO: 576533 - RNA, 22 nt, Human
ugcaucugauucucaggcagaa

SEQ ID NO: 576534 - RNA, 22 nt, Human
ccagcaggagaugccugugucu

SEQ ID NO: 576535 - RNA, 22 nt, Human
ucuggaguccuggaaucagcua

SEQ ID NO: 576536 - RNA, 22 nt, Human
cccauucccuuuacuguugcau

SEQ ID NO: 576537 - RNA, 22 nt, Human
uuauugccugucauuauugaau

SEQ ID NO: 576538 - RNA, 22 nt, Human
gcagcagggugccagcuuugca

SEQ ID NO: 576539 - RNA, 22 nt, Human
ucuguugcaaugugcaugguga

SEQ ID NO: 576540 - RNA, 18 nt, Human
ggagcccagaggugaguu

SEQ ID NO: 576541 - RNA, 22 nt, Human
ucaagagagugcugcuuggggu

SEQ ID NO: 576542 - RNA, 22 nt, Human
uucaacaucuuggagcuggaac

SEQ ID NO: 576543 - RNA, 23 nt, Human
ggagaucuagguuggcauuuccu

SEQ ID NO: 576544 - RNA, 19 nt, Human
uuuuuacaaguagguguga

SEQ ID NO: 576545 - RNA, 22 nt, Human
uuuauuguuguuagucauaagu

SEQ ID NO: 576546 - RNA, 22 nt, Human
cugggcacagcguugggcucuu

SEQ ID NO: 576547 - RNA, 19 nt, Human
uggguuggaagggaaugaa

SEQ ID NO: 576548 - RNA, 22 nt, Human
ucuguuuugugucucucuggug

SEQ ID NO: 576549 - RNA, 22 nt, Human
uguguaaaagauuaguuuacua

SEQ ID NO: 576550 - RNA, 22 nt, Human
agauuuuaguguagaggacuug

SEQ ID NO: 576551 - RNA, 22 nt, Human
uugcagagcaguaggaauauag

SEQ ID NO: 576552 - RNA, 22 nt, Human
cagcuguguaugagagcaugcu

SEQ ID NO: 576553 - RNA, 22 nt, Human
gauauguauugaaugaucauuu

SEQ ID NO: 576554 - RNA, 19 nt, Human
ccagaggcagcuucuguaa

SEQ ID NO: 576555 - RNA, 22 nt, Human
aagagcaacuuggaaacacuca

SEQ ID NO: 576556 - RNA, 22 nt, Human
uguguguggggaggcagcagau

SEQ ID NO: 576557 - RNA, 22 nt, Human
aaacaaauuucaagcugugaca

SEQ ID NO: 576558 - RNA, 22 nt, Human
ugcaucuguucauucguuccca

SEQ ID NO: 576559 - RNA, 22 nt, Human
gagucacaaagccuuucuuauu

SEQ ID NO: 576560 - RNA, 22 nt, Human
uugcugaagcugccaaaccagu

SEQ ID NO: 576561 - RNA, 22 nt, Human
uauuuaaccaguuaaauuucca

SEQ ID NO: 576562 - RNA, 22 nt, Human
auguuacaguugaguaaauuaa

SEQ ID NO: 576563 - RNA, 22 nt, Human
aacauugccaugguuaauuuua

SEQ ID NO: 576564 - RNA, 22 nt, Human
caggucagcacuuggaggugca

SEQ ID NO: 576565 - RNA, 22 nt, Human
agagcacagccaccauuuacaa

SEQ ID NO: 576566 - RNA, 22 nt, Human
uccuuacaguuaaaaugggagu

SEQ ID NO: 576567 - RNA, 22 nt, Human
gccuuccuuacaccugcucagc

SEQ ID NO: 576568 - RNA, 22 nt, Human
ggaacacagugccuuacaaacu

SEQ ID NO: 576569 - RNA, 22 nt, Human
aggcuggagcaagggggcauau

SEQ ID NO: 576570 - RNA, 22 nt, Human
ucaguguugugcacauacaaaa

SEQ ID NO: 576571 - RNA, 22 nt, Human
agagcagauggccagggggccu

SEQ ID NO: 576572 - RNA, 22 nt, Human
auacaugauggguguauaguuu

SEQ ID NO: 576573 - RNA, 22 nt, Human
cccagacagugauuuacuuaau

SEQ ID NO: 576574 - RNA, 22 nt, Human
agcucuccacacauaggacuag

SEQ ID NO: 576575 - RNA, 22 nt, Human
ggacuuggggaaggcacaguua

SEQ ID NO: 576576 - RNA, 23 nt, Human
ggggacaguucccacuggggucu

SEQ ID NO: 576577 - RNA, 22 nt, Human
gccuggagaagauggaacuagc

SEQ ID NO: 576578 - RNA, 23 nt, Human
uccuaacugauucugcagucucu

SEQ ID NO: 576579 - RNA, 22 nt, Human
cagcuaguaaauggcaagacua

SEQ ID NO: 576580 - RNA, 22 nt, Human
gggcagcugccaagugcaucgc

SEQ ID NO: 576581 - RNA, 18 nt, Human
cuacauucauaggaaagg

SEQ ID NO: 576582 - RNA, 22 nt, Human
ucacaguaucuagaaaugaggg

SEQ ID NO: 576583 - RNA, 22 nt, Human
auguaacacccacuuuuauagc

SEQ ID NO: 576584 - RNA, 22 nt, Human
acagcuggaggucugugagcac

SEQ ID NO: 576585 - RNA, 22 nt, Human
ugcauauuuucugauucagaag

SEQ ID NO: 576586 - RNA, 22 nt, Human
gccuucugaucgcuggacugac

SEQ ID NO: 576587 - RNA, 22 nt, Human
gcugucaggccaugugggccuu

SEQ ID NO: 576588 - RNA, 22 nt, Human
gauuuugaauauuaaagaagag

SEQ ID NO: 576589 - RNA, 22 nt, Human
caggcagcucgaugccuuguug

SEQ ID NO: 576590 - RNA, 22 nt, Human
gacuggucuuuugugauggaug

SEQ ID NO: 576591 - RNA, 22 nt, Human
caguagcaggcaggugcuuuug

SEQ ID NO: 576592 - RNA, 22 nt, Human
ugagcuguggugggguagagga

SEQ ID NO: 576593 - RNA, 22 nt, Human
auuucucacccuaccucacucc

SEQ ID NO: 576594 - RNA, 22 nt, Human
ugaucuagguuggcuucaacug

SEQ ID NO: 576595 - RNA, 22 nt, Human
uuguauuuccuauaaccuuucu

SEQ ID NO: 576596 - RNA, 22 nt, Human
ugagccagucugucugggugaa

SEQ ID NO: 576597 - RNA, 22 nt, Human
ggaggagcacuucugagcucag

SEQ ID NO: 576598 - RNA, 22 nt, Human
ggugcaggagcggggugcucgg

SEQ ID NO: 576599 - RNA, 22 nt, Human
ucuuaaagccaagcauaaacca

SEQ ID NO: 576600 - RNA, 22 nt, Human
ggcaaggccuugcccagcauuc

SEQ ID NO: 576601 - RNA, 22 nt, Human
cccccagucugaacagcagcug

SEQ ID NO: 576602 - RNA, 20 nt, Human
cuuagcuaguaagaagcugu

SEQ ID NO: 576603 - RNA, 22 nt, Human
uguggaaugggagugagaagac

SEQ ID NO: 576604 - RNA, 22 nt, Human
gaaaucuuuuaaccauucauuu

SEQ ID NO: 576605 - RNA, 23 nt, Human
caacagcuguuagauaugggcuu

SEQ ID NO: 576606 - RNA, 22 nt, Human
ugccauggaaguggccagaccu

SEQ ID NO: 576607 - RNA, 22 nt, Human
aguggccagugcugcucugggg

SEQ ID NO: 576608 - RNA, 22 nt, Human
guggagagagauaagccugguc

SEQ ID NO: 576609 - RNA, 22 nt, Human
ggcugcaggaacgacggagggg

SEQ ID NO: 576610 - RNA, 22 nt, Human
gcaaagcugggugugaaugcac

SEQ ID NO: 576611 - RNA, 22 nt, Human
agaccuggaaguucaagagaaa

SEQ ID NO: 576612 - RNA, 22 nt, Human
agacccugucaguguuaggaaa

SEQ ID NO: 576613 - RNA, 22 nt, Human
caugcuuccuccaaacuacccu

SEQ ID NO: 576614 - RNA, 21 nt, Human
gucuucaaaggcagugggcag

SEQ ID NO: 576615 - RNA, 22 nt, Human
gcuuucugggcuauagaacggg

SEQ ID NO: 576616 - RNA, 22 nt, Human
uuaaaugagauguucagauauu

SEQ ID NO: 576617 - RNA, 22 nt, Human
ucacagcaacccugaggcgagu

SEQ ID NO: 576618 - RNA, 19 nt, Human
uagcugccuguuaccucca

SEQ ID NO: 576619 - RNA, 22 nt, Human
gcucccuguucucagccaugau

SEQ ID NO: 576620 - RNA, 22 nt, Human
cuccucccugcgauugcucugc

SEQ ID NO: 576621 - RNA, 22 nt, Human
ugagauggguggguagccaagg

SEQ ID NO: 576622 - RNA, 22 nt, Human
aauagacaagcacccugguaaa

SEQ ID NO: 576623 - RNA, 22 nt, Human
ugcugaaugggugauuuuggag

SEQ ID NO: 576624 - RNA, 22 nt, Human
ggccaggaggcaggggcucaau

SEQ ID NO: 576625 - RNA, 23 nt, Human
gaggaaagaauauagaugcaauc

SEQ ID NO: 576626 - RNA, 22 nt, Human
ucaauguucaaguaugacaaug

SEQ ID NO: 576627 - RNA, 22 nt, Human
gggccaaggggagcuggaaggg

SEQ ID NO: 576628 - RNA, 22 nt, Human
uuacaugcaggucagacugcau

SEQ ID NO: 576629 - RNA, 22 nt, Human
cuguacagaagcuagagcaaau

SEQ ID NO: 576630 - RNA, 22 nt, Human
aagaauuaucugaaagcugugu

SEQ ID NO: 576631 - RNA, 22 nt, Human
auucugaggacagagucuagca

SEQ ID NO: 576632 - RNA, 22 nt, Human
cuuggcuuuugcucccagauca

SEQ ID NO: 576633 - RNA, 22 nt, Human
uggaugcugagaacacugccug

SEQ ID NO: 576634 - RNA, 22 nt, Human
uaugugaauacagcaguggaug

SEQ ID NO: 576635 - RNA, 22 nt, Human
ucaggggaaaucucucagcgaa

SEQ ID NO: 576636 - RNA, 22 nt, Human
uguggccaggccccugauggug

SEQ ID NO: 576637 - RNA, 22 nt, Human
cugggugguuuugaugugaauu

SEQ ID NO: 576638 - RNA, 22 nt, Human
agagauuugucaaugauuucca

SEQ ID NO: 576639 - RNA, 23 nt, Human
agccagauuucuuugcagggcag

SEQ ID NO: 576640 - RNA, 22 nt, Human
auacugaaggcauucagauaac

SEQ ID NO: 576641 - RNA, 22 nt, Human
uguaaauaaugcauguaaauca

SEQ ID NO: 576642 - RNA, 22 nt, Human
ugggcagccaucccagccucuc

SEQ ID NO: 576643 - RNA, 22 nt, Human
gcaaauacauguugagcaccua

SEQ ID NO: 576644 - RNA, 22 nt, Human
cuggugccuccucccugugcuu

SEQ ID NO: 576645 - RNA, 22 nt, Human
aucuacaaccccucaaacugug

SEQ ID NO: 576646 - RNA, 22 nt, Human
uaggaaacucaaagggaagugg

SEQ ID NO: 576647 - RNA, 22 nt, Human
ccugggcaacauagugagaccu

SEQ ID NO: 576648 - RNA, 22 nt, Human
cacacagaugguaagggaggga

SEQ ID NO: 576649 - RNA, 19 nt, Human
uugagaaaguugauuuggg

SEQ ID NO: 576650 - RNA, 22 nt, Human
ccucuguggcccugacucucuu

SEQ ID NO: 576651 - RNA, 23 nt, Human
uauccuaaaggcaacaggaaguc

SEQ ID NO: 576652 - RNA, 22 nt, Human
guggcagagauagaacuggaau

SEQ ID NO: 576653 - RNA, 22 nt, Human
uggcagagccuugccaaacucc

SEQ ID NO: 576654 - RNA, 22 nt, Human
ugggccaggcaugugaucagca

SEQ ID NO: 576655 - RNA, 22 nt, Human
uuggcauucaugggacaacaaa

SEQ ID NO: 576656 - RNA, 22 nt, Human
ggugaaggcacaagagggcaag

SEQ ID NO: 576657 - RNA, 22 nt, Human
gccagcagggcggagccaucua

SEQ ID NO: 576658 - RNA, 22 nt, Human
gaggugagaagggggucagaug

SEQ ID NO: 576659 - RNA, 22 nt, Human
gcucuggggaugcuucugccgu

SEQ ID NO: 576660 - RNA, 22 nt, Human
ccugugguuuacaugacaguua

SEQ ID NO: 576661 - RNA, 22 nt, Human
ugccaggcgauugcuaucagca

SEQ ID NO: 576662 - RNA, 22 nt, Human
acaagucuuuuucaugucuucu

SEQ ID NO: 576663 - RNA, 19 nt, Human
ugagccagggaggccaugc

SEQ ID NO: 576664 - RNA, 22 nt, Human
gaaggaaguuuauuuuagaaga

SEQ ID NO: 576665 - RNA, 22 nt, Human
ccagcugagaaguguaaaguga

SEQ ID NO: 576666 - RNA, 22 nt, Human
aaucacaugcagggccuccacc

SEQ ID NO: 576667 - RNA, 22 nt, Human
uggagaagauuggucaccauuc

SEQ ID NO: 576668 - RNA, 22 nt, Human
uuguuacaucuuauguaagugg

SEQ ID NO: 576669 - RNA, 22 nt, Human
agagccacggcaggccuaggaa

SEQ ID NO: 576670 - RNA, 22 nt, Human
uaaaugugcacagguuagaagg

SEQ ID NO: 576671 - RNA, 22 nt, Human
uuuacaacguuccuggugcuaa

SEQ ID NO: 576672 - RNA, 22 nt, Human
aacucacagcuguuuggauuag

SEQ ID NO: 576673 - RNA, 22 nt, Human
uuaaaguauagaggacaaaaac

SEQ ID NO: 576674 - RNA, 22 nt, Human
cucucagacacccauuuggaaa

SEQ ID NO: 576675 - RNA, 22 nt, Human
aaagcuugugcuguaguauuua

SEQ ID NO: 576676 - RNA, 22 nt, Human
agccaugggcucccaguccuuu

SEQ ID NO: 576677 - RNA, 18 nt, Human
gagcccugagucugcaca

SEQ ID NO: 576678 - RNA, 22 nt, Human
ucuucauguugcuguagggaga

SEQ ID NO: 576679 - RNA, 18 nt, Human
uaaauauauuucccccuu

SEQ ID NO: 576680 - RNA, 17 nt, Human
ugggguccccgauggug

SEQ ID NO: 576681 - RNA, 22 nt, Human
gacugggacaggacagacaucu

SEQ ID NO: 576682 - RNA, 22 nt, Human
caggguucagugggcccucuug

SEQ ID NO: 576683 - RNA, 22 nt, Human
ccuggcugcuauagcagcaugu

SEQ ID NO: 576684 - RNA, 22 nt, Human
gaagagcauuugcccaggcugu

SEQ ID NO: 576685 - RNA, 22 nt, Human
uaguccuuuaucaaacauuuau

SEQ ID NO: 576686 - RNA, 22 nt, Human
gaccuucuugcuguguccuaac

SEQ ID NO: 576687 - RNA, 22 nt, Human
aggcuggcuggcaggggacaca

SEQ ID NO: 576688 - RNA, 22 nt, Human
cccaggcugugcaaacuucaaa

SEQ ID NO: 576689 - RNA, 22 nt, Human
aaaguugaguuuuauguguuac

SEQ ID NO: 576690 - RNA, 22 nt, Human
auugcugaacuuauaaaugaau

SEQ ID NO: 576691 - RNA, 22 nt, Human
acacagcuucaaagucuaauuc

SEQ ID NO: 576692 - RNA, 22 nt, Human
uuuacauggaauauugucuugu

SEQ ID NO: 576693 - RNA, 22 nt, Human
agucuccucuuuccuuguuauu

SEQ ID NO: 576694 - RNA, 23 nt, Human
uggcccugaaucuguccuggagg

SEQ ID NO: 576695 - RNA, 22 nt, Human
aagcacaucauguuguucagac

SEQ ID NO: 576696 - RNA, 22 nt, Human
uuacaguuuacauaagaauugu

SEQ ID NO: 576697 - RNA, 22 nt, Human
cuuuguuuuacucagaggcaug

SEQ ID NO: 576698 - RNA, 22 nt, Human
gggaggagcuuggagauucacu

SEQ ID NO: 576699 - RNA, 22 nt, Human
agcacuuuccuggcaaaugugg

SEQ ID NO: 576700 - RNA, 22 nt, Human
uggcugagccuuuggggcuuuc

SEQ ID NO: 576701 - RNA, 22 nt, Human
aguuaagagugugaaaauguua

SEQ ID NO: 576702 - RNA, 22 nt, Human
cugcucugagaggcucuuccua

SEQ ID NO: 576703 - RNA, 22 nt, Human
aaagcacuucaggagcaguuug

SEQ ID NO: 576704 - RNA, 22 nt, Human
gcuggaguaggaccaugcuuga

SEQ ID NO: 576705 - RNA, 22 nt, Human
augaggucacaguguuuggcau

SEQ ID NO: 576706 - RNA, 22 nt, Human
ggggcaggagcccuucuucagc

SEQ ID NO: 576707 - RNA, 22 nt, Human
ccagggcuggaccagugcuugg

SEQ ID NO: 576708 - RNA, 22 nt, Human
ggcugugcgggcagccguggga

SEQ ID NO: 576709 - RNA, 22 nt, Human
cuggcagugacauugcaggugc

SEQ ID NO: 576710 - RNA, 22 nt, Human
accagcucagagcaggcuccug

SEQ ID NO: 576711 - RNA, 22 nt, Human
gccaggagacuccauucauuug

SEQ ID NO: 576712 - RNA, 22 nt, Human
ugagcugguucuugaggcauga

SEQ ID NO: 576713 - RNA, 22 nt, Human
uguggccugauuuugcaucucu

SEQ ID NO: 576714 - RNA, 22 nt, Human
auucaccuguuaguaaaaaucu

SEQ ID NO: 576715 - RNA, 22 nt, Human
ggaagggccucgggcgugggac

SEQ ID NO: 576716 - RNA, 22 nt, Human
uagcuuugcccgugcuggauuu

SEQ ID NO: 576717 - RNA, 22 nt, Human
caagcaaugcuauacucauuau

SEQ ID NO: 576718 - RNA, 22 nt, Human
uucagugugugauaccugcugu

SEQ ID NO: 576719 - RNA, 22 nt, Human
acccaggguagaaccucagagc

SEQ ID NO: 576720 - RNA, 22 nt, Human
gcugcagguugggcaacagagu

SEQ ID NO: 576721 - RNA, 22 nt, Human
acauuucuugaugccucuguga

SEQ ID NO: 576722 - RNA, 22 nt, Human
ccagugcacagccaggcaggug

SEQ ID NO: 576723 - RNA, 22 nt, Human
cagcuucccagcucacucauaa

SEQ ID NO: 576724 - RNA, 22 nt, Human
uuucucaaccucaacacuauuu

SEQ ID NO: 576725 - RNA, 22 nt, Human
cccagggaaggcagauggagga

SEQ ID NO: 576726 - RNA, 22 nt, Human
acauggcacccagaucucaaaa

SEQ ID NO: 576727 - RNA, 22 nt, Human
cccaggaggcagagguuggagc

SEQ ID NO: 576728 - RNA, 22 nt, Human
aacacugcugcuggguucugug

SEQ ID NO: 576729 - RNA, 22 nt, Human
agcacacaguauuagccauugu

SEQ ID NO: 576730 - RNA, 22 nt, Human
caagauuuagccugcugccugu

SEQ ID NO: 576731 - RNA, 22 nt, Human
gcucaagggaugggagugggug

SEQ ID NO: 576732 - RNA, 22 nt, Human
uugccugugaacgcugaguccu

SEQ ID NO: 576733 - RNA, 22 nt, Human
cuggggcugugggagacaaggc

SEQ ID NO: 576734 - RNA, 22 nt, Human
agcaucccaugacucuggagga

SEQ ID NO: 576735 - RNA, 22 nt, Human
cagcuugggaguuugguuuuau

SEQ ID NO: 576736 - RNA, 22 nt, Human
ucagugaaguaauggugagaga

SEQ ID NO: 576737 - RNA, 22 nt, Human
ucaauagauuagguauuagauu

SEQ ID NO: 576738 - RNA, 22 nt, Human
cugccagcucaaagcgcagcua

SEQ ID NO: 576739 - RNA, 22 nt, Human
auccauuucuaucuugcugagg

SEQ ID NO: 576740 - RNA, 22 nt, Human
aagggaaacuuucacaaugucc

SEQ ID NO: 576741 - RNA, 22 nt, Human
ugcaggcucugugugugccugg

SEQ ID NO: 576742 - RNA, 22 nt, Human
aaagggaggggcgauaagccgg

SEQ ID NO: 576743 - RNA, 22 nt, Human
auauggaaguuaccugacuuca

SEQ ID NO: 576744 - RNA, 22 nt, Human
uccuuauaguugucuuugaacc

SEQ ID NO: 576745 - RNA, 22 nt, Human
agauugguguugcagaaccaug

SEQ ID NO: 576746 - RNA, 22 nt, Human
uaaggcagccgcucagagaggu

SEQ ID NO: 576747 - RNA, 22 nt, Human
gggagggaucugcuaggcaaug

SEQ ID NO: 576748 - RNA, 22 nt, Human
uuagggcuuuucugaauaggcc

SEQ ID NO: 576749 - RNA, 18 nt, Human
ccuggagcuccacagcaa

SEQ ID NO: 576750 - RNA, 23 nt, Human
augagguaaagaucagcuuuaaa

SEQ ID NO: 576751 - RNA, 22 nt, Human
uggcucugaucagauguccagu

SEQ ID NO: 576752 - RNA, 22 nt, Human
ccaggcuuccuaaugugugcag

SEQ ID NO: 576753 - RNA, 23 nt, Human
aagaggaggcccugcucccgucc

SEQ ID NO: 576754 - RNA, 22 nt, Human
cagggagcggagucccaugccu

SEQ ID NO: 576755 - RNA, 22 nt, Human
aggugagaaaacgaggguugca

SEQ ID NO: 576756 - RNA, 22 nt, Human
aaagguuuauuuaaucagggag

SEQ ID NO: 576757 - RNA, 22 nt, Human
guccucagagugggcagguccu

SEQ ID NO: 576758 - RNA, 22 nt, Human
cugauacaaugcuaauaaauuu

SEQ ID NO: 576759 - RNA, 22 nt, Human
gaagcaguuucuguaaugaaau

SEQ ID NO: 576760 - RNA, 22 nt, Human
cccugggauggauuggcaggaa

SEQ ID NO: 576761 - RNA, 22 nt, Human
uggcucaguuccaucaucugga

SEQ ID NO: 576762 - RNA, 22 nt, Human
acuuggagagcauugcugggga

SEQ ID NO: 576763 - RNA, 22 nt, Human
ugggugaggagaggcugucuaa

SEQ ID NO: 576764 - RNA, 22 nt, Human
cagcuuugugacuucggacaag

SEQ ID NO: 576765 - RNA, 18 nt, Human
ugcacuagaugcuggcag

SEQ ID NO: 576766 - RNA, 17 nt, Human
agcauuuguguuaacag

SEQ ID NO: 576767 - RNA, 22 nt, Human
gcaggauggugcccuuucugcc

SEQ ID NO: 576768 - RNA, 20 nt, Human
cugggcugcccagcuauggg

SEQ ID NO: 576769 - RNA, 23 nt, Human
aggaaugugcccacccaucuccu

SEQ ID NO: 576770 - RNA, 22 nt, Human
ugggagaagacguacuuuagac

SEQ ID NO: 576771 - RNA, 22 nt, Human
cugggccucaugcacagagaug

SEQ ID NO: 576772 - RNA, 22 nt, Human
auccaaagcccuaaguuaacug

SEQ ID NO: 576773 - RNA, 22 nt, Human
gcagagaaaguuuuguccucag

SEQ ID NO: 576774 - RNA, 20 nt, Human
uaaagacauaagcuacuauc

SEQ ID NO: 576775 - RNA, 22 nt, Human
ucacugcucuccaauguggagu

SEQ ID NO: 576776 - RNA, 22 nt, Human
uucuaugaagguaagauguacg

SEQ ID NO: 576777 - RNA, 22 nt, Human
ggcugggcaggucugcacaggg

SEQ ID NO: 576778 - RNA, 22 nt, Human
uggcacugggacagaugcucuc

SEQ ID NO: 576779 - RNA, 22 nt, Human
gugaagcacaugggcguugggu

SEQ ID NO: 576780 - RNA, 22 nt, Human
agggcagacuaggauggaagug

SEQ ID NO: 576781 - RNA, 16 nt, Human
acugcuuuucauaaga

SEQ ID NO: 576782 - RNA, 22 nt, Human
cagagcugagucuucaagguug

SEQ ID NO: 576783 - RNA, 22 nt, Human
uucuuuuaauguucugaaguuu

SEQ ID NO: 576784 - RNA, 22 nt, Human
uaauuacagguccaaaacaauc

SEQ ID NO: 576785 - RNA, 22 nt, Human
gugggccacaucccagggcucu

SEQ ID NO: 576786 - RNA, 22 nt, Human
uagcauuaaagguaagacauua

SEQ ID NO: 576787 - RNA, 22 nt, Human
cagagggagcccuccaggagca

SEQ ID NO: 576788 - RNA, 22 nt, Human
ucaacaaugggucuguaaugga

SEQ ID NO: 576789 - RNA, 22 nt, Human
acagcucugagauauuacuauu

SEQ ID NO: 576790 - RNA, 22 nt, Human
gcccugugccagucacgcugug

SEQ ID NO: 576791 - RNA, 22 nt, Human
auuauggagaaauauguacagg

SEQ ID NO: 576792 - RNA, 21 nt, Human
ucuaugcaagacccuaguccu

SEQ ID NO: 576793 - RNA, 20 nt, Human
uugaggucaaggacuaggcc

SEQ ID NO: 576794 - RNA, 22 nt, Human
auggcuaaaccugaacuggucu

SEQ ID NO: 576795 - RNA, 20 nt, Human
agaaacagcacaauucuguu

SEQ ID NO: 576796 - RNA, 22 nt, Human
uuagaaauacaagugagguuga

SEQ ID NO: 576797 - RNA, 22 nt, Human
auuuagaaguuggagggcaaga

SEQ ID NO: 576798 - RNA, 22 nt, Human
ucccaggacaggccacauggaa

SEQ ID NO: 576799 - RNA, 22 nt, Human
uuuauugagcacccguugugcg

SEQ ID NO: 576800 - RNA, 22 nt, Human
ucuccugcucccaacugcugca

SEQ ID NO: 576801 - RNA, 22 nt, Human
cacaguaugaucuaaaguaagu

SEQ ID NO: 576802 - RNA, 22 nt, Human
cagggccacccucugcugggug

SEQ ID NO: 576803 - RNA, 22 nt, Human
ugccugggaaccaauccuggcu

SEQ ID NO: 576804 - RNA, 22 nt, Human
ggagggagcauccccuugcuga

SEQ ID NO: 576805 - RNA, 22 nt, Human
uuuuuuauagcaaugaacccac

SEQ ID NO: 576806 - RNA, 22 nt, Human
cacaugcaguuuacgucacuga

SEQ ID NO: 576807 - RNA, 22 nt, Human
guccucuccaggaggcucugau

SEQ ID NO: 576808 - RNA, 22 nt, Human
uaggaucucaccauagaaggaa

SEQ ID NO: 576809 - RNA, 22 nt, Human
cagggcuugaucugcauccugc

SEQ ID NO: 576810 - RNA, 22 nt, Human
gugcccugacacaccuggugug

SEQ ID NO: 576811 - RNA, 22 nt, Human
auuuccuaauuuagggauagac

SEQ ID NO: 576812 - RNA, 19 nt, Human
aguaugucuaugagucuuu

SEQ ID NO: 576813 - RNA, 22 nt, Human
ugagcaagacccggccucugcc

SEQ ID NO: 576814 - RNA, 22 nt, Human
ugaggugguuuguaucacuggg

SEQ ID NO: 576815 - RNA, 22 nt, Human
acacagauauuguacuugaucc

SEQ ID NO: 576816 - RNA, 22 nt, Human
acaggcagguugagaaacauuu

SEQ ID NO: 576817 - RNA, 22 nt, Human
uccuuccuggggucucugcugc

SEQ ID NO: 576818 - RNA, 22 nt, Human
uaguuaaagcccuaaauugaua

SEQ ID NO: 576819 - RNA, 22 nt, Human
ugaagucucuguuuucucauuu

SEQ ID NO: 576820 - RNA, 22 nt, Human
ggcagccauggacacuggcuag

SEQ ID NO: 576821 - RNA, 22 nt, Human
ugaacacagcauauuuuguuac

SEQ ID NO: 576822 - RNA, 20 nt, Human
ugggagaagaacacuggaac

SEQ ID NO: 576823 - RNA, 22 nt, Human
ucaucacauguguagucauccc

SEQ ID NO: 576824 - RNA, 22 nt, Human
cuacaagauuuuuaaaacugua

SEQ ID NO: 576825 - RNA, 22 nt, Human
uacauuugcuuugauuuucagc

SEQ ID NO: 576826 - RNA, 22 nt, Human
ggagugaaucacuagaugcaga

SEQ ID NO: 576827 - RNA, 22 nt, Human
uggagcaggugggaugucguga

SEQ ID NO: 576828 - RNA, 22 nt, Human
ucacagcaaaugcugcuucuca

SEQ ID NO: 576829 - RNA, 22 nt, Human
gaccuggguaaggggcugacaa

SEQ ID NO: 576830 - RNA, 22 nt, Human
ugugaaggagcaugcagagggg

SEQ ID NO: 576831 - RNA, 22 nt, Human
acagcaguuacugaaauaaagu

SEQ ID NO: 576832 - RNA, 22 nt, Human
cuccuucuccucgggaggccag

SEQ ID NO: 576833 - RNA, 22 nt, Human
ugugaagaucaggguccuagag

SEQ ID NO: 576834 - RNA, 22 nt, Human
gaggcagcaucuauggugggaa

SEQ ID NO: 576835 - RNA, 21 nt, Human
aggaaaggccagcacguaggg

SEQ ID NO: 576836 - RNA, 22 nt, Human
aaaguaagauuugcauuucaga

SEQ ID NO: 576837 - RNA, 22 nt, Human
uuuacugaacugcuaguacagg

SEQ ID NO: 576838 - RNA, 22 nt, Human
aguaaagcggugucacagaaug

SEQ ID NO: 576839 - RNA, 22 nt, Human
ugcugaauauagagcaagaagu

SEQ ID NO: 576840 - RNA, 22 nt, Human
agugccuggaccccaugacaua

SEQ ID NO: 576841 - RNA, 22 nt, Human
uuggcagggcugcuugucuagg

SEQ ID NO: 576842 - RNA, 22 nt, Human
cugcuucauauuucauagugau

SEQ ID NO: 576843 - RNA, 19 nt, Human
cugugcaggccgggcugag

SEQ ID NO: 576844 - RNA, 22 nt, Human
auuguacaaugccuggaacauu

SEQ ID NO: 576845 - RNA, 22 nt, Human
aggagaccuuuugagugugaga

SEQ ID NO: 576846 - RNA, 22 nt, Human
uggcagagucugggcuugggca

SEQ ID NO: 576847 - RNA, 22 nt, Human
ucucaucuuuaaaugaaaauuu

SEQ ID NO: 576848 - RNA, 22 nt, Human
aaagggagcauggcugcaggga

SEQ ID NO: 576849 - RNA, 20 nt, Human
ucuccuggugacaguaccca

SEQ ID NO: 576850 - RNA, 22 nt, Human
cccagggauuauaaaggugaaa

SEQ ID NO: 576851 - RNA, 22 nt, Human
acuugguugaugucauaagguu

SEQ ID NO: 576852 - RNA, 22 nt, Human
cauggaacaaggaagauguuug

SEQ ID NO: 576853 - RNA, 22 nt, Human
ugggagaagagaaauuacugcc

SEQ ID NO: 576854 - RNA, 22 nt, Human
auauagcugagggguauuauaa

SEQ ID NO: 576855 - RNA, 22 nt, Human
ugcauuaguaaguaauuuuaau

SEQ ID NO: 576856 - RNA, 22 nt, Human
aaaggcacuggauagcugggga

SEQ ID NO: 576857 - RNA, 22 nt, Human
cacuuaaagucuuagcuuacag

SEQ ID NO: 576858 - RNA, 22 nt, Human
gugggaagaacuucaaguggcu

SEQ ID NO: 576859 - RNA, 22 nt, Human
aauagcugggaggcacauucau

SEQ ID NO: 576860 - RNA, 22 nt, Human
ggcagcaaauauugucagcugu

SEQ ID NO: 576861 - RNA, 22 nt, Human
caggaggcagaggaugcccagu

SEQ ID NO: 576862 - RNA, 22 nt, Human
gcugagguggagauugcaguga

SEQ ID NO: 576863 - RNA, 22 nt, Human
cucccagccuucgccagucuga

SEQ ID NO: 576864 - RNA, 22 nt, Human
gugaggagcucuuugacucacg

SEQ ID NO: 576865 - RNA, 21 nt, Human
ucuuuccugcccaguugcccu

SEQ ID NO: 576866 - RNA, 22 nt, Human
ugguuucucagacucuuugcag

SEQ ID NO: 576867 - RNA, 22 nt, Human
aaauaggagcuuaagcacuucu

SEQ ID NO: 576868 - RNA, 22 nt, Human
uccaguacaggucucucauuuc

SEQ ID NO: 576869 - RNA, 22 nt, Human
uaaauuguuuucuagaaguugu

SEQ ID NO: 576870 - RNA, 22 nt, Human
caggagccccaggcugacaaua

SEQ ID NO: 576871 - RNA, 22 nt, Human
agggcugaccuaagcuccacuu

SEQ ID NO: 576872 - RNA, 22 nt, Human
ucccagagcccaaguuggagag

SEQ ID NO: 576873 - RNA, 22 nt, Human
uccuuagcugugaaaugagaau

SEQ ID NO: 576874 - RNA, 22 nt, Human
guacaauaacuagucuuauagu

SEQ ID NO: 576875 - RNA, 22 nt, Human
uuauguuuuauggcuauaucau

SEQ ID NO: 576876 - RNA, 22 nt, Human
ugugucugaacuaguugcucuc

SEQ ID NO: 576877 - RNA, 22 nt, Human
ucagccucauuuucugcucugu

SEQ ID NO: 576878 - RNA, 22 nt, Human
agcuguguccugaagacacugc

SEQ ID NO: 576879 - RNA, 22 nt, Human
guuauauauaguauuucucuga

SEQ ID NO: 576880 - RNA, 22 nt, Human
aaaguacaaggaaaggaucuga

SEQ ID NO: 576881 - RNA, 22 nt, Human
aucaguuuguauaugaaacacu

SEQ ID NO: 576882 - RNA, 22 nt, Human
caggugggcugccucuccagcu

SEQ ID NO: 576883 - RNA, 22 nt, Human
ugccugcaagaguuggggcuac

SEQ ID NO: 576884 - RNA, 22 nt, Human
ugugucucuccuggaagcacgu

SEQ ID NO: 576885 - RNA, 22 nt, Human
cauuuacacacagaggugugcu

SEQ ID NO: 576886 - RNA, 22 nt, Human
ugagagugguucagcucagaag

SEQ ID NO: 576887 - RNA, 22 nt, Human
cagagaaacucagauagcugau

SEQ ID NO: 576888 - RNA, 22 nt, Human
guuccuaagcuguggcccugga

SEQ ID NO: 576889 - RNA, 21 nt, Human
acuuuacaauuuacauaguga

SEQ ID NO: 576890 - RNA, 17 nt, Human
agccugggaaggaguga

SEQ ID NO: 576891 - RNA, 22 nt, Human
gugaaggaggggccacagauau

SEQ ID NO: 576892 - RNA, 22 nt, Human
uuuaggaucucucuuguuacau

SEQ ID NO: 576893 - RNA, 22 nt, Human
uugcugaaguauugugaauccu

SEQ ID NO: 576894 - RNA, 22 nt, Human
aucugaaacucugacauugucu

SEQ ID NO: 576895 - RNA, 22 nt, Human
gacaaagccuaagaaguauuua

SEQ ID NO: 576896 - RNA, 22 nt, Human
gaguuagagccauagagcacgg

SEQ ID NO: 576897 - RNA, 17 nt, Human
uagcugccccgaaugcu

SEQ ID NO: 576898 - RNA, 22 nt, Human
ucuguauaaggacaaacauuua

SEQ ID NO: 576899 - RNA, 22 nt, Human
uauagaaguaagcauugugaug

SEQ ID NO: 576900 - RNA, 22 nt, Human
ggucagaacaaggguaaauaaa

SEQ ID NO: 576901 - RNA, 22 nt, Human
cugaggugaugucaaauggguu

SEQ ID NO: 576902 - RNA, 22 nt, Human
augcauucagcggaaugcuuag

SEQ ID NO: 576903 - RNA, 22 nt, Human
acauuucugcaucucagagcua

SEQ ID NO: 576904 - RNA, 22 nt, Human
ggcccuguuagagcucccacaa

SEQ ID NO: 576905 - RNA, 22 nt, Human
uagggaugagccaguggguagu

SEQ ID NO: 576906 - RNA, 22 nt, Human
ccaguguuuccgucaguacacg

SEQ ID NO: 576907 - RNA, 22 nt, Human
uccuggccaaguagauguggcg

SEQ ID NO: 576908 - RNA, 22 nt, Human
ucuggaguaauuacagugacug

SEQ ID NO: 576909 - RNA, 22 nt, Human
aaagcagcggugucuuuacugc

SEQ ID NO: 576910 - RNA, 22 nt, Human
cuuuuuccagcuucaggguggg

SEQ ID NO: 576911 - RNA, 22 nt, Human
acuuuguuuuauagcacauaag

SEQ ID NO: 576912 - RNA, 22 nt, Human
gagcccagguucugcuuccagc

SEQ ID NO: 576913 - RNA, 22 nt, Human
ucuucacugugaauuuguucuu

SEQ ID NO: 576914 - RNA, 22 nt, Human
ugccugaggagucagggcaggu

SEQ ID NO: 576915 - RNA, 22 nt, Human
uccugagaauagaguugcaugu

SEQ ID NO: 576916 - RNA, 22 nt, Human
cagagccaggccugcccucuuu

SEQ ID NO: 576917 - RNA, 22 nt, Human
acuuagcagguacuuucauauu

SEQ ID NO: 576918 - RNA, 23 nt, Human
uaguuacauuauugucagagcug

SEQ ID NO: 576919 - RNA, 22 nt, Human
aacaugugucuugcauuucuug

SEQ ID NO: 576920 - RNA, 22 nt, Human
cucuuucucgccgcccgcaguc

SEQ ID NO: 576921 - RNA, 22 nt, Human
gggcaugacuuuuggaguggga

SEQ ID NO: 576922 - RNA, 22 nt, Human
uccugaaaugugcacaugacau

SEQ ID NO: 576923 - RNA, 22 nt, Human
uugagguccaggugugggcagg

SEQ ID NO: 576924 - RNA, 22 nt, Human
cuuguauugcuguuuugcaucu

SEQ ID NO: 576925 - RNA, 22 nt, Human
uauugacagugacuauugguag

SEQ ID NO: 576926 - RNA, 22 nt, Human
caccagcuucccaucgcggguc

SEQ ID NO: 576927 - RNA, 22 nt, Human
gccuugaacucauguauauuga

SEQ ID NO: 576928 - RNA, 22 nt, Human
ggagaggaaaugccagcacuuc

SEQ ID NO: 576929 - RNA, 22 nt, Human
agaggccagguccagaguuugu

SEQ ID NO: 576930 - RNA, 22 nt, Human
guggcagaaacuggcagaggag

SEQ ID NO: 576931 - RNA, 22 nt, Human
ugagguggcuagggaggcacuc

SEQ ID NO: 576932 - RNA, 22 nt, Human
gaggcugagaguuuguucuacu

SEQ ID NO: 576933 - RNA, 22 nt, Human
gcaguguggccccaguaucacg

SEQ ID NO: 576934 - RNA, 21 nt, Human
ucaggaggcucagacuccugc

SEQ ID NO: 576935 - RNA, 22 nt, Human
uuuccacuccuauugcaucuca

SEQ ID NO: 576936 - RNA, 22 nt, Human
cugccugcugccuguggagggu

SEQ ID NO: 576937 - RNA, 22 nt, Human
gggugggauggcaggagccgcu

SEQ ID NO: 576938 - RNA, 19 nt, Human
uguguucauucaucagagg

SEQ ID NO: 576939 - RNA, 22 nt, Human
aggagccaaauuuuagacucug

SEQ ID NO: 576940 - RNA, 22 nt, Human
ggccaggagcugcacagggcuc

SEQ ID NO: 576941 - RNA, 23 nt, Human
guauuucagcauucucaguuaaa

SEQ ID NO: 576942 - RNA, 23 nt, Human
aaaaucuucugccuaugaagaaa

SEQ ID NO: 576943 - RNA, 22 nt, Human
gacuuuugaauaagguaggaua

SEQ ID NO: 576944 - RNA, 22 nt, Human
accugcccaugaaaauggggag

SEQ ID NO: 576945 - RNA, 22 nt, Human
uuuuccugggcuuucuguguaa

SEQ ID NO: 576946 - RNA, 21 nt, Human
aagauccaagcaggcacuugu

SEQ ID NO: 576947 - RNA, 22 nt, Human
gaagcugaggucaggugggugg

SEQ ID NO: 576948 - RNA, 22 nt, Human
uaaagugugcauggucaaauau

SEQ ID NO: 576949 - RNA, 22 nt, Human
auauacaguuuuacaggguuuc

SEQ ID NO: 576950 - RNA, 22 nt, Human
auuagaauuaugcuugcuaaug

SEQ ID NO: 576951 - RNA, 22 nt, Human
uccuaacugcccugggcaaggu

SEQ ID NO: 576952 - RNA, 22 nt, Human
uacaguauggaaaauguauagu

SEQ ID NO: 576953 - RNA, 22 nt, Human
ccugccugcagaaaguaucucc

SEQ ID NO: 576954 - RNA, 22 nt, Human
uucucuuacauuuucucagccu

SEQ ID NO: 576955 - RNA, 22 nt, Human
ccaggagagcucuaaauggcug

SEQ ID NO: 576956 - RNA, 22 nt, Human
uggccuggugucugcgaggccu

SEQ ID NO: 576957 - RNA, 23 nt, Human
cuuguauucacucauuugggaac

SEQ ID NO: 576958 - RNA, 21 nt, Human
aagggagauaggaaucaggcc

SEQ ID NO: 576959 - RNA, 22 nt, Human
agcucucugauaaauugauaaa

SEQ ID NO: 576960 - RNA, 22 nt, Human
aggggaaggccagccuguagag

SEQ ID NO: 576961 - RNA, 22 nt, Human
cugcagggcagggccuccuggc

SEQ ID NO: 576962 - RNA, 22 nt, Human
ugggagaacccagggucaggcu

SEQ ID NO: 576963 - RNA, 22 nt, Human
gcaggacuugaauccaggcagu

SEQ ID NO: 576964 - RNA, 22 nt, Human
caaaacauucagagagcucacu

SEQ ID NO: 576965 - RNA, 22 nt, Human
ccugggcaucaacaagcagaga

SEQ ID NO: 576966 - RNA, 22 nt, Human
uccaggucccagacugggcagc

SEQ ID NO: 576967 - RNA, 22 nt, Human
cagagcugagaauguugaugcu

SEQ ID NO: 576968 - RNA, 22 nt, Human
ucagccuccgaaagugcuggga

SEQ ID NO: 576969 - RNA, 22 nt, Human
aguguuucaagugaugcuuugg

SEQ ID NO: 576970 - RNA, 23 nt, Human
auuuuaaccuugacuaacaugca

SEQ ID NO: 576971 - RNA, 22 nt, Human
gcugcuucucugauggagucca

SEQ ID NO: 576972 - RNA, 22 nt, Human
cccaggcuggagugcaauggug

SEQ ID NO: 576973 - RNA, 22 nt, Human
uggccuggcccugaggcccugu

SEQ ID NO: 576974 - RNA, 22 nt, Human
ccacugccaugggcuaggcaug

SEQ ID NO: 576975 - RNA, 22 nt, Human
uucugucugauggugccagaac

SEQ ID NO: 576976 - RNA, 22 nt, Human
aauuuuauuaacuggauguagc

SEQ ID NO: 576977 - RNA, 22 nt, Human
uugauacaggcucuauuucauc

SEQ ID NO: 576978 - RNA, 23 nt, Human
gacagagugagaccuugucuuac

SEQ ID NO: 576979 - RNA, 22 nt, Human
auuacaauaauacaugcucauu

SEQ ID NO: 576980 - RNA, 22 nt, Human
cugucccucucacaccucacca

SEQ ID NO: 576981 - RNA, 22 nt, Human
auacaucuuccuuuuaaaaugc

SEQ ID NO: 576982 - RNA, 22 nt, Human
auuuuaauaagauccauuuggu

SEQ ID NO: 576983 - RNA, 22 nt, Human
ugggaugucuuuaggggaagag

SEQ ID NO: 576984 - RNA, 23 nt, Human
ggcagccucugacucugcuuugc

SEQ ID NO: 576985 - RNA, 22 nt, Human
ucucagaagugaucaggauguu

SEQ ID NO: 576986 - RNA, 21 nt, Human
agaccucuucccuucaugcac

SEQ ID NO: 576987 - RNA, 22 nt, Human
ucagggagaggugagagccugu

SEQ ID NO: 576988 - RNA, 22 nt, Human
ucccuggcuguguucaggugcg

SEQ ID NO: 576989 - RNA, 22 nt, Human
aucacuguggcccaaaaccuca

SEQ ID NO: 576990 - RNA, 22 nt, Human
ucuguggcacgauugcacugca

SEQ ID NO: 576991 - RNA, 22 nt, Human
ccaggcugugcuuuucauaaau

SEQ ID NO: 576992 - RNA, 22 nt, Human
ccacacugaaccucagugucuu

SEQ ID NO: 576993 - RNA, 22 nt, Human
cugauccuccuuuaaguagcug

SEQ ID NO: 576994 - RNA, 22 nt, Human
ucacacuggcagugcugaaggc

SEQ ID NO: 576995 - RNA, 19 nt, Human
gcauaaauacacuauuguc

SEQ ID NO: 576996 - RNA, 22 nt, Human
uagcauuuggcaccaguuauuu

SEQ ID NO: 576997 - RNA, 22 nt, Human
ucaggcugaccagguuuugcuc

SEQ ID NO: 576998 - RNA, 22 nt, Human
ucuucucuguggccugguggug

SEQ ID NO: 576999 - RNA, 22 nt, Human
uaacuucugcacagaaaauuug

SEQ ID NO: 577000 - RNA, 22 nt, Human
ccuccccugcucagaacucugg

SEQ ID NO: 577001 - RNA, 22 nt, Human
cauacuuuugcccugacauucu

SEQ ID NO: 577002 - RNA, 22 nt, Human
cucaggaguuggaggcuacagu

SEQ ID NO: 577003 - RNA, 22 nt, Human
gcaugcacgggcacauaugcua

SEQ ID NO: 577004 - RNA, 22 nt, Human
caucaaaucugacuuuucuucc

SEQ ID NO: 577005 - RNA, 22 nt, Human
agauccuuaauuuaaucacauc

SEQ ID NO: 577006 - RNA, 22 nt, Human
gaaggaggucugauacaauaug

SEQ ID NO: 577007 - RNA, 19 nt, Human
cuuauuucugguuuugggu

SEQ ID NO: 577008 - RNA, 22 nt, Human
agggaagccccgaggaggcacc

SEQ ID NO: 577009 - RNA, 22 nt, Human
cgugagcaaaauggacacuccc

SEQ ID NO: 577010 - RNA, 22 nt, Human
augaucucauucuuucaaaggg

SEQ ID NO: 577011 - RNA, 22 nt, Human
cagcucugugggagcguaugug

SEQ ID NO: 577012 - RNA, 22 nt, Human
aaagaguuuccauugacauuuc

SEQ ID NO: 577013 - RNA, 22 nt, Human
augaggcccaaacauuacaaau

SEQ ID NO: 577014 - RNA, 22 nt, Human
agcagcaggcuagggaacugcu

SEQ ID NO: 577015 - RNA, 22 nt, Human
uucuuaaucccacaaaucuuca

SEQ ID NO: 577016 - RNA, 21 nt, Human
cagagcugaaggguguagugu

SEQ ID NO: 577017 - RNA, 23 nt, Human
ucauucaaggcugguaucuuuca

SEQ ID NO: 577018 - RNA, 22 nt, Human
gaguuaaaggaaaauaacuuua

SEQ ID NO: 577019 - RNA, 22 nt, Human
ucacacuuagagcgaauuguuu

SEQ ID NO: 577020 - RNA, 22 nt, Human
caagauuugacuucgugguuug

SEQ ID NO: 577021 - RNA, 22 nt, Human
acuggcuucagggggaaagucc

SEQ ID NO: 577022 - RNA, 22 nt, Human
uaacaucaaacugcauuuucua

SEQ ID NO: 577023 - RNA, 22 nt, Human
cagcuuucugucucaugacuga

SEQ ID NO: 577024 - RNA, 22 nt, Human
aacagauaaguauaucuaugua

SEQ ID NO: 577025 - RNA, 22 nt, Human
ugucaaccagguauuuuggucu

SEQ ID NO: 577026 - RNA, 22 nt, Human
uaggggaggggaucaugugcug

SEQ ID NO: 577027 - RNA, 20 nt, Human
agggccuguugcaagcguuu

SEQ ID NO: 577028 - RNA, 18 nt, Human
cagagcaguaugaauguu

SEQ ID NO: 577029 - RNA, 21 nt, Human
uccagggaacuucucaggaau

SEQ ID NO: 577030 - RNA, 22 nt, Human
cugguccuaaagcccuacucca

SEQ ID NO: 577031 - RNA, 22 nt, Human
cuucagaauuccucagccucag

SEQ ID NO: 577032 - RNA, 22 nt, Human
ccacaguaagagauaguuuaug

SEQ ID NO: 577033 - RNA, 22 nt, Human
cuggcucaugugaugagggcaa

SEQ ID NO: 577034 - RNA, 22 nt, Human
cugugcccuguggcuggcaccu

SEQ ID NO: 577035 - RNA, 22 nt, Human
aaggacagaaacagauugcugg

SEQ ID NO: 577036 - RNA, 22 nt, Human
cuuuaugacugaguugucaauu

SEQ ID NO: 577037 - RNA, 18 nt, Human
acuggagcauuagcagcu

SEQ ID NO: 577038 - RNA, 22 nt, Human
uaugaguuuaaggcuaaaauag

SEQ ID NO: 577039 - RNA, 22 nt, Human
uucauacauuuuuacuaacagc

SEQ ID NO: 577040 - RNA, 22 nt, Human
uccuugagccguggccagggcc

SEQ ID NO: 577041 - RNA, 22 nt, Human
aucuuaaucgaguccaugaaaa

SEQ ID NO: 577042 - RNA, 22 nt, Human
caaggccacguucugcaugcgg

SEQ ID NO: 577043 - RNA, 22 nt, Human
aaauguuccggguaaggagaaa

SEQ ID NO: 577044 - RNA, 22 nt, Human
ggggaggaccuuuccaaggcuu

SEQ ID NO: 577045 - RNA, 22 nt, Human
ucagcuucaaauuuggugaagu

SEQ ID NO: 577046 - RNA, 22 nt, Human
ugaaagcagugccaugauuaug

SEQ ID NO: 577047 - RNA, 22 nt, Human
agagcuuagaauuucagaugau

SEQ ID NO: 577048 - RNA, 22 nt, Human
cagcucuggcgucagggagcga

SEQ ID NO: 577049 - RNA, 22 nt, Human
cuaaacaugaacuacauuuagg

SEQ ID NO: 577050 - RNA, 22 nt, Human
agccaaagaucagugugcaagu

SEQ ID NO: 577051 - RNA, 22 nt, Human
uucacagauguauuggaacucc

SEQ ID NO: 577052 - RNA, 22 nt, Human
gcaacaaguguaaacaugcauu

SEQ ID NO: 577053 - RNA, 22 nt, Human
uccugagggcucggggcucaug

SEQ ID NO: 577054 - RNA, 22 nt, Human
uuccuaacaagucuaucuuuga

SEQ ID NO: 577055 - RNA, 22 nt, Human
ggcugugggaugcauaggagcu

SEQ ID NO: 577056 - RNA, 22 nt, Human
gguuaaaaauaauuuacuuggc

SEQ ID NO: 577057 - RNA, 22 nt, Human
uccaggcuuuuucaugcugucu

SEQ ID NO: 577058 - RNA, 22 nt, Human
cacugucugagcuggugauuag

SEQ ID NO: 577059 - RNA, 22 nt, Human
guaagacaagcggacugccguu

SEQ ID NO: 577060 - RNA, 22 nt, Human
cugaaugagggauucugagggc

SEQ ID NO: 577061 - RNA, 22 nt, Human
ugcagugggccggaggccaggg

SEQ ID NO: 577062 - RNA, 22 nt, Human
cucuuaaugaccuuaauucaag

SEQ ID NO: 577063 - RNA, 21 nt, Human
aguuuuuacucuuaacugugg

SEQ ID NO: 577064 - RNA, 22 nt, Human
aucccugcccucauggagcuua

SEQ ID NO: 577065 - RNA, 22 nt, Human
aaagguuauuauuacuauuguc

SEQ ID NO: 577066 - RNA, 22 nt, Human
ucccuggggauguuggccugcc

SEQ ID NO: 577067 - RNA, 22 nt, Human
agucccagaugacccagcuacu

SEQ ID NO: 577068 - RNA, 21 nt, Human
cccaggaggcugagaagagca

SEQ ID NO: 577069 - RNA, 22 nt, Human
augauucuggcaaauuuauuau

SEQ ID NO: 577070 - RNA, 21 nt, Human
gacuggagagaggaagucugg

SEQ ID NO: 577071 - RNA, 22 nt, Human
agcaaauacuugaauaaaaaga

SEQ ID NO: 577072 - RNA, 17 nt, Human
auucucaguguacagug

SEQ ID NO: 577073 - RNA, 22 nt, Human
ggcuccugagaaugggccauca

SEQ ID NO: 577074 - RNA, 22 nt, Human
aguccaagaucaaggugucaac

SEQ ID NO: 577075 - RNA, 22 nt, Human
cucugagaugcuugaagaggau

SEQ ID NO: 577076 - RNA, 21 nt, Human
agauuacaggugugauccacc

SEQ ID NO: 577077 - RNA, 22 nt, Human
auaucacagguguuuaccugau

SEQ ID NO: 577078 - RNA, 22 nt, Human
acagucuaggccuaggucaaaa

SEQ ID NO: 577079 - RNA, 22 nt, Human
aaggccagcccuaaugaugcuc

SEQ ID NO: 577080 - RNA, 22 nt, Human
augaagacaaacgacguugcaa

SEQ ID NO: 577081 - RNA, 22 nt, Human
cagagccuggcgaugucaugga

SEQ ID NO: 577082 - RNA, 22 nt, Human
gacaggcaggccagggcugugg

SEQ ID NO: 577083 - RNA, 22 nt, Human
ugacccaucaggccacaugagg

SEQ ID NO: 577084 - RNA, 22 nt, Human
aaaauagccucacauaauugcu

SEQ ID NO: 577085 - RNA, 22 nt, Human
uuggaacagaaacagacaaaua

SEQ ID NO: 577086 - RNA, 21 nt, Human
cagcacaguacugggucuugc

SEQ ID NO: 577087 - RNA, 22 nt, Human
ggcaucuguccaucucuccagc

SEQ ID NO: 577088 - RNA, 22 nt, Human
ucacuguuaauaaauagcaaag

SEQ ID NO: 577089 - RNA, 22 nt, Human
uuauuuuaccuuccucugagcu

SEQ ID NO: 577090 - RNA, 22 nt, Human
ucuauuuacagaaagcagaauu

SEQ ID NO: 577091 - RNA, 22 nt, Human
cccagcucuuccugggagcuaa

SEQ ID NO: 577092 - RNA, 22 nt, Human
cacccagagccugagagggaua

SEQ ID NO: 577093 - RNA, 22 nt, Human
aucucauaaacacacauauaug

SEQ ID NO: 577094 - RNA, 22 nt, Human
ucucuuccauguuucagcccca

SEQ ID NO: 577095 - RNA, 22 nt, Human
cauuuuauccucugggaagcua

SEQ ID NO: 577096 - RNA, 18 nt, Human
auauccaauaaugaacac

SEQ ID NO: 577097 - RNA, 22 nt, Human
uggcagcugaggggaggcuuug

SEQ ID NO: 577098 - RNA, 22 nt, Human
cagaacuucauauugacguuag

SEQ ID NO: 577099 - RNA, 22 nt, Human
agagcagccugugaugaugcac

SEQ ID NO: 577100 - RNA, 20 nt, Human
cccaggagcugugccccauc

SEQ ID NO: 577101 - RNA, 20 nt, Human
acuuuggggucuuucucaga

SEQ ID NO: 577102 - RNA, 22 nt, Human
gagggaaacagauggguugugg

SEQ ID NO: 577103 - RNA, 18 nt, Human
gggugcaggcacugacug

SEQ ID NO: 577104 - RNA, 22 nt, Human
uucucuccuacccaguauccau

SEQ ID NO: 577105 - RNA, 22 nt, Human
uaggccaggacagagcuuccag

SEQ ID NO: 577106 - RNA, 22 nt, Human
aagcacccaauuuacagcaguu

SEQ ID NO: 577107 - RNA, 22 nt, Human
agagauguucauucagcauguu

SEQ ID NO: 577108 - RNA, 20 nt, Human
ucaaggacucccugggaaga

SEQ ID NO: 577109 - RNA, 23 nt, Human
acacauuuuucccguucugaggu

SEQ ID NO: 577110 - RNA, 22 nt, Human
uucuauuuuuguggaacuguag

SEQ ID NO: 577111 - RNA, 22 nt, Human
gauuauuuugugcaauaaucgg

SEQ ID NO: 577112 - RNA, 22 nt, Human
ucauacauaaauaagaguuuag

SEQ ID NO: 577113 - RNA, 22 nt, Human
uccuuggagguguucaucugcc

SEQ ID NO: 577114 - RNA, 17 nt, Human
ugaaacaccaagacugu

SEQ ID NO: 577115 - RNA, 22 nt, Human
uugacaaucccuguuagaagug

SEQ ID NO: 577116 - RNA, 22 nt, Human
agggcagccucucagccuaggu

SEQ ID NO: 577117 - RNA, 22 nt, Human
ggcuggaauguguggaugugau

SEQ ID NO: 577118 - RNA, 22 nt, Human
auggcagcauaguggcaaguua

SEQ ID NO: 577119 - RNA, 22 nt, Human
cuuccugggacaccuaacucua

SEQ ID NO: 577120 - RNA, 19 nt, Human
gggagcaggaaagcugugg

SEQ ID NO: 577121 - RNA, 22 nt, Human
cuguacaauguuaccuauuuau

SEQ ID NO: 577122 - RNA, 22 nt, Human
cauaacuugcuuuggagcccgg

SEQ ID NO: 577123 - RNA, 22 nt, Human
cuucaugagacuccacugccau

SEQ ID NO: 577124 - RNA, 22 nt, Human
ugcugagacaccuaagguaaau

SEQ ID NO: 577125 - RNA, 22 nt, Human
caggguuucaccauguuagcag

SEQ ID NO: 577126 - RNA, 22 nt, Human
uuccuucucagcccucgaggau

SEQ ID NO: 577127 - RNA, 22 nt, Human
gcagcugggccccagccucucc

SEQ ID NO: 577128 - RNA, 22 nt, Human
gcccagcccugaggucacagcu

SEQ ID NO: 577129 - RNA, 22 nt, Human
caggaaaucacucugauuuugg

SEQ ID NO: 577130 - RNA, 21 nt, Human
gggcagaggggccuccugggu

SEQ ID NO: 577131 - RNA, 21 nt, Human
guucaaauccugacacuacac

SEQ ID NO: 577132 - RNA, 22 nt, Human
ugcaugagcgaauguguccugu

SEQ ID NO: 577133 - RNA, 22 nt, Human
uccuuagcuuacaagucuucug

SEQ ID NO: 577134 - RNA, 22 nt, Human
ccagcucugcauguuucccuug

SEQ ID NO: 577135 - RNA, 22 nt, Human
augggcagaguggggacaggaa

SEQ ID NO: 577136 - RNA, 22 nt, Human
agcugcccuuaauaggcauuca

SEQ ID NO: 577137 - RNA, 22 nt, Human
acccaggagacggaggugcagu

SEQ ID NO: 577138 - RNA, 22 nt, Human
ucaguguuuuuaaagcaauaua

SEQ ID NO: 577139 - RNA, 22 nt, Human
aaauguaagucuuuguuucuua

SEQ ID NO: 577140 - RNA, 22 nt, Human
uaugaaaugauggggaaaauag

SEQ ID NO: 577141 - RNA, 22 nt, Human
uagcuucaugcuucaccacgcu

SEQ ID NO: 577142 - RNA, 22 nt, Human
uuuuauguuccugaagcuaucu

SEQ ID NO: 577143 - RNA, 22 nt, Human
gcugaggccccagggugauggg

SEQ ID NO: 577144 - RNA, 22 nt, Human
cagagguguacagagggaggcc

SEQ ID NO: 577145 - RNA, 22 nt, Human
agugaccauuuucagcuagagg

SEQ ID NO: 577146 - RNA, 22 nt, Human
ggcagagcuaguggcuucucuu

SEQ ID NO: 577147 - RNA, 22 nt, Human
cugaagcagggagugaugaagu

SEQ ID NO: 577148 - RNA, 22 nt, Human
ccugagguuuuuggauaguugu

SEQ ID NO: 577149 - RNA, 22 nt, Human
ugagccagccucagaagucacg

SEQ ID NO: 577150 - RNA, 22 nt, Human
uuugacagggugaugagguggu

SEQ ID NO: 577151 - RNA, 22 nt, Human
ucaggcuguaaauggugugggu

SEQ ID NO: 577152 - RNA, 22 nt, Human
ggagauggaauagauucugacu

SEQ ID NO: 577153 - RNA, 22 nt, Human
ucagcaagaagcugugggcuuc

SEQ ID NO: 577154 - RNA, 22 nt, Human
agaggcugcaggcuggaaauca

SEQ ID NO: 577155 - RNA, 22 nt, Human
cagcuggcagcccuggcccugc

SEQ ID NO: 577156 - RNA, 22 nt, Human
ugcucuaagaacucuaggaauu

SEQ ID NO: 577157 - RNA, 22 nt, Human
gcucugcuugcaucaugacugc

SEQ ID NO: 577158 - RNA, 22 nt, Human
ggaugggugacuuugggcaaug

SEQ ID NO: 577159 - RNA, 22 nt, Human
gcaguacuuuaagggaugaagc

SEQ ID NO: 577160 - RNA, 22 nt, Human
ucauauaacuggauauuuucaa

SEQ ID NO: 577161 - RNA, 22 nt, Human
ucacacaggguucuggucucau

SEQ ID NO: 577162 - RNA, 22 nt, Human
uguggggcuuacaaaggcagau

SEQ ID NO: 577163 - RNA, 19 nt, Human
ggcugcagagccccggcgc

SEQ ID NO: 577164 - RNA, 20 nt, Human
gaaaauaggccagccaggua

SEQ ID NO: 577165 - RNA, 22 nt, Human
uuaauuuugaugagguucaguu

SEQ ID NO: 577166 - RNA, 20 nt, Human
uuuuccuuguugccgcugcu

SEQ ID NO: 577167 - RNA, 22 nt, Human
gacacaggggggcgcuagaaga

SEQ ID NO: 577168 - RNA, 22 nt, Human
gcaaugcauauguggguagcau

SEQ ID NO: 577169 - RNA, 22 nt, Human
ucccaggaugugcgugccgccg

SEQ ID NO: 577170 - RNA, 22 nt, Human
aaaguucuucauuuuuauugga

SEQ ID NO: 577171 - RNA, 22 nt, Human
gcuggagccauuggcuuggccu

SEQ ID NO: 577172 - RNA, 22 nt, Human
ggagugaagcaaauaaugcugg

SEQ ID NO: 577173 - RNA, 22 nt, Human
aggcuggagugcaauggcguga

SEQ ID NO: 577174 - RNA, 22 nt, Human
gacaggccaggggcugaggugg

SEQ ID NO: 577175 - RNA, 19 nt, Human
ucugugcugggaggcagca

SEQ ID NO: 577176 - RNA, 22 nt, Human
ugggccacggggguggagagcu

SEQ ID NO: 577177 - RNA, 22 nt, Human
ccaugccagcugcuaggucaca

SEQ ID NO: 577178 - RNA, 22 nt, Human
aacuguaauuuuuacauaguaa

SEQ ID NO: 577179 - RNA, 22 nt, Human
uucaagucuggagaucuggaac

SEQ ID NO: 577180 - RNA, 22 nt, Human
ggccugaaugccugaguguggg

SEQ ID NO: 577181 - RNA, 20 nt, Human
cuccaggggaagagccuucc

SEQ ID NO: 577182 - RNA, 22 nt, Human
cccaggcuggaauuccaggccu

SEQ ID NO: 577183 - RNA, 22 nt, Human
ggggauggauuccgggucccug

SEQ ID NO: 577184 - RNA, 22 nt, Human
caugccaacaacaagcaaugag

SEQ ID NO: 577185 - RNA, 22 nt, Human
ucuggcagugauuucugugauc

SEQ ID NO: 577186 - RNA, 22 nt, Human
uguguucuccuacagauaagga

SEQ ID NO: 577187 - RNA, 22 nt, Human
gcucuggcuaguuaccucuuac

SEQ ID NO: 577188 - RNA, 22 nt, Human
acugggccuguacagagaaaac

SEQ ID NO: 577189 - RNA, 22 nt, Human
aagaccucugaaguaccuggug

SEQ ID NO: 577190 - RNA, 22 nt, Human
gugcccagugcaggcccgcagg

SEQ ID NO: 577191 - RNA, 22 nt, Human
cuggggcagagcccagcaauuu

SEQ ID NO: 577192 - RNA, 22 nt, Human
uuggccuccacauuuuccaggu

SEQ ID NO: 577193 - RNA, 22 nt, Human
gcaggcacaugggcgggucugg

SEQ ID NO: 577194 - RNA, 22 nt, Human
gccccacuguggaaccuaaguc

SEQ ID NO: 577195 - RNA, 23 nt, Human
gccagccuugcucuccugcagcc

SEQ ID NO: 577196 - RNA, 22 nt, Human
ccagccagccuugaucugagua

SEQ ID NO: 577197 - RNA, 22 nt, Human
agaugaaauuuguguugaguug

SEQ ID NO: 577198 - RNA, 22 nt, Human
agggcccucuggcaggccaggc

SEQ ID NO: 577199 - RNA, 22 nt, Human
gugcaaaaguaauugcaguuuu

SEQ ID NO: 577200 - RNA, 19 nt, Human
cagaguacaccagauagga

SEQ ID NO: 577201 - RNA, 22 nt, Human
ugcaggccggcccuaggccuca

SEQ ID NO: 577202 - RNA, 22 nt, Human
aggaaauugagaaucagaauaa

SEQ ID NO: 577203 - RNA, 22 nt, Human
ugcauuucagaagaaaauucgg

SEQ ID NO: 577204 - RNA, 22 nt, Human
cuuuaguuaguagauaauggca

SEQ ID NO: 577205 - RNA, 22 nt, Human
aucaaaauggaagaauuuggcu

SEQ ID NO: 577206 - RNA, 23 nt, Human
ucccucaggccuuaucuccaucu

SEQ ID NO: 577207 - RNA, 22 nt, Human
agcagcaggcuguguggacuga

SEQ ID NO: 577208 - RNA, 22 nt, Human
acauuuuucacauuuguagggu

SEQ ID NO: 577209 - RNA, 22 nt, Human
cuucauaaacucagaaggcagc

SEQ ID NO: 577210 - RNA, 22 nt, Human
auauuuguuagagucuaugugu

SEQ ID NO: 577211 - RNA, 21 nt, Human
gucauccaccucucgggcucu

SEQ ID NO: 577212 - RNA, 22 nt, Human
uuauggaaaacuccagagagua

SEQ ID NO: 577213 - RNA, 22 nt, Human
gugucccacucuggaggugaag

SEQ ID NO: 577214 - RNA, 22 nt, Human
uccugcagagccgcccucaggu

SEQ ID NO: 577215 - RNA, 22 nt, Human
acaggcaagaggaaagcaagua

SEQ ID NO: 577216 - RNA, 22 nt, Human
auuuuuuagaaccuggccugau

SEQ ID NO: 577217 - RNA, 18 nt, Human
acuaugcugaauaaaugg

SEQ ID NO: 577218 - RNA, 20 nt, Human
agauuauuccuaagauuucu

SEQ ID NO: 577219 - RNA, 22 nt, Human
cugggccuggggcuguugagag

SEQ ID NO: 577220 - RNA, 22 nt, Human
ucaagacagauggguaacuugg

SEQ ID NO: 577221 - RNA, 22 nt, Human
aucuuucaaucaggaaaaaucu

SEQ ID NO: 577222 - RNA, 23 nt, Human
ugcuggaguuuacucaggccagc

SEQ ID NO: 577223 - RNA, 21 nt, Human
uccugggagucugagauccug

SEQ ID NO: 577224 - RNA, 20 nt, Human
uuucaaaggcaccuaugaag

SEQ ID NO: 577225 - RNA, 22 nt, Human
ccccuccuggccacacugucag

SEQ ID NO: 577226 - RNA, 22 nt, Human
cuaggcacucacguggcuuuag

SEQ ID NO: 577227 - RNA, 22 nt, Human
agacuguaauugacaugucagc

SEQ ID NO: 577228 - RNA, 22 nt, Human
gcugaggccaguuuaaugagga

SEQ ID NO: 577229 - RNA, 22 nt, Human
cagaguggugcaagggcagugu

SEQ ID NO: 577230 - RNA, 22 nt, Human
aagcaacugccuucaauauuua

SEQ ID NO: 577231 - RNA, 22 nt, Human
acaauguagaguaaaauauguu

SEQ ID NO: 577232 - RNA, 22 nt, Human
aggcaucucucugcuucugagc

SEQ ID NO: 577233 - RNA, 22 nt, Human
gggacaggcugagacuugagcu

SEQ ID NO: 577234 - RNA, 22 nt, Human
agcauccagaaaacucucagaa

SEQ ID NO: 577235 - RNA, 22 nt, Human
cagagcugacccaaggauugaa

SEQ ID NO: 577236 - RNA, 22 nt, Human
cagagguagaacuggcccucac

SEQ ID NO: 577237 - RNA, 22 nt, Human
cuacagcagagcuacacuaacu

SEQ ID NO: 577238 - RNA, 22 nt, Human
ugcaguggaaucuggagagcag

SEQ ID NO: 577239 - RNA, 22 nt, Human
uggagguguauaagguagcuuc

SEQ ID NO: 577240 - RNA, 22 nt, Human
aauaguuugaauuuaucagaug

SEQ ID NO: 577241 - RNA, 22 nt, Human
guagaaaaagcaguaagucuca

SEQ ID NO: 577242 - RNA, 22 nt, Human
auuuuacuuaguguaaugucca

SEQ ID NO: 577243 - RNA, 21 nt, Human
uuagcuuucuagaaucuuugu

SEQ ID NO: 577244 - RNA, 22 nt, Human
ucuccagggugagcuaggccag

SEQ ID NO: 577245 - RNA, 22 nt, Human
accagagcuuacaugcuagaaa

SEQ ID NO: 577246 - RNA, 21 nt, Human
uuuauuaacaacuguggacgu

SEQ ID NO: 577247 - RNA, 22 nt, Human
uuggcugaugcaagagcuuccu

SEQ ID NO: 577248 - RNA, 22 nt, Human
uccagccaugacucggacagug

SEQ ID NO: 577249 - RNA, 22 nt, Human
auccaaaggugacacagaauac

SEQ ID NO: 577250 - RNA, 19 nt, Human
acacagggaucagaggguu

SEQ ID NO: 577251 - RNA, 22 nt, Human
uaagacauguccaggcugugag

SEQ ID NO: 577252 - RNA, 22 nt, Human
uucauuugggaugagucagaag

SEQ ID NO: 577253 - RNA, 22 nt, Human
gcagcagcucugaaugggcccc

SEQ ID NO: 577254 - RNA, 22 nt, Human
caguuuuaaauuguuagauaau

SEQ ID NO: 577255 - RNA, 22 nt, Human
uuucagagagaucaacauagcu

SEQ ID NO: 577256 - RNA, 22 nt, Human
gugguaggcacagagaacaaga

SEQ ID NO: 577257 - RNA, 22 nt, Human
cagccugcccuggaagcccagc

SEQ ID NO: 577258 - RNA, 22 nt, Human
agcagccacccagcugcucauu

SEQ ID NO: 577259 - RNA, 22 nt, Human
gcaguguuuuacagaccagcau

SEQ ID NO: 577260 - RNA, 22 nt, Human
uuuucucuauauugucugugaa

SEQ ID NO: 577261 - RNA, 22 nt, Human
cagguucagcaggaggcauccc

SEQ ID NO: 577262 - RNA, 20 nt, Human
aaguuacauuguauuguacc

SEQ ID NO: 577263 - RNA, 22 nt, Human
gacuuuccagguccugggcuau

SEQ ID NO: 577264 - RNA, 22 nt, Human
gaucuccuggacgucuuguuaa

SEQ ID NO: 577265 - RNA, 22 nt, Human
uuugugaagggaacagaagugu

SEQ ID NO: 577266 - RNA, 22 nt, Human
aagaugcgguugaccauggugu

SEQ ID NO: 577267 - RNA, 22 nt, Human
guuuguaauuaccucuuuugac

SEQ ID NO: 577268 - RNA, 18 nt, Human
ggauaggaccuuaggcag

SEQ ID NO: 577269 - RNA, 22 nt, Human
acaaaugauuuuccaagccagu

SEQ ID NO: 577270 - RNA, 22 nt, Human
cuggcuggccauguagagauga

SEQ ID NO: 577271 - RNA, 22 nt, Human
uuuuuugucuugaagaaauggu

SEQ ID NO: 577272 - RNA, 22 nt, Human
aguucuaauugcguuuucuugc

SEQ ID NO: 577273 - RNA, 22 nt, Human
auccuuaagaaaguuuucuaua

SEQ ID NO: 577274 - RNA, 22 nt, Human
cugccugcuuuucugggagccg

SEQ ID NO: 577275 - RNA, 22 nt, Human
gcucugagaggaugcugagcag

SEQ ID NO: 577276 - RNA, 22 nt, Human
caaugucagucaagcagcaaau

SEQ ID NO: 577277 - RNA, 22 nt, Human
cagccaggcccccgagucguug

SEQ ID NO: 577278 - RNA, 22 nt, Human
uugggcucaggaguuugagacc

SEQ ID NO: 577279 - RNA, 22 nt, Human
cagagcccagggccuacguccc

SEQ ID NO: 577280 - RNA, 22 nt, Human
ucagacagaaagaugaguaugg

SEQ ID NO: 577281 - RNA, 22 nt, Human
gcucugcuguguuuguucagca

SEQ ID NO: 577282 - RNA, 22 nt, Human
agagccccugggucacacagcc

SEQ ID NO: 577283 - RNA, 22 nt, Human
agugaaaacacuaguucuugcc

SEQ ID NO: 577284 - RNA, 22 nt, Human
ugggcccugacuucaagcaucc

SEQ ID NO: 577285 - RNA, 22 nt, Human
cugcuuaaaaugcagauucugu

SEQ ID NO: 577286 - RNA, 22 nt, Human
cuaaagaagcuagcaaucuaua

SEQ ID NO: 577287 - RNA, 22 nt, Human
aagcuucagugugagcauguaa

SEQ ID NO: 577288 - RNA, 22 nt, Human
aggcugcuucuuguccuuggca

SEQ ID NO: 577289 - RNA, 22 nt, Human
cuacuuuaauuuucugcagaga

SEQ ID NO: 577290 - RNA, 22 nt, Human
uggcagaguucgcuccuauuca

SEQ ID NO: 577291 - RNA, 22 nt, Human
aauauagcauuguaugacugug

SEQ ID NO: 577292 - RNA, 22 nt, Human
uaaaaaguagugagaauggcgc

SEQ ID NO: 577293 - RNA, 22 nt, Human
cccuguggaggcagcauccugc

SEQ ID NO: 577294 - RNA, 22 nt, Human
ucaaaaguggccuguaaaaucu

SEQ ID NO: 577295 - RNA, 22 nt, Human
cgugggaguggugggugcucag

SEQ ID NO: 577296 - RNA, 22 nt, Human
aggccuggccccaguugcuagg

SEQ ID NO: 577297 - RNA, 22 nt, Human
ugccaggcugaacagggucuua

SEQ ID NO: 577298 - RNA, 17 nt, Human
gcagaaaagucaaggga

SEQ ID NO: 577299 - RNA, 22 nt, Human
uccugggacucaacuuagaagg

SEQ ID NO: 577300 - RNA, 22 nt, Human
ucacugacguggggcuacuuga

SEQ ID NO: 577301 - RNA, 22 nt, Human
uauauacuaugcgauuccugcc

SEQ ID NO: 577302 - RNA, 22 nt, Human
uuacuuacagacaguagacucu

SEQ ID NO: 577303 - RNA, 22 nt, Human
auccaaagaaugcuuagaccug

SEQ ID NO: 577304 - RNA, 22 nt, Human
aagcagugcgcucaucuaaggg

SEQ ID NO: 577305 - RNA, 22 nt, Human
ucagcaggcugucagcaggggc

SEQ ID NO: 577306 - RNA, 22 nt, Human
gaagggugugugugagggacac

SEQ ID NO: 577307 - RNA, 22 nt, Human
cuuuuuguuguccacacuagga

SEQ ID NO: 577308 - RNA, 22 nt, Human
ugauagaaucagauaaaaggau

SEQ ID NO: 577309 - RNA, 22 nt, Human
augucuuuauuaauaucaugcc

SEQ ID NO: 577310 - RNA, 22 nt, Human
ccugggcuggaguacagcagug

SEQ ID NO: 577311 - RNA, 22 nt, Human
cagcuggccccacaguagaggc

SEQ ID NO: 577312 - RNA, 23 nt, Human
uucugaaaauagauaguggcucc

SEQ ID NO: 577313 - RNA, 20 nt, Human
ugcucuggaaauggucugag

SEQ ID NO: 577314 - RNA, 22 nt, Human
uuuuaucaaucauuaagacauu

SEQ ID NO: 577315 - RNA, 22 nt, Human
acacugaauauacaaugaauau

SEQ ID NO: 577316 - RNA, 22 nt, Human
uauauagaaaagcagauguugg

SEQ ID NO: 577317 - RNA, 22 nt, Human
gaaggggaaaguugagcaaaua

SEQ ID NO: 577318 - RNA, 23 nt, Human
cccagcuuucccacugccgagag

SEQ ID NO: 577319 - RNA, 22 nt, Human
uuucuucuccauggcagguccu

SEQ ID NO: 577320 - RNA, 22 nt, Human
gcuucaggaggucggucuccuu

SEQ ID NO: 577321 - RNA, 22 nt, Human
aagggcuggaauaucucuuaga

SEQ ID NO: 577322 - RNA, 22 nt, Human
aacacugugcuccccaggcugu

SEQ ID NO: 577323 - RNA, 22 nt, Human
gggagcgggacugcgcaggcuu

SEQ ID NO: 577324 - RNA, 20 nt, Human
aggcugagggugauuguguc

SEQ ID NO: 577325 - RNA, 22 nt, Human
gcucuaacuauuaagaggucau

SEQ ID NO: 577326 - RNA, 22 nt, Human
acaccagggccuagccagggcg

SEQ ID NO: 577327 - RNA, 22 nt, Human
caggcauggaaaagcccagagg

SEQ ID NO: 577328 - RNA, 22 nt, Human
cucuguguuccggguugcugcu

SEQ ID NO: 577329 - RNA, 22 nt, Human
aagacuuucuguaaagcuacag

SEQ ID NO: 577330 - RNA, 22 nt, Human
aggacuggugccagacaaggua

SEQ ID NO: 577331 - RNA, 22 nt, Human
uguagaaccuguuuauuauaga

SEQ ID NO: 577332 - RNA, 22 nt, Human
aacacaguuuuccaaaauagag

SEQ ID NO: 577333 - RNA, 23 nt, Human
uguauacacccugugcaucuggg

SEQ ID NO: 577334 - RNA, 22 nt, Human
gccaggaggcuuaacuggacag

SEQ ID NO: 577335 - RNA, 16 nt, Human
ugaggccagccauuuc

SEQ ID NO: 577336 - RNA, 22 nt, Human
auaugaauuuggcuggaaaggu

SEQ ID NO: 577337 - RNA, 22 nt, Human
auuccauuguauguguagacua

SEQ ID NO: 577338 - RNA, 22 nt, Human
ggagccagggaagcugcuuccu

SEQ ID NO: 577339 - RNA, 22 nt, Human
gcagugaagauggcagguuggg

SEQ ID NO: 577340 - RNA, 22 nt, Human
ucuguuauggaaguuuccuuuu

SEQ ID NO: 577341 - RNA, 22 nt, Human
gggaaacucaggcauuuccacu

SEQ ID NO: 577342 - RNA, 22 nt, Human
auguuucaccagcaaauuaccu

SEQ ID NO: 577343 - RNA, 19 nt, Human
caaguucuggagauuaggg

SEQ ID NO: 577344 - RNA, 22 nt, Human
agcagcugagaugguaagauuc

SEQ ID NO: 577345 - RNA, 22 nt, Human
uguuucaugaagucuggauauc

SEQ ID NO: 577346 - RNA, 22 nt, Human
cugaaaggguuacauaguaagu

SEQ ID NO: 577347 - RNA, 22 nt, Human
guccugugaccugcauccugag

SEQ ID NO: 577348 - RNA, 20 nt, Human
cuguggcaucugucauggug

SEQ ID NO: 577349 - RNA, 22 nt, Human
uuauguaaguggagucauauag

SEQ ID NO: 577350 - RNA, 22 nt, Human
cuccagguuacuuagccuagcu

SEQ ID NO: 577351 - RNA, 23 nt, Human
aaaaaaccauguaggcacucagu

SEQ ID NO: 577352 - RNA, 22 nt, Human
uuuaccaagcuuuaauuacaua

SEQ ID NO: 577353 - RNA, 22 nt, Human
uggacucuaagcagaggaucua

SEQ ID NO: 577354 - RNA, 22 nt, Human
gaacaaugagucauucagguga

SEQ ID NO: 577355 - RNA, 22 nt, Human
aacacagaucaaaauauuuccu

SEQ ID NO: 577356 - RNA, 22 nt, Human
ugcuggcugcagugcugucaaa

SEQ ID NO: 577357 - RNA, 22 nt, Human
caggcagcuagauuuauaacaa

SEQ ID NO: 577358 - RNA, 23 nt, Human
uuuagcuucccuuuaguuagggg

SEQ ID NO: 577359 - RNA, 22 nt, Human
gaagcugacccaggagcgugug

SEQ ID NO: 577360 - RNA, 22 nt, Human
aucugggcucgaauccuagcuc

SEQ ID NO: 577361 - RNA, 22 nt, Human
guggccagugggaaugggcuca

SEQ ID NO: 577362 - RNA, 22 nt, Human
cccagguccccaccugucugcu

SEQ ID NO: 577363 - RNA, 22 nt, Human
cacccuguacaaauggacaucu

SEQ ID NO: 577364 - RNA, 22 nt, Human
cacuuuaugggaagcaaaaauu

SEQ ID NO: 577365 - RNA, 22 nt, Human
caguuuuaucaucugugaaaug

SEQ ID NO: 577366 - RNA, 22 nt, Human
cccugccugugggcaucaacau

SEQ ID NO: 577367 - RNA, 22 nt, Human
uccagcagaccaucaaggcuca

SEQ ID NO: 577368 - RNA, 22 nt, Human
cgagcagagcagagacgucugg

SEQ ID NO: 577369 - RNA, 22 nt, Human
accccaggucuccaggcucugg

SEQ ID NO: 577370 - RNA, 22 nt, Human
aaacugugaagcaaguacaagg

SEQ ID NO: 577371 - RNA, 22 nt, Human
aggccagguggucaugcuugcu

SEQ ID NO: 577372 - RNA, 22 nt, Human
agucucuuggcauucugaaaca

SEQ ID NO: 577373 - RNA, 22 nt, Human
cccagccaaggugcugguguug

SEQ ID NO: 577374 - RNA, 22 nt, Human
ucugcucagugcuuaucucuaa

SEQ ID NO: 577375 - RNA, 22 nt, Human
cccuuagcucaauuucuugccc

SEQ ID NO: 577376 - RNA, 22 nt, Human
aggcaauccucuuacagauggg

SEQ ID NO: 577377 - RNA, 22 nt, Human
cagggcacaguuauggaggugg

SEQ ID NO: 577378 - RNA, 22 nt, Human
cugugccuccagucucgcuucu

SEQ ID NO: 577379 - RNA, 22 nt, Human
uuuacaagucagggacuguucu

SEQ ID NO: 577380 - RNA, 22 nt, Human
cagagguacagccauugaagau

SEQ ID NO: 577381 - RNA, 22 nt, Human
aagaacuaucucuggcuguagg

SEQ ID NO: 577382 - RNA, 22 nt, Human
agcauggggcuccgcaaugaac

SEQ ID NO: 577383 - RNA, 22 nt, Human
ugagcugucaagguacagugaa

SEQ ID NO: 577384 - RNA, 22 nt, Human
ggagcccucaccggcgagugcc

SEQ ID NO: 577385 - RNA, 22 nt, Human
gaaaggagggaaacagagcggu

SEQ ID NO: 577386 - RNA, 22 nt, Human
ucauuucuccuaagugaaauau

SEQ ID NO: 577387 - RNA, 22 nt, Human
cuguguagccucaugugggcuu

SEQ ID NO: 577388 - RNA, 22 nt, Human
auggcagccugaacacuuccug

SEQ ID NO: 577389 - RNA, 22 nt, Human
agcccagguggagugugugggg

SEQ ID NO: 577390 - RNA, 22 nt, Human
ugcagggaacuuggacagcuag

SEQ ID NO: 577391 - RNA, 22 nt, Human
cccuggaguccuggcaguugau

SEQ ID NO: 577392 - RNA, 22 nt, Human
agcugcuccuuuccugcaggcg

SEQ ID NO: 577393 - RNA, 22 nt, Human
aaaaaucuaugacugcuucucc

SEQ ID NO: 577394 - RNA, 22 nt, Human
uaaguguuucuccagugucuuu

SEQ ID NO: 577395 - RNA, 22 nt, Human
gcugccucaggcaccuccuggc

SEQ ID NO: 577396 - RNA, 22 nt, Human
aacuagagcuuccagcuucuug

SEQ ID NO: 577397 - RNA, 22 nt, Human
aucagcaagcauuuauugagug

SEQ ID NO: 577398 - RNA, 22 nt, Human
ccuggcuccagcugccuguccu

SEQ ID NO: 577399 - RNA, 22 nt, Human
gugugugugcaucucuuuuauu

SEQ ID NO: 577400 - RNA, 22 nt, Human
uuguuuucuuguauauagccuc

SEQ ID NO: 577401 - RNA, 22 nt, Human
auaacaugaccugugcuucaca

SEQ ID NO: 577402 - RNA, 22 nt, Human
ugggcagagucauacaggagac

SEQ ID NO: 577403 - RNA, 17 nt, Human
ggcagcugugugcaugc

SEQ ID NO: 577404 - RNA, 22 nt, Human
uggaauuuuguauuagcuuuga

SEQ ID NO: 577405 - RNA, 22 nt, Human
cacauuuagagguuagcauggu

SEQ ID NO: 577406 - RNA, 21 nt, Human
aaagagacaaauggcauauac

SEQ ID NO: 577407 - RNA, 22 nt, Human
aauucaaauuacaauaguuguu

SEQ ID NO: 577408 - RNA, 20 nt, Human
ccugugugguuugcacuaca

SEQ ID NO: 577409 - RNA, 22 nt, Human
ugguggcaugauagugugaaug

SEQ ID NO: 577410 - RNA, 22 nt, Human
gacagcuguggagaggcaugug

SEQ ID NO: 577411 - RNA, 22 nt, Human
gggaugcagacuacagggcuua

SEQ ID NO: 577412 - RNA, 21 nt, Human
gggcuggaggaugggaagccc

SEQ ID NO: 577413 - RNA, 22 nt, Human
uccccucucugcgcucccaggu

SEQ ID NO: 577414 - RNA, 22 nt, Human
aaauauguaagauuagcacuag

SEQ ID NO: 577415 - RNA, 20 nt, Human
aaguuugccccaggaaauug

SEQ ID NO: 577416 - RNA, 22 nt, Human
cagcugagaccagaaugcaggu

SEQ ID NO: 577417 - RNA, 22 nt, Human
guggaagggacugccuagagga

SEQ ID NO: 577418 - RNA, 23 nt, Human
ugugaagguggguccaagggcug

SEQ ID NO: 577419 - RNA, 22 nt, Human
ugagaacauugggaaagcuaug

SEQ ID NO: 577420 - RNA, 22 nt, Human
ucuggagucuaaagaaccaaaa

SEQ ID NO: 577421 - RNA, 22 nt, Human
guauggaaguauaaguuuugaa

SEQ ID NO: 577422 - RNA, 22 nt, Human
cccagggacucgggauucuagg

SEQ ID NO: 577423 - RNA, 22 nt, Human
aggcacuguggaagacaugguu

SEQ ID NO: 577424 - RNA, 22 nt, Human
auguuauuuuggaaaauacaaa

SEQ ID NO: 577425 - RNA, 22 nt, Human
gccaggagggaaaggacaauuu

SEQ ID NO: 577426 - RNA, 22 nt, Human
agggccagaggcaccuugcagc

SEQ ID NO: 577427 - RNA, 22 nt, Human
acugugugacuguuauuacugu

SEQ ID NO: 577428 - RNA, 22 nt, Human
uuauuugccagaauuucucuug

SEQ ID NO: 577429 - RNA, 22 nt, Human
uugggaaauauggauuguuauu

SEQ ID NO: 577430 - RNA, 17 nt, Human
cuccuggccaccccucu

SEQ ID NO: 577431 - RNA, 22 nt, Human
ucaggggcagcugugcuuugug

SEQ ID NO: 577432 - RNA, 22 nt, Human
ugguccaugcccacggaaugug

SEQ ID NO: 577433 - RNA, 22 nt, Human
gaauuucaaagagguuaagagg

SEQ ID NO: 577434 - RNA, 22 nt, Human
aggccaggccuuucuccauucc

SEQ ID NO: 577435 - RNA, 22 nt, Human
gggacagaggcaaacuagcaga

SEQ ID NO: 577436 - RNA, 22 nt, Human
acagggcuuuuaaucaguaguu

SEQ ID NO: 577437 - RNA, 21 nt, Human
cagugcucaggaauagagaga

SEQ ID NO: 577438 - RNA, 19 nt, Human
aguguucugaguacuccuc

SEQ ID NO: 577439 - RNA, 22 nt, Human
agggcuggagccacagcuggga

SEQ ID NO: 577440 - RNA, 22 nt, Human
gccuggcaaggcccuguugacu

SEQ ID NO: 577441 - RNA, 22 nt, Human
auguuacugugaucaugauacu

SEQ ID NO: 577442 - RNA, 22 nt, Human
aggaggccgggauucuggagau

SEQ ID NO: 577443 - RNA, 22 nt, Human
aaggcagauauaaagacuagag

SEQ ID NO: 577444 - RNA, 22 nt, Human
acucauuuuauaacacuguagu

SEQ ID NO: 577445 - RNA, 22 nt, Human
ugggccucccaugucuuaggga

SEQ ID NO: 577446 - RNA, 22 nt, Human
ugcccugggaguuggagcugcu

SEQ ID NO: 577447 - RNA, 22 nt, Human
uccugggcugcagggaagagca

SEQ ID NO: 577448 - RNA, 21 nt, Human
ggcugagauggcagaaucacc

SEQ ID NO: 577449 - RNA, 22 nt, Human
gcccugaguugagccuuccaaa

SEQ ID NO: 577450 - RNA, 22 nt, Human
guaaaauugcaauuacuuuugc

SEQ ID NO: 577451 - RNA, 22 nt, Human
uagcauuuggacauugucaccu

SEQ ID NO: 577452 - RNA, 22 nt, Human
caggugaggcugaacagaugaa

SEQ ID NO: 577453 - RNA, 22 nt, Human
auacaucauuuaugaugugugu

SEQ ID NO: 577454 - RNA, 21 nt, Human
ccaaagaacugccauuuguca

SEQ ID NO: 577455 - RNA, 22 nt, Human
cacagaggaaaugacuuucuua

SEQ ID NO: 577456 - RNA, 22 nt, Human
uucugugucuucuuguucugug

SEQ ID NO: 577457 - RNA, 22 nt, Human
gucugggguacuuucaucugau

SEQ ID NO: 577458 - RNA, 22 nt, Human
cagaaacuucuggugucaaaua

SEQ ID NO: 577459 - RNA, 20 nt, Human
gggagacagggccagugucc

SEQ ID NO: 577460 - RNA, 22 nt, Human
agaaaggaggaagaaugaccuc

SEQ ID NO: 577461 - RNA, 22 nt, Human
aaaugaacucuuccugcauccc

SEQ ID NO: 577462 - RNA, 22 nt, Human
cauuacauuucaaaauguuucc

SEQ ID NO: 577463 - RNA, 22 nt, Human
agcugcuuagaguccucaggau

SEQ ID NO: 577464 - RNA, 22 nt, Human
agagccuguuuugugggagaug

SEQ ID NO: 577465 - RNA, 22 nt, Human
gagcccuggcagucugggaugg

SEQ ID NO: 577466 - RNA, 22 nt, Human
acuucccaggugguguggaguu

SEQ ID NO: 577467 - RNA, 22 nt, Human
caggagcugggucuggaagcag

SEQ ID NO: 577468 - RNA, 22 nt, Human
cagaggcugacaaaauauugcu

SEQ ID NO: 577469 - RNA, 22 nt, Human
gggguggaucaggcaggcccag

SEQ ID NO: 577470 - RNA, 22 nt, Human
uuguuagcugaucuugagugca

SEQ ID NO: 577471 - RNA, 22 nt, Human
uuagcuguggaagcuucagcca

SEQ ID NO: 577472 - RNA, 22 nt, Human
uauuaacaugaacugacuuuuc

SEQ ID NO: 577473 - RNA, 22 nt, Human
caucuguagcuccaugacaauu

SEQ ID NO: 577474 - RNA, 18 nt, Human
aucaugcugaauuaaaga

SEQ ID NO: 577475 - RNA, 19 nt, Human
uggcaggcccaggauggac

SEQ ID NO: 577476 - RNA, 22 nt, Human
uuucaucuugauucuauauggc

SEQ ID NO: 577477 - RNA, 22 nt, Human
ggcugagaacaggcccagccuc

SEQ ID NO: 577478 - RNA, 22 nt, Human
accagcuccaggccccugcuga

SEQ ID NO: 577479 - RNA, 22 nt, Human
ugcugcagggauuucagagaca

SEQ ID NO: 577480 - RNA, 22 nt, Human
acuuacaaguucccuuucucag

SEQ ID NO: 577481 - RNA, 22 nt, Human
acaugcagugaggaucuuagaa

SEQ ID NO: 577482 - RNA, 22 nt, Human
uuugucaaucccuugaaaaccu

SEQ ID NO: 577483 - RNA, 20 nt, Human
uuucacuggcuugauaaggu

SEQ ID NO: 577484 - RNA, 22 nt, Human
aagacagcacuggcauuuucaa

SEQ ID NO: 577485 - RNA, 22 nt, Human
acaguucugccuguuugagaag

SEQ ID NO: 577486 - RNA, 22 nt, Human
aaacaaugacaacacagcugcg

SEQ ID NO: 577487 - RNA, 22 nt, Human
uuugugaacaaacaugaagaug

SEQ ID NO: 577488 - RNA, 22 nt, Human
uauucugugugauauguaaaug

SEQ ID NO: 577489 - RNA, 22 nt, Human
gcagagaccccgcagugaggcc

SEQ ID NO: 577490 - RNA, 22 nt, Human
uccaggagcucauccacgucaa

SEQ ID NO: 577491 - RNA, 22 nt, Human
agcuggccuuagugagcaccug

SEQ ID NO: 577492 - RNA, 21 nt, Human
ugcuccaggagggggcagucc

SEQ ID NO: 577493 - RNA, 22 nt, Human
gcugcccugacuccagcagccu

SEQ ID NO: 577494 - RNA, 22 nt, Human
uucucuucuguucagugcccaa

SEQ ID NO: 577495 - RNA, 23 nt, Human
ggagaggggugugggcaucuuua

SEQ ID NO: 577496 - RNA, 22 nt, Human
cuucauuucaggcugaagaaua

SEQ ID NO: 577497 - RNA, 22 nt, Human
cagccugcagggcugccuguug

SEQ ID NO: 577498 - RNA, 22 nt, Human
agaacauuugucgaucaauuug

SEQ ID NO: 577499 - RNA, 22 nt, Human
cagcgcaguguagguggggggc

SEQ ID NO: 577500 - RNA, 22 nt, Human
aggcuccagcagccagaggaag

SEQ ID NO: 577501 - RNA, 23 nt, Human
acuuaaaugguucuuuaucucag

SEQ ID NO: 577502 - RNA, 22 nt, Human
cuucacaguaaauccagaagaa

SEQ ID NO: 577503 - RNA, 22 nt, Human
gaagguggcgagcggauugcug

SEQ ID NO: 577504 - RNA, 22 nt, Human
ugccugucuuggaguccuggcc

SEQ ID NO: 577505 - RNA, 22 nt, Human
uuucugcucgcucucaaucagg

SEQ ID NO: 577506 - RNA, 22 nt, Human
agaaagcccacccagaagaugu

SEQ ID NO: 577507 - RNA, 22 nt, Human
uaucaagagucucuacauuaau

SEQ ID NO: 577508 - RNA, 22 nt, Human
gccagagguaucaaagauagua

SEQ ID NO: 577509 - RNA, 22 nt, Human
cugcccugcccaggccuugggc

SEQ ID NO: 577510 - RNA, 22 nt, Human
uggagauguaaagcaaggcuua

SEQ ID NO: 577511 - RNA, 22 nt, Human
uagucacaaccuucaaguuguc

SEQ ID NO: 577512 - RNA, 22 nt, Human
acacaaacugcuagaaaauugg

SEQ ID NO: 577513 - RNA, 22 nt, Human
ggaugacaaggaaagcaaacca

SEQ ID NO: 577514 - RNA, 22 nt, Human
ucuugaauuguacucccauaag

SEQ ID NO: 577515 - RNA, 22 nt, Human
gagggggucuaugagguagagc

SEQ ID NO: 577516 - RNA, 22 nt, Human
uggcagaguggaccauacucaa

SEQ ID NO: 577517 - RNA, 22 nt, Human
auuuacagaugaugcuauuuga

SEQ ID NO: 577518 - RNA, 22 nt, Human
gcuggcuuugucaagggcagca

SEQ ID NO: 577519 - RNA, 22 nt, Human
gcugcuggccgcccagcuucuc

SEQ ID NO: 577520 - RNA, 22 nt, Human
gcccaggaaaugccccguggug

SEQ ID NO: 577521 - RNA, 22 nt, Human
ucaggguugugaaggaaagggg

SEQ ID NO: 577522 - RNA, 22 nt, Human
agucuggcuuuuugaugagcuu

SEQ ID NO: 577523 - RNA, 22 nt, Human
uguggcugcaggcgauggagga

SEQ ID NO: 577524 - RNA, 22 nt, Human
gagagcugauagaugagcuacu

SEQ ID NO: 577525 - RNA, 22 nt, Human
uagaacuugaaugugaaaucag

SEQ ID NO: 577526 - RNA, 22 nt, Human
ggccagagguguccucaguucu

SEQ ID NO: 577527 - RNA, 22 nt, Human
aagcccagaugggagcauuuca

SEQ ID NO: 577528 - RNA, 22 nt, Human
aguaacacuuggaaugauagca

SEQ ID NO: 577529 - RNA, 22 nt, Human
ugggagacacuggugggagcuu

SEQ ID NO: 577530 - RNA, 22 nt, Human
gugaggagcugacacuggggug

SEQ ID NO: 577531 - RNA, 22 nt, Human
cagacagggaccucgcuccaga

SEQ ID NO: 577532 - RNA, 22 nt, Human
gcccucccuacagccuauuucu

SEQ ID NO: 577533 - RNA, 22 nt, Human
ucagggcauacucuucaagguc

SEQ ID NO: 577534 - RNA, 22 nt, Human
cuccuggcuuucccagaccagg

SEQ ID NO: 577535 - RNA, 22 nt, Human
gaagaaguauuuuuguccuguu

SEQ ID NO: 577536 - RNA, 22 nt, Human
uauggcaagagaaucaacugaa

SEQ ID NO: 577537 - RNA, 22 nt, Human
ggaggccaucagggagggcauu

SEQ ID NO: 577538 - RNA, 21 nt, Human
ccagcugccugcacuuuggac

SEQ ID NO: 577539 - RNA, 22 nt, Human
caauuucucuuuauaucucaca

SEQ ID NO: 577540 - RNA, 22 nt, Human
ucuguacauuuguguugugaau

SEQ ID NO: 577541 - RNA, 22 nt, Human
uggaagggaaaguuuggggucc

SEQ ID NO: 577542 - RNA, 22 nt, Human
gcagcagcucaguucugggagg

SEQ ID NO: 577543 - RNA, 22 nt, Human
auauaucugcaguacugaagaa

SEQ ID NO: 577544 - RNA, 22 nt, Human
ucgcccaggauggagugcagua

SEQ ID NO: 577545 - RNA, 22 nt, Human
guguuaaccagcuaaacuuugc

SEQ ID NO: 577546 - RNA, 22 nt, Human
uguuucaaguuugcucaaagga

SEQ ID NO: 577547 - RNA, 22 nt, Human
aaauugcagaugcuaaaugacu

SEQ ID NO: 577548 - RNA, 22 nt, Human
uaaauugaucguuugggaugaa

SEQ ID NO: 577549 - RNA, 22 nt, Human
aaauacuguagauaauagaguu

SEQ ID NO: 577550 - RNA, 22 nt, Human
uccagagcuacuugcucaacuu

SEQ ID NO: 577551 - RNA, 22 nt, Human
augaaaguguuuaaguuuaugu

SEQ ID NO: 577552 - RNA, 22 nt, Human
agcagggcaaagucaggcuaac

SEQ ID NO: 577553 - RNA, 20 nt, Human
aagaggugauaacaggugag

SEQ ID NO: 577554 - RNA, 22 nt, Human
uucauucuuauuugugaucugg

SEQ ID NO: 577555 - RNA, 22 nt, Human
gaggccuccucugagacaucug

SEQ ID NO: 577556 - RNA, 22 nt, Human
gugugaaaugguucucuuuguu

SEQ ID NO: 577557 - RNA, 22 nt, Human
ggcuguggccagcggggcugag

SEQ ID NO: 577558 - RNA, 22 nt, Human
gcuuugacacucgcccagcccu

SEQ ID NO: 577559 - RNA, 22 nt, Human
ucuugacaacuauacuacuuac

SEQ ID NO: 577560 - RNA, 22 nt, Human
cugagguggaacagaggugaag

SEQ ID NO: 577561 - RNA, 22 nt, Human
acagagacacggaagcuaaaga

SEQ ID NO: 577562 - RNA, 19 nt, Human
agccuggcuuugcucugcu

SEQ ID NO: 577563 - RNA, 22 nt, Human
cugaggaaaguauugccuggug

SEQ ID NO: 577564 - RNA, 22 nt, Human
ucucuguagagacagcacugug

SEQ ID NO: 577565 - RNA, 22 nt, Human
ucugccuggaugauggcagggc

SEQ ID NO: 577566 - RNA, 19 nt, Human
ugcuggaggguagugaguc

SEQ ID NO: 577567 - RNA, 22 nt, Human
cuucugcaggcccugucugacc

SEQ ID NO: 577568 - RNA, 20 nt, Human
acacacagagacaugcgcau

SEQ ID NO: 577569 - RNA, 22 nt, Human
guacauuuugagguuaaaacaa

SEQ ID NO: 577570 - RNA, 22 nt, Human
gagacacaguuaucaggcauac

SEQ ID NO: 577571 - RNA, 22 nt, Human
cucccagagaccaagcugagaa

SEQ ID NO: 577572 - RNA, 22 nt, Human
aucugaguguuggauuuauugu

SEQ ID NO: 577573 - RNA, 22 nt, Human
gcccuggggaaggugucuccaa

SEQ ID NO: 577574 - RNA, 22 nt, Human
ccucagaaggacaagagacaaa

SEQ ID NO: 577575 - RNA, 22 nt, Human
ccagaggaugcuggucagccuc

SEQ ID NO: 577576 - RNA, 22 nt, Human
acagaacagaggguuuuagaau

SEQ ID NO: 577577 - RNA, 22 nt, Human
uaaguuuaaauguacaugaagc

SEQ ID NO: 577578 - RNA, 17 nt, Human
ugggugguagggagagg

SEQ ID NO: 577579 - RNA, 22 nt, Human
uggccuggaaaaaugcagaugg

SEQ ID NO: 577580 - RNA, 22 nt, Human
ucccagcagcauagcucagaau

SEQ ID NO: 577581 - RNA, 22 nt, Human
aaucaggaugacugucauuuca

SEQ ID NO: 577582 - RNA, 22 nt, Human
uugcuaaauguguuauaucugu

SEQ ID NO: 577583 - RNA, 22 nt, Human
caaaauuagaaaugcagcuguu

SEQ ID NO: 577584 - RNA, 19 nt, Human
agcagcuggagguggagug

SEQ ID NO: 577585 - RNA, 22 nt, Human
augaaaugucuggaucuuuuuc

SEQ ID NO: 577586 - RNA, 22 nt, Human
gggugggacucuuuggccugag

SEQ ID NO: 577587 - RNA, 22 nt, Human
aagcugccuuccaugugaggaa

SEQ ID NO: 577588 - RNA, 22 nt, Human
gaucugaagaguuauuuucuga

SEQ ID NO: 577589 - RNA, 22 nt, Human
uggcccgaagauccgaggguca

SEQ ID NO: 577590 - RNA, 22 nt, Human
gguggacaaaugaaugacugaa

SEQ ID NO: 577591 - RNA, 22 nt, Human
caaacuuuugaggaguucagga

SEQ ID NO: 577592 - RNA, 22 nt, Human
gagccuggggacccuccugagu

SEQ ID NO: 577593 - RNA, 22 nt, Human
ucagaacagcucucagauaucc

SEQ ID NO: 577594 - RNA, 18 nt, Human
acuguuaucugauaaggc

SEQ ID NO: 577595 - RNA, 22 nt, Human
ccaggugcacucaagaccugcu

SEQ ID NO: 577596 - RNA, 22 nt, Human
ugccagugggugugcagagacu

SEQ ID NO: 577597 - RNA, 22 nt, Human
gcuggccauucucuuugagaug

SEQ ID NO: 577598 - RNA, 22 nt, Human
ugcuggcuccucgaggcuucgu

SEQ ID NO: 577599 - RNA, 22 nt, Human
uguguucuuaaaagcagugaua

SEQ ID NO: 577600 - RNA, 20 nt, Human
ucacagaguagccuugucug

SEQ ID NO: 577601 - RNA, 22 nt, Human
ucucagagagaugaaacuucca

SEQ ID NO: 577602 - RNA, 22 nt, Human
uccaaagagguuaagaacgaga

SEQ ID NO: 577603 - RNA, 22 nt, Human
cuggacuuuggcccaucugcca

SEQ ID NO: 577604 - RNA, 22 nt, Human
ucugucuccugccagugccucu

SEQ ID NO: 577605 - RNA, 22 nt, Human
guucacaguguuuucuuugcau

SEQ ID NO: 577606 - RNA, 22 nt, Human
agacacugcggaggucgggugg

SEQ ID NO: 577607 - RNA, 22 nt, Human
uugccugugucagcagguggaa

SEQ ID NO: 577608 - RNA, 22 nt, Human
uacugugaauacaaaauaaauu

SEQ ID NO: 577609 - RNA, 22 nt, Human
gcaagcaauggacggugacuuu

SEQ ID NO: 577610 - RNA, 22 nt, Human
agcccaggagccuuuggagggu

SEQ ID NO: 577611 - RNA, 22 nt, Human
ucucauuugccucaucuauaaa

SEQ ID NO: 577612 - RNA, 22 nt, Human
acagaggcagugugagauacug

SEQ ID NO: 577613 - RNA, 22 nt, Human
auauaacucuuguucuuauagu

SEQ ID NO: 577614 - RNA, 22 nt, Human
uuuucaguuacuguuuauguga

SEQ ID NO: 577615 - RNA, 22 nt, Human
gguggaugcugacuguucugcu

SEQ ID NO: 577616 - RNA, 22 nt, Human
ucuagaaagccaaauuaggaau

SEQ ID NO: 577617 - RNA, 22 nt, Human
caauauucaguggaaaagccau

SEQ ID NO: 577618 - RNA, 22 nt, Human
uucagucccuugcuuaaauuua

SEQ ID NO: 577619 - RNA, 22 nt, Human
ugucuccugggucccuuccacc

SEQ ID NO: 577620 - RNA, 20 nt, Human
cuguccccgaggucaccagg

SEQ ID NO: 577621 - RNA, 17 nt, Human
ggaagaaaaggaucauc

SEQ ID NO: 577622 - RNA, 22 nt, Human
uggggaagacagcagacacugu

SEQ ID NO: 577623 - RNA, 22 nt, Human
auaguguuacccuucuuaaagu

SEQ ID NO: 577624 - RNA, 22 nt, Human
aagauaaugugucugucuuugc

SEQ ID NO: 577625 - RNA, 22 nt, Human
ccaggccaaauucagucagcag

SEQ ID NO: 577626 - RNA, 22 nt, Human
aaugaugguuucaucacuugaa

SEQ ID NO: 577627 - RNA, 17 nt, Human
agauggcaggaggcaga

SEQ ID NO: 577628 - RNA, 22 nt, Human
ugucucuugagcugccugaugc

SEQ ID NO: 577629 - RNA, 22 nt, Human
aaagcagaggugauaugacuua

SEQ ID NO: 577630 - RNA, 22 nt, Human
gagcucugggaaacaaagugua

SEQ ID NO: 577631 - RNA, 22 nt, Human
ggcagcaggcgacuucccuauu

SEQ ID NO: 577632 - RNA, 22 nt, Human
cuccagugcacuggucuuuuca

SEQ ID NO: 577633 - RNA, 22 nt, Human
agcuaguucagagagauaugua

SEQ ID NO: 577634 - RNA, 22 nt, Human
uuucuguauuuugucauaaccu

SEQ ID NO: 577635 - RNA, 19 nt, Human
auacacauacguaaacuga

SEQ ID NO: 577636 - RNA, 22 nt, Human
cuucaaauacaaguagauuaug

SEQ ID NO: 577637 - RNA, 22 nt, Human
cccaggaaaguggaggcggcug

SEQ ID NO: 577638 - RNA, 22 nt, Human
uauuucuuguucccuccaaguu

SEQ ID NO: 577639 - RNA, 22 nt, Human
aauucauacucuauauugcuuu

SEQ ID NO: 577640 - RNA, 21 nt, Human
agugaaauugcaucagaggga

SEQ ID NO: 577641 - RNA, 22 nt, Human
aggaaugucauagaauaaucau

SEQ ID NO: 577642 - RNA, 22 nt, Human
cucagggagagccaagaguucc

SEQ ID NO: 577643 - RNA, 22 nt, Human
ccugccaggccagugagcuucc

SEQ ID NO: 577644 - RNA, 18 nt, Human
ucuuuuccuuccacuucc

SEQ ID NO: 577645 - RNA, 22 nt, Human
gcagcuggucuggccuagagua

SEQ ID NO: 577646 - RNA, 22 nt, Human
acugaaauacugcucuuggauu

SEQ ID NO: 577647 - RNA, 18 nt, Human
acaggccucaguccugca

SEQ ID NO: 577648 - RNA, 22 nt, Human
uaacaaaguaccauagacugga

SEQ ID NO: 577649 - RNA, 22 nt, Human
ucaugcagcuuuuccauucagc

SEQ ID NO: 577650 - RNA, 22 nt, Human
uucaugaauguuccaugugagu

SEQ ID NO: 577651 - RNA, 22 nt, Human
cuucacugcagucauggcucug

SEQ ID NO: 577652 - RNA, 22 nt, Human
cagaguggcaugaaugaagccu

SEQ ID NO: 577653 - RNA, 22 nt, Human
ggauuuuagaguaccuaagugu

SEQ ID NO: 577654 - RNA, 22 nt, Human
augcauaugcaaugcacaauuu

SEQ ID NO: 577655 - RNA, 22 nt, Human
cccaggaaauagccaggaggug

SEQ ID NO: 577656 - RNA, 22 nt, Human
ucccagggcucuagagugcugg

SEQ ID NO: 577657 - RNA, 22 nt, Human
cugggcuggcgcauccgacacg

SEQ ID NO: 577658 - RNA, 22 nt, Human
cagcccuguccagcagagggug

SEQ ID NO: 577659 - RNA, 21 nt, Human
uuauugaauguuuaccgugug

SEQ ID NO: 577660 - RNA, 22 nt, Human
uauaggaaguaauuguugccug

SEQ ID NO: 577661 - RNA, 22 nt, Human
augcauaucuccuaucuccuca

SEQ ID NO: 577662 - RNA, 22 nt, Human
ucuggucccuuuuccugcaguc

SEQ ID NO: 577663 - RNA, 20 nt, Human
auccaucauguccaugacuu

SEQ ID NO: 577664 - RNA, 22 nt, Human
cagagcugguguuacaagucca

SEQ ID NO: 577665 - RNA, 22 nt, Human
cagagcauaauugacaugaggu

SEQ ID NO: 577666 - RNA, 22 nt, Human
gagccuggacaucucaggccca

SEQ ID NO: 577667 - RNA, 22 nt, Human
aaacucuucauauacauaugcu

SEQ ID NO: 577668 - RNA, 22 nt, Human
gcuguggcugaccaccaggggg

SEQ ID NO: 577669 - RNA, 20 nt, Human
agcaguguggggagacugug

SEQ ID NO: 577670 - RNA, 22 nt, Human
aauagcaugcauccugcauaga

SEQ ID NO: 577671 - RNA, 22 nt, Human
agcaggcacgcucccugcgcga

SEQ ID NO: 577672 - RNA, 22 nt, Human
cagaaaauagaguuucucugag

SEQ ID NO: 577673 - RNA, 22 nt, Human
uagucucugcuuugcccuuggc

SEQ ID NO: 577674 - RNA, 22 nt, Human
ggacacuggccacauuucaaaa

SEQ ID NO: 577675 - RNA, 22 nt, Human
gagauacaguuggcugcaggcu

SEQ ID NO: 577676 - RNA, 22 nt, Human
acuuguuuacaagcaguucuga

SEQ ID NO: 577677 - RNA, 22 nt, Human
uucugcugguaacuauguuuca

SEQ ID NO: 577678 - RNA, 22 nt, Human
gaggagaaauuauccuuggugu

SEQ ID NO: 577679 - RNA, 22 nt, Human
gauuuuaucgucauccuucugg

SEQ ID NO: 577680 - RNA, 22 nt, Human
ggcugccuucagacuccagcuu

SEQ ID NO: 577681 - RNA, 22 nt, Human
ugaagaagccaauugguaggcu

SEQ ID NO: 577682 - RNA, 22 nt, Human
cauuuauugguuaggccagcag

SEQ ID NO: 577683 - RNA, 23 nt, Human
uacugccuggggccagagagcgg

SEQ ID NO: 577684 - RNA, 22 nt, Human
uucauuugucugcuauagaucc

SEQ ID NO: 577685 - RNA, 22 nt, Human
cccagggagagcgcggaggcgg

SEQ ID NO: 577686 - RNA, 22 nt, Human
agcuccugugugaagccucccu

SEQ ID NO: 577687 - RNA, 22 nt, Human
caggcugcagaggccuuucaug

SEQ ID NO: 577688 - RNA, 22 nt, Human
auuuccuauacaguuguccaua

SEQ ID NO: 577689 - RNA, 22 nt, Human
uguggcagcuggagguggagaa

SEQ ID NO: 577690 - RNA, 22 nt, Human
cugauuuagauuucacacguga

SEQ ID NO: 577691 - RNA, 22 nt, Human
agagacaggguuuugucguguu

SEQ ID NO: 577692 - RNA, 22 nt, Human
acucucugggcaugccccacca

SEQ ID NO: 577693 - RNA, 23 nt, Human
agcuccugaggccagccucuccu

SEQ ID NO: 577694 - RNA, 22 nt, Human
ugauucaacuuucauaacaaaa

SEQ ID NO: 577695 - RNA, 22 nt, Human
gcagggugugucucauacaguu

SEQ ID NO: 577696 - RNA, 22 nt, Human
cugcuuuugagcccagugcuca

SEQ ID NO: 577697 - RNA, 22 nt, Human
uuaugaaaacaaucaguaggca

SEQ ID NO: 577698 - RNA, 22 nt, Human
gccuggagggauagaaugcaag

SEQ ID NO: 577699 - RNA, 22 nt, Human
cuccugggucauugccagcaaa

SEQ ID NO: 577700 - RNA, 22 nt, Human
augucagaaucuacauucuacu

SEQ ID NO: 577701 - RNA, 21 nt, Human
uuuugguccuggcuuaggagc

SEQ ID NO: 577702 - RNA, 22 nt, Human
ucugauaacaaccaugucuggc

SEQ ID NO: 577703 - RNA, 21 nt, Human
cacagagauauuggugagccu

SEQ ID NO: 577704 - RNA, 22 nt, Human
caucauauauuucuacaagugc

SEQ ID NO: 577705 - RNA, 22 nt, Human
ggggucaagcucagaauccuag

SEQ ID NO: 577706 - RNA, 22 nt, Human
caguccuuggcuucauccgagu

SEQ ID NO: 577707 - RNA, 22 nt, Human
gcuggcccagggucaccuagga

SEQ ID NO: 577708 - RNA, 22 nt, Human
acacuacaaucucagaacuaua

SEQ ID NO: 577709 - RNA, 22 nt, Human
aaucuuacaccgaauuuaaacu

SEQ ID NO: 577710 - RNA, 22 nt, Human
ggccaguccccuaauccagggc

SEQ ID NO: 577711 - RNA, 22 nt, Human
gaucacaucuuuaugaguauuu

SEQ ID NO: 577712 - RNA, 22 nt, Human
uacacauaaaaugcucauggua

SEQ ID NO: 577713 - RNA, 22 nt, Human
gcucaaagaauauucagaauga

SEQ ID NO: 577714 - RNA, 22 nt, Human
uaaaaccauaaggcuggaagga

SEQ ID NO: 577715 - RNA, 22 nt, Human
aguuucaguucugucauuuaua

SEQ ID NO: 577716 - RNA, 22 nt, Human
ucuuuacaaucuaagcauaguu

SEQ ID NO: 577717 - RNA, 21 nt, Human
cuacacagcuuucuauaggaa

SEQ ID NO: 577718 - RNA, 22 nt, Human
cagcugugcuguauuaagcucu

SEQ ID NO: 577719 - RNA, 22 nt, Human
cuccagcugccaccagauguuu

SEQ ID NO: 577720 - RNA, 22 nt, Human
caagaauccuguucuugaagau

SEQ ID NO: 577721 - RNA, 22 nt, Human
ggaggccaaggcaggcggauca

SEQ ID NO: 577722 - RNA, 22 nt, Human
gugcauauaugugcagcaucaa

SEQ ID NO: 577723 - RNA, 22 nt, Human
auuugcauaauagugauuugua

SEQ ID NO: 577724 - RNA, 22 nt, Human
cagcucuuccuacccuaguugg

SEQ ID NO: 577725 - RNA, 22 nt, Human
gcgcaggagccgcggagggccg

SEQ ID NO: 577726 - RNA, 22 nt, Human
uuuaucuggacugugauauaaa

SEQ ID NO: 577727 - RNA, 22 nt, Human
uuugcaaagugacuauuauaug

SEQ ID NO: 577728 - RNA, 22 nt, Human
uguuucuucucacacaaacuca

SEQ ID NO: 577729 - RNA, 22 nt, Human
gccuggcugcuagccagaggca

SEQ ID NO: 577730 - RNA, 22 nt, Human
gcgucucaaggcccccaggcca

SEQ ID NO: 577731 - RNA, 20 nt, Human
uccuucagacgacaagcaag

SEQ ID NO: 577732 - RNA, 22 nt, Human
gucuggaggaggaagaaggcac

SEQ ID NO: 577733 - RNA, 22 nt, Human
cuuuucaugccagcccaucaca

SEQ ID NO: 577734 - RNA, 22 nt, Human
gugcugggcccugagaccaggg

SEQ ID NO: 577735 - RNA, 20 nt, Human
guaaagcauucuuggcauac

SEQ ID NO: 577736 - RNA, 22 nt, Human
ggugagaggcagaggacagcuu

SEQ ID NO: 577737 - RNA, 22 nt, Human
cccugggcagucugcacuucag

SEQ ID NO: 577738 - RNA, 22 nt, Human
cugggcucugcggugucgcucu

SEQ ID NO: 577739 - RNA, 22 nt, Human
acugugcuaucuacugaauuau

SEQ ID NO: 577740 - RNA, 22 nt, Human
gugcuucuccguucugcagcac

SEQ ID NO: 577741 - RNA, 18 nt, Human
ggagucucaggagaggaa

SEQ ID NO: 577742 - RNA, 22 nt, Human
gagguuuuaaguugaaggggga

SEQ ID NO: 577743 - RNA, 22 nt, Human
guauuuccucgcuugugggauu

SEQ ID NO: 577744 - RNA, 22 nt, Human
uguauagaguuggaagaugacu

SEQ ID NO: 577745 - RNA, 22 nt, Human
uucacaaaaaugcugaacaguu

SEQ ID NO: 577746 - RNA, 23 nt, Human
agagggagauguuuuucucaaga

SEQ ID NO: 577747 - RNA, 21 nt, Human
aaugugugcuauuuaucuuuu

SEQ ID NO: 577748 - RNA, 22 nt, Human
gaguuacacaaaauuucuauuu

SEQ ID NO: 577749 - RNA, 19 nt, Human
ccuaaguaacaacaguugu

SEQ ID NO: 577750 - RNA, 22 nt, Human
gaccagggucacucacagggcu

SEQ ID NO: 577751 - RNA, 22 nt, Human
uucaagauaauaggaaugaaaa

SEQ ID NO: 577752 - RNA, 22 nt, Human
gcuuugugaauuauuacucaca

SEQ ID NO: 577753 - RNA, 22 nt, Human
caugcacaaagguaagaugcgu

SEQ ID NO: 577754 - RNA, 19 nt, Human
caauucugcaacacugucc

SEQ ID NO: 577755 - RNA, 22 nt, Human
agcaugcugguguucauggcag

SEQ ID NO: 577756 - RNA, 22 nt, Human
ugagguaaauucuggcccaaac

SEQ ID NO: 577757 - RNA, 22 nt, Human
caggccacagcuaaagaggauu

SEQ ID NO: 577758 - RNA, 22 nt, Human
ugcccuggaaaugagaggugug

SEQ ID NO: 577759 - RNA, 22 nt, Human
uucuauguggcaucaagcucag

SEQ ID NO: 577760 - RNA, 22 nt, Human
gcaggaggaucacuugagccca

SEQ ID NO: 577761 - RNA, 22 nt, Human
aaggggugagcagaggcuucgc

SEQ ID NO: 577762 - RNA, 22 nt, Human
cuguagccaguuuggccucacc

SEQ ID NO: 577763 - RNA, 22 nt, Human
ccagccaggcauugcaaacuga

SEQ ID NO: 577764 - RNA, 22 nt, Human
cuguggcucaauugccuacuga

SEQ ID NO: 577765 - RNA, 22 nt, Human
cagucucucugaaguauuaaga

SEQ ID NO: 577766 - RNA, 22 nt, Human
acugcagcaaagcccgugucuu

SEQ ID NO: 577767 - RNA, 22 nt, Human
aaggagaauuuggcuugugaug

SEQ ID NO: 577768 - RNA, 18 nt, Human
caguuacaccuucauuca

SEQ ID NO: 577769 - RNA, 21 nt, Human
cucagagaaaugucugggagc

SEQ ID NO: 577770 - RNA, 22 nt, Human
gcugagugaggaaaagguuaua

SEQ ID NO: 577771 - RNA, 22 nt, Human
ccagugugccaauuuacagcug

SEQ ID NO: 577772 - RNA, 22 nt, Human
ugggggacugcacuggcgucag

SEQ ID NO: 577773 - RNA, 17 nt, Human
uuacacaggagagcucu

SEQ ID NO: 577774 - RNA, 20 nt, Human
agcagcagauguuggaggug

SEQ ID NO: 577775 - RNA, 22 nt, Human
cauuuucagcacccaucugaaa

SEQ ID NO: 577776 - RNA, 22 nt, Human
caucaucaaaacaaauggaguc

SEQ ID NO: 577777 - RNA, 22 nt, Human
ucauuacaguguuuauaugucu

SEQ ID NO: 577778 - RNA, 22 nt, Human
uccugacuuaacuacucucugg

SEQ ID NO: 577779 - RNA, 22 nt, Human
gcagcaguaggaaauaacacag

SEQ ID NO: 577780 - RNA, 22 nt, Human
gccuggggccagcuugggcuga

SEQ ID NO: 577781 - RNA, 22 nt, Human
augcaguccacaggccacagug

SEQ ID NO: 577782 - RNA, 22 nt, Human
cagcuuugucauuugauuuggg

SEQ ID NO: 577783 - RNA, 20 nt, Human
guuuuaaggcacaggccuuu

SEQ ID NO: 577784 - RNA, 22 nt, Human
ccuuucucuuugcugaucaugu

SEQ ID NO: 577785 - RNA, 22 nt, Human
ccucuccuugcacccgucccgc

SEQ ID NO: 577786 - RNA, 22 nt, Human
gcugggcuugguuucccugcuu

SEQ ID NO: 577787 - RNA, 22 nt, Human
cagcugccagcuucucuccauc

SEQ ID NO: 577788 - RNA, 22 nt, Human
aucacauggaaugauuuuagac

SEQ ID NO: 577789 - RNA, 22 nt, Human
aacaaauuaguugcaagacugg

SEQ ID NO: 577790 - RNA, 22 nt, Human
caggaacaaucuuacuacuauu

SEQ ID NO: 577791 - RNA, 22 nt, Human
acauauugagcucuaaaaguac

SEQ ID NO: 577792 - RNA, 22 nt, Human
auguuucuauaaagaaguuugg

SEQ ID NO: 577793 - RNA, 22 nt, Human
agaggugacauaggagaggcuc

SEQ ID NO: 577794 - RNA, 22 nt, Human
aaugcacaaaaauuguauguaa

SEQ ID NO: 577795 - RNA, 22 nt, Human
aaaguucagugccuucuauaca

SEQ ID NO: 577796 - RNA, 22 nt, Human
cucucucuuguguugcugcaga

SEQ ID NO: 577797 - RNA, 19 nt, Human
uguuucuuccuccaucuga

SEQ ID NO: 577798 - RNA, 22 nt, Human
ugagcugugugacauugagcca

SEQ ID NO: 577799 - RNA, 22 nt, Human
cagcauugaucccaggcugugg

SEQ ID NO: 577800 - RNA, 21 nt, Human
agaggccaagucaucauuucc

SEQ ID NO: 577801 - RNA, 22 nt, Human
uuauuuccuaaaucucuuuguu

SEQ ID NO: 577802 - RNA, 22 nt, Human
ucaauuaugccauugcaauauu

SEQ ID NO: 577803 - RNA, 22 nt, Human
accagggcaaauguuuguacuc

SEQ ID NO: 577804 - RNA, 22 nt, Human
gcuuuuggccagauggggaaac

SEQ ID NO: 577805 - RNA, 19 nt, Human
cuagcuugucauuugugug

SEQ ID NO: 577806 - RNA, 22 nt, Human
guuuccuauguccauugaggga

SEQ ID NO: 577807 - RNA, 18 nt, Human
uguuuauuuuucucuuac

SEQ ID NO: 577808 - RNA, 19 nt, Human
ugugccuccucgucuccua

SEQ ID NO: 577809 - RNA, 22 nt, Human
uagaggcauuaaugaauaaaca

SEQ ID NO: 577810 - RNA, 22 nt, Human
caaacauagugaagcaaugaca

SEQ ID NO: 577811 - RNA, 22 nt, Human
aaaacauuuuacugccaucuca

SEQ ID NO: 577812 - RNA, 22 nt, Human
ggggaggagccauguaacuagu

SEQ ID NO: 577813 - RNA, 22 nt, Human
gcagcugcaggcaggcuugcug

SEQ ID NO: 577814 - RNA, 22 nt, Human
ggcuuggcuacaagccaugggc

SEQ ID NO: 577815 - RNA, 22 nt, Human
agucccagcucagaaccacuag

SEQ ID NO: 577816 - RNA, 22 nt, Human
ugagucucccaaguaguuggaa

SEQ ID NO: 577817 - RNA, 22 nt, Human
ccaggccagggcugcagcgagc

SEQ ID NO: 577818 - RNA, 22 nt, Human
cuucccagaccuuagagugcag

SEQ ID NO: 577819 - RNA, 22 nt, Human
uguuugcucugacuaucuugcg

SEQ ID NO: 577820 - RNA, 22 nt, Human
ugacuggagaccucaguagggu

SEQ ID NO: 577821 - RNA, 19 nt, Human
acagacauuugcaauuagc

SEQ ID NO: 577822 - RNA, 22 nt, Human
ucauggaaacaaugcggaaaaa

SEQ ID NO: 577823 - RNA, 22 nt, Human
ccuacaggaaauuguaucaaaa

SEQ ID NO: 577824 - RNA, 22 nt, Human
uuaagacauucagauauuucua

SEQ ID NO: 577825 - RNA, 22 nt, Human
ugcugcucgccacggcccaggg

SEQ ID NO: 577826 - RNA, 22 nt, Human
acagaugcaaggaaaugauugc

SEQ ID NO: 577827 - RNA, 22 nt, Human
cagggcagggauguugcggcag

SEQ ID NO: 577828 - RNA, 22 nt, Human
gggcugagacgauggggucuuc

SEQ ID NO: 577829 - RNA, 22 nt, Human
uuuaagagcauuugcaauuuau

SEQ ID NO: 577830 - RNA, 22 nt, Human
auguuucuacagcguccacuga

SEQ ID NO: 577831 - RNA, 22 nt, Human
ugucauuauuugccuacugacu

SEQ ID NO: 577832 - RNA, 22 nt, Human
uccugccacugcacauauacuu

SEQ ID NO: 577833 - RNA, 22 nt, Human
ugcagcugguuuagaacuagau

SEQ ID NO: 577834 - RNA, 20 nt, Human
cugagagucugugcuuaguc

SEQ ID NO: 577835 - RNA, 22 nt, Human
cuucuggguguggagugaggac

SEQ ID NO: 577836 - RNA, 22 nt, Human
uauuugaaggcauacauuuuga

SEQ ID NO: 577837 - RNA, 19 nt, Human
aggcugcaagguggugggc

SEQ ID NO: 577838 - RNA, 22 nt, Human
cagccagggucaggcagcuucu

SEQ ID NO: 577839 - RNA, 22 nt, Human
uucugagaaugcuucuggaauc

SEQ ID NO: 577840 - RNA, 22 nt, Human
gcugccuccaaucugugccccg

SEQ ID NO: 577841 - RNA, 22 nt, Human
gugccucucauuggcugagccc

SEQ ID NO: 577842 - RNA, 22 nt, Human
cccccucugccgggguccuuca

SEQ ID NO: 577843 - RNA, 22 nt, Human
uuuucagugguaucuuuguaaa

SEQ ID NO: 577844 - RNA, 22 nt, Human
cagugcugugcuggaagcuguu

SEQ ID NO: 577845 - RNA, 22 nt, Human
aaacaggcacauaguaacauuu

SEQ ID NO: 577846 - RNA, 22 nt, Human
ccagggaugcagagguugcagu

SEQ ID NO: 577847 - RNA, 22 nt, Human
gggccacggaaggaccaguggg

SEQ ID NO: 577848 - RNA, 22 nt, Human
uuuuuaucuuguaugugucucu

SEQ ID NO: 577849 - RNA, 22 nt, Human
ucaggcuguagggccccuggag

SEQ ID NO: 577850 - RNA, 22 nt, Human
uggaacacuuuguugaaaugca

SEQ ID NO: 577851 - RNA, 21 nt, Human
agguuucucuuuuauggaggg

SEQ ID NO: 577852 - RNA, 22 nt, Human
gauggggaugagaagugagcag

SEQ ID NO: 577853 - RNA, 22 nt, Human
ugaaggaaugagggaguggguc

SEQ ID NO: 577854 - RNA, 19 nt, Human
uucuccagccugaccugag

SEQ ID NO: 577855 - RNA, 22 nt, Human
auggaucagaaucccgggaggg

SEQ ID NO: 577856 - RNA, 22 nt, Human
ugugaguugcucuuuugcuacu

SEQ ID NO: 577857 - RNA, 22 nt, Human
uugcaggguugacacugccugc

SEQ ID NO: 577858 - RNA, 20 nt, Human
aacaaacuacaaaauuaugu

SEQ ID NO: 577859 - RNA, 22 nt, Human
ggcaggcaucauguggucauua

SEQ ID NO: 577860 - RNA, 22 nt, Human
cagcugaguuuccaagucugcc

SEQ ID NO: 577861 - RNA, 21 nt, Human
acuggccaccacuggcagggg

SEQ ID NO: 577862 - RNA, 21 nt, Human
ugcauauucuucugguggcug

SEQ ID NO: 577863 - RNA, 22 nt, Human
aaaugcagauucaugagcccca

SEQ ID NO: 577864 - RNA, 21 nt, Human
uaucuacaguguccauucagu

SEQ ID NO: 577865 - RNA, 22 nt, Human
caggauggagggagggcuguua

SEQ ID NO: 577866 - RNA, 22 nt, Human
gaggcagcaugguaccuuggag

SEQ ID NO: 577867 - RNA, 22 nt, Human
gugugcaggccacaggccaggg

SEQ ID NO: 577868 - RNA, 22 nt, Human
ggucagaaggcaguuaaacaaa

SEQ ID NO: 577869 - RNA, 22 nt, Human
uuagcaagauaacaguaauuuu

SEQ ID NO: 577870 - RNA, 22 nt, Human
gcugaagggagugcugagucug

SEQ ID NO: 577871 - RNA, 22 nt, Human
uggcagcugucuguggggucuc

SEQ ID NO: 577872 - RNA, 22 nt, Human
ucugggcugaaaugaaggccuu

SEQ ID NO: 577873 - RNA, 22 nt, Human
acaguggaauuuguagaugugu

SEQ ID NO: 577874 - RNA, 22 nt, Human
aaggcaguaggaucuuccacag

SEQ ID NO: 577875 - RNA, 22 nt, Human
uauucaaaguaccuucauugcc

SEQ ID NO: 577876 - RNA, 22 nt, Human
ugccaucuuccuuccucugcac

SEQ ID NO: 577877 - RNA, 22 nt, Human
gggcagcucucacagcagccaa

SEQ ID NO: 577878 - RNA, 22 nt, Human
uugggcugaggagggcguggcc

SEQ ID NO: 577879 - RNA, 22 nt, Human
ccuuacaccuaaaaugagaguu

SEQ ID NO: 577880 - RNA, 22 nt, Human
aucuggaacaaagcuuaggaau

SEQ ID NO: 577881 - RNA, 18 nt, Human
uggcuucuauuuuacuca

SEQ ID NO: 577882 - RNA, 22 nt, Human
acauuucuuccacaugcugcug

SEQ ID NO: 577883 - RNA, 22 nt, Human
uacaagacgagggaaguucuuu

SEQ ID NO: 577884 - RNA, 22 nt, Human
ugaaaucaugagauagugucac

SEQ ID NO: 577885 - RNA, 17 nt, Human
ccuuccucaucuccuuc

SEQ ID NO: 577886 - RNA, 22 nt, Human
ccauguugucaaacuuagagua

SEQ ID NO: 577887 - RNA, 22 nt, Human
cucaaagaagggagguauuugg

SEQ ID NO: 577888 - RNA, 22 nt, Human
aauuuacaggugcacucgccau

SEQ ID NO: 577889 - RNA, 22 nt, Human
ggggcgccccgagggugcgcac

SEQ ID NO: 577890 - RNA, 22 nt, Human
cugggcugcaggaguggggcaa

SEQ ID NO: 577891 - RNA, 21 nt, Human
aggagcuguguuagcuggucg

SEQ ID NO: 577892 - RNA, 22 nt, Human
aaguuacauaaauguccucuag

SEQ ID NO: 577893 - RNA, 22 nt, Human
cugagguagcugugaauguucu

SEQ ID NO: 577894 - RNA, 22 nt, Human
uagggcagcugcaucaggcacu

SEQ ID NO: 577895 - RNA, 22 nt, Human
uggagaugcacgagcaggugga

SEQ ID NO: 577896 - RNA, 22 nt, Human
aaguuacaggagaaagagauca

SEQ ID NO: 577897 - RNA, 20 nt, Human
uggaccauaaacaccaggua

SEQ ID NO: 577898 - RNA, 22 nt, Human
ggagagcaggguccugagauac

SEQ ID NO: 577899 - RNA, 22 nt, Human
ucuuacaagucacccgcuuucu

SEQ ID NO: 577900 - RNA, 21 nt, Human
gauuaaauuuaagcuacaugc

SEQ ID NO: 577901 - RNA, 22 nt, Human
agagauggauguuauuaugggu

SEQ ID NO: 577902 - RNA, 22 nt, Human
agccaacacauguaaaugcacc

SEQ ID NO: 577903 - RNA, 22 nt, Human
aagauauuuuagaacauucacu

SEQ ID NO: 577904 - RNA, 21 nt, Human
aaggacgagguuuugauuaca

SEQ ID NO: 577905 - RNA, 22 nt, Human
auccugggaaugggagggucau

SEQ ID NO: 577906 - RNA, 22 nt, Human
ggcagcaggguagccauuucuc

SEQ ID NO: 577907 - RNA, 22 nt, Human
uacaaagcuguauagccugguc

SEQ ID NO: 577908 - RNA, 20 nt, Human
agccaggcucaagcuccccc

SEQ ID NO: 577909 - RNA, 22 nt, Human
caaguuacauuagaaaucaugc

SEQ ID NO: 577910 - RNA, 22 nt, Human
cagagcaguaaaucuggggcac

SEQ ID NO: 577911 - RNA, 22 nt, Human
uaacacaguucucuguugcaca

SEQ ID NO: 577912 - RNA, 22 nt, Human
agcugcaguuagccccagauga

SEQ ID NO: 577913 - RNA, 22 nt, Human
aguuauaccuuauacacauaug

SEQ ID NO: 577914 - RNA, 22 nt, Human
ggagcagcacugccacacagag

SEQ ID NO: 577915 - RNA, 22 nt, Human
guggcagggguauuccagcuga

SEQ ID NO: 577916 - RNA, 22 nt, Human
cacagagaaugaugagucacug

SEQ ID NO: 577917 - RNA, 22 nt, Human
uuguauuuuguuaugcuacugc

SEQ ID NO: 577918 - RNA, 22 nt, Human
uguauucuaaauacaucuuacc

SEQ ID NO: 577919 - RNA, 23 nt, Human
auuuccuaaaagauaaucauuac

SEQ ID NO: 577920 - RNA, 22 nt, Human
agccugugaaaucucugccacu

SEQ ID NO: 577921 - RNA, 22 nt, Human
auuauuagauucuuaauuguaa

SEQ ID NO: 577922 - RNA, 22 nt, Human
ugggaaauuguauuucuauuuc

SEQ ID NO: 577923 - RNA, 22 nt, Human
uuugggcaggcuuuucccuaga

SEQ ID NO: 577924 - RNA, 22 nt, Human
aagccaguccucuacugggcac

SEQ ID NO: 577925 - RNA, 22 nt, Human
cugccucacauuggcuguguga

SEQ ID NO: 577926 - RNA, 22 nt, Human
agagggagcccagucauagcug

SEQ ID NO: 577927 - RNA, 22 nt, Human
uaugaacuuuugaugugacaug

SEQ ID NO: 577928 - RNA, 22 nt, Human
aaagcucuuuuccaaguauuga

SEQ ID NO: 577929 - RNA, 22 nt, Human
gacagucccccagcagcaaacc

SEQ ID NO: 577930 - RNA, 22 nt, Human
cccagggguucugagcagcagc

SEQ ID NO: 577931 - RNA, 22 nt, Human
ugguuccuacgcacauugaauu

SEQ ID NO: 577932 - RNA, 22 nt, Human
ccaguuuugccaugguaacacu

SEQ ID NO: 577933 - RNA, 21 nt, Human
ucuccaguauccuucucugag

SEQ ID NO: 577934 - RNA, 22 nt, Human
aagaacuuccuaauauauuuuc

SEQ ID NO: 577935 - RNA, 19 nt, Human
cuggcagccugucuguguc

SEQ ID NO: 577936 - RNA, 22 nt, Human
aggcacugugcugaugucuuau

SEQ ID NO: 577937 - RNA, 22 nt, Human
cagggugcagugucgcugcuag

SEQ ID NO: 577938 - RNA, 22 nt, Human
aucuuacauucccucaccauuu

SEQ ID NO: 577939 - RNA, 22 nt, Human
uauaaaauggcaucagcuccaa

SEQ ID NO: 577940 - RNA, 22 nt, Human
uacaaauuaaugggcauguuua

SEQ ID NO: 577941 - RNA, 22 nt, Human
uugcccugucuuaagcuggcaa

SEQ ID NO: 577942 - RNA, 22 nt, Human
agacuuaauagaagcaugacau

SEQ ID NO: 577943 - RNA, 22 nt, Human
gcauuccuugguuuaaaacaag

SEQ ID NO: 577944 - RNA, 22 nt, Human
uaacuuuaggaauagguaaucu

SEQ ID NO: 577945 - RNA, 22 nt, Human
cugcuccagacaccugcagggg

SEQ ID NO: 577946 - RNA, 21 nt, Human
gaugauggcaggcagcacugg

SEQ ID NO: 577947 - RNA, 22 nt, Human
ugaugcauugccgacuuacugg

SEQ ID NO: 577948 - RNA, 22 nt, Human
gugggagcuuuggcaucaggcu

SEQ ID NO: 577949 - RNA, 20 nt, Human
acugggcauaccuguccugu

SEQ ID NO: 577950 - RNA, 22 nt, Human
ugaauaaacuaugaggaggaau

SEQ ID NO: 577951 - RNA, 21 nt, Human
ggcagccugacccccagagag

SEQ ID NO: 577952 - RNA, 23 nt, Human
agggaagaaacaugaagggcugu

SEQ ID NO: 577953 - RNA, 22 nt, Human
gacagcuucgaggaggugagcu

SEQ ID NO: 577954 - RNA, 22 nt, Human
ccacagcugaaagcagaggcuc

SEQ ID NO: 577955 - RNA, 22 nt, Human
uggcagaggaaaaagucacugg

SEQ ID NO: 577956 - RNA, 22 nt, Human
ggccugggccuuuguguuuuga

SEQ ID NO: 577957 - RNA, 22 nt, Human
ucaguggauuggaugagaucug

SEQ ID NO: 577958 - RNA, 22 nt, Human
acagcagugcacagagaacccu

SEQ ID NO: 577959 - RNA, 22 nt, Human
ggagguggcagagggacauucu

SEQ ID NO: 577960 - RNA, 22 nt, Human
ucagcucuguguacaguuagca

SEQ ID NO: 577961 - RNA, 22 nt, Human
ugcaauuucaggcauauauugu

SEQ ID NO: 577962 - RNA, 22 nt, Human
cccugccuucuuggccuuuaaa

SEQ ID NO: 577963 - RNA, 22 nt, Human
gccucuggguuggugacaggcu

SEQ ID NO: 577964 - RNA, 22 nt, Human
cagcccaggacugcagguguuu

SEQ ID NO: 577965 - RNA, 22 nt, Human
uccaggcuugagaccaggcucu

SEQ ID NO: 577966 - RNA, 22 nt, Human
caguccuucuccauuaaggcuc

SEQ ID NO: 577967 - RNA, 23 nt, Human
ugaaauauucuuuugcaugagcu

SEQ ID NO: 577968 - RNA, 22 nt, Human
cuccccuccuuaggucuucuag

SEQ ID NO: 577969 - RNA, 21 nt, Human
uggcucgauuuauagcauuuc

SEQ ID NO: 577970 - RNA, 22 nt, Human
caguaugugaugcaacggaaua

SEQ ID NO: 577971 - RNA, 22 nt, Human
acacagaagcuuuuucuauucc

SEQ ID NO: 577972 - RNA, 22 nt, Human
agggcaguucagccacaggcuc

SEQ ID NO: 577973 - RNA, 22 nt, Human
cucccaggcacagggaggagcc

SEQ ID NO: 577974 - RNA, 19 nt, Human
ucucugccgaucagggccc

SEQ ID NO: 577975 - RNA, 22 nt, Human
aguuacaaccaugacacaagca

SEQ ID NO: 577976 - RNA, 22 nt, Human
augcauauuuucuacuauaucg

SEQ ID NO: 577977 - RNA, 22 nt, Human
uguuaaacagcugucuucuuca

SEQ ID NO: 577978 - RNA, 23 nt, Human
cccagguagcccucuagagccug

SEQ ID NO: 577979 - RNA, 22 nt, Human
auuacaauaagguuuauuugua

SEQ ID NO: 577980 - RNA, 22 nt, Human
accccagguccagguuacagag

SEQ ID NO: 577981 - RNA, 22 nt, Human
agggaaaguaagcauuucauua

SEQ ID NO: 577982 - RNA, 22 nt, Human
uccucugcucagcauuccucac

SEQ ID NO: 577983 - RNA, 22 nt, Human
aagcagugaugcauacagcugu

SEQ ID NO: 577984 - RNA, 22 nt, Human
gcucagagaaaacuggggcuug

SEQ ID NO: 577985 - RNA, 22 nt, Human
ugucuccuaaugucuguuuccu

SEQ ID NO: 577986 - RNA, 22 nt, Human
ucugaagaacugucuagagaac

SEQ ID NO: 577987 - RNA, 22 nt, Human
gggguggagaugguggcccuuu

SEQ ID NO: 577988 - RNA, 22 nt, Human
caguccaggccuggaggagcca

SEQ ID NO: 577989 - RNA, 22 nt, Human
ucaggaacauaaugugagucag

SEQ ID NO: 577990 - RNA, 22 nt, Human
ucuugggggacuuuggcaugga

SEQ ID NO: 577991 - RNA, 22 nt, Human
acagagacaaauguuaguaguu

SEQ ID NO: 577992 - RNA, 19 nt, Human
uguggccaugguucagcug

SEQ ID NO: 577993 - RNA, 22 nt, Human
ggugaagguggaacgcagagca

SEQ ID NO: 577994 - RNA, 22 nt, Human
gaagccaagugcaaaugccuua

SEQ ID NO: 577995 - RNA, 22 nt, Human
aaaugugucauauucaaaguca

SEQ ID NO: 577996 - RNA, 22 nt, Human
aaguacagaaauagcaggugca

SEQ ID NO: 577997 - RNA, 22 nt, Human
agaauaagccugacgaaaccua

SEQ ID NO: 577998 - RNA, 22 nt, Human
uaggaaggccugucacuacuug

SEQ ID NO: 577999 - RNA, 22 nt, Human
uaguguucugggcugagagggg

SEQ ID NO: 578000 - RNA, 22 nt, Human
aagcaaaugugggugcagaauu

SEQ ID NO: 578001 - RNA, 22 nt, Human
uaacaguauugaagauaaacua

SEQ ID NO: 578002 - RNA, 22 nt, Human
uucugcuuuucucugucugagu

SEQ ID NO: 578003 - RNA, 22 nt, Human
uuccuucuggagcccggggagc

SEQ ID NO: 578004 - RNA, 22 nt, Human
gcagccacucucauuccacgug

SEQ ID NO: 578005 - RNA, 20 nt, Human
ggccugagcauggcuggcag

SEQ ID NO: 578006 - RNA, 22 nt, Human
uauuagcuuguuuggcaggaug

SEQ ID NO: 578007 - RNA, 22 nt, Human
cugcucuugagggacugcgguc

SEQ ID NO: 578008 - RNA, 22 nt, Human
caaggaaaagaaguauuucaga

SEQ ID NO: 578009 - RNA, 22 nt, Human
aauaaauguuaagauugucuca

SEQ ID NO: 578010 - RNA, 22 nt, Human
cagcuucaugacaaacaguuuu

SEQ ID NO: 578011 - RNA, 22 nt, Human
uugucaugauccuucuguuagg

SEQ ID NO: 578012 - RNA, 22 nt, Human
gucauucaaacuguaucacuug

SEQ ID NO: 578013 - RNA, 22 nt, Human
cccagguggcagaagcugcagu

SEQ ID NO: 578014 - RNA, 22 nt, Human
uccugagauaggaguugaaggc

SEQ ID NO: 578015 - RNA, 22 nt, Human
uuuaucuguuguacauuuaugc

SEQ ID NO: 578016 - RNA, 22 nt, Human
uacagucaagcauaagaaguca

SEQ ID NO: 578017 - RNA, 22 nt, Human
agcugcaggcccaugcucaguc

SEQ ID NO: 578018 - RNA, 22 nt, Human
cuuagaaugggacccaaugggu

SEQ ID NO: 578019 - RNA, 22 nt, Human
uccaguuugguucuguucucca

SEQ ID NO: 578020 - RNA, 22 nt, Human
acauggaaaacuaacugcuuuu

SEQ ID NO: 578021 - RNA, 22 nt, Human
uugucucucauuccugcaacuc

SEQ ID NO: 578022 - RNA, 22 nt, Human
guauuuccuauagugagggccu

SEQ ID NO: 578023 - RNA, 22 nt, Human
agcuggagccagugugaggcuu

SEQ ID NO: 578024 - RNA, 22 nt, Human
aaaguuuuguugauuguggaau

SEQ ID NO: 578025 - RNA, 22 nt, Human
gugcagugagcagugcagcacc

SEQ ID NO: 578026 - RNA, 22 nt, Human
aucauuauaaugguauaguugu

SEQ ID NO: 578027 - RNA, 22 nt, Human
aucuacaacaucacauggcauu

SEQ ID NO: 578028 - RNA, 22 nt, Human
acccaaagcaauauucaucagu

SEQ ID NO: 578029 - RNA, 22 nt, Human
aggcacaaaagcagggugacca

SEQ ID NO: 578030 - RNA, 22 nt, Human
ucaguguuuccuagagcauaua

SEQ ID NO: 578031 - RNA, 22 nt, Human
auucuacaacccaauaauaauu

SEQ ID NO: 578032 - RNA, 22 nt, Human
ccagcccucacugaggccucuc

SEQ ID NO: 578033 - RNA, 22 nt, Human
ucuaaagagaaccuuuucucau

SEQ ID NO: 578034 - RNA, 22 nt, Human
gggugcaggggacccuagggac

SEQ ID NO: 578035 - RNA, 20 nt, Human
auacaagaugaguaauuucu

SEQ ID NO: 578036 - RNA, 22 nt, Human
uucucacaggcuggaaugauga

SEQ ID NO: 578037 - RNA, 22 nt, Human
aacagcuuagaaauguugcuaa

SEQ ID NO: 578038 - RNA, 22 nt, Human
gccaggcuguggggaacuugaa

SEQ ID NO: 578039 - RNA, 22 nt, Human
agcugguugacguuauccagga

SEQ ID NO: 578040 - RNA, 22 nt, Human
ucaaauaugugauagaagcuaa

SEQ ID NO: 578041 - RNA, 22 nt, Human
uccugccuucauacugcuguau

SEQ ID NO: 578042 - RNA, 21 nt, Human
gaccccagaccagcagacaca

SEQ ID NO: 578043 - RNA, 22 nt, Human
uagcuauuuggaaaauuccaau

SEQ ID NO: 578044 - RNA, 22 nt, Human
ucaugcuuugguugcuguccuu

SEQ ID NO: 578045 - RNA, 22 nt, Human
accugagggcccaaacuuggua

SEQ ID NO: 578046 - RNA, 21 nt, Human
cucagagacaaaugccauccc

SEQ ID NO: 578047 - RNA, 22 nt, Human
ugcccuuaugaaagaggcccaa

SEQ ID NO: 578048 - RNA, 17 nt, Human
gaggagcuccaguaggu

SEQ ID NO: 578049 - RNA, 22 nt, Human
aacaggaaauacuuaugaggua

SEQ ID NO: 578050 - RNA, 22 nt, Human
uggcuccuaucaaggagugggu

SEQ ID NO: 578051 - RNA, 22 nt, Human
cagcucugccacuuccuagcua

SEQ ID NO: 578052 - RNA, 22 nt, Human
ugcacuuugcaggcauggaaac

SEQ ID NO: 578053 - RNA, 22 nt, Human
ucauuuucccacugaagcuguc

SEQ ID NO: 578054 - RNA, 22 nt, Human
cuucuucucuacauccuuugau

SEQ ID NO: 578055 - RNA, 22 nt, Human
uguccuggugcuccagguggcu

SEQ ID NO: 578056 - RNA, 22 nt, Human
agugcugggauuacaggcauaa

SEQ ID NO: 578057 - RNA, 22 nt, Human
agugcugggauugcaggcauga

SEQ ID NO: 578058 - RNA, 22 nt, Human
aagaucagaacuuuauacagga

SEQ ID NO: 578059 - RNA, 22 nt, Human
gagagccagcaguaaagacauu

SEQ ID NO: 578060 - RNA, 22 nt, Human
gcagggcugcugaaacuuguuu

SEQ ID NO: 578061 - RNA, 22 nt, Human
uccaggcuucacgucugcccuc

SEQ ID NO: 578062 - RNA, 22 nt, Human
acuuccuggauucccaagggcu

SEQ ID NO: 578063 - RNA, 22 nt, Human
gcugagucagauugcagucuug

SEQ ID NO: 578064 - RNA, 22 nt, Human
aggcaggccgugucccuccuca

SEQ ID NO: 578065 - RNA, 22 nt, Human
agugggaggcggcugacgggcg

SEQ ID NO: 578066 - RNA, 22 nt, Human
cccagcaguacccaagcccuug

SEQ ID NO: 578067 - RNA, 22 nt, Human
uuuuguguuguaaugucagcua

SEQ ID NO: 578068 - RNA, 22 nt, Human
ccaagagguugaggcugcagug

SEQ ID NO: 578069 - RNA, 22 nt, Human
gaggcagcuuaggguacugacu

SEQ ID NO: 578070 - RNA, 22 nt, Human
ccaggagcuggcauguggagag

SEQ ID NO: 578071 - RNA, 22 nt, Human
ccaggguggggcaggcccacug

SEQ ID NO: 578072 - RNA, 22 nt, Human
uugaggcagggcaugguggccc

SEQ ID NO: 578073 - RNA, 20 nt, Human
cugagcccccagccugcagg

SEQ ID NO: 578074 - RNA, 22 nt, Human
agcugaggcaugaugcuaucag

SEQ ID NO: 578075 - RNA, 22 nt, Human
aggaggccccuccuggguugcu

SEQ ID NO: 578076 - RNA, 22 nt, Human
ucauuucaaguucugacagcua

SEQ ID NO: 578077 - RNA, 22 nt, Human
ugugcuucucacaucacuguug

SEQ ID NO: 578078 - RNA, 22 nt, Human
ugacacugccgaaacuguagag

SEQ ID NO: 578079 - RNA, 19 nt, Human
acagugcuucugagugagg

SEQ ID NO: 578080 - RNA, 19 nt, Human
acugucacauaaaggaagg

SEQ ID NO: 578081 - RNA, 22 nt, Human
cccagcacuuugaauaugucac

SEQ ID NO: 578082 - RNA, 22 nt, Human
cuggagccuagguugaccuggg

SEQ ID NO: 578083 - RNA, 23 nt, Human
aaagaugugaguauucauauggc

SEQ ID NO: 578084 - RNA, 22 nt, Human
ugacagcauaacacuggucuug

SEQ ID NO: 578085 - RNA, 22 nt, Human
ugugaagguaaggaggggcaag

SEQ ID NO: 578086 - RNA, 22 nt, Human
uaguacaguacugggcucuagu

SEQ ID NO: 578087 - RNA, 23 nt, Human
uucugcauguuucagagcuggga

SEQ ID NO: 578088 - RNA, 22 nt, Human
ccugggcaucucaugcaccugc

SEQ ID NO: 578089 - RNA, 22 nt, Human
caggccagaguccaacuccaga

SEQ ID NO: 578090 - RNA, 22 nt, Human
cacagagauggccagggcacau

SEQ ID NO: 578091 - RNA, 22 nt, Human
auuauaggcuugagccaccgug

SEQ ID NO: 578092 - RNA, 21 nt, Human
uaagcuaaacauucaguuaac

SEQ ID NO: 578093 - RNA, 22 nt, Human
uccucccugcacucagugaagu

SEQ ID NO: 578094 - RNA, 22 nt, Human
auccucagagaacgaacacaau

SEQ ID NO: 578095 - RNA, 22 nt, Human
ugcagggcccuugggguugaac

SEQ ID NO: 578096 - RNA, 22 nt, Human
ccagugcuucuuugcuagcugg

SEQ ID NO: 578097 - RNA, 22 nt, Human
cagacacuauuguguauaaauc

SEQ ID NO: 578098 - RNA, 22 nt, Human
uuuucuauuaacucauuuugca

SEQ ID NO: 578099 - RNA, 22 nt, Human
ugcagagguuuccaggcaaguu

SEQ ID NO: 578100 - RNA, 22 nt, Human
guugaguggguuaggaugcuga

SEQ ID NO: 578101 - RNA, 22 nt, Human
uucagaaaggauaauuggaagg

SEQ ID NO: 578102 - RNA, 22 nt, Human
gcagggccagugcagagaggaa

SEQ ID NO: 578103 - RNA, 22 nt, Human
agccagcuggugggucagcugg

SEQ ID NO: 578104 - RNA, 22 nt, Human
gagugaguggccaggaggcaga

SEQ ID NO: 578105 - RNA, 22 nt, Human
ucaggcugcuggccagcaggcu

SEQ ID NO: 578106 - RNA, 22 nt, Human
gagcaaagcuuuuagggccuuu

SEQ ID NO: 578107 - RNA, 18 nt, Human
acaggcuauugcaggaga

SEQ ID NO: 578108 - RNA, 22 nt, Human
gacacucuccuccaguggauag

SEQ ID NO: 578109 - RNA, 22 nt, Human
ccuggcugaacaaagucccucc

SEQ ID NO: 578110 - RNA, 22 nt, Human
cauuucagugucuugugaugaa

SEQ ID NO: 578111 - RNA, 22 nt, Human
uguauuaugauuguuguucaug

SEQ ID NO: 578112 - RNA, 22 nt, Human
uagaaaccaucucacugcucag

SEQ ID NO: 578113 - RNA, 22 nt, Human
ucucacacuauuucaggugacu

SEQ ID NO: 578114 - RNA, 22 nt, Human
cacugucuuuugugaagacaau

SEQ ID NO: 578115 - RNA, 22 nt, Human
cuuaauuucaaacugcuaguga

SEQ ID NO: 578116 - RNA, 22 nt, Human
ucugccuguugagccuaaggcc

SEQ ID NO: 578117 - RNA, 22 nt, Human
uggagggcucuuucaccuggua

SEQ ID NO: 578118 - RNA, 22 nt, Human
cgagguaguggcggccgcggcc

SEQ ID NO: 578119 - RNA, 22 nt, Human
uaacaaugguuuugcugauaau

SEQ ID NO: 578120 - RNA, 22 nt, Human
uuagugauaggacuuuaaagcc

SEQ ID NO: 578121 - RNA, 22 nt, Human
gacagcuucuaugugacgagca

SEQ ID NO: 578122 - RNA, 22 nt, Human
caggagcucaagaccacccugg

SEQ ID NO: 578123 - RNA, 23 nt, Human
ucuguuuugcaacaugugacaag

SEQ ID NO: 578124 - RNA, 22 nt, Human
cagaggcugccagccaugugca

SEQ ID NO: 578125 - RNA, 22 nt, Human
cagagacaggcuugcccuccac

SEQ ID NO: 578126 - RNA, 22 nt, Human
ccagcucuuggugcacuuacau

SEQ ID NO: 578127 - RNA, 22 nt, Human
ugaagccacuuuccagaaucac

SEQ ID NO: 578128 - RNA, 22 nt, Human
cuacagugucgugugguuucug

SEQ ID NO: 578129 - RNA, 22 nt, Human
gcuggagauacugcucaguauc

SEQ ID NO: 578130 - RNA, 23 nt, Human
acagggcuagcugacagugguau

SEQ ID NO: 578131 - RNA, 22 nt, Human
auucuuguaaauuuugugugaa

SEQ ID NO: 578132 - RNA, 22 nt, Human
cagagagagugggguguggauu

SEQ ID NO: 578133 - RNA, 22 nt, Human
ggcuuccuccuuccugcuguca

SEQ ID NO: 578134 - RNA, 22 nt, Human
uggaaagagguagaggaucugg

SEQ ID NO: 578135 - RNA, 22 nt, Human
ucuggagaggaggauguggaca

SEQ ID NO: 578136 - RNA, 22 nt, Human
caaagaccauguggccugaaaa

SEQ ID NO: 578137 - RNA, 22 nt, Human
auaguuuccauugcugaccaaa

SEQ ID NO: 578138 - RNA, 22 nt, Human
cuucaaaucccccugaguuuga

SEQ ID NO: 578139 - RNA, 22 nt, Human
ucaaugaaagagcaugcauuuu

SEQ ID NO: 578140 - RNA, 22 nt, Human
aagggcuggcccugggaagagu

SEQ ID NO: 578141 - RNA, 22 nt, Human
accacuggccugguggggacca

SEQ ID NO: 578142 - RNA, 22 nt, Human
aggaaaaugaaacagcaacugu

SEQ ID NO: 578143 - RNA, 22 nt, Human
uauguacucuaauuugucucau

SEQ ID NO: 578144 - RNA, 22 nt, Human
acagcagguuuuaacuuugaag

SEQ ID NO: 578145 - RNA, 22 nt, Human
gagcuucuuguuucuucaucug

SEQ ID NO: 578146 - RNA, 22 nt, Human
uuaaagcaaaaacuaggaugga

SEQ ID NO: 578147 - RNA, 22 nt, Human
aacuucauuccuuuuuaugacu

SEQ ID NO: 578148 - RNA, 22 nt, Human
accucagaggaggcuccuggcu

SEQ ID NO: 578149 - RNA, 22 nt, Human
cugauuccugauucaugcucuu

SEQ ID NO: 578150 - RNA, 22 nt, Human
augauauuuuaguaaagugaua

SEQ ID NO: 578151 - RNA, 22 nt, Human
ugucccaggccucauguugcca

SEQ ID NO: 578152 - RNA, 22 nt, Human
caccagguuccgggcagagcug

SEQ ID NO: 578153 - RNA, 22 nt, Human
uuggccaaaggaaagacuacug

SEQ ID NO: 578154 - RNA, 22 nt, Human
ggaggccaggugggagucaucu

SEQ ID NO: 578155 - RNA, 22 nt, Human
ccaggcccaccuuggccacuua

SEQ ID NO: 578156 - RNA, 22 nt, Human
gauguucuagaagugugguguu

SEQ ID NO: 578157 - RNA, 22 nt, Human
ucagaacagaagaaggaacacg

SEQ ID NO: 578158 - RNA, 22 nt, Human
gggguggauuccuacaggucca

SEQ ID NO: 578159 - RNA, 22 nt, Human
ugugggaaucagccaggggggc

SEQ ID NO: 578160 - RNA, 22 nt, Human
uuuagacauagcugaaaucauu

SEQ ID NO: 578161 - RNA, 22 nt, Human
auugugcaguaaaguccuuuuc

SEQ ID NO: 578162 - RNA, 22 nt, Human
ugaaugaugaggggagaauaau

SEQ ID NO: 578163 - RNA, 22 nt, Human
ucugagaacauaaauugacuuc

SEQ ID NO: 578164 - RNA, 22 nt, Human
uuucugccaaccauuuaaacuc

SEQ ID NO: 578165 - RNA, 22 nt, Human
gcagggcugauguuauugacga

SEQ ID NO: 578166 - RNA, 22 nt, Human
aggccaaagcacagagcuggaa

SEQ ID NO: 578167 - RNA, 22 nt, Human
gagagugucgggggccccagga

SEQ ID NO: 578168 - RNA, 22 nt, Human
auucugauaucuuauucuagcu

SEQ ID NO: 578169 - RNA, 21 nt, Human
ggugacacguggccccgcucu

SEQ ID NO: 578170 - RNA, 22 nt, Human
agcacuagacauguaagugagc

SEQ ID NO: 578171 - RNA, 22 nt, Human
acccagggucaccccguagggu

SEQ ID NO: 578172 - RNA, 22 nt, Human
ugagaaagugggugccuagcaa

SEQ ID NO: 578173 - RNA, 22 nt, Human
aaagagcuaacauugccgagau

SEQ ID NO: 578174 - RNA, 22 nt, Human
gaugagacagaauagcccaagg

SEQ ID NO: 578175 - RNA, 22 nt, Human
gaaaauuuaauucucuucugug

SEQ ID NO: 578176 - RNA, 22 nt, Human
cugugggaauacugcgagugua

SEQ ID NO: 578177 - RNA, 19 nt, Human
ugagugaaggccguggugg

SEQ ID NO: 578178 - RNA, 22 nt, Human
gggcagugucggggcccaggga

SEQ ID NO: 578179 - RNA, 22 nt, Human
caggguggugaauagcuauagu

SEQ ID NO: 578180 - RNA, 22 nt, Human
acacauuaaaacgucuacaaug

SEQ ID NO: 578181 - RNA, 22 nt, Human
gaggcagagugcaccccaggag

SEQ ID NO: 578182 - RNA, 22 nt, Human
uacaggaagcacucaagaaaug

SEQ ID NO: 578183 - RNA, 22 nt, Human
ucacacagugagaaagugcgga

SEQ ID NO: 578184 - RNA, 22 nt, Human
acccaggcuggaaugcaguggu

SEQ ID NO: 578185 - RNA, 22 nt, Human
ucuuugaacucuguguauuaac

SEQ ID NO: 578186 - RNA, 22 nt, Human
aucauccuauugugccccaggu

SEQ ID NO: 578187 - RNA, 22 nt, Human
cugaggugcuagggucccugcu

SEQ ID NO: 578188 - RNA, 20 nt, Human
ucugggcagggcacauggaa

SEQ ID NO: 578189 - RNA, 22 nt, Human
cgcuggucaccauggcguccug

SEQ ID NO: 578190 - RNA, 18 nt, Human
uguuuccuccuggaggcu

SEQ ID NO: 578191 - RNA, 19 nt, Human
uaaugcacuuaacacaugg

SEQ ID NO: 578192 - RNA, 22 nt, Human
ggugaggaauuggggacugacc

SEQ ID NO: 578193 - RNA, 19 nt, Human
cacuuuauuucuguuuugu

SEQ ID NO: 578194 - RNA, 22 nt, Human
cugcccugugaggguccuuggg

SEQ ID NO: 578195 - RNA, 22 nt, Human
auggcagccugagcagaggaau

SEQ ID NO: 578196 - RNA, 22 nt, Human
auuuauuaagcaucugcuaugu

SEQ ID NO: 578197 - RNA, 22 nt, Human
uuguuuaaaagaaaucauagaa

SEQ ID NO: 578198 - RNA, 22 nt, Human
ugccaggcucaggaugucccug

SEQ ID NO: 578199 - RNA, 22 nt, Human
ggcugcugaaguguggcaaucu

SEQ ID NO: 578200 - RNA, 22 nt, Human
acacuucauagcaagguuggag

SEQ ID NO: 578201 - RNA, 22 nt, Human
ggcaaaggaaaacgucucagcu

SEQ ID NO: 578202 - RNA, 21 nt, Human
ucccagcugggucagugcugc

SEQ ID NO: 578203 - RNA, 22 nt, Human
gcucccaggaagagaagggcca

SEQ ID NO: 578204 - RNA, 22 nt, Human
gcccaggaguuggaggcugcag

SEQ ID NO: 578205 - RNA, 22 nt, Human
uaaugcuuuguuuugaucuaac

SEQ ID NO: 578206 - RNA, 22 nt, Human
ccaggagcauuaagagaacaua

SEQ ID NO: 578207 - RNA, 22 nt, Human
gcagagcucuguucuuaucucc

SEQ ID NO: 578208 - RNA, 21 nt, Human
augaagcaagggucacacgug

SEQ ID NO: 578209 - RNA, 18 nt, Human
agcaggugugcagaaugu

SEQ ID NO: 578210 - RNA, 22 nt, Human
gcuguucccauguggggcucag

SEQ ID NO: 578211 - RNA, 22 nt, Human
cuguguuuggacaacuuuucag

SEQ ID NO: 578212 - RNA, 22 nt, Human
gcugucugagaacaugguggaa

SEQ ID NO: 578213 - RNA, 22 nt, Human
acagccaaggaauuaggaaggg

SEQ ID NO: 578214 - RNA, 22 nt, Human
caaggaaggagagaugaugggu

SEQ ID NO: 578215 - RNA, 22 nt, Human
cacaugcuuagauuucagugga

SEQ ID NO: 578216 - RNA, 22 nt, Human
cauaucuucugacaugaucagg

SEQ ID NO: 578217 - RNA, 22 nt, Human
aaauucuguccugaaugccauu

SEQ ID NO: 578218 - RNA, 22 nt, Human
agcuccuguucugagagcagga

SEQ ID NO: 578219 - RNA, 22 nt, Human
uucuuggagauaaauucuuaca

SEQ ID NO: 578220 - RNA, 22 nt, Human
acagcagagccaguggcucuag

SEQ ID NO: 578221 - RNA, 20 nt, Human
uguuucugacgguaggagag

SEQ ID NO: 578222 - RNA, 22 nt, Human
uagacauuuggaguuuuaugac

SEQ ID NO: 578223 - RNA, 20 nt, Human
uuauuuccaguccagguccu

SEQ ID NO: 578224 - RNA, 22 nt, Human
ccuaccaguaggaggccagaga

SEQ ID NO: 578225 - RNA, 22 nt, Human
uggcugagugaacauguccauu

SEQ ID NO: 578226 - RNA, 22 nt, Human
gcuucugugagugcagaugcug

SEQ ID NO: 578227 - RNA, 22 nt, Human
uugagguauauucacauauauc

SEQ ID NO: 578228 - RNA, 22 nt, Human
aucugaagggaaguggaaggca

SEQ ID NO: 578229 - RNA, 22 nt, Human
caaacugaacacgaaagucuuu

SEQ ID NO: 578230 - RNA, 22 nt, Human
caugucaaccaguuguuugaau

SEQ ID NO: 578231 - RNA, 22 nt, Human
guauuuuucaguuaggagcuua

SEQ ID NO: 578232 - RNA, 22 nt, Human
ugagacagggucuugcucuguu

SEQ ID NO: 578233 - RNA, 22 nt, Human
uccaggcugcagucuugcccuc

SEQ ID NO: 578234 - RNA, 22 nt, Human
ugaucacaagucugaagaauga

SEQ ID NO: 578235 - RNA, 22 nt, Human
accuuuauggagaacuugggau

SEQ ID NO: 578236 - RNA, 22 nt, Human
uuuccucuuugugacacagcug

SEQ ID NO: 578237 - RNA, 19 nt, Human
cucagcuguagcucaugug

SEQ ID NO: 578238 - RNA, 22 nt, Human
ugcaguuuucaaaaguuuacag

SEQ ID NO: 578239 - RNA, 20 nt, Human
gugcauuucaccuguacugu

SEQ ID NO: 578240 - RNA, 18 nt, Human
aaagaaggauuggagagc

SEQ ID NO: 578241 - RNA, 22 nt, Human
gcccaggauaaugcugucccug

SEQ ID NO: 578242 - RNA, 22 nt, Human
cagcucuggcuauugaggacca

SEQ ID NO: 578243 - RNA, 22 nt, Human
uggcagugucuugcuggggcag

SEQ ID NO: 578244 - RNA, 22 nt, Human
ugccagggucagcugcagcucu

SEQ ID NO: 578245 - RNA, 22 nt, Human
ucugaaaugaccuuuccccacu

SEQ ID NO: 578246 - RNA, 22 nt, Human
aaagacauggaacuagagaugg

SEQ ID NO: 578247 - RNA, 20 nt, Human
agggcagagggauuacaggc

SEQ ID NO: 578248 - RNA, 22 nt, Human
uagcuuugggaaugcucuccug

SEQ ID NO: 578249 - RNA, 22 nt, Human
gacagacacaauugauccauga

SEQ ID NO: 578250 - RNA, 23 nt, Human
gaacauucauugguugcuuuaga

SEQ ID NO: 578251 - RNA, 22 nt, Human
cacccagcagcacuuaagacua

SEQ ID NO: 578252 - RNA, 22 nt, Human
ccucccugcuccucaacuggca

SEQ ID NO: 578253 - RNA, 22 nt, Human
aguuaagaauacacaucauaau

SEQ ID NO: 578254 - RNA, 22 nt, Human
ugugccugauggucacguggcc

SEQ ID NO: 578255 - RNA, 22 nt, Human
gagacugcauagauggccacaa

SEQ ID NO: 578256 - RNA, 22 nt, Human
ugaaggugucuuugugaacauc

SEQ ID NO: 578257 - RNA, 22 nt, Human
uggagaaggggcagggucucca

SEQ ID NO: 578258 - RNA, 22 nt, Human
aaguccaaggucaccauucaca

SEQ ID NO: 578259 - RNA, 22 nt, Human
ggccccacgggggaguccuagu

SEQ ID NO: 578260 - RNA, 22 nt, Human
augcauauguacccauguucug

SEQ ID NO: 578261 - RNA, 22 nt, Human
ugucaccucuuuggcugcagcu

SEQ ID NO: 578262 - RNA, 22 nt, Human
uucauauucaaauacucugcuu

SEQ ID NO: 578263 - RNA, 22 nt, Human
ugcuucuuuacuauaggcaauu

SEQ ID NO: 578264 - RNA, 22 nt, Human
guaggcugugugaggcuagaga

SEQ ID NO: 578265 - RNA, 22 nt, Human
cugagaaaugcauuuuuccagc

SEQ ID NO: 578266 - RNA, 21 nt, Human
ugcugccauagaccugaggga

SEQ ID NO: 578267 - RNA, 22 nt, Human
agugggcaggcagggugcgcag

SEQ ID NO: 578268 - RNA, 22 nt, Human
ggacacugaagaaucucagaug

SEQ ID NO: 578269 - RNA, 22 nt, Human
gcuuacaaacaacagaaauuaa

SEQ ID NO: 578270 - RNA, 22 nt, Human
cagcagggcccccgggugcgcc

SEQ ID NO: 578271 - RNA, 22 nt, Human
gccuggagcuacuggacacuga

SEQ ID NO: 578272 - RNA, 22 nt, Human
aauuucuugggagcucagagaa

SEQ ID NO: 578273 - RNA, 22 nt, Human
uucuauaaaugaauguguauau

SEQ ID NO: 578274 - RNA, 22 nt, Human
ccugaccauuugccacaugggu

SEQ ID NO: 578275 - RNA, 22 nt, Human
cugcccugcuggagaucacagu

SEQ ID NO: 578276 - RNA, 22 nt, Human
cuucauuuccauccaacuggga

SEQ ID NO: 578277 - RNA, 22 nt, Human
agagcagguggcaacucuggga

SEQ ID NO: 578278 - RNA, 22 nt, Human
auugcaaucuggugaaaacagu

SEQ ID NO: 578279 - RNA, 19 nt, Human
cucagcacuuuuacacagg

SEQ ID NO: 578280 - RNA, 22 nt, Human
uacaaaguaauguauaauaucg

SEQ ID NO: 578281 - RNA, 21 nt, Human
ccuaguguuaaaacaguuuaa

SEQ ID NO: 578282 - RNA, 22 nt, Human
gguuuuauagcaguacuaucag

SEQ ID NO: 578283 - RNA, 22 nt, Human
guccugugccgaggugggaagc

SEQ ID NO: 578284 - RNA, 22 nt, Human
uucuguguggguagcuccuguu

SEQ ID NO: 578285 - RNA, 22 nt, Human
uuauugcaacuccuaaauagag

SEQ ID NO: 578286 - RNA, 22 nt, Human
gacccugccaugagugacaggg

SEQ ID NO: 578287 - RNA, 21 nt, Human
acccaggggaagcagaaacug

SEQ ID NO: 578288 - RNA, 22 nt, Human
uaggaaauauugauuucaguca

SEQ ID NO: 578289 - RNA, 22 nt, Human
aauaagaauugccagauuugaa

SEQ ID NO: 578290 - RNA, 22 nt, Human
acaugcauacaagcacauguag

SEQ ID NO: 578291 - RNA, 22 nt, Human
ggcagccaugcuccaggugcag

SEQ ID NO: 578292 - RNA, 22 nt, Human
aggggcucaaagugugcaggga

SEQ ID NO: 578293 - RNA, 22 nt, Human
uccugggaaguugcaucaccgu

SEQ ID NO: 578294 - RNA, 22 nt, Human
gcuggcuuccaucagaggguga

SEQ ID NO: 578295 - RNA, 22 nt, Human
guggaugcuuaggcagccuggg

SEQ ID NO: 578296 - RNA, 22 nt, Human
ccugggcagugcuggaguugaa

SEQ ID NO: 578297 - RNA, 21 nt, Human
gccuccagccagauggccucc

SEQ ID NO: 578298 - RNA, 22 nt, Human
ugaggcuuggaggcuccagugg

SEQ ID NO: 578299 - RNA, 22 nt, Human
aggcagaugguaacugugauau

SEQ ID NO: 578300 - RNA, 22 nt, Human
gaggccuggagccgccuaggcg

SEQ ID NO: 578301 - RNA, 22 nt, Human
uccugagaggugugaggugcag

SEQ ID NO: 578302 - RNA, 22 nt, Human
gucacacagggccuccaaauca

SEQ ID NO: 578303 - RNA, 22 nt, Human
uguaguaagugcgcaauaaaua

SEQ ID NO: 578304 - RNA, 22 nt, Human
gcccacacaccagcucaggagg

SEQ ID NO: 578305 - RNA, 22 nt, Human
gaggguuggugcaaaugggaug

SEQ ID NO: 578306 - RNA, 22 nt, Human
ggcaaggggucaggcugagaca

SEQ ID NO: 578307 - RNA, 22 nt, Human
gugcugggauuacaggugugag

SEQ ID NO: 578308 - RNA, 22 nt, Human
cccugaggcugaggauaggugg

SEQ ID NO: 578309 - RNA, 22 nt, Human
uaguggaacugugucauacaaa

SEQ ID NO: 578310 - RNA, 22 nt, Human
auacaugugccauguuggugua

SEQ ID NO: 578311 - RNA, 22 nt, Human
auacacuuuagaaaaacgcugc

SEQ ID NO: 578312 - RNA, 22 nt, Human
agcauuuaauccuacauagauc

SEQ ID NO: 578313 - RNA, 22 nt, Human
ucuuuggggcaucugggagauu

SEQ ID NO: 578314 - RNA, 22 nt, Human
cuugagggacucuaugacuuag

SEQ ID NO: 578315 - RNA, 22 nt, Human
ccagaggggcugagcaggucac

SEQ ID NO: 578316 - RNA, 21 nt, Human
ugggagagcguugcuguccuc

SEQ ID NO: 578317 - RNA, 19 nt, Human
uccugggcguugacuuugg

SEQ ID NO: 578318 - RNA, 22 nt, Human
auugaggagcagagauggggua

SEQ ID NO: 578319 - RNA, 22 nt, Human
ggguggucuggcaggcuggaaa

SEQ ID NO: 578320 - RNA, 22 nt, Human
gcacaugguaggcauuugaugu

SEQ ID NO: 578321 - RNA, 19 nt, Human
gugaggucuuuccuuuugu

SEQ ID NO: 578322 - RNA, 22 nt, Human
ucaguguuuauugcggugugua

SEQ ID NO: 578323 - RNA, 18 nt, Human
gagaggcccggcugugcc

SEQ ID NO: 578324 - RNA, 22 nt, Human
cggggugggaauagaccugucu

SEQ ID NO: 578325 - RNA, 22 nt, Human
ggaaggagccauaucauaucca

SEQ ID NO: 578326 - RNA, 22 nt, Human
ccuccagcugccucagucucuu

SEQ ID NO: 578327 - RNA, 19 nt, Human
ccacuggggcuccacauua

SEQ ID NO: 578328 - RNA, 22 nt, Human
uuuauugucuucguggugccua

SEQ ID NO: 578329 - RNA, 22 nt, Human
gucucugugccuucuccccacc

SEQ ID NO: 578330 - RNA, 22 nt, Human
aguguaaacuuaagagaauauc

SEQ ID NO: 578331 - RNA, 22 nt, Human
auaguuaugcucuagacaagaa

SEQ ID NO: 578332 - RNA, 17 nt, Human
agccaggcauaugaagu

SEQ ID NO: 578333 - RNA, 22 nt, Human
caguuccucaaagguuaaaugu

SEQ ID NO: 578334 - RNA, 18 nt, Human
ccuggaguguguuaggcu

SEQ ID NO: 578335 - RNA, 22 nt, Human
aggcugagaaagugggaagaug

SEQ ID NO: 578336 - RNA, 22 nt, Human
cacaugugugcugaggacugug

SEQ ID NO: 578337 - RNA, 22 nt, Human
agagcccugacggggacagaug

SEQ ID NO: 578338 - RNA, 22 nt, Human
agugucacaaaccugccuugua

SEQ ID NO: 578339 - RNA, 22 nt, Human
gcugcuugauuagguugacacu

SEQ ID NO: 578340 - RNA, 22 nt, Human
agauucauuaucuucuuuguac

SEQ ID NO: 578341 - RNA, 20 nt, Human
cagagccaagagcagcaucu

SEQ ID NO: 578342 - RNA, 22 nt, Human
aaaccacaguucagugcuuuug

SEQ ID NO: 578343 - RNA, 22 nt, Human
uagcccagagucccaauuccag

SEQ ID NO: 578344 - RNA, 22 nt, Human
aacaguuugagcuuugaauuuc

SEQ ID NO: 578345 - RNA, 22 nt, Human
gggcugagggguaucucauggg

SEQ ID NO: 578346 - RNA, 22 nt, Human
uuccagaaaucuuucagcucaa

SEQ ID NO: 578347 - RNA, 22 nt, Human
aggugggcaccaggcuuguggu

SEQ ID NO: 578348 - RNA, 22 nt, Human
gcacggcuaauuuuuguauuuu

SEQ ID NO: 578349 - RNA, 22 nt, Human
ggcugaugggcaugagcuguca

SEQ ID NO: 578350 - RNA, 22 nt, Human
caaauggcuggcauccuucuac

SEQ ID NO: 578351 - RNA, 22 nt, Human
uagcauuagucagauauguuuu

SEQ ID NO: 578352 - RNA, 22 nt, Human
aauacuuuugaacugaaaggca

SEQ ID NO: 578353 - RNA, 22 nt, Human
agcuuugaaugagugcauugca

SEQ ID NO: 578354 - RNA, 22 nt, Human
uggucgaccaguuggaaaguaa

SEQ ID NO: 578355 - RNA, 22 nt, Human
ugugacuugauguuugcaccag

SEQ ID NO: 578356 - RNA, 22 nt, Human
ugaaguuagaacuaugaggaua

SEQ ID NO: 578357 - RNA, 22 nt, Human
cuggaacaguguuggagcuuga

SEQ ID NO: 578358 - RNA, 22 nt, Human
acaugaaaccugagucuaacuc

SEQ ID NO: 578359 - RNA, 22 nt, Human
accugccuaucagcugccugcu

SEQ ID NO: 578360 - RNA, 22 nt, Human
aaagagcucacaguccacugga

SEQ ID NO: 578361 - RNA, 22 nt, Human
ccuccuucuggggccuucugcu

SEQ ID NO: 578362 - RNA, 22 nt, Human
cugggaggcagucucucuagaa

SEQ ID NO: 578363 - RNA, 22 nt, Human
auagucuuagucuauaguuuug

SEQ ID NO: 578364 - RNA, 22 nt, Human
uuccagugaaacaugaggugug

SEQ ID NO: 578365 - RNA, 23 nt, Human
uauuugcuacugguaauucugga

SEQ ID NO: 578366 - RNA, 22 nt, Human
ugacagaaugugacucucagau

SEQ ID NO: 578367 - RNA, 22 nt, Human
uuccuucuuccagaggcugccc

SEQ ID NO: 578368 - RNA, 22 nt, Human
aaggcugagguagggccuaaaa

SEQ ID NO: 578369 - RNA, 22 nt, Human
uuuuaugugugaaaugcugucu

SEQ ID NO: 578370 - RNA, 22 nt, Human
cuuucucuucgaaaaccugccc

SEQ ID NO: 578371 - RNA, 22 nt, Human
augcuaaauguuaauguuaccu

SEQ ID NO: 578372 - RNA, 22 nt, Human
auauuucucucagacauggaag

SEQ ID NO: 578373 - RNA, 22 nt, Human
aaagaauacccugggucauaaa

SEQ ID NO: 578374 - RNA, 22 nt, Human
cugugaguucauugugccaccu

SEQ ID NO: 578375 - RNA, 22 nt, Human
ggugaaggucagagcaggaaaa

SEQ ID NO: 578376 - RNA, 22 nt, Human
gagcucagauucuggugucaga

SEQ ID NO: 578377 - RNA, 20 nt, Human
acugagcugcauggagagga

SEQ ID NO: 578378 - RNA, 22 nt, Human
auguauugucucuuuuccuuaa

SEQ ID NO: 578379 - RNA, 22 nt, Human
ggccaggccaagaggguuggaa

SEQ ID NO: 578380 - RNA, 22 nt, Human
acuggggcagugggcagugguu

SEQ ID NO: 578381 - RNA, 22 nt, Human
aaggcagaaagggaugugagug

SEQ ID NO: 578382 - RNA, 22 nt, Human
ucccaggacccaggcauucaca

SEQ ID NO: 578383 - RNA, 22 nt, Human
ucugcagcuucuugccagagag

SEQ ID NO: 578384 - RNA, 22 nt, Human
cauuacaucuuugaugcaguau

SEQ ID NO: 578385 - RNA, 22 nt, Human
uauaaagagucuaucugguggc

SEQ ID NO: 578386 - RNA, 21 nt, Human
gagacagacuuucguccccug

SEQ ID NO: 578387 - RNA, 22 nt, Human
uuccaggacucguucuggcuca

SEQ ID NO: 578388 - RNA, 22 nt, Human
uagcuguguagacacucagagc

SEQ ID NO: 578389 - RNA, 22 nt, Human
uaaauugagauuauuaggguaa

SEQ ID NO: 578390 - RNA, 22 nt, Human
ugggagccauuuuagaggcugc

SEQ ID NO: 578391 - RNA, 22 nt, Human
ggccagcagucacagggucaga

SEQ ID NO: 578392 - RNA, 22 nt, Human
uaacauuccauggaucugcaga

SEQ ID NO: 578393 - RNA, 20 nt, Human
aaucacuuuguacaggaagc

SEQ ID NO: 578394 - RNA, 22 nt, Human
uccuuucuucuucugcccaugg

SEQ ID NO: 578395 - RNA, 22 nt, Human
aaaguuguucaguaagaaacuc

SEQ ID NO: 578396 - RNA, 22 nt, Human
ucccugggcacaaucugcuggc

SEQ ID NO: 578397 - RNA, 17 nt, Human
gaacaguguaagacacu

SEQ ID NO: 578398 - RNA, 22 nt, Human
ccucacagaggggcagccaucu

SEQ ID NO: 578399 - RNA, 21 nt, Human
ggaagcaguggcggcaacucc

SEQ ID NO: 578400 - RNA, 22 nt, Human
ccagaggaguugaggcuuuggg

SEQ ID NO: 578401 - RNA, 22 nt, Human
gcaaaaaccacaauuacuuuua

SEQ ID NO: 578402 - RNA, 22 nt, Human
aggagcugagucagcccgacag

SEQ ID NO: 578403 - RNA, 21 nt, Human
ugccaggccugagcugggguc

SEQ ID NO: 578404 - RNA, 22 nt, Human
uagugauuauaaaacaguuuuu

SEQ ID NO: 578405 - RNA, 22 nt, Human
agcugaggccugauuucgccgu

SEQ ID NO: 578406 - RNA, 22 nt, Human
uccacugcagcuucugauggaa

SEQ ID NO: 578407 - RNA, 22 nt, Human
uucuguuucuggggucucugac

SEQ ID NO: 578408 - RNA, 22 nt, Human
ucccaaaguauuagcauuucaa

SEQ ID NO: 578409 - RNA, 22 nt, Human
cuggagggcuucugcagguuac

SEQ ID NO: 578410 - RNA, 22 nt, Human
caguuaauguccuauacaauag

SEQ ID NO: 578411 - RNA, 22 nt, Human
ucaggcugguggucagauggcu

SEQ ID NO: 578412 - RNA, 22 nt, Human
cauaacuugguguuggaaacug

SEQ ID NO: 578413 - RNA, 22 nt, Human
acacaugcugauaagaauauaa

SEQ ID NO: 578414 - RNA, 22 nt, Human
ugugaguuauuuucaggaguuu

SEQ ID NO: 578415 - RNA, 22 nt, Human
uauccaauucaccauugauggg

SEQ ID NO: 578416 - RNA, 20 nt, Human
agggccuggaguacagcagg

SEQ ID NO: 578417 - RNA, 22 nt, Human
gcuuggaaguaggauugggaga

SEQ ID NO: 578418 - RNA, 22 nt, Human
caguguuuagcacagugcuugg

SEQ ID NO: 578419 - RNA, 22 nt, Human
ugagguaggagggugaucagca

SEQ ID NO: 578420 - RNA, 22 nt, Human
agcugccaccucugccuuuggg

SEQ ID NO: 578421 - RNA, 22 nt, Human
gaaccacaaugugaagaaggag

SEQ ID NO: 578422 - RNA, 22 nt, Human
ucguuaaaugcuaaaacugaca

SEQ ID NO: 578423 - RNA, 21 nt, Human
agcaggcaaaggugaagucuu

SEQ ID NO: 578424 - RNA, 22 nt, Human
augcugagugagugaaacccag

SEQ ID NO: 578425 - RNA, 22 nt, Human
ugggggcauggaccagccuggc

SEQ ID NO: 578426 - RNA, 22 nt, Human
cuggaagaguccuaaacagaua

SEQ ID NO: 578427 - RNA, 22 nt, Human
ccagcccugaacccugcugcau

SEQ ID NO: 578428 - RNA, 22 nt, Human
ucaguaaaaccugcuuuuagug

SEQ ID NO: 578429 - RNA, 22 nt, Human
uggcacagccacugaaucggga

SEQ ID NO: 578430 - RNA, 22 nt, Human
uacacaugcauguacuccagga

SEQ ID NO: 578431 - RNA, 22 nt, Human
aauaaguugccuguugaaucau

SEQ ID NO: 578432 - RNA, 22 nt, Human
acaugcuuguuuuucacaaccu

SEQ ID NO: 578433 - RNA, 22 nt, Human
agccagcuaagggaagcaugau

SEQ ID NO: 578434 - RNA, 22 nt, Human
cugggcuccacuacuugcuaac

SEQ ID NO: 578435 - RNA, 22 nt, Human
gcuuccuugggaaaauuagaug

SEQ ID NO: 578436 - RNA, 22 nt, Human
ccacccacaaccagcuggcugu

SEQ ID NO: 578437 - RNA, 22 nt, Human
ucucacaggugcacguggcugu

SEQ ID NO: 578438 - RNA, 22 nt, Human
ugagauggagucucacucuguu

SEQ ID NO: 578439 - RNA, 22 nt, Human
uugucuguaaagacggccacca

SEQ ID NO: 578440 - RNA, 22 nt, Human
ggcagugaaucugagagccugg

SEQ ID NO: 578441 - RNA, 22 nt, Human
auucuuuucccaacugcuuuaa

SEQ ID NO: 578442 - RNA, 22 nt, Human
uucuuugaguuaguacagucca

SEQ ID NO: 578443 - RNA, 22 nt, Human
augcauauuuucuguuggugac

SEQ ID NO: 578444 - RNA, 22 nt, Human
uucugaaaacacacuuugcagc

SEQ ID NO: 578445 - RNA, 22 nt, Human
cucucuggcacuucauugcugu

SEQ ID NO: 578446 - RNA, 22 nt, Human
augcagauaagaaucagguuug

SEQ ID NO: 578447 - RNA, 22 nt, Human
cugggagauugaggccauggug

SEQ ID NO: 578448 - RNA, 22 nt, Human
uuguaacagcuguuuauauagu

SEQ ID NO: 578449 - RNA, 23 nt, Human
uccugaggaauggcaucucacau

SEQ ID NO: 578450 - RNA, 20 nt, Human
ugagagcugggcagggauac

SEQ ID NO: 578451 - RNA, 22 nt, Human
aauguaaaguugggcacaaaug

SEQ ID NO: 578452 - RNA, 20 nt, Human
auguuuuauaaaagaacggg

SEQ ID NO: 578453 - RNA, 22 nt, Human
ucagaagcuaaauuugauauuu

SEQ ID NO: 578454 - RNA, 22 nt, Human
gcaggguccauggaggcagccc

SEQ ID NO: 578455 - RNA, 23 nt, Human
acaaugucuguucauaaaauacc

SEQ ID NO: 578456 - RNA, 22 nt, Human
aggugcugugcuaugcacuugu

SEQ ID NO: 578457 - RNA, 22 nt, Human
ugaggcagccugcauuaaagag

SEQ ID NO: 578458 - RNA, 22 nt, Human
uucuuguucugguucuguuagc

SEQ ID NO: 578459 - RNA, 22 nt, Human
gcucagggaacuuuuugcaggc

SEQ ID NO: 578460 - RNA, 22 nt, Human
uccaaaggcaaaacuguggugu

SEQ ID NO: 578461 - RNA, 22 nt, Human
gggcagcacagacagugaaggc

SEQ ID NO: 578462 - RNA, 22 nt, Human
cuuuaugaaaaccagauugggg

SEQ ID NO: 578463 - RNA, 22 nt, Human
gaauuuuaucuuauuacuugca

SEQ ID NO: 578464 - RNA, 22 nt, Human
uacaaagugggaaacgaagguu

SEQ ID NO: 578465 - RNA, 22 nt, Human
ggaggccuugaggccaggagcu

SEQ ID NO: 578466 - RNA, 22 nt, Human
ccuugccucauugugcuucucc

SEQ ID NO: 578467 - RNA, 21 nt, Human
ugagggguuauaacagggugg

SEQ ID NO: 578468 - RNA, 22 nt, Human
agcaguggcugaagauguuccu

SEQ ID NO: 578469 - RNA, 22 nt, Human
gcuuucugugcagugaacacua

SEQ ID NO: 578470 - RNA, 21 nt, Human
gacaggacuagaccagagcuc

SEQ ID NO: 578471 - RNA, 20 nt, Human
ccagguggugccuggagagg

SEQ ID NO: 578472 - RNA, 22 nt, Human
auucugcugguaacucuauaaa

SEQ ID NO: 578473 - RNA, 22 nt, Human
uuugggcaauucagugggaccu

SEQ ID NO: 578474 - RNA, 22 nt, Human
agcagguguaucggucaccuac

SEQ ID NO: 578475 - RNA, 22 nt, Human
acuuuacuccccaacauaaaug

SEQ ID NO: 578476 - RNA, 22 nt, Human
gagcuuggugcacagugguuaa

SEQ ID NO: 578477 - RNA, 22 nt, Human
acugcccagaagagaugaaagu

SEQ ID NO: 578478 - RNA, 22 nt, Human
agcaggcuaagggaccuguuua

SEQ ID NO: 578479 - RNA, 22 nt, Human
agugggagccagcagcuugggg

SEQ ID NO: 578480 - RNA, 22 nt, Human
agggcuccaggggcugggugac

SEQ ID NO: 578481 - RNA, 22 nt, Human
guuauuguuuauccugcacccc

SEQ ID NO: 578482 - RNA, 16 nt, Human
gagggcagaggcggaa

SEQ ID NO: 578483 - RNA, 22 nt, Human
gagcuuuguuccgugguggcac

SEQ ID NO: 578484 - RNA, 22 nt, Human
aagggcugaucucacuuucuuu

SEQ ID NO: 578485 - RNA, 22 nt, Human
uaugcaaacaguucaggugaca

SEQ ID NO: 578486 - RNA, 22 nt, Human
uacuuugaccaccaucugauua

SEQ ID NO: 578487 - RNA, 22 nt, Human
uggcaaaggaaaugauuuaaga

SEQ ID NO: 578488 - RNA, 22 nt, Human
gacuggagugccuccaggaaag

SEQ ID NO: 578489 - RNA, 20 nt, Human
aaauuuaggaaauuuuacgc

SEQ ID NO: 578490 - RNA, 22 nt, Human
uaggggugggauccaggaauua

SEQ ID NO: 578491 - RNA, 22 nt, Human
cagcucagcuuccugggugugu

SEQ ID NO: 578492 - RNA, 22 nt, Human
cacaagauggucacauaagugc

SEQ ID NO: 578493 - RNA, 22 nt, Human
gcuugccuggcauuucuggggc

SEQ ID NO: 578494 - RNA, 18 nt, Human
acagggagggcgcugggg

SEQ ID NO: 578495 - RNA, 22 nt, Human
uguuuuguagcuaauagcuauu

SEQ ID NO: 578496 - RNA, 22 nt, Human
cucuccagggguagaugccuuc

SEQ ID NO: 578497 - RNA, 22 nt, Human
gcuuggcagggccugcuggagc

SEQ ID NO: 578498 - RNA, 22 nt, Human
cucaugucaggggugucaaugu

SEQ ID NO: 578499 - RNA, 22 nt, Human
cauacaguguggcauguagucu

SEQ ID NO: 578500 - RNA, 22 nt, Human
uccagggcauggggagagagug

SEQ ID NO: 578501 - RNA, 22 nt, Human
uaggcugagguugaugccaggg

SEQ ID NO: 578502 - RNA, 22 nt, Human
gagguagggcagaggcugaaug

SEQ ID NO: 578503 - RNA, 22 nt, Human
gcuggaguuagaacuagccugg

SEQ ID NO: 578504 - RNA, 22 nt, Human
uuccuucugaagccuuuguguu

SEQ ID NO: 578505 - RNA, 22 nt, Human
augggcugggaauacacagggg

SEQ ID NO: 578506 - RNA, 22 nt, Human
ggcuccaggaaccuccucuccu

SEQ ID NO: 578507 - RNA, 21 nt, Human
gccugccccauguuucuguug

SEQ ID NO: 578508 - RNA, 18 nt, Human
uggcagggaggaaauaua

SEQ ID NO: 578509 - RNA, 22 nt, Human
uaauuuuacuuccugagcaccu

SEQ ID NO: 578510 - RNA, 22 nt, Human
ccaggagcagggcuggcugcac

SEQ ID NO: 578511 - RNA, 22 nt, Human
uuucuccugaguuccacgcuac

SEQ ID NO: 578512 - RNA, 22 nt, Human
gagcucccuggagguucagaua

SEQ ID NO: 578513 - RNA, 22 nt, Human
acucagcuaaacucagucuaug

SEQ ID NO: 578514 - RNA, 22 nt, Human
aggggcagccucacaauccucu

SEQ ID NO: 578515 - RNA, 22 nt, Human
aggagaaggaggccccucacac

SEQ ID NO: 578516 - RNA, 22 nt, Human
cuugccuuugucuucaaaggcu

SEQ ID NO: 578517 - RNA, 22 nt, Human
ucuagaaacaugacauugaucu

SEQ ID NO: 578518 - RNA, 22 nt, Human
ccuagucuuccgcguccccacc

SEQ ID NO: 578519 - RNA, 23 nt, Human
aggugcccagggcagguuuacug

SEQ ID NO: 578520 - RNA, 23 nt, Human
aggauggguggcaauagaaagac

SEQ ID NO: 578521 - RNA, 22 nt, Human
auggacagugugaagcagauag

SEQ ID NO: 578522 - RNA, 22 nt, Human
acccagcucuuugauggucuug

SEQ ID NO: 578523 - RNA, 22 nt, Human
ggaugaggaagauuacugagaa

SEQ ID NO: 578524 - RNA, 22 nt, Human
ucacaguaguuguucucuguuu

SEQ ID NO: 578525 - RNA, 22 nt, Human
aucugcaggaaugugugcagag

SEQ ID NO: 578526 - RNA, 22 nt, Human
cagccaccauacagcagaagcu

SEQ ID NO: 578527 - RNA, 22 nt, Human
cugggaaauggcuucgagcuca

SEQ ID NO: 578528 - RNA, 22 nt, Human
uuagcaaacccuugcuggugag

SEQ ID NO: 578529 - RNA, 22 nt, Human
ugugcucuggaguugccuucac

SEQ ID NO: 578530 - RNA, 22 nt, Human
ucagccaggcagcccccugguc

SEQ ID NO: 578531 - RNA, 22 nt, Human
cuggagaggcugggaacagguu

SEQ ID NO: 578532 - RNA, 22 nt, Human
uccugcagcugcagaccugggg

SEQ ID NO: 578533 - RNA, 22 nt, Human
ccaggagcaggagcuggacaga

SEQ ID NO: 578534 - RNA, 22 nt, Human
ucagucuuucgaauucagccag

SEQ ID NO: 578535 - RNA, 22 nt, Human
ucugucugagggagugacauuu

SEQ ID NO: 578536 - RNA, 22 nt, Human
cagcugccccgcuggcugacca

SEQ ID NO: 578537 - RNA, 22 nt, Human
ggcuuggcagaggugggugcuu

SEQ ID NO: 578538 - RNA, 22 nt, Human
uuagauaacaguagaauaucaa

SEQ ID NO: 578539 - RNA, 22 nt, Human
augagguagcuguggcuggcug

SEQ ID NO: 578540 - RNA, 22 nt, Human
ucucugccaccaugagaugggc

SEQ ID NO: 578541 - RNA, 22 nt, Human
cagcugagaaauggggaaaggg

SEQ ID NO: 578542 - RNA, 22 nt, Human
aauaucagcucugucacuuacu

SEQ ID NO: 578543 - RNA, 22 nt, Human
aggcugaggcagguggaucacc

SEQ ID NO: 578544 - RNA, 22 nt, Human
ucacauugccgucugugcacuu

SEQ ID NO: 578545 - RNA, 22 nt, Human
uagcuacacaucuaaacagcaa

SEQ ID NO: 578546 - RNA, 22 nt, Human
gcugcccugucugcagcaggac

SEQ ID NO: 578547 - RNA, 22 nt, Human
uacauucuacuuuuucacuccc

SEQ ID NO: 578548 - RNA, 22 nt, Human
gugcaaaaauaauugugguuuu

SEQ ID NO: 578549 - RNA, 22 nt, Human
uuguuucuccuggugccugaua

SEQ ID NO: 578550 - RNA, 22 nt, Human
accagcuccaggccccugcugg

SEQ ID NO: 578551 - RNA, 22 nt, Human
ugcaccaguuucucagagaauc

SEQ ID NO: 578552 - RNA, 22 nt, Human
uucaaagauaauguagcauuuu

SEQ ID NO: 578553 - RNA, 22 nt, Human
uaacacugugguguucuuuguc

SEQ ID NO: 578554 - RNA, 22 nt, Human
auccuuaauuuacuugcaucuu

SEQ ID NO: 578555 - RNA, 22 nt, Human
uggauuuaacagaauaccaggu

SEQ ID NO: 578556 - RNA, 22 nt, Human
gaggagacauauuuuugaagca

SEQ ID NO: 578557 - RNA, 22 nt, Human
ccuguacacggucuaugccucc

SEQ ID NO: 578558 - RNA, 22 nt, Human
aacauucaccucuaccuccuuc

SEQ ID NO: 578559 - RNA, 22 nt, Human
ucccugggccacagcugugagc

SEQ ID NO: 578560 - RNA, 22 nt, Human
aaaguuuuauucaagcauuagu

SEQ ID NO: 578561 - RNA, 22 nt, Human
gcugcaggggggucuggacuug

SEQ ID NO: 578562 - RNA, 22 nt, Human
ugaaggcugggcucagccagcu

SEQ ID NO: 578563 - RNA, 22 nt, Human
uuacuugaaaaccaccaguauu

SEQ ID NO: 578564 - RNA, 22 nt, Human
uuaaaaugcagauucugauuca

SEQ ID NO: 578565 - RNA, 22 nt, Human
uuucauugagacuauagacauc

SEQ ID NO: 578566 - RNA, 22 nt, Human
gcauccagucuuggcuccugga

SEQ ID NO: 578567 - RNA, 22 nt, Human
agggcacaagacucugagcccc

SEQ ID NO: 578568 - RNA, 22 nt, Human
agaggcuaggaccauguaucau

SEQ ID NO: 578569 - RNA, 20 nt, Human
ggcaccaggcuaggauugga

SEQ ID NO: 578570 - RNA, 22 nt, Human
aaggugggcagaucacaagguc

SEQ ID NO: 578571 - RNA, 22 nt, Human
ugacaggugauugugaacuaag

SEQ ID NO: 578572 - RNA, 22 nt, Human
cuguugcagaggggcggagagg

SEQ ID NO: 578573 - RNA, 22 nt, Human
cacccaggcuggagugcauugg

SEQ ID NO: 578574 - RNA, 22 nt, Human
auuauggguauaacacaguuau

SEQ ID NO: 578575 - RNA, 18 nt, Human
uggcagcaggaagccauu

SEQ ID NO: 578576 - RNA, 22 nt, Human
gcuguuuccauuuaagugaauc

SEQ ID NO: 578577 - RNA, 22 nt, Human
auaguuuaccuuccagauggcu

SEQ ID NO: 578578 - RNA, 22 nt, Human
aguggcugauguaggcaguggg

SEQ ID NO: 578579 - RNA, 22 nt, Human
gugugucagagcucagagaagu

SEQ ID NO: 578580 - RNA, 22 nt, Human
caagcagacaguaggccuagaa

SEQ ID NO: 578581 - RNA, 22 nt, Human
cucuuuccucagccacagucua

SEQ ID NO: 578582 - RNA, 22 nt, Human
caaaugaagguggugggucauu

SEQ ID NO: 578583 - RNA, 22 nt, Human
aggaguuuauccgagggcauaa

SEQ ID NO: 578584 - RNA, 22 nt, Human
acauuugacauuuaguaucagc

SEQ ID NO: 578585 - RNA, 22 nt, Human
aauaauaguugcaaaguguuua

SEQ ID NO: 578586 - RNA, 22 nt, Human
gggugggccacugagcagcgug

SEQ ID NO: 578587 - RNA, 22 nt, Human
uagcugaagggcauuuaauaaa

SEQ ID NO: 578588 - RNA, 22 nt, Human
aggagcaaggaagcuacaguuu

SEQ ID NO: 578589 - RNA, 22 nt, Human
ucucagaauaaauuccuaacuu

SEQ ID NO: 578590 - RNA, 22 nt, Human
gcugccugucccaggaugagga

SEQ ID NO: 578591 - RNA, 22 nt, Human
gcuucagccucacacugauauc

SEQ ID NO: 578592 - RNA, 22 nt, Human
ccugagagagaagcgaccuggu

SEQ ID NO: 578593 - RNA, 22 nt, Human
gcugggcaacggaagagagaaa

SEQ ID NO: 578594 - RNA, 22 nt, Human
aaggugucacugggacaggaaa

SEQ ID NO: 578595 - RNA, 22 nt, Human
gcugaggcaguccacccuugug

SEQ ID NO: 578596 - RNA, 22 nt, Human
ccucugggggcuuccuuacccu

SEQ ID NO: 578597 - RNA, 22 nt, Human
gacauguuaucucuggcuucaa

SEQ ID NO: 578598 - RNA, 22 nt, Human
aaagccaguuucuggaaguacc

SEQ ID NO: 578599 - RNA, 22 nt, Human
ugcagcuccucuggcugccuga

SEQ ID NO: 578600 - RNA, 22 nt, Human
uucucuguaguugccuggugga

SEQ ID NO: 578601 - RNA, 22 nt, Human
ugaggcagugugagauaauaaa

SEQ ID NO: 578602 - RNA, 22 nt, Human
cucagcacacucccaucuaauu

SEQ ID NO: 578603 - RNA, 22 nt, Human
cuuugugcguagugagugguca

SEQ ID NO: 578604 - RNA, 21 nt, Human
ugaaugaugccccagaguugu

SEQ ID NO: 578605 - RNA, 22 nt, Human
ggcaccagccaccuauuucuag

SEQ ID NO: 578606 - RNA, 22 nt, Human
aagacacucauuaucacugguu

SEQ ID NO: 578607 - RNA, 22 nt, Human
agcagaaccugcagaccugucu

SEQ ID NO: 578608 - RNA, 18 nt, Human
uggagcugagugcugugc

SEQ ID NO: 578609 - RNA, 19 nt, Human
gcuccugggccucacucau

SEQ ID NO: 578610 - RNA, 22 nt, Human
ucucugagccccugccucuuuc

SEQ ID NO: 578611 - RNA, 17 nt, Human
gccuuccuuccuccaca

SEQ ID NO: 578612 - RNA, 22 nt, Human
agagcugggugguggugacuca

SEQ ID NO: 578613 - RNA, 22 nt, Human
caugcaaaugugcuaaucugaa

SEQ ID NO: 578614 - RNA, 22 nt, Human
auuugcuuuuacuauguuaaaa

SEQ ID NO: 578615 - RNA, 22 nt, Human
ucuguccagagguccuggagac

SEQ ID NO: 578616 - RNA, 20 nt, Human
agcaggaaaagugccagucu

SEQ ID NO: 578617 - RNA, 22 nt, Human
uggcucagcauucacuggucuu

SEQ ID NO: 578618 - RNA, 22 nt, Human
gugugcauguggaagcauguau

SEQ ID NO: 578619 - RNA, 22 nt, Human
cacaucuacugauauuccagga

SEQ ID NO: 578620 - RNA, 22 nt, Human
cugaacuuauugagugcuugcu

SEQ ID NO: 578621 - RNA, 22 nt, Human
gaccuucaagcaccauauuuau

SEQ ID NO: 578622 - RNA, 22 nt, Human
agucugcacucagguggagguc

SEQ ID NO: 578623 - RNA, 22 nt, Human
acccaggaugauaauguucaca

SEQ ID NO: 578624 - RNA, 23 nt, Human
augcagagaauaacaaaugccau

SEQ ID NO: 578625 - RNA, 22 nt, Human
gggagaguagcuggaagguucu

SEQ ID NO: 578626 - RNA, 22 nt, Human
caaaucauggaauaacuagaga

SEQ ID NO: 578627 - RNA, 22 nt, Human
ucucaaauauuuggagagagga

SEQ ID NO: 578628 - RNA, 22 nt, Human
acaaugucucauauucguguuc

SEQ ID NO: 578629 - RNA, 22 nt, Human
uugcaguuguuuagaauaugug

SEQ ID NO: 578630 - RNA, 22 nt, Human
gcagcaagagguuucuguugac

SEQ ID NO: 578631 - RNA, 22 nt, Human
uucaguucacauguaucauggc

SEQ ID NO: 578632 - RNA, 20 nt, Human
gggguuggcuggcacaggga

SEQ ID NO: 578633 - RNA, 22 nt, Human
ugcuggaggauuaaacaaguca

SEQ ID NO: 578634 - RNA, 22 nt, Human
auuuggaacaaauauuaguaaa

SEQ ID NO: 578635 - RNA, 22 nt, Human
cuuugcuucuccaaccugcuca

SEQ ID NO: 578636 - RNA, 22 nt, Human
ccuggcuggauggagccccugg

SEQ ID NO: 578637 - RNA, 22 nt, Human
ucucuggcagaggcccuauccc

SEQ ID NO: 578638 - RNA, 22 nt, Human
ugcuccugaacacagcccuaug

SEQ ID NO: 578639 - RNA, 22 nt, Human
uaugugcaaauuaauugcuaga

SEQ ID NO: 578640 - RNA, 22 nt, Human
uuguauuaauugaaaugaaugc

SEQ ID NO: 578641 - RNA, 23 nt, Human
uaaauugaugguauggguuaagc

SEQ ID NO: 578642 - RNA, 22 nt, Human
uauuaugaucgugacucaagga

SEQ ID NO: 578643 - RNA, 23 nt, Human
acugccugugccgaucucucuca

SEQ ID NO: 578644 - RNA, 17 nt, Human
cagacagauauccuggg

SEQ ID NO: 578645 - RNA, 22 nt, Human
cugcuuuagagcugagccucag

SEQ ID NO: 578646 - RNA, 22 nt, Human
cugcugacuuacacuguuuauu

SEQ ID NO: 578647 - RNA, 23 nt, Human
ugcagagugucacuugaaaacca

SEQ ID NO: 578648 - RNA, 22 nt, Human
ucacauuuuaguaccaugauuu

SEQ ID NO: 578649 - RNA, 22 nt, Human
ccaggcagucaggguugugugu

SEQ ID NO: 578650 - RNA, 17 nt, Human
ugcugccaagucccaac

SEQ ID NO: 578651 - RNA, 18 nt, Human
acaggugauaucuugaga

SEQ ID NO: 578652 - RNA, 22 nt, Human
agguacagaugaaagucuaguu

SEQ ID NO: 578653 - RNA, 22 nt, Human
uguggccaccagagcugcuauu

SEQ ID NO: 578654 - RNA, 22 nt, Human
acagcccgugucaucagcugcu

SEQ ID NO: 578655 - RNA, 22 nt, Human
gccaggcagccacccucugcga

SEQ ID NO: 578656 - RNA, 22 nt, Human
aaaugucuuucaauagagaaau

SEQ ID NO: 578657 - RNA, 21 nt, Human
cacuggaauuuucugugacau

SEQ ID NO: 578658 - RNA, 22 nt, Human
uacuccugcugauccugccagc

SEQ ID NO: 578659 - RNA, 22 nt, Human
ucagugcuugccucuggaggag

SEQ ID NO: 578660 - RNA, 22 nt, Human
ggccucucaugcccagagccaa

SEQ ID NO: 578661 - RNA, 22 nt, Human
uucagagggacauucaagggaa

SEQ ID NO: 578662 - RNA, 22 nt, Human
cucaggcccacagcagacccac

SEQ ID NO: 578663 - RNA, 22 nt, Human
acacagcugugcaguuuuuuca

SEQ ID NO: 578664 - RNA, 22 nt, Human
agaugcuggauggaaaaugauc

SEQ ID NO: 578665 - RNA, 22 nt, Human
ucacuuuaccaaaguacaggag

SEQ ID NO: 578666 - RNA, 22 nt, Human
aaguacauguuguucaaaagcc

SEQ ID NO: 578667 - RNA, 22 nt, Human
ugaauaaaucaaagacugcccu

SEQ ID NO: 578668 - RNA, 22 nt, Human
cuuguuuuaaacuguuguggcu

SEQ ID NO: 578669 - RNA, 22 nt, Human
gaaguucaacugccaugcuugg

SEQ ID NO: 578670 - RNA, 22 nt, Human
cugcaggggcaguccacuuccu

SEQ ID NO: 578671 - RNA, 22 nt, Human
gcugccugauuuacauagugaa

SEQ ID NO: 578672 - RNA, 22 nt, Human
acuguccugaauacugcaugac

SEQ ID NO: 578673 - RNA, 22 nt, Human
ggagaagcagcuucuugaugaa

SEQ ID NO: 578674 - RNA, 22 nt, Human
gucccagaugucuggaacuccc

SEQ ID NO: 578675 - RNA, 22 nt, Human
uccagggaguuggcuggauagu

SEQ ID NO: 578676 - RNA, 21 nt, Human
cuucagcaaauacuuggcagg

SEQ ID NO: 578677 - RNA, 22 nt, Human
aguguggagccacugaguggcu

SEQ ID NO: 578678 - RNA, 22 nt, Human
agcuggggcugcagagaacagg

SEQ ID NO: 578679 - RNA, 22 nt, Human
caaauagacuucaaucucuuga

SEQ ID NO: 578680 - RNA, 22 nt, Human
uuaugcaaagaaauagacuaau

SEQ ID NO: 578681 - RNA, 22 nt, Human
auguuuguugaacaucuacugc

SEQ ID NO: 578682 - RNA, 22 nt, Human
cuucagccucaucucagcccgu

SEQ ID NO: 578683 - RNA, 22 nt, Human
uugugaauagugccgcuauaaa

SEQ ID NO: 578684 - RNA, 22 nt, Human
ggcgagggaaguuuacugugag

SEQ ID NO: 578685 - RNA, 22 nt, Human
guuucuuagacagacauuaucu

SEQ ID NO: 578686 - RNA, 21 nt, Human
uauuuaguuuuacaaaugugg

SEQ ID NO: 578687 - RNA, 22 nt, Human
gaggaggguuggccuuagguag

SEQ ID NO: 578688 - RNA, 22 nt, Human
aagacuagaccagugaauagga

SEQ ID NO: 578689 - RNA, 22 nt, Human
acagaaguggcuucaaagagca

SEQ ID NO: 578690 - RNA, 22 nt, Human
cuugaucuacauagugaaaccc

SEQ ID NO: 578691 - RNA, 22 nt, Human
uaagacaauucuucagucacaa

SEQ ID NO: 578692 - RNA, 22 nt, Human
gaugaaauccagaucacaggug

SEQ ID NO: 578693 - RNA, 22 nt, Human
uggccugggccugccggugcaa

SEQ ID NO: 578694 - RNA, 22 nt, Human
aauauaaauuccugggcccagc

SEQ ID NO: 578695 - RNA, 22 nt, Human
ggagcuguugcgcaugcgcucg

SEQ ID NO: 578696 - RNA, 22 nt, Human
caggcucccugccagggccggc

SEQ ID NO: 578697 - RNA, 22 nt, Human
cugccuguauugucugcuuggg

SEQ ID NO: 578698 - RNA, 22 nt, Human
aagaguaaaugucuaauuagga

SEQ ID NO: 578699 - RNA, 22 nt, Human
gccuggcccagggcuccgcagg

SEQ ID NO: 578700 - RNA, 17 nt, Human
ggcaccagacggagagu

SEQ ID NO: 578701 - RNA, 22 nt, Human
cauguauaguuggaacuacauc

SEQ ID NO: 578702 - RNA, 18 nt, Human
agaagccacgaggagucc

SEQ ID NO: 578703 - RNA, 21 nt, Human
cccucaggaaacagaaugcac

SEQ ID NO: 578704 - RNA, 22 nt, Human
agaaguuaccacauacuucucu

SEQ ID NO: 578705 - RNA, 22 nt, Human
auucagugggugcucagcacaa

SEQ ID NO: 578706 - RNA, 22 nt, Human
agggucuugaggaucugaacug

SEQ ID NO: 578707 - RNA, 22 nt, Human
aaaugacaauaaaaguccaugc

SEQ ID NO: 578708 - RNA, 22 nt, Human
cagggugggcacccagccucca

SEQ ID NO: 578709 - RNA, 22 nt, Human
acagggcuccuugggcugacac

SEQ ID NO: 578710 - RNA, 22 nt, Human
uggaagaaggcagagaggcauu

SEQ ID NO: 578711 - RNA, 22 nt, Human
uagaaagaacuucauguaaaac

SEQ ID NO: 578712 - RNA, 22 nt, Human
cugucuguuuuaccuucuccag

SEQ ID NO: 578713 - RNA, 22 nt, Human
uucuccagucacugacuucgag

SEQ ID NO: 578714 - RNA, 22 nt, Human
caggagcucuuaaggaugugau

SEQ ID NO: 578715 - RNA, 20 nt, Human
aauuagcuuaagucaaucag

SEQ ID NO: 578716 - RNA, 15 nt, Human
aggcacugugggacc

SEQ ID NO: 578717 - RNA, 22 nt, Human
aaauucacuugccugcuuagcu

SEQ ID NO: 578718 - RNA, 22 nt, Human
ugcuggaggcaguggaggugcc

SEQ ID NO: 578719 - RNA, 20 nt, Human
gauaaauugucucuuaagug

SEQ ID NO: 578720 - RNA, 22 nt, Human
agacagcaugauacaugaugcu

SEQ ID NO: 578721 - RNA, 22 nt, Human
agaauaaaugcuaccuaucaca

SEQ ID NO: 578722 - RNA, 22 nt, Human
uccucuccaugucucacgccac

SEQ ID NO: 578723 - RNA, 22 nt, Human
augaggcaaggcuggccguguu

SEQ ID NO: 578724 - RNA, 22 nt, Human
ugcuucugcaacuugaauguac

SEQ ID NO: 578725 - RNA, 22 nt, Human
uguagcucuccagccagcaagg

SEQ ID NO: 578726 - RNA, 22 nt, Human
ucagaaugaaauuucuuucaga

SEQ ID NO: 578727 - RNA, 22 nt, Human
uaugagaaaggagaaugacuuu

SEQ ID NO: 578728 - RNA, 22 nt, Human
gagaggcuuaagggcugugaag

SEQ ID NO: 578729 - RNA, 22 nt, Human
ggccucgcggcuucugguggcu

SEQ ID NO: 578730 - RNA, 22 nt, Human
ucuccucuacugggucugcaga

SEQ ID NO: 578731 - RNA, 22 nt, Human
cucagccagacaugacccaguc

SEQ ID NO: 578732 - RNA, 22 nt, Human
gcacacaguagggauucaauga

SEQ ID NO: 578733 - RNA, 22 nt, Human
uucucaguaguuagcauuugug

SEQ ID NO: 578734 - RNA, 22 nt, Human
gcugccucuguagcuuuggacc

SEQ ID NO: 578735 - RNA, 22 nt, Human
ggcuccugcaccugucccucug

SEQ ID NO: 578736 - RNA, 22 nt, Human
agcuccugugugcccaccugcu

SEQ ID NO: 578737 - RNA, 22 nt, Human
cucuucuugucucugguuagaa

SEQ ID NO: 578738 - RNA, 22 nt, Human
uguguucuggcugugacagcug

SEQ ID NO: 578739 - RNA, 22 nt, Human
uugggguacgcaggucugggag

SEQ ID NO: 578740 - RNA, 22 nt, Human
auuacagaaagcaauauugagu

SEQ ID NO: 578741 - RNA, 22 nt, Human
agcugcccccagggcugugcuu

SEQ ID NO: 578742 - RNA, 22 nt, Human
cugagagacuguuuguaauauu

SEQ ID NO: 578743 - RNA, 22 nt, Human
ccaguguuauuuuagaguguga

SEQ ID NO: 578744 - RNA, 22 nt, Human
ggcucugaauuauuccugaguc

SEQ ID NO: 578745 - RNA, 22 nt, Human
aaggacaggagaaaacgggauc

SEQ ID NO: 578746 - RNA, 22 nt, Human
uggaauguguucuauuuuacag

SEQ ID NO: 578747 - RNA, 22 nt, Human
uagggaggaggguuuucaaauc

SEQ ID NO: 578748 - RNA, 22 nt, Human
auacauacauguacacauaaau

SEQ ID NO: 578749 - RNA, 22 nt, Human
acuugccauaaaugaaaauacu

SEQ ID NO: 578750 - RNA, 22 nt, Human
ucaauaauggcaggauaaauuu

SEQ ID NO: 578751 - RNA, 22 nt, Human
cucccucacacccuugcccaga

SEQ ID NO: 578752 - RNA, 22 nt, Human
caaggaggaagaugcaggggac

SEQ ID NO: 578753 - RNA, 21 nt, Human
ucaggcaggcgcagagggaag

SEQ ID NO: 578754 - RNA, 22 nt, Human
gcucccaccuccagccugaguu

SEQ ID NO: 578755 - RNA, 22 nt, Human
augacauugaauauguuaacua

SEQ ID NO: 578756 - RNA, 22 nt, Human
ucacaguaucagguggagugga

SEQ ID NO: 578757 - RNA, 22 nt, Human
caguccagagcccaccagagga

SEQ ID NO: 578758 - RNA, 22 nt, Human
aggaggguacaauggguggaaa

SEQ ID NO: 578759 - RNA, 22 nt, Human
ucuggaguguguguauucagcu

SEQ ID NO: 578760 - RNA, 22 nt, Human
cuuccucuagccuaguaaugcc

SEQ ID NO: 578761 - RNA, 22 nt, Human
ucacccagaaaagacagcagau

SEQ ID NO: 578762 - RNA, 22 nt, Human
auucuacaccucucucauuuag

SEQ ID NO: 578763 - RNA, 22 nt, Human
cccaggaagggaugccaaggaa

SEQ ID NO: 578764 - RNA, 22 nt, Human
uagagcaguuggcagcuguauu

SEQ ID NO: 578765 - RNA, 22 nt, Human
aggcucugggcucuagauuuug

SEQ ID NO: 578766 - RNA, 22 nt, Human
gcagggcagcucacugugguuc

SEQ ID NO: 578767 - RNA, 20 nt, Human
uuagcuuuggcaauagugac

SEQ ID NO: 578768 - RNA, 22 nt, Human
uugcauaaagauuuuauugcau

SEQ ID NO: 578769 - RNA, 22 nt, Human
uuaaagagggaaagacuucaga

SEQ ID NO: 578770 - RNA, 22 nt, Human
gaacuaaaugaaauuacuggug

SEQ ID NO: 578771 - RNA, 21 nt, Human
agcugcccagaguagggaagg

SEQ ID NO: 578772 - RNA, 21 nt, Human
ugaggcaggggugcuuuuguc

SEQ ID NO: 578773 - RNA, 22 nt, Human
aaugaacccuucaagcucugau

SEQ ID NO: 578774 - RNA, 22 nt, Human
gagguacaugaggauacacagg

SEQ ID NO: 578775 - RNA, 17 nt, Human
gcccugccugcugcccu

SEQ ID NO: 578776 - RNA, 22 nt, Human
cacacagaaccgcucgccacuu

SEQ ID NO: 578777 - RNA, 22 nt, Human
cucccagguugauucuuucccu

SEQ ID NO: 578778 - RNA, 22 nt, Human
acaauucucucauaucuuauua

SEQ ID NO: 578779 - RNA, 19 nt, Human
cuccagaauacauguuccu

SEQ ID NO: 578780 - RNA, 22 nt, Human
uccaggcucccucaggaugcac

SEQ ID NO: 578781 - RNA, 22 nt, Human
ccucuucucaacuccagccaga

SEQ ID NO: 578782 - RNA, 22 nt, Human
agcuuaaaguauuuaaauuuca

SEQ ID NO: 578783 - RNA, 22 nt, Human
ccugacucuggccaggccagcu

SEQ ID NO: 578784 - RNA, 22 nt, Human
augggauaacaagaaggcugag

SEQ ID NO: 578785 - RNA, 22 nt, Human
cuuaaacugaaagcuacaagau

SEQ ID NO: 578786 - RNA, 22 nt, Human
ucaguaaaguucuuucuugcug

SEQ ID NO: 578787 - RNA, 22 nt, Human
aggccaggggugagcacuucug

SEQ ID NO: 578788 - RNA, 22 nt, Human
gacugaggugaccuaggacuac

SEQ ID NO: 578789 - RNA, 22 nt, Human
ccaguaaauuacuugaugucau

SEQ ID NO: 578790 - RNA, 22 nt, Human
uauguacaucuugagcaaugaa

SEQ ID NO: 578791 - RNA, 22 nt, Human
guagagcaggacuugagauguu

SEQ ID NO: 578792 - RNA, 22 nt, Human
uugaagaccuuuagugcuaugu

SEQ ID NO: 578793 - RNA, 23 nt, Human
cuggaacauaguagauggucaga

SEQ ID NO: 578794 - RNA, 22 nt, Human
gcuccagggaacagaauguacu

SEQ ID NO: 578795 - RNA, 22 nt, Human
uuucacagcuggguggcagagu

SEQ ID NO: 578796 - RNA, 23 nt, Human
uagagcuucagcgaaugugcuca

SEQ ID NO: 578797 - RNA, 22 nt, Human
gcugccuuccaaagaguuuuau

SEQ ID NO: 578798 - RNA, 22 nt, Human
gaauucuuuucuuucugaaagu

SEQ ID NO: 578799 - RNA, 22 nt, Human
uugugcaauaguuuucucauga

SEQ ID NO: 578800 - RNA, 23 nt, Human
aaaguuugaagcaacaguaguug

SEQ ID NO: 578801 - RNA, 22 nt, Human
aaagguuagacagcucugcaua

SEQ ID NO: 578802 - RNA, 22 nt, Human
augaaauuugaccaauuauuua

SEQ ID NO: 578803 - RNA, 22 nt, Human
aaaaauugcugagaacggaauu

SEQ ID NO: 578804 - RNA, 21 nt, Human
uggcugagccaggugugugga

SEQ ID NO: 578805 - RNA, 22 nt, Human
auuaguuuggugcaaaaguaau

SEQ ID NO: 578806 - RNA, 22 nt, Human
cucacugcccugaaguuggguu

SEQ ID NO: 578807 - RNA, 22 nt, Human
ugccagagccaggcuuuaggaa

SEQ ID NO: 578808 - RNA, 22 nt, Human
gugugccaacaaaagacagugc

SEQ ID NO: 578809 - RNA, 22 nt, Human
caguucuacuuggaugucugca

SEQ ID NO: 578810 - RNA, 22 nt, Human
ugagagagcgccugggaucauu

SEQ ID NO: 578811 - RNA, 22 nt, Human
acuuuucaaaugggaaacucag

SEQ ID NO: 578812 - RNA, 20 nt, Human
caccuggcugacugucucca

SEQ ID NO: 578813 - RNA, 22 nt, Human
ucuggcccagccccugagguca

SEQ ID NO: 578814 - RNA, 22 nt, Human
gcugucuugcucacucuugcag

SEQ ID NO: 578815 - RNA, 22 nt, Human
auggagacgcaagggaccuagg

SEQ ID NO: 578816 - RNA, 22 nt, Human
gccacaggcuuaggagggaggu

SEQ ID NO: 578817 - RNA, 20 nt, Human
ccuggcugcauucaggacgg

SEQ ID NO: 578818 - RNA, 22 nt, Human
ggcguuucaccauguugaccag

SEQ ID NO: 578819 - RNA, 22 nt, Human
caggcugcagugcaguggcuau

SEQ ID NO: 578820 - RNA, 22 nt, Human
agaaaucaaugaagucugcuaa

SEQ ID NO: 578821 - RNA, 21 nt, Human
ucugagagcaacugcccuuua

SEQ ID NO: 578822 - RNA, 22 nt, Human
ugugccuggaucucugugacaa

SEQ ID NO: 578823 - RNA, 20 nt, Human
uaaauuagccuugaagauua

SEQ ID NO: 578824 - RNA, 22 nt, Human
uugauguugcucuuaacaguau

SEQ ID NO: 578825 - RNA, 22 nt, Human
uuaaaugugccuaaaccuguaa

SEQ ID NO: 578826 - RNA, 22 nt, Human
gugucccaaucuacuuuucccu

SEQ ID NO: 578827 - RNA, 22 nt, Human
uggagcugaacuuugaggccag

SEQ ID NO: 578828 - RNA, 20 nt, Human
guauauaaccauagugacua

SEQ ID NO: 578829 - RNA, 22 nt, Human
uacacuacacgaaggcauugca

SEQ ID NO: 578830 - RNA, 22 nt, Human
gaaggcagggaauguggugcua

SEQ ID NO: 578831 - RNA, 22 nt, Human
ccugcccuagagaugacacaau

SEQ ID NO: 578832 - RNA, 22 nt, Human
gacagaagaggaacuuggacag

SEQ ID NO: 578833 - RNA, 22 nt, Human
agaguguaauaagggcaagggc

SEQ ID NO: 578834 - RNA, 22 nt, Human
guaagaggagugggaagccuca

SEQ ID NO: 578835 - RNA, 22 nt, Human
agcuuucacgauuuggaacagg

SEQ ID NO: 578836 - RNA, 22 nt, Human
caguuacagagccaguuagaga

SEQ ID NO: 578837 - RNA, 22 nt, Human
ggaguggcagcgaggaucagau

SEQ ID NO: 578838 - RNA, 22 nt, Human
cccaggaguucgaggcuguagu

SEQ ID NO: 578839 - RNA, 22 nt, Human
ccucagcugcugcacagcuuuu

SEQ ID NO: 578840 - RNA, 21 nt, Human
uagguauuucuaucaugucuc

SEQ ID NO: 578841 - RNA, 17 nt, Human
cagguacauugcuacug

SEQ ID NO: 578842 - RNA, 22 nt, Human
uucuuuuccuacacagcgauuu

SEQ ID NO: 578843 - RNA, 22 nt, Human
uuuuagcacuaagugauaugcu

SEQ ID NO: 578844 - RNA, 22 nt, Human
ucugccgugcgaggucccacca

SEQ ID NO: 578845 - RNA, 22 nt, Human
acagugaggaagcagcugugcu

SEQ ID NO: 578846 - RNA, 22 nt, Human
uucauauauaugcacuacguac

SEQ ID NO: 578847 - RNA, 22 nt, Human
gagaaggcugauccuuggaguu

SEQ ID NO: 578848 - RNA, 21 nt, Human
uaauaauuccacuacagagua

SEQ ID NO: 578849 - RNA, 22 nt, Human
uggcaggguacaccuuaacacc

SEQ ID NO: 578850 - RNA, 22 nt, Human
uaaaucaguuucucuuauuggu

SEQ ID NO: 578851 - RNA, 22 nt, Human
uucugcauuuaaaauauuacua

SEQ ID NO: 578852 - RNA, 22 nt, Human
gaaguuaucaaagauguauucu

SEQ ID NO: 578853 - RNA, 22 nt, Human
gcaguguucuuguugcuuuuau

SEQ ID NO: 578854 - RNA, 22 nt, Human
cuuuuuuccuaaggcaacauga

SEQ ID NO: 578855 - RNA, 22 nt, Human
uagccaggcugcagcugauccg

SEQ ID NO: 578856 - RNA, 22 nt, Human
uccucacagaugggugcauagc

SEQ ID NO: 578857 - RNA, 22 nt, Human
uuacaguuuaagaggaaacaaa

SEQ ID NO: 578858 - RNA, 22 nt, Human
gcaggcugcugagauccuuagg

SEQ ID NO: 578859 - RNA, 22 nt, Human
uuacuguucauguuguacacuu

SEQ ID NO: 578860 - RNA, 22 nt, Human
ucugacuuccuccacaucuguu

SEQ ID NO: 578861 - RNA, 22 nt, Human
caccagcuuacagucucacccc

SEQ ID NO: 578862 - RNA, 22 nt, Human
ugcucccaggcucuguggucug

SEQ ID NO: 578863 - RNA, 22 nt, Human
ugaaccaggaggcagccagcac

SEQ ID NO: 578864 - RNA, 22 nt, Human
cugauugagaaggaaggggauc

SEQ ID NO: 578865 - RNA, 18 nt, Human
ggccucuggacuggcagc

SEQ ID NO: 578866 - RNA, 22 nt, Human
cagagccauccaggugccuguu

SEQ ID NO: 578867 - RNA, 22 nt, Human
ugguuucuggguuugucuagga

SEQ ID NO: 578868 - RNA, 22 nt, Human
agcaguaagcaacugagcuugc

SEQ ID NO: 578869 - RNA, 22 nt, Human
ugccagagaaucaccucuccuu

SEQ ID NO: 578870 - RNA, 23 nt, Human
uucugggcuguggaagccucggg

SEQ ID NO: 578871 - RNA, 22 nt, Human
acuucuguccuccaagccacgu

SEQ ID NO: 578872 - RNA, 22 nt, Human
gccuccugcccagaugagugau

SEQ ID NO: 578873 - RNA, 22 nt, Human
aucuguaaaugcaaauguagcu

SEQ ID NO: 578874 - RNA, 20 nt, Human
uuucacaucugucccuuuaa

SEQ ID NO: 578875 - RNA, 22 nt, Human
ggcaggugccaguuggcuuggg

SEQ ID NO: 578876 - RNA, 22 nt, Human
ggagcugaugacgucaccaugg

SEQ ID NO: 578877 - RNA, 22 nt, Human
uuuauauaacagagacugcuau

SEQ ID NO: 578878 - RNA, 22 nt, Human
uggaggccgaauuagagcguug

SEQ ID NO: 578879 - RNA, 22 nt, Human
caaggcugcaaaacuacauggg

SEQ ID NO: 578880 - RNA, 22 nt, Human
ccuucugcucccuggccagggc

SEQ ID NO: 578881 - RNA, 22 nt, Human
auuuaagacugacuucaccagu

SEQ ID NO: 578882 - RNA, 22 nt, Human
uuuccucugcugccauugcccc

SEQ ID NO: 578883 - RNA, 22 nt, Human
ucuacacauuuguaaaggcauu

SEQ ID NO: 578884 - RNA, 22 nt, Human
cuggggugugcucagagcaggg

SEQ ID NO: 578885 - RNA, 22 nt, Human
ugaggucuuuuauaguguguca

SEQ ID NO: 578886 - RNA, 22 nt, Human
uuucuugaccacuauguugaua

SEQ ID NO: 578887 - RNA, 22 nt, Human
ccuggcugguugucugauucua

SEQ ID NO: 578888 - RNA, 22 nt, Human
auuagaaugcaggguucauugu

SEQ ID NO: 578889 - RNA, 22 nt, Human
agggagguaggagcuucuagcu

SEQ ID NO: 578890 - RNA, 22 nt, Human
gccugggauucucaaaggggug

SEQ ID NO: 578891 - RNA, 22 nt, Human
ugcucuggcugggaugagugca

SEQ ID NO: 578892 - RNA, 22 nt, Human
gguggggagucaggcauucuug

SEQ ID NO: 578893 - RNA, 22 nt, Human
augcaaaauuaccauucuguuc

SEQ ID NO: 578894 - RNA, 22 nt, Human
ugcuauuuuuaucuugaucaaa

SEQ ID NO: 578895 - RNA, 21 nt, Human
gcaaggcuuuuguguuuccca

SEQ ID NO: 578896 - RNA, 22 nt, Human
ugcucuguaggggaaagagagc

SEQ ID NO: 578897 - RNA, 22 nt, Human
aguucuuugucaucucuggagu

SEQ ID NO: 578898 - RNA, 22 nt, Human
ggcaugagagguccuggggauu

SEQ ID NO: 578899 - RNA, 22 nt, Human
agcacauuuuauuuaagaaaau

SEQ ID NO: 578900 - RNA, 21 nt, Human
ugcucaguaaaugcugaguga

SEQ ID NO: 578901 - RNA, 22 nt, Human
gcagggcucaacaggacacccc

SEQ ID NO: 578902 - RNA, 22 nt, Human
ucagguccagcuccugugccuc

SEQ ID NO: 578903 - RNA, 21 nt, Human
ugucuuuggccucauucccag

SEQ ID NO: 578904 - RNA, 22 nt, Human
aguguggauuggcuggagcuau

SEQ ID NO: 578905 - RNA, 21 nt, Human
gccugccugcgugacccucuu

SEQ ID NO: 578906 - RNA, 22 nt, Human
agcaggcacuaugccaggaucu

SEQ ID NO: 578907 - RNA, 20 nt, Human
auuuuggugaacacagcuuc

SEQ ID NO: 578908 - RNA, 22 nt, Human
agggccugguucuguguaggga

SEQ ID NO: 578909 - RNA, 22 nt, Human
gaggccacccuaugggucccag

SEQ ID NO: 578910 - RNA, 22 nt, Human
ucuucagagacucugagccccu

SEQ ID NO: 578911 - RNA, 22 nt, Human
gagcugguucuguccagggaau

SEQ ID NO: 578912 - RNA, 22 nt, Human
auggccuggccagagcucugcu

SEQ ID NO: 578913 - RNA, 21 nt, Human
uccaggcugaugaugucaacu

SEQ ID NO: 578914 - RNA, 22 nt, Human
cagguccaagagauccuccuac

SEQ ID NO: 578915 - RNA, 22 nt, Human
aacagcuuacucaauggugauu

SEQ ID NO: 578916 - RNA, 22 nt, Human
gcugcccucccagggcaagcuu

SEQ ID NO: 578917 - RNA, 22 nt, Human
aggaggcccuagagcucuagag

SEQ ID NO: 578918 - RNA, 22 nt, Human
ggucccaguccucucccugcua

SEQ ID NO: 578919 - RNA, 22 nt, Human
ucccagagcucuggagguugga

SEQ ID NO: 578920 - RNA, 22 nt, Human
cugaaauauuuuaaucucagga

SEQ ID NO: 578921 - RNA, 22 nt, Human
uccaguuuacaggguugcuuuu

SEQ ID NO: 578922 - RNA, 22 nt, Human
gccagaagacuggagucagcug

SEQ ID NO: 578923 - RNA, 22 nt, Human
uaugcuuuuaaccuguaacuga

SEQ ID NO: 578924 - RNA, 22 nt, Human
aaguugagaugucauaggagac

SEQ ID NO: 578925 - RNA, 22 nt, Human
ccucaggcuucuaguucaguga

SEQ ID NO: 578926 - RNA, 22 nt, Human
uacaggcacugaaaugcuuauu

SEQ ID NO: 578927 - RNA, 22 nt, Human
agaggcugggcaggacccacag

SEQ ID NO: 578928 - RNA, 22 nt, Human
ucagccuccuaauuuccuguga

SEQ ID NO: 578929 - RNA, 22 nt, Human
aggugcagaaaaaaguccuuua

SEQ ID NO: 578930 - RNA, 23 nt, Human
uggcuucugccccauucucucca

SEQ ID NO: 578931 - RNA, 22 nt, Human
cagcugguuggaagggagcuga

SEQ ID NO: 578932 - RNA, 22 nt, Human
gcugaagcugacacauagugcu

SEQ ID NO: 578933 - RNA, 22 nt, Human
gugaggucuuugggaggugauu

SEQ ID NO: 578934 - RNA, 22 nt, Human
ggccuggaaugcuuuccuacca

SEQ ID NO: 578935 - RNA, 22 nt, Human
acccaggagcucugggguccuc

SEQ ID NO: 578936 - RNA, 22 nt, Human
caauuuuuaaacuaugaaguug

SEQ ID NO: 578937 - RNA, 22 nt, Human
agcaguuguagucauggaaaau

SEQ ID NO: 578938 - RNA, 22 nt, Human
augcuuuacaguuuuccaaaca

SEQ ID NO: 578939 - RNA, 22 nt, Human
gcucucccgcagccuggugggc

SEQ ID NO: 578940 - RNA, 22 nt, Human
ccugggcagggcuggacucuca

SEQ ID NO: 578941 - RNA, 22 nt, Human
gcucuccacugaccacggggca

SEQ ID NO: 578942 - RNA, 22 nt, Human
ugaaggagauuuuuagggaggc

SEQ ID NO: 578943 - RNA, 22 nt, Human
uccugggaguggccauguaaug

SEQ ID NO: 578944 - RNA, 22 nt, Human
ugaaugaugcaguauaaugaua

SEQ ID NO: 578945 - RNA, 22 nt, Human
aaacagauaaugcuauaaaugg

SEQ ID NO: 578946 - RNA, 22 nt, Human
gacagcuucuagaaauggucac

SEQ ID NO: 578947 - RNA, 22 nt, Human
gagaacacgaggaggcccagcg

SEQ ID NO: 578948 - RNA, 22 nt, Human
ggaggagauuccccucucacuu

SEQ ID NO: 578949 - RNA, 22 nt, Human
agcccaggaguccuuaaggacc

SEQ ID NO: 578950 - RNA, 21 nt, Human
auaagcaugcugauuacauuu

SEQ ID NO: 578951 - RNA, 22 nt, Human
caguguggagggagagagccug

SEQ ID NO: 578952 - RNA, 22 nt, Human
aacuaugguauucugauguuuc

SEQ ID NO: 578953 - RNA, 22 nt, Human
guccuuggagcuccccucugua

SEQ ID NO: 578954 - RNA, 22 nt, Human
uuacaucagaaggaaacagcgu

SEQ ID NO: 578955 - RNA, 22 nt, Human
gccugagaguugaaguucagug

SEQ ID NO: 578956 - RNA, 22 nt, Human
acugugccacaauucaccaggg

SEQ ID NO: 578957 - RNA, 22 nt, Human
acaggaagugggaagaaacagg

SEQ ID NO: 578958 - RNA, 21 nt, Human
aucccagcacccaggagugca

SEQ ID NO: 578959 - RNA, 22 nt, Human
gggauggaucuuggcugaggcu

SEQ ID NO: 578960 - RNA, 22 nt, Human
aggcacagauuuggggaaagca

SEQ ID NO: 578961 - RNA, 22 nt, Human
cugcagagaguaacugaaauau

SEQ ID NO: 578962 - RNA, 22 nt, Human
augaauccaaaguuuacuauua

SEQ ID NO: 578963 - RNA, 22 nt, Human
auaaaugaacauucacagagcu

SEQ ID NO: 578964 - RNA, 22 nt, Human
cuuccuuggcuucuggggugug

SEQ ID NO: 578965 - RNA, 22 nt, Human
uccagggaugccagccauguug

SEQ ID NO: 578966 - RNA, 22 nt, Human
ggcagggaguggagacucccua

SEQ ID NO: 578967 - RNA, 22 nt, Human
cugggccaggaccaggguugaa

SEQ ID NO: 578968 - RNA, 22 nt, Human
uccaggcugugcgcaccgugug

SEQ ID NO: 578969 - RNA, 22 nt, Human
aaagguuuuuauuuauccugga

SEQ ID NO: 578970 - RNA, 22 nt, Human
cuuuagugguauuuuagcaagu

SEQ ID NO: 578971 - RNA, 22 nt, Human
ucacugcaaggaggcuucucaa

SEQ ID NO: 578972 - RNA, 23 nt, Human
agcagcaaaaauuuaucuuucug

SEQ ID NO: 578973 - RNA, 22 nt, Human
augaucugauaaucauccacua

SEQ ID NO: 578974 - RNA, 22 nt, Human
aaacagcaauggagaagccagg

SEQ ID NO: 578975 - RNA, 22 nt, Human
ggucccuggaaggccaagcuug

SEQ ID NO: 578976 - RNA, 22 nt, Human
cuaguguuuauuaacauaauuc

SEQ ID NO: 578977 - RNA, 22 nt, Human
cagcaggcggcccgcgggcccg

SEQ ID NO: 578978 - RNA, 22 nt, Human
ugaagauugugcuuggccugua

SEQ ID NO: 578979 - RNA, 22 nt, Human
gccugagagaacugaccaagag

SEQ ID NO: 578980 - RNA, 22 nt, Human
gcucgguggccagccugaggcc

SEQ ID NO: 578981 - RNA, 22 nt, Human
gaguuauauuugcgauauugga

SEQ ID NO: 578982 - RNA, 19 nt, Human
ccagggcuuuaaguugagg

SEQ ID NO: 578983 - RNA, 22 nt, Human
ugagccagccuugcagcugugc

SEQ ID NO: 578984 - RNA, 20 nt, Human
uacaaauuuuccauguuucc

SEQ ID NO: 578985 - RNA, 23 nt, Human
ucugcucugaaguucggcugagc

SEQ ID NO: 578986 - RNA, 21 nt, Human
ucucacaauaugaugccagau

SEQ ID NO: 578987 - RNA, 22 nt, Human
uaaaugauuuauguaugugaaa

SEQ ID NO: 578988 - RNA, 22 nt, Human
caguggcaaguccgguauugaa

SEQ ID NO: 578989 - RNA, 22 nt, Human
uuuggggcucagcaggcuguuu

SEQ ID NO: 578990 - RNA, 22 nt, Human
augauguugauaaauuacuuua

SEQ ID NO: 578991 - RNA, 21 nt, Human
ucugucuuccucagccuaagg

SEQ ID NO: 578992 - RNA, 22 nt, Human
accuuuuuucagaacucuaaag

SEQ ID NO: 578993 - RNA, 22 nt, Human
ugcugagguuucugacuaugga

SEQ ID NO: 578994 - RNA, 22 nt, Human
acuguaauauuuuaagaugucu

SEQ ID NO: 578995 - RNA, 22 nt, Human
uaguuacagaagauaaggguau

SEQ ID NO: 578996 - RNA, 22 nt, Human
gcaccugguuuauauaaucaua

SEQ ID NO: 578997 - RNA, 22 nt, Human
gcuccuggcucucugagggcug

SEQ ID NO: 578998 - RNA, 17 nt, Human
ugaaaucagcacccagg

SEQ ID NO: 578999 - RNA, 22 nt, Human
ggcaggugcaccugagccaucu

SEQ ID NO: 579000 - RNA, 22 nt, Human
ugaaaagacugcaagagagcau

SEQ ID NO: 579001 - RNA, 22 nt, Human
ggaggggauuuaguagaugcua

SEQ ID NO: 579002 - RNA, 22 nt, Human
uucugucacagugcugguauca

SEQ ID NO: 579003 - RNA, 22 nt, Human
gaaaagagaacaucugaggauc

SEQ ID NO: 579004 - RNA, 22 nt, Human
gcagagugggagcccagggcug

SEQ ID NO: 579005 - RNA, 22 nt, Human
uugaaugaagucccuuuuuacu

SEQ ID NO: 579006 - RNA, 22 nt, Human
aggcugagauagguggaucauu

SEQ ID NO: 579007 - RNA, 16 nt, Human
ccuuucucugccuucc

SEQ ID NO: 579008 - RNA, 22 nt, Human
ugagguaguuuguuguacagua

SEQ ID NO: 579009 - RNA, 22 nt, Human
uguccuggggacaagaggcccu

SEQ ID NO: 579010 - RNA, 22 nt, Human
ccagcgcuucccaucagggagg

SEQ ID NO: 579011 - RNA, 22 nt, Human
uggugacacgaaguuugcuauc

SEQ ID NO: 579012 - RNA, 22 nt, Human
auuuuguuaaugucaccgugcu

SEQ ID NO: 579013 - RNA, 22 nt, Human
caaaucuaggaugcauguagug

SEQ ID NO: 579014 - RNA, 22 nt, Human
gcaagcugcuuaagcucauugu

SEQ ID NO: 579015 - RNA, 22 nt, Human
ugcauuccuuucuaggauagcu

SEQ ID NO: 579016 - RNA, 21 nt, Human
cuguccaaauuucauaacuuu

SEQ ID NO: 579017 - RNA, 22 nt, Human
ggccucugguucacagggagga

SEQ ID NO: 579018 - RNA, 22 nt, Human
gcacccaggccggcgacugcag

SEQ ID NO: 579019 - RNA, 22 nt, Human
agaggcuccucggugccucgug

SEQ ID NO: 579020 - RNA, 22 nt, Human
uuagcauuucaguacacauguu

SEQ ID NO: 579021 - RNA, 20 nt, Human
agaggaggauuauuuuauuc

SEQ ID NO: 579022 - RNA, 22 nt, Human
ugcaguccuaaauauauagcug

SEQ ID NO: 579023 - RNA, 22 nt, Human
ugaagcccugugucagcuucca

SEQ ID NO: 579024 - RNA, 22 nt, Human
ugcacuauuucgccaugguugu

SEQ ID NO: 579025 - RNA, 22 nt, Human
uauuuugagguauuuuugagcu

SEQ ID NO: 579026 - RNA, 22 nt, Human
ggggccuuuucugaauguggaa

SEQ ID NO: 579027 - RNA, 22 nt, Human
gauggccuuguuuucucccuuc

SEQ ID NO: 579028 - RNA, 22 nt, Human
ugggaggcuuccagaccuugcu

SEQ ID NO: 579029 - RNA, 22 nt, Human
uggauggguugaaaugugagcc

SEQ ID NO: 579030 - RNA, 22 nt, Human
gcccauggacacccaagugcca

SEQ ID NO: 579031 - RNA, 22 nt, Human
agcuccugaguagcuuuacuca

SEQ ID NO: 579032 - RNA, 22 nt, Human
aaaagcagguacucagcuuggg

SEQ ID NO: 579033 - RNA, 22 nt, Human
ggaacacucgucaaauagcggg

SEQ ID NO: 579034 - RNA, 20 nt, Human
agcaguuuccuaacucagcu

SEQ ID NO: 579035 - RNA, 22 nt, Human
ucuaaagauuuggauucauuug

SEQ ID NO: 579036 - RNA, 22 nt, Human
ugaggcaguugagcuuccugag

SEQ ID NO: 579037 - RNA, 23 nt, Human
ugacagagcacagugggggagau

SEQ ID NO: 579038 - RNA, 22 nt, Human
ucuguuuugcauaauguucuuu

SEQ ID NO: 579039 - RNA, 22 nt, Human
aauuucacuguggagcacauuu

SEQ ID NO: 579040 - RNA, 22 nt, Human
ucaggcugugucuuuaaacaau

SEQ ID NO: 579041 - RNA, 22 nt, Human
aaacaacaauccaaugggagcu

SEQ ID NO: 579042 - RNA, 22 nt, Human
aacuacaggggguggcaggcgg

SEQ ID NO: 579043 - RNA, 22 nt, Human
gggguagggugauugugaagua

SEQ ID NO: 579044 - RNA, 22 nt, Human
uuguuggugaauaggguggaau

SEQ ID NO: 579045 - RNA, 22 nt, Human
ugaugggaggugcugcaggacc

SEQ ID NO: 579046 - RNA, 22 nt, Human
cuggagugaggucugggagccu

SEQ ID NO: 579047 - RNA, 22 nt, Human
ggagccugaaaagucugcauuu

SEQ ID NO: 579048 - RNA, 20 nt, Human
uuuuucugggcuuccauagc

SEQ ID NO: 579049 - RNA, 22 nt, Human
gcucccucccaccagccugcag

SEQ ID NO: 579050 - RNA, 19 nt, Human
cagaaauagcgaaguguaa

SEQ ID NO: 579051 - RNA, 22 nt, Human
acauagaaggaagaguaguagg

SEQ ID NO: 579052 - RNA, 22 nt, Human
uucuucauggguucuuuuagga

SEQ ID NO: 579053 - RNA, 22 nt, Human
caaaugauagagccgauuauca

SEQ ID NO: 579054 - RNA, 22 nt, Human
uuagauuuauaugugagaaugg

SEQ ID NO: 579055 - RNA, 22 nt, Human
gggaagcugaagcuagagaaaa

SEQ ID NO: 579056 - RNA, 22 nt, Human
ccuggagcuuuuccauccugga

SEQ ID NO: 579057 - RNA, 22 nt, Human
uauauucauuuuaaagccaucu

SEQ ID NO: 579058 - RNA, 22 nt, Human
ugggccugccccaggcuucagc

SEQ ID NO: 579059 - RNA, 22 nt, Human
uuaaacaccugucuaguguagc

SEQ ID NO: 579060 - RNA, 22 nt, Human
cacaggaaucagcauuaauggc

SEQ ID NO: 579061 - RNA, 22 nt, Human
uauggagauucaaaagcaucuu

SEQ ID NO: 579062 - RNA, 18 nt, Human
ucucuugcaucuucugua

SEQ ID NO: 579063 - RNA, 22 nt, Human
agcagagcuauucuugugcaau

SEQ ID NO: 579064 - RNA, 22 nt, Human
ccucuuccucaccaucuacaac

SEQ ID NO: 579065 - RNA, 22 nt, Human
caggaacauguuggaaagaaau

SEQ ID NO: 579066 - RNA, 17 nt, Human
gcuugccuugucuuccu

SEQ ID NO: 579067 - RNA, 22 nt, Human
caggaaggggcucacucuggcc

SEQ ID NO: 579068 - RNA, 22 nt, Human
guccuggggaauacagaagccg

SEQ ID NO: 579069 - RNA, 22 nt, Human
cugaggagaaagaugguccaag

SEQ ID NO: 579070 - RNA, 22 nt, Human
gcaggggaguccacucuaugca

SEQ ID NO: 579071 - RNA, 22 nt, Human
cagcagagcugggaauaaaauu

SEQ ID NO: 579072 - RNA, 22 nt, Human
uuauugcaaccuuuucuggugu

SEQ ID NO: 579073 - RNA, 22 nt, Human
cagcuguucuugggacagacag

SEQ ID NO: 579074 - RNA, 22 nt, Human
uugauacagcagccugugaucc

SEQ ID NO: 579075 - RNA, 20 nt, Human
aucaaaauccuauugagguu

SEQ ID NO: 579076 - RNA, 22 nt, Human
acuugguuggucucacccuguu

SEQ ID NO: 579077 - RNA, 19 nt, Human
acaaugaauguguucucuu

SEQ ID NO: 579078 - RNA, 22 nt, Human
aauccaugcaugcaaggaaagg

SEQ ID NO: 579079 - RNA, 22 nt, Human
ccaggcuuucuccugacucaca

SEQ ID NO: 579080 - RNA, 22 nt, Human
aucagcuuuucucaucagaaau

SEQ ID NO: 579081 - RNA, 22 nt, Human
ccuggugccgguagacgcgcag

SEQ ID NO: 579082 - RNA, 22 nt, Human
gaugucuuucugugugccuaga

SEQ ID NO: 579083 - RNA, 22 nt, Human
cugccuggaugaauggcgccuu

SEQ ID NO: 579084 - RNA, 22 nt, Human
ucagagaauucucagaugacuc

SEQ ID NO: 579085 - RNA, 22 nt, Human
gggagguguuccaguguuggua

SEQ ID NO: 579086 - RNA, 22 nt, Human
gagaaguuucugguuugcauag

SEQ ID NO: 579087 - RNA, 22 nt, Human
uaagaauauugggaauggaugg

SEQ ID NO: 579088 - RNA, 22 nt, Human
gcuccuggguguggcugccccu

SEQ ID NO: 579089 - RNA, 22 nt, Human
ggccuuggugcucuguguugca

SEQ ID NO: 579090 - RNA, 22 nt, Human
gagggcuggggcuuaggcuuag

SEQ ID NO: 579091 - RNA, 22 nt, Human
agacauuuuacauucuuccauu

SEQ ID NO: 579092 - RNA, 22 nt, Human
acauccacuauccuugcuuguu

SEQ ID NO: 579093 - RNA, 22 nt, Human
uaacacugugcccagaguccca

SEQ ID NO: 579094 - RNA, 22 nt, Human
uucaagcagggauuggugaugg

SEQ ID NO: 579095 - RNA, 22 nt, Human
ucaaauuuuaacaugcauuaga

SEQ ID NO: 579096 - RNA, 22 nt, Human
gccucugucauagcucauguga

SEQ ID NO: 579097 - RNA, 22 nt, Human
uuucaacaggaugauaauaggc

SEQ ID NO: 579098 - RNA, 22 nt, Human
uagccaggcgaggucagugucg

SEQ ID NO: 579099 - RNA, 22 nt, Human
ugagguaggaauuuguauuggg

SEQ ID NO: 579100 - RNA, 22 nt, Human
uuccacagauguaugaaguggu

SEQ ID NO: 579101 - RNA, 23 nt, Human
gucucccauagcgcucccaggcu

SEQ ID NO: 579102 - RNA, 22 nt, Human
uccucuggucuucgguguggac

SEQ ID NO: 579103 - RNA, 18 nt, Human
ucauuagggauugcaaag

SEQ ID NO: 579104 - RNA, 22 nt, Human
aaauuguaggaucacaugaccu

SEQ ID NO: 579105 - RNA, 22 nt, Human
cugcaggguucggagaguuccc

SEQ ID NO: 579106 - RNA, 22 nt, Human
ugcuuccugaggccgucuucuc

SEQ ID NO: 579107 - RNA, 22 nt, Human
acaaagaaggaauuggucuuua

SEQ ID NO: 579108 - RNA, 22 nt, Human
agaggggguguuccagaagcau

SEQ ID NO: 579109 - RNA, 22 nt, Human
acagacagggcaccugccuccu

SEQ ID NO: 579110 - RNA, 22 nt, Human
cauggcagagccugcagguggg

SEQ ID NO: 579111 - RNA, 22 nt, Human
gccuggcagugaugucuuuugg

SEQ ID NO: 579112 - RNA, 22 nt, Human
uccugccucacaguugaaguuu

SEQ ID NO: 579113 - RNA, 22 nt, Human
aaagcucuuaaugagauuaucc

SEQ ID NO: 579114 - RNA, 22 nt, Human
uuucacauuggcuucuauuucu

SEQ ID NO: 579115 - RNA, 22 nt, Human
ucaggagauggucuuuauaggc

SEQ ID NO: 579116 - RNA, 22 nt, Human
gauaaauugcacuuuuucuuac

SEQ ID NO: 579117 - RNA, 22 nt, Human
aacuuucuugugacauuugggg

SEQ ID NO: 579118 - RNA, 22 nt, Human
agccaacuaggagauuaaggua

SEQ ID NO: 579119 - RNA, 22 nt, Human
ggaaagagcuaaaagggugaga

SEQ ID NO: 579120 - RNA, 22 nt, Human
ugguaaauuauuuuuauauccc

SEQ ID NO: 579121 - RNA, 22 nt, Human
uaucuuucuguccuagauucug

SEQ ID NO: 579122 - RNA, 22 nt, Human
gggcguggauggucagugcagg

SEQ ID NO: 579123 - RNA, 22 nt, Human
gcucauucagccagggcccggu

SEQ ID NO: 579124 - RNA, 22 nt, Human
ggaacacucagaaaugcucguc

SEQ ID NO: 579125 - RNA, 22 nt, Human
ggccauggcgggagccggcguc

SEQ ID NO: 579126 - RNA, 22 nt, Human
acacagugucuuagguaguguc

SEQ ID NO: 579127 - RNA, 22 nt, Human
uuccaaagucauguugcugaua

SEQ ID NO: 579128 - RNA, 19 nt, Human
cuggcucuuggguggagga

SEQ ID NO: 579129 - RNA, 19 nt, Human
ggggccugugauggucaca

SEQ ID NO: 579130 - RNA, 22 nt, Human
cuggccaguuguccuggcuugg

SEQ ID NO: 579131 - RNA, 22 nt, Human
ccaccacuucuggcuucuggug

SEQ ID NO: 579132 - RNA, 20 nt, Human
uuaguugaguagcuccugaa

SEQ ID NO: 579133 - RNA, 22 nt, Human
uucuugaaucacuuuagagaua

SEQ ID NO: 579134 - RNA, 22 nt, Human
gagcugaguaucccacugaagu

SEQ ID NO: 579135 - RNA, 22 nt, Human
augcucaguagcuggcugaccc

SEQ ID NO: 579136 - RNA, 22 nt, Human
auacaucauuuauggaauaagg

SEQ ID NO: 579137 - RNA, 23 nt, Human
ggcugagaagucccaugauaggu

SEQ ID NO: 579138 - RNA, 22 nt, Human
ugcaagaucacgguguugagag

SEQ ID NO: 579139 - RNA, 22 nt, Human
uaaaggcagccacugagcucaa

SEQ ID NO: 579140 - RNA, 22 nt, Human
aagacaauauugcugugaacgu

SEQ ID NO: 579141 - RNA, 22 nt, Human
aaugcuuaauucaauacugugu

SEQ ID NO: 579142 - RNA, 23 nt, Human
uuggcagcgggucaggcuguggg

SEQ ID NO: 579143 - RNA, 22 nt, Human
agcuacuggagaacacaaaacc

SEQ ID NO: 579144 - RNA, 22 nt, Human
augaggcauuccacucaaacuc

SEQ ID NO: 579145 - RNA, 22 nt, Human
cuacuuuaacaauucgcaagaa

SEQ ID NO: 579146 - RNA, 22 nt, Human
uuuagagucccuuucucaccac

SEQ ID NO: 579147 - RNA, 17 nt, Human
agcugagcuggccaggg

SEQ ID NO: 579148 - RNA, 22 nt, Human
uaguguuaauucaguuuauaau

SEQ ID NO: 579149 - RNA, 22 nt, Human
cccucugguuugcccuugggug

SEQ ID NO: 579150 - RNA, 22 nt, Human
auugugcagaauuggaauugca

SEQ ID NO: 579151 - RNA, 22 nt, Human
agcaguggcauacauuuugagu

SEQ ID NO: 579152 - RNA, 19 nt, Human
cugugcccuaugacuugua

SEQ ID NO: 579153 - RNA, 22 nt, Human
aaugagggggaugggaaagugu

SEQ ID NO: 579154 - RNA, 22 nt, Human
aacagcuuuguauacaguaacu

SEQ ID NO: 579155 - RNA, 22 nt, Human
caaaagcagcaaguuuauaugu

SEQ ID NO: 579156 - RNA, 20 nt, Human
cauuaugguugggcacagug

SEQ ID NO: 579157 - RNA, 22 nt, Human
acagcaagaccccuagcauggu

SEQ ID NO: 579158 - RNA, 22 nt, Human
ugagcuguuucucugguggcuu

SEQ ID NO: 579159 - RNA, 22 nt, Human
ccaucaaugacuaauaaaauag

SEQ ID NO: 579160 - RNA, 22 nt, Human
ugccugcuuguguaccugguga

SEQ ID NO: 579161 - RNA, 22 nt, Human
auacaaaauauauacuggagac

SEQ ID NO: 579162 - RNA, 22 nt, Human
guccugggggcagcugugucca

SEQ ID NO: 579163 - RNA, 22 nt, Human
cucagggaauuauuucuguccu

SEQ ID NO: 579164 - RNA, 22 nt, Human
ucugaaagaaagauuuuguuuc

SEQ ID NO: 579165 - RNA, 22 nt, Human
uugacaauguccuuugaauuuc

SEQ ID NO: 579166 - RNA, 18 nt, Human
aagcugggaaggagacag

SEQ ID NO: 579167 - RNA, 22 nt, Human
aaucaacaggaugugcauugua

SEQ ID NO: 579168 - RNA, 22 nt, Human
ugcugauauauucuaguuuucu

SEQ ID NO: 579169 - RNA, 22 nt, Human
cugaaugccugcagagccagag

SEQ ID NO: 579170 - RNA, 22 nt, Human
agacaauacauuuauucccuuu

SEQ ID NO: 579171 - RNA, 22 nt, Human
gggcuccaguuguccccaggau

SEQ ID NO: 579172 - RNA, 22 nt, Human
uaccauaacguaaugaacuuga

SEQ ID NO: 579173 - RNA, 22 nt, Human
gcccacaggggaccugguggcu

SEQ ID NO: 579174 - RNA, 20 nt, Human
accauuaauguaagcuuugu

SEQ ID NO: 579175 - RNA, 22 nt, Human
ugaaaugcuuaggaccagaagg

SEQ ID NO: 579176 - RNA, 22 nt, Human
gucuggaagaacuagggauguu

SEQ ID NO: 579177 - RNA, 22 nt, Human
uucuugaugaaugcuaagaacu

SEQ ID NO: 579178 - RNA, 20 nt, Human
cucaguaaaagcacaggguc

SEQ ID NO: 579179 - RNA, 22 nt, Human
acauuucugcuagaauagguga

SEQ ID NO: 579180 - RNA, 23 nt, Human
aagguguuuguuuucagaaagca

SEQ ID NO: 579181 - RNA, 23 nt, Human
aucaagucaucagcaaaauacau

SEQ ID NO: 579182 - RNA, 22 nt, Human
guggcccucugauagggucagg

SEQ ID NO: 579183 - RNA, 21 nt, Human
gcccucaggggaggauggccu

SEQ ID NO: 579184 - RNA, 22 nt, Human
ugcuuccuugagcucuccaauc

SEQ ID NO: 579185 - RNA, 22 nt, Human
aucaaaaccuugacuuuuaaug

SEQ ID NO: 579186 - RNA, 22 nt, Human
agggggcucagugacugaagug

SEQ ID NO: 579187 - RNA, 22 nt, Human
uaaugcucacccugcaucaggc

SEQ ID NO: 579188 - RNA, 22 nt, Human
agucccagaucuccauucgguc

SEQ ID NO: 579189 - RNA, 22 nt, Human
aauaauuuugagagccuggaaa

SEQ ID NO: 579190 - RNA, 22 nt, Human
uguuuucuuccuaauugcucau

SEQ ID NO: 579191 - RNA, 22 nt, Human
uguaaaugugaauuuccuuuuc

SEQ ID NO: 579192 - RNA, 22 nt, Human
augggcugaggaagcuccugag

SEQ ID NO: 579193 - RNA, 22 nt, Human
uagucaacuagugagcauaugg

SEQ ID NO: 579194 - RNA, 22 nt, Human
gucccagaggcuuuggccacag

SEQ ID NO: 579195 - RNA, 17 nt, Human
ucugcucugccaaucca

SEQ ID NO: 579196 - RNA, 22 nt, Human
aucugguucuucuuaggcauca

SEQ ID NO: 579197 - RNA, 22 nt, Human
ucagggagggaccugaggcugg

SEQ ID NO: 579198 - RNA, 22 nt, Human
uccuucagggggccgccugcac

SEQ ID NO: 579199 - RNA, 22 nt, Human
aggccuggugaaugaaguaucu

SEQ ID NO: 579200 - RNA, 22 nt, Human
uuguuagauauuucuuagaaga

SEQ ID NO: 579201 - RNA, 22 nt, Human
aagaagaugguuaacuuucagu

SEQ ID NO: 579202 - RNA, 22 nt, Human
uucauagugcuuaauuugauaa

SEQ ID NO: 579203 - RNA, 22 nt, Human
acagccagucaucucagcaggg

SEQ ID NO: 579204 - RNA, 22 nt, Human
aaagcaauugugguuuuugcca

SEQ ID NO: 579205 - RNA, 22 nt, Human
ugaauuuaucaaagauucuuaa

SEQ ID NO: 579206 - RNA, 22 nt, Human
auaagaggaauuacagaagagg

SEQ ID NO: 579207 - RNA, 21 nt, Human
aggcagcaggauccagggaca

SEQ ID NO: 579208 - RNA, 23 nt, Human
cggcugcucggccgaguccucgg

SEQ ID NO: 579209 - RNA, 22 nt, Human
ucugaaauauauuuugaguguu

SEQ ID NO: 579210 - RNA, 22 nt, Human
aggucaggaggccucugccauu

SEQ ID NO: 579211 - RNA, 22 nt, Human
uaacuugaccuguauaaaacac

SEQ ID NO: 579212 - RNA, 22 nt, Human
aaagcaaucuaguuccaauucu

SEQ ID NO: 579213 - RNA, 22 nt, Human
uugucugugaaauggaaauagu

SEQ ID NO: 579214 - RNA, 22 nt, Human
cggcugaggaucuccaggccug

SEQ ID NO: 579215 - RNA, 22 nt, Human
uggggugaaucuuuguuguccg

SEQ ID NO: 579216 - RNA, 22 nt, Human
uaucuacaggugucagguaaga

SEQ ID NO: 579217 - RNA, 22 nt, Human
ggcucagguuaccagucccucc

SEQ ID NO: 579218 - RNA, 22 nt, Human
cagugggauaugggggcagcau

SEQ ID NO: 579219 - RNA, 22 nt, Human
agcugcccugggucuugcugcu

SEQ ID NO: 579220 - RNA, 22 nt, Human
ugcaugcugcacacaugcguag

SEQ ID NO: 579221 - RNA, 22 nt, Human
gucugaaacgcauuguuaucga

SEQ ID NO: 579222 - RNA, 22 nt, Human
ggagcugugcugggugaucagg

SEQ ID NO: 579223 - RNA, 22 nt, Human
ccguggaguugugcugaguaug

SEQ ID NO: 579224 - RNA, 22 nt, Human
agaggcuccuucacucuggcac

SEQ ID NO: 579225 - RNA, 22 nt, Human
caaauuacccucaacaucuaga

SEQ ID NO: 579226 - RNA, 22 nt, Human
aggcacaggccucagcacccag

SEQ ID NO: 579227 - RNA, 19 nt, Human
gcuuccagcacugcaggag

SEQ ID NO: 579228 - RNA, 22 nt, Human
augaaggacaacaggggagcag

SEQ ID NO: 579229 - RNA, 22 nt, Human
agcuuuguggcuuugcaagacu

SEQ ID NO: 579230 - RNA, 21 nt, Human
aguguaggucauuagcuguug

SEQ ID NO: 579231 - RNA, 22 nt, Human
gaggagcugggcugagaggguc

SEQ ID NO: 579232 - RNA, 22 nt, Human
uuucuucucugauuaaggcuca

SEQ ID NO: 579233 - RNA, 22 nt, Human
ucugaggaccuacugaagaguu

SEQ ID NO: 579234 - RNA, 22 nt, Human
agaaggccuaacuugggggcaa

SEQ ID NO: 579235 - RNA, 22 nt, Human
agguccauggcagcggguacuu

SEQ ID NO: 579236 - RNA, 22 nt, Human
acuggaguucaugguaaaguca

SEQ ID NO: 579237 - RNA, 22 nt, Human
gggugggguucaggaaucuuca

SEQ ID NO: 579238 - RNA, 22 nt, Human
uucuucauucccuuacuuccga

SEQ ID NO: 579239 - RNA, 22 nt, Human
acuggaguacaguggcgugaac

SEQ ID NO: 579240 - RNA, 20 nt, Human
gaaggaagggggcaagguga

SEQ ID NO: 579241 - RNA, 22 nt, Human
ccaugccucgggaagagucugu

SEQ ID NO: 579242 - RNA, 22 nt, Human
uuacaacauauuuagcuugauu

SEQ ID NO: 579243 - RNA, 22 nt, Human
gugaggcaggcauucuccuuuc

SEQ ID NO: 579244 - RNA, 22 nt, Human
cucaggcugcccugacagcccc

SEQ ID NO: 579245 - RNA, 22 nt, Human
cagggcaggaauuugacauugc

SEQ ID NO: 579246 - RNA, 20 nt, Human
ugaggcaggagaauggcaug

SEQ ID NO: 579247 - RNA, 22 nt, Human
ucgccagggaugcuguaaggaa

SEQ ID NO: 579248 - RNA, 22 nt, Human
ccacagagagugucagccuuug

SEQ ID NO: 579249 - RNA, 22 nt, Human
aggcagccuauggggagcucag

SEQ ID NO: 579250 - RNA, 22 nt, Human
agagcugcaggguggacccagg

SEQ ID NO: 579251 - RNA, 21 nt, Human
cuuggaacggguagaacucac

SEQ ID NO: 579252 - RNA, 22 nt, Human
ucccaggcuaggccucugcguu

SEQ ID NO: 579253 - RNA, 22 nt, Human
uuuuauugggaguccucuacug

SEQ ID NO: 579254 - RNA, 22 nt, Human
uaucuucagcugaagcagaguc

SEQ ID NO: 579255 - RNA, 22 nt, Human
ggcagcuagaauugugaugcug

SEQ ID NO: 579256 - RNA, 22 nt, Human
uucuuaaaacuuauggacaggu

SEQ ID NO: 579257 - RNA, 22 nt, Human
ugaaggcacguggguggauacu

SEQ ID NO: 579258 - RNA, 23 nt, Human
ucugucaccuauggcugcucuuc

SEQ ID NO: 579259 - RNA, 22 nt, Human
aggcagccugguuugaauggaa

SEQ ID NO: 579260 - RNA, 22 nt, Human
gcauacagagaggauguggcau

SEQ ID NO: 579261 - RNA, 22 nt, Human
uucagggagagcgggacgggug

SEQ ID NO: 579262 - RNA, 22 nt, Human
aaaauugaggccaguaugccau

SEQ ID NO: 579263 - RNA, 22 nt, Human
ugaaacggaauguucuuuaucg

SEQ ID NO: 579264 - RNA, 17 nt, Human
ugcagcugcucccaggc

SEQ ID NO: 579265 - RNA, 22 nt, Human
uguagaacugacauuuuggacu

SEQ ID NO: 579266 - RNA, 22 nt, Human
ucaguaaaugagcaaaaauuuc

SEQ ID NO: 579267 - RNA, 22 nt, Human
cagcaguguacaaggugucaga

SEQ ID NO: 579268 - RNA, 22 nt, Human
guggcuugaccaucccugcuac

SEQ ID NO: 579269 - RNA, 20 nt, Human
ccuccuggucaggugugcag

SEQ ID NO: 579270 - RNA, 20 nt, Human
uucaugcuggaggggcuggc

SEQ ID NO: 579271 - RNA, 23 nt, Human
cagcucagcacauaggagguacu

SEQ ID NO: 579272 - RNA, 22 nt, Human
ggaggguggcagcguccugggc

SEQ ID NO: 579273 - RNA, 22 nt, Human
uauuacaaauuauaaugggaga

SEQ ID NO: 579274 - RNA, 22 nt, Human
agggcuggcuccguuaccuuga

SEQ ID NO: 579275 - RNA, 22 nt, Human
uccagggcaugcucagacucag

SEQ ID NO: 579276 - RNA, 22 nt, Human
gagagcuggccagcuucaguau

SEQ ID NO: 579277 - RNA, 22 nt, Human
gccugggaaagaguagggaaau

SEQ ID NO: 579278 - RNA, 22 nt, Human
uacuuacaguuacggcaagugg

SEQ ID NO: 579279 - RNA, 21 nt, Human
ugcuggaaaaagugguucuag

SEQ ID NO: 579280 - RNA, 22 nt, Human
uggccugguccuugucaaggca

SEQ ID NO: 579281 - RNA, 22 nt, Human
uacagugucuggauaucaaagg

SEQ ID NO: 579282 - RNA, 22 nt, Human
uucugaggcauagaggaugaga

SEQ ID NO: 579283 - RNA, 22 nt, Human
ccuguacagugaaugaauguga

SEQ ID NO: 579284 - RNA, 22 nt, Human
gcagggucugaggccacagagg

SEQ ID NO: 579285 - RNA, 22 nt, Human
acuccaaggccacaugcauucc

SEQ ID NO: 579286 - RNA, 22 nt, Human
uccuucagcucucuauuuagau

SEQ ID NO: 579287 - RNA, 22 nt, Human
uuuccuuccauguugggcaaaa

SEQ ID NO: 579288 - RNA, 22 nt, Human
cccuccccagggucauauugaa

SEQ ID NO: 579289 - RNA, 22 nt, Human
ucucugagaaguuccuuuguga

SEQ ID NO: 579290 - RNA, 22 nt, Human
uuuauuaauuagugacccaaug

SEQ ID NO: 579291 - RNA, 22 nt, Human
guaaugaauagaugguggcagg

SEQ ID NO: 579292 - RNA, 22 nt, Human
cagauuuaagagauaaacagug

SEQ ID NO: 579293 - RNA, 22 nt, Human
gcacccagccagcaucucagag

SEQ ID NO: 579294 - RNA, 22 nt, Human
gagguccacugaggcaacaggg

SEQ ID NO: 579295 - RNA, 22 nt, Human
ucauuucaaugauacuacuaag

SEQ ID NO: 579296 - RNA, 22 nt, Human
ucaaaaauguuuuauauuggua

SEQ ID NO: 579297 - RNA, 22 nt, Human
augcaguacugauacaugccac

SEQ ID NO: 579298 - RNA, 22 nt, Human
auucacaugcccaagcagcacc

SEQ ID NO: 579299 - RNA, 22 nt, Human
ccccagcugagauuugaggaga

SEQ ID NO: 579300 - RNA, 19 nt, Human
ggcuggaguggccaucugu

SEQ ID NO: 579301 - RNA, 20 nt, Human
ccuccacugucacugaccug

SEQ ID NO: 579302 - RNA, 22 nt, Human
ucuuccuuguaagggcuuuaga

SEQ ID NO: 579303 - RNA, 22 nt, Human
gggaggucagggugccugcugg

SEQ ID NO: 579304 - RNA, 23 nt, Human
uggagcugggcucagacccuggg

SEQ ID NO: 579305 - RNA, 22 nt, Human
ccugggucccagccaggcuuug

SEQ ID NO: 579306 - RNA, 22 nt, Human
gcugccacuuggucaugucaug

SEQ ID NO: 579307 - RNA, 22 nt, Human
gcuggagcuugagaggacaggg

SEQ ID NO: 579308 - RNA, 22 nt, Human
cccugccuacaggguuuucuuu

SEQ ID NO: 579309 - RNA, 23 nt, Human
ugucuggagccugagcaggugcu

SEQ ID NO: 579310 - RNA, 22 nt, Human
cagcugccaugacauguccugc

SEQ ID NO: 579311 - RNA, 22 nt, Human
agccagcuggagaccacuguuu

SEQ ID NO: 579312 - RNA, 22 nt, Human
aggcagggugaugauaaugauu

SEQ ID NO: 579313 - RNA, 22 nt, Human
ccuagacuagaggcagggagcc

SEQ ID NO: 579314 - RNA, 22 nt, Human
uccccagaggaauaugagauug

SEQ ID NO: 579315 - RNA, 22 nt, Human
cugggcaauaugcugggccugg

SEQ ID NO: 579316 - RNA, 23 nt, Human
ccagggccccuacaccacugucc

SEQ ID NO: 579317 - RNA, 22 nt, Human
gucuccagauauccuacacaac

SEQ ID NO: 579318 - RNA, 20 nt, Human
aagcacauuucuacaauaau

SEQ ID NO: 579319 - RNA, 22 nt, Human
gcugucccaugguugcaagaug

SEQ ID NO: 579320 - RNA, 22 nt, Human
ugaaugauacagaauuauguag

SEQ ID NO: 579321 - RNA, 18 nt, Human
agggcugaugaguuuggg

SEQ ID NO: 579322 - RNA, 22 nt, Human
uuuaaauguguucuuaguagcu

SEQ ID NO: 579323 - RNA, 22 nt, Human
caaauagugaaacagauggggg

SEQ ID NO: 579324 - RNA, 22 nt, Human
aaguuacagucugcuugcugac

SEQ ID NO: 579325 - RNA, 22 nt, Human
acagagcaugcucaguguguga

SEQ ID NO: 579326 - RNA, 22 nt, Human
agucacaguucugcugucugag

SEQ ID NO: 579327 - RNA, 22 nt, Human
gaggggcugcccuggugucagg

SEQ ID NO: 579328 - RNA, 23 nt, Human
uggccucuccccaccuggcagaa

SEQ ID NO: 579329 - RNA, 22 nt, Human
ugugaaaucugaugaauugacc

SEQ ID NO: 579330 - RNA, 22 nt, Human
ggccaccucugcccuacugagu

SEQ ID NO: 579331 - RNA, 22 nt, Human
gcuuccuggagggagagagcug

SEQ ID NO: 579332 - RNA, 22 nt, Human
uccagcauuagaugugaaauug

SEQ ID NO: 579333 - RNA, 22 nt, Human
agagaaacaggucagcugggag

SEQ ID NO: 579334 - RNA, 22 nt, Human
ugugaaaaaaguucuagaagga

SEQ ID NO: 579335 - RNA, 22 nt, Human
gcagagcugucuaagucacuuc

SEQ ID NO: 579336 - RNA, 22 nt, Human
ggcuccuguuauuuaaugagga

SEQ ID NO: 579337 - RNA, 22 nt, Human
caagauuuggcaacuuugucau

SEQ ID NO: 579338 - RNA, 21 nt, Human
uccacucguauucuguuggca

SEQ ID NO: 579339 - RNA, 22 nt, Human
ucagcugccucucccuggaaga

SEQ ID NO: 579340 - RNA, 22 nt, Human
ugauucaucagaauaggaguuu

SEQ ID NO: 579341 - RNA, 22 nt, Human
uguuuucuucuguaccgugcca

SEQ ID NO: 579342 - RNA, 22 nt, Human
cugaaacuacaguaaggagaac

SEQ ID NO: 579343 - RNA, 22 nt, Human
cccacuccuggagcuagggcuc

SEQ ID NO: 579344 - RNA, 22 nt, Human
gccuucaggaaaucaguccuug

SEQ ID NO: 579345 - RNA, 22 nt, Human
uuacaagugucagguacuggca

SEQ ID NO: 579346 - RNA, 22 nt, Human
caagcaaugcccugguauauua

SEQ ID NO: 579347 - RNA, 22 nt, Human
ugaauccuaauucuaucacuua

SEQ ID NO: 579348 - RNA, 22 nt, Human
uaaagcaaggaauagaguaguc

SEQ ID NO: 579349 - RNA, 22 nt, Human
agagguucagagaaggcgaucu

SEQ ID NO: 579350 - RNA, 22 nt, Human
ccuggcuuuuguuuauaaauuc

SEQ ID NO: 579351 - RNA, 22 nt, Human
uccaguuucauagcuaaggaac

SEQ ID NO: 579352 - RNA, 22 nt, Human
uuaagaggagaucauacuggag

SEQ ID NO: 579353 - RNA, 22 nt, Human
aaacuguagugcuucgaucuga

SEQ ID NO: 579354 - RNA, 22 nt, Human
auuuauugagagggaggggaau

SEQ ID NO: 579355 - RNA, 22 nt, Human
ccugaggagauuguggcugggg

SEQ ID NO: 579356 - RNA, 22 nt, Human
ucuccuggagcaggaagguggg

SEQ ID NO: 579357 - RNA, 22 nt, Human
guggagcccugccuugcucaug

SEQ ID NO: 579358 - RNA, 22 nt, Human
ucugaaagcuagaaaaugcucu

SEQ ID NO: 579359 - RNA, 22 nt, Human
ucccacagugaaguucaugaua

SEQ ID NO: 579360 - RNA, 22 nt, Human
cuuaaaaguugcuucccuaacu

SEQ ID NO: 579361 - RNA, 22 nt, Human
auggcuggaggccgggcuuccu

SEQ ID NO: 579362 - RNA, 22 nt, Human
uuucacaggauucugauguagu

SEQ ID NO: 579363 - RNA, 22 nt, Human
ugucuucacaaagcagaaggga

SEQ ID NO: 579364 - RNA, 22 nt, Human
uauuguaucuucuguuuagaag

SEQ ID NO: 579365 - RNA, 22 nt, Human
accuguggaucagauucuugua

SEQ ID NO: 579366 - RNA, 22 nt, Human
gugcaggagguaacauagcaaa

SEQ ID NO: 579367 - RNA, 22 nt, Human
gcaguuaaaaauaaaccuucau

SEQ ID NO: 579368 - RNA, 22 nt, Human
guccuauauucuuuuaaaauuu

SEQ ID NO: 579369 - RNA, 22 nt, Human
uccugcaggggcugaggaacca

SEQ ID NO: 579370 - RNA, 22 nt, Human
aauaguagucgccuuuuguaag

SEQ ID NO: 579371 - RNA, 22 nt, Human
acaguaaacaaugcagcaaauu

SEQ ID NO: 579372 - RNA, 22 nt, Human
uuuauguuugcauuuucaaaga

SEQ ID NO: 579373 - RNA, 22 nt, Human
uauuucuugaguggucaguuuc

SEQ ID NO: 579374 - RNA, 22 nt, Human
agccucugcacgggcacgggug

SEQ ID NO: 579375 - RNA, 22 nt, Human
gcuccuggugcuguagagauuu

SEQ ID NO: 579376 - RNA, 23 nt, Human
agggaaauacugcaauuuuugga

SEQ ID NO: 579377 - RNA, 22 nt, Human
auucuagcagauauuggaaauu

SEQ ID NO: 579378 - RNA, 22 nt, Human
caugugcuguagcagagaggaa

SEQ ID NO: 579379 - RNA, 20 nt, Human
ucugagacuuguagugugga

SEQ ID NO: 579380 - RNA, 22 nt, Human
aaaacauaaacugacagcccau

SEQ ID NO: 579381 - RNA, 22 nt, Human
aggaggugagcggucauguggu

SEQ ID NO: 579382 - RNA, 22 nt, Human
ggcagagguagcuggaaccagg

SEQ ID NO: 579383 - RNA, 22 nt, Human
aaaugguguuucuaaugcuaga

SEQ ID NO: 579384 - RNA, 22 nt, Human
gaggcucuucaauaggucaaug

SEQ ID NO: 579385 - RNA, 22 nt, Human
agcagaggaggauuuaguuagg

SEQ ID NO: 579386 - RNA, 22 nt, Human
accuggagauccauggugucga

SEQ ID NO: 579387 - RNA, 22 nt, Human
uuugugucgucacugucuucuc

SEQ ID NO: 579388 - RNA, 19 nt, Human
cagcucaggacucagcccc

SEQ ID NO: 579389 - RNA, 22 nt, Human
ugggcccaucauugcugugggc

SEQ ID NO: 579390 - RNA, 22 nt, Human
ugugggaggucuggaaggcucc

SEQ ID NO: 579391 - RNA, 22 nt, Human
cuucugugcuaaaugcaaaacc

SEQ ID NO: 579392 - RNA, 22 nt, Human
ccacugccgugggccuugggga

SEQ ID NO: 579393 - RNA, 22 nt, Human
gccugcccugaaagaggugaag

SEQ ID NO: 579394 - RNA, 22 nt, Human
cuauguucucggcacuauggau

SEQ ID NO: 579395 - RNA, 22 nt, Human
gcuccaggagagggaagcagau

SEQ ID NO: 579396 - RNA, 22 nt, Human
aagagacuaagaaagggcaaua

SEQ ID NO: 579397 - RNA, 22 nt, Human
aucugguuuuggcugugucccu

SEQ ID NO: 579398 - RNA, 22 nt, Human
agcuggagaauaggaauuagug

SEQ ID NO: 579399 - RNA, 22 nt, Human
uuugcaaauaaauaagugcucg

SEQ ID NO: 579400 - RNA, 22 nt, Human
uuggagggacagauggcuaggc

SEQ ID NO: 579401 - RNA, 22 nt, Human
cagagccugccucuggcugugg

SEQ ID NO: 579402 - RNA, 22 nt, Human
aggaccugagaguuggaaaucc

SEQ ID NO: 579403 - RNA, 22 nt, Human
gcuauguuagacauucucauuu

SEQ ID NO: 579404 - RNA, 22 nt, Human
ugcaugaggacucagagcuucu

SEQ ID NO: 579405 - RNA, 19 nt, Human
ggagcuugguggcuguggc

SEQ ID NO: 579406 - RNA, 22 nt, Human
uuugcugugaauccauuacugu

SEQ ID NO: 579407 - RNA, 22 nt, Human
guuguuuugcugucugucuuag

SEQ ID NO: 579408 - RNA, 22 nt, Human
cgagcaugaugacggcuguggc

SEQ ID NO: 579409 - RNA, 22 nt, Human
uggagcugagaaguggagcucu

SEQ ID NO: 579410 - RNA, 22 nt, Human
auugcacuuuccccugugagaa

SEQ ID NO: 579411 - RNA, 22 nt, Human
aaagcucacaguaauacaaggc

SEQ ID NO: 579412 - RNA, 22 nt, Human
uccuuuaugugaguuguuuccc

SEQ ID NO: 579413 - RNA, 22 nt, Human
uggcuucuagcaguguugauuu

SEQ ID NO: 579414 - RNA, 22 nt, Human
acauuucagugagcuauugaag

SEQ ID NO: 579415 - RNA, 22 nt, Human
gucccagaggacagggucacau

SEQ ID NO: 579416 - RNA, 22 nt, Human
agccagcacggcgccauggagu

SEQ ID NO: 579417 - RNA, 21 nt, Human
uccucuccaugaucuguuugu

SEQ ID NO: 579418 - RNA, 22 nt, Human
cuuaagagucuuucuguguuua

SEQ ID NO: 579419 - RNA, 22 nt, Human
uaacaugagagcuaagacauua

SEQ ID NO: 579420 - RNA, 22 nt, Human
uagggcuguuuaaaagugaggu

SEQ ID NO: 579421 - RNA, 18 nt, Human
ggccucagccuggccgga

SEQ ID NO: 579422 - RNA, 22 nt, Human
guuucuguugcucagauaaugc

SEQ ID NO: 579423 - RNA, 22 nt, Human
uccaggcucuaggcugcucucc

SEQ ID NO: 579424 - RNA, 22 nt, Human
gagaacaggcucuggagucaga

SEQ ID NO: 579425 - RNA, 22 nt, Human
agcuguaauauaagcaaugaaa

SEQ ID NO: 579426 - RNA, 22 nt, Human
ccugggaagucagccaaggacg

SEQ ID NO: 579427 - RNA, 22 nt, Human
auaagagucuuguuuucuuauu

SEQ ID NO: 579428 - RNA, 22 nt, Human
ucugacaauaacugaguuuaac

SEQ ID NO: 579429 - RNA, 22 nt, Human
aaggcaauguaaauuacagcuu

SEQ ID NO: 579430 - RNA, 22 nt, Human
ccugccugauuccaggauggcu

SEQ ID NO: 579431 - RNA, 22 nt, Human
uuaugagacuguuuuacacacu

SEQ ID NO: 579432 - RNA, 22 nt, Human
ggcagacaccuuuaugucuaau

SEQ ID NO: 579433 - RNA, 22 nt, Human
gcuggagaaacugcagcugagg

SEQ ID NO: 579434 - RNA, 19 nt, Human
ucugggcagggccagcacc

SEQ ID NO: 579435 - RNA, 22 nt, Human
ugggaagauaugagugaccaac

SEQ ID NO: 579436 - RNA, 22 nt, Human
cccuuagcuccaagggguuugg

SEQ ID NO: 579437 - RNA, 22 nt, Human
cugugcugcagacgcaguagcu

SEQ ID NO: 579438 - RNA, 22 nt, Human
cagggacaauggcagagccuga

SEQ ID NO: 579439 - RNA, 22 nt, Human
gcuggagagauaggcauggggu

SEQ ID NO: 579440 - RNA, 22 nt, Human
ugcucugguaacucacuuccau

SEQ ID NO: 579441 - RNA, 22 nt, Human
caaugguggugucagaagagau

SEQ ID NO: 579442 - RNA, 22 nt, Human
uucagaaaucgaguuucauguc

SEQ ID NO: 579443 - RNA, 22 nt, Human
guauuuuaagugacuacuaggu

SEQ ID NO: 579444 - RNA, 23 nt, Human
aauuacaaccaagaacuggaagg

SEQ ID NO: 579445 - RNA, 22 nt, Human
accucuuugaaccucaguguga

SEQ ID NO: 579446 - RNA, 22 nt, Human
auaaauguuuguugaaugaaua

SEQ ID NO: 579447 - RNA, 22 nt, Human
ucacugaauacuugucucaucc

SEQ ID NO: 579448 - RNA, 22 nt, Human
auuccauucuugcuuuugaucu

SEQ ID NO: 579449 - RNA, 22 nt, Human
ccuucuggaugugcuaaggaag

SEQ ID NO: 579450 - RNA, 22 nt, Human
ccaaguguuuuauaagggacag

SEQ ID NO: 579451 - RNA, 22 nt, Human
gcaguguuuuucaaugcuucca

SEQ ID NO: 579452 - RNA, 22 nt, Human
aaggccagcaguuugagaccag

SEQ ID NO: 579453 - RNA, 21 nt, Human
agccagcuaucacacagcauu

SEQ ID NO: 579454 - RNA, 22 nt, Human
gccugggagggcagcagugugg

SEQ ID NO: 579455 - RNA, 23 nt, Human
gaauucuuaaggucacuaaaguc

SEQ ID NO: 579456 - RNA, 22 nt, Human
ucuugaaaguaucuuauuuugu

SEQ ID NO: 579457 - RNA, 21 nt, Human
aaucauacaaaacaugucagg

SEQ ID NO: 579458 - RNA, 22 nt, Human
uuuaagaguuaaacuuugaccu

SEQ ID NO: 579459 - RNA, 22 nt, Human
augcauaaagaaagcuaucugg

SEQ ID NO: 579460 - RNA, 22 nt, Human
aagagcuggauugugcugcaga

SEQ ID NO: 579461 - RNA, 22 nt, Human
cuuaaggaaaagucucuuuuaa

SEQ ID NO: 579462 - RNA, 22 nt, Human
gggcagagaaauggacaguugg

SEQ ID NO: 579463 - RNA, 22 nt, Human
gaagaacugugacagaagcagu

SEQ ID NO: 579464 - RNA, 18 nt, Human
gggcaagcggcugucacc

SEQ ID NO: 579465 - RNA, 22 nt, Human
aauaaaguagcguuuaaggugc

SEQ ID NO: 579466 - RNA, 22 nt, Human
caugcaaaauguauuuuauuag

SEQ ID NO: 579467 - RNA, 16 nt, Human
cuuuuucuccccucuu

SEQ ID NO: 579468 - RNA, 22 nt, Human
cauuuacuuaaaucuuuacaag

SEQ ID NO: 579469 - RNA, 21 nt, Human
ggccugagcaccuguccaccu

SEQ ID NO: 579470 - RNA, 22 nt, Human
ggcuuaaaaggaaaaugagagu

SEQ ID NO: 579471 - RNA, 22 nt, Human
cauuacaaccccaaauuacaaa

SEQ ID NO: 579472 - RNA, 22 nt, Human
auguacauguuuaagugaagga

SEQ ID NO: 579473 - RNA, 21 nt, Human
gguugguguguccaguggcca

SEQ ID NO: 579474 - RNA, 22 nt, Human
ugcccucagcagcagcuccugc

SEQ ID NO: 579475 - RNA, 22 nt, Human
cucucccuaugccucccaggag

SEQ ID NO: 579476 - RNA, 22 nt, Human
aguccaggcggguauagaggcu

SEQ ID NO: 579477 - RNA, 22 nt, Human
acaggcugccuaccaaguauca

SEQ ID NO: 579478 - RNA, 22 nt, Human
agaggccaguggcugugcuguc

SEQ ID NO: 579479 - RNA, 21 nt, Human
ggcagcugaccgcgcggugca

SEQ ID NO: 579480 - RNA, 22 nt, Human
ugggguucuuuguuuccugccu

SEQ ID NO: 579481 - RNA, 22 nt, Human
gugcaguggcagauccuagcuc

SEQ ID NO: 579482 - RNA, 22 nt, Human
uuccugagaacauggcagcuua

SEQ ID NO: 579483 - RNA, 22 nt, Human
uacacagaggcugaugucuuag

SEQ ID NO: 579484 - RNA, 22 nt, Human
uuuggucuggaaucuucagggu

SEQ ID NO: 579485 - RNA, 22 nt, Human
gggacgggcaguccaagggguc

SEQ ID NO: 579486 - RNA, 22 nt, Human
augcuuaacuuccuagucuaua

SEQ ID NO: 579487 - RNA, 22 nt, Human
caacuuuugacacgugugcuaa

SEQ ID NO: 579488 - RNA, 22 nt, Human
agaguuuggugaagcaauuuga

SEQ ID NO: 579489 - RNA, 22 nt, Human
agaagcagacucugaggcaagg

SEQ ID NO: 579490 - RNA, 22 nt, Human
aggcacaggaaugucauccagu

SEQ ID NO: 579491 - RNA, 22 nt, Human
ccugggcuguugcaucauccuu

SEQ ID NO: 579492 - RNA, 22 nt, Human
ggucagcagugcagggcagagc

SEQ ID NO: 579493 - RNA, 22 nt, Human
gagggugggcuuuguuccucca

SEQ ID NO: 579494 - RNA, 20 nt, Human
agcuucaggcucaagagaac

SEQ ID NO: 579495 - RNA, 22 nt, Human
ccugggagcuguggaaaggcug

SEQ ID NO: 579496 - RNA, 22 nt, Human
cuuagcaugugguguccuugua

SEQ ID NO: 579497 - RNA, 22 nt, Human
agacaggacacaagcugcauaa

SEQ ID NO: 579498 - RNA, 22 nt, Human
ggggaagggaguccaaguguua

SEQ ID NO: 579499 - RNA, 22 nt, Human
ucauuuuuuuccgguaggaaua

SEQ ID NO: 579500 - RNA, 22 nt, Human
ucuagucauauuuuuucaguau

SEQ ID NO: 579501 - RNA, 22 nt, Human
cccaggcugucuguccuuugcu

SEQ ID NO: 579502 - RNA, 22 nt, Human
ggagauggaguggauucagcag

SEQ ID NO: 579503 - RNA, 22 nt, Human
gauaauuugauaccucaaucag

SEQ ID NO: 579504 - RNA, 22 nt, Human
guacccaggcacgccuugcuga

SEQ ID NO: 579505 - RNA, 22 nt, Human
cuccuuccugguuagcaccuua

SEQ ID NO: 579506 - RNA, 22 nt, Human
gcccaggggcagcgcauagugg

SEQ ID NO: 579507 - RNA, 20 nt, Human
ucuuccagguacagucugca

SEQ ID NO: 579508 - RNA, 22 nt, Human
uggcaggguuggccaccuuacc

SEQ ID NO: 579509 - RNA, 22 nt, Human
caggugaaaaagcaaccauauu

SEQ ID NO: 579510 - RNA, 22 nt, Human
ucuguugcauaugcugcugggu

SEQ ID NO: 579511 - RNA, 22 nt, Human
aaaguguugauuuuauagugca

SEQ ID NO: 579512 - RNA, 22 nt, Human
aggugcugccccgagaaggaug

SEQ ID NO: 579513 - RNA, 22 nt, Human
gagagaaaggauaacagcucaa

SEQ ID NO: 579514 - RNA, 22 nt, Human
uagaaaggauauugagaugaau

SEQ ID NO: 579515 - RNA, 22 nt, Human
aaguuacaguuaugaaacucac

SEQ ID NO: 579516 - RNA, 22 nt, Human
ugcuuucauauugccuaugacu

SEQ ID NO: 579517 - RNA, 19 nt, Human
uucucuauuaugucuucuc

SEQ ID NO: 579518 - RNA, 20 nt, Human
uguggaaaaacagaagcaga

SEQ ID NO: 579519 - RNA, 22 nt, Human
cccugagccacacagagcaggu

SEQ ID NO: 579520 - RNA, 22 nt, Human
gcccaagaucuggagcugcagg

SEQ ID NO: 579521 - RNA, 22 nt, Human
cagcugugaauugucuuaucua

SEQ ID NO: 579522 - RNA, 22 nt, Human
uguccuuuuucuuaggaaauau

SEQ ID NO: 579523 - RNA, 22 nt, Human
uccuggugaaugacuuuuuauu

SEQ ID NO: 579524 - RNA, 22 nt, Human
ugcugccugguuucuucuugcu

SEQ ID NO: 579525 - RNA, 22 nt, Human
cugcagagcuuucugaaugaag

SEQ ID NO: 579526 - RNA, 22 nt, Human
caggcuuuacuuucucucugaa

SEQ ID NO: 579527 - RNA, 22 nt, Human
cugggaugggaacugagaauca

SEQ ID NO: 579528 - RNA, 22 nt, Human
aguuaacuaaacugugaguaaa

SEQ ID NO: 579529 - RNA, 20 nt, Human
cagugaggaggugcuggggg

SEQ ID NO: 579530 - RNA, 22 nt, Human
uaaugccuuaugucaaauguaa

SEQ ID NO: 579531 - RNA, 20 nt, Human
aggggccuggaacaggccuu

SEQ ID NO: 579532 - RNA, 22 nt, Human
auuauauugaguauaaccagag

SEQ ID NO: 579533 - RNA, 22 nt, Human
cugcaggggccucgagcacagg

SEQ ID NO: 579534 - RNA, 23 nt, Human
cugaagcaguucccucucugccc

SEQ ID NO: 579535 - RNA, 22 nt, Human
gugccagcaguuauggugauuu

SEQ ID NO: 579536 - RNA, 22 nt, Human
agugcuggguacuguucccauu

SEQ ID NO: 579537 - RNA, 22 nt, Human
uccuuucugucuuuacucugga

SEQ ID NO: 579538 - RNA, 22 nt, Human
aguacaaacuguuucaaaguag

SEQ ID NO: 579539 - RNA, 22 nt, Human
aaaucucugaacuuaauaaugc

SEQ ID NO: 579540 - RNA, 22 nt, Human
aauguuuucccagugcagacga

SEQ ID NO: 579541 - RNA, 22 nt, Human
ucagaacauguuugaguaagac

SEQ ID NO: 579542 - RNA, 22 nt, Human
caggccacacggcggcucccug

SEQ ID NO: 579543 - RNA, 22 nt, Human
cacugccauguugauagaugug

SEQ ID NO: 579544 - RNA, 22 nt, Human
ggagcuggccgccuaugugcag

SEQ ID NO: 579545 - RNA, 19 nt, Human
gggaaauucacuugcuucc

SEQ ID NO: 579546 - RNA, 22 nt, Human
uacauauagacaguuacucuag

SEQ ID NO: 579547 - RNA, 22 nt, Human
gcugcaggcucugcaggaauug

SEQ ID NO: 579548 - RNA, 22 nt, Human
cauuaaacaaccuugaaucaau

SEQ ID NO: 579549 - RNA, 22 nt, Human
agacagacguagugugagagua

SEQ ID NO: 579550 - RNA, 22 nt, Human
ucauuuacacuucacaaaugga

SEQ ID NO: 579551 - RNA, 23 nt, Human
gcagacagagcagacuaagacaa

SEQ ID NO: 579552 - RNA, 22 nt, Human
aaaagcaguuaucugggaggaa

SEQ ID NO: 579553 - RNA, 22 nt, Human
ugggcucauggcccagcacugg

SEQ ID NO: 579554 - RNA, 18 nt, Human
ugaggcagucagugaugg

SEQ ID NO: 579555 - RNA, 22 nt, Human
aaucuucacagaaaaaugucug

SEQ ID NO: 579556 - RNA, 22 nt, Human
agaaaugaaaccaaagccuaga

SEQ ID NO: 579557 - RNA, 22 nt, Human
gccacaggcacuuaagggcugg

SEQ ID NO: 579558 - RNA, 22 nt, Human
aguguuauaaaggccaaguuuu

SEQ ID NO: 579559 - RNA, 22 nt, Human
gcaggccacugucuccucuggg

SEQ ID NO: 579560 - RNA, 22 nt, Human
aaucuucacucuuaacugugca

SEQ ID NO: 579561 - RNA, 22 nt, Human
aaagauacuuaauaguugucug

SEQ ID NO: 579562 - RNA, 22 nt, Human
caggcagaaauuuuguuucauu

SEQ ID NO: 579563 - RNA, 22 nt, Human
aagagcuggucacagguccauu

SEQ ID NO: 579564 - RNA, 22 nt, Human
cugugcccaggcuggagugcag

SEQ ID NO: 579565 - RNA, 20 nt, Human
uggcaggaauagggccagag

SEQ ID NO: 579566 - RNA, 19 nt, Human
ccuagagggaaggcaggac

SEQ ID NO: 579567 - RNA, 22 nt, Human
agugcucuaacagucaaaaaag

SEQ ID NO: 579568 - RNA, 21 nt, Human
uguucaaacguacacauuucu

SEQ ID NO: 579569 - RNA, 22 nt, Human
uucuugcucaaugucuguuuaa

SEQ ID NO: 579570 - RNA, 22 nt, Human
ugaggagaaaugcucagagcca

SEQ ID NO: 579571 - RNA, 22 nt, Human
aaucacuuuucucuaauguagc

SEQ ID NO: 579572 - RNA, 22 nt, Human
ccugggcagguguggcuucccc

SEQ ID NO: 579573 - RNA, 22 nt, Human
gcaggcugaaacucggggucua

SEQ ID NO: 579574 - RNA, 22 nt, Human
gacuuggggauuuaucucacag

SEQ ID NO: 579575 - RNA, 22 nt, Human
ucucuucuaacacuagaaauuc

SEQ ID NO: 579576 - RNA, 22 nt, Human
aaaggaagaugccaggacucug

SEQ ID NO: 579577 - RNA, 22 nt, Human
agucacugguucuguaauuaau

SEQ ID NO: 579578 - RNA, 19 nt, Human
gcagcaguggaaggaaaaa

SEQ ID NO: 579579 - RNA, 21 nt, Human
ucaggggcuguguuuuccauc

SEQ ID NO: 579580 - RNA, 19 nt, Human
agugagcauccagagaggu

SEQ ID NO: 579581 - RNA, 22 nt, Human
aggugaaguugaggaggcagaa

SEQ ID NO: 579582 - RNA, 22 nt, Human
uucucuuauucuggauaugcag

SEQ ID NO: 579583 - RNA, 22 nt, Human
cuggaguguaaagagcauagaa

SEQ ID NO: 579584 - RNA, 19 nt, Human
gaguuauugccagggcaug

SEQ ID NO: 579585 - RNA, 22 nt, Human
ccaaggcuccucagcuggucuu

SEQ ID NO: 579586 - RNA, 22 nt, Human
caccugagcacuggggccgccc

SEQ ID NO: 579587 - RNA, 22 nt, Human
ccaaggcuggagugcaguggcg

SEQ ID NO: 579588 - RNA, 22 nt, Human
uuguauuucuccacuuucuguu

SEQ ID NO: 579589 - RNA, 22 nt, Human
cuggagcugccagggcugccgc

SEQ ID NO: 579590 - RNA, 22 nt, Human
augaagcagaauuucccacucu

SEQ ID NO: 579591 - RNA, 19 nt, Human
caggauuguuuaaagcuuu

SEQ ID NO: 579592 - RNA, 22 nt, Human
uuuaucuguuguaccugcauug

SEQ ID NO: 579593 - RNA, 22 nt, Human
ugaggcacuccaggaugcuguu

SEQ ID NO: 579594 - RNA, 22 nt, Human
aauuuucacagugcugugagau

SEQ ID NO: 579595 - RNA, 22 nt, Human
uuugugcagcuaagaaaauggc

SEQ ID NO: 579596 - RNA, 22 nt, Human
uccauacauaaaauguuuaaug

SEQ ID NO: 579597 - RNA, 22 nt, Human
uuacucagucucccauacauug

SEQ ID NO: 579598 - RNA, 22 nt, Human
ugccucagagaccugacaguac

SEQ ID NO: 579599 - RNA, 22 nt, Human
uuuuauugucaaugaagacaga

SEQ ID NO: 579600 - RNA, 22 nt, Human
acuuucaagcccucuagagaca

SEQ ID NO: 579601 - RNA, 22 nt, Human
cccauuuugcuuaugcugcugu

SEQ ID NO: 579602 - RNA, 22 nt, Human
ccuguguguaggccaggggagu

SEQ ID NO: 579603 - RNA, 22 nt, Human
guuuccagccuagagaugguga

SEQ ID NO: 579604 - RNA, 22 nt, Human
aagcagcuuccccaaagugccu

SEQ ID NO: 579605 - RNA, 22 nt, Human
uggggguccuccucugcuuaag

SEQ ID NO: 579606 - RNA, 22 nt, Human
ugagcuguaaggcugucacuga

SEQ ID NO: 579607 - RNA, 22 nt, Human
uggaauacuguaaagaaaaauc

SEQ ID NO: 579608 - RNA, 22 nt, Human
acaggcaggcuucggccagagc

SEQ ID NO: 579609 - RNA, 22 nt, Human
gauauuuucagucuccuuucaa

SEQ ID NO: 579610 - RNA, 22 nt, Human
gaggccaaguuggagaccaggu

SEQ ID NO: 579611 - RNA, 22 nt, Human
agaggcugugcccaccaggcaa

SEQ ID NO: 579612 - RNA, 22 nt, Human
ccugggagagccaucuguggcc

SEQ ID NO: 579613 - RNA, 23 nt, Human
cagggccaggcagcagcugucac

SEQ ID NO: 579614 - RNA, 22 nt, Human
ucuggaguggaggugccuuggg

SEQ ID NO: 579615 - RNA, 22 nt, Human
cuuagaauaaaagggggcuaua

SEQ ID NO: 579616 - RNA, 22 nt, Human
cagacuggccacaucugcacug

SEQ ID NO: 579617 - RNA, 22 nt, Human
uguauuuucagaguggcauuuc

SEQ ID NO: 579618 - RNA, 22 nt, Human
gcagaggagugauuaugccgug

SEQ ID NO: 579619 - RNA, 22 nt, Human
uggcagcugagugcacccccuc

SEQ ID NO: 579620 - RNA, 22 nt, Human
cagugggcugugauggauucac

SEQ ID NO: 579621 - RNA, 17 nt, Human
uuguguguaguucugau

SEQ ID NO: 579622 - RNA, 22 nt, Human
gggcuucugggcaccacucccu

SEQ ID NO: 579623 - RNA, 21 nt, Human
agcuggcucucucuggagaga

SEQ ID NO: 579624 - RNA, 22 nt, Human
uuacaagauaugugagaacuag

SEQ ID NO: 579625 - RNA, 22 nt, Human
cucucuuucauuggucgccuug

SEQ ID NO: 579626 - RNA, 22 nt, Human
acacaguaaauauugucuccuc

SEQ ID NO: 579627 - RNA, 22 nt, Human
ugagaugggaugugcacuuggc

SEQ ID NO: 579628 - RNA, 22 nt, Human
agugaagcccauuuuuagcugu

SEQ ID NO: 579629 - RNA, 22 nt, Human
ugagguaggcuugagaugggag

SEQ ID NO: 579630 - RNA, 21 nt, Human
gggaaacucugcuuaacagag

SEQ ID NO: 579631 - RNA, 22 nt, Human
acacauguauaugcuugugugu

SEQ ID NO: 579632 - RNA, 22 nt, Human
agggugcauguuugcaagagug

SEQ ID NO: 579633 - RNA, 23 nt, Human
acugccugcuacuaugcccacgg

SEQ ID NO: 579634 - RNA, 22 nt, Human
ugagagcugcugagacuguccu

SEQ ID NO: 579635 - RNA, 22 nt, Human
ccccugccagcuaucccugaac

SEQ ID NO: 579636 - RNA, 22 nt, Human
gccagcucucauuguauaggcu

SEQ ID NO: 579637 - RNA, 22 nt, Human
agccagguuaaaccacagucaa

SEQ ID NO: 579638 - RNA, 22 nt, Human
cugccucaugcugccugcagcc

SEQ ID NO: 579639 - RNA, 22 nt, Human
gaguucucaagcaaucaaagag

SEQ ID NO: 579640 - RNA, 22 nt, Human
uagcuuugcuggcaagcauguc

SEQ ID NO: 579641 - RNA, 22 nt, Human
auaucauuauguuaugagcaca

SEQ ID NO: 579642 - RNA, 22 nt, Human
uagagcuauuuagagcauuuua

SEQ ID NO: 579643 - RNA, 22 nt, Human
cuggcuuugguccccugugccu

SEQ ID NO: 579644 - RNA, 23 nt, Human
cuuuaaugaaauucucugugaag

SEQ ID NO: 579645 - RNA, 22 nt, Human
gcaauaaaauguaaugauuggg

SEQ ID NO: 579646 - RNA, 22 nt, Human
aagccagauagaagaacucauu

SEQ ID NO: 579647 - RNA, 22 nt, Human
caguggguggcuaaguggcuga

SEQ ID NO: 579648 - RNA, 21 nt, Human
aacaugauauguguauggauu

SEQ ID NO: 579649 - RNA, 22 nt, Human
cuggcugacaccuugauagcag

SEQ ID NO: 579650 - RNA, 22 nt, Human
caucacugucaccaucuuuccu

SEQ ID NO: 579651 - RNA, 22 nt, Human
cucaggaggccauucucaaggu

SEQ ID NO: 579652 - RNA, 22 nt, Human
aauuauggugugugguuaaggg

SEQ ID NO: 579653 - RNA, 22 nt, Human
cauuuguugggacaaugaaaag

SEQ ID NO: 579654 - RNA, 22 nt, Human
aacugcuuagugauggaugacc

SEQ ID NO: 579655 - RNA, 22 nt, Human
ucugagcauaugcagcaccugg

SEQ ID NO: 579656 - RNA, 23 nt, Human
aggauguaggauguauggcagag

SEQ ID NO: 579657 - RNA, 22 nt, Human
gugucagaaacaggaaggggaa

SEQ ID NO: 579658 - RNA, 22 nt, Human
aaggcagucaaagcagacuucu

SEQ ID NO: 579659 - RNA, 22 nt, Human
ccuuccuggagcccaugcagau

SEQ ID NO: 579660 - RNA, 22 nt, Human
acuguguccucauguggcagaa

SEQ ID NO: 579661 - RNA, 22 nt, Human
caggcucuuccauccugcugag

SEQ ID NO: 579662 - RNA, 22 nt, Human
ugagaggugaggcaugaggcau

SEQ ID NO: 579663 - RNA, 22 nt, Human
aaaaagacagaggaugaggcag

SEQ ID NO: 579664 - RNA, 22 nt, Human
gccagccauaggccagcacugg

SEQ ID NO: 579665 - RNA, 22 nt, Human
aggggaagauuauacuuuugaa

SEQ ID NO: 579666 - RNA, 22 nt, Human
agagcauccauuuuugucacau

SEQ ID NO: 579667 - RNA, 22 nt, Human
ccagcucugccaagcgucagcu

SEQ ID NO: 579668 - RNA, 22 nt, Human
gagcugaauugaagcaaggagc

SEQ ID NO: 579669 - RNA, 22 nt, Human
uguccuuaucuccaaacaauca

SEQ ID NO: 579670 - RNA, 22 nt, Human
uuccugguccuauuauauacac

SEQ ID NO: 579671 - RNA, 22 nt, Human
ucugcaaacccccaucuaucau

SEQ ID NO: 579672 - RNA, 19 nt, Human
uucauaacuuuuauauccu

SEQ ID NO: 579673 - RNA, 22 nt, Human
gggccagcucugugauguaggg

SEQ ID NO: 579674 - RNA, 22 nt, Human
cugaggcaccggcaauguucug

SEQ ID NO: 579675 - RNA, 22 nt, Human
cucccugcuuguuucccuucag

SEQ ID NO: 579676 - RNA, 22 nt, Human
gugcaggugguuggcccagccg

SEQ ID NO: 579677 - RNA, 22 nt, Human
cugaggcagagaaugaguuugu

SEQ ID NO: 579678 - RNA, 22 nt, Human
cugagauggaguuuugcucuug

SEQ ID NO: 579679 - RNA, 22 nt, Human
cagugagcuccugucugucccu

SEQ ID NO: 579680 - RNA, 22 nt, Human
ugucuuuacuuaauaaauauac

SEQ ID NO: 579681 - RNA, 22 nt, Human
uuauaguuaugaaagacugagg

SEQ ID NO: 579682 - RNA, 22 nt, Human
auuucagugagaaagcaaucaa

SEQ ID NO: 579683 - RNA, 22 nt, Human
aggccagcucacccuggcuccu

SEQ ID NO: 579684 - RNA, 22 nt, Human
gucuuucuaugaugaacuguug

SEQ ID NO: 579685 - RNA, 22 nt, Human
cucucuggguccucuuuuauag

SEQ ID NO: 579686 - RNA, 22 nt, Human
ggaccccagagauaccaguuuu

SEQ ID NO: 579687 - RNA, 22 nt, Human
gagacacucaacaaagauauga

SEQ ID NO: 579688 - RNA, 22 nt, Human
gagacacacauucuggagagaa

SEQ ID NO: 579689 - RNA, 22 nt, Human
ucugaggcugcaucuaugugac

SEQ ID NO: 579690 - RNA, 22 nt, Human
agcuccagccgcugauggguuu

SEQ ID NO: 579691 - RNA, 22 nt, Human
uggagagcaaugaggggcaggc

SEQ ID NO: 579692 - RNA, 22 nt, Human
uucugggacauugcagguauuc

SEQ ID NO: 579693 - RNA, 22 nt, Human
uuucaacagaauaugaucagag

SEQ ID NO: 579694 - RNA, 17 nt, Human
agcugccagggagugug

SEQ ID NO: 579695 - RNA, 22 nt, Human
uauucaugagauaggcaguuuu

SEQ ID NO: 579696 - RNA, 22 nt, Human
uauuugcaaagaacuacacuag

SEQ ID NO: 579697 - RNA, 22 nt, Human
uucaaaaugcacaaagggcuag

SEQ ID NO: 579698 - RNA, 22 nt, Human
auuccuaaaguaauacacuaga

SEQ ID NO: 579699 - RNA, 16 nt, Human
caauacauggcauuuc

SEQ ID NO: 579700 - RNA, 22 nt, Human
ggcuagggaaaaugauuggaua

SEQ ID NO: 579701 - RNA, 22 nt, Human
cagcuguucggggcuggcaugu

SEQ ID NO: 579702 - RNA, 22 nt, Human
aagauauucaaagauuuauuag

SEQ ID NO: 579703 - RNA, 22 nt, Human
ugggagcaggugugcuagggaa

SEQ ID NO: 579704 - RNA, 22 nt, Human
uguccuuagggauauaaaauau

SEQ ID NO: 579705 - RNA, 22 nt, Human
uauguguauguacauacauaca

SEQ ID NO: 579706 - RNA, 22 nt, Human
gauguagacacuuggaggcuua

SEQ ID NO: 579707 - RNA, 22 nt, Human
caggcacacagcacauggccug

SEQ ID NO: 579708 - RNA, 20 nt, Human
agugucugggccucaggccc

SEQ ID NO: 579709 - RNA, 22 nt, Human
augaggcagagggcugugccag

SEQ ID NO: 579710 - RNA, 22 nt, Human
ugugaaaugaguauauuugaau

SEQ ID NO: 579711 - RNA, 22 nt, Human
aaaguuuuauaugcugcagcga

SEQ ID NO: 579712 - RNA, 22 nt, Human
acccagaguaacagauggauuc

SEQ ID NO: 579713 - RNA, 20 nt, Human
cugggcugggcuacaggguc

SEQ ID NO: 579714 - RNA, 22 nt, Human
uggcagaggcucugugauguug

SEQ ID NO: 579715 - RNA, 22 nt, Human
uugcagggcuggaacauggaau

SEQ ID NO: 579716 - RNA, 22 nt, Human
agggcagaaguacagacacuua

SEQ ID NO: 579717 - RNA, 22 nt, Human
agcuggcauacuuugcuaggaa

SEQ ID NO: 579718 - RNA, 22 nt, Human
cugcccugccuggccagugugg

SEQ ID NO: 579719 - RNA, 22 nt, Human
uuccaaauguuggacaacugua

SEQ ID NO: 579720 - RNA, 22 nt, Human
aguaaacauaauuuaccuguag

SEQ ID NO: 579721 - RNA, 22 nt, Human
gccagcaguccaguccuuagug

SEQ ID NO: 579722 - RNA, 22 nt, Human
ucuuugaacuuggcugaucucu

SEQ ID NO: 579723 - RNA, 22 nt, Human
augcccaaugucacaauuuuug

SEQ ID NO: 579724 - RNA, 22 nt, Human
agagagcucugaugggagguga

SEQ ID NO: 579725 - RNA, 22 nt, Human
gcagcagaaggccaaggggagc

SEQ ID NO: 579726 - RNA, 22 nt, Human
cagggccaaguuggugccuuuu

SEQ ID NO: 579727 - RNA, 22 nt, Human
ccugcccauacugaccucuaau

SEQ ID NO: 579728 - RNA, 22 nt, Human
ggguuggauuacuuagggagaa

SEQ ID NO: 579729 - RNA, 22 nt, Human
aauaucuguggccauacaauuu

SEQ ID NO: 579730 - RNA, 22 nt, Human
acuguacaacugcugagcagaa

SEQ ID NO: 579731 - RNA, 22 nt, Human
gaagggagaagguugggugacg

SEQ ID NO: 579732 - RNA, 20 nt, Human
uuccucaggagaggauguua

SEQ ID NO: 579733 - RNA, 22 nt, Human
auugugaauagugccgcaguaa

SEQ ID NO: 579734 - RNA, 20 nt, Human
ggaagccagcauccuugagg

SEQ ID NO: 579735 - RNA, 22 nt, Human
guucagauuucaugaguaauug

SEQ ID NO: 579736 - RNA, 22 nt, Human
uguguaaagcuuguuccagaaa

SEQ ID NO: 579737 - RNA, 22 nt, Human
cccaggcagucuggcucuaaag

SEQ ID NO: 579738 - RNA, 23 nt, Human
ugauucugcuuugagaaucaugg

SEQ ID NO: 579739 - RNA, 22 nt, Human
aagaacauguuaaaagauucac

SEQ ID NO: 579740 - RNA, 23 nt, Human
cugcuuucccacuccaugcucuu

SEQ ID NO: 579741 - RNA, 22 nt, Human
uucuccuuuguaauucucaucc

SEQ ID NO: 579742 - RNA, 22 nt, Human
uuccuguuguguuagagucaau

SEQ ID NO: 579743 - RNA, 22 nt, Human
caaauguaauggcagguuuugc

SEQ ID NO: 579744 - RNA, 22 nt, Human
ugcucacagcccagaacauaau

SEQ ID NO: 579745 - RNA, 22 nt, Human
uuaaaaauauguagggcccgau

SEQ ID NO: 579746 - RNA, 19 nt, Human
ggccaggcugacugugguc

SEQ ID NO: 579747 - RNA, 22 nt, Human
cacaggcuugucagcaugaggc

SEQ ID NO: 579748 - RNA, 22 nt, Human
agaggccaggcagcccaaggug

SEQ ID NO: 579749 - RNA, 22 nt, Human
aguaggaugcuuuauaugaaag

SEQ ID NO: 579750 - RNA, 22 nt, Human
ugcuucugaacucagcaugugg

SEQ ID NO: 579751 - RNA, 22 nt, Human
aaaugacagaguaagcuguuua

SEQ ID NO: 579752 - RNA, 22 nt, Human
ugccaucucuuccucgugcugc

SEQ ID NO: 579753 - RNA, 22 nt, Human
ggccucagggucacucuguaga

SEQ ID NO: 579754 - RNA, 22 nt, Human
uucagcacuuuguuuugcucau

SEQ ID NO: 579755 - RNA, 22 nt, Human
cucagaaaggugccauuuaugu

SEQ ID NO: 579756 - RNA, 22 nt, Human
cuccccagcucgcgggugacgg

SEQ ID NO: 579757 - RNA, 22 nt, Human
guuaagccugaaucacauuaau

SEQ ID NO: 579758 - RNA, 18 nt, Human
agguggccugggagcuuu

SEQ ID NO: 579759 - RNA, 22 nt, Human
uccaaaaaacguuugaauaguu

SEQ ID NO: 579760 - RNA, 22 nt, Human
cuggugcaggaaggagcuggca

SEQ ID NO: 579761 - RNA, 20 nt, Human
cuaagagguccuuccacauc

SEQ ID NO: 579762 - RNA, 22 nt, Human
acaauagucaaugcacgucauu

SEQ ID NO: 579763 - RNA, 22 nt, Human
auuccucauuauuuacugagga

SEQ ID NO: 579764 - RNA, 22 nt, Human
cagucuccugggggcuguuguu

SEQ ID NO: 579765 - RNA, 22 nt, Human
gcaggugggggagaaguuguga

SEQ ID NO: 579766 - RNA, 22 nt, Human
auauuucuggggguguguuucu

SEQ ID NO: 579767 - RNA, 22 nt, Human
acuguacuuuucuuggcuagau

SEQ ID NO: 579768 - RNA, 22 nt, Human
ggguugggacugucaucuggag

SEQ ID NO: 579769 - RNA, 22 nt, Human
agcugcaggagucgccuaggau

SEQ ID NO: 579770 - RNA, 22 nt, Human
cugaaaggagagcugcaaggau

SEQ ID NO: 579771 - RNA, 22 nt, Human
agauggaaaauauagacagaga

SEQ ID NO: 579772 - RNA, 22 nt, Human
cagggccaguucucgcagcagu

SEQ ID NO: 579773 - RNA, 22 nt, Human
aggugccagcucucaggcagga

SEQ ID NO: 579774 - RNA, 22 nt, Human
uuuuuaaccuaccuuaagagca

SEQ ID NO: 579775 - RNA, 22 nt, Human
cugggcucagcccaugcugucc

SEQ ID NO: 579776 - RNA, 22 nt, Human
ccaguguggccaggugcuggua

SEQ ID NO: 579777 - RNA, 22 nt, Human
uauguucucugcucuaggaugu

SEQ ID NO: 579778 - RNA, 22 nt, Human
uuaaagcugagcccucagaagc

SEQ ID NO: 579779 - RNA, 22 nt, Human
cuuauugugauaccaugcagua

SEQ ID NO: 579780 - RNA, 22 nt, Human
uagcagggucucaggagucagg

SEQ ID NO: 579781 - RNA, 22 nt, Human
aaggcugacucaacagggggcc

SEQ ID NO: 579782 - RNA, 22 nt, Human
ucagaacaugaagguuaauuug

SEQ ID NO: 579783 - RNA, 22 nt, Human
uggcuucccauagcuugcuagu

SEQ ID NO: 579784 - RNA, 22 nt, Human
agcagcagaucaaacaggcuug

SEQ ID NO: 579785 - RNA, 23 nt, Human
ggagccagccuguggggagcggg

SEQ ID NO: 579786 - RNA, 17 nt, Human
uccaggcagcaacugag

SEQ ID NO: 579787 - RNA, 22 nt, Human
cugggacagcugagacaggaga

SEQ ID NO: 579788 - RNA, 22 nt, Human
uuuaagagcuaguaugucauuu

SEQ ID NO: 579789 - RNA, 22 nt, Human
cuugccucccucagcucacagc

SEQ ID NO: 579790 - RNA, 22 nt, Human
uccaugccaggcagucgaugca

SEQ ID NO: 579791 - RNA, 22 nt, Human
uguggcuguguccaccugcugc

SEQ ID NO: 579792 - RNA, 22 nt, Human
uggccuggcugcccugucugga

SEQ ID NO: 579793 - RNA, 19 nt, Human
uggcagggagugauauuag

SEQ ID NO: 579794 - RNA, 22 nt, Human
uaugcauauagaugcacacaca

SEQ ID NO: 579795 - RNA, 22 nt, Human
aaacugggauucuucacaaggu

SEQ ID NO: 579796 - RNA, 22 nt, Human
gucuuuggagaggugccauuuc

SEQ ID NO: 579797 - RNA, 22 nt, Human
guuuauuggguauuguggagcc

SEQ ID NO: 579798 - RNA, 22 nt, Human
auggaagacagauaaggcagaa

SEQ ID NO: 579799 - RNA, 20 nt, Human
cuccugguccaggagccuga

SEQ ID NO: 579800 - RNA, 22 nt, Human
aguacuuuacuucuuacaguuu

SEQ ID NO: 579801 - RNA, 22 nt, Human
ugugccuuaugaauucuuucug

SEQ ID NO: 579802 - RNA, 22 nt, Human
cagugcagcugccccgcuggua

SEQ ID NO: 579803 - RNA, 22 nt, Human
ucccagcccagauuugugugac

SEQ ID NO: 579804 - RNA, 22 nt, Human
guggaacagccugugcaaaccu

SEQ ID NO: 579805 - RNA, 23 nt, Human
cucugcaggagagugggcagggc

SEQ ID NO: 579806 - RNA, 22 nt, Human
guuaaauucgaugauggauaaa

SEQ ID NO: 579807 - RNA, 22 nt, Human
aguauacugaaaguaaauauga

SEQ ID NO: 579808 - RNA, 22 nt, Human
gcugaaugaauguauuuuaaaa

SEQ ID NO: 579809 - RNA, 22 nt, Human
uugaagcagagaaauacuugaa

SEQ ID NO: 579810 - RNA, 22 nt, Human
ucacauuuuaucugagauugac

SEQ ID NO: 579811 - RNA, 19 nt, Human
ucugccucuggucaggcuc

SEQ ID NO: 579812 - RNA, 22 nt, Human
ucuugagguuauuaagcuguua

SEQ ID NO: 579813 - RNA, 22 nt, Human
ucuccagggcagagaauagcaa

SEQ ID NO: 579814 - RNA, 22 nt, Human
cucaguuuccucaacugcaaaa

SEQ ID NO: 579815 - RNA, 22 nt, Human
uuuauaaccaaguucugcuugu

SEQ ID NO: 579816 - RNA, 17 nt, Human
gagugcugguggagcuc

SEQ ID NO: 579817 - RNA, 22 nt, Human
gggagacuagugcuauguuuuc

SEQ ID NO: 579818 - RNA, 22 nt, Human
cuacaaagcucuucuacaggca

SEQ ID NO: 579819 - RNA, 22 nt, Human
gugggggcaggcagugcuagga

SEQ ID NO: 579820 - RNA, 22 nt, Human
ugugcacaggaagcuauucucu

SEQ ID NO: 579821 - RNA, 22 nt, Human
aaacaaacaauuaguugugugg

SEQ ID NO: 579822 - RNA, 22 nt, Human
cagagagagucugucccugaag

SEQ ID NO: 579823 - RNA, 22 nt, Human
agugcccuggcccagcuggacc

SEQ ID NO: 579824 - RNA, 23 nt, Human
ugagcccaggaggucaaggcugc

SEQ ID NO: 579825 - RNA, 18 nt, Human
agcugguggggagacagc

SEQ ID NO: 579826 - RNA, 22 nt, Human
gucccagggagguucagggcuu

SEQ ID NO: 579827 - RNA, 22 nt, Human
uuccucagcuggccugauuggg

SEQ ID NO: 579828 - RNA, 22 nt, Human
aggaggcucucagguccucccc

SEQ ID NO: 579829 - RNA, 22 nt, Human
cagggcugagaauuuagagaca

SEQ ID NO: 579830 - RNA, 22 nt, Human
aguguuuggggugauuguaacc

SEQ ID NO: 579831 - RNA, 22 nt, Human
uggggacugacagccaggccuc

SEQ ID NO: 579832 - RNA, 22 nt, Human
gagcccaggcagagguugcagu

SEQ ID NO: 579833 - RNA, 17 nt, Human
gcuuccucaugcaguuc

SEQ ID NO: 579834 - RNA, 22 nt, Human
auucauaucauagaguuauuga

SEQ ID NO: 579835 - RNA, 22 nt, Human
uguauauacauacacacaugaa

SEQ ID NO: 579836 - RNA, 22 nt, Human
ucagcugcucaaauuuauguca

SEQ ID NO: 579837 - RNA, 20 nt, Human
ccuuucuggagugcuguuca

SEQ ID NO: 579838 - RNA, 22 nt, Human
agagaaaguaaagauucuaccu

SEQ ID NO: 579839 - RNA, 22 nt, Human
guggcagcagguacucacgcac

SEQ ID NO: 579840 - RNA, 22 nt, Human
agggcugaguggugcagucaaa

SEQ ID NO: 579841 - RNA, 22 nt, Human
uaggcugggcauucuggccagg

SEQ ID NO: 579842 - RNA, 23 nt, Human
ugagaucgcccagcugguaggca

SEQ ID NO: 579843 - RNA, 22 nt, Human
uccacagaauguaagauccaca

SEQ ID NO: 579844 - RNA, 22 nt, Human
caccgcggagugauggagaaac

SEQ ID NO: 579845 - RNA, 22 nt, Human
ggugggcaggucacucugccuc

SEQ ID NO: 579846 - RNA, 22 nt, Human
cacaauaaauguuugcugauga

SEQ ID NO: 579847 - RNA, 22 nt, Human
ucuaagaaaucagaugaugagg

SEQ ID NO: 579848 - RNA, 22 nt, Human
caguguacuuggaauguaacag

SEQ ID NO: 579849 - RNA, 22 nt, Human
uccuaguucucugccagucgcu

SEQ ID NO: 579850 - RNA, 22 nt, Human
augaaacaaaccucuauggagu

SEQ ID NO: 579851 - RNA, 22 nt, Human
acuucuuuucaaaucaugcaaa

SEQ ID NO: 579852 - RNA, 22 nt, Human
guaugucaaaaucugcaugaua

SEQ ID NO: 579853 - RNA, 22 nt, Human
gugagcuguuggaguggcagag

SEQ ID NO: 579854 - RNA, 22 nt, Human
auuccacagcucagccucucuu

SEQ ID NO: 579855 - RNA, 22 nt, Human
acuguggcgucaggaagaaauu

SEQ ID NO: 579856 - RNA, 22 nt, Human
uggugcagaugcaggucacugg

SEQ ID NO: 579857 - RNA, 22 nt, Human
aacaguuuauguaaauguccag

SEQ ID NO: 579858 - RNA, 22 nt, Human
uggaggcauugugacugcugaa

SEQ ID NO: 579859 - RNA, 22 nt, Human
agaaaguuugagaacuguagau

SEQ ID NO: 579860 - RNA, 22 nt, Human
ucuggaguugaaguucuucccc

SEQ ID NO: 579861 - RNA, 20 nt, Human
cuguuaaaagguaugaauuc

SEQ ID NO: 579862 - RNA, 22 nt, Human
uucuaugauucauuuagaaguu

SEQ ID NO: 579863 - RNA, 22 nt, Human
gguuugcacgauauuuccaugg

SEQ ID NO: 579864 - RNA, 22 nt, Human
ggggcacuuccaggcugaggcu

SEQ ID NO: 579865 - RNA, 22 nt, Human
ucaugaacuuccuagccagacu

SEQ ID NO: 579866 - RNA, 22 nt, Human
acggguggcugaggaggccucu

SEQ ID NO: 579867 - RNA, 22 nt, Human
ucugugaacaucacauugacag

SEQ ID NO: 579868 - RNA, 22 nt, Human
gagcccugugaggaaagagggu

SEQ ID NO: 579869 - RNA, 22 nt, Human
augcugaaugaaagaaauuagu

SEQ ID NO: 579870 - RNA, 22 nt, Human
ucuuucuucagcccuguaagau

SEQ ID NO: 579871 - RNA, 19 nt, Human
gagaaagcaggcacagcac

SEQ ID NO: 579872 - RNA, 22 nt, Human
aggacaguggcaaggcaggaca

SEQ ID NO: 579873 - RNA, 21 nt, Human
accaucuuccaugcauuauau

SEQ ID NO: 579874 - RNA, 22 nt, Human
uguuuauucauggcuaaugaaa

SEQ ID NO: 579875 - RNA, 22 nt, Human
ccagcugcccaagaggcauccu

SEQ ID NO: 579876 - RNA, 22 nt, Human
uuuaauagggcccaaugagacu

SEQ ID NO: 579877 - RNA, 22 nt, Human
ggcagcacgacaggaguggaag

SEQ ID NO: 579878 - RNA, 22 nt, Human
uuaagagauuuaggaacauuau

SEQ ID NO: 579879 - RNA, 22 nt, Human
aggaagcccuugucauuucugu

SEQ ID NO: 579880 - RNA, 22 nt, Human
uagaggcuccuguguguagguu

SEQ ID NO: 579881 - RNA, 22 nt, Human
uugaaauacugcauuguucagu

SEQ ID NO: 579882 - RNA, 22 nt, Human
auuuugugaacccucaagcaau

SEQ ID NO: 579883 - RNA, 22 nt, Human
uucuacauuuaaaaggaaaauc

SEQ ID NO: 579884 - RNA, 20 nt, Human
cuagaagcagaauugcugau

SEQ ID NO: 579885 - RNA, 22 nt, Human
auacaugauacuuaguacguag

SEQ ID NO: 579886 - RNA, 22 nt, Human
accagagcagacuacuggaggu

SEQ ID NO: 579887 - RNA, 22 nt, Human
agagcugcaccuaugcagaccu

SEQ ID NO: 579888 - RNA, 22 nt, Human
ggcucuguaaagugacaccugc

SEQ ID NO: 579889 - RNA, 22 nt, Human
gggagggaaggaccuuaugaau

SEQ ID NO: 579890 - RNA, 22 nt, Human
agugcucucuccccagugcuac

SEQ ID NO: 579891 - RNA, 22 nt, Human
gguggcaggcccugagcauccc

SEQ ID NO: 579892 - RNA, 22 nt, Human
gcuggcuuccuucugcagcuag

SEQ ID NO: 579893 - RNA, 22 nt, Human
gcugccucccccauggcuggaa

SEQ ID NO: 579894 - RNA, 22 nt, Human
gugugcgccgacacagccaggu

SEQ ID NO: 579895 - RNA, 22 nt, Human
accagagcucuucagcacagga

SEQ ID NO: 579896 - RNA, 22 nt, Human
agggagaacaguugcagcagac

SEQ ID NO: 579897 - RNA, 22 nt, Human
cuaagaggaaguacucuguuau

SEQ ID NO: 579898 - RNA, 22 nt, Human
agagccuggucugagauaggac

SEQ ID NO: 579899 - RNA, 22 nt, Human
cugugcauugucuugucuguag

SEQ ID NO: 579900 - RNA, 22 nt, Human
ucccaggguuacagccagggca

SEQ ID NO: 579901 - RNA, 22 nt, Human
acacagcuuucagucauuaucu

SEQ ID NO: 579902 - RNA, 22 nt, Human
uggguagaguggagggauaaga

SEQ ID NO: 579903 - RNA, 22 nt, Human
gcccuccaccagagcccuucuc

SEQ ID NO: 579904 - RNA, 22 nt, Human
gugcaggauuuauagcccagcu

SEQ ID NO: 579905 - RNA, 22 nt, Human
aaauauuauugcuuaaggggag

SEQ ID NO: 579906 - RNA, 22 nt, Human
ugggcagggagcuggaaccaca

SEQ ID NO: 579907 - RNA, 22 nt, Human
acauacaugggauuaaaaaauu

SEQ ID NO: 579908 - RNA, 22 nt, Human
gagauucuguagucaggcaucu

SEQ ID NO: 579909 - RNA, 22 nt, Human
agaaacauauucagugaguaau

SEQ ID NO: 579910 - RNA, 22 nt, Human
agaaucuuucugaaugacugug

SEQ ID NO: 579911 - RNA, 22 nt, Human
ugcuuucucucuaccccacuuu

SEQ ID NO: 579912 - RNA, 22 nt, Human
uggagcagaggaagaaggcuuu

SEQ ID NO: 579913 - RNA, 22 nt, Human
cuuuucucugcgggucuuucau

SEQ ID NO: 579914 - RNA, 22 nt, Human
uccucaggcugccuggaagacu

SEQ ID NO: 579915 - RNA, 22 nt, Human
uuaugcuuuuagaauuuagcau

SEQ ID NO: 579916 - RNA, 22 nt, Human
agucaccuugaaaugucuugaa

SEQ ID NO: 579917 - RNA, 22 nt, Human
aggcucugugacaaucaagcug

SEQ ID NO: 579918 - RNA, 22 nt, Human
uauguucauagaaaucaugacc

SEQ ID NO: 579919 - RNA, 22 nt, Human
ccagcuggagcucgcagauagg

SEQ ID NO: 579920 - RNA, 22 nt, Human
ggcugcugaguuggccaggaga

SEQ ID NO: 579921 - RNA, 22 nt, Human
uuauuuacaacucuucucuucc

SEQ ID NO: 579922 - RNA, 22 nt, Human
caggcaacguccuuagagaugc

SEQ ID NO: 579923 - RNA, 22 nt, Human
aaacaacaugguggguguguag

SEQ ID NO: 579924 - RNA, 22 nt, Human
ggguaauuggggccuugcagug

SEQ ID NO: 579925 - RNA, 22 nt, Human
cugcaguucucaauuucuauug

SEQ ID NO: 579926 - RNA, 22 nt, Human
auuugccuuucgaaucaacagg

SEQ ID NO: 579927 - RNA, 22 nt, Human
ucugccugcggcugcagguggc

SEQ ID NO: 579928 - RNA, 22 nt, Human
auaaccuaggaggguagaggua

SEQ ID NO: 579929 - RNA, 22 nt, Human
gaggcugcccaacuggagugga

SEQ ID NO: 579930 - RNA, 22 nt, Human
ccaaaccauccaucuccaggcu

SEQ ID NO: 579931 - RNA, 22 nt, Human
ggcuaggcgggcacauggugga

SEQ ID NO: 579932 - RNA, 22 nt, Human
cugggcacaggggagcagaguc

SEQ ID NO: 579933 - RNA, 22 nt, Human
cccuuggaggaagcucuaggcu

SEQ ID NO: 579934 - RNA, 22 nt, Human
aaugggauaggucuucaggaau

SEQ ID NO: 579935 - RNA, 22 nt, Human
ucugggggaggaggcauggccc

SEQ ID NO: 579936 - RNA, 22 nt, Human
ccuggaggcucugggagggcag

SEQ ID NO: 579937 - RNA, 22 nt, Human
caugggcucuucuggacugcac

SEQ ID NO: 579938 - RNA, 22 nt, Human
agccagagaguguuggagaugu

SEQ ID NO: 579939 - RNA, 18 nt, Human
ggcuccaggaccuaccca

SEQ ID NO: 579940 - RNA, 22 nt, Human
acaggagccaaacacaugccag

SEQ ID NO: 579941 - RNA, 22 nt, Human
uauuucucucacgguugccugg

SEQ ID NO: 579942 - RNA, 22 nt, Human
uagacaguuaaacuacuggugg

SEQ ID NO: 579943 - RNA, 22 nt, Human
gcugcccagcaggccccagggg

SEQ ID NO: 579944 - RNA, 22 nt, Human
ggacaggaugcugaagaugaag

SEQ ID NO: 579945 - RNA, 22 nt, Human
ccucugugccucguguccucug

SEQ ID NO: 579946 - RNA, 22 nt, Human
gcuggccagggcugcucgcgga

SEQ ID NO: 579947 - RNA, 22 nt, Human
ucuacaggguaaggggcuugcc

SEQ ID NO: 579948 - RNA, 22 nt, Human
ggagacuuggcuuggaugcuuc

SEQ ID NO: 579949 - RNA, 22 nt, Human
uuucaugaggggcaaaaucuca

SEQ ID NO: 579950 - RNA, 22 nt, Human
agcuccuggcaaggucauggug

SEQ ID NO: 579951 - RNA, 22 nt, Human
ucauacaucuuguauaucuauc

SEQ ID NO: 579952 - RNA, 22 nt, Human
cugcagcuaaggaaugugguug

SEQ ID NO: 579953 - RNA, 22 nt, Human
gaggaaggcuaaggggcuuaga

SEQ ID NO: 579954 - RNA, 22 nt, Human
acacugaauguuuaagaacuug

SEQ ID NO: 579955 - RNA, 22 nt, Human
aagaggagaaaggcuggcuuug

SEQ ID NO: 579956 - RNA, 22 nt, Human
gauauuuuuaguauuucugccu

SEQ ID NO: 579957 - RNA, 22 nt, Human
ugcagccuugccuccucccagc

SEQ ID NO: 579958 - RNA, 22 nt, Human
auuuauugagacuuaacaaccc

SEQ ID NO: 579959 - RNA, 22 nt, Human
ccaaggcugucauucaguagcu

SEQ ID NO: 579960 - RNA, 22 nt, Human
uuucauugagaauauaagauuu

SEQ ID NO: 579961 - RNA, 22 nt, Human
ucuuggaacuuauuauuguaga

SEQ ID NO: 579962 - RNA, 22 nt, Human
agggaagaggaccagagucucu

SEQ ID NO: 579963 - RNA, 22 nt, Human
cuccuggugacucccagauaaa

SEQ ID NO: 579964 - RNA, 22 nt, Human
augacacauuugugcuguugaa

SEQ ID NO: 579965 - RNA, 22 nt, Human
uggagcuggcuuguggaaguug

SEQ ID NO: 579966 - RNA, 22 nt, Human
auuuuuuauauaccaagguggg

SEQ ID NO: 579967 - RNA, 22 nt, Human
agagcugcucagaugucacugc

SEQ ID NO: 579968 - RNA, 22 nt, Human
agggcuggcuaggugcguuccc

SEQ ID NO: 579969 - RNA, 22 nt, Human
caggaaauaggcguuuguccuc

SEQ ID NO: 579970 - RNA, 22 nt, Human
gggagcugaccugcagguuccc

SEQ ID NO: 579971 - RNA, 22 nt, Human
uguuuugcuucucuguuuccca

SEQ ID NO: 579972 - RNA, 22 nt, Human
ugggucagauugagccccuggu

SEQ ID NO: 579973 - RNA, 22 nt, Human
cugaauggaaucaucccugcuu

SEQ ID NO: 579974 - RNA, 22 nt, Human
caucuuucuuagaacuuucagu

SEQ ID NO: 579975 - RNA, 22 nt, Human
agcacaugcacagugcuacacu

SEQ ID NO: 579976 - RNA, 22 nt, Human
caguccugagccaaucaugaug

SEQ ID NO: 579977 - RNA, 22 nt, Human
aaacacuugcaaaaugguuccu

SEQ ID NO: 579978 - RNA, 22 nt, Human
acagcuggccgaggcucaggga

SEQ ID NO: 579979 - RNA, 22 nt, Human
gccuggugcuaugagggccagc

SEQ ID NO: 579980 - RNA, 22 nt, Human
ccugaagauccauuauagacac

SEQ ID NO: 579981 - RNA, 22 nt, Human
ugcagaagugagucaugaggaa

SEQ ID NO: 579982 - RNA, 22 nt, Human
guccugcacauggagggcaaug

SEQ ID NO: 579983 - RNA, 22 nt, Human
aaauucuaugucaauguuuauu

SEQ ID NO: 579984 - RNA, 22 nt, Human
agugagcauucguuuggaaccc

SEQ ID NO: 579985 - RNA, 22 nt, Human
aggccagugcagcuggaacaga

SEQ ID NO: 579986 - RNA, 22 nt, Human
cagaugcuuuugauucuggggu

SEQ ID NO: 579987 - RNA, 22 nt, Human
uacagcuggacugguagcugug

SEQ ID NO: 579988 - RNA, 22 nt, Human
ucagccagggcucuggccucag

SEQ ID NO: 579989 - RNA, 22 nt, Human
guccugggccugcugaggcuga

SEQ ID NO: 579990 - RNA, 22 nt, Human
uagauaaauuagaaaguuuacu

SEQ ID NO: 579991 - RNA, 22 nt, Human
uuuuaaaucuccaguugacccc

SEQ ID NO: 579992 - RNA, 22 nt, Human
augaauugaggaaaacagucgu

SEQ ID NO: 579993 - RNA, 22 nt, Human
acauuucagcgugcaugacaug

SEQ ID NO: 579994 - RNA, 22 nt, Human
cccaggagacagaaacagaggu

SEQ ID NO: 579995 - RNA, 22 nt, Human
cacacagcuagugacaggagaa

SEQ ID NO: 579996 - RNA, 22 nt, Human
agugaugccacacaaugcuuug

SEQ ID NO: 579997 - RNA, 22 nt, Human
aauaagauccugaagauauguu

SEQ ID NO: 579998 - RNA, 18 nt, Human
gcacuucacagggauagu

SEQ ID NO: 579999 - RNA, 22 nt, Human
gaagcaguauccugacagcacc

SEQ ID NO: 580000 - RNA, 22 nt, Human
auauagugagagauuacagaag

SEQ ID NO: 580001 - RNA, 22 nt, Human
cacauucacauuuuucccucua

SEQ ID NO: 580002 - RNA, 19 nt, Human
ggcuucagggaguuagcau

SEQ ID NO: 580003 - RNA, 22 nt, Human
ucucacugggucacagcagagg

SEQ ID NO: 580004 - RNA, 22 nt, Human
uuggccagugaaccaggccugg

SEQ ID NO: 580005 - RNA, 22 nt, Human
cuggcucacaggugagaugcau

SEQ ID NO: 580006 - RNA, 22 nt, Human
gcucccagacugaccagaggug

SEQ ID NO: 580007 - RNA, 22 nt, Human
uccugccucuugccuucuucac

SEQ ID NO: 580008 - RNA, 21 nt, Human
auuuucauuaauucagugugg

SEQ ID NO: 580009 - RNA, 22 nt, Human
ggugcagcaguuuguucagcuu

SEQ ID NO: 580010 - RNA, 20 nt, Human
cugccuggaggccucuaccu

SEQ ID NO: 580011 - RNA, 22 nt, Human
ucugguaaccuuuaucccuccu

SEQ ID NO: 580012 - RNA, 22 nt, Human
cugggacagagcagcagugggg

SEQ ID NO: 580013 - RNA, 22 nt, Human
ugggacagggaaucugaucccc

SEQ ID NO: 580014 - RNA, 22 nt, Human
gaagauuaaugagaaaccugcu

SEQ ID NO: 580015 - RNA, 22 nt, Human
gaagcaucagcaauggcuggaa

SEQ ID NO: 580016 - RNA, 22 nt, Human
uuuaaaauuuagaccucuccac

SEQ ID NO: 580017 - RNA, 22 nt, Human
guggccugccagcagauggcgc

SEQ ID NO: 580018 - RNA, 17 nt, Human
gggcuggauggccaugg

SEQ ID NO: 580019 - RNA, 22 nt, Human
cugggcuccuaaccauccaggu

SEQ ID NO: 580020 - RNA, 22 nt, Human
uacacauacauugcuuacaagg

SEQ ID NO: 580021 - RNA, 22 nt, Human
ggaaugggagcuauuaguggaa

SEQ ID NO: 580022 - RNA, 22 nt, Human
acuggaguagaucugacugagu

SEQ ID NO: 580023 - RNA, 22 nt, Human
gugcaaauuccacuggaaagcu

SEQ ID NO: 580024 - RNA, 22 nt, Human
gccccagcccuguggaccaugg

SEQ ID NO: 580025 - RNA, 23 nt, Human
aggcugagcucucccagcuucag

SEQ ID NO: 580026 - RNA, 22 nt, Human
aggugaguccugggcacaggua

SEQ ID NO: 580027 - RNA, 22 nt, Human
gcccuccuuugcuucuccuagu

SEQ ID NO: 580028 - RNA, 22 nt, Human
uuucuccaauguaucagcacac

SEQ ID NO: 580029 - RNA, 22 nt, Human
cugugaggccuuuggccagaua

SEQ ID NO: 580030 - RNA, 22 nt, Human
cugcucugcagcuuggacuccc

SEQ ID NO: 580031 - RNA, 22 nt, Human
ugcuugggcggccagcauggcg

SEQ ID NO: 580032 - RNA, 22 nt, Human
ccugccuauguaagugguuucu

SEQ ID NO: 580033 - RNA, 22 nt, Human
cagggcuucgugucucagugcu

SEQ ID NO: 580034 - RNA, 22 nt, Human
cagggacagccuugggguggcg

SEQ ID NO: 580035 - RNA, 22 nt, Human
acuguaauuggauugucugacu

SEQ ID NO: 580036 - RNA, 22 nt, Human
uuucuaaaauagauuuuauggu

SEQ ID NO: 580037 - RNA, 22 nt, Human
caaagaauagcauggcauuugu

SEQ ID NO: 580038 - RNA, 22 nt, Human
ggaggugaggccguagggugug

SEQ ID NO: 580039 - RNA, 22 nt, Human
ucaaauaggcuuguagugacug

SEQ ID NO: 580040 - RNA, 22 nt, Human
ggguggagguggguuuugagau

SEQ ID NO: 580041 - RNA, 22 nt, Human
gacacuggcuugucccgccauc

SEQ ID NO: 580042 - RNA, 22 nt, Human
uugccugcuacggucuucacug

SEQ ID NO: 580043 - RNA, 22 nt, Human
ucuguauauauuaaugaaauuc

SEQ ID NO: 580044 - RNA, 22 nt, Human
agcagcuuacauguggccuauc

SEQ ID NO: 580045 - RNA, 19 nt, Human
cuucuucuuggcagccaag

SEQ ID NO: 580046 - RNA, 22 nt, Human
ugauaaauccauguaaauggua

SEQ ID NO: 580047 - RNA, 22 nt, Human
gccaucuugagccaggaaguga

SEQ ID NO: 580048 - RNA, 22 nt, Human
ggaaaggagaugaauaggauua

SEQ ID NO: 580049 - RNA, 22 nt, Human
ugaaauuagugaaguuacaguu

SEQ ID NO: 580050 - RNA, 22 nt, Human
aauagauucaugguuaagagca

SEQ ID NO: 580051 - RNA, 22 nt, Human
acccaggagagagcuauaaaau

SEQ ID NO: 580052 - RNA, 22 nt, Human
cuuuaauucagauuugaaggga

SEQ ID NO: 580053 - RNA, 22 nt, Human
caccucaggcagcaaagucuca

SEQ ID NO: 580054 - RNA, 22 nt, Human
uuuauucacuggggucugcccg

SEQ ID NO: 580055 - RNA, 22 nt, Human
uuauacuaaaacgcauugaauu

SEQ ID NO: 580056 - RNA, 22 nt, Human
agcuguggcagcacuuuggagu

SEQ ID NO: 580057 - RNA, 22 nt, Human
cagcugaacauguagagcaucu

SEQ ID NO: 580058 - RNA, 20 nt, Human
ugggucugcuuggcuucagu

SEQ ID NO: 580059 - RNA, 22 nt, Human
aaacaguccucuuuauuuaguc

SEQ ID NO: 580060 - RNA, 22 nt, Human
ucaguucuuauuuucaugaaua

SEQ ID NO: 580061 - RNA, 22 nt, Human
aaugaacuucagugauuucugg

SEQ ID NO: 580062 - RNA, 22 nt, Human
guggcaacaaaagagccuagug

SEQ ID NO: 580063 - RNA, 22 nt, Human
ucccugaguguauguggugaac

SEQ ID NO: 580064 - RNA, 22 nt, Human
acacagcaacuugcaguaugga

SEQ ID NO: 580065 - RNA, 22 nt, Human
auuuucuguaacuauuucuaua

SEQ ID NO: 580066 - RNA, 22 nt, Human
ucuguuucuucuucuguuauau

SEQ ID NO: 580067 - RNA, 19 nt, Human
cccaacuugacuauuuucu

SEQ ID NO: 580068 - RNA, 22 nt, Human
uuuuauuaguggcuagaugggg

SEQ ID NO: 580069 - RNA, 22 nt, Human
ugacauaaugcuuugaaguugc

SEQ ID NO: 580070 - RNA, 21 nt, Human
agcagcuuugguugaagcaga

SEQ ID NO: 580071 - RNA, 22 nt, Human
uaaugaacaucuuaaucugaaa

SEQ ID NO: 580072 - RNA, 20 nt, Human
ucagagaaggagcuuuccug

SEQ ID NO: 580073 - RNA, 22 nt, Human
ccagaaaagcaucugguucuuu

SEQ ID NO: 580074 - RNA, 22 nt, Human
gugcaggagcuucuggccugac

SEQ ID NO: 580075 - RNA, 22 nt, Human
uuuauccauaucauuaaaaucu

SEQ ID NO: 580076 - RNA, 22 nt, Human
auaaaaugucuccacugggcuc

SEQ ID NO: 580077 - RNA, 22 nt, Human
ggggcggggcucugagaagcau

SEQ ID NO: 580078 - RNA, 19 nt, Human
ucuugcagccccagcaggc

SEQ ID NO: 580079 - RNA, 23 nt, Human
uuuauauuccuaaugucuugagc

SEQ ID NO: 580080 - RNA, 22 nt, Human
aacaugauuucaugcauuuaga

SEQ ID NO: 580081 - RNA, 22 nt, Human
uaugcacaguuacaagaauauc

SEQ ID NO: 580082 - RNA, 22 nt, Human
uaaguccaguguucucucugug

SEQ ID NO: 580083 - RNA, 22 nt, Human
cuugucugauaauggggccaac

SEQ ID NO: 580084 - RNA, 22 nt, Human
uucuaaauggggauccuuucug

SEQ ID NO: 580085 - RNA, 22 nt, Human
ggcagauggaagaggcuggguc

SEQ ID NO: 580086 - RNA, 22 nt, Human
uuuuaccacugggugacaugga

SEQ ID NO: 580087 - RNA, 22 nt, Human
gagaggagaagccugcgcuuca

SEQ ID NO: 580088 - RNA, 22 nt, Human
ucacacagugguaaaacccuga

SEQ ID NO: 580089 - RNA, 19 nt, Human
cuuuucaucaacagccaau

SEQ ID NO: 580090 - RNA, 22 nt, Human
ugaggucauggcugauauuucc

SEQ ID NO: 580091 - RNA, 22 nt, Human
agaggcagccguauuucaaagg

SEQ ID NO: 580092 - RNA, 22 nt, Human
agcuuccucaccucagaggucu

SEQ ID NO: 580093 - RNA, 22 nt, Human
cagcacuaugacauuuaauucu

SEQ ID NO: 580094 - RNA, 22 nt, Human
aaccaacaggaguggggauugg

SEQ ID NO: 580095 - RNA, 22 nt, Human
ugccacugggcaugcagauguc

SEQ ID NO: 580096 - RNA, 22 nt, Human
ucuauucauucaauuuagcucu

SEQ ID NO: 580097 - RNA, 23 nt, Human
agguacauauacuuggaggucag

SEQ ID NO: 580098 - RNA, 22 nt, Human
gacccuggugggcacuggcacc

SEQ ID NO: 580099 - RNA, 22 nt, Human
ccugcucuagacucugggaagg

SEQ ID NO: 580100 - RNA, 22 nt, Human
caggacugauguuccuccagcc

SEQ ID NO: 580101 - RNA, 22 nt, Human
augggcucuaugucuaggagau

SEQ ID NO: 580102 - RNA, 22 nt, Human
cagggugguaccagcaucuagu

SEQ ID NO: 580103 - RNA, 22 nt, Human
uucuuacaucuauaaaguuggg

SEQ ID NO: 580104 - RNA, 22 nt, Human
uggaaacuaagacuagagagac

SEQ ID NO: 580105 - RNA, 21 nt, Human
agagaagaggacuuucucaca

SEQ ID NO: 580106 - RNA, 22 nt, Human
ucauuucuguugugcaucacug

SEQ ID NO: 580107 - RNA, 22 nt, Human
cagguacacucccuugugcuga

SEQ ID NO: 580108 - RNA, 22 nt, Human
gcugcuccaguguucugucuag

SEQ ID NO: 580109 - RNA, 22 nt, Human
ggucccaguugcccaggucagg

SEQ ID NO: 580110 - RNA, 20 nt, Human
cuggggagcugcucccacga

SEQ ID NO: 580111 - RNA, 22 nt, Human
augaucagggcagaagcagaag

SEQ ID NO: 580112 - RNA, 22 nt, Human
cugcccuguggcucugagucau

SEQ ID NO: 580113 - RNA, 19 nt, Human
cacuaagaugagauauagc

SEQ ID NO: 580114 - RNA, 22 nt, Human
gacaggcuuagggagggugcuc

SEQ ID NO: 580115 - RNA, 22 nt, Human
ucucucugccaacucacagcca

SEQ ID NO: 580116 - RNA, 22 nt, Human
agaagaaacugucggggauauu

SEQ ID NO: 580117 - RNA, 22 nt, Human
ucaguguuuauucaauguuauu

SEQ ID NO: 580118 - RNA, 22 nt, Human
cacucccucuaguugcauucug

SEQ ID NO: 580119 - RNA, 21 nt, Human
gaggcccaugggacaggggcu

SEQ ID NO: 580120 - RNA, 22 nt, Human
cacauggcagaaucaugcaucu

SEQ ID NO: 580121 - RNA, 22 nt, Human
cuguaugauuccauuucuauaa

SEQ ID NO: 580122 - RNA, 23 nt, Human
ucagaacaaugccuuaggggcau

SEQ ID NO: 580123 - RNA, 22 nt, Human
uagaguguuuuguuaggcagca

SEQ ID NO: 580124 - RNA, 22 nt, Human
cagcaggccaugcugcuuuuca

SEQ ID NO: 580125 - RNA, 22 nt, Human
agaaucuuuccucauugcuguc

SEQ ID NO: 580126 - RNA, 22 nt, Human
gcuucucauguuuauuuuuaca

SEQ ID NO: 580127 - RNA, 22 nt, Human
uguacaaucugaugauguaugg

SEQ ID NO: 580128 - RNA, 21 nt, Human
cuggagucauuuucugaguag

SEQ ID NO: 580129 - RNA, 22 nt, Human
cuguggcaagucugccugucac

SEQ ID NO: 580130 - RNA, 22 nt, Human
agguuacagucaucucagaauc

SEQ ID NO: 580131 - RNA, 22 nt, Human
gcaugcugcagggaaugcuugu

SEQ ID NO: 580132 - RNA, 22 nt, Human
aaugauauuuauugaauagaug

SEQ ID NO: 580133 - RNA, 22 nt, Human
ccugugcuucagcuggaggagg

SEQ ID NO: 580134 - RNA, 22 nt, Human
guggcagcaaaugccuggacua

SEQ ID NO: 580135 - RNA, 22 nt, Human
ugagauaacauggaagaguagc

SEQ ID NO: 580136 - RNA, 22 nt, Human
gaugggggccagggccugcuuu

SEQ ID NO: 580137 - RNA, 22 nt, Human
aaguucaagcucugccuaaaau

SEQ ID NO: 580138 - RNA, 22 nt, Human
aaacaaagcaucuugcuaugca

SEQ ID NO: 580139 - RNA, 22 nt, Human
gggaggcuggcucuggccacag

SEQ ID NO: 580140 - RNA, 19 nt, Human
cuaaacuuaugugaccaca

SEQ ID NO: 580141 - RNA, 22 nt, Human
uuccauaaaggugauaguauac

SEQ ID NO: 580142 - RNA, 22 nt, Human
ucaguggagcuaagcaugagau

SEQ ID NO: 580143 - RNA, 22 nt, Human
agccuccuguagcccucaccca

SEQ ID NO: 580144 - RNA, 22 nt, Human
uccuggggcucuuugaugugau

SEQ ID NO: 580145 - RNA, 22 nt, Human
uggcaguccccugugccuggaa

SEQ ID NO: 580146 - RNA, 22 nt, Human
uaagaacagugucugucucaca

SEQ ID NO: 580147 - RNA, 22 nt, Human
acucugccuuucagcagaugaa

SEQ ID NO: 580148 - RNA, 18 nt, Human
gagaaaccugugaaugcu

SEQ ID NO: 580149 - RNA, 21 nt, Human
auuuccaaggguaccuaagau

SEQ ID NO: 580150 - RNA, 22 nt, Human
cuggagcuuauugggagcagaa

SEQ ID NO: 580151 - RNA, 22 nt, Human
ggaaauauuuugucuaauuugu

SEQ ID NO: 580152 - RNA, 22 nt, Human
aguuaccuuucugaaacuucgu

SEQ ID NO: 580153 - RNA, 22 nt, Human
acauauuuccaugcagcauguc

SEQ ID NO: 580154 - RNA, 22 nt, Human
agcauccaacuuugauuagaga

SEQ ID NO: 580155 - RNA, 19 nt, Human
ccaggagagcuuggagaag

SEQ ID NO: 580156 - RNA, 22 nt, Human
ucacuguuuccuguacuggaca

SEQ ID NO: 580157 - RNA, 22 nt, Human
aaggguggauuucugagcucua

SEQ ID NO: 580158 - RNA, 22 nt, Human
uuaaagcaccuccuuggaugug

SEQ ID NO: 580159 - RNA, 22 nt, Human
aggaugggccugggauaugcuu

SEQ ID NO: 580160 - RNA, 22 nt, Human
acauugaauucaaaauuacuga

SEQ ID NO: 580161 - RNA, 22 nt, Human
cucacugcaaguuccaccuacc

SEQ ID NO: 580162 - RNA, 22 nt, Human
accacaggaggauggcugcugg

SEQ ID NO: 580163 - RNA, 19 nt, Human
aaauaucagagagaugaua

SEQ ID NO: 580164 - RNA, 22 nt, Human
aagaaacugaaaguggcuucau

SEQ ID NO: 580165 - RNA, 22 nt, Human
ugagaguagagucuucaucugu

SEQ ID NO: 580166 - RNA, 22 nt, Human
caaucacaaagagacaaguguc

SEQ ID NO: 580167 - RNA, 22 nt, Human
agcagaaccacagcacuguuga

SEQ ID NO: 580168 - RNA, 22 nt, Human
cuuuccugaaaucucuucugca

SEQ ID NO: 580169 - RNA, 22 nt, Human
gagggccagccugccaagggcc

SEQ ID NO: 580170 - RNA, 22 nt, Human
gcagggcugaaggucccaggcc

SEQ ID NO: 580171 - RNA, 22 nt, Human
uccccaggggcaucucucugcu

SEQ ID NO: 580172 - RNA, 22 nt, Human
uuucauguuggauacuguuuca

SEQ ID NO: 580173 - RNA, 22 nt, Human
gcugggcuucucaaugcugccu

SEQ ID NO: 580174 - RNA, 22 nt, Human
gugauuucuaaucaucugaaug

SEQ ID NO: 580175 - RNA, 17 nt, Human
uuacauccuucugaauu

SEQ ID NO: 580176 - RNA, 21 nt, Human
ugcaggcuacuucugacucua

SEQ ID NO: 580177 - RNA, 22 nt, Human
gcccagcaggacagagugguuu

SEQ ID NO: 580178 - RNA, 22 nt, Human
uaaagcagucuguguaugugaa

SEQ ID NO: 580179 - RNA, 22 nt, Human
uuuagaauguuagcguuaaagg

SEQ ID NO: 580180 - RNA, 22 nt, Human
uuuccucuuuguaccuugacua

SEQ ID NO: 580181 - RNA, 22 nt, Human
ucuugcuaaagaccaacacauu

SEQ ID NO: 580182 - RNA, 22 nt, Human
caggcacugugcugagcucugc

SEQ ID NO: 580183 - RNA, 22 nt, Human
cugugucccaguaccuugggua

SEQ ID NO: 580184 - RNA, 22 nt, Human
agccaggcggggcagguuuccu

SEQ ID NO: 580185 - RNA, 22 nt, Human
ucuuuuaucuguuguguaacaa

SEQ ID NO: 580186 - RNA, 21 nt, Human
ggauuuuaaaaacugcaccug

SEQ ID NO: 580187 - RNA, 22 nt, Human
ggaaacuuggcauaauuuuaag

SEQ ID NO: 580188 - RNA, 22 nt, Human
caguccuucauuccuccuuuga

SEQ ID NO: 580189 - RNA, 22 nt, Human
caaaagaagcucuuggggcuag

SEQ ID NO: 580190 - RNA, 22 nt, Human
agugaaaggaaaaacugauauu

SEQ ID NO: 580191 - RNA, 22 nt, Human
cuuggucauuuggggcugcuau

SEQ ID NO: 580192 - RNA, 22 nt, Human
aucacuguggaaaacuguaugg

SEQ ID NO: 580193 - RNA, 22 nt, Human
caagauucagcccuccugaccu

SEQ ID NO: 580194 - RNA, 22 nt, Human
aaguuacaagacuaaauggaag

SEQ ID NO: 580195 - RNA, 22 nt, Human
accaggcuugaugauuugcuua

SEQ ID NO: 580196 - RNA, 22 nt, Human
cuccuccacagaguccuugcca

SEQ ID NO: 580197 - RNA, 22 nt, Human
ucucugcucaggcaccagcccu

SEQ ID NO: 580198 - RNA, 22 nt, Human
uucugaggccauuaccaauaaa

SEQ ID NO: 580199 - RNA, 22 nt, Human
cugccuguuuccucuugcuccc

SEQ ID NO: 580200 - RNA, 22 nt, Human
ccaaaggccaagcucagguaaa

SEQ ID NO: 580201 - RNA, 22 nt, Human
uaaauagaaucuaaacugcuca

SEQ ID NO: 580202 - RNA, 22 nt, Human
agcugagcugcagaugacugua

SEQ ID NO: 580203 - RNA, 22 nt, Human
gcugggcagcugaggccucuca

SEQ ID NO: 580204 - RNA, 22 nt, Human
cauugucauucuaugcuauuca

SEQ ID NO: 580205 - RNA, 22 nt, Human
ugcaggaggcuuuauucaggau

SEQ ID NO: 580206 - RNA, 22 nt, Human
acuucaugcuuuagagagauga

SEQ ID NO: 580207 - RNA, 22 nt, Human
uuuagaagacagaugcacagcc

SEQ ID NO: 580208 - RNA, 22 nt, Human
uucacaguggcccucucugagu

SEQ ID NO: 580209 - RNA, 22 nt, Human
cuuccuccgaagaaguugcugg

SEQ ID NO: 580210 - RNA, 22 nt, Human
gcauuuuugaucccacuaggau

SEQ ID NO: 580211 - RNA, 22 nt, Human
aaucuguauugcucauacuuga

SEQ ID NO: 580212 - RNA, 22 nt, Human
uagaauaugugguaggaucugg

SEQ ID NO: 580213 - RNA, 22 nt, Human
ugaaaauauaguuuuccagacu

SEQ ID NO: 580214 - RNA, 22 nt, Human
auuaaagaaacccagcauguga

SEQ ID NO: 580215 - RNA, 22 nt, Human
cauuacaaaguuauaaacaguu

SEQ ID NO: 580216 - RNA, 19 nt, Human
agacagagacugaaauaga

SEQ ID NO: 580217 - RNA, 22 nt, Human
cagagagaggggcugccuggcc

SEQ ID NO: 580218 - RNA, 22 nt, Human
uucagaaaugaauauugguauu

SEQ ID NO: 580219 - RNA, 22 nt, Human
auuucuucaggucagaaauaga

SEQ ID NO: 580220 - RNA, 22 nt, Human
ccaguguugaacaguauuugga

SEQ ID NO: 580221 - RNA, 22 nt, Human
aguuuacacuaugaaaagacua

SEQ ID NO: 580222 - RNA, 22 nt, Human
uacuuucuagcucuccccaguu

SEQ ID NO: 580223 - RNA, 22 nt, Human
gcucaggaaacagcagggcuug

SEQ ID NO: 580224 - RNA, 22 nt, Human
ugcuguguaaaaggugauugaa

SEQ ID NO: 580225 - RNA, 22 nt, Human
ccagaaagacuuuuuagguacg

SEQ ID NO: 580226 - RNA, 22 nt, Human
aauguuuucugacugcuaacuu

SEQ ID NO: 580227 - RNA, 22 nt, Human
uccaagaagcuuacaaucuaau

SEQ ID NO: 580228 - RNA, 22 nt, Human
ggaggccagccugaggcugagg

SEQ ID NO: 580229 - RNA, 22 nt, Human
cuguccucuguccucagcagga

SEQ ID NO: 580230 - RNA, 19 nt, Human
acugugcucgggaaccacu

SEQ ID NO: 580231 - RNA, 22 nt, Human
ucucaaauuuguuagauaaaau

SEQ ID NO: 580232 - RNA, 22 nt, Human
aacagcauauuucauauauuga

SEQ ID NO: 580233 - RNA, 22 nt, Human
gcugagguuuucugccugcuca

SEQ ID NO: 580234 - RNA, 22 nt, Human
uccugggcagcgggacgcucag

SEQ ID NO: 580235 - RNA, 22 nt, Human
uuuuauugguaaugauaaaagu

SEQ ID NO: 580236 - RNA, 22 nt, Human
ucuguuauacaacaaguaacag

SEQ ID NO: 580237 - RNA, 22 nt, Human
uuacuuuggauggucaagaaag

SEQ ID NO: 580238 - RNA, 22 nt, Human
ugcccagcacccagcaugaugc

SEQ ID NO: 580239 - RNA, 22 nt, Human
uggcaccugaacuuagaggugu

SEQ ID NO: 580240 - RNA, 22 nt, Human
ugcugaaugguaaagaaguaua

SEQ ID NO: 580241 - RNA, 22 nt, Human
auucaaaugucaaauccaccag

SEQ ID NO: 580242 - RNA, 22 nt, Human
acugaguguaggacuuugaguu

SEQ ID NO: 580243 - RNA, 22 nt, Human
caccuagccuucuugugccucu

SEQ ID NO: 580244 - RNA, 22 nt, Human
agacugagacuggggaaagaca

SEQ ID NO: 580245 - RNA, 22 nt, Human
aaaugcagguucuugagccaag

SEQ ID NO: 580246 - RNA, 22 nt, Human
ucuccaggagcaagucacccag

SEQ ID NO: 580247 - RNA, 22 nt, Human
uggggccaagaaggucucaugu

SEQ ID NO: 580248 - RNA, 22 nt, Human
ucauguugaauuaucguuccca

SEQ ID NO: 580249 - RNA, 22 nt, Human
ggcugggcuccgggagcaugcg

SEQ ID NO: 580250 - RNA, 22 nt, Human
uguuucuagagaaaauauuuac

SEQ ID NO: 580251 - RNA, 22 nt, Human
uccaaagggaagcgcuuucugu

SEQ ID NO: 580252 - RNA, 22 nt, Human
ucccaggguauccuguaguaaa

SEQ ID NO: 580253 - RNA, 22 nt, Human
cgcaccacugaauuccagccug

SEQ ID NO: 580254 - RNA, 22 nt, Human
ugagccagguuaagacaggagc

SEQ ID NO: 580255 - RNA, 22 nt, Human
acacuguaaauugagugcguga

SEQ ID NO: 580256 - RNA, 22 nt, Human
gaggccagcuaguccaggaagu

SEQ ID NO: 580257 - RNA, 22 nt, Human
aggaggcacucacucucagggu

SEQ ID NO: 580258 - RNA, 22 nt, Human
aacugcuuccuuggcaggcaug

SEQ ID NO: 580259 - RNA, 22 nt, Human
ugggggagauuagagcuucuua

SEQ ID NO: 580260 - RNA, 22 nt, Human
uagaacuuaaauauguuuuccc

SEQ ID NO: 580261 - RNA, 22 nt, Human
ucagggacuuacaaaccagaag

SEQ ID NO: 580262 - RNA, 22 nt, Human
gcagagaggaaugaagccaucc

SEQ ID NO: 580263 - RNA, 22 nt, Human
ccugcccagagccccuuucacu

SEQ ID NO: 580264 - RNA, 22 nt, Human
uguagaaagaauauguuucaua

SEQ ID NO: 580265 - RNA, 22 nt, Human
aaacuuuaggaaggaauuuaca

SEQ ID NO: 580266 - RNA, 22 nt, Human
cuucuucugguuuauguggcaa

SEQ ID NO: 580267 - RNA, 22 nt, Human
uccccuccaacuccaacuaugg

SEQ ID NO: 580268 - RNA, 18 nt, Human
cuccuccacagccccugc

SEQ ID NO: 580269 - RNA, 22 nt, Human
ucugccuggcucauggcaguga

SEQ ID NO: 580270 - RNA, 22 nt, Human
agggcugagacuaaggccagau

SEQ ID NO: 580271 - RNA, 22 nt, Human
ugaacauuccugaaugaagcau

SEQ ID NO: 580272 - RNA, 22 nt, Human
gccaagaagguggggacaugca

SEQ ID NO: 580273 - RNA, 22 nt, Human
gauuuccuugcauauugguaau

SEQ ID NO: 580274 - RNA, 22 nt, Human
cugucccucaucaccucugggu

SEQ ID NO: 580275 - RNA, 22 nt, Human
ugaguguauaugaagguuguaa

SEQ ID NO: 580276 - RNA, 22 nt, Human
uuagauaaagugauguaggcua

SEQ ID NO: 580277 - RNA, 22 nt, Human
agcucugugaagccagcaguuc

SEQ ID NO: 580278 - RNA, 23 nt, Human
ugagcugguauuguccaucucca

SEQ ID NO: 580279 - RNA, 16 nt, Human
gcccaggacgggaggc

SEQ ID NO: 580280 - RNA, 22 nt, Human
uggcucagcuuuccccaucugg

SEQ ID NO: 580281 - RNA, 22 nt, Human
gccaugugggcagaggaggcug

SEQ ID NO: 580282 - RNA, 22 nt, Human
gucugaggaagaugcaggggga

SEQ ID NO: 580283 - RNA, 22 nt, Human
gggagagguuacccgagcaacu

SEQ ID NO: 580284 - RNA, 22 nt, Human
ucaagcagcuuuuacagaagag

SEQ ID NO: 580285 - RNA, 22 nt, Human
agagaacagacagaugcaauga

SEQ ID NO: 580286 - RNA, 22 nt, Human
uggcugagguuaugcugguugu

SEQ ID NO: 580287 - RNA, 22 nt, Human
uccagccuaggggaacagcugc

SEQ ID NO: 580288 - RNA, 22 nt, Human
agaaacuucagcuauucuuuug

SEQ ID NO: 580289 - RNA, 22 nt, Human
gugccuuugugucuaaaacagc

SEQ ID NO: 580290 - RNA, 22 nt, Human
uggaugagggcugagcacuggg

SEQ ID NO: 580291 - RNA, 22 nt, Human
uugacacuaagauuuccaaaca

SEQ ID NO: 580292 - RNA, 22 nt, Human
gacaagacauugguaaagauau

SEQ ID NO: 580293 - RNA, 16 nt, Human
ccugggcucuguugga

SEQ ID NO: 580294 - RNA, 22 nt, Human
agaaggggcccaaggaugucag

SEQ ID NO: 580295 - RNA, 22 nt, Human
ccucaggcuugugagccuucag

SEQ ID NO: 580296 - RNA, 22 nt, Human
auauuguuaguaauauuucgaa

SEQ ID NO: 580297 - RNA, 22 nt, Human
acagacaguaaauaguguggcu

SEQ ID NO: 580298 - RNA, 22 nt, Human
uaaaugauaauaaugcuagugu

SEQ ID NO: 580299 - RNA, 22 nt, Human
ggcagcaguggcugcuauuguc

SEQ ID NO: 580300 - RNA, 22 nt, Human
uucucaugaugcaauucauccc

SEQ ID NO: 580301 - RNA, 22 nt, Human
agagguagaaaauaauggagag

SEQ ID NO: 580302 - RNA, 22 nt, Human
ugcccuggcuggagugcagugg

SEQ ID NO: 580303 - RNA, 22 nt, Human
uuuguucaccuagcaaacuuuu

SEQ ID NO: 580304 - RNA, 17 nt, Human
agagggcucaaggcauc

SEQ ID NO: 580305 - RNA, 22 nt, Human
auuuauugguuugcauggugaa

SEQ ID NO: 580306 - RNA, 22 nt, Human
gggaggagcugagugugugugc

SEQ ID NO: 580307 - RNA, 22 nt, Human
aauacaguagguaauaguucau

SEQ ID NO: 580308 - RNA, 22 nt, Human
uagaggcagaagaaauugacaa

SEQ ID NO: 580309 - RNA, 22 nt, Human
uaggggaacuggcacagggcag

SEQ ID NO: 580310 - RNA, 22 nt, Human
gcugaagguaugaguuuuaucu

SEQ ID NO: 580311 - RNA, 22 nt, Human
aagagguuuaacugacucacag

SEQ ID NO: 580312 - RNA, 22 nt, Human
aaugucauagcaaagagaguga

SEQ ID NO: 580313 - RNA, 22 nt, Human
cccaguuguugccggcucugga

SEQ ID NO: 580314 - RNA, 22 nt, Human
accuaacuuaccuagguccaca

SEQ ID NO: 580315 - RNA, 20 nt, Human
acaguuuauccaguuagcag

SEQ ID NO: 580316 - RNA, 22 nt, Human
ucugaggucauuccaaggacau

SEQ ID NO: 580317 - RNA, 22 nt, Human
uggaaggagacugggaagugug

SEQ ID NO: 580318 - RNA, 22 nt, Human
cagaacauucacucauaugugg

SEQ ID NO: 580319 - RNA, 22 nt, Human
agaaaacugggaggagagcuuc

SEQ ID NO: 580320 - RNA, 22 nt, Human
gauuaugguagaaacaagaagu

SEQ ID NO: 580321 - RNA, 22 nt, Human
ugucugccugcgggccggcaca

SEQ ID NO: 580322 - RNA, 22 nt, Human
acaguguuuggcaaugcaugca

SEQ ID NO: 580323 - RNA, 22 nt, Human
gcagggaagggaaacagagacc

SEQ ID NO: 580324 - RNA, 22 nt, Human
agacagggccacucauccucac

SEQ ID NO: 580325 - RNA, 22 nt, Human
cugagauggucucuuuguuacu

SEQ ID NO: 580326 - RNA, 22 nt, Human
gaaugugggcugugaagaggag

SEQ ID NO: 580327 - RNA, 22 nt, Human
cugggcagguauacaaaaaaug

SEQ ID NO: 580328 - RNA, 22 nt, Human
ggucagagcuggagagauaggg

SEQ ID NO: 580329 - RNA, 22 nt, Human
cccgacuagcugggauuacagg

SEQ ID NO: 580330 - RNA, 22 nt, Human
uauguuuacgcugguagaauua

SEQ ID NO: 580331 - RNA, 22 nt, Human
ugugacuuagggcaggugagau

SEQ ID NO: 580332 - RNA, 22 nt, Human
cuuauugaaagccccugugccu

SEQ ID NO: 580333 - RNA, 22 nt, Human
acaguguuguggcucuuaauag

SEQ ID NO: 580334 - RNA, 22 nt, Human
caggagacuauggcccaaggcc

SEQ ID NO: 580335 - RNA, 22 nt, Human
aaguuuuauuggcuauagcacu

SEQ ID NO: 580336 - RNA, 22 nt, Human
agagaacuacuuuuuauaugug

SEQ ID NO: 580337 - RNA, 22 nt, Human
ucagugcacccaauucucucca

SEQ ID NO: 580338 - RNA, 22 nt, Human
ccagucucaguucacguuggua

SEQ ID NO: 580339 - RNA, 22 nt, Human
gaauuucagagguaacaucauc

SEQ ID NO: 580340 - RNA, 22 nt, Human
uuggaagaaauaucaauagugu

SEQ ID NO: 580341 - RNA, 22 nt, Human
cccaggagaccugugaaaggac

SEQ ID NO: 580342 - RNA, 21 nt, Human
uccuucagucuagaugauugu

SEQ ID NO: 580343 - RNA, 22 nt, Human
uugugucauguuccauugaaaa

SEQ ID NO: 580344 - RNA, 22 nt, Human
ccuuccagaguucagucugccc

SEQ ID NO: 580345 - RNA, 22 nt, Human
cugcacaguuugauuucuugcu

SEQ ID NO: 580346 - RNA, 22 nt, Human
cuuauugugagaugcgauaauu

SEQ ID NO: 580347 - RNA, 22 nt, Human
ggcucaggagaggggcuaaaag

SEQ ID NO: 580348 - RNA, 22 nt, Human
uuucuaguucucugccaaaaaa

SEQ ID NO: 580349 - RNA, 22 nt, Human
caccaggcuggagugcagaggu

SEQ ID NO: 580350 - RNA, 20 nt, Human
ggaccagguggggcgguggc

SEQ ID NO: 580351 - RNA, 22 nt, Human
uccugagguuuuaaaacuauuc

SEQ ID NO: 580352 - RNA, 21 nt, Human
cugcaggaugcugaagccagg

SEQ ID NO: 580353 - RNA, 22 nt, Human
uaagacauagccaagagcaucc

SEQ ID NO: 580354 - RNA, 22 nt, Human
ugccugaguuuaacccucagag

SEQ ID NO: 580355 - RNA, 22 nt, Human
aucuacauguugauuuaaagaa

SEQ ID NO: 580356 - RNA, 22 nt, Human
caggaggaaaugugacccugcu

SEQ ID NO: 580357 - RNA, 22 nt, Human
aguacacagaauucuacuuguu

SEQ ID NO: 580358 - RNA, 22 nt, Human
gaggcacauauauacagagccc

SEQ ID NO: 580359 - RNA, 22 nt, Human
aauguuaaaaccuucagugcuu

SEQ ID NO: 580360 - RNA, 22 nt, Human
cuggagugcaaccucugccucc

SEQ ID NO: 580361 - RNA, 19 nt, Human
gcagaugaugaggcugguc

SEQ ID NO: 580362 - RNA, 22 nt, Human
ucccucagaaauucucucugaa

SEQ ID NO: 580363 - RNA, 22 nt, Human
cagccuccugggacacucaccg

SEQ ID NO: 580364 - RNA, 21 nt, Human
uucacagaugggaaaacugag

SEQ ID NO: 580365 - RNA, 22 nt, Human
uaggaagcugagcagcauuccu

SEQ ID NO: 580366 - RNA, 22 nt, Human
gugagcuggaauaguggagaaa

SEQ ID NO: 580367 - RNA, 22 nt, Human
uaguguuuaguacauaugcaua

SEQ ID NO: 580368 - RNA, 22 nt, Human
uuaguaauuagaaaguaauucu

SEQ ID NO: 580369 - RNA, 22 nt, Human
aaagcugcugccaaucaggcuu

SEQ ID NO: 580370 - RNA, 22 nt, Human
gauuaugguaacaaugauuaaa

SEQ ID NO: 580371 - RNA, 22 nt, Human
ugagccagguuuuccaucauuc

SEQ ID NO: 580372 - RNA, 22 nt, Human
gauuuagagaauguuuuguaag

SEQ ID NO: 580373 - RNA, 22 nt, Human
gaugcagugcuuaaaucauuug

SEQ ID NO: 580374 - RNA, 22 nt, Human
cugaagcacagcauauaaauaa

SEQ ID NO: 580375 - RNA, 22 nt, Human
cagcucuuccauuuccuucagc

SEQ ID NO: 580376 - RNA, 19 nt, Human
cagguggcgcucuacaggg

SEQ ID NO: 580377 - RNA, 22 nt, Human
cuaggaaagacacagagaguuu

SEQ ID NO: 580378 - RNA, 22 nt, Human
uuaggaaaucacuuugcucacc

SEQ ID NO: 580379 - RNA, 22 nt, Human
auuaauaaaauaccacuuuguu

SEQ ID NO: 580380 - RNA, 22 nt, Human
uguccuguuauauguuggguag

SEQ ID NO: 580381 - RNA, 22 nt, Human
gcuuccagugacuuuggucgug

SEQ ID NO: 580382 - RNA, 22 nt, Human
uaauuuacucagauguucaauc

SEQ ID NO: 580383 - RNA, 22 nt, Human
aguguugcaugaggcaguacca

SEQ ID NO: 580384 - RNA, 22 nt, Human
augcaguugcaauggaggacuc

SEQ ID NO: 580385 - RNA, 22 nt, Human
cagugcuccugauguacccuug

SEQ ID NO: 580386 - RNA, 23 nt, Human
uagauacugcauauagguggaau

SEQ ID NO: 580387 - RNA, 22 nt, Human
agauacagccugccagguucuu

SEQ ID NO: 580388 - RNA, 22 nt, Human
cugaagaaauaugauugcuuaa

SEQ ID NO: 580389 - RNA, 22 nt, Human
caugcuaaaauaucugaagauu

SEQ ID NO: 580390 - RNA, 22 nt, Human
agcagaacauuuucagggcugu

SEQ ID NO: 580391 - RNA, 22 nt, Human
gggcgcaucaccugaggucagg

SEQ ID NO: 580392 - RNA, 22 nt, Human
ugggccugauucuugaauccug

SEQ ID NO: 580393 - RNA, 22 nt, Human
cagcagcagauucagcgucugg

SEQ ID NO: 580394 - RNA, 22 nt, Human
agugaaaugauaguguaaauac

SEQ ID NO: 580395 - RNA, 22 nt, Human
aaguuuaucccucucacaguua

SEQ ID NO: 580396 - RNA, 22 nt, Human
cuggcccuaugagccuccugau

SEQ ID NO: 580397 - RNA, 19 nt, Human
aaggacacaacagagauag

SEQ ID NO: 580398 - RNA, 22 nt, Human
uauuuacuguauuugaaguuga

SEQ ID NO: 580399 - RNA, 22 nt, Human
gagcacaguccuuuuguuaaaa

SEQ ID NO: 580400 - RNA, 22 nt, Human
gagcuuccugcaggucacugug

SEQ ID NO: 580401 - RNA, 20 nt, Human
gucucaaguaucucacaguc

SEQ ID NO: 580402 - RNA, 22 nt, Human
auauuuuuccaugugggacucu

SEQ ID NO: 580403 - RNA, 22 nt, Human
ugagcagagcaauaggacucuc

SEQ ID NO: 580404 - RNA, 22 nt, Human
uaaggaaacaacuuguauuuuu

SEQ ID NO: 580405 - RNA, 22 nt, Human
uaugagaaaauaaauaucuguu

SEQ ID NO: 580406 - RNA, 22 nt, Human
ucucagagugacaaugagaauu

SEQ ID NO: 580407 - RNA, 22 nt, Human
gcugggucccaagccuggggag

SEQ ID NO: 580408 - RNA, 22 nt, Human
guggucagugguacaguuugaa

SEQ ID NO: 580409 - RNA, 22 nt, Human
aacauacauauuucagugucca

SEQ ID NO: 580410 - RNA, 22 nt, Human
cccagcaguuguuggugcacau

SEQ ID NO: 580411 - RNA, 22 nt, Human
cuagccagacucaagggccacc

SEQ ID NO: 580412 - RNA, 22 nt, Human
agaccuggaugugagggaagua

SEQ ID NO: 580413 - RNA, 22 nt, Human
agguaggaaagucuccuuguau

SEQ ID NO: 580414 - RNA, 22 nt, Human
uguguccacugaauguguauua

SEQ ID NO: 580415 - RNA, 22 nt, Human
cagaggcagaauggagauuugg

SEQ ID NO: 580416 - RNA, 22 nt, Human
uggaggacguguccaccaugaa

SEQ ID NO: 580417 - RNA, 22 nt, Human
caggugcccagcuccugcugug

SEQ ID NO: 580418 - RNA, 23 nt, Human
caucauuguuaugggugcuacua

SEQ ID NO: 580419 - RNA, 22 nt, Human
accagugcuuccugcuggagcu

SEQ ID NO: 580420 - RNA, 22 nt, Human
agguaggauggguggagaugau

SEQ ID NO: 580421 - RNA, 22 nt, Human
ccaguguucccucggguucaug

SEQ ID NO: 580422 - RNA, 22 nt, Human
uugagaagaggcuuuguaggaa

SEQ ID NO: 580423 - RNA, 22 nt, Human
uuagaaagguuuugcucugaaa

SEQ ID NO: 580424 - RNA, 20 nt, Human
auuuuguuuauguuccucuc

SEQ ID NO: 580425 - RNA, 23 nt, Human
ucaguuuuggcuguucaguguug

SEQ ID NO: 580426 - RNA, 22 nt, Human
cauucucucuacuuguuuucaa

SEQ ID NO: 580427 - RNA, 22 nt, Human
ugaauguugauaugaguacaga

SEQ ID NO: 580428 - RNA, 22 nt, Human
gccaagcucaccuucugaugga

SEQ ID NO: 580429 - RNA, 22 nt, Human
guaaaauagaauaacguggcua

SEQ ID NO: 580430 - RNA, 18 nt, Human
aagaggaggagcagguug

SEQ ID NO: 580431 - RNA, 22 nt, Human
ccaggcuuauuaucuucuccau

SEQ ID NO: 580432 - RNA, 22 nt, Human
aucuuucuccauauacaucuuu

SEQ ID NO: 580433 - RNA, 19 nt, Human
caggccagugucagggggc

SEQ ID NO: 580434 - RNA, 21 nt, Human
uaaaacuguaacuuuguccug

SEQ ID NO: 580435 - RNA, 22 nt, Human
uaagguuuguggggagcaaaag

SEQ ID NO: 580436 - RNA, 22 nt, Human
aaguaaaacacacaguccaccg

SEQ ID NO: 580437 - RNA, 22 nt, Human
aucagcucauuuugauggaaau

SEQ ID NO: 580438 - RNA, 22 nt, Human
guuuucauuacugcugugauuu

SEQ ID NO: 580439 - RNA, 22 nt, Human
ccugggcucaagugaugguccc

SEQ ID NO: 580440 - RNA, 22 nt, Human
aggcacugaaggaagcuugcgc

SEQ ID NO: 580441 - RNA, 20 nt, Human
auagauaucaucuuuagaag

SEQ ID NO: 580442 - RNA, 22 nt, Human
ucccagggccgcaaacgaguuu

SEQ ID NO: 580443 - RNA, 22 nt, Human
aaggguugcaaggucagaggaa

SEQ ID NO: 580444 - RNA, 22 nt, Human
uuguaaauaguaguaagaugcc

SEQ ID NO: 580445 - RNA, 22 nt, Human
aaaugcagaucccugaaucuca

SEQ ID NO: 580446 - RNA, 22 nt, Human
ugccucagagugggcuugcuau

SEQ ID NO: 580447 - RNA, 22 nt, Human
ucucugggugauggcagggcac

SEQ ID NO: 580448 - RNA, 22 nt, Human
uagaaagcagaaaccaucagag

SEQ ID NO: 580449 - RNA, 22 nt, Human
uagcuuugaaguuauuuaacag

SEQ ID NO: 580450 - RNA, 22 nt, Human
ugugguggggucugguauucca

SEQ ID NO: 580451 - RNA, 22 nt, Human
uccaggcaaaaaccaacuacag

SEQ ID NO: 580452 - RNA, 22 nt, Human
aggcugagcaaagggccuuacc

SEQ ID NO: 580453 - RNA, 22 nt, Human
ugcaugcacuaucuagaugaug

SEQ ID NO: 580454 - RNA, 22 nt, Human
acaggcuggaggaggaccaaga

SEQ ID NO: 580455 - RNA, 22 nt, Human
uaaguuuucuggaauaacuugg

SEQ ID NO: 580456 - RNA, 22 nt, Human
uucaggaggugagcaagaaggg

SEQ ID NO: 580457 - RNA, 22 nt, Human
agucuucccugugccagagugu

SEQ ID NO: 580458 - RNA, 22 nt, Human
gagcacagauccuggagccaca

SEQ ID NO: 580459 - RNA, 22 nt, Human
acagugcuuuuguuccucuccu

SEQ ID NO: 580460 - RNA, 22 nt, Human
acagggcagagaggcaggcuug

SEQ ID NO: 580461 - RNA, 22 nt, Human
ugggcagggucucuguuaucag

SEQ ID NO: 580462 - RNA, 22 nt, Human
cuggaaguauaggggagaugau

SEQ ID NO: 580463 - RNA, 22 nt, Human
acauucuguuuccccaaagaga

SEQ ID NO: 580464 - RNA, 22 nt, Human
uagcaaagcuccguaguuauuu

SEQ ID NO: 580465 - RNA, 22 nt, Human
cuccagugagcgcggggcaugg

SEQ ID NO: 580466 - RNA, 22 nt, Human
aacaaugccugaugaccuccug

SEQ ID NO: 580467 - RNA, 22 nt, Human
ggcuggugaguucagagaaccc

SEQ ID NO: 580468 - RNA, 22 nt, Human
auacauacauguaugcacauac

SEQ ID NO: 580469 - RNA, 22 nt, Human
gcuucuccagaccuucaucccc

SEQ ID NO: 580470 - RNA, 22 nt, Human
gagggccucugugggugcucac

SEQ ID NO: 580471 - RNA, 22 nt, Human
ucuguaaucuuccccagcucag

SEQ ID NO: 580472 - RNA, 22 nt, Human
cagcugcccaggccaccuggag

SEQ ID NO: 580473 - RNA, 22 nt, Human
acugggaaucucaggaacaugg

SEQ ID NO: 580474 - RNA, 21 nt, Human
ccagcuccaggaccuuggauc

SEQ ID NO: 580475 - RNA, 22 nt, Human
uagaugaccuuguguuaggcaa

SEQ ID NO: 580476 - RNA, 18 nt, Human
aaauggcacacagaccug

SEQ ID NO: 580477 - RNA, 22 nt, Human
ugucacaugacacaaauaucua

SEQ ID NO: 580478 - RNA, 22 nt, Human
cuggccuggggccucagcugcu

SEQ ID NO: 580479 - RNA, 22 nt, Human
caacaauaugcugaguuuuuca

SEQ ID NO: 580480 - RNA, 22 nt, Human
acaggcuguacuucuaaucauc

SEQ ID NO: 580481 - RNA, 22 nt, Human
ucaauuacagcaaugacuguac

SEQ ID NO: 580482 - RNA, 19 nt, Human
uauuucaaagugccgucua

SEQ ID NO: 580483 - RNA, 21 nt, Human
ccugccaggaaacugaguguc

SEQ ID NO: 580484 - RNA, 22 nt, Human
ucacaaaugaggaaaucgagca

SEQ ID NO: 580485 - RNA, 22 nt, Human
cuggaguuuuggaaaaaugcuu

SEQ ID NO: 580486 - RNA, 22 nt, Human
guggaggacaaaagaagccuuu

SEQ ID NO: 580487 - RNA, 22 nt, Human
gaagaggcuuuccuagggcaag

SEQ ID NO: 580488 - RNA, 22 nt, Human
aacacucucuguugguaaggcu

SEQ ID NO: 580489 - RNA, 22 nt, Human
ccugauggagcccugcugcaug

SEQ ID NO: 580490 - RNA, 22 nt, Human
cugggcugcaguuccugguccu

SEQ ID NO: 580491 - RNA, 22 nt, Human
gagcugcccugagcuuugcaug

SEQ ID NO: 580492 - RNA, 22 nt, Human
guagggagcccagagcccagug

SEQ ID NO: 580493 - RNA, 22 nt, Human
ggccaggcugcugggaccccgc

SEQ ID NO: 580494 - RNA, 22 nt, Human
aggucacccguuugacuaucca

SEQ ID NO: 580495 - RNA, 22 nt, Human
aucaaaguuucccagaaguugu

SEQ ID NO: 580496 - RNA, 22 nt, Human
uaagguuucuaguuucuaaacu

SEQ ID NO: 580497 - RNA, 22 nt, Human
ucagcacuggcgcugggcaggu

SEQ ID NO: 580498 - RNA, 22 nt, Human
cagcaagggauaaagaguuacu

SEQ ID NO: 580499 - RNA, 22 nt, Human
agccugguuuaagcauuuuaua

SEQ ID NO: 580500 - RNA, 22 nt, Human
uaaugcuuuuccuucaaauaag

SEQ ID NO: 580501 - RNA, 22 nt, Human
aggacaggauugagcugaacug

SEQ ID NO: 580502 - RNA, 22 nt, Human
uucaguauaaaaucaaagugau

SEQ ID NO: 580503 - RNA, 22 nt, Human
cacauacaaugguguuauuugg

SEQ ID NO: 580504 - RNA, 22 nt, Human
uuuuaagaggaggcuguuugaa

SEQ ID NO: 580505 - RNA, 22 nt, Human
cuggcucauagagcagcuccaa

SEQ ID NO: 580506 - RNA, 22 nt, Human
ggccaugggaagagguggagag

SEQ ID NO: 580507 - RNA, 22 nt, Human
uggcuccaucauccaugcaaga

SEQ ID NO: 580508 - RNA, 22 nt, Human
agacaauggcuaaguaaccugu

SEQ ID NO: 580509 - RNA, 22 nt, Human
ggcucaagcagucugccugccu

SEQ ID NO: 580510 - RNA, 22 nt, Human
agaagccauaguaucucagggu

SEQ ID NO: 580511 - RNA, 21 nt, Human
gcccagaagacuggcucugcc

SEQ ID NO: 580512 - RNA, 22 nt, Human
aaucagaacgcucgaucuucgg

SEQ ID NO: 580513 - RNA, 22 nt, Human
aguaaagcagaguugcaguaca

SEQ ID NO: 580514 - RNA, 22 nt, Human
cuguauaacaucuuuuguuucc

SEQ ID NO: 580515 - RNA, 22 nt, Human
aacuuuaaagaggaggcuuggg

SEQ ID NO: 580516 - RNA, 22 nt, Human
cagcucucuaaggucuugcuuu

SEQ ID NO: 580517 - RNA, 22 nt, Human
ucauguaaauguggaugcuucc

SEQ ID NO: 580518 - RNA, 22 nt, Human
aagggagguaaagcuauuuaaa

SEQ ID NO: 580519 - RNA, 22 nt, Human
gaauguuauuggacagcagugg

SEQ ID NO: 580520 - RNA, 23 nt, Human
cuaggcaggauuguaggcgggua

SEQ ID NO: 580521 - RNA, 22 nt, Human
ucgaauggcaaggaaagaggcu

SEQ ID NO: 580522 - RNA, 22 nt, Human
gggcagcaguugcccuaaucaa

SEQ ID NO: 580523 - RNA, 22 nt, Human
uacuucuagccugccccuugug

SEQ ID NO: 580524 - RNA, 22 nt, Human
gcagcuggcucagagagguggg

SEQ ID NO: 580525 - RNA, 22 nt, Human
ucauuaucuuggcucauuucug

SEQ ID NO: 580526 - RNA, 22 nt, Human
auuugccuguaagacaaggccu

SEQ ID NO: 580527 - RNA, 22 nt, Human
ugagaugguugaccagagagca

SEQ ID NO: 580528 - RNA, 22 nt, Human
uuuagaguugguccccugugag

SEQ ID NO: 580529 - RNA, 22 nt, Human
gaggcuggacgugcauuucuac

SEQ ID NO: 580530 - RNA, 22 nt, Human
uuaggauuugaaaaggggcaga

SEQ ID NO: 580531 - RNA, 22 nt, Human
ccugggugaaauaguccucaag

SEQ ID NO: 580532 - RNA, 22 nt, Human
ucagguggcuucggggaguggc

SEQ ID NO: 580533 - RNA, 22 nt, Human
aagaguuuuagacaaacugauu

SEQ ID NO: 580534 - RNA, 22 nt, Human
ucaguaaaagggugcuuuacuc

SEQ ID NO: 580535 - RNA, 22 nt, Human
uucuaauuauucccuuguccca

SEQ ID NO: 580536 - RNA, 22 nt, Human
cuauauuucuuggcuuuaaaca

SEQ ID NO: 580537 - RNA, 20 nt, Human
cucugcuuuaggagagucag

SEQ ID NO: 580538 - RNA, 22 nt, Human
caucucuguguccccagagcuu

SEQ ID NO: 580539 - RNA, 22 nt, Human
aauuucagaugucauaaauaua

SEQ ID NO: 580540 - RNA, 22 nt, Human
agguccugaugaucucugagag

SEQ ID NO: 580541 - RNA, 21 nt, Human
gagaugcuuuuuauucaaccc

SEQ ID NO: 580542 - RNA, 22 nt, Human
ucagugcuucggcgagcaccua

SEQ ID NO: 580543 - RNA, 22 nt, Human
cagaaacaggcaacgugugcac

SEQ ID NO: 580544 - RNA, 22 nt, Human
cacaugcauuggcaaaagugua

SEQ ID NO: 580545 - RNA, 22 nt, Human
gucugagggacagaguccuggc

SEQ ID NO: 580546 - RNA, 22 nt, Human
gccuggcacauugcaguggauu

SEQ ID NO: 580547 - RNA, 22 nt, Human
ugguggagggaacuauuuccag

SEQ ID NO: 580548 - RNA, 22 nt, Human
gcagauggcucagacacugggg

SEQ ID NO: 580549 - RNA, 22 nt, Human
cccagcagccagaaugaggagc

SEQ ID NO: 580550 - RNA, 22 nt, Human
ucugagaaggaagcucugugua

SEQ ID NO: 580551 - RNA, 22 nt, Human
gcaggcugugaggcucagaugg

SEQ ID NO: 580552 - RNA, 22 nt, Human
cccaggagaauauuuuuggguc

SEQ ID NO: 580553 - RNA, 22 nt, Human
ugcugcugauggcaccuaggca

SEQ ID NO: 580554 - RNA, 22 nt, Human
aucaggaaugaauacuuuugga

SEQ ID NO: 580555 - RNA, 22 nt, Human
ccagccagcugguuggacgccu

SEQ ID NO: 580556 - RNA, 22 nt, Human
ccugggaaagugaggucauuau

SEQ ID NO: 580557 - RNA, 22 nt, Human
acaguaauuaaggucugaaacg

SEQ ID NO: 580558 - RNA, 22 nt, Human
ucagaggagaaguugggaaaau

SEQ ID NO: 580559 - RNA, 22 nt, Human
guguggggaggagagagcccuu

SEQ ID NO: 580560 - RNA, 22 nt, Human
caguagcauguaauaaagacag

SEQ ID NO: 580561 - RNA, 22 nt, Human
ugagguagaagccuggguugag

SEQ ID NO: 580562 - RNA, 22 nt, Human
cccagggacagcuagguggggc

SEQ ID NO: 580563 - RNA, 22 nt, Human
ugagaggguucccagggguuuc

SEQ ID NO: 580564 - RNA, 22 nt, Human
ugagcagaggccagcaccuggg

SEQ ID NO: 580565 - RNA, 22 nt, Human
ucuguagcaagugagaggcauu

SEQ ID NO: 580566 - RNA, 22 nt, Human
uucacagucacccuucuccaug

SEQ ID NO: 580567 - RNA, 22 nt, Human
aggaaaggugagagcggccgcg

SEQ ID NO: 580568 - RNA, 22 nt, Human
uuacagucuggauuaggaaaca

SEQ ID NO: 580569 - RNA, 22 nt, Human
ugggccacaagccaugggacca

SEQ ID NO: 580570 - RNA, 22 nt, Human
agggcgugguggugcuggagca

SEQ ID NO: 580571 - RNA, 23 nt, Human
gagcugaguguagggagacuagg

SEQ ID NO: 580572 - RNA, 22 nt, Human
gugccucagcaccgccugcagc

SEQ ID NO: 580573 - RNA, 22 nt, Human
uagaaagacaaugggaagugcu

SEQ ID NO: 580574 - RNA, 22 nt, Human
uggcucaguagcagugugguca

SEQ ID NO: 580575 - RNA, 22 nt, Human
gggcuucuggcuacuguaugag

SEQ ID NO: 580576 - RNA, 22 nt, Human
ucuggccacccgaggccccugc

SEQ ID NO: 580577 - RNA, 22 nt, Human
cccagcucccaaguugcuaugg

SEQ ID NO: 580578 - RNA, 22 nt, Human
uauucacaugaaaacaaauuuu

SEQ ID NO: 580579 - RNA, 22 nt, Human
aagcaucuccucaucauuuggg

SEQ ID NO: 580580 - RNA, 22 nt, Human
uuacaguuuaccaagaauauug

SEQ ID NO: 580581 - RNA, 22 nt, Human
gagaaagacguaggcugggagg

SEQ ID NO: 580582 - RNA, 22 nt, Human
aaugauuacugaucgcauagga

SEQ ID NO: 580583 - RNA, 22 nt, Human
agcauuuaccucaaugcaucug

SEQ ID NO: 580584 - RNA, 22 nt, Human
cccaggagauggugcguggucu

SEQ ID NO: 580585 - RNA, 22 nt, Human
ucugaggccccugggcaggaug

SEQ ID NO: 580586 - RNA, 21 nt, Human
ucuuggcucugccacuuauua

SEQ ID NO: 580587 - RNA, 22 nt, Human
ugguuccucaagcgcuggcggc

SEQ ID NO: 580588 - RNA, 22 nt, Human
acagcuuuucaauucugcugag

SEQ ID NO: 580589 - RNA, 22 nt, Human
ucauuucugagccuuccaugau

SEQ ID NO: 580590 - RNA, 22 nt, Human
ggcuccugcuguccuuugaagc

SEQ ID NO: 580591 - RNA, 22 nt, Human
ucuagcuuugagaucaguagcc

SEQ ID NO: 580592 - RNA, 22 nt, Human
cauggaaugugaguuguuuagu

SEQ ID NO: 580593 - RNA, 22 nt, Human
caggggacauuaaagcuccaua

SEQ ID NO: 580594 - RNA, 22 nt, Human
cuuaucagauuaucugggcugu

SEQ ID NO: 580595 - RNA, 22 nt, Human
cuguacauaaaggaauaggugu

SEQ ID NO: 580596 - RNA, 23 nt, Human
agugugacuuuuuugacugucac

SEQ ID NO: 580597 - RNA, 22 nt, Human
uuggcucaaaacuuagauucca

SEQ ID NO: 580598 - RNA, 22 nt, Human
ucagcugcauaagucaccuugc

SEQ ID NO: 580599 - RNA, 22 nt, Human
cugucucagcaggaagucauca

SEQ ID NO: 580600 - RNA, 22 nt, Human
cugccuggagcauucugaaggu

SEQ ID NO: 580601 - RNA, 22 nt, Human
auggacagguacugcagugggu

SEQ ID NO: 580602 - RNA, 22 nt, Human
ugaauaugcuuugcaauccuaa

SEQ ID NO: 580603 - RNA, 22 nt, Human
agaggccucccucccagcuggu

SEQ ID NO: 580604 - RNA, 22 nt, Human
acagggcagugucuugaaaaau

SEQ ID NO: 580605 - RNA, 22 nt, Human
aggcucugggaacagacgggug

SEQ ID NO: 580606 - RNA, 22 nt, Human
uuuucugagcucagugacuuac

SEQ ID NO: 580607 - RNA, 22 nt, Human
ccaggagcaaagaucacuggga

SEQ ID NO: 580608 - RNA, 22 nt, Human
gacucuuucaaacagaaagcca

SEQ ID NO: 580609 - RNA, 22 nt, Human
aggacuccauguguccuggaga

SEQ ID NO: 580610 - RNA, 22 nt, Human
aaaugcagcugggcaugagagg

SEQ ID NO: 580611 - RNA, 19 nt, Human
ccagguggaacugagguag

SEQ ID NO: 580612 - RNA, 17 nt, Human
agcuccugcccauggcu

SEQ ID NO: 580613 - RNA, 22 nt, Human
auauuccaguuauaucaaauca

SEQ ID NO: 580614 - RNA, 22 nt, Human
uuccaguucagaugcaacaggg

SEQ ID NO: 580615 - RNA, 22 nt, Human
acuuggcaggucaggggauauu

SEQ ID NO: 580616 - RNA, 22 nt, Human
acucacagcaugagcuuggcag

SEQ ID NO: 580617 - RNA, 22 nt, Human
uuauuugugaaucauuuaucua

SEQ ID NO: 580618 - RNA, 22 nt, Human
aaggaagagaauccuucucaga

SEQ ID NO: 580619 - RNA, 22 nt, Human
ugcauauuguccuugauauuau

SEQ ID NO: 580620 - RNA, 22 nt, Human
cucugggcugaauggcugaacc

SEQ ID NO: 580621 - RNA, 22 nt, Human
agaccaggucuuuauggcucca

SEQ ID NO: 580622 - RNA, 22 nt, Human
uuuuauuggagugauaccaagc

SEQ ID NO: 580623 - RNA, 22 nt, Human
cugcaggguuucgccaguugug

SEQ ID NO: 580624 - RNA, 17 nt, Human
ggagagugggaauggcc

SEQ ID NO: 580625 - RNA, 22 nt, Human
gggccagaccucuucucaggga

SEQ ID NO: 580626 - RNA, 22 nt, Human
ccacauuuacuggaugcucagg

SEQ ID NO: 580627 - RNA, 19 nt, Human
cucuuaaauugucucuugc

SEQ ID NO: 580628 - RNA, 22 nt, Human
auacacacgugcacgugggaaa

SEQ ID NO: 580629 - RNA, 22 nt, Human
caaugaaaauuuaaguugcagc

SEQ ID NO: 580630 - RNA, 22 nt, Human
gaucaaaagcuggguucuaaaa

SEQ ID NO: 580631 - RNA, 22 nt, Human
cacucccuucaggagccuagga

SEQ ID NO: 580632 - RNA, 22 nt, Human
ucccagcagaugagcugaccua

SEQ ID NO: 580633 - RNA, 22 nt, Human
uuagggagcucaguccucagau

SEQ ID NO: 580634 - RNA, 22 nt, Human
uuggaauucaaguuguagcuua

SEQ ID NO: 580635 - RNA, 22 nt, Human
uuggccaaaaaagucauuagaa

SEQ ID NO: 580636 - RNA, 22 nt, Human
uuaaugucaacauuucugaaga

SEQ ID NO: 580637 - RNA, 22 nt, Human
aggccagacagcuagaaacagg

SEQ ID NO: 580638 - RNA, 22 nt, Human
gagcaacaguuuaugguuuuuc

SEQ ID NO: 580639 - RNA, 22 nt, Human
gcagaggucucuucaaaauaau

SEQ ID NO: 580640 - RNA, 22 nt, Human
aaugucauugguaaagauuagg

SEQ ID NO: 580641 - RNA, 16 nt, Human
ccaccugcagcucuca

SEQ ID NO: 580642 - RNA, 22 nt, Human
uggaggcagguggaggagugaa

SEQ ID NO: 580643 - RNA, 22 nt, Human
uacauggugguggcacuugacu

SEQ ID NO: 580644 - RNA, 22 nt, Human
aauuaacagagggcuuauuacu

SEQ ID NO: 580645 - RNA, 22 nt, Human
gccagaagcacaugagagguga

SEQ ID NO: 580646 - RNA, 22 nt, Human
aggaggaacucagaaagaaggu

SEQ ID NO: 580647 - RNA, 22 nt, Human
uucauaguguuuccuuccagug

SEQ ID NO: 580648 - RNA, 22 nt, Human
aagcacauuaaggaacauugaa

SEQ ID NO: 580649 - RNA, 22 nt, Human
ugugugccagauacaagcacug

SEQ ID NO: 580650 - RNA, 22 nt, Human
agcauggggcaaugcaugugcu

SEQ ID NO: 580651 - RNA, 22 nt, Human
gaggggcaaugagggaaagagu

SEQ ID NO: 580652 - RNA, 22 nt, Human
aaacaugagcaucucuucaagc

SEQ ID NO: 580653 - RNA, 22 nt, Human
aaggcugagacagcacaggucc

SEQ ID NO: 580654 - RNA, 22 nt, Human
aacagcuugaggaauaucauca

SEQ ID NO: 580655 - RNA, 18 nt, Human
ucccuccugccugcuucc

SEQ ID NO: 580656 - RNA, 22 nt, Human
gucccugcaucugcaggccaug

SEQ ID NO: 580657 - RNA, 22 nt, Human
gccagcaguauguccuggcagu

SEQ ID NO: 580658 - RNA, 22 nt, Human
aggcuccagucuccucuggcag

SEQ ID NO: 580659 - RNA, 22 nt, Human
uccuugaaaggggcugcagggc

SEQ ID NO: 580660 - RNA, 22 nt, Human
cggagcugccugccaagccugc

SEQ ID NO: 580661 - RNA, 22 nt, Human
agcugcccaauccugcagggcg

SEQ ID NO: 580662 - RNA, 22 nt, Human
uuggcagcagaguguggugcuc

SEQ ID NO: 580663 - RNA, 22 nt, Human
uccugggauuugcccuuuucuc

SEQ ID NO: 580664 - RNA, 22 nt, Human
uauagacuuggcaugcauguuc

SEQ ID NO: 580665 - RNA, 22 nt, Human
auugcaaagaaauacaugcuua

SEQ ID NO: 580666 - RNA, 22 nt, Human
gugugcagucugcuaggcaggg

SEQ ID NO: 580667 - RNA, 22 nt, Human
cuuuguuaucuguaaaugguua

SEQ ID NO: 580668 - RNA, 22 nt, Human
aaaucagaguagaauugagcca

SEQ ID NO: 580669 - RNA, 22 nt, Human
cagagcugcuucccaguuugug

SEQ ID NO: 580670 - RNA, 22 nt, Human
ucuggccaacaaaaacuaaguc

SEQ ID NO: 580671 - RNA, 22 nt, Human
gcuuuccuggcccugucccugc

SEQ ID NO: 580672 - RNA, 19 nt, Human
cagagcagugguuccugaa

SEQ ID NO: 580673 - RNA, 22 nt, Human
uuccuugaccacugcauaauga

SEQ ID NO: 580674 - RNA, 23 nt, Human
acucucagguucuuuccagcagg

SEQ ID NO: 580675 - RNA, 22 nt, Human
aagaacaugaaccucuucuaac

SEQ ID NO: 580676 - RNA, 22 nt, Human
uugcagggcaucgcguacuucu

SEQ ID NO: 580677 - RNA, 22 nt, Human
aaugcagauucuuauucuguag

SEQ ID NO: 580678 - RNA, 22 nt, Human
agaaagcacucugucuuuuacc

SEQ ID NO: 580679 - RNA, 22 nt, Human
guggccuggcgagcuggcgcgg

SEQ ID NO: 580680 - RNA, 22 nt, Human
uagguaguuacacagcaaugua

SEQ ID NO: 580681 - RNA, 22 nt, Human
uccauacacauugaauuuuagu

SEQ ID NO: 580682 - RNA, 21 nt, Human
cuacagaaucgagcauucugg

SEQ ID NO: 580683 - RNA, 22 nt, Human
aagcuuuaaggaauuuuaugga

SEQ ID NO: 580684 - RNA, 22 nt, Human
acagggaauggagggaucagua

SEQ ID NO: 580685 - RNA, 22 nt, Human
gauacacuggccaaguggagga

SEQ ID NO: 580686 - RNA, 22 nt, Human
caggcacucagucuggaucccu

SEQ ID NO: 580687 - RNA, 22 nt, Human
aaguacauauauuuaugauucu

SEQ ID NO: 580688 - RNA, 22 nt, Human
augaaaugauugaaaucuuuac

SEQ ID NO: 580689 - RNA, 22 nt, Human
aguuuauuuuugauaagucuug

SEQ ID NO: 580690 - RNA, 22 nt, Human
cccugggcaagcccuauuuucc

SEQ ID NO: 580691 - RNA, 22 nt, Human
ucauuauaaacauaugcuaaag

SEQ ID NO: 580692 - RNA, 22 nt, Human
uggcuucucuguuuuaguauuu

SEQ ID NO: 580693 - RNA, 22 nt, Human
cauguucaaauaaguaguuucu

SEQ ID NO: 580694 - RNA, 22 nt, Human
acaggcucucagccaguuggca

SEQ ID NO: 580695 - RNA, 23 nt, Human
auaaauuacuaucucccuagagc

SEQ ID NO: 580696 - RNA, 22 nt, Human
uccuggccgccgcguggggccg

SEQ ID NO: 580697 - RNA, 22 nt, Human
ugcagcuguaacagaggccuca

SEQ ID NO: 580698 - RNA, 22 nt, Human
uauaaccuuuucuuuauccucc

SEQ ID NO: 580699 - RNA, 22 nt, Human
uuauuuuuaaaaguucacacag

SEQ ID NO: 580700 - RNA, 22 nt, Human
cucguugcugaagccaaaguca

SEQ ID NO: 580701 - RNA, 22 nt, Human
agauaaauuccuaagauuucag

SEQ ID NO: 580702 - RNA, 18 nt, Human
uccagagguguuggagcc

SEQ ID NO: 580703 - RNA, 22 nt, Human
gugggcagcaccagggaagugu

SEQ ID NO: 580704 - RNA, 22 nt, Human
uuguuuuggaagaacuuacucu

SEQ ID NO: 580705 - RNA, 22 nt, Human
uaggaauccagaucuagacugu

SEQ ID NO: 580706 - RNA, 22 nt, Human
aaagguuuuauguuuuccacuu

SEQ ID NO: 580707 - RNA, 22 nt, Human
cugaggccagcugcagagcucu

SEQ ID NO: 580708 - RNA, 22 nt, Human
ccccagggacugguuucaugga

SEQ ID NO: 580709 - RNA, 22 nt, Human
uucagcaagugucucuacuguc

SEQ ID NO: 580710 - RNA, 22 nt, Human
ugcauucuaugauaucaaaaca

SEQ ID NO: 580711 - RNA, 22 nt, Human
uccugaagccugagugaugacu

SEQ ID NO: 580712 - RNA, 22 nt, Human
cagcuggucaacugaaugaaca

SEQ ID NO: 580713 - RNA, 22 nt, Human
ccagcuggugacauccccaacc

SEQ ID NO: 580714 - RNA, 22 nt, Human
uauaaguguaguuucaaauguu

SEQ ID NO: 580715 - RNA, 22 nt, Human
cccaggcucagacuggcuuguu

SEQ ID NO: 580716 - RNA, 22 nt, Human
ccugccuguacuagagacccag

SEQ ID NO: 580717 - RNA, 22 nt, Human
gaagguuuucaggagccuaguc

SEQ ID NO: 580718 - RNA, 19 nt, Human
accaggccucagaggcccu

SEQ ID NO: 580719 - RNA, 23 nt, Human
ugaaugauuguacugagcuuuua

SEQ ID NO: 580720 - RNA, 22 nt, Human
uuuuuaagcuccuuugauguca

SEQ ID NO: 580721 - RNA, 22 nt, Human
gcagagaaggauugaaaccaga

SEQ ID NO: 580722 - RNA, 22 nt, Human
aaggcugaggcagugaggcaga

SEQ ID NO: 580723 - RNA, 22 nt, Human
uuagauaggacucauagauugg

SEQ ID NO: 580724 - RNA, 22 nt, Human
ucugagcuaauccuguugccga

SEQ ID NO: 580725 - RNA, 22 nt, Human
cuggugaccuugccccagguca

SEQ ID NO: 580726 - RNA, 22 nt, Human
uuacaggucugugucaucaucu

SEQ ID NO: 580727 - RNA, 20 nt, Human
cucacagucaaugcagaggu

SEQ ID NO: 580728 - RNA, 22 nt, Human
aggcccaugugagucuuguccu

SEQ ID NO: 580729 - RNA, 22 nt, Human
ucacaccuguaaucccaggccu

SEQ ID NO: 580730 - RNA, 22 nt, Human
ugcucccaggcauucucuguug

SEQ ID NO: 580731 - RNA, 22 nt, Human
augaggcagcacaugggauugu

SEQ ID NO: 580732 - RNA, 22 nt, Human
uggugaggccaaagccaugaca

SEQ ID NO: 580733 - RNA, 22 nt, Human
uugcccuguggggccuccagcc

SEQ ID NO: 580734 - RNA, 22 nt, Human
agccuggaggccaggagacagu

SEQ ID NO: 580735 - RNA, 22 nt, Human
uucagcacaagacuagacaggu

SEQ ID NO: 580736 - RNA, 22 nt, Human
acagucugucccccaggugcua

SEQ ID NO: 580737 - RNA, 22 nt, Human
gggaagagaggaggugguuucg

SEQ ID NO: 580738 - RNA, 19 nt, Human
ggagccagcuguggaaggc

SEQ ID NO: 580739 - RNA, 22 nt, Human
acugacucuuguuaacuucagc

SEQ ID NO: 580740 - RNA, 22 nt, Human
gcagcugcagacccucagugcu

SEQ ID NO: 580741 - RNA, 22 nt, Human
gucacacagagcccugugcuca

SEQ ID NO: 580742 - RNA, 16 nt, Human
cucagcuaaggagagg

SEQ ID NO: 580743 - RNA, 22 nt, Human
uccucccuguaccauuccucug

SEQ ID NO: 580744 - RNA, 22 nt, Human
ugcugagguuguggagugcauu

SEQ ID NO: 580745 - RNA, 22 nt, Human
auguuaaaagugaggauggcca

SEQ ID NO: 580746 - RNA, 21 nt, Human
ucccagggucuuaugggaugu

SEQ ID NO: 580747 - RNA, 22 nt, Human
cugggccagaccuuguggucuu

SEQ ID NO: 580748 - RNA, 22 nt, Human
uggacagguugaguaggaggag

SEQ ID NO: 580749 - RNA, 22 nt, Human
gccaggcuggugucacaacucu

SEQ ID NO: 580750 - RNA, 18 nt, Human
cagggcuguggggucacu

SEQ ID NO: 580751 - RNA, 22 nt, Human
guuuuucugugagcgguaaagg

SEQ ID NO: 580752 - RNA, 22 nt, Human
gccuggagcccaguguggggcu

SEQ ID NO: 580753 - RNA, 22 nt, Human
aaaacaggaguuuugguaggcu

SEQ ID NO: 580754 - RNA, 22 nt, Human
uguaugaaugggaaaaggaaac

SEQ ID NO: 580755 - RNA, 22 nt, Human
gcaauaaaguagcagcucauca

SEQ ID NO: 580756 - RNA, 22 nt, Human
cugcaggcuuccagggcugugg

SEQ ID NO: 580757 - RNA, 22 nt, Human
uccucucugcacuggcccugcc

SEQ ID NO: 580758 - RNA, 22 nt, Human
acagagcucccagccaucuccu

SEQ ID NO: 580759 - RNA, 22 nt, Human
augcaugcacacacugcauugc

SEQ ID NO: 580760 - RNA, 22 nt, Human
ucugguggugggccacaagcau

SEQ ID NO: 580761 - RNA, 22 nt, Human
caggaggggguggaguuucgcc

SEQ ID NO: 580762 - RNA, 22 nt, Human
uugaaaggugacauuguuagag

SEQ ID NO: 580763 - RNA, 22 nt, Human
ugucaaaguaucagucucuggc

SEQ ID NO: 580764 - RNA, 23 nt, Human
uuuuauugauauguagcuguugu

SEQ ID NO: 580765 - RNA, 22 nt, Human
uucuccagaccuugugacuaug

SEQ ID NO: 580766 - RNA, 22 nt, Human
ucucuggcuggcaccccaggga

SEQ ID NO: 580767 - RNA, 22 nt, Human
uauguacaagcacacaugugac

SEQ ID NO: 580768 - RNA, 22 nt, Human
ucuauuuuuauaguugaagugc

SEQ ID NO: 580769 - RNA, 22 nt, Human
agugucuuucauauccuccauc

SEQ ID NO: 580770 - RNA, 22 nt, Human
cauggcagaaaccugagcugcu

SEQ ID NO: 580771 - RNA, 23 nt, Human
agcugggaauuuucugaagcuuu

SEQ ID NO: 580772 - RNA, 22 nt, Human
caugccaguuuugagaugcacc

SEQ ID NO: 580773 - RNA, 22 nt, Human
ccagcucugcagggccuggggu

SEQ ID NO: 580774 - RNA, 22 nt, Human
gagccugggacugggggucaug

SEQ ID NO: 580775 - RNA, 22 nt, Human
ccagcugcagguguuccagaug

SEQ ID NO: 580776 - RNA, 22 nt, Human
aacauacagugagcaguggacu

SEQ ID NO: 580777 - RNA, 22 nt, Human
acaaugaaccaaauuuaccaau

SEQ ID NO: 580778 - RNA, 22 nt, Human
cagagcugauuggauccagaga

SEQ ID NO: 580779 - RNA, 21 nt, Human
uuacagaauccaugggaaguc

SEQ ID NO: 580780 - RNA, 18 nt, Human
gagcagaggcucaacugg

SEQ ID NO: 580781 - RNA, 22 nt, Human
ugauuagcugaagaauaugcug

SEQ ID NO: 580782 - RNA, 22 nt, Human
aagauccaugggaauguuuggc

SEQ ID NO: 580783 - RNA, 22 nt, Human
agauacaucauuuauaccuuca

SEQ ID NO: 580784 - RNA, 23 nt, Human
uauuugucucuuaccacugcugu

SEQ ID NO: 580785 - RNA, 22 nt, Human
uuuacaaguuuacagaaugaug

SEQ ID NO: 580786 - RNA, 22 nt, Human
cagagcagacguugagauuaag

SEQ ID NO: 580787 - RNA, 20 nt, Human
acaguggaaauugaugucug

SEQ ID NO: 580788 - RNA, 22 nt, Human
cuggagcugcuguccuugggug

SEQ ID NO: 580789 - RNA, 18 nt, Human
agcagcugugccacacug

SEQ ID NO: 580790 - RNA, 22 nt, Human
gcuagaaaucgacuucagaauu

SEQ ID NO: 580791 - RNA, 22 nt, Human
uccugguggugccggugcccgg

SEQ ID NO: 580792 - RNA, 22 nt, Human
ggucagaacaagcaaauaauag

SEQ ID NO: 580793 - RNA, 17 nt, Human
ggcugcaguccaggagg

SEQ ID NO: 580794 - RNA, 22 nt, Human
cugcuucacguugugccuuguu

SEQ ID NO: 580795 - RNA, 22 nt, Human
cuggguuuuauuacagugagcu

SEQ ID NO: 580796 - RNA, 22 nt, Human
gagggagaauugcagccagcgu

SEQ ID NO: 580797 - RNA, 22 nt, Human
auuuugcuuuauguaaauaugu

SEQ ID NO: 580798 - RNA, 20 nt, Human
agucacaguaucagucuuag

SEQ ID NO: 580799 - RNA, 22 nt, Human
gaagaaggugccagaggcuuac

SEQ ID NO: 580800 - RNA, 22 nt, Human
ggcagguggcacugcugcuccc

SEQ ID NO: 580801 - RNA, 22 nt, Human
aagggcaggcacccacccucac

SEQ ID NO: 580802 - RNA, 22 nt, Human
uaaguccacaggaguuguguuc

SEQ ID NO: 580803 - RNA, 22 nt, Human
cuuccuaaaagcuucaagagaa

SEQ ID NO: 580804 - RNA, 22 nt, Human
gaggcagcauucgcauagacag

SEQ ID NO: 580805 - RNA, 22 nt, Human
aauuucagagguagagauucua

SEQ ID NO: 580806 - RNA, 22 nt, Human
auacaucaugcuccauauauuu

SEQ ID NO: 580807 - RNA, 22 nt, Human
cugcugcugagagcucagccug

SEQ ID NO: 580808 - RNA, 22 nt, Human
aguguuuuauuagaacacagcc

SEQ ID NO: 580809 - RNA, 21 nt, Human
acaaugcauggaacucauggc

SEQ ID NO: 580810 - RNA, 22 nt, Human
uugauuagugaaacaugccuag

SEQ ID NO: 580811 - RNA, 22 nt, Human
aggagccaggccccauggggcu

SEQ ID NO: 580812 - RNA, 22 nt, Human
uaggaaaacgugauuuucucac

SEQ ID NO: 580813 - RNA, 22 nt, Human
gugcaaaaguaauugcgguuuu

SEQ ID NO: 580814 - RNA, 22 nt, Human
uuauuuccaaacuggauauacc

SEQ ID NO: 580815 - RNA, 22 nt, Human
ucugacaggucauuuucuauag

SEQ ID NO: 580816 - RNA, 22 nt, Human
cauguuaaauugaguuugcaau

SEQ ID NO: 580817 - RNA, 22 nt, Human
auaaauuuauaauuguuuccug

SEQ ID NO: 580818 - RNA, 22 nt, Human
agugcuuuagaccuuuuggggu

SEQ ID NO: 580819 - RNA, 22 nt, Human
cauucagagcuuucuuaucaua

SEQ ID NO: 580820 - RNA, 21 nt, Human
uguuuucuaaagggcggauca

SEQ ID NO: 580821 - RNA, 22 nt, Human
guucugaaugugccuguacucu

SEQ ID NO: 580822 - RNA, 22 nt, Human
ggugagcagcugucuguaugga

SEQ ID NO: 580823 - RNA, 22 nt, Human
ggggaagaccuggcacuacagc

SEQ ID NO: 580824 - RNA, 22 nt, Human
ugagcagaguuguuucuccuga

SEQ ID NO: 580825 - RNA, 22 nt, Human
gccaggcugguuauuuaaugag

SEQ ID NO: 580826 - RNA, 22 nt, Human
ggcuguggcauuaggugaggcc

SEQ ID NO: 580827 - RNA, 22 nt, Human
agcagcugaucaaagcacuuau

SEQ ID NO: 580828 - RNA, 22 nt, Human
aaauuagaaauacuuucaaagc

SEQ ID NO: 580829 - RNA, 22 nt, Human
ugggaacaacaugcacugccac

SEQ ID NO: 580830 - RNA, 22 nt, Human
ggcuccaggguaccccuggaug

SEQ ID NO: 580831 - RNA, 22 nt, Human
ugacauuuuuauaagagucaaa

SEQ ID NO: 580832 - RNA, 22 nt, Human
uuccuucuggaggcuccagggg

SEQ ID NO: 580833 - RNA, 22 nt, Human
uacaaagauaguguuagaguaa

SEQ ID NO: 580834 - RNA, 16 nt, Human
agccaggcugccucgg

SEQ ID NO: 580835 - RNA, 22 nt, Human
aacauugauugcaucuguucac

SEQ ID NO: 580836 - RNA, 22 nt, Human
auuaugcucaccuggcaacuug

SEQ ID NO: 580837 - RNA, 22 nt, Human
aggccacauagcuugcauguag

SEQ ID NO: 580838 - RNA, 22 nt, Human
ucuuauaauguugaaggguugg

SEQ ID NO: 580839 - RNA, 22 nt, Human
ugagcagagcaggcugcgcccu

SEQ ID NO: 580840 - RNA, 22 nt, Human
gccugcuggcuguccauugcag

SEQ ID NO: 580841 - RNA, 22 nt, Human
ugcuucuggguaggccucagga

SEQ ID NO: 580842 - RNA, 22 nt, Human
aacucuuuggucucaggaaagg

SEQ ID NO: 580843 - RNA, 22 nt, Human
uaacacuguaaaccuagauguu

SEQ ID NO: 580844 - RNA, 22 nt, Human
ggcugaguggcugggucuaguu

SEQ ID NO: 580845 - RNA, 22 nt, Human
gaaaguuuucucacacaguaau

SEQ ID NO: 580846 - RNA, 22 nt, Human
uucagaaugacuuauguaaggc

SEQ ID NO: 580847 - RNA, 22 nt, Human
caggaacagcaccaggagcuag

SEQ ID NO: 580848 - RNA, 22 nt, Human
ccagggaugccaagcuuuacca

SEQ ID NO: 580849 - RNA, 22 nt, Human
uggagggcuaagcugagggaua

SEQ ID NO: 580850 - RNA, 22 nt, Human
uuuaaauuuagaagaaacacug

SEQ ID NO: 580851 - RNA, 22 nt, Human
ucucagaacacccuucuauggu

SEQ ID NO: 580852 - RNA, 22 nt, Human
aggcaagaacagacaugggagu

SEQ ID NO: 580853 - RNA, 22 nt, Human
ucaaacauaaaacuaaaucgag

SEQ ID NO: 580854 - RNA, 22 nt, Human
cagcucugagacugaggcuaug

SEQ ID NO: 580855 - RNA, 22 nt, Human
aagaggcuagccggcucacuaa

SEQ ID NO: 580856 - RNA, 22 nt, Human
aggaaaagugugaaguauggag

SEQ ID NO: 580857 - RNA, 22 nt, Human
auaauaaaccaggaugggucug

SEQ ID NO: 580858 - RNA, 22 nt, Human
ucuccuggccgggcuguccccu

SEQ ID NO: 580859 - RNA, 22 nt, Human
cuuccaggguccaggaagagcc

SEQ ID NO: 580860 - RNA, 19 nt, Human
uuuuccugccucauuguuu

SEQ ID NO: 580861 - RNA, 22 nt, Human
uauuagcuguguaacucugguu

SEQ ID NO: 580862 - RNA, 22 nt, Human
gcuccaggugucccagguaaaa

SEQ ID NO: 580863 - RNA, 23 nt, Human
acuggcuuugauccagauagauu

SEQ ID NO: 580864 - RNA, 22 nt, Human
cuguggcugcagccuugguccu

SEQ ID NO: 580865 - RNA, 22 nt, Human
agugucugcagugaugucucuu

SEQ ID NO: 580866 - RNA, 22 nt, Human
augaggccagggugccaugaaa

SEQ ID NO: 580867 - RNA, 22 nt, Human
gggagcucgugcgcccaggugc

SEQ ID NO: 580868 - RNA, 20 nt, Human
gagguagggcuuaaggcaag

SEQ ID NO: 580869 - RNA, 22 nt, Human
uuuugccugagagugaaaauaa

SEQ ID NO: 580870 - RNA, 22 nt, Human
acccugcagggcagaggcuggu

SEQ ID NO: 580871 - RNA, 22 nt, Human
gaggcccacagggaguaccaag

SEQ ID NO: 580872 - RNA, 22 nt, Human
gagcauccaugacuuuggcuuu

SEQ ID NO: 580873 - RNA, 22 nt, Human
cagcuggcguggagugauugca

SEQ ID NO: 580874 - RNA, 22 nt, Human
uggucagcguuugucagagcag

SEQ ID NO: 580875 - RNA, 22 nt, Human
acugucaaggaaacaaaauuac

SEQ ID NO: 580876 - RNA, 22 nt, Human
cucauauugcugguggucuaag

SEQ ID NO: 580877 - RNA, 22 nt, Human
cuuuuucugauguuccaugauu

SEQ ID NO: 580878 - RNA, 22 nt, Human
cacuaagauuuaaaguauuagu

SEQ ID NO: 580879 - RNA, 22 nt, Human
auacacacauaugugaguuuug

SEQ ID NO: 580880 - RNA, 22 nt, Human
aagucucucauggcugacagca

SEQ ID NO: 580881 - RNA, 22 nt, Human
ugaggccugcauugaacuagaa

SEQ ID NO: 580882 - RNA, 22 nt, Human
aaagcaaugcuuguggaaugua

SEQ ID NO: 580883 - RNA, 22 nt, Human
gcaggaguuaggcgucguggau

SEQ ID NO: 580884 - RNA, 23 nt, Human
agggaagggggcuuauuccacag

SEQ ID NO: 580885 - RNA, 22 nt, Human
cacagaguggaggcuuggccug

SEQ ID NO: 580886 - RNA, 22 nt, Human
ucaaaguagggguaagccaggc

SEQ ID NO: 580887 - RNA, 22 nt, Human
gcugggcuggccgccgagaucg

SEQ ID NO: 580888 - RNA, 21 nt, Human
ucuuucugaaaucucagucug

SEQ ID NO: 580889 - RNA, 22 nt, Human
agagcugggacuuggacucaau

SEQ ID NO: 580890 - RNA, 22 nt, Human
uggcaggaaccaggaggcucuc

SEQ ID NO: 580891 - RNA, 22 nt, Human
aucagaccugucuccucuugcc

SEQ ID NO: 580892 - RNA, 22 nt, Human
ccuacacaucucaccucacagg

SEQ ID NO: 580893 - RNA, 22 nt, Human
ugaaacuuauucaguuucuacc

SEQ ID NO: 580894 - RNA, 22 nt, Human
agcuuugugacuuugagcuagu

SEQ ID NO: 580895 - RNA, 22 nt, Human
aagcuuccugaaugcucauuua

SEQ ID NO: 580896 - RNA, 22 nt, Human
gguaacuugaguguguuguuca

SEQ ID NO: 580897 - RNA, 21 nt, Human
ggcuggucgcgugcaugucuc

SEQ ID NO: 580898 - RNA, 22 nt, Human
gagaaggggugauguggguaau

SEQ ID NO: 580899 - RNA, 22 nt, Human
gcugcuuccuuuccugcugacc

SEQ ID NO: 580900 - RNA, 22 nt, Human
cugagguaccuggagcaggucc

SEQ ID NO: 580901 - RNA, 22 nt, Human
aauguuuucucugugaacacau

SEQ ID NO: 580902 - RNA, 22 nt, Human
ugucucaucucuuaaccccacu

SEQ ID NO: 580903 - RNA, 21 nt, Human
agcugccacccuagcuucuga

SEQ ID NO: 580904 - RNA, 22 nt, Human
cugcucagcggaaggaagagcg

SEQ ID NO: 580905 - RNA, 22 nt, Human
uaguggagaaguggagucugug

SEQ ID NO: 580906 - RNA, 22 nt, Human
uuuccuuccuugcuagccugag

SEQ ID NO: 580907 - RNA, 22 nt, Human
cuuauucagaaggagaaaugga

SEQ ID NO: 580908 - RNA, 22 nt, Human
aaguaaaauguuuccuuuauua

SEQ ID NO: 580909 - RNA, 22 nt, Human
augucccagcugagagacaacu

SEQ ID NO: 580910 - RNA, 22 nt, Human
auuauuuauccucuuggucuau

SEQ ID NO: 580911 - RNA, 22 nt, Human
cagacacagauaugcauauggc

SEQ ID NO: 580912 - RNA, 22 nt, Human
gccuauggauuggagaaggagc

SEQ ID NO: 580913 - RNA, 22 nt, Human
uccugcagagucccacugauuu

SEQ ID NO: 580914 - RNA, 22 nt, Human
aagacuaaauguguucuaaagu

SEQ ID NO: 580915 - RNA, 22 nt, Human
ugagugccugaacauagaguag

SEQ ID NO: 580916 - RNA, 22 nt, Human
agagugcuuuauuagauguagc

SEQ ID NO: 580917 - RNA, 22 nt, Human
ugcaccuuguccauuuuuggcc

SEQ ID NO: 580918 - RNA, 22 nt, Human
gacaggcuuugagucccagaac

SEQ ID NO: 580919 - RNA, 22 nt, Human
uucccagaggagauuugcuuau

SEQ ID NO: 580920 - RNA, 22 nt, Human
auauaucaugaguaaaacuuga

SEQ ID NO: 580921 - RNA, 22 nt, Human
cuggcuuugaggauccccucuu

SEQ ID NO: 580922 - RNA, 22 nt, Human
acccccuucgcacacucuuuca

SEQ ID NO: 580923 - RNA, 22 nt, Human
accauacauuaaaugacuuuca

SEQ ID NO: 580924 - RNA, 17 nt, Human
agaaagaggauccacag

SEQ ID NO: 580925 - RNA, 22 nt, Human
aggcuggagacccgccaagaaa

SEQ ID NO: 580926 - RNA, 22 nt, Human
agcagcugggcucagagcuggg

SEQ ID NO: 580927 - RNA, 21 nt, Human
gcugcagggcccagggcaccc

SEQ ID NO: 580928 - RNA, 22 nt, Human
ucagggaaccucuccuguuucu

SEQ ID NO: 580929 - RNA, 22 nt, Human
auuuucuauucugcugguuuag

SEQ ID NO: 580930 - RNA, 22 nt, Human
uuuauugucaaucuauucccag

SEQ ID NO: 580931 - RNA, 22 nt, Human
ccaccaggacagcccugagggg

SEQ ID NO: 580932 - RNA, 22 nt, Human
agugcuggagggaggcagguuc

SEQ ID NO: 580933 - RNA, 22 nt, Human
acugggccuggauuggcguguc

SEQ ID NO: 580934 - RNA, 22 nt, Human
ggugaaauauuuuugauauguu

SEQ ID NO: 580935 - RNA, 19 nt, Human
uggggccuccugucccugg

SEQ ID NO: 580936 - RNA, 22 nt, Human
ccacagcaugcaggccugacac

SEQ ID NO: 580937 - RNA, 20 nt, Human
cugcaguccccucugaauca

SEQ ID NO: 580938 - RNA, 22 nt, Human
acaguccuguacaggccauauc

SEQ ID NO: 580939 - RNA, 22 nt, Human
agggaagcaggaauagcucuga

SEQ ID NO: 580940 - RNA, 22 nt, Human
gcacucaggacucucaucagua

SEQ ID NO: 580941 - RNA, 23 nt, Human
cagggcugguagggaagagcgug

SEQ ID NO: 580942 - RNA, 22 nt, Human
gggacugggagauccuccuggc

SEQ ID NO: 580943 - RNA, 22 nt, Human
gccccagcucugccacaacuag

SEQ ID NO: 580944 - RNA, 22 nt, Human
ccagggcuucccacgugcccug

SEQ ID NO: 580945 - RNA, 22 nt, Human
agacaaauaacuuuuuaugucc

SEQ ID NO: 580946 - RNA, 22 nt, Human
auuccacacaguaauacucaau

SEQ ID NO: 580947 - RNA, 22 nt, Human
uuacacaaacacauuccagaua

SEQ ID NO: 580948 - RNA, 19 nt, Human
ugcucucuggugcuucaug

SEQ ID NO: 580949 - RNA, 22 nt, Human
acauucauuccaggucagucag

SEQ ID NO: 580950 - RNA, 22 nt, Human
aacaugcuggguguuuuugaug

SEQ ID NO: 580951 - RNA, 22 nt, Human
uucugaaauuucuguagaucuu

SEQ ID NO: 580952 - RNA, 22 nt, Human
agguggagaagagaugggcagu

SEQ ID NO: 580953 - RNA, 22 nt, Human
gugauauuuuuaaagauuaagg

SEQ ID NO: 580954 - RNA, 22 nt, Human
cagcucagucuugaagcacugg

SEQ ID NO: 580955 - RNA, 22 nt, Human
uacccagcaaucccuagagguu

SEQ ID NO: 580956 - RNA, 22 nt, Human
cagcuggcaaguggagcagggu

SEQ ID NO: 580957 - RNA, 22 nt, Human
aggccagaaauuuggaguaugu

SEQ ID NO: 580958 - RNA, 22 nt, Human
agcagaggacaguucuuaggaa

SEQ ID NO: 580959 - RNA, 22 nt, Human
gcccaggaguugaagggcugac

SEQ ID NO: 580960 - RNA, 22 nt, Human
ucaggcugcagcugucagcagc

SEQ ID NO: 580961 - RNA, 20 nt, Human
uccugccacaccucaguugc

SEQ ID NO: 580962 - RNA, 22 nt, Human
augaacaauaaucaugucuaug

SEQ ID NO: 580963 - RNA, 22 nt, Human
aaggcauuggacuaguaucaga

SEQ ID NO: 580964 - RNA, 22 nt, Human
cagcuuuguggccuugaccucg

SEQ ID NO: 580965 - RNA, 22 nt, Human
aggauguguucauagcugacgc

SEQ ID NO: 580966 - RNA, 16 nt, Human
ggcuccagaauagcga

SEQ ID NO: 580967 - RNA, 22 nt, Human
aacauuuccggccuuuuguucu

SEQ ID NO: 580968 - RNA, 22 nt, Human
agaaauacugugagagcagccu

SEQ ID NO: 580969 - RNA, 22 nt, Human
agccaggcgggucuuugcuccu

SEQ ID NO: 580970 - RNA, 22 nt, Human
gccguuagauaauaacaagcau

SEQ ID NO: 580971 - RNA, 22 nt, Human
uguuuuuuuauauaccugaagu

SEQ ID NO: 580972 - RNA, 22 nt, Human
cucugagacucaagugaguggg

SEQ ID NO: 580973 - RNA, 22 nt, Human
uuucuccugcccagaugccugg

SEQ ID NO: 580974 - RNA, 22 nt, Human
cagcuuuguccugcaaaccuga

SEQ ID NO: 580975 - RNA, 22 nt, Human
ccugcacuaccuggggcugcug

SEQ ID NO: 580976 - RNA, 22 nt, Human
guggacaugcauacauauguuu

SEQ ID NO: 580977 - RNA, 22 nt, Human
uuaaagcauguugcuuaacagg

SEQ ID NO: 580978 - RNA, 22 nt, Human
uucauagugacaugcauucugg

SEQ ID NO: 580979 - RNA, 22 nt, Human
ucaguguuugguuucagaauug

SEQ ID NO: 580980 - RNA, 21 nt, Human
cccugguuccacugucaccgc

SEQ ID NO: 580981 - RNA, 22 nt, Human
uagcaaagaccaaagcuaguug

SEQ ID NO: 580982 - RNA, 22 nt, Human
gggauuugugggauggccagug

SEQ ID NO: 580983 - RNA, 23 nt, Human
augacaaacaggacaucuugugc

SEQ ID NO: 580984 - RNA, 22 nt, Human
aaaagcaguuuauagucaguug

SEQ ID NO: 580985 - RNA, 22 nt, Human
uaacagcaaccacagugcuggu

SEQ ID NO: 580986 - RNA, 22 nt, Human
agaggccagaaaguaugccacc

SEQ ID NO: 580987 - RNA, 22 nt, Human
ccagagaguaucauggagagua

SEQ ID NO: 580988 - RNA, 22 nt, Human
ggcagcaaguggugggagacuu

SEQ ID NO: 580989 - RNA, 22 nt, Human
ucaguaaaauuacagaucuaca

SEQ ID NO: 580990 - RNA, 22 nt, Human
cuguuuuaauggagacugaugu

SEQ ID NO: 580991 - RNA, 22 nt, Human
ggguuuuaugguucacuugcaa

SEQ ID NO: 580992 - RNA, 22 nt, Human
gaugcaggauagcuucacccag

SEQ ID NO: 580993 - RNA, 22 nt, Human
ccccaccauguagaaacugaga

SEQ ID NO: 580994 - RNA, 22 nt, Human
uuuaugacccaagaagauacca

SEQ ID NO: 580995 - RNA, 22 nt, Human
cccaggcucccaggugggacaa

SEQ ID NO: 580996 - RNA, 22 nt, Human
uaaaucucacuggguauauugg

SEQ ID NO: 580997 - RNA, 22 nt, Human
gggguggauuucaggcgguguc

SEQ ID NO: 580998 - RNA, 22 nt, Human
accuuauucuugcccuuagaug

SEQ ID NO: 580999 - RNA, 22 nt, Human
caggagacaaguuagcagcuga

SEQ ID NO: 581000 - RNA, 21 nt, Human
uaaauaauaaguugcugagau

SEQ ID NO: 581001 - RNA, 22 nt, Human
ggagagagaccuccaugcccag

SEQ ID NO: 581002 - RNA, 22 nt, Human
ugccuacauuccuugcuuaugg

SEQ ID NO: 581003 - RNA, 22 nt, Human
gguuaucauaguuguuaucagg

SEQ ID NO: 581004 - RNA, 22 nt, Human
gccugaaguuucaugccucuau

SEQ ID NO: 581005 - RNA, 22 nt, Human
cuuuguaaucauucccuugguu

SEQ ID NO: 581006 - RNA, 22 nt, Human
uuugcauuacuugacuuuaguu

SEQ ID NO: 581007 - RNA, 22 nt, Human
gcagauggugccaugucuugug

SEQ ID NO: 581008 - RNA, 22 nt, Human
aaggcagcaacuaauggaucuc

SEQ ID NO: 581009 - RNA, 22 nt, Human
uccuugggucagugagugaggu

SEQ ID NO: 581010 - RNA, 22 nt, Human
uugcaguuucuggaugccuucu

SEQ ID NO: 581011 - RNA, 22 nt, Human
acauagcucagcauaaucgugg

SEQ ID NO: 581012 - RNA, 22 nt, Human
ucccucucuggcuggggugcgg

SEQ ID NO: 581013 - RNA, 20 nt, Human
gcagugcuggugccucugcu

SEQ ID NO: 581014 - RNA, 22 nt, Human
agauggggcucaguguggaggc

SEQ ID NO: 581015 - RNA, 22 nt, Human
aaugcugucuuagcaugaaagc

SEQ ID NO: 581016 - RNA, 22 nt, Human
ggaggucaaauggagggcuggg

SEQ ID NO: 581017 - RNA, 22 nt, Human
ggcuccaguuuccccuuggggc

SEQ ID NO: 581018 - RNA, 22 nt, Human
uuacuaggccaguuuucacuuu

SEQ ID NO: 581019 - RNA, 22 nt, Human
cugucuuuuacuaucauuuacu

SEQ ID NO: 581020 - RNA, 22 nt, Human
ugccucugaggaagauuguguu

SEQ ID NO: 581021 - RNA, 22 nt, Human
uuuagauaaugcucaagcaauu

SEQ ID NO: 581022 - RNA, 22 nt, Human
caagucuagcuuggucacuugg

SEQ ID NO: 581023 - RNA, 22 nt, Human
augagcauccagaacagugccu

SEQ ID NO: 581024 - RNA, 22 nt, Human
acauuguuuggaggagugagag

SEQ ID NO: 581025 - RNA, 22 nt, Human
acaagcuccuuauucagcuggg

SEQ ID NO: 581026 - RNA, 20 nt, Human
cagccuccacucacucagcu

SEQ ID NO: 581027 - RNA, 22 nt, Human
gaggagagaacauuccuccaua

SEQ ID NO: 581028 - RNA, 22 nt, Human
uuuacagaugaggaaacugaga

SEQ ID NO: 581029 - RNA, 22 nt, Human
guucucucucuugccugggugg

SEQ ID NO: 581030 - RNA, 20 nt, Human
aaagugcacagauacagcuc

SEQ ID NO: 581031 - RNA, 19 nt, Human
cugaggugaggggcaucau

SEQ ID NO: 581032 - RNA, 17 nt, Human
agcagcuggcacaggag

SEQ ID NO: 581033 - RNA, 22 nt, Human
uacuguuuucuuuauaguacag

SEQ ID NO: 581034 - RNA, 22 nt, Human
cagugcaguuucccagaugcug

SEQ ID NO: 581035 - RNA, 22 nt, Human
gugcagggagcccagaaggucc

SEQ ID NO: 581036 - RNA, 22 nt, Human
aaaugguaugaaaagagauuuc

SEQ ID NO: 581037 - RNA, 22 nt, Human
uauuccaugccagaguuuauug

SEQ ID NO: 581038 - RNA, 22 nt, Human
aauagcuuaugggauagauguu

SEQ ID NO: 581039 - RNA, 22 nt, Human
gggagacccccaaugccagguc

SEQ ID NO: 581040 - RNA, 22 nt, Human
uggcaggaucuuugagagugaa

SEQ ID NO: 581041 - RNA, 22 nt, Human
ugaaauguuuggguccagaagu

SEQ ID NO: 581042 - RNA, 20 nt, Human
gcacccagcuucuuguucua

SEQ ID NO: 581043 - RNA, 22 nt, Human
uucaggagaaaguucaguacuu

SEQ ID NO: 581044 - RNA, 22 nt, Human
agcugugggccugggagagcug

SEQ ID NO: 581045 - RNA, 20 nt, Human
ucuagcuuagugccugccuc

SEQ ID NO: 581046 - RNA, 22 nt, Human
ucaacaaauacuuaaagcagag

SEQ ID NO: 581047 - RNA, 18 nt, Human
ccagcugugcagcaucug

SEQ ID NO: 581048 - RNA, 22 nt, Human
acaguaaagccuucugguugac

SEQ ID NO: 581049 - RNA, 22 nt, Human
caguccuuagucuggauggcuu

SEQ ID NO: 581050 - RNA, 22 nt, Human
cuguauaauucaugcucuuauu

SEQ ID NO: 581051 - RNA, 22 nt, Human
ggccugagcucuggggaggcaa

SEQ ID NO: 581052 - RNA, 22 nt, Human
cauagaauaugugugauuguua

SEQ ID NO: 581053 - RNA, 22 nt, Human
ccuguacuagggucucauugcc

SEQ ID NO: 581054 - RNA, 22 nt, Human
ucacacugugaagagacaagca

SEQ ID NO: 581055 - RNA, 22 nt, Human
gcauuuuauaaagaguuauuug

SEQ ID NO: 581056 - RNA, 22 nt, Human
aauucauugccagaaucuauga

SEQ ID NO: 581057 - RNA, 22 nt, Human
accacauuucugaauagcauaa

SEQ ID NO: 581058 - RNA, 22 nt, Human
aggugucugggcuuuggaguca

SEQ ID NO: 581059 - RNA, 22 nt, Human
aacucacacaaguauugccugc

SEQ ID NO: 581060 - RNA, 22 nt, Human
uccugccucuuuucuuauucca

SEQ ID NO: 581061 - RNA, 22 nt, Human
cagcuucugagcaagccagggg

SEQ ID NO: 581062 - RNA, 18 nt, Human
caauagaaacaguaggaa

SEQ ID NO: 581063 - RNA, 22 nt, Human
uggcuucucccucugccugauu

SEQ ID NO: 581064 - RNA, 22 nt, Human
ugcgauggcguagacaaauccc

SEQ ID NO: 581065 - RNA, 21 nt, Human
ccuggcugcacaguugcuggu

SEQ ID NO: 581066 - RNA, 22 nt, Human
gcugcaggaugaggcucugcuc

SEQ ID NO: 581067 - RNA, 22 nt, Human
auguaugucugcauacacauac

SEQ ID NO: 581068 - RNA, 22 nt, Human
cccaaagcagggucauugggcc

SEQ ID NO: 581069 - RNA, 22 nt, Human
gggcaucuucuguagccaucuc

SEQ ID NO: 581070 - RNA, 22 nt, Human
cuccugggcuucgaaggcuccc

SEQ ID NO: 581071 - RNA, 22 nt, Human
cuggccucaccucagacuuacu

SEQ ID NO: 581072 - RNA, 22 nt, Human
ugucucuuggcucuaucacuua

SEQ ID NO: 581073 - RNA, 22 nt, Human
agugggcagcccaggaggucuu

SEQ ID NO: 581074 - RNA, 22 nt, Human
uggccaagccacugcugggucu

SEQ ID NO: 581075 - RNA, 22 nt, Human
auuuuuaugacaaaccauccuc

SEQ ID NO: 581076 - RNA, 22 nt, Human
accacuguacagcagauauagu

SEQ ID NO: 581077 - RNA, 22 nt, Human
auaccauuguuucuaccagcug

SEQ ID NO: 581078 - RNA, 22 nt, Human
cagagugaacagugggaugugc

SEQ ID NO: 581079 - RNA, 22 nt, Human
ugcuggagaagcuccugggacu

SEQ ID NO: 581080 - RNA, 22 nt, Human
uggcagaggaggcucagauuga

SEQ ID NO: 581081 - RNA, 22 nt, Human
ggcucugcuuccuggaauugug

SEQ ID NO: 581082 - RNA, 22 nt, Human
cccaaggccucuccuuggcuug

SEQ ID NO: 581083 - RNA, 22 nt, Human
agccugggagacacuaaguugu

SEQ ID NO: 581084 - RNA, 22 nt, Human
aaggacaggcacagugguggag

SEQ ID NO: 581085 - RNA, 22 nt, Human
aagccuuuuccaccuaauagag

SEQ ID NO: 581086 - RNA, 22 nt, Human
cagcuuccaucuccacugcccu

SEQ ID NO: 581087 - RNA, 22 nt, Human
uuucaagaauugaagaggauuu

SEQ ID NO: 581088 - RNA, 22 nt, Human
gcacccagggacuuggcuggcc

SEQ ID NO: 581089 - RNA, 22 nt, Human
aagugugggaaguagguggcga

SEQ ID NO: 581090 - RNA, 22 nt, Human
uuuaucuguauaucucaagugu

SEQ ID NO: 581091 - RNA, 22 nt, Human
uuuagcuucuucagcuuguuca

SEQ ID NO: 581092 - RNA, 22 nt, Human
aggaguuuggggauuagucagg

SEQ ID NO: 581093 - RNA, 22 nt, Human
ugaggguaaccuggagcugcug

SEQ ID NO: 581094 - RNA, 22 nt, Human
aaacuacacuuugggaccagca

SEQ ID NO: 581095 - RNA, 22 nt, Human
uggcaguuauuaaucaagucuu

SEQ ID NO: 581096 - RNA, 22 nt, Human
ucugagcuucugcauuuccaac

SEQ ID NO: 581097 - RNA, 22 nt, Human
agcccucauggaacagcuccua

SEQ ID NO: 581098 - RNA, 22 nt, Human
auuuugauaaucauguuagaga

SEQ ID NO: 581099 - RNA, 20 nt, Human
gcagcugcccccagucccug

SEQ ID NO: 581100 - RNA, 22 nt, Human
aggaagcuccuggagagccagu

SEQ ID NO: 581101 - RNA, 22 nt, Human
uaaagguaugucuuaaucaaac

SEQ ID NO: 581102 - RNA, 22 nt, Human
gcuggugauugccucaggaggc

SEQ ID NO: 581103 - RNA, 22 nt, Human
ccuacagacaaaccagugacua

SEQ ID NO: 581104 - RNA, 17 nt, Human
ugugcucucucacucag

SEQ ID NO: 581105 - RNA, 22 nt, Human
aggucagaaaaggagagcauug

SEQ ID NO: 581106 - RNA, 22 nt, Human
caggcagccaggggaccugucc

SEQ ID NO: 581107 - RNA, 22 nt, Human
uauucauuaugaccaaaucuag

SEQ ID NO: 581108 - RNA, 18 nt, Human
gcccagaggucugggccc

SEQ ID NO: 581109 - RNA, 22 nt, Human
cggcugagcagugcugauggaa

SEQ ID NO: 581110 - RNA, 22 nt, Human
acagccaggaggaacucaguga

SEQ ID NO: 581111 - RNA, 22 nt, Human
ggaggaggggugacugaaugcu

SEQ ID NO: 581112 - RNA, 22 nt, Human
uuuguguuuucacuagcagugu

SEQ ID NO: 581113 - RNA, 22 nt, Human
gucuccuuguggaucucaagga

SEQ ID NO: 581114 - RNA, 17 nt, Human
ggcugugccaggugaga

SEQ ID NO: 581115 - RNA, 22 nt, Human
agcuguguagggaaucagagaa

SEQ ID NO: 581116 - RNA, 22 nt, Human
acaccuuugugaagugaugaug

SEQ ID NO: 581117 - RNA, 22 nt, Human
ugugcuucugcagagacuauuu

SEQ ID NO: 581118 - RNA, 23 nt, Human
acagaguacagugugcuuagugg

SEQ ID NO: 581119 - RNA, 22 nt, Human
gacccaggggcagggagaaagu

SEQ ID NO: 581120 - RNA, 21 nt, Human
acugugauaaugcuuuuucug

SEQ ID NO: 581121 - RNA, 22 nt, Human
guggcucaguuaacuuccaugu

SEQ ID NO: 581122 - RNA, 19 nt, Human
aggaaggaaccugagucug

SEQ ID NO: 581123 - RNA, 22 nt, Human
uuuggccuuguguucucuccau

SEQ ID NO: 581124 - RNA, 22 nt, Human
ccugaggcuuaaucugucccaa

SEQ ID NO: 581125 - RNA, 22 nt, Human
ucuuaugaaaagcacuuagaac

SEQ ID NO: 581126 - RNA, 22 nt, Human
uuucugcuuucagagugagaca

SEQ ID NO: 581127 - RNA, 22 nt, Human
gugcagggcagccgaaugggcu

SEQ ID NO: 581128 - RNA, 22 nt, Human
uucucuggagaguaucuucuua

SEQ ID NO: 581129 - RNA, 22 nt, Human
auugaaagcauggauuuggauu

SEQ ID NO: 581130 - RNA, 22 nt, Human
gggcugagcuaagcuggguuga

SEQ ID NO: 581131 - RNA, 22 nt, Human
aacaaguguauuaauggaaaua

SEQ ID NO: 581132 - RNA, 22 nt, Human
caugcagauauuuuuauugugg

SEQ ID NO: 581133 - RNA, 22 nt, Human
ucuuuagcuagaaauacucuaa

SEQ ID NO: 581134 - RNA, 22 nt, Human
gagagggccagggugagaacua

SEQ ID NO: 581135 - RNA, 22 nt, Human
auauaauucucagguuugacua

SEQ ID NO: 581136 - RNA, 19 nt, Human
aggaaaggaucaaaauagc

SEQ ID NO: 581137 - RNA, 22 nt, Human
cagcagucaggcaaaugggagg

SEQ ID NO: 581138 - RNA, 22 nt, Human
guuucaaagucagaaaaggagg

SEQ ID NO: 581139 - RNA, 22 nt, Human
aggcucugcaguccaucccgug

SEQ ID NO: 581140 - RNA, 22 nt, Human
aggcacugaagaacucuuuuug

SEQ ID NO: 581141 - RNA, 22 nt, Human
ggccucaguuucuucaacugua

SEQ ID NO: 581142 - RNA, 22 nt, Human
cuauauucuggaauguccauuu

SEQ ID NO: 581143 - RNA, 22 nt, Human
guuuccuuucuauugccuugau

SEQ ID NO: 581144 - RNA, 20 nt, Human
gccucagccaacccaugggg

SEQ ID NO: 581145 - RNA, 22 nt, Human
cccaggaggccaagguugcagu

SEQ ID NO: 581146 - RNA, 22 nt, Human
agcgcgcucgaugguuuccgcg

SEQ ID NO: 581147 - RNA, 22 nt, Human
ucagaagcauccauuucaccac

SEQ ID NO: 581148 - RNA, 22 nt, Human
uuagcaucugcuguaagcuuau

SEQ ID NO: 581149 - RNA, 22 nt, Human
uuauggaaaugaaauuuuauug

SEQ ID NO: 581150 - RNA, 22 nt, Human
ggagccagagcacuggggagcc

SEQ ID NO: 581151 - RNA, 22 nt, Human
uagaaagcccuguguucacugc

SEQ ID NO: 581152 - RNA, 22 nt, Human
gcagcugaaagggaucucuaca

SEQ ID NO: 581153 - RNA, 22 nt, Human
uacuucccacuggggucuacca

SEQ ID NO: 581154 - RNA, 22 nt, Human
aggcaucugcugcccuucugga

SEQ ID NO: 581155 - RNA, 22 nt, Human
acagguccuuauaagagcacuc

SEQ ID NO: 581156 - RNA, 20 nt, Human
caaggcagaccagagugagu

SEQ ID NO: 581157 - RNA, 22 nt, Human
aagcucagagucucggagggaa

SEQ ID NO: 581158 - RNA, 22 nt, Human
cccugagagugagugccaccuu

SEQ ID NO: 581159 - RNA, 22 nt, Human
uguuuuaucaagauggcauguc

SEQ ID NO: 581160 - RNA, 22 nt, Human
gagcugccaagauuacaaucag

SEQ ID NO: 581161 - RNA, 22 nt, Human
aaucacauuuacauugcuaauu

SEQ ID NO: 581162 - RNA, 22 nt, Human
agcagaagaaagccacaugacu

SEQ ID NO: 581163 - RNA, 22 nt, Human
gugcuaggauuacaggcauggg

SEQ ID NO: 581164 - RNA, 22 nt, Human
aggcagcuggcagcacccaggg

SEQ ID NO: 581165 - RNA, 22 nt, Human
gcucccagauuucagccuugug

SEQ ID NO: 581166 - RNA, 22 nt, Human
ggcucaggacacagugguuuag

SEQ ID NO: 581167 - RNA, 22 nt, Human
uuauuaauacaugcaccugcau

SEQ ID NO: 581168 - RNA, 22 nt, Human
uuaagagggugaugcuagcauu

SEQ ID NO: 581169 - RNA, 22 nt, Human
cuaacgaauauguaugcauguu

SEQ ID NO: 581170 - RNA, 22 nt, Human
uaauuuacuugcaaauaacaau

SEQ ID NO: 581171 - RNA, 22 nt, Human
cauaaaauggcuuguucuuuaa

SEQ ID NO: 581172 - RNA, 22 nt, Human
gaggcccagcagcgcaggucuu

SEQ ID NO: 581173 - RNA, 22 nt, Human
uauagugugugagagagugaaa

SEQ ID NO: 581174 - RNA, 22 nt, Human
ugcuuccagcucucuguaaggu

SEQ ID NO: 581175 - RNA, 22 nt, Human
cuuguuuuuaagagauguuuac

SEQ ID NO: 581176 - RNA, 22 nt, Human
augugcuugcagaugagccuca

SEQ ID NO: 581177 - RNA, 22 nt, Human
ggcuggucccggguccuccggc

SEQ ID NO: 581178 - RNA, 22 nt, Human
cagagucuuguguguucagccc

SEQ ID NO: 581179 - RNA, 22 nt, Human
augagcuguaagguggcuuccu

SEQ ID NO: 581180 - RNA, 22 nt, Human
uucuucugaaacauaaucaaua

SEQ ID NO: 581181 - RNA, 22 nt, Human
agcuuaggaggaugaugaacau

SEQ ID NO: 581182 - RNA, 22 nt, Human
aggcuucuugagccccacaggc

SEQ ID NO: 581183 - RNA, 22 nt, Human
guacaaaugcagguuuguuaca

SEQ ID NO: 581184 - RNA, 22 nt, Human
aacacuguaucagucuucaaua

SEQ ID NO: 581185 - RNA, 22 nt, Human
cagcuauucucugaaaugaaua

SEQ ID NO: 581186 - RNA, 22 nt, Human
aguggguggcgcagaggaggaa

SEQ ID NO: 581187 - RNA, 22 nt, Human
ugcucugucaagaaaagaugcc

SEQ ID NO: 581188 - RNA, 22 nt, Human
gugccagggggcacugaacaga

SEQ ID NO: 581189 - RNA, 22 nt, Human
gauggcccgcuagcuggccucu

SEQ ID NO: 581190 - RNA, 22 nt, Human
aggcaugcgccaauuuauuaga

SEQ ID NO: 581191 - RNA, 22 nt, Human
aggccaggacacuuaaguaaga

SEQ ID NO: 581192 - RNA, 23 nt, Human
ccacagcuauaggguagugcagu

SEQ ID NO: 581193 - RNA, 22 nt, Human
ccuccuggguucaagcgauucu

SEQ ID NO: 581194 - RNA, 22 nt, Human
agaauuugguaguuauuuuugg

SEQ ID NO: 581195 - RNA, 22 nt, Human
agugaaaagaugcauuucucug

SEQ ID NO: 581196 - RNA, 22 nt, Human
cagggcuguggaaaacuggugc

SEQ ID NO: 581197 - RNA, 22 nt, Human
cuggagcugggcuaggguagga

SEQ ID NO: 581198 - RNA, 22 nt, Human
gaggcacaguguuuggucagug

SEQ ID NO: 581199 - RNA, 22 nt, Human
acaggauuagcaaguaaucagg

SEQ ID NO: 581200 - RNA, 22 nt, Human
uacauauucaacguucaguauu

SEQ ID NO: 581201 - RNA, 19 nt, Human
gcauuucucuuuacagcca

SEQ ID NO: 581202 - RNA, 22 nt, Human
aagacuuucucccaaauccuca

SEQ ID NO: 581203 - RNA, 22 nt, Human
aagauuuacuuucuuuguaaua

SEQ ID NO: 581204 - RNA, 22 nt, Human
aguaccauuacucacuuauuuu

SEQ ID NO: 581205 - RNA, 20 nt, Human
cagaggcaaggagacuugga

SEQ ID NO: 581206 - RNA, 21 nt, Human
ggggccucuccacacagccgg

SEQ ID NO: 581207 - RNA, 22 nt, Human
aacuuuaaaaaauaugucuguu

SEQ ID NO: 581208 - RNA, 22 nt, Human
aaugaacaacacugaaggaaga

SEQ ID NO: 581209 - RNA, 22 nt, Human
agcaacauuuuucaauuaacau

SEQ ID NO: 581210 - RNA, 22 nt, Human
ucacuguuagagcaaacguaug

SEQ ID NO: 581211 - RNA, 22 nt, Human
ucuguccauucagaauggcccu

SEQ ID NO: 581212 - RNA, 22 nt, Human
ucuugaaggggggcaguguuga

SEQ ID NO: 581213 - RNA, 19 nt, Human
agggaaggauucugucauu

SEQ ID NO: 581214 - RNA, 20 nt, Human
ggggaagaaaaggaugugau

SEQ ID NO: 581215 - RNA, 22 nt, Human
agccccuuggaacacagggcug

SEQ ID NO: 581216 - RNA, 22 nt, Human
uaacaucuuuagcagcucgaac

SEQ ID NO: 581217 - RNA, 22 nt, Human
auaaaaguuuccaaucaugccu

SEQ ID NO: 581218 - RNA, 22 nt, Human
uggcccagugcuuaugcucuga

SEQ ID NO: 581219 - RNA, 22 nt, Human
aagaguuauaguugguaugugg

SEQ ID NO: 581220 - RNA, 22 nt, Human
uuuuaauuuugcaaaucuggug

SEQ ID NO: 581221 - RNA, 22 nt, Human
uuuguucacugagcaaugauua

SEQ ID NO: 581222 - RNA, 22 nt, Human
gccucuccgagccacugccucu

SEQ ID NO: 581223 - RNA, 22 nt, Human
augcagggaccuuugcuuuggu

SEQ ID NO: 581224 - RNA, 22 nt, Human
aggcuuuaauuaucuacaggag

SEQ ID NO: 581225 - RNA, 22 nt, Human
caguggcagaucaccaacugga

SEQ ID NO: 581226 - RNA, 22 nt, Human
uuccugggcugcagagagcacc

SEQ ID NO: 581227 - RNA, 22 nt, Human
agcaggaacucagggaguucuc

SEQ ID NO: 581228 - RNA, 22 nt, Human
uggugcaagucucugaggaggg

SEQ ID NO: 581229 - RNA, 22 nt, Human
uccuggugcugacacccauagc

SEQ ID NO: 581230 - RNA, 20 nt, Human
cauuucauugugucuucacu

SEQ ID NO: 581231 - RNA, 22 nt, Human
aauaaaguguauucuuugucau

SEQ ID NO: 581232 - RNA, 22 nt, Human
gccuaggagacaagcgugaaag

SEQ ID NO: 581233 - RNA, 22 nt, Human
uguguuggcugccggcacagga

SEQ ID NO: 581234 - RNA, 22 nt, Human
gcagaggugaguuucucagcug

SEQ ID NO: 581235 - RNA, 22 nt, Human
aauggcuuauguaaugcuguuu

SEQ ID NO: 581236 - RNA, 22 nt, Human
ggcccugagcugaaguacugug

SEQ ID NO: 581237 - RNA, 22 nt, Human
aauuaagagagaguugaagcaa

SEQ ID NO: 581238 - RNA, 22 nt, Human
augauucuggugagaaugagga

SEQ ID NO: 581239 - RNA, 18 nt, Human
acaggcugugggaauggu

SEQ ID NO: 581240 - RNA, 22 nt, Human
ucucugaauaaugcuauucuuu

SEQ ID NO: 581241 - RNA, 22 nt, Human
gguggggcucagcaaucugugu

SEQ ID NO: 581242 - RNA, 21 nt, Human
aggagggcacaaggccaggaa

SEQ ID NO: 581243 - RNA, 22 nt, Human
auugcaguguguguuccaugag

SEQ ID NO: 581244 - RNA, 22 nt, Human
ccccacaacucauguugaaacu

SEQ ID NO: 581245 - RNA, 22 nt, Human
aguaacauuuagcuucucacug

SEQ ID NO: 581246 - RNA, 22 nt, Human
gcuacaguagauaaggacgguc

SEQ ID NO: 581247 - RNA, 22 nt, Human
ccacagaaccucagcuuugagc

SEQ ID NO: 581248 - RNA, 22 nt, Human
caaauuaaugugucucaaaaua

SEQ ID NO: 581249 - RNA, 22 nt, Human
acccugagccaaaccaguuaga

SEQ ID NO: 581250 - RNA, 22 nt, Human
aagcccagcugaaagcauuuuu

SEQ ID NO: 581251 - RNA, 22 nt, Human
gagcuucagagaccacuuaacu

SEQ ID NO: 581252 - RNA, 22 nt, Human
guugaggagguucagggugguu

SEQ ID NO: 581253 - RNA, 22 nt, Human
ugggaagaugauaauucacagu

SEQ ID NO: 581254 - RNA, 22 nt, Human
ccagcccuugagauggaaggga

SEQ ID NO: 581255 - RNA, 22 nt, Human
uccuucagaaaaccucagucuu

SEQ ID NO: 581256 - RNA, 22 nt, Human
uggacaggaucugagacugaga

SEQ ID NO: 581257 - RNA, 22 nt, Human
ucuuagcacagcuauauaaguu

SEQ ID NO: 581258 - RNA, 22 nt, Human
augggcuguccuaguccagccc

SEQ ID NO: 581259 - RNA, 18 nt, Human
augcauauuuuaaguugu

SEQ ID NO: 581260 - RNA, 22 nt, Human
aguggcauuuuaauggauguca

SEQ ID NO: 581261 - RNA, 22 nt, Human
guggccauuuggaaggcaagua

SEQ ID NO: 581262 - RNA, 22 nt, Human
cugucucucuaggacacugggg

SEQ ID NO: 581263 - RNA, 15 nt, Human
uuucaaaaugaggcc

SEQ ID NO: 581264 - RNA, 22 nt, Human
ugugugugugcgcgcacgcaua

SEQ ID NO: 581265 - RNA, 22 nt, Human
uugugaaaagccgcaaguauag

SEQ ID NO: 581266 - RNA, 22 nt, Human
gccuggagugcaguggcgugau

SEQ ID NO: 581267 - RNA, 22 nt, Human
uaaacauuuguuauucuuguuu

SEQ ID NO: 581268 - RNA, 22 nt, Human
auaucacaguaguuguuuaguu

SEQ ID NO: 581269 - RNA, 22 nt, Human
agcgcaggaacacgucugccuu

SEQ ID NO: 581270 - RNA, 20 nt, Human
guggcaggcagugaaggagc

SEQ ID NO: 581271 - RNA, 17 nt, Human
gugcagggaugaaggau

SEQ ID NO: 581272 - RNA, 23 nt, Human
cccaggagccugaguccucucug

SEQ ID NO: 581273 - RNA, 22 nt, Human
agguauuuaugagagcacauau

SEQ ID NO: 581274 - RNA, 22 nt, Human
gaauuuuagaauaugugggcuu

SEQ ID NO: 581275 - RNA, 22 nt, Human
ggcucaccauggccucccugcu

SEQ ID NO: 581276 - RNA, 22 nt, Human
cucugacaccaucucaugacag

SEQ ID NO: 581277 - RNA, 22 nt, Human
ggcugagaagacaguggggugg

SEQ ID NO: 581278 - RNA, 22 nt, Human
ugggaaggcguggaaguagaag

SEQ ID NO: 581279 - RNA, 22 nt, Human
gcugccaccguggagaugagug

SEQ ID NO: 581280 - RNA, 22 nt, Human
ccugugggucacaugggugacu

SEQ ID NO: 581281 - RNA, 22 nt, Human
auuuaugacguguucggucaau

SEQ ID NO: 581282 - RNA, 22 nt, Human
uuuucuauucauugucuauggu

SEQ ID NO: 581283 - RNA, 22 nt, Human
uuuucaagggcagggaaaucau

SEQ ID NO: 581284 - RNA, 22 nt, Human
cacugccuggaaggagagacau

SEQ ID NO: 581285 - RNA, 18 nt, Human
ggcagugcagucucaggg

SEQ ID NO: 581286 - RNA, 22 nt, Human
aaauauaauuucugccucaaua

SEQ ID NO: 581287 - RNA, 22 nt, Human
uuugucuuaaaucuuguuacug

SEQ ID NO: 581288 - RNA, 22 nt, Human
gggccugagacugagggugagg

SEQ ID NO: 581289 - RNA, 22 nt, Human
uggcccugacuuggaggccuga

SEQ ID NO: 581290 - RNA, 18 nt, Human
aagcugcccucaggcagg

SEQ ID NO: 581291 - RNA, 22 nt, Human
aauacuuaugugaccucauuuu

SEQ ID NO: 581292 - RNA, 22 nt, Human
guuugaaaguggcaaguccuug

SEQ ID NO: 581293 - RNA, 22 nt, Human
acaaagcuuagaccuaagagau

SEQ ID NO: 581294 - RNA, 22 nt, Human
gauguuucaugcuagcaugugu

SEQ ID NO: 581295 - RNA, 22 nt, Human
ccuuugugaauaugcagaaaau

SEQ ID NO: 581296 - RNA, 22 nt, Human
aacaucuuguacugcacauuuu

SEQ ID NO: 581297 - RNA, 22 nt, Human
ugcugaggaauaauuguuccug

SEQ ID NO: 581298 - RNA, 22 nt, Human
acauucauggguuuuacauuau

SEQ ID NO: 581299 - RNA, 22 nt, Human
uuauuaugccauuaccucccug

SEQ ID NO: 581300 - RNA, 22 nt, Human
cccuggaggucagaggccuggg

SEQ ID NO: 581301 - RNA, 22 nt, Human
ugcuuaaacacauacauacaua

SEQ ID NO: 581302 - RNA, 22 nt, Human
cagaauacccuauagacagaau

SEQ ID NO: 581303 - RNA, 22 nt, Human
ucagaauauauucauguuguca

SEQ ID NO: 581304 - RNA, 22 nt, Human
uguugauuaguguuuagacuua

SEQ ID NO: 581305 - RNA, 22 nt, Human
aagcaauguguuaaugaaugag

SEQ ID NO: 581306 - RNA, 22 nt, Human
acugcucaaggaucugguaggg

SEQ ID NO: 581307 - RNA, 22 nt, Human
gagcugccaguguaugaauucu

SEQ ID NO: 581308 - RNA, 22 nt, Human
gcuggagcgugauccuugaucu

SEQ ID NO: 581309 - RNA, 22 nt, Human
cugagaaauucuuucuuucacu

SEQ ID NO: 581310 - RNA, 22 nt, Human
caauuaaagaagaccugccuca

SEQ ID NO: 581311 - RNA, 22 nt, Human
uucucauucugacucaguguag

SEQ ID NO: 581312 - RNA, 22 nt, Human
uaugaagacaaugauagcauga

SEQ ID NO: 581313 - RNA, 22 nt, Human
ugcagggcaucuuugaagugug

SEQ ID NO: 581314 - RNA, 22 nt, Human
ugaggcucaagaauagacagua

SEQ ID NO: 581315 - RNA, 17 nt, Human
cucuuuugucuucuucc

SEQ ID NO: 581316 - RNA, 22 nt, Human
caggaagauuagaccaagagcu

SEQ ID NO: 581317 - RNA, 22 nt, Human
guuucucaaauuauuucagcuu

SEQ ID NO: 581318 - RNA, 22 nt, Human
auguuuauggagcagguauuag

SEQ ID NO: 581319 - RNA, 22 nt, Human
uuucaauguaacauuuccaggc

SEQ ID NO: 581320 - RNA, 22 nt, Human
aaaugcuugcucuugauuauuu

SEQ ID NO: 581321 - RNA, 22 nt, Human
ucugggauuuuauagacaugcu

SEQ ID NO: 581322 - RNA, 22 nt, Human
auccacucccuaacaccauguu

SEQ ID NO: 581323 - RNA, 22 nt, Human
acuggcagccacaacuggcagg

SEQ ID NO: 581324 - RNA, 22 nt, Human
uauguacaucguugaauucaaa

SEQ ID NO: 581325 - RNA, 22 nt, Human
cuaugaccccagcaugaauaag

SEQ ID NO: 581326 - RNA, 22 nt, Human
auacacaggugcuaggucaaua

SEQ ID NO: 581327 - RNA, 22 nt, Human
gaaaauguuuccuguuauuugc

SEQ ID NO: 581328 - RNA, 22 nt, Human
aagggcuggucuagaaagggag

SEQ ID NO: 581329 - RNA, 22 nt, Human
aaauauuagggagaacagggac

SEQ ID NO: 581330 - RNA, 22 nt, Human
aauuccaaguagcaucccauca

SEQ ID NO: 581331 - RNA, 22 nt, Human
aagggcuguaagccaaguaaag

SEQ ID NO: 581332 - RNA, 22 nt, Human
ucugaaauuuuaguuauagaaa

SEQ ID NO: 581333 - RNA, 22 nt, Human
uguucuuacggaacuuaucuuu

SEQ ID NO: 581334 - RNA, 22 nt, Human
caguuuuaggacauguggaugu

SEQ ID NO: 581335 - RNA, 22 nt, Human
uggagugaaguaaagaggacaa

SEQ ID NO: 581336 - RNA, 22 nt, Human
cagcucuggcagagcccaaccc

SEQ ID NO: 581337 - RNA, 22 nt, Human
gcaugcugcaccagagccucuc

SEQ ID NO: 581338 - RNA, 22 nt, Human
acaggcuugcacuaggguggca

SEQ ID NO: 581339 - RNA, 22 nt, Human
agggcuggccacaugauuuggu

SEQ ID NO: 581340 - RNA, 22 nt, Human
auuugcauuuagaaagaucacu

SEQ ID NO: 581341 - RNA, 22 nt, Human
uuucagaaaacuuaucaucagu

SEQ ID NO: 581342 - RNA, 22 nt, Human
gaggagcacaugaggcugaggg

SEQ ID NO: 581343 - RNA, 22 nt, Human
auuucaguguugguuagcaagc

SEQ ID NO: 581344 - RNA, 22 nt, Human
uuuccacugggcacggggccag

SEQ ID NO: 581345 - RNA, 22 nt, Human
cagacagaaggcuccuugaggu

SEQ ID NO: 581346 - RNA, 22 nt, Human
acaguguuucacuuaaccguuu

SEQ ID NO: 581347 - RNA, 22 nt, Human
gggcucugggauucagagcaag

SEQ ID NO: 581348 - RNA, 22 nt, Human
ugucuccucaacucaugcucga

SEQ ID NO: 581349 - RNA, 22 nt, Human
agcuuuuaguacguuaaaauug

SEQ ID NO: 581350 - RNA, 22 nt, Human
accaggagucuagccuagucaa

SEQ ID NO: 581351 - RNA, 22 nt, Human
ccaggucuggaaccaccagggc

SEQ ID NO: 581352 - RNA, 21 nt, Human
gccugcccucugugauggcca

SEQ ID NO: 581353 - RNA, 22 nt, Human
cagguggaucucuaaggacuga

SEQ ID NO: 581354 - RNA, 22 nt, Human
aggcuaaggagugugaugcuca

SEQ ID NO: 581355 - RNA, 22 nt, Human
guugaggagcaagcaugugucu

SEQ ID NO: 581356 - RNA, 22 nt, Human
uccugaaauucugguugucacu

SEQ ID NO: 581357 - RNA, 22 nt, Human
gccagguggcugagcagcugca

SEQ ID NO: 581358 - RNA, 18 nt, Human
cugaggccaacuacacug

SEQ ID NO: 581359 - RNA, 22 nt, Human
uuucaaacuuuacucuugaauc

SEQ ID NO: 581360 - RNA, 22 nt, Human
agggcagcagcggcccaggccu

SEQ ID NO: 581361 - RNA, 22 nt, Human
aaagguuugcauggaauuuacc

SEQ ID NO: 581362 - RNA, 22 nt, Human
uuccuucucuguggggaaggca

SEQ ID NO: 581363 - RNA, 21 nt, Human
aggggaaguagaguuuugauu

SEQ ID NO: 581364 - RNA, 22 nt, Human
ucagaacauuaaggauuugaag

SEQ ID NO: 581365 - RNA, 21 nt, Human
uugauuuuaggaaguuuguca

SEQ ID NO: 581366 - RNA, 19 nt, Human
cagagcugcuggccucguc

SEQ ID NO: 581367 - RNA, 22 nt, Human
agcugcagauucuaucuagaag

SEQ ID NO: 581368 - RNA, 17 nt, Human
agcagaagucagaggga

SEQ ID NO: 581369 - RNA, 22 nt, Human
guugaaagaugucuugguuccc

SEQ ID NO: 581370 - RNA, 22 nt, Human
uugcauuugagaaaguucuccu

SEQ ID NO: 581371 - RNA, 22 nt, Human
uaguaucuuucuauauuuccca

SEQ ID NO: 581372 - RNA, 22 nt, Human
ccucagucuugaauuagccaga

SEQ ID NO: 581373 - RNA, 21 nt, Human
gauaaagcagcuugccuaagg

SEQ ID NO: 581374 - RNA, 20 nt, Human
aauguauaugugaccccaaa

SEQ ID NO: 581375 - RNA, 22 nt, Human
aggugggacccguggggugcga

SEQ ID NO: 581376 - RNA, 22 nt, Human
ccacaaaacugugugucaaaga

SEQ ID NO: 581377 - RNA, 23 nt, Human
agaagcaaugcuuuuuuuccucu

SEQ ID NO: 581378 - RNA, 22 nt, Human
uccuucuuugacaaguggcaga

SEQ ID NO: 581379 - RNA, 22 nt, Human
auuuguaucaaucucaauauau

SEQ ID NO: 581380 - RNA, 22 nt, Human
ccaguguucaucaagaaaaugu

SEQ ID NO: 581381 - RNA, 22 nt, Human
aguaacagaaggccugacuuaa

SEQ ID NO: 581382 - RNA, 22 nt, Human
gccuccaggguagaggaggaag

SEQ ID NO: 581383 - RNA, 22 nt, Human
gugggcaguuggugauucucgu

SEQ ID NO: 581384 - RNA, 23 nt, Human
uguguguguauucuacgcaaggu

SEQ ID NO: 581385 - RNA, 22 nt, Human
ggcaggcaggucuucauggccc

SEQ ID NO: 581386 - RNA, 22 nt, Human
aaguaugugauacauguuaauu

SEQ ID NO: 581387 - RNA, 22 nt, Human
cccaggcuggcacugcugaagu

SEQ ID NO: 581388 - RNA, 22 nt, Human
uguauuuuuaggaaugcgcuau

SEQ ID NO: 581389 - RNA, 22 nt, Human
aaagcaguaugaaaggcaauaa

SEQ ID NO: 581390 - RNA, 22 nt, Human
uaacagaaacagauaaguguaa

SEQ ID NO: 581391 - RNA, 22 nt, Human
cagaggccuggcuuggacaccu

SEQ ID NO: 581392 - RNA, 20 nt, Human
ugcugcugcuucacccccau

SEQ ID NO: 581393 - RNA, 22 nt, Human
gugggagaaauuagcucuaguu

SEQ ID NO: 581394 - RNA, 22 nt, Human
gagcaagauccuguuuuucuau

SEQ ID NO: 581395 - RNA, 22 nt, Human
cugucuuugguccugucuguua

SEQ ID NO: 581396 - RNA, 22 nt, Human
ugugguggcuauucuggucuca

SEQ ID NO: 581397 - RNA, 22 nt, Human
ggagccuguuaguugagugcuc

SEQ ID NO: 581398 - RNA, 22 nt, Human
gacacagaugaucaggugugga

SEQ ID NO: 581399 - RNA, 22 nt, Human
ccugucaggguuugccucagaa

SEQ ID NO: 581400 - RNA, 22 nt, Human
gagagaagaaagccaugguccu

SEQ ID NO: 581401 - RNA, 22 nt, Human
aaaugcuguaacugauauucug

SEQ ID NO: 581402 - RNA, 22 nt, Human
auauguuuugugcuucauuggu

SEQ ID NO: 581403 - RNA, 22 nt, Human
auuagcuauaugcuaugugcca

SEQ ID NO: 581404 - RNA, 22 nt, Human
ccauccugcaggaccuccauau

SEQ ID NO: 581405 - RNA, 22 nt, Human
augugcuucauaaucuucucau

SEQ ID NO: 581406 - RNA, 22 nt, Human
uaaguacaaauguauacauaag

SEQ ID NO: 581407 - RNA, 21 nt, Human
ccucuggcuugugcugugccc

SEQ ID NO: 581408 - RNA, 22 nt, Human
agguggcucugacagcucuggu

SEQ ID NO: 581409 - RNA, 22 nt, Human
caggugaguaacaaugggugau

SEQ ID NO: 581410 - RNA, 22 nt, Human
caguccugggcaggucaggcca

SEQ ID NO: 581411 - RNA, 22 nt, Human
acaguggaugacauccuuuugc

SEQ ID NO: 581412 - RNA, 22 nt, Human
caggggcuuuuccucuauaagg

SEQ ID NO: 581413 - RNA, 22 nt, Human
agagagggaauauuugggguau

SEQ ID NO: 581414 - RNA, 19 nt, Human
guguggcagagagugacca

SEQ ID NO: 581415 - RNA, 22 nt, Human
aagcuucaguucuggggcaaug

SEQ ID NO: 581416 - RNA, 22 nt, Human
agagggcugcugcacagugcuc

SEQ ID NO: 581417 - RNA, 22 nt, Human
uuuagcauuaagcuuuucaaau

SEQ ID NO: 581418 - RNA, 22 nt, Human
agccagcuguucuggggcagca

SEQ ID NO: 581419 - RNA, 22 nt, Human
uucugagagagccucucauguu

SEQ ID NO: 581420 - RNA, 22 nt, Human
aucuuauugcuguugccagaua

SEQ ID NO: 581421 - RNA, 21 nt, Human
uuagaagcuaaugcagcuggu

SEQ ID NO: 581422 - RNA, 22 nt, Human
ccaggcucugugugggcuagag

SEQ ID NO: 581423 - RNA, 22 nt, Human
uucuccauuuaacuuccuuaug

SEQ ID NO: 581424 - RNA, 22 nt, Human
ucaaaauuuuauuucucaagga

SEQ ID NO: 581425 - RNA, 22 nt, Human
ucuucuaguaggccaagaagcu

SEQ ID NO: 581426 - RNA, 20 nt, Human
cuccaguguucaggggagug

SEQ ID NO: 581427 - RNA, 22 nt, Human
agaguacugccucaguuaugaa

SEQ ID NO: 581428 - RNA, 19 nt, Human
cugcagggaugugcagagu

SEQ ID NO: 581429 - RNA, 22 nt, Human
ucucuggcagacaccucccuga

SEQ ID NO: 581430 - RNA, 22 nt, Human
ggagcccugcccuaggcagcuc

SEQ ID NO: 581431 - RNA, 22 nt, Human
cauuucaaaagaauugccagaa

SEQ ID NO: 581432 - RNA, 22 nt, Human
ucauucugcaucacucuugcuc

SEQ ID NO: 581433 - RNA, 22 nt, Human
uuucuugauuagcuguggcuca

SEQ ID NO: 581434 - RNA, 20 nt, Human
ccacaggaguccagucgacc

SEQ ID NO: 581435 - RNA, 22 nt, Human
guuauaaaugacugcaaaaguu

SEQ ID NO: 581436 - RNA, 22 nt, Human
ucaguaaaugcuugcaggccga

SEQ ID NO: 581437 - RNA, 22 nt, Human
guggucaggcagugggagagaa

SEQ ID NO: 581438 - RNA, 23 nt, Human
agggcaugaagcagaggacgugg

SEQ ID NO: 581439 - RNA, 22 nt, Human
agggguggccugccuuacuccc

SEQ ID NO: 581440 - RNA, 22 nt, Human
gugaggagggcuggucccaggc

SEQ ID NO: 581441 - RNA, 22 nt, Human
caugaaaaauuuacuguuaaca

SEQ ID NO: 581442 - RNA, 22 nt, Human
ugguauguaaauuguaacucaa

SEQ ID NO: 581443 - RNA, 22 nt, Human
agggcucuuccuuugccucuca

SEQ ID NO: 581444 - RNA, 22 nt, Human
ccucuucuaggacguccuugug

SEQ ID NO: 581445 - RNA, 22 nt, Human
cacauuuacauauaaaacuuuc

SEQ ID NO: 581446 - RNA, 22 nt, Human
aaguaaauguuggagcucaaau

SEQ ID NO: 581447 - RNA, 22 nt, Human
uguguggauucaucucaaagag

SEQ ID NO: 581448 - RNA, 22 nt, Human
cacccaggacaaaauauggaau

SEQ ID NO: 581449 - RNA, 22 nt, Human
aauggcacaagaguaaacuguu

SEQ ID NO: 581450 - RNA, 22 nt, Human
cagaaccaggaacugauggaga

SEQ ID NO: 581451 - RNA, 22 nt, Human
ggaggccuagaaaagugguucu

SEQ ID NO: 581452 - RNA, 22 nt, Human
uccugggacccugggugcagag

SEQ ID NO: 581453 - RNA, 22 nt, Human
ucauugucuugauaugauuguc

SEQ ID NO: 581454 - RNA, 22 nt, Human
gcagagugaggaagagcuucca

SEQ ID NO: 581455 - RNA, 22 nt, Human
ccagcuccucuucccaguguca

SEQ ID NO: 581456 - RNA, 22 nt, Human
uucauucuguuuggaaaggugg

SEQ ID NO: 581457 - RNA, 22 nt, Human
agguggucuuggcccacccagg

SEQ ID NO: 581458 - RNA, 22 nt, Human
ugggccacauuccaaaccagcu

SEQ ID NO: 581459 - RNA, 22 nt, Human
caguuucuuuccauuguuaccu

SEQ ID NO: 581460 - RNA, 22 nt, Human
agcagcacgaguccacaaaucc

SEQ ID NO: 581461 - RNA, 22 nt, Human
cacaggccaguaagacuguguu

SEQ ID NO: 581462 - RNA, 22 nt, Human
gccucagguaaaacuugaguuu

SEQ ID NO: 581463 - RNA, 22 nt, Human
caggaggcccaaagggcgcaga

SEQ ID NO: 581464 - RNA, 22 nt, Human
cagcaagauuuuuaaagcaagg

SEQ ID NO: 581465 - RNA, 22 nt, Human
uucccucccccagccuggcagg

SEQ ID NO: 581466 - RNA, 22 nt, Human
gaggaacuuaugauauucuacu

SEQ ID NO: 581467 - RNA, 22 nt, Human
ugccuggggauugcucugggcc

SEQ ID NO: 581468 - RNA, 22 nt, Human
caaacuuucaguuauaacauga

SEQ ID NO: 581469 - RNA, 22 nt, Human
aggcaccgcuccucaguccaga

SEQ ID NO: 581470 - RNA, 22 nt, Human
ucaguuuucaauuucaucagag

SEQ ID NO: 581471 - RNA, 22 nt, Human
cauggccaggccaagagaguac

SEQ ID NO: 581472 - RNA, 22 nt, Human
gacaggaggcagagcucaggug

SEQ ID NO: 581473 - RNA, 22 nt, Human
ggccagaggccacagcuguguc

SEQ ID NO: 581474 - RNA, 22 nt, Human
agcugccagaugacagugcuau

SEQ ID NO: 581475 - RNA, 22 nt, Human
cccaggcuuuuaaguuagacag

SEQ ID NO: 581476 - RNA, 22 nt, Human
aaauuagugcaccagguugaag

SEQ ID NO: 581477 - RNA, 22 nt, Human
ugagcuagggcuggugaggagc

SEQ ID NO: 581478 - RNA, 22 nt, Human
ccagggcauguaacuaauggug

SEQ ID NO: 581479 - RNA, 22 nt, Human
cacaaucauaauguauguacau

SEQ ID NO: 581480 - RNA, 22 nt, Human
gaagcacauggcugugagcaac

SEQ ID NO: 581481 - RNA, 22 nt, Human
uuacuuaaaaauucuaagcccc

SEQ ID NO: 581482 - RNA, 22 nt, Human
agaaagagcucgggauuaacag

SEQ ID NO: 581483 - RNA, 19 nt, Human
uccagccugcuguuucucu

SEQ ID NO: 581484 - RNA, 22 nt, Human
agccucucuuucugguggcuaa

SEQ ID NO: 581485 - RNA, 22 nt, Human
agggcuguuuuuggcaccuggg

SEQ ID NO: 581486 - RNA, 22 nt, Human
uccugggacucuuuaucagaga

SEQ ID NO: 581487 - RNA, 22 nt, Human
agagccuguacuuuucugugaa

SEQ ID NO: 581488 - RNA, 22 nt, Human
uacucacauucuguuucuugcu

SEQ ID NO: 581489 - RNA, 22 nt, Human
ugccccucuaggcccuguucua

SEQ ID NO: 581490 - RNA, 22 nt, Human
uaggauuuaauaaaagaauaga

SEQ ID NO: 581491 - RNA, 22 nt, Human
aaucuucauguccucucuaauu

SEQ ID NO: 581492 - RNA, 22 nt, Human
cugaggcucccucgggucugcu

SEQ ID NO: 581493 - RNA, 22 nt, Human
ugcugaggaaaaaugugacucu

SEQ ID NO: 581494 - RNA, 22 nt, Human
ugccugccucaggccgagugcu

SEQ ID NO: 581495 - RNA, 22 nt, Human
gggcauggugaugugcaccugu

SEQ ID NO: 581496 - RNA, 22 nt, Human
gauuaagauuacauauuuaagu

SEQ ID NO: 581497 - RNA, 22 nt, Human
guucacaagcugauugucuuuc

SEQ ID NO: 581498 - RNA, 22 nt, Human
ccagccuggagggcaguggugg

SEQ ID NO: 581499 - RNA, 22 nt, Human
cuguggaguggggaguacuggu

SEQ ID NO: 581500 - RNA, 22 nt, Human
agacaauggagggaaauacuuc

SEQ ID NO: 581501 - RNA, 22 nt, Human
cugggcacacucugcuccagcu

SEQ ID NO: 581502 - RNA, 19 nt, Human
cagcccucuuaccacugug

SEQ ID NO: 581503 - RNA, 22 nt, Human
uaauccaaaacugaaucugugg

SEQ ID NO: 581504 - RNA, 22 nt, Human
ccucccaggcauugccauuuuc

SEQ ID NO: 581505 - RNA, 22 nt, Human
gcuguguugggaaucauguggg

SEQ ID NO: 581506 - RNA, 22 nt, Human
aucacauuauguagugaaaagg

SEQ ID NO: 581507 - RNA, 22 nt, Human
acugaugugacagcugagcaga

SEQ ID NO: 581508 - RNA, 22 nt, Human
agagaaauuucccugccuucug

SEQ ID NO: 581509 - RNA, 18 nt, Human
gcagcugacacuggaguu

SEQ ID NO: 581510 - RNA, 23 nt, Human
guguguucccggaguagcucccg

SEQ ID NO: 581511 - RNA, 22 nt, Human
cuacccaggcuggagugcagua

SEQ ID NO: 581512 - RNA, 22 nt, Human
uuuuaaguuaauauaauugagg

SEQ ID NO: 581513 - RNA, 18 nt, Human
gccagagggcccaagguc

SEQ ID NO: 581514 - RNA, 22 nt, Human
agaggcaggagguugacuugag

SEQ ID NO: 581515 - RNA, 22 nt, Human
gcaggcagagguggaggagaca

SEQ ID NO: 581516 - RNA, 22 nt, Human
uugcaguugucuuuccuaauuu

SEQ ID NO: 581517 - RNA, 22 nt, Human
accuccagcuuuuuagagacau

SEQ ID NO: 581518 - RNA, 22 nt, Human
auacaguauaacuaauaaaccc

SEQ ID NO: 581519 - RNA, 22 nt, Human
acuuguuagauauaaaguuugu

SEQ ID NO: 581520 - RNA, 22 nt, Human
ugcucuucaccauuacaucaug

SEQ ID NO: 581521 - RNA, 22 nt, Human
caguccagccaguagggugugg

SEQ ID NO: 581522 - RNA, 22 nt, Human
aagagggcugcaaucuuauugc

SEQ ID NO: 581523 - RNA, 22 nt, Human
aaaaacacaaguggcuuggucu

SEQ ID NO: 581524 - RNA, 22 nt, Human
caggaaggaaaggguguggaga

SEQ ID NO: 581525 - RNA, 22 nt, Human
agcugccuuauggaguaugaaa

SEQ ID NO: 581526 - RNA, 22 nt, Human
caggaugggauguagugggccc

SEQ ID NO: 581527 - RNA, 22 nt, Human
uuucugauuugacuugaaguau

SEQ ID NO: 581528 - RNA, 22 nt, Human
auuuaagaggcugcuagaguau

SEQ ID NO: 581529 - RNA, 22 nt, Human
gcuccuggccagcacagggccc

SEQ ID NO: 581530 - RNA, 22 nt, Human
uuuuaccugaaccacacaguau

SEQ ID NO: 581531 - RNA, 22 nt, Human
uuuuccuauaugcaaagaaugc

SEQ ID NO: 581532 - RNA, 22 nt, Human
caggcuucaugaauuaugcacc

SEQ ID NO: 581533 - RNA, 22 nt, Human
accuacauggcuuuaaguaagu

SEQ ID NO: 581534 - RNA, 22 nt, Human
gaggagacaguggagccgcuac

SEQ ID NO: 581535 - RNA, 22 nt, Human
acacaaugucaucauaauguca

SEQ ID NO: 581536 - RNA, 21 nt, Human
ucaggcugucugcugguucca

SEQ ID NO: 581537 - RNA, 22 nt, Human
caggaacacaaugagucucaaa

SEQ ID NO: 581538 - RNA, 22 nt, Human
agcccaggaaguugaggcuugc

SEQ ID NO: 581539 - RNA, 20 nt, Human
gggaggccccagaguccagg

SEQ ID NO: 581540 - RNA, 22 nt, Human
cacuggcuugauggguaaugcc

SEQ ID NO: 581541 - RNA, 21 nt, Human
ucuuggccuaaguucacugaa

SEQ ID NO: 581542 - RNA, 22 nt, Human
gccccagccaaggugacacgaa

SEQ ID NO: 581543 - RNA, 22 nt, Human
gugcuucucuucacacccaacu

SEQ ID NO: 581544 - RNA, 22 nt, Human
cucccuggucuuucccaucauu

SEQ ID NO: 581545 - RNA, 22 nt, Human
aaaucagacacagugaaaguua

SEQ ID NO: 581546 - RNA, 22 nt, Human
aagauuuuuuuccacagacuca

SEQ ID NO: 581547 - RNA, 22 nt, Human
gagcacaggcugcugugaacug

SEQ ID NO: 581548 - RNA, 22 nt, Human
ucacugcagacaaccucaguca

SEQ ID NO: 581549 - RNA, 22 nt, Human
agagccagauggagccgugugu

SEQ ID NO: 581550 - RNA, 22 nt, Human
ugcaauaacuacuuuaauguug

SEQ ID NO: 581551 - RNA, 22 nt, Human
ucucagaauuguguccacuggg

SEQ ID NO: 581552 - RNA, 22 nt, Human
uucuuaauaccuauuuucuacc

SEQ ID NO: 581553 - RNA, 22 nt, Human
auccugaguucucagagucucc

SEQ ID NO: 581554 - RNA, 22 nt, Human
agaccaggaaggccuacagaua

SEQ ID NO: 581555 - RNA, 21 nt, Human
ucucugguuggaguugugcca

SEQ ID NO: 581556 - RNA, 22 nt, Human
ucucagaaccucaguuugcucu

SEQ ID NO: 581557 - RNA, 22 nt, Human
ccuccuuccugggacagagcug

SEQ ID NO: 581558 - RNA, 22 nt, Human
ggucccuggaagucccucuucu

SEQ ID NO: 581559 - RNA, 22 nt, Human
ugcagaagaccuuccagggcug

SEQ ID NO: 581560 - RNA, 22 nt, Human
gcacagcacagcaacauguuuu

SEQ ID NO: 581561 - RNA, 22 nt, Human
uuuuaaugugcucugcaaugau

SEQ ID NO: 581562 - RNA, 22 nt, Human
uuuaacauguucaagaaacaua

SEQ ID NO: 581563 - RNA, 20 nt, Human
cuacuuuaggcacugagaau

SEQ ID NO: 581564 - RNA, 22 nt, Human
uggccuauuucaucaguucaau

SEQ ID NO: 581565 - RNA, 22 nt, Human
ucccuuggaaaguagccucaca

SEQ ID NO: 581566 - RNA, 22 nt, Human
guuuacauguuuuucucuuaca

SEQ ID NO: 581567 - RNA, 18 nt, Human
uggggucucucagguaag

SEQ ID NO: 581568 - RNA, 22 nt, Human
uccgggggugguagauuuccuu

SEQ ID NO: 581569 - RNA, 22 nt, Human
guuccccuuguguuguugccca

SEQ ID NO: 581570 - RNA, 22 nt, Human
uauggacaucugaaguugcaga

SEQ ID NO: 581571 - RNA, 22 nt, Human
uccucagggaagaugagccuca

SEQ ID NO: 581572 - RNA, 19 nt, Human
aaggcuggagaaggccucu

SEQ ID NO: 581573 - RNA, 22 nt, Human
auguucuuucagccagugcauc

SEQ ID NO: 581574 - RNA, 22 nt, Human
uuuagacagcggcucugaacca

SEQ ID NO: 581575 - RNA, 22 nt, Human
uugaggagcaggaugggaggcu

SEQ ID NO: 581576 - RNA, 19 nt, Human
gcugagguggaggaaggag

SEQ ID NO: 581577 - RNA, 21 nt, Human
caguucucuuagauuuccagu

SEQ ID NO: 581578 - RNA, 22 nt, Human
ggguuaaaacaggaagaucagc

SEQ ID NO: 581579 - RNA, 22 nt, Human
aaaauugucagaaguugaucuu

SEQ ID NO: 581580 - RNA, 17 nt, Human
aggaagcgagcuggccu

SEQ ID NO: 581581 - RNA, 22 nt, Human
cauugcuuugugcauauuuaaa

SEQ ID NO: 581582 - RNA, 22 nt, Human
uagaggagaguugcuggaugga

SEQ ID NO: 581583 - RNA, 22 nt, Human
uuuugaaagaguccugcuacag

SEQ ID NO: 581584 - RNA, 22 nt, Human
cucuggaauugaccugggaggg

SEQ ID NO: 581585 - RNA, 19 nt, Human
agacaugagacacaggaug

SEQ ID NO: 581586 - RNA, 22 nt, Human
gccuucucugugagcuccuagg

SEQ ID NO: 581587 - RNA, 22 nt, Human
uagcaaugcuucauuauuuaaa

SEQ ID NO: 581588 - RNA, 22 nt, Human
cacauucaggauuuuccauguc

SEQ ID NO: 581589 - RNA, 22 nt, Human
gcuggcagccaagugaagaggg

SEQ ID NO: 581590 - RNA, 22 nt, Human
cugagccagcuggcaugugcua

SEQ ID NO: 581591 - RNA, 22 nt, Human
acacuaaucuuuuauuugguuu

SEQ ID NO: 581592 - RNA, 22 nt, Human
ggagaggcuuggcccagccugg

SEQ ID NO: 581593 - RNA, 22 nt, Human
ucauggcacuuagcacaguccu

SEQ ID NO: 581594 - RNA, 22 nt, Human
uggaaacuagagaguuuguauu

SEQ ID NO: 581595 - RNA, 22 nt, Human
agaggccggccgagcccauggg

SEQ ID NO: 581596 - RNA, 22 nt, Human
acuuauuucauggaucauaaug

SEQ ID NO: 581597 - RNA, 22 nt, Human
cagcagagacgguaagcagaac

SEQ ID NO: 581598 - RNA, 22 nt, Human
ggaugcaggggcagcagagccu

SEQ ID NO: 581599 - RNA, 22 nt, Human
ggccugagucccaccuggcugu

SEQ ID NO: 581600 - RNA, 22 nt, Human
gauugagucugaggaugcugca

SEQ ID NO: 581601 - RNA, 22 nt, Human
gaagaggcaauugaauaagcua

SEQ ID NO: 581602 - RNA, 22 nt, Human
gcagcugagcgugaggaagagu

SEQ ID NO: 581603 - RNA, 22 nt, Human
gagcucagguggucaaaacaau

SEQ ID NO: 581604 - RNA, 22 nt, Human
gcaguguuuggauccauagcga

SEQ ID NO: 581605 - RNA, 20 nt, Human
cccagaagcuuaacagagca

SEQ ID NO: 581606 - RNA, 18 nt, Human
ugucaguaaagugacaga

SEQ ID NO: 581607 - RNA, 23 nt, Human
uagaaucuguauuucugcaguuc

SEQ ID NO: 581608 - RNA, 22 nt, Human
agaguuuggagagggugaggca

SEQ ID NO: 581609 - RNA, 22 nt, Human
acauuugacucuguucauauua

SEQ ID NO: 581610 - RNA, 22 nt, Human
ucugcagggucccagccucagc

SEQ ID NO: 581611 - RNA, 22 nt, Human
aauuagagaagcuucuuccauu

SEQ ID NO: 581612 - RNA, 22 nt, Human
caggggcuuaagugacagaagg

SEQ ID NO: 581613 - RNA, 22 nt, Human
ccaggcaggcagcguucucagg

SEQ ID NO: 581614 - RNA, 22 nt, Human
acugugagugauuuccuucugg

SEQ ID NO: 581615 - RNA, 22 nt, Human
acaagagacaagagguucuucu

SEQ ID NO: 581616 - RNA, 22 nt, Human
caagggaauugugugugagagg

SEQ ID NO: 581617 - RNA, 22 nt, Human
cccaguggggaaauagcuagcu

SEQ ID NO: 581618 - RNA, 22 nt, Human
agcuguggaagacugucagggu

SEQ ID NO: 581619 - RNA, 22 nt, Human
cuaauguaaagcauuuguucag

SEQ ID NO: 581620 - RNA, 22 nt, Human
agaggcugggaaggguccccgg

SEQ ID NO: 581621 - RNA, 22 nt, Human
ugaauucuuaaugaaaucuacu

SEQ ID NO: 581622 - RNA, 22 nt, Human
gagugagggccaacauccagcu

SEQ ID NO: 581623 - RNA, 22 nt, Human
agggucaguucugugagguguu

SEQ ID NO: 581624 - RNA, 18 nt, Human
cugaggcuggcaggagcc

SEQ ID NO: 581625 - RNA, 22 nt, Human
ugcagaguggauucuguauacc

SEQ ID NO: 581626 - RNA, 22 nt, Human
aggggcacuagaaugggagacu

SEQ ID NO: 581627 - RNA, 22 nt, Human
cuggcuugaaguuaugcaccag

SEQ ID NO: 581628 - RNA, 22 nt, Human
uugcuaaaucccuauaauauuc

SEQ ID NO: 581629 - RNA, 22 nt, Human
augauuuguuaacagacuuaau

SEQ ID NO: 581630 - RNA, 22 nt, Human
acggugcuggguauugggguuc

SEQ ID NO: 581631 - RNA, 22 nt, Human
caugaugucacagagaagcaca

SEQ ID NO: 581632 - RNA, 20 nt, Human
uccugcagucgcuagcgccc

SEQ ID NO: 581633 - RNA, 22 nt, Human
acuguccauucacucauauuca

SEQ ID NO: 581634 - RNA, 21 nt, Human
auagugauagauaacugaguu

SEQ ID NO: 581635 - RNA, 22 nt, Human
gagagaaaaaugagcuucauug

SEQ ID NO: 581636 - RNA, 22 nt, Human
cagggcugagucauauagccuu

SEQ ID NO: 581637 - RNA, 22 nt, Human
uuggggagguugccacauucca

SEQ ID NO: 581638 - RNA, 22 nt, Human
gagcugggaagauagcuugagc

SEQ ID NO: 581639 - RNA, 22 nt, Human
agggguuggauuuggccuagag

SEQ ID NO: 581640 - RNA, 22 nt, Human
uagaauauacacuacagcuuaa

SEQ ID NO: 581641 - RNA, 22 nt, Human
gcugggcaacgggcagaaagau

SEQ ID NO: 581642 - RNA, 22 nt, Human
cccagggucccugcucucugug

SEQ ID NO: 581643 - RNA, 22 nt, Human
cacagcuuguuuagugacucac

SEQ ID NO: 581644 - RNA, 22 nt, Human
aguuaucccaaaugcaaaaugg

SEQ ID NO: 581645 - RNA, 22 nt, Human
agggaaaggcugaugcuguggg

SEQ ID NO: 581646 - RNA, 22 nt, Human
ccauccaggcugugggugagcu

SEQ ID NO: 581647 - RNA, 22 nt, Human
aaguucaucuuaccuagauuuu

SEQ ID NO: 581648 - RNA, 22 nt, Human
ugguccuggaagguccugaggg

SEQ ID NO: 581649 - RNA, 22 nt, Human
gagcugccggcccacaguacua

SEQ ID NO: 581650 - RNA, 22 nt, Human
auaaaguggaaguguuaaaggg

SEQ ID NO: 581651 - RNA, 22 nt, Human
uuuucuguuugcuucaagacau

SEQ ID NO: 581652 - RNA, 22 nt, Human
auguuauaaauagagacacugg

SEQ ID NO: 581653 - RNA, 22 nt, Human
aaaauucauuccucagacugcc

SEQ ID NO: 581654 - RNA, 22 nt, Human
uauuuccuugagacggagucuc

SEQ ID NO: 581655 - RNA, 22 nt, Human
ucucuuaauccggugcuuucug

SEQ ID NO: 581656 - RNA, 22 nt, Human
uuucccucugugccagcuucuc

SEQ ID NO: 581657 - RNA, 22 nt, Human
uaaacagagagugcaguuauag

SEQ ID NO: 581658 - RNA, 22 nt, Human
ccaggcuugguguguggucagg

SEQ ID NO: 581659 - RNA, 22 nt, Human
gucauaaaaggaccaccuauug

SEQ ID NO: 581660 - RNA, 22 nt, Human
gucuucuuuucagucugcuugu

SEQ ID NO: 581661 - RNA, 22 nt, Human
ucacaagauacaguuagaagca

SEQ ID NO: 581662 - RNA, 22 nt, Human
uuacacauuaacaggcagcuaa

SEQ ID NO: 581663 - RNA, 22 nt, Human
ugaagggggagauauaugugug

SEQ ID NO: 581664 - RNA, 22 nt, Human
ucacacacauuugcugucugau

SEQ ID NO: 581665 - RNA, 22 nt, Human
gauauuuauuaagugguuggua

SEQ ID NO: 581666 - RNA, 22 nt, Human
auuaaauuuucacuaggcuccc

SEQ ID NO: 581667 - RNA, 22 nt, Human
caagaccucaaaaugagagggg

SEQ ID NO: 581668 - RNA, 22 nt, Human
cuugagucauauaaagacagag

SEQ ID NO: 581669 - RNA, 22 nt, Human
cuguguacccacgugggcaccc

SEQ ID NO: 581670 - RNA, 22 nt, Human
aagcagccagccaucaugcccg

SEQ ID NO: 581671 - RNA, 22 nt, Human
auggaaaugauggaacauuaaa

SEQ ID NO: 581672 - RNA, 22 nt, Human
cugcuuugacuguuaagaacca

SEQ ID NO: 581673 - RNA, 22 nt, Human
cuggggcugcggacgggagccc

SEQ ID NO: 581674 - RNA, 22 nt, Human
gaaaacugugauuagaaugccu

SEQ ID NO: 581675 - RNA, 22 nt, Human
aggcucugacgucacacguggc

SEQ ID NO: 581676 - RNA, 22 nt, Human
uuucucucagccuguagaaacu

SEQ ID NO: 581677 - RNA, 22 nt, Human
uggaaacacucaagcuuauauu

SEQ ID NO: 581678 - RNA, 22 nt, Human
ggaagaggaggagccaggcuuu

SEQ ID NO: 581679 - RNA, 22 nt, Human
acauuucuucccuuuagcagaa

SEQ ID NO: 581680 - RNA, 22 nt, Human
ggcuguguccccaccugagcag

SEQ ID NO: 581681 - RNA, 22 nt, Human
gaauuauagguuugcaugcuaa

SEQ ID NO: 581682 - RNA, 22 nt, Human
cgugaaaugaguugaauuauug

SEQ ID NO: 581683 - RNA, 22 nt, Human
uaagcaaugcuguaguucaguc

SEQ ID NO: 581684 - RNA, 21 nt, Human
ggcagugaugugaagugcauc

SEQ ID NO: 581685 - RNA, 22 nt, Human
cugaggucaauuaaucaacaac

SEQ ID NO: 581686 - RNA, 17 nt, Human
guguacaagcagaaggc

SEQ ID NO: 581687 - RNA, 22 nt, Human
uuccuguucaggaaaguugugu

SEQ ID NO: 581688 - RNA, 22 nt, Human
ucuacauuuuaacaagaugccc

SEQ ID NO: 581689 - RNA, 22 nt, Human
gagcagagcuucucaaaguaaa

SEQ ID NO: 581690 - RNA, 22 nt, Human
ucugcugugaaaggugaauauu

SEQ ID NO: 581691 - RNA, 20 nt, Human
ucugcucagcccucaguggc

SEQ ID NO: 581692 - RNA, 22 nt, Human
cagaguguauucugcaguugca

SEQ ID NO: 581693 - RNA, 22 nt, Human
uugcagggccuuggcuucuucc

SEQ ID NO: 581694 - RNA, 22 nt, Human
ucccagagcugauaagccuuua

SEQ ID NO: 581695 - RNA, 21 nt, Human
ugcuuuaugggaaaaauguca

SEQ ID NO: 581696 - RNA, 22 nt, Human
caagacauugauuuuguacaga

SEQ ID NO: 581697 - RNA, 22 nt, Human
cacuuuauuauaaauuugagag

SEQ ID NO: 581698 - RNA, 22 nt, Human
agggugaaucucacaacucuua

SEQ ID NO: 581699 - RNA, 22 nt, Human
caaagaguccagcacccucucc

SEQ ID NO: 581700 - RNA, 22 nt, Human
uguguuuacuucuaugcaguuu

SEQ ID NO: 581701 - RNA, 22 nt, Human
cugagguuuacaagcuauugcu

SEQ ID NO: 581702 - RNA, 22 nt, Human
cccagcucuuuuagcggcaucu

SEQ ID NO: 581703 - RNA, 23 nt, Human
aguguugguugggaagccaagca

SEQ ID NO: 581704 - RNA, 22 nt, Human
ccuucugugugcccacguuuau

SEQ ID NO: 581705 - RNA, 22 nt, Human
uuccagauuucuacacaagacc

SEQ ID NO: 581706 - RNA, 21 nt, Human
aucugaaagguuaguguugag

SEQ ID NO: 581707 - RNA, 22 nt, Human
ugagcagaugucuaacuuuuac

SEQ ID NO: 581708 - RNA, 22 nt, Human
uucccagaaugaauggauggag

SEQ ID NO: 581709 - RNA, 22 nt, Human
cuuuacacuuggacccacacuu

SEQ ID NO: 581710 - RNA, 22 nt, Human
ccagggcauccucacaucgcag

SEQ ID NO: 581711 - RNA, 22 nt, Human
aagcagagaaucugggagcgag

SEQ ID NO: 581712 - RNA, 22 nt, Human
acuuaaaguuauaauuugcuaa

SEQ ID NO: 581713 - RNA, 22 nt, Human
agccuggcuguaaccucauggu

SEQ ID NO: 581714 - RNA, 22 nt, Human
guuuaugaguuacguagggguu

SEQ ID NO: 581715 - RNA, 22 nt, Human
agggugguauuuaacaacugga

SEQ ID NO: 581716 - RNA, 22 nt, Human
cagcuccagccugacaccaaga

SEQ ID NO: 581717 - RNA, 22 nt, Human
guggcagcagaggggugguaug

SEQ ID NO: 581718 - RNA, 22 nt, Human
aaaaggaggucacuuuauuccu

SEQ ID NO: 581719 - RNA, 22 nt, Human
gugauggguaacuguuuaggga

SEQ ID NO: 581720 - RNA, 20 nt, Human
acagcagccuugcuagaaac

SEQ ID NO: 581721 - RNA, 22 nt, Human
agcugggcuccaagagggaucu

SEQ ID NO: 581722 - RNA, 22 nt, Human
aaagcuaugaggcaugcauuuc

SEQ ID NO: 581723 - RNA, 22 nt, Human
ucugaacacugagugucaucac

SEQ ID NO: 581724 - RNA, 22 nt, Human
cugucugucaccaaaacagacu

SEQ ID NO: 581725 - RNA, 22 nt, Human
gcuuccaguccucagaggcugg

SEQ ID NO: 581726 - RNA, 22 nt, Human
cugugucuucaauguacuggga

SEQ ID NO: 581727 - RNA, 22 nt, Human
uuacagagcucauuucuaaggg

SEQ ID NO: 581728 - RNA, 22 nt, Human
aggggagcaaggccguggugua

SEQ ID NO: 581729 - RNA, 22 nt, Human
caaugcuucucauuagccaaug

SEQ ID NO: 581730 - RNA, 22 nt, Human
uuuguuuucaaugugucauuca

SEQ ID NO: 581731 - RNA, 22 nt, Human
ucuggccaggauggcaagacca

SEQ ID NO: 581732 - RNA, 23 nt, Human
ugcuucucugcuugacaguucug

SEQ ID NO: 581733 - RNA, 23 nt, Human
cuguuaaauuccuuaagagcagg

SEQ ID NO: 581734 - RNA, 22 nt, Human
aauaaagacaaacaggggagcc

SEQ ID NO: 581735 - RNA, 22 nt, Human
caguauuuuccuuguuaacuua

SEQ ID NO: 581736 - RNA, 22 nt, Human
gcagggaaacaggugcuaagga

SEQ ID NO: 581737 - RNA, 22 nt, Human
cugaggccucuuuccuuggcuu

SEQ ID NO: 581738 - RNA, 22 nt, Human
cuacuuuaacauggaggcacuu

SEQ ID NO: 581739 - RNA, 22 nt, Human
ccugugggagggagcggcugga

SEQ ID NO: 581740 - RNA, 22 nt, Human
gaggcuccgugcugcugcccug

SEQ ID NO: 581741 - RNA, 22 nt, Human
ccuccagcgcgauccacuccgg

SEQ ID NO: 581742 - RNA, 22 nt, Human
agacaaguaggaaugguugaag

SEQ ID NO: 581743 - RNA, 22 nt, Human
ucagaaguugauaaaguaguug

SEQ ID NO: 581744 - RNA, 22 nt, Human
ucacaggaggaaccuggccugg

SEQ ID NO: 581745 - RNA, 22 nt, Human
gcagcauguugaaagggccaca

SEQ ID NO: 581746 - RNA, 22 nt, Human
cagccucugagccuuggcagau

SEQ ID NO: 581747 - RNA, 17 nt, Human
ucugagaacuugaagca

SEQ ID NO: 581748 - RNA, 22 nt, Human
agcccagagacaaugcucagua

SEQ ID NO: 581749 - RNA, 22 nt, Human
aucauuagaccaaacuagagcu

SEQ ID NO: 581750 - RNA, 22 nt, Human
agcccagggaaccaggaagugg

SEQ ID NO: 581751 - RNA, 22 nt, Human
ggccuguccagccugccuggcu

SEQ ID NO: 581752 - RNA, 22 nt, Human
uguuuacuucaucgaguacuuc

SEQ ID NO: 581753 - RNA, 22 nt, Human
cugccugcugauuaguauuguc

SEQ ID NO: 581754 - RNA, 22 nt, Human
ggacagaggguugacagaguau

SEQ ID NO: 581755 - RNA, 22 nt, Human
gcuggccacauugugccguccu

SEQ ID NO: 581756 - RNA, 22 nt, Human
agugcugucccgacaacugagg

SEQ ID NO: 581757 - RNA, 22 nt, Human
agagauuagccuggauuaugca

SEQ ID NO: 581758 - RNA, 22 nt, Human
ugugaagguuuuuaugggauau

SEQ ID NO: 581759 - RNA, 20 nt, Human
uggcccaguggggcagggug

SEQ ID NO: 581760 - RNA, 22 nt, Human
cagucugaacacugggcuacuc

SEQ ID NO: 581761 - RNA, 22 nt, Human
agcagggcuuugucucugugaa

SEQ ID NO: 581762 - RNA, 22 nt, Human
uggcuccagcccugagcaagcu

SEQ ID NO: 581763 - RNA, 17 nt, Human
cucugggcagccugggg

SEQ ID NO: 581764 - RNA, 23 nt, Human
cccugcucaggggucugauucuc

SEQ ID NO: 581765 - RNA, 22 nt, Human
uccucagcauuagcacagacau

SEQ ID NO: 581766 - RNA, 20 nt, Human
acaguguaauauucacauuc

SEQ ID NO: 581767 - RNA, 22 nt, Human
gugccuuuucuucauaguuacu

SEQ ID NO: 581768 - RNA, 22 nt, Human
aaggggugggcauuagagcagu

SEQ ID NO: 581769 - RNA, 22 nt, Human
gccacaugucaugugcucagua

SEQ ID NO: 581770 - RNA, 22 nt, Human
cugucugggucuacauccucug

SEQ ID NO: 581771 - RNA, 22 nt, Human
gcagcgaggugaugaaauagcu

SEQ ID NO: 581772 - RNA, 18 nt, Human
gcucaggcccuagucagu

SEQ ID NO: 581773 - RNA, 22 nt, Human
aauguuaauuuacugucuucau

SEQ ID NO: 581774 - RNA, 22 nt, Human
uuacaaaguuuaagguggcacu

SEQ ID NO: 581775 - RNA, 22 nt, Human
ugucccucauugacgcugugcc

SEQ ID NO: 581776 - RNA, 22 nt, Human
gccagcuguaagcuggggugau

SEQ ID NO: 581777 - RNA, 22 nt, Human
uucugggaacaaaguggagugg

SEQ ID NO: 581778 - RNA, 22 nt, Human
caagcugcagcgccugcgccgg

SEQ ID NO: 581779 - RNA, 22 nt, Human
gcuggccuugugucugaggaag

SEQ ID NO: 581780 - RNA, 22 nt, Human
uugccacacaaguaaagaaaca

SEQ ID NO: 581781 - RNA, 22 nt, Human
ccaguggguaggccauggugag

SEQ ID NO: 581782 - RNA, 22 nt, Human
aacauguugcuuuaauaauauu

SEQ ID NO: 581783 - RNA, 22 nt, Human
ugucucaguucccuucucugga

SEQ ID NO: 581784 - RNA, 22 nt, Human
aggccaaguagcuagcauugaa

SEQ ID NO: 581785 - RNA, 22 nt, Human
auuagauuguaaauguuuucac

SEQ ID NO: 581786 - RNA, 22 nt, Human
agaagccagcuucagcugcccg

SEQ ID NO: 581787 - RNA, 22 nt, Human
uccugguguuacuaaauugaaa

SEQ ID NO: 581788 - RNA, 22 nt, Human
ugugugugcacgugcgcgcgag

SEQ ID NO: 581789 - RNA, 22 nt, Human
gaggggcuggguagggcaaccc

SEQ ID NO: 581790 - RNA, 22 nt, Human
cuccucaguugucccauggaga

SEQ ID NO: 581791 - RNA, 23 nt, Human
aagcugccuucgcaguuggucug

SEQ ID NO: 581792 - RNA, 22 nt, Human
aagauacaccaagagccuagua

SEQ ID NO: 581793 - RNA, 22 nt, Human
aggcucuggacagugaggaguu

SEQ ID NO: 581794 - RNA, 22 nt, Human
uauuaaauuauggauuuaggag

SEQ ID NO: 581795 - RNA, 22 nt, Human
gaugcagggcuggcaggagcuu

SEQ ID NO: 581796 - RNA, 22 nt, Human
gcaguggauggccagcaggggc

SEQ ID NO: 581797 - RNA, 22 nt, Human
ugggagugauacaguauggaau

SEQ ID NO: 581798 - RNA, 22 nt, Human
gcuguguguucaauaaugugau

SEQ ID NO: 581799 - RNA, 18 nt, Human
ucucucugaagaguuccc

SEQ ID NO: 581800 - RNA, 22 nt, Human
gccacagcucacguuccccauu

SEQ ID NO: 581801 - RNA, 22 nt, Human
auaaagcuauuuuuaauucugu

SEQ ID NO: 581802 - RNA, 22 nt, Human
cagggagaagucuggucagucc

SEQ ID NO: 581803 - RNA, 22 nt, Human
gcugauuuugagaagcacaguc

SEQ ID NO: 581804 - RNA, 22 nt, Human
gccuccggagucacagugucuu

SEQ ID NO: 581805 - RNA, 22 nt, Human
auuguauacaagcuuaauuguu

SEQ ID NO: 581806 - RNA, 22 nt, Human
gcccaggccggagagcagugcu

SEQ ID NO: 581807 - RNA, 19 nt, Human
ugcaggaggacugagcaga

SEQ ID NO: 581808 - RNA, 22 nt, Human
auguguaaaaagugcuuaauau

SEQ ID NO: 581809 - RNA, 17 nt, Human
gaaaguuucucucucuu

SEQ ID NO: 581810 - RNA, 22 nt, Human
ggagcuguaacgagccauugcu

SEQ ID NO: 581811 - RNA, 22 nt, Human
gcuacaggugacagccucugca

SEQ ID NO: 581812 - RNA, 18 nt, Human
gcucuggcucaccuccag

SEQ ID NO: 581813 - RNA, 22 nt, Human
uggaaguugaaucucagucaug

SEQ ID NO: 581814 - RNA, 22 nt, Human
gagcugaguaugaaggauguga

SEQ ID NO: 581815 - RNA, 22 nt, Human
gcugucacacauggccccagcu

SEQ ID NO: 581816 - RNA, 22 nt, Human
gggaccugcgccacucacuguc

SEQ ID NO: 581817 - RNA, 22 nt, Human
ugugccagaaaauaugcugagg

SEQ ID NO: 581818 - RNA, 22 nt, Human
uuccugagcaccagacacugca

SEQ ID NO: 581819 - RNA, 22 nt, Human
ccagguggugccucuguucgca

SEQ ID NO: 581820 - RNA, 22 nt, Human
cagggagaucuuggcuccuggu

SEQ ID NO: 581821 - RNA, 22 nt, Human
ccacugccagcuuuguccuccc

SEQ ID NO: 581822 - RNA, 22 nt, Human
ugguccacagggaguccgugcu

SEQ ID NO: 581823 - RNA, 22 nt, Human
cuggcagcuuauuagaaaugca

SEQ ID NO: 581824 - RNA, 22 nt, Human
aauguguuacuguguaagagca

SEQ ID NO: 581825 - RNA, 22 nt, Human
agacagggucuugaucagagcu

SEQ ID NO: 581826 - RNA, 22 nt, Human
caugacaauauguucuuucauu

SEQ ID NO: 581827 - RNA, 22 nt, Human
cacacuguccccuucuccccag

SEQ ID NO: 581828 - RNA, 22 nt, Human
gcaccuggcugcccagguggag

SEQ ID NO: 581829 - RNA, 22 nt, Human
cacacagguaagccucuuucaa

SEQ ID NO: 581830 - RNA, 22 nt, Human
cagugugacuucugagcugcca

SEQ ID NO: 581831 - RNA, 22 nt, Human
uggcuuccuaggagcccgugcu

SEQ ID NO: 581832 - RNA, 22 nt, Human
ggcugcuggaagacugaacaag

SEQ ID NO: 581833 - RNA, 22 nt, Human
ucucugucugagccuggcagac

SEQ ID NO: 581834 - RNA, 22 nt, Human
ugucacauguguggcauuuuuc

SEQ ID NO: 581835 - RNA, 22 nt, Human
cugccuuugugaucaguucuuu

SEQ ID NO: 581836 - RNA, 22 nt, Human
aauaacuucaguucuuacauua

SEQ ID NO: 581837 - RNA, 20 nt, Human
augugaaagaucaguugucu

SEQ ID NO: 581838 - RNA, 22 nt, Human
uaucuacauucuuguaucuucu

SEQ ID NO: 581839 - RNA, 22 nt, Human
caggggaguuuuaugcaacaga

SEQ ID NO: 581840 - RNA, 22 nt, Human
uccaggaggacugagggggcug

SEQ ID NO: 581841 - RNA, 22 nt, Human
agguuugugucuugcuuaaggu

SEQ ID NO: 581842 - RNA, 22 nt, Human
uucuauugacauucacuguaac

SEQ ID NO: 581843 - RNA, 22 nt, Human
cagguggcagugccugcauucu

SEQ ID NO: 581844 - RNA, 22 nt, Human
caaauguaauaaggaguuuccc

SEQ ID NO: 581845 - RNA, 19 nt, Human
uggaaacuccugauauuag

SEQ ID NO: 581846 - RNA, 22 nt, Human
caaauaucuuuggcaaagagaa

SEQ ID NO: 581847 - RNA, 22 nt, Human
agcaggagacauggggguggug

SEQ ID NO: 581848 - RNA, 22 nt, Human
gcuuacaagccagcuguaccac

SEQ ID NO: 581849 - RNA, 20 nt, Human
gcagagcuguucugugggga

SEQ ID NO: 581850 - RNA, 23 nt, Human
cugagguaaaauauucugaagga

SEQ ID NO: 581851 - RNA, 22 nt, Human
ucugaggcauacccaggccccc

SEQ ID NO: 581852 - RNA, 22 nt, Human
gugugugucuccgcggccguag

SEQ ID NO: 581853 - RNA, 22 nt, Human
gccagcucagaugcaggaagga

SEQ ID NO: 581854 - RNA, 22 nt, Human
gagagucuaggaaccucauaua

SEQ ID NO: 581855 - RNA, 22 nt, Human
ucuguuauaaaucacacugcau

SEQ ID NO: 581856 - RNA, 22 nt, Human
agaggccagcaaccacaguaaa

SEQ ID NO: 581857 - RNA, 22 nt, Human
auaugugugugugagaaaagcu

SEQ ID NO: 581858 - RNA, 22 nt, Human
uaacuggcuuaaauuuuaucaa

SEQ ID NO: 581859 - RNA, 22 nt, Human
cugcccaggcugaaggaacauc

SEQ ID NO: 581860 - RNA, 22 nt, Human
cuagaaauauuuuacagucaag

SEQ ID NO: 581861 - RNA, 22 nt, Human
aagauguaaaggcaauauaaag

SEQ ID NO: 581862 - RNA, 22 nt, Human
guggcgcagaggguggcagaga

SEQ ID NO: 581863 - RNA, 22 nt, Human
uuuguaugggcagaaauuagau

SEQ ID NO: 581864 - RNA, 22 nt, Human
cuggguuccauguagccaagag

SEQ ID NO: 581865 - RNA, 22 nt, Human
cagauacauuaaaaugaugauu

SEQ ID NO: 581866 - RNA, 22 nt, Human
aaagaaauagauggcauuuaaa

SEQ ID NO: 581867 - RNA, 22 nt, Human
cucagccagugaucuuuccuuu

SEQ ID NO: 581868 - RNA, 22 nt, Human
aggagacagccaggggccugag

SEQ ID NO: 581869 - RNA, 22 nt, Human
gaggcagccucaguggaccucg

SEQ ID NO: 581870 - RNA, 22 nt, Human
uuuucuguguauccaggcuucc

SEQ ID NO: 581871 - RNA, 22 nt, Human
cuguaaaacacuguaguaucug

SEQ ID NO: 581872 - RNA, 22 nt, Human
auaaaucucuuaagacucaaca

SEQ ID NO: 581873 - RNA, 22 nt, Human
cccaacuacucucaggcagcuu

SEQ ID NO: 581874 - RNA, 23 nt, Human
uccuucaaguuaggaagugaaca

SEQ ID NO: 581875 - RNA, 22 nt, Human
cucaguuuccucuucuguugaa

SEQ ID NO: 581876 - RNA, 22 nt, Human
gaggagcaugggaaggcucugg

SEQ ID NO: 581877 - RNA, 22 nt, Human
gcagacaugggaucuauucaca

SEQ ID NO: 581878 - RNA, 22 nt, Human
aagaagcacuuuccuacauguu

SEQ ID NO: 581879 - RNA, 22 nt, Human
cagcuguuguguaucaggcaga

SEQ ID NO: 581880 - RNA, 22 nt, Human
ccucccucccucuuaugguuua

SEQ ID NO: 581881 - RNA, 22 nt, Human
gaagagcugcaguuuccugggc

SEQ ID NO: 581882 - RNA, 22 nt, Human
uuugauccguugcuggugagga

SEQ ID NO: 581883 - RNA, 22 nt, Human
aaacacuagcaggaagcacuga

SEQ ID NO: 581884 - RNA, 22 nt, Human
gccagagcagaauagaguggcc

SEQ ID NO: 581885 - RNA, 22 nt, Human
agagguaugugucagugcuuau

SEQ ID NO: 581886 - RNA, 22 nt, Human
ugggcagagaguagaggcaacg

SEQ ID NO: 581887 - RNA, 20 nt, Human
ccacuccaggugauucugau

SEQ ID NO: 581888 - RNA, 22 nt, Human
caggguugguuucuccucaggc

SEQ ID NO: 581889 - RNA, 22 nt, Human
uuucauguacuuuuuugauaga

SEQ ID NO: 581890 - RNA, 22 nt, Human
aaauaagaaauucuucuuugca

SEQ ID NO: 581891 - RNA, 22 nt, Human
aucguuaaucuugugugucaac

SEQ ID NO: 581892 - RNA, 20 nt, Human
ucuaggcaggcaggcucgug

SEQ ID NO: 581893 - RNA, 22 nt, Human
ucacaguugauugaaacacagc

SEQ ID NO: 581894 - RNA, 21 nt, Human
ggucaggcaugugcccugagc

SEQ ID NO: 581895 - RNA, 18 nt, Human
aggcuucccaggcaggcc

SEQ ID NO: 581896 - RNA, 22 nt, Human
ucacaguauaaccucauauagg

SEQ ID NO: 581897 - RNA, 22 nt, Human
ggcagcuauuccaagcagcacu

SEQ ID NO: 581898 - RNA, 19 nt, Human
aggcuggagacaccaggcc

SEQ ID NO: 581899 - RNA, 22 nt, Human
cagcagagguuggaacaguucu

SEQ ID NO: 581900 - RNA, 22 nt, Human
gggaagaguaacuagcccaugu

SEQ ID NO: 581901 - RNA, 22 nt, Human
aucucugguuguuuugcuccca

SEQ ID NO: 581902 - RNA, 22 nt, Human
uacacuggccccagggcggggc

SEQ ID NO: 581903 - RNA, 22 nt, Human
uacacuggcuguuuugcagaaa

SEQ ID NO: 581904 - RNA, 22 nt, Human
ggucaggauccaagucugugcu

SEQ ID NO: 581905 - RNA, 22 nt, Human
ggucccagguugacagggagac

SEQ ID NO: 581906 - RNA, 22 nt, Human
aaugcuuuuacgacauguaccu

SEQ ID NO: 581907 - RNA, 23 nt, Human
ucuccagugucucuucauugagu

SEQ ID NO: 581908 - RNA, 22 nt, Human
uuaggaaaauggaguccuuuua

SEQ ID NO: 581909 - RNA, 22 nt, Human
auacuucuuugauguucacagg

SEQ ID NO: 581910 - RNA, 22 nt, Human
agccaggcucaaggccugcucc

SEQ ID NO: 581911 - RNA, 22 nt, Human
ggcuggucucagugcuggguuc

SEQ ID NO: 581912 - RNA, 22 nt, Human
gcaggauugggcagagggugaa

SEQ ID NO: 581913 - RNA, 22 nt, Human
acccaggaggcagagguugcag

SEQ ID NO: 581914 - RNA, 22 nt, Human
acacaggaagucagcacugaug

SEQ ID NO: 581915 - RNA, 22 nt, Human
ucugaaguucuuaaauuaguuu

SEQ ID NO: 581916 - RNA, 22 nt, Human
acugggacuguaugugcuggac

SEQ ID NO: 581917 - RNA, 22 nt, Human
cacaguacuuaauucucuaaau

SEQ ID NO: 581918 - RNA, 22 nt, Human
acagccaggaauucuggagaag

SEQ ID NO: 581919 - RNA, 22 nt, Human
uuggcugguuucaagaaggcau

SEQ ID NO: 581920 - RNA, 22 nt, Human
acuaaauauuugagagguguag

SEQ ID NO: 581921 - RNA, 23 nt, Human
agaagcagcuucuggaguaucgg

SEQ ID NO: 581922 - RNA, 22 nt, Human
cuuucagaagaggaccuuucca

SEQ ID NO: 581923 - RNA, 22 nt, Human
aguguacaaaaugauagauaaa

SEQ ID NO: 581924 - RNA, 22 nt, Human
augugggccgugcggguguccu

SEQ ID NO: 581925 - RNA, 22 nt, Human
gugcaugugcauccauguguac

SEQ ID NO: 581926 - RNA, 22 nt, Human
auccugggcaaaguaugcuguc

SEQ ID NO: 581927 - RNA, 22 nt, Human
ucccuggcagcuaagggugguc

SEQ ID NO: 581928 - RNA, 22 nt, Human
ggcugagucugugacccaugcg

SEQ ID NO: 581929 - RNA, 22 nt, Human
uaauaacaauuguaggacauga

SEQ ID NO: 581930 - RNA, 22 nt, Human
ggcugaagaacugggagucuca

SEQ ID NO: 581931 - RNA, 22 nt, Human
agucucuuccucaugcauaugu

SEQ ID NO: 581932 - RNA, 22 nt, Human
auagacagaaagauaauagaau

SEQ ID NO: 581933 - RNA, 22 nt, Human
cugccucugcgucccacagagu

SEQ ID NO: 581934 - RNA, 22 nt, Human
ggaacacagaagggcugaaaaa

SEQ ID NO: 581935 - RNA, 22 nt, Human
ugauuucuuccuugucauuaga

SEQ ID NO: 581936 - RNA, 22 nt, Human
gcuggagugcugaggugcagug

SEQ ID NO: 581937 - RNA, 22 nt, Human
uuuagcuuaaauggagaaagag

SEQ ID NO: 581938 - RNA, 22 nt, Human
aggacccaagcacaguuccugg

SEQ ID NO: 581939 - RNA, 22 nt, Human
cugaacaacuugucauuccaag

SEQ ID NO: 581940 - RNA, 17 nt, Human
ggcagggugcuggguau

SEQ ID NO: 581941 - RNA, 22 nt, Human
agaguuugaauuuugaaaagau

SEQ ID NO: 581942 - RNA, 22 nt, Human
guuuccuuuaauagugauauug

SEQ ID NO: 581943 - RNA, 22 nt, Human
aagcacagauaaaacaggauuc

SEQ ID NO: 581944 - RNA, 22 nt, Human
uccuccaggucuaggguggcuu

SEQ ID NO: 581945 - RNA, 22 nt, Human
ccucuggcuguaccacuggcac

SEQ ID NO: 581946 - RNA, 22 nt, Human
aggugacaggacaggagcuggu

SEQ ID NO: 581947 - RNA, 22 nt, Human
gguagggaaggucucccacauu

SEQ ID NO: 581948 - RNA, 22 nt, Human
gcagggggucauucacgcuggc

SEQ ID NO: 581949 - RNA, 22 nt, Human
gcccagcugagaagcgcggggc

SEQ ID NO: 581950 - RNA, 22 nt, Human
gccugugucauguaguagcuuc

SEQ ID NO: 581951 - RNA, 22 nt, Human
cagggcccauggcucagguagg

SEQ ID NO: 581952 - RNA, 22 nt, Human
uuauaagacuguagugaguauu

SEQ ID NO: 581953 - RNA, 22 nt, Human
uucuucuguuggcagagcauac

SEQ ID NO: 581954 - RNA, 22 nt, Human
aagcuuugauaauuggauuacu

SEQ ID NO: 581955 - RNA, 22 nt, Human
ucuccaggaaagacacuggacu

SEQ ID NO: 581956 - RNA, 22 nt, Human
uggaguggacuucaugaggcca

SEQ ID NO: 581957 - RNA, 22 nt, Human
auggcuuaugaauaacaguagg

SEQ ID NO: 581958 - RNA, 22 nt, Human
ggauuagaggugaugauuauaa

SEQ ID NO: 581959 - RNA, 21 nt, Human
uucucuggauaggccaguccu

SEQ ID NO: 581960 - RNA, 22 nt, Human
uugaagcaugguacuuguucaa

SEQ ID NO: 581961 - RNA, 22 nt, Human
cagagccugcugccuucugaag

SEQ ID NO: 581962 - RNA, 22 nt, Human
aguuuaugucuuuacuucagcu

SEQ ID NO: 581963 - RNA, 22 nt, Human
ggggccagcaauguugaggaau

SEQ ID NO: 581964 - RNA, 22 nt, Human
acucagcugaugaagcacaagu

SEQ ID NO: 581965 - RNA, 22 nt, Human
auugcuucaacuguucaauggg

SEQ ID NO: 581966 - RNA, 22 nt, Human
ugcccagcacugugccagucac

SEQ ID NO: 581967 - RNA, 22 nt, Human
auaguuauaagaaaacguugaa

SEQ ID NO: 581968 - RNA, 22 nt, Human
guugugcauuuaugaagaaguu

SEQ ID NO: 581969 - RNA, 22 nt, Human
aaagguuuucaucacagcaaga

SEQ ID NO: 581970 - RNA, 22 nt, Human
uaaaugagggcugacaugauug

SEQ ID NO: 581971 - RNA, 22 nt, Human
cucuuuuucaccucugucagcg

SEQ ID NO: 581972 - RNA, 22 nt, Human
uggaacaaggguucauuuaaau

SEQ ID NO: 581973 - RNA, 22 nt, Human
aaauugcucuuuaaaaguacug

SEQ ID NO: 581974 - RNA, 22 nt, Human
ggaggggaggauuaaugacaaa

SEQ ID NO: 581975 - RNA, 20 nt, Human
gacaacacagcuucaggucc

SEQ ID NO: 581976 - RNA, 22 nt, Human
cagggcuuugugugccugggga

SEQ ID NO: 581977 - RNA, 22 nt, Human
uucacaauaggagcaugcaaau

SEQ ID NO: 581978 - RNA, 22 nt, Human
uacaagaaggaaaacuagcaau

SEQ ID NO: 581979 - RNA, 22 nt, Human
uacaaaguagaaauucaguaaa

SEQ ID NO: 581980 - RNA, 22 nt, Human
ccuccaggcugaauaucuagaa

SEQ ID NO: 581981 - RNA, 22 nt, Human
cugcauaugauagaugccuugc

SEQ ID NO: 581982 - RNA, 22 nt, Human
cagggacccgcacagguagcau

SEQ ID NO: 581983 - RNA, 22 nt, Human
cuggcugcgcuaguccagaaga

SEQ ID NO: 581984 - RNA, 22 nt, Human
cccuaaugcagcugagaagggc

SEQ ID NO: 581985 - RNA, 22 nt, Human
gaaucuuauccccaguccuuaa

SEQ ID NO: 581986 - RNA, 22 nt, Human
uaaccauauuuuccauuaaguu

SEQ ID NO: 581987 - RNA, 22 nt, Human
uggguccacggaagacuuaggg

SEQ ID NO: 581988 - RNA, 22 nt, Human
aacacugugcccacccuagucc

SEQ ID NO: 581989 - RNA, 22 nt, Human
aagcaauguuagaggccuuagg

SEQ ID NO: 581990 - RNA, 22 nt, Human
uucugacacauuacuacaugga

SEQ ID NO: 581991 - RNA, 22 nt, Human
gcucuguccagcgugcacagaa

SEQ ID NO: 581992 - RNA, 22 nt, Human
cugagcuuaacccuguuagcaa

SEQ ID NO: 581993 - RNA, 22 nt, Human
ugaccacagacccaaugacuac

SEQ ID NO: 581994 - RNA, 22 nt, Human
uuuagcauauccuauaaaacua

SEQ ID NO: 581995 - RNA, 22 nt, Human
uauugaucuggauauuuagaca

SEQ ID NO: 581996 - RNA, 22 nt, Human
gcagcccucuuggucacuaggc

SEQ ID NO: 581997 - RNA, 22 nt, Human
ccaggaggcggaagguacagug

SEQ ID NO: 581998 - RNA, 22 nt, Human
augggaggaucacuugaggcca

SEQ ID NO: 581999 - RNA, 22 nt, Human
ugggccagcaauugcugcucag

SEQ ID NO: 582000 - RNA, 22 nt, Human
ggaaggggugucgcccauggau

SEQ ID NO: 582001 - RNA, 22 nt, Human
cuuuuucauuggcuuuaggaca

SEQ ID NO: 582002 - RNA, 22 nt, Human
gcuacagguauauagaugaaac

SEQ ID NO: 582003 - RNA, 22 nt, Human
acauuguauaaugauuaucaca

SEQ ID NO: 582004 - RNA, 22 nt, Human
accagcucauaauuuucaaaac

SEQ ID NO: 582005 - RNA, 22 nt, Human
gcuggaagaaugagugccucgu

SEQ ID NO: 582006 - RNA, 22 nt, Human
uugaggucccaaacccacugag

SEQ ID NO: 582007 - RNA, 22 nt, Human
caggcagcugcuggguucagcc

SEQ ID NO: 582008 - RNA, 22 nt, Human
gcugggcucugucaugccuucc

SEQ ID NO: 582009 - RNA, 22 nt, Human
cucugccaguuucuggccucag

SEQ ID NO: 582010 - RNA, 22 nt, Human
gauguagcggcagcuguuuuuc

SEQ ID NO: 582011 - RNA, 22 nt, Human
caguguggugugcacagcuuag

SEQ ID NO: 582012 - RNA, 22 nt, Human
cuucacuugcucaucaugcuau

SEQ ID NO: 582013 - RNA, 22 nt, Human
cuugggccagcccagggggcau

SEQ ID NO: 582014 - RNA, 23 nt, Human
uggggagggaagucauuucugua

SEQ ID NO: 582015 - RNA, 22 nt, Human
cuguuuuccuggguuccaugag

SEQ ID NO: 582016 - RNA, 22 nt, Human
ucugggcaauggaugcacucac

SEQ ID NO: 582017 - RNA, 19 nt, Human
gucuuacaggcaacaugag

SEQ ID NO: 582018 - RNA, 22 nt, Human
ugaacauauucaccucuaaaua

SEQ ID NO: 582019 - RNA, 22 nt, Human
agugucugcuagguucaucaac

SEQ ID NO: 582020 - RNA, 22 nt, Human
acaaauuaccauggaauuuggg

SEQ ID NO: 582021 - RNA, 22 nt, Human
uuagcacuuugauucaugcaga

SEQ ID NO: 582022 - RNA, 22 nt, Human
uagaaacaaagaccugggugcu

SEQ ID NO: 582023 - RNA, 22 nt, Human
ucacugcuucuuggagaauguc

SEQ ID NO: 582024 - RNA, 22 nt, Human
gcugauggcuugcuggcugaca

SEQ ID NO: 582025 - RNA, 22 nt, Human
ucuuuuauuaggcugaaauggg

SEQ ID NO: 582026 - RNA, 22 nt, Human
cagggguguuuuuggccaggag

SEQ ID NO: 582027 - RNA, 22 nt, Human
guuagagguucagucgcuauaa

SEQ ID NO: 582028 - RNA, 22 nt, Human
gaggggcuugaggcccugaugg

SEQ ID NO: 582029 - RNA, 22 nt, Human
ucagcuccucaugcaggggaua

SEQ ID NO: 582030 - RNA, 22 nt, Human
gcagcaggucugucaaugucau

SEQ ID NO: 582031 - RNA, 19 nt, Human
ucucugcuucucuuggcau

SEQ ID NO: 582032 - RNA, 22 nt, Human
uucauuacugcgguagucacac

SEQ ID NO: 582033 - RNA, 22 nt, Human
uguaugcuuuccuucuuucugg

SEQ ID NO: 582034 - RNA, 22 nt, Human
gacacugucccacagaauucga

SEQ ID NO: 582035 - RNA, 20 nt, Human
augcauauauguggugucug

SEQ ID NO: 582036 - RNA, 22 nt, Human
uagagcuggaaaacugcaggua

SEQ ID NO: 582037 - RNA, 22 nt, Human
cuguccagucuuuagcaagcug

SEQ ID NO: 582038 - RNA, 22 nt, Human
accagacacugugaagacaggc

SEQ ID NO: 582039 - RNA, 22 nt, Human
aauauauuugaaucaggaacaa

SEQ ID NO: 582040 - RNA, 19 nt, Human
ugaggccaaggucacagau

SEQ ID NO: 582041 - RNA, 22 nt, Human
gcagucaguaaggcagccagaa

SEQ ID NO: 582042 - RNA, 22 nt, Human
agggcaugugggagaggagccu

SEQ ID NO: 582043 - RNA, 22 nt, Human
cauggcugaaauucuucgcuug

SEQ ID NO: 582044 - RNA, 22 nt, Human
cuauuguaguaagggaaagcca

SEQ ID NO: 582045 - RNA, 22 nt, Human
uuuuccucuguuauuaguguga

SEQ ID NO: 582046 - RNA, 22 nt, Human
gcuauguguaucuguuagagag

SEQ ID NO: 582047 - RNA, 21 nt, Human
acagggcaugcagcuggcugu

SEQ ID NO: 582048 - RNA, 22 nt, Human
uuccagugacuaagcuucugcu

SEQ ID NO: 582049 - RNA, 22 nt, Human
aucuccaguccugguuuccugg

SEQ ID NO: 582050 - RNA, 22 nt, Human
uaggaaauggcucaguuacugc

SEQ ID NO: 582051 - RNA, 22 nt, Human
aauaugaguuugccuuuccugc

SEQ ID NO: 582052 - RNA, 21 nt, Human
ucuuuucucugcaggauuccu

SEQ ID NO: 582053 - RNA, 22 nt, Human
gaagccagcaguggagaaagga

SEQ ID NO: 582054 - RNA, 22 nt, Human
uggcaauguaaauugaacuaga

SEQ ID NO: 582055 - RNA, 22 nt, Human
aaauuaagaguaacucuguaga

SEQ ID NO: 582056 - RNA, 22 nt, Human
uggccuggggaagaccaugggc

SEQ ID NO: 582057 - RNA, 22 nt, Human
cagcuggcagaaccugcaucca

SEQ ID NO: 582058 - RNA, 22 nt, Human
gggcccugcguccggaagucug

SEQ ID NO: 582059 - RNA, 22 nt, Human
gguaacaacccuacaaauccac

SEQ ID NO: 582060 - RNA, 22 nt, Human
agaguggggacagggccugucc

SEQ ID NO: 582061 - RNA, 22 nt, Human
aacauuuacaaauccuucugca

SEQ ID NO: 582062 - RNA, 22 nt, Human
agccuccuggaguuucugggau

SEQ ID NO: 582063 - RNA, 22 nt, Human
ccagggcugccuggccgugugu

SEQ ID NO: 582064 - RNA, 22 nt, Human
uuggaagacagccgucuuuauu

SEQ ID NO: 582065 - RNA, 22 nt, Human
uggcuuccaguaaucaggauuu

SEQ ID NO: 582066 - RNA, 22 nt, Human
gagcuggccgcagagagggcag

SEQ ID NO: 582067 - RNA, 22 nt, Human
gugcaagguacauccuugaugu

SEQ ID NO: 582068 - RNA, 19 nt, Human
cugccuguuauggagagaa

SEQ ID NO: 582069 - RNA, 22 nt, Human
ugccaucugcacccaccugccc

SEQ ID NO: 582070 - RNA, 22 nt, Human
uaccugcacagccagccaugug

SEQ ID NO: 582071 - RNA, 22 nt, Human
ggagcuguugauuguuugagga

SEQ ID NO: 582072 - RNA, 22 nt, Human
ugcagucuggauguccucagau

SEQ ID NO: 582073 - RNA, 22 nt, Human
gaagaaggaagaucaugcuuga

SEQ ID NO: 582074 - RNA, 22 nt, Human
gucccucaguagugcacagugg

SEQ ID NO: 582075 - RNA, 22 nt, Human
uugugcuaagugcuaugaaggc

SEQ ID NO: 582076 - RNA, 22 nt, Human
cccucccucugcuggguguaga

SEQ ID NO: 582077 - RNA, 22 nt, Human
aguuuauucucuggucuuagua

SEQ ID NO: 582078 - RNA, 22 nt, Human
cuuguuaaauuauauaagcaga

SEQ ID NO: 582079 - RNA, 22 nt, Human
acaaugcuguugagacauucuu

SEQ ID NO: 582080 - RNA, 22 nt, Human
uuaaagcacuaaaugaugaggg

SEQ ID NO: 582081 - RNA, 22 nt, Human
cccaggaaugagcaggcagggg

SEQ ID NO: 582082 - RNA, 22 nt, Human
aaguauuucagcgguucuuugu

SEQ ID NO: 582083 - RNA, 22 nt, Human
agcauauaaauggacauauuug

SEQ ID NO: 582084 - RNA, 18 nt, Human
cuuccucaucgcucuccc

SEQ ID NO: 582085 - RNA, 22 nt, Human
uuacaauaccacaucaccucau

SEQ ID NO: 582086 - RNA, 22 nt, Human
ugagguaguguuuaguccaguc

SEQ ID NO: 582087 - RNA, 23 nt, Human
cagaagcaccuguugacugcugc

SEQ ID NO: 582088 - RNA, 22 nt, Human
aacuguaagagaauaaaugugu

SEQ ID NO: 582089 - RNA, 22 nt, Human
gagaaacuaacaucugaaggug

SEQ ID NO: 582090 - RNA, 22 nt, Human
ucaaagcaugguuuugaaagac

SEQ ID NO: 582091 - RNA, 22 nt, Human
cugccugcugacauucuuuaua

SEQ ID NO: 582092 - RNA, 22 nt, Human
auccaaaguagauuaagucaca

SEQ ID NO: 582093 - RNA, 22 nt, Human
acaaggcugugggagaaccucu

SEQ ID NO: 582094 - RNA, 22 nt, Human
gcaggccugacuguagggggca

SEQ ID NO: 582095 - RNA, 22 nt, Human
ccuuggcuuaccuucugugugg

SEQ ID NO: 582096 - RNA, 19 nt, Human
aggugaggggcaccauguc

SEQ ID NO: 582097 - RNA, 22 nt, Human
accugggcauuuuggaugauua

SEQ ID NO: 582098 - RNA, 22 nt, Human
ucucuuucucaaaauguaagca

SEQ ID NO: 582099 - RNA, 22 nt, Human
uuucuccuguguaagccgccca

SEQ ID NO: 582100 - RNA, 22 nt, Human
agcugaaggcuagaacagcugg

SEQ ID NO: 582101 - RNA, 18 nt, Human
gcugaaugucugcuuugc

SEQ ID NO: 582102 - RNA, 22 nt, Human
uuucuguuaggcaucauuuuaa

SEQ ID NO: 582103 - RNA, 22 nt, Human
cuguauuuaguuaaaaugcuaa

SEQ ID NO: 582104 - RNA, 22 nt, Human
gacacagaccaccaggcccugg

SEQ ID NO: 582105 - RNA, 22 nt, Human
gggcuccagggcccgagucguc

SEQ ID NO: 582106 - RNA, 22 nt, Human
gagaacuuucuguguuuuuauc

SEQ ID NO: 582107 - RNA, 22 nt, Human
ucccagccauuccuuuaggugu

SEQ ID NO: 582108 - RNA, 22 nt, Human
gggacuggauagauguggguga

SEQ ID NO: 582109 - RNA, 22 nt, Human
ucuguggcugugcugggccaga

SEQ ID NO: 582110 - RNA, 22 nt, Human
aagcagggugucuugacccaug

SEQ ID NO: 582111 - RNA, 22 nt, Human
uccugggagcccuugcuccacc

SEQ ID NO: 582112 - RNA, 22 nt, Human
aauaaugucuaugguuccaaaa

SEQ ID NO: 582113 - RNA, 22 nt, Human
uuacuguuugaaaaaugaaugu

SEQ ID NO: 582114 - RNA, 22 nt, Human
gugauaauugcagagaaaggag

SEQ ID NO: 582115 - RNA, 23 nt, Human
uucucuuuagauuuacauuacuc

SEQ ID NO: 582116 - RNA, 22 nt, Human
agaggccacaccagccucccgu

SEQ ID NO: 582117 - RNA, 22 nt, Human
agagcucugcagcuggccucag

SEQ ID NO: 582118 - RNA, 21 nt, Human
cccuguguuccacagcagaca

SEQ ID NO: 582119 - RNA, 22 nt, Human
gagguagguguaggaggccugc

SEQ ID NO: 582120 - RNA, 22 nt, Human
acccagagucauguuuauuccc

SEQ ID NO: 582121 - RNA, 22 nt, Human
cccagggaagccauuucugacu

SEQ ID NO: 582122 - RNA, 22 nt, Human
cagcuugggucaggugccugcu

SEQ ID NO: 582123 - RNA, 22 nt, Human
acacaugcagguauacauguuc

SEQ ID NO: 582124 - RNA, 22 nt, Human
caggggcugaaauguugggguu

SEQ ID NO: 582125 - RNA, 22 nt, Human
agccaguuggcuaugaggagga

SEQ ID NO: 582126 - RNA, 22 nt, Human
cacaggcuuccaguccccagcu

SEQ ID NO: 582127 - RNA, 22 nt, Human
gggagggcuuggacccagaugu

SEQ ID NO: 582128 - RNA, 22 nt, Human
ccagggcugcugugggacucca

SEQ ID NO: 582129 - RNA, 23 nt, Human
uggcacagcaggugugcuuuguu

SEQ ID NO: 582130 - RNA, 22 nt, Human
acuggcuugaaguagauucaaa

SEQ ID NO: 582131 - RNA, 22 nt, Human
cccaggcuaguaugauaucagu

SEQ ID NO: 582132 - RNA, 22 nt, Human
augcaguggcuucagugucagu

SEQ ID NO: 582133 - RNA, 21 nt, Human
caucacauuacucaaaguccu

SEQ ID NO: 582134 - RNA, 22 nt, Human
uaaaucuuguggcaaugcuucu

SEQ ID NO: 582135 - RNA, 22 nt, Human
auugcauucauugacauaugag

SEQ ID NO: 582136 - RNA, 22 nt, Human
gccuucugugcuccuggccuuu

SEQ ID NO: 582137 - RNA, 22 nt, Human
acagcaaaggacgaacacucug

SEQ ID NO: 582138 - RNA, 22 nt, Human
gagacaggccaggugguacuua

SEQ ID NO: 582139 - RNA, 22 nt, Human
ccugcagguugcagaggcggaa

SEQ ID NO: 582140 - RNA, 19 nt, Human
ccagagagcuagguacaga

SEQ ID NO: 582141 - RNA, 22 nt, Human
aaacuuuuucuuagguaugucu

SEQ ID NO: 582142 - RNA, 22 nt, Human
acauguauugacauuauauucu

SEQ ID NO: 582143 - RNA, 22 nt, Human
uuugaaaguucuucugacacua

SEQ ID NO: 582144 - RNA, 22 nt, Human
auggaaaucagguucauccaag

SEQ ID NO: 582145 - RNA, 22 nt, Human
aaggcacuagcagaauuaguga

SEQ ID NO: 582146 - RNA, 22 nt, Human
uagcacacgcauuagcaaauca

SEQ ID NO: 582147 - RNA, 22 nt, Human
aggaguggugcaggaccugcca

SEQ ID NO: 582148 - RNA, 22 nt, Human
ggaggggugcucagcugucacg

SEQ ID NO: 582149 - RNA, 22 nt, Human
uuucuguuguacuuaaacuagg

SEQ ID NO: 582150 - RNA, 22 nt, Human
accugcagccacuucucuccuu

SEQ ID NO: 582151 - RNA, 21 nt, Human
uuuaggaaguuuaaggcaggu

SEQ ID NO: 582152 - RNA, 22 nt, Human
ccagcccugucaccaacuggag

SEQ ID NO: 582153 - RNA, 22 nt, Human
cacaaaugacugaaacgacugu

SEQ ID NO: 582154 - RNA, 22 nt, Human
aauuggaaaaagacuuaauugc

SEQ ID NO: 582155 - RNA, 22 nt, Human
agcaggugucggcgagggucuu

SEQ ID NO: 582156 - RNA, 22 nt, Human
cuguagccagaagcagaaggcc

SEQ ID NO: 582157 - RNA, 22 nt, Human
ugcagcagguuccaaaggguua

SEQ ID NO: 582158 - RNA, 18 nt, Human
caaauacuguugucuuau

SEQ ID NO: 582159 - RNA, 23 nt, Human
ccacgucugcacuguagcuguug

SEQ ID NO: 582160 - RNA, 23 nt, Human
aauagcugguaaugauagcacaa

SEQ ID NO: 582161 - RNA, 22 nt, Human
gccaggcugacucccccggccu

SEQ ID NO: 582162 - RNA, 22 nt, Human
gaaaccucuuagccucucuuug

SEQ ID NO: 582163 - RNA, 22 nt, Human
caggaacaauguaagucucauu

SEQ ID NO: 582164 - RNA, 22 nt, Human
guuuugaaaugaaagaaccaag

SEQ ID NO: 582165 - RNA, 22 nt, Human
ucuguuccauguuuuguuccau

SEQ ID NO: 582166 - RNA, 22 nt, Human
acaguucugagcuauaauugcu

SEQ ID NO: 582167 - RNA, 22 nt, Human
uuaagacauuuuuggagauuau

SEQ ID NO: 582168 - RNA, 22 nt, Human
auuugacauugacacaccuaug

SEQ ID NO: 582169 - RNA, 22 nt, Human
cugugacagagcuugagugaga

SEQ ID NO: 582170 - RNA, 22 nt, Human
ucuuugaaaagauauuccuccu

SEQ ID NO: 582171 - RNA, 22 nt, Human
augcaguagauaggcacuuuua

SEQ ID NO: 582172 - RNA, 22 nt, Human
cugugaauuuuccaauauuccg

SEQ ID NO: 582173 - RNA, 22 nt, Human
aucaaugacaguugaauucuac

SEQ ID NO: 582174 - RNA, 18 nt, Human
uaggaagcuuaauguuuu

SEQ ID NO: 582175 - RNA, 22 nt, Human
gugauaaaggggaggaagugug

SEQ ID NO: 582176 - RNA, 22 nt, Human
gcauaucaugacuucuaucuua

SEQ ID NO: 582177 - RNA, 22 nt, Human
uagggcuguuaguaauucucag

SEQ ID NO: 582178 - RNA, 22 nt, Human
gcugcccugacaagcuacuccc

SEQ ID NO: 582179 - RNA, 22 nt, Human
agaggccaugcuagaggccugg

SEQ ID NO: 582180 - RNA, 22 nt, Human
ucuccacacuuucucucccagg

SEQ ID NO: 582181 - RNA, 22 nt, Human
aagcaucaacacuauauugaug

SEQ ID NO: 582182 - RNA, 22 nt, Human
auucauuccaggucagucagac

SEQ ID NO: 582183 - RNA, 22 nt, Human
ucuguacacuucagcaugcauc

SEQ ID NO: 582184 - RNA, 22 nt, Human
acuguagaggccuggauugagg

SEQ ID NO: 582185 - RNA, 22 nt, Human
uggccugggucacaccaggguc

SEQ ID NO: 582186 - RNA, 19 nt, Human
acccagggguuuaugugug

SEQ ID NO: 582187 - RNA, 22 nt, Human
auacagaacucucaguuguaua

SEQ ID NO: 582188 - RNA, 21 nt, Human
cagugagguccccagccuagg

SEQ ID NO: 582189 - RNA, 22 nt, Human
cucagggaauugaaucuccuug

SEQ ID NO: 582190 - RNA, 22 nt, Human
uuuucauuguaaaucaggaaac

SEQ ID NO: 582191 - RNA, 22 nt, Human
aaaaaagauugaugguggaugc

SEQ ID NO: 582192 - RNA, 22 nt, Human
uuagcaaaaauaucucauauua

SEQ ID NO: 582193 - RNA, 22 nt, Human
augcaggcagacacugugggca

SEQ ID NO: 582194 - RNA, 22 nt, Human
aaggcugaccaguuuacacuuu

SEQ ID NO: 582195 - RNA, 22 nt, Human
ucuguggagugaccugggcuuu

SEQ ID NO: 582196 - RNA, 22 nt, Human
cuggcuuccucaggagcagugg

SEQ ID NO: 582197 - RNA, 22 nt, Human
acuuuacucaacaaauauuuau

SEQ ID NO: 582198 - RNA, 22 nt, Human
gauauucuggugaaaccuuugg

SEQ ID NO: 582199 - RNA, 21 nt, Human
ccaggcuccugaggcugguca

SEQ ID NO: 582200 - RNA, 22 nt, Human
ucagaggaccuuacugagaacc

SEQ ID NO: 582201 - RNA, 19 nt, Human
ccccuuagggguuaagccu

SEQ ID NO: 582202 - RNA, 22 nt, Human
cuccagaaauucaacagcaaau

SEQ ID NO: 582203 - RNA, 20 nt, Human
uugcuagcuuuugugucacu

SEQ ID NO: 582204 - RNA, 22 nt, Human
uggcucagucauggaugaguaa

SEQ ID NO: 582205 - RNA, 22 nt, Human
ggcuggagugggcuccagaguu

SEQ ID NO: 582206 - RNA, 22 nt, Human
ugugugggugguaaggaaggcc

SEQ ID NO: 582207 - RNA, 22 nt, Human
gcugggcagccuggccgcugcc

SEQ ID NO: 582208 - RNA, 22 nt, Human
acuugaauaggaaagccacaaa

SEQ ID NO: 582209 - RNA, 22 nt, Human
agcagagcugcaguggccugcu

SEQ ID NO: 582210 - RNA, 22 nt, Human
acuuugacagcauuuuaauuau

SEQ ID NO: 582211 - RNA, 22 nt, Human
cuguggagcagggcagggucac

SEQ ID NO: 582212 - RNA, 18 nt, Human
gagcccugggagaucucu

SEQ ID NO: 582213 - RNA, 22 nt, Human
ggcaggagaaaggucucuucuu

SEQ ID NO: 582214 - RNA, 22 nt, Human
ucacugcaaccucugccuuccg

SEQ ID NO: 582215 - RNA, 22 nt, Human
uggcucauauugagugauuucu

SEQ ID NO: 582216 - RNA, 20 nt, Human
ugccaugguaacagagugug

SEQ ID NO: 582217 - RNA, 22 nt, Human
gcucugugaccuuaggcaaguu

SEQ ID NO: 582218 - RNA, 22 nt, Human
ccagggcacguugggacaguac

SEQ ID NO: 582219 - RNA, 22 nt, Human
gcagggugauagugaggcucag

SEQ ID NO: 582220 - RNA, 22 nt, Human
agaggaggaagagcuuuaaaau

SEQ ID NO: 582221 - RNA, 22 nt, Human
ccuggggauucugacacggagu

SEQ ID NO: 582222 - RNA, 22 nt, Human
uguccuugaugaauaugaaauu

SEQ ID NO: 582223 - RNA, 22 nt, Human
ucagggcaggcgagcagcugcu

SEQ ID NO: 582224 - RNA, 22 nt, Human
cuggccaguguggcucugaucu

SEQ ID NO: 582225 - RNA, 22 nt, Human
cuggcagcucuacucagagccu

SEQ ID NO: 582226 - RNA, 22 nt, Human
gggcuggaaaaacaacauacaa

SEQ ID NO: 582227 - RNA, 22 nt, Human
aaccugagucuuuugauuugcu

SEQ ID NO: 582228 - RNA, 18 nt, Human
gcccccagaugcuacuga

SEQ ID NO: 582229 - RNA, 19 nt, Human
gcccugcaggagguggggc

SEQ ID NO: 582230 - RNA, 22 nt, Human
uuugcugaguugaaguuugagg

SEQ ID NO: 582231 - RNA, 23 nt, Human
aaucacuucccuccaaauggauu

SEQ ID NO: 582232 - RNA, 22 nt, Human
agcugugugguuugggcaaauu

SEQ ID NO: 582233 - RNA, 22 nt, Human
ggcugcaggcaggguauccacu

SEQ ID NO: 582234 - RNA, 22 nt, Human
cacagaggaaugcaucagcaga

SEQ ID NO: 582235 - RNA, 22 nt, Human
ugacauuuaauuaacgaaugcu

SEQ ID NO: 582236 - RNA, 17 nt, Human
gcucugccccagccucu

SEQ ID NO: 582237 - RNA, 22 nt, Human
ugccuuuuccagcuuccaggag

SEQ ID NO: 582238 - RNA, 19 nt, Human
ugcuaaguccuuuagaggc

SEQ ID NO: 582239 - RNA, 22 nt, Human
uaagauaaguggguugagaugg

SEQ ID NO: 582240 - RNA, 22 nt, Human
auguguacacacauauauguau

SEQ ID NO: 582241 - RNA, 22 nt, Human
ccaggggcucucagggugugug

SEQ ID NO: 582242 - RNA, 22 nt, Human
uucuauuguaccuuuucucuca

SEQ ID NO: 582243 - RNA, 22 nt, Human
gacccagcuuaagucacauguu

SEQ ID NO: 582244 - RNA, 22 nt, Human
cuucuggaggcuccagggaggu

SEQ ID NO: 582245 - RNA, 22 nt, Human
gacagggaggaaagagacugcu

SEQ ID NO: 582246 - RNA, 23 nt, Human
uuguaucucuggaaauucuucaa

SEQ ID NO: 582247 - RNA, 22 nt, Human
aaguuaagcauggccaugugac

SEQ ID NO: 582248 - RNA, 22 nt, Human
cccucacucugccuccuggggu

SEQ ID NO: 582249 - RNA, 22 nt, Human
gagauuucuuuugaugccuguc

SEQ ID NO: 582250 - RNA, 22 nt, Human
uagcagcuuccagagagggcag

SEQ ID NO: 582251 - RNA, 22 nt, Human
uccugcagguggaugauucucu

SEQ ID NO: 582252 - RNA, 22 nt, Human
ugaaacaaaaguauguagcuug

SEQ ID NO: 582253 - RNA, 22 nt, Human
ggccugaaauaaaguagcagaa

SEQ ID NO: 582254 - RNA, 22 nt, Human
aaaauugguuccuuucugaggc

SEQ ID NO: 582255 - RNA, 22 nt, Human
cauuuuaaaugauuuaagccaa

SEQ ID NO: 582256 - RNA, 17 nt, Human
cugaagauaauggcaac

SEQ ID NO: 582257 - RNA, 23 nt, Human
agcuggaggcugucuacucccaa

SEQ ID NO: 582258 - RNA, 22 nt, Human
aggcugcucugcgaagucagcu

SEQ ID NO: 582259 - RNA, 22 nt, Human
ggccaggaagggaagaucagca

SEQ ID NO: 582260 - RNA, 22 nt, Human
cagcaggcugcgauugcucauu

SEQ ID NO: 582261 - RNA, 22 nt, Human
aauuuucugaugaugaagcacg

SEQ ID NO: 582262 - RNA, 22 nt, Human
uacuuccauguccuuagagucc

SEQ ID NO: 582263 - RNA, 22 nt, Human
auuuacagguagaauuuuaagu

SEQ ID NO: 582264 - RNA, 22 nt, Human
gcucacagccggcuggcagggg

SEQ ID NO: 582265 - RNA, 22 nt, Human
guggcaggagacuggaagaugg

SEQ ID NO: 582266 - RNA, 22 nt, Human
ucagggagagccugucugacgu

SEQ ID NO: 582267 - RNA, 22 nt, Human
gccaggcugcuccagggaggcc

SEQ ID NO: 582268 - RNA, 22 nt, Human
aacaguuuggguagguauguag

SEQ ID NO: 582269 - RNA, 22 nt, Human
cugggcucaaauccuggcccug

SEQ ID NO: 582270 - RNA, 22 nt, Human
acuguauauuggacaaggaaaa

SEQ ID NO: 582271 - RNA, 22 nt, Human
uccaucaccacagaggacagag

SEQ ID NO: 582272 - RNA, 22 nt, Human
ugauuuacaguagugucuaaac

SEQ ID NO: 582273 - RNA, 22 nt, Human
acauuaacaccgugaguuuggu

SEQ ID NO: 582274 - RNA, 22 nt, Human
augcaaauugccauaaaguggg

SEQ ID NO: 582275 - RNA, 22 nt, Human
agcccggcuuccccgguugcua

SEQ ID NO: 582276 - RNA, 22 nt, Human
gccaaggccucugcaggaugag

SEQ ID NO: 582277 - RNA, 22 nt, Human
cagcuccagcccaggcagcucc

SEQ ID NO: 582278 - RNA, 22 nt, Human
caggccugguugagcccugaga

SEQ ID NO: 582279 - RNA, 22 nt, Human
cccagacuccucuggcuggugg

SEQ ID NO: 582280 - RNA, 22 nt, Human
uucugaaauuucaacuuuacua

SEQ ID NO: 582281 - RNA, 22 nt, Human
acauuaacacuggugcuggugu

SEQ ID NO: 582282 - RNA, 20 nt, Human
augaaauuccuguuuucuga

SEQ ID NO: 582283 - RNA, 22 nt, Human
auugaaagagaauguagcucuu

SEQ ID NO: 582284 - RNA, 22 nt, Human
uguuuauugagugccuacuaua

SEQ ID NO: 582285 - RNA, 22 nt, Human
ucuccugaagaccaugugcacu

SEQ ID NO: 582286 - RNA, 22 nt, Human
cuguuauuuagaacauggaauc

SEQ ID NO: 582287 - RNA, 22 nt, Human
aaacagcugcacugcugauguc

SEQ ID NO: 582288 - RNA, 22 nt, Human
ucccugaggaagggguguggug

SEQ ID NO: 582289 - RNA, 22 nt, Human
auauuucuccaaauguuuucaa

SEQ ID NO: 582290 - RNA, 23 nt, Human
ugaugggaaggaacgacuaccac

SEQ ID NO: 582291 - RNA, 22 nt, Human
ccuggggaccugccucagcccu

SEQ ID NO: 582292 - RNA, 22 nt, Human
uuguucuuccaucaucccucag

SEQ ID NO: 582293 - RNA, 22 nt, Human
cugggaggcggagguuguagug

SEQ ID NO: 582294 - RNA, 22 nt, Human
acuggagucagggaaaaagugu

SEQ ID NO: 582295 - RNA, 22 nt, Human
ucucccagaggaucccagugga

SEQ ID NO: 582296 - RNA, 22 nt, Human
ucuuggcucugccacuaauuag

SEQ ID NO: 582297 - RNA, 22 nt, Human
ucuggcccaugauccugcuaac

SEQ ID NO: 582298 - RNA, 22 nt, Human
ggcuucucucccccagcuccac

SEQ ID NO: 582299 - RNA, 17 nt, Human
aaaucacugucaguuca

SEQ ID NO: 582300 - RNA, 22 nt, Human
ggaaggaggaugcucuggccuu

SEQ ID NO: 582301 - RNA, 22 nt, Human
ucuuuagaguuaacaauaauga

SEQ ID NO: 582302 - RNA, 22 nt, Human
augccuccucaaaucugccaca

SEQ ID NO: 582303 - RNA, 22 nt, Human
gcagagacagacuaaugaaaag

SEQ ID NO: 582304 - RNA, 22 nt, Human
acagggcagaaauguugcaucu

SEQ ID NO: 582305 - RNA, 22 nt, Human
cucuucccagcuccacgagagg

SEQ ID NO: 582306 - RNA, 22 nt, Human
cagaaggcaaacaaaaggauuu

SEQ ID NO: 582307 - RNA, 22 nt, Human
ugaggcacauccaggccagcuc

SEQ ID NO: 582308 - RNA, 22 nt, Human
aauauagcucacuauaccaugg

SEQ ID NO: 582309 - RNA, 21 nt, Human
aucuuuauuacgcagagaaga

SEQ ID NO: 582310 - RNA, 22 nt, Human
uuuaagacagugcaagcugaau

SEQ ID NO: 582311 - RNA, 22 nt, Human
gaagaauauauaaugauuuugu

SEQ ID NO: 582312 - RNA, 22 nt, Human
agauacugauucucaauggcuc

SEQ ID NO: 582313 - RNA, 22 nt, Human
gcaguccuccugccucagccuc

SEQ ID NO: 582314 - RNA, 22 nt, Human
aagcagcauaauugcuauuuua

SEQ ID NO: 582315 - RNA, 22 nt, Human
acuuuacauuugaucucucuaa

SEQ ID NO: 582316 - RNA, 22 nt, Human
agcuccagaggcagugaugaag

SEQ ID NO: 582317 - RNA, 22 nt, Human
aucagugcuucauagcccuggu

SEQ ID NO: 582318 - RNA, 22 nt, Human
cagagagcuuagugugcugcau

SEQ ID NO: 582319 - RNA, 17 nt, Human
uucugcugucguccucu

SEQ ID NO: 582320 - RNA, 22 nt, Human
gcucagaagauauuugaugcug

SEQ ID NO: 582321 - RNA, 22 nt, Human
ucucucauaagaugaguacuua

SEQ ID NO: 582322 - RNA, 22 nt, Human
ugugaaaucugaacucaaagau

SEQ ID NO: 582323 - RNA, 22 nt, Human
caagauaaagccaccagaagcu

SEQ ID NO: 582324 - RNA, 23 nt, Human
uggcugagguccagguaguuuca

SEQ ID NO: 582325 - RNA, 22 nt, Human
cagaggaagcagacacaucuug

SEQ ID NO: 582326 - RNA, 22 nt, Human
uaagagauucuaaagcuacugg

SEQ ID NO: 582327 - RNA, 20 nt, Human
uccagccccugcauguugcu

SEQ ID NO: 582328 - RNA, 22 nt, Human
uggaagugcucuucugaccaac

SEQ ID NO: 582329 - RNA, 17 nt, Human
ucuccaggacgagcuca

SEQ ID NO: 582330 - RNA, 22 nt, Human
gcuggccauggccugcgccauc

SEQ ID NO: 582331 - RNA, 22 nt, Human
cuuguauucugccuaaccuuca

SEQ ID NO: 582332 - RNA, 20 nt, Human
uggcuccugcgguggaacca

SEQ ID NO: 582333 - RNA, 22 nt, Human
uggcucaggugugagcugaaga

SEQ ID NO: 582334 - RNA, 22 nt, Human
cuggaggaaaacaacugcagac

SEQ ID NO: 582335 - RNA, 22 nt, Human
cagccagagaaagggcacugcc

SEQ ID NO: 582336 - RNA, 22 nt, Human
aggcagcaagauuauuuaaucc

SEQ ID NO: 582337 - RNA, 22 nt, Human
ggaaggaagaggaccgagcugg

SEQ ID NO: 582338 - RNA, 20 nt, Human
gcucccagccugcagucccc

SEQ ID NO: 582339 - RNA, 22 nt, Human
gaagcccagcaaacugugauca

SEQ ID NO: 582340 - RNA, 22 nt, Human
agaauuugagugcuuucugugu

SEQ ID NO: 582341 - RNA, 22 nt, Human
uugagguccccaguacccacug

SEQ ID NO: 582342 - RNA, 22 nt, Human
ccucagagacaguaacuggaau

SEQ ID NO: 582343 - RNA, 22 nt, Human
uaaggaggcugcugugaagaaa

SEQ ID NO: 582344 - RNA, 22 nt, Human
ucugaagauuaccagcuaaaug

SEQ ID NO: 582345 - RNA, 22 nt, Human
cuuccugagcaaggaacuauag

SEQ ID NO: 582346 - RNA, 22 nt, Human
ugggcuuaggucggaggcggcc

SEQ ID NO: 582347 - RNA, 22 nt, Human
ggcuggucuccaacccccgauc

SEQ ID NO: 582348 - RNA, 22 nt, Human
caaggaaguuuuaggagaggaa

SEQ ID NO: 582349 - RNA, 17 nt, Human
auaagacagaagacaau

SEQ ID NO: 582350 - RNA, 21 nt, Human
cucugggccauuuucuuccac

SEQ ID NO: 582351 - RNA, 22 nt, Human
uguuaagguccugacuucugca

SEQ ID NO: 582352 - RNA, 22 nt, Human
gcagggcugggauuugagccca

SEQ ID NO: 582353 - RNA, 22 nt, Human
agcuuuuacauaaugaucuuga

SEQ ID NO: 582354 - RNA, 22 nt, Human
ugcaggaggccccauggaaccg

SEQ ID NO: 582355 - RNA, 22 nt, Human
cagggugcgccacucagaugua

SEQ ID NO: 582356 - RNA, 22 nt, Human
aagacagagacucugcaacagg

SEQ ID NO: 582357 - RNA, 22 nt, Human
uauuggauugagacauuuuaga

SEQ ID NO: 582358 - RNA, 22 nt, Human
cucccucauauacccagcgaga

SEQ ID NO: 582359 - RNA, 22 nt, Human
uggauuuaguucuucacaggcc

SEQ ID NO: 582360 - RNA, 22 nt, Human
ccugugugaagguuaggcaggu

SEQ ID NO: 582361 - RNA, 22 nt, Human
acaguagaguaaaugguuagau

SEQ ID NO: 582362 - RNA, 22 nt, Human
auucaaaagaccaugcagacuc

SEQ ID NO: 582363 - RNA, 23 nt, Human
aucugaaaagcauuugcaguuug

SEQ ID NO: 582364 - RNA, 22 nt, Human
uuccaggaacaaacucaccuua

SEQ ID NO: 582365 - RNA, 22 nt, Human
ggguccagaaugagaaugggcu

SEQ ID NO: 582366 - RNA, 22 nt, Human
cagucccaugagcccagaacau

SEQ ID NO: 582367 - RNA, 22 nt, Human
cugaagcugaaaacuuccagca

SEQ ID NO: 582368 - RNA, 22 nt, Human
ccagugugcaaucucuggcuua

SEQ ID NO: 582369 - RNA, 22 nt, Human
guauuugauacaugaaauggug

SEQ ID NO: 582370 - RNA, 22 nt, Human
ccagagcccagggucaugcagg

SEQ ID NO: 582371 - RNA, 22 nt, Human
gcagcuuuaaaggaggcucuga

SEQ ID NO: 582372 - RNA, 22 nt, Human
cagcagcuggugagacacagcc

SEQ ID NO: 582373 - RNA, 22 nt, Human
uggggagguaacaauuucaggc

SEQ ID NO: 582374 - RNA, 22 nt, Human
ccugguggagaggggcggagcg

SEQ ID NO: 582375 - RNA, 22 nt, Human
uaguggagaggauguggagaaa

SEQ ID NO: 582376 - RNA, 22 nt, Human
uagauuuuaggagauuuuacug

SEQ ID NO: 582377 - RNA, 22 nt, Human
uccccagggcugcagagggugu

SEQ ID NO: 582378 - RNA, 22 nt, Human
acugcuuuagaccuagagcucu

SEQ ID NO: 582379 - RNA, 20 nt, Human
uuuccuuucauuuuaguacc

SEQ ID NO: 582380 - RNA, 19 nt, Human
cuuccccuguuaccucacu

SEQ ID NO: 582381 - RNA, 22 nt, Human
gcaaacauaauaugaagacacu

SEQ ID NO: 582382 - RNA, 22 nt, Human
gaggaagcagggcuuggcugag

SEQ ID NO: 582383 - RNA, 22 nt, Human
ccuuuugaagguguuguuaagu

SEQ ID NO: 582384 - RNA, 22 nt, Human
ccugucucccuggcauggcuca

SEQ ID NO: 582385 - RNA, 22 nt, Human
uacagcuuuucauauuuguguu

SEQ ID NO: 582386 - RNA, 22 nt, Human
aagagacuguaaaggcgugagu

SEQ ID NO: 582387 - RNA, 22 nt, Human
ugcugaaugaauggaugguugc

SEQ ID NO: 582388 - RNA, 22 nt, Human
ggcacacaggcagauggagugu

SEQ ID NO: 582389 - RNA, 22 nt, Human
gggcacuguggggcccaugcug

SEQ ID NO: 582390 - RNA, 22 nt, Human
uucugacaauucaguaacagca

SEQ ID NO: 582391 - RNA, 22 nt, Human
agugaccaaucaugguuagauu

SEQ ID NO: 582392 - RNA, 22 nt, Human
ggcugccucuggaagcuggaga

SEQ ID NO: 582393 - RNA, 21 nt, Human
acucugaaaauuaauaguuau

SEQ ID NO: 582394 - RNA, 22 nt, Human
guucaaguucauaucucuuaac

SEQ ID NO: 582395 - RNA, 22 nt, Human
ucaggaggccaccaggaccugu

SEQ ID NO: 582396 - RNA, 22 nt, Human
uaaaugacccaugcugaccuca

SEQ ID NO: 582397 - RNA, 22 nt, Human
gcucaguuauccgugugugacu

SEQ ID NO: 582398 - RNA, 22 nt, Human
aacacauggguguuuauuguac

SEQ ID NO: 582399 - RNA, 20 nt, Human
uugaaugaaugucuggcuca

SEQ ID NO: 582400 - RNA, 22 nt, Human
uucuuucucuacuagcagagcu

SEQ ID NO: 582401 - RNA, 22 nt, Human
caacuauagaucaaaugaguuu

SEQ ID NO: 582402 - RNA, 22 nt, Human
auuuauaacgugcagccagggu

SEQ ID NO: 582403 - RNA, 22 nt, Human
cagugaggaguccagggcagag

SEQ ID NO: 582404 - RNA, 22 nt, Human
aauguuacauaacccauugucc

SEQ ID NO: 582405 - RNA, 22 nt, Human
ccugaguaacauggugagaacc

SEQ ID NO: 582406 - RNA, 22 nt, Human
ucagcuuccucugugguuccag

SEQ ID NO: 582407 - RNA, 19 nt, Human
uccagaagucccugagcgg

SEQ ID NO: 582408 - RNA, 22 nt, Human
ucccugcugcacucacaccuac

SEQ ID NO: 582409 - RNA, 22 nt, Human
agaugggugccuucuuucuuua

SEQ ID NO: 582410 - RNA, 22 nt, Human
agagcagagggcucugggacaa

SEQ ID NO: 582411 - RNA, 23 nt, Human
acauuguucaaugaaaguuagga

SEQ ID NO: 582412 - RNA, 22 nt, Human
ggcucccugccuguccucaguc

SEQ ID NO: 582413 - RNA, 22 nt, Human
uguccucagauaugucuacucu

SEQ ID NO: 582414 - RNA, 22 nt, Human
ucugcagcuuuuugguggggug

SEQ ID NO: 582415 - RNA, 22 nt, Human
ccaggccaguguuugguccagg

SEQ ID NO: 582416 - RNA, 22 nt, Human
uuuuuaagagauucuccagucu

SEQ ID NO: 582417 - RNA, 22 nt, Human
ugagccuggagucguggagggg

SEQ ID NO: 582418 - RNA, 17 nt, Human
acagcaggcccggaggg

SEQ ID NO: 582419 - RNA, 22 nt, Human
uugcuguagggggaaaauacuu

SEQ ID NO: 582420 - RNA, 22 nt, Human
uuuuauucauagggauggagag

SEQ ID NO: 582421 - RNA, 19 nt, Human
agggcggggcccaggcaca

SEQ ID NO: 582422 - RNA, 22 nt, Human
auuugaaaucccuucuacugua

SEQ ID NO: 582423 - RNA, 22 nt, Human
aacuccaggcagggaggccacu

SEQ ID NO: 582424 - RNA, 22 nt, Human
auuaggcacuagaaugucaauu

SEQ ID NO: 582425 - RNA, 22 nt, Human
gccuggcaggccucaugagggg

SEQ ID NO: 582426 - RNA, 22 nt, Human
ugggaggucucuugcggccuag

SEQ ID NO: 582427 - RNA, 22 nt, Human
augggcaugcuucuaguugaaa

SEQ ID NO: 582428 - RNA, 22 nt, Human
ccugggcuugcaucugugcugg

SEQ ID NO: 582429 - RNA, 22 nt, Human
uucuaguuuugccuuaucaaca

SEQ ID NO: 582430 - RNA, 22 nt, Human
gcaggccacaguggagucucug

SEQ ID NO: 582431 - RNA, 22 nt, Human
cagcugaagaaagagugguuag

SEQ ID NO: 582432 - RNA, 21 nt, Human
cucagaccacagcucacaccc

SEQ ID NO: 582433 - RNA, 22 nt, Human
gacagguggguucucguaucug

SEQ ID NO: 582434 - RNA, 22 nt, Human
caggaggaacaagagguucugg

SEQ ID NO: 582435 - RNA, 22 nt, Human
gcagacagccagacugcacugg

SEQ ID NO: 582436 - RNA, 22 nt, Human
aaacaucauaggcaugcaugau

SEQ ID NO: 582437 - RNA, 22 nt, Human
ugguccuguagcacuugauuag

SEQ ID NO: 582438 - RNA, 22 nt, Human
ugcccugugccagacuuccugg

SEQ ID NO: 582439 - RNA, 22 nt, Human
gcagugcugaucccauggcaga

SEQ ID NO: 582440 - RNA, 22 nt, Human
ucuggccucuugggaugcuccc

SEQ ID NO: 582441 - RNA, 22 nt, Human
uucucagauauuuguauggaac

SEQ ID NO: 582442 - RNA, 22 nt, Human
cuugcucuagauguucagagcu

SEQ ID NO: 582443 - RNA, 17 nt, Human
uaucucuucaaguuuca

SEQ ID NO: 582444 - RNA, 22 nt, Human
agcaugaagacuucagagcuag

SEQ ID NO: 582445 - RNA, 22 nt, Human
agagaaggaaagcugacauggg

SEQ ID NO: 582446 - RNA, 22 nt, Human
gacaggccagacaggagacuga

SEQ ID NO: 582447 - RNA, 22 nt, Human
ggucucugacuuagagauggau

SEQ ID NO: 582448 - RNA, 21 nt, Human
ucaggcagugcaaauacaugg

SEQ ID NO: 582449 - RNA, 22 nt, Human
uaauacaucauucaucuaagga

SEQ ID NO: 582450 - RNA, 22 nt, Human
gcagaugguggaggcaagaggc

SEQ ID NO: 582451 - RNA, 22 nt, Human
ugcagagaaaccaguggaggac

SEQ ID NO: 582452 - RNA, 22 nt, Human
auguuccugguauaucaugacc

SEQ ID NO: 582453 - RNA, 16 nt, Human
uaaacagcagacaguu

SEQ ID NO: 582454 - RNA, 22 nt, Human
uuuaucacagaauaagaaguca

SEQ ID NO: 582455 - RNA, 22 nt, Human
aauggguugcuuuccacagccu

SEQ ID NO: 582456 - RNA, 22 nt, Human
gccgugggugucauggcccaua

SEQ ID NO: 582457 - RNA, 22 nt, Human
gggugcagggucuccagcagcu

SEQ ID NO: 582458 - RNA, 22 nt, Human
uugcauuagugucauaaggugg

SEQ ID NO: 582459 - RNA, 23 nt, Human
ucaguaaaugguaaagucucuuc

SEQ ID NO: 582460 - RNA, 22 nt, Human
uucucagaaaauguagagaaaa

SEQ ID NO: 582461 - RNA, 22 nt, Human
ugcagaccucccauggcugccu

SEQ ID NO: 582462 - RNA, 22 nt, Human
cuaaaaauccacacuaggugaa

SEQ ID NO: 582463 - RNA, 22 nt, Human
ucacagcauugucacaaggcug

SEQ ID NO: 582464 - RNA, 22 nt, Human
agaagauuauuagagacuuugu

SEQ ID NO: 582465 - RNA, 22 nt, Human
ccccaccaccaaggcucaguuu

SEQ ID NO: 582466 - RNA, 22 nt, Human
aaauaguuagcccugcauauau

SEQ ID NO: 582467 - RNA, 22 nt, Human
aaacaggcuuauauuuugcucu

SEQ ID NO: 582468 - RNA, 22 nt, Human
ucaguguucagcggugugugca

SEQ ID NO: 582469 - RNA, 20 nt, Human
augaguuuaaacauucagag

SEQ ID NO: 582470 - RNA, 22 nt, Human
gggggacuaacuggauccugga

SEQ ID NO: 582471 - RNA, 23 nt, Human
ugcaggacuacucgagcacugcu

SEQ ID NO: 582472 - RNA, 22 nt, Human
ccagagccuggcaucugcauaa

SEQ ID NO: 582473 - RNA, 22 nt, Human
auaagguuggucuuaacuaccu

SEQ ID NO: 582474 - RNA, 22 nt, Human
acaguccuuguguggaacauua

SEQ ID NO: 582475 - RNA, 22 nt, Human
ugugaggcuaccugccaggguc

SEQ ID NO: 582476 - RNA, 22 nt, Human
uccaggguguguuuacuggggu

SEQ ID NO: 582477 - RNA, 22 nt, Human
augacaauggacauaguuaaaa

SEQ ID NO: 582478 - RNA, 22 nt, Human
uucaguauguagaacaaguguu

SEQ ID NO: 582479 - RNA, 21 nt, Human
uagcacagcuguagacaguuu

SEQ ID NO: 582480 - RNA, 22 nt, Human
cugaguaagauacagaagcucc

SEQ ID NO: 582481 - RNA, 22 nt, Human
agcuggagaaaccugggagggu

SEQ ID NO: 582482 - RNA, 22 nt, Human
caggcucuagguuaguaggaga

SEQ ID NO: 582483 - RNA, 22 nt, Human
augaaauggugguuuuccauuu

SEQ ID NO: 582484 - RNA, 22 nt, Human
acuggauggugucaugagcagc

SEQ ID NO: 582485 - RNA, 22 nt, Human
aaccagcuaaacuuugcucgaa

SEQ ID NO: 582486 - RNA, 22 nt, Human
gugcaguucccaaggucacaca

SEQ ID NO: 582487 - RNA, 22 nt, Human
gagcuuccucagccuuucucac

SEQ ID NO: 582488 - RNA, 22 nt, Human
ugcugagggagcaucaaagaaa

SEQ ID NO: 582489 - RNA, 22 nt, Human
cagagcugucauuugccaguga

SEQ ID NO: 582490 - RNA, 22 nt, Human
uucuucaaauagcagggaguca

SEQ ID NO: 582491 - RNA, 23 nt, Human
gggagccaggaccucgcgcccca

SEQ ID NO: 582492 - RNA, 22 nt, Human
ucagaggaaaggucagauggcu

SEQ ID NO: 582493 - RNA, 22 nt, Human
uugaagcacaaugucuuuuauc

SEQ ID NO: 582494 - RNA, 22 nt, Human
uacauauuugucuuuguacugu

SEQ ID NO: 582495 - RNA, 22 nt, Human
cagcuguugcagcacugagaga

SEQ ID NO: 582496 - RNA, 22 nt, Human
uagcugacgcuaaauaaauguu

SEQ ID NO: 582497 - RNA, 22 nt, Human
cagaggcucuuccucacugccc

SEQ ID NO: 582498 - RNA, 23 nt, Human
gauacacucccugcugggcacug

SEQ ID NO: 582499 - RNA, 22 nt, Human
gagugguuagaaguaguguggc

SEQ ID NO: 582500 - RNA, 19 nt, Human
ccacuuugcuucucugggu

SEQ ID NO: 582501 - RNA, 22 nt, Human
gugugcagcagagacaggacuc

SEQ ID NO: 582502 - RNA, 22 nt, Human
accuugaacccagcuugcugca

SEQ ID NO: 582503 - RNA, 22 nt, Human
caguuuucuuguuauauuuggg

SEQ ID NO: 582504 - RNA, 22 nt, Human
aacauuuauauggguucaugaa

SEQ ID NO: 582505 - RNA, 22 nt, Human
aggcacugugcagucccaagca

SEQ ID NO: 582506 - RNA, 22 nt, Human
uuaagacaugugagcauaacuu

SEQ ID NO: 582507 - RNA, 23 nt, Human
gcagcugguuagaagggaaggag

SEQ ID NO: 582508 - RNA, 22 nt, Human
uucucuggauguuucucaguca

SEQ ID NO: 582509 - RNA, 22 nt, Human
caguuucugggcguucacaggu

SEQ ID NO: 582510 - RNA, 22 nt, Human
cucugggguuaagcuuccaugg

SEQ ID NO: 582511 - RNA, 22 nt, Human
cucugggcacauuuuccaggac

SEQ ID NO: 582512 - RNA, 22 nt, Human
cuggguggaaagugcugagaau

SEQ ID NO: 582513 - RNA, 21 nt, Human
uccugccuuaguccagagcag

SEQ ID NO: 582514 - RNA, 22 nt, Human
acaggcagggaccucuugaguu

SEQ ID NO: 582515 - RNA, 22 nt, Human
caggcccagggagggagaccaa

SEQ ID NO: 582516 - RNA, 22 nt, Human
cagggcuccaugcagggacucc

SEQ ID NO: 582517 - RNA, 22 nt, Human
cuguggaagguuuagauaggua

SEQ ID NO: 582518 - RNA, 21 nt, Human
caaugucugcucucugccuag

SEQ ID NO: 582519 - RNA, 22 nt, Human
uaccugaaguaacaaugaauau

SEQ ID NO: 582520 - RNA, 22 nt, Human
acugagguuuuuaguguuaaau

SEQ ID NO: 582521 - RNA, 22 nt, Human
uggaggacaggacuggacagcc

SEQ ID NO: 582522 - RNA, 22 nt, Human
cagguggucaggcagaugggcu

SEQ ID NO: 582523 - RNA, 22 nt, Human
ggcccugugguuuugcaaaguc

SEQ ID NO: 582524 - RNA, 23 nt, Human
ggcucugugcugggccugcagga

SEQ ID NO: 582525 - RNA, 22 nt, Human
uaaugcacauagaaguacuuag

SEQ ID NO: 582526 - RNA, 22 nt, Human
agaucauaugcaguaaugaacu

SEQ ID NO: 582527 - RNA, 22 nt, Human
uggccugaauuauggcagaucu

SEQ ID NO: 582528 - RNA, 22 nt, Human
ucaggcagagcuguggagcucu

SEQ ID NO: 582529 - RNA, 22 nt, Human
ccccaaagcugaguucccgccu

SEQ ID NO: 582530 - RNA, 22 nt, Human
gggcuggagccagcuguggcug

SEQ ID NO: 582531 - RNA, 22 nt, Human
cuccaggauaccuguuccuaua

SEQ ID NO: 582532 - RNA, 22 nt, Human
cuucagugaauguugaguaagg

SEQ ID NO: 582533 - RNA, 18 nt, Human
ugcaaauggcuguuugau

SEQ ID NO: 582534 - RNA, 22 nt, Human
ucuuccugaaacccuguuccag

SEQ ID NO: 582535 - RNA, 22 nt, Human
aggagagcaggccagccguccc

SEQ ID NO: 582536 - RNA, 22 nt, Human
ggagcuggagaguacagaguuu

SEQ ID NO: 582537 - RNA, 22 nt, Human
acauuucuggaguuucucaaca

SEQ ID NO: 582538 - RNA, 22 nt, Human
gaguuauuggguggaaagguag

SEQ ID NO: 582539 - RNA, 22 nt, Human
ucaggggcagccggggaagcca

SEQ ID NO: 582540 - RNA, 22 nt, Human
aguuuccaaauauuguuuuagc

SEQ ID NO: 582541 - RNA, 22 nt, Human
caguggcgugaucucugcucac

SEQ ID NO: 582542 - RNA, 18 nt, Human
aguccuuacgaggcuaua

SEQ ID NO: 582543 - RNA, 22 nt, Human
uccucagcaaacacuucacucu

SEQ ID NO: 582544 - RNA, 19 nt, Human
ugccugcuccuggcuucca

SEQ ID NO: 582545 - RNA, 22 nt, Human
cuggugccauucuguggccuag

SEQ ID NO: 582546 - RNA, 22 nt, Human
ucaggaagccgguuaaauagau

SEQ ID NO: 582547 - RNA, 21 nt, Human
ugcccuggggcucuucccuca

SEQ ID NO: 582548 - RNA, 22 nt, Human
cuggccccaucuggagucugag

SEQ ID NO: 582549 - RNA, 22 nt, Human
ggaggccaaggcagguggaucg

SEQ ID NO: 582550 - RNA, 22 nt, Human
aaaaggcauggagguugauagu

SEQ ID NO: 582551 - RNA, 22 nt, Human
uaacaaugauuagugacuacag

SEQ ID NO: 582552 - RNA, 22 nt, Human
aaauauguuuuccaguugucau

SEQ ID NO: 582553 - RNA, 22 nt, Human
acagcacagagugguauggcug

SEQ ID NO: 582554 - RNA, 22 nt, Human
cucagcuucuaccuccugagug

SEQ ID NO: 582555 - RNA, 22 nt, Human
cuaggaacaguucaacaguuua

SEQ ID NO: 582556 - RNA, 22 nt, Human
ucacacagggucggaaagagug

SEQ ID NO: 582557 - RNA, 22 nt, Human
aagccacuauggugauucucaa

SEQ ID NO: 582558 - RNA, 22 nt, Human
ugcugcagaaauucugugagga

SEQ ID NO: 582559 - RNA, 22 nt, Human
auggacagcaacuggaagcuuc

SEQ ID NO: 582560 - RNA, 22 nt, Human
uccugucugcucacagagcugg

SEQ ID NO: 582561 - RNA, 22 nt, Human
uauuuucuggacagucuugcuu

SEQ ID NO: 582562 - RNA, 22 nt, Human
uucuuacagcccuauuacuaaa

SEQ ID NO: 582563 - RNA, 22 nt, Human
acauuucuuucuauucaguagc

SEQ ID NO: 582564 - RNA, 22 nt, Human
uagcagaggcugucugacuuaa

SEQ ID NO: 582565 - RNA, 22 nt, Human
gaggaaaauaacaacuaagggc

SEQ ID NO: 582566 - RNA, 22 nt, Human
ucaguccuacacgcucagggac

SEQ ID NO: 582567 - RNA, 22 nt, Human
gaggccagaagucugagaucag

SEQ ID NO: 582568 - RNA, 22 nt, Human
auuucucagcacuuccuaucuc

SEQ ID NO: 582569 - RNA, 19 nt, Human
gcaggucauuaggcuaggu

SEQ ID NO: 582570 - RNA, 22 nt, Human
aauuacacagggaucacuuuuu

SEQ ID NO: 582571 - RNA, 22 nt, Human
cuucagcaccucagcuggagag

SEQ ID NO: 582572 - RNA, 19 nt, Human
ucccugaguuccagcccag

SEQ ID NO: 582573 - RNA, 22 nt, Human
guggaccaagguggaagauaaa

SEQ ID NO: 582574 - RNA, 22 nt, Human
aacaaggcacaagcuggcuguu

SEQ ID NO: 582575 - RNA, 22 nt, Human
guucugaguccuccuuugaagg

SEQ ID NO: 582576 - RNA, 22 nt, Human
uuacugaaaauucuucaggauu

SEQ ID NO: 582577 - RNA, 22 nt, Human
ucacaggagucaaggaauagua

SEQ ID NO: 582578 - RNA, 22 nt, Human
uugugaaugcuuaauauguuuc

SEQ ID NO: 582579 - RNA, 22 nt, Human
gauaccagacagggagggagaa

SEQ ID NO: 582580 - RNA, 22 nt, Human
guuacaaaggaagcuucacugc

SEQ ID NO: 582581 - RNA, 22 nt, Human
ucagaacagcgagaauauucac

SEQ ID NO: 582582 - RNA, 22 nt, Human
aaugaacaugggaguacuaaua

SEQ ID NO: 582583 - RNA, 22 nt, Human
auacaagacucagcacagacgg

SEQ ID NO: 582584 - RNA, 23 nt, Human
cugagggcuggucugaagucugc

SEQ ID NO: 582585 - RNA, 22 nt, Human
gcaguggggcgcugggaguugg

SEQ ID NO: 582586 - RNA, 19 nt, Human
ccagaagggcagcuaugga

SEQ ID NO: 582587 - RNA, 22 nt, Human
auagcuguagaauguauacaca

SEQ ID NO: 582588 - RNA, 22 nt, Human
gguuccuguacuuagcuaugua

SEQ ID NO: 582589 - RNA, 20 nt, Human
guucucacugaucugcaggg

SEQ ID NO: 582590 - RNA, 20 nt, Human
uccagcacccucacagagaa

SEQ ID NO: 582591 - RNA, 22 nt, Human
uuuaucuauuguauuguugaug

SEQ ID NO: 582592 - RNA, 22 nt, Human
ggcaguggcauguggguagugg

SEQ ID NO: 582593 - RNA, 22 nt, Human
gaggggccggcaugugccucuc

SEQ ID NO: 582594 - RNA, 22 nt, Human
aucaaguucugucacauuuguc

SEQ ID NO: 582595 - RNA, 22 nt, Human
gagggcugauaaaugcgcaugg

SEQ ID NO: 582596 - RNA, 22 nt, Human
ggagcagagcauuucacagccu

SEQ ID NO: 582597 - RNA, 23 nt, Human
ugaagcccagugauuuuguuuca

SEQ ID NO: 582598 - RNA, 22 nt, Human
gcugccuccacuggcucccagu

SEQ ID NO: 582599 - RNA, 22 nt, Human
uagaacaugugaaaauauagcc

SEQ ID NO: 582600 - RNA, 22 nt, Human
aucagaacaaaagaacaguuua

SEQ ID NO: 582601 - RNA, 22 nt, Human
ucagaggcuggaagagccuccu

SEQ ID NO: 582602 - RNA, 18 nt, Human
agcaccagucacuaacag

SEQ ID NO: 582603 - RNA, 22 nt, Human
ggaaggcuuuguagaagugcca

SEQ ID NO: 582604 - RNA, 22 nt, Human
uuuguuucgcagccucucucug

SEQ ID NO: 582605 - RNA, 22 nt, Human
acacagagcuggaacugcuuca

SEQ ID NO: 582606 - RNA, 22 nt, Human
acauuucuuugcuagacagcag

SEQ ID NO: 582607 - RNA, 22 nt, Human
guccccagcuaaucucuuugcc

SEQ ID NO: 582608 - RNA, 22 nt, Human
agcucuaucaccugucaguugc

SEQ ID NO: 582609 - RNA, 22 nt, Human
caguggaaacuaugcugcugga

SEQ ID NO: 582610 - RNA, 22 nt, Human
agauguguuucuaguuccugca

SEQ ID NO: 582611 - RNA, 22 nt, Human
auuucucaguaaucucagcaau

SEQ ID NO: 582612 - RNA, 22 nt, Human
aacaagaagggaaggcaugauu

SEQ ID NO: 582613 - RNA, 22 nt, Human
cccaggcugcguauccacaaua

SEQ ID NO: 582614 - RNA, 22 nt, Human
auacaacagaaaaugauuauuc

SEQ ID NO: 582615 - RNA, 22 nt, Human
aggcuauuuccacucuucucau

SEQ ID NO: 582616 - RNA, 22 nt, Human
gagugggcuuggggagaguuug

SEQ ID NO: 582617 - RNA, 22 nt, Human
agggcagaccacgugcaaggau

SEQ ID NO: 582618 - RNA, 22 nt, Human
gugaaggacugaaugaaaaugu

SEQ ID NO: 582619 - RNA, 22 nt, Human
aguggcuggcauaggaacagac

SEQ ID NO: 582620 - RNA, 22 nt, Human
gcccaggaaguugaggcugccg

SEQ ID NO: 582621 - RNA, 22 nt, Human
cccugcagccggccagcucauu

SEQ ID NO: 582622 - RNA, 22 nt, Human
gagauuuauugacuuaacagua

SEQ ID NO: 582623 - RNA, 22 nt, Human
ccuggaguugaaggaagguggg

SEQ ID NO: 582624 - RNA, 22 nt, Human
ggcuucuguccucuggaucugu

SEQ ID NO: 582625 - RNA, 22 nt, Human
aacuuuaucggaacagguacuc

SEQ ID NO: 582626 - RNA, 22 nt, Human
guggauggauuuugaggaaugg

SEQ ID NO: 582627 - RNA, 22 nt, Human
gcuaugaacaugagaaugcaaa

SEQ ID NO: 582628 - RNA, 22 nt, Human
ugugcaauaaucauagugauuu

SEQ ID NO: 582629 - RNA, 22 nt, Human
auuuccuauccuggucuuaaaa

SEQ ID NO: 582630 - RNA, 22 nt, Human
ucugagguuuucauguuuucug

SEQ ID NO: 582631 - RNA, 22 nt, Human
ggcugggaggaugacuugcuac

SEQ ID NO: 582632 - RNA, 22 nt, Human
agcagcuucuuucacuccugga

SEQ ID NO: 582633 - RNA, 22 nt, Human
uggaucucggcaaugcgggacu

SEQ ID NO: 582634 - RNA, 22 nt, Human
ccuggccagaggcgugccugug

SEQ ID NO: 582635 - RNA, 22 nt, Human
cuccaggacccaguggcuccag

SEQ ID NO: 582636 - RNA, 18 nt, Human
auguacauuugcuaaagc

SEQ ID NO: 582637 - RNA, 22 nt, Human
aaauuuuagaccaggcaaaacu

SEQ ID NO: 582638 - RNA, 22 nt, Human
ucaucuaauuuuggaacagaga

SEQ ID NO: 582639 - RNA, 22 nt, Human
augaaaagggagugauauuugu

SEQ ID NO: 582640 - RNA, 22 nt, Human
caggcugggcuccggagauaaa

SEQ ID NO: 582641 - RNA, 22 nt, Human
aacugcauucagaaagcucacu

SEQ ID NO: 582642 - RNA, 22 nt, Human
ucacugggagaugugggaaggg

SEQ ID NO: 582643 - RNA, 22 nt, Human
aggugcagcugacaccaugugg

SEQ ID NO: 582644 - RNA, 22 nt, Human
cuuaugcugagaaugaaagaau

SEQ ID NO: 582645 - RNA, 22 nt, Human
guccuguugggguguugcaguc

SEQ ID NO: 582646 - RNA, 22 nt, Human
cuuuuucccagguggagagagg

SEQ ID NO: 582647 - RNA, 22 nt, Human
ucauuucaugucucaggcacug

SEQ ID NO: 582648 - RNA, 22 nt, Human
ugaggcaggaguuaaugugcuc

SEQ ID NO: 582649 - RNA, 22 nt, Human
ccagagagguagcuuacccucu

SEQ ID NO: 582650 - RNA, 22 nt, Human
cuggcuuuguauaguucccuga

SEQ ID NO: 582651 - RNA, 22 nt, Human
aguccaagaccaaggugucacc

SEQ ID NO: 582652 - RNA, 22 nt, Human
guguucucuagagcuguacaaa

SEQ ID NO: 582653 - RNA, 18 nt, Human
uggacacauggccugggu

SEQ ID NO: 582654 - RNA, 22 nt, Human
ggaggcuuccuggcucuugauu

SEQ ID NO: 582655 - RNA, 19 nt, Human
cuggcugcaaugccagggu

SEQ ID NO: 582656 - RNA, 22 nt, Human
acuguauuuccaacagacaaau

SEQ ID NO: 582657 - RNA, 22 nt, Human
ugcagcugagucacccagccau

SEQ ID NO: 582658 - RNA, 22 nt, Human
gugugcacagagcuccaguguu

SEQ ID NO: 582659 - RNA, 18 nt, Human
acagaggcagacauguau

SEQ ID NO: 582660 - RNA, 22 nt, Human
uaggcaggugugcacugcccac

SEQ ID NO: 582661 - RNA, 22 nt, Human
cagaaagcucuuucaaucuugc

SEQ ID NO: 582662 - RNA, 22 nt, Human
aauaaaugaacaaagcagguug

SEQ ID NO: 582663 - RNA, 22 nt, Human
auuuaugauuagccuauuguug

SEQ ID NO: 582664 - RNA, 22 nt, Human
aagcucuucuguggauuugagu

SEQ ID NO: 582665 - RNA, 22 nt, Human
uagcagagcagggaucagagcc

SEQ ID NO: 582666 - RNA, 22 nt, Human
aauguuagauuccuccaccuag

SEQ ID NO: 582667 - RNA, 22 nt, Human
acagcaguuaacgaucagacuc

SEQ ID NO: 582668 - RNA, 22 nt, Human
agucccagugagaugaaccagg

SEQ ID NO: 582669 - RNA, 22 nt, Human
gcagggcagugugucugugggg

SEQ ID NO: 582670 - RNA, 22 nt, Human
ucaguaaacagguuuaaguccu

SEQ ID NO: 582671 - RNA, 22 nt, Human
gaaagggaguggacaacaggca

SEQ ID NO: 582672 - RNA, 22 nt, Human
cucaguuucuuacucuguauaa

SEQ ID NO: 582673 - RNA, 22 nt, Human
guuguuuuauugugagucccau

SEQ ID NO: 582674 - RNA, 22 nt, Human
auaugcuuaugaugguuaauuu

SEQ ID NO: 582675 - RNA, 22 nt, Human
cugcagggcuuaccuugcucug

SEQ ID NO: 582676 - RNA, 22 nt, Human
cagucuccaaaucaaucugaau

SEQ ID NO: 582677 - RNA, 22 nt, Human
ggccucuucugcucauacuuuc

SEQ ID NO: 582678 - RNA, 22 nt, Human
uggucuggaacuccuggcuuca

SEQ ID NO: 582679 - RNA, 22 nt, Human
ccaagggcucuggacagagugg

SEQ ID NO: 582680 - RNA, 22 nt, Human
ucaaaguuacuugugguuuucu

SEQ ID NO: 582681 - RNA, 22 nt, Human
aauuaacaaauguagcugugau

SEQ ID NO: 582682 - RNA, 22 nt, Human
acaguggaagaagcacugaacu

SEQ ID NO: 582683 - RNA, 22 nt, Human
auagccaggagaugauggggga

SEQ ID NO: 582684 - RNA, 22 nt, Human
uuucuuggguuccaguucccag

SEQ ID NO: 582685 - RNA, 22 nt, Human
uuccuagcuauaaagcucuucc

SEQ ID NO: 582686 - RNA, 22 nt, Human
uaaagauguucucauuucauag

SEQ ID NO: 582687 - RNA, 22 nt, Human
acagugucuccugguacccagu

SEQ ID NO: 582688 - RNA, 22 nt, Human
gcuucaaagauucacaguuuca

SEQ ID NO: 582689 - RNA, 22 nt, Human
cuggugagacucagggaugcuu

SEQ ID NO: 582690 - RNA, 22 nt, Human
uuucacaucagagguagauuag

SEQ ID NO: 582691 - RNA, 22 nt, Human
agccaggcagacucucuuucuu

SEQ ID NO: 582692 - RNA, 22 nt, Human
ucccaggcuggcaggcagcagu

SEQ ID NO: 582693 - RNA, 22 nt, Human
acuguacauauggauucuaaga

SEQ ID NO: 582694 - RNA, 22 nt, Human
cuggagugaagucuggcagcuu

SEQ ID NO: 582695 - RNA, 20 nt, Human
aacacacugguggcaucagg

SEQ ID NO: 582696 - RNA, 22 nt, Human
gagcugagacacacuuuggcaa

SEQ ID NO: 582697 - RNA, 22 nt, Human
ggccugagaauguaccagaucu

SEQ ID NO: 582698 - RNA, 22 nt, Human
agguccugggaguucuagugug

SEQ ID NO: 582699 - RNA, 22 nt, Human
auaagcuuuuaaagcuacuuug

SEQ ID NO: 582700 - RNA, 22 nt, Human
cugccugccacguucagcugua

SEQ ID NO: 582701 - RNA, 22 nt, Human
cuguuucuccacacucuuccca

SEQ ID NO: 582702 - RNA, 22 nt, Human
uucacaggaggguggaugcaug

SEQ ID NO: 582703 - RNA, 22 nt, Human
gcucccagggaccgcagggcag

SEQ ID NO: 582704 - RNA, 22 nt, Human
aacugcuuguaaauaauguuga

SEQ ID NO: 582705 - RNA, 22 nt, Human
gagaaggacuacacaucuggcc

SEQ ID NO: 582706 - RNA, 22 nt, Human
ugaaaauucaucucauagcaga

SEQ ID NO: 582707 - RNA, 20 nt, Human
gaaaucaguuaaugaugguu

SEQ ID NO: 582708 - RNA, 22 nt, Human
uugcuacuguucuuugcuagag

SEQ ID NO: 582709 - RNA, 22 nt, Human
auuagagauuaugaauuccuag

SEQ ID NO: 582710 - RNA, 22 nt, Human
cagugucugggacagaaaguca

SEQ ID NO: 582711 - RNA, 22 nt, Human
gaaaagcuaggccaguucagcu

SEQ ID NO: 582712 - RNA, 19 nt, Human
ucccaagauuucuguauca

SEQ ID NO: 582713 - RNA, 21 nt, Human
uugccccugaguuuuucugag

SEQ ID NO: 582714 - RNA, 22 nt, Human
cucugaaacuccugcaccuucu

SEQ ID NO: 582715 - RNA, 22 nt, Human
ucugagaauggagcuaaaaauc

SEQ ID NO: 582716 - RNA, 22 nt, Human
gcuucuguauuuauuguccuuu

SEQ ID NO: 582717 - RNA, 22 nt, Human
auccucagaccucagcaaagcc

SEQ ID NO: 582718 - RNA, 22 nt, Human
gaacccaguccaggugcagccu

SEQ ID NO: 582719 - RNA, 22 nt, Human
ucucuuucucagaugguggaga

SEQ ID NO: 582720 - RNA, 22 nt, Human
uccaauuuucugauuucacuug

SEQ ID NO: 582721 - RNA, 22 nt, Human
ugugaugcuggagugcgaauau

SEQ ID NO: 582722 - RNA, 22 nt, Human
cagccuguagaauacaguaaau

SEQ ID NO: 582723 - RNA, 22 nt, Human
aguggcaauguagagagugauc

SEQ ID NO: 582724 - RNA, 22 nt, Human
uacauacuccauaaugacagca

SEQ ID NO: 582725 - RNA, 22 nt, Human
ggccacacagaugacugcuuuc

SEQ ID NO: 582726 - RNA, 22 nt, Human
agcugagcacauucaaacaggu

SEQ ID NO: 582727 - RNA, 22 nt, Human
gcuuuguguagaaggaggaugg

SEQ ID NO: 582728 - RNA, 22 nt, Human
aaaugucagaaaacauggagug

SEQ ID NO: 582729 - RNA, 22 nt, Human
gccuuccuuuuaccaccagcca

SEQ ID NO: 582730 - RNA, 20 nt, Human
cugcagggugagugggcgau

SEQ ID NO: 582731 - RNA, 22 nt, Human
cugagcuuggcuuaucuccagc

SEQ ID NO: 582732 - RNA, 22 nt, Human
acaguguccccagcucugugag

SEQ ID NO: 582733 - RNA, 22 nt, Human
uuguuucugaguuuucauguau

SEQ ID NO: 582734 - RNA, 17 nt, Human
cccagcuggcagugccg

SEQ ID NO: 582735 - RNA, 22 nt, Human
ucugggaauaaaacuagggacu

SEQ ID NO: 582736 - RNA, 22 nt, Human
cucaucuaggauaaagcaucuu

SEQ ID NO: 582737 - RNA, 22 nt, Human
uggagcugggaguccugggcug

SEQ ID NO: 582738 - RNA, 22 nt, Human
auugcugaaucuaaggcuucca

SEQ ID NO: 582739 - RNA, 20 nt, Human
cucugcuuuccaccuuucag

SEQ ID NO: 582740 - RNA, 19 nt, Human
cccucuugcacaaagcaaa

SEQ ID NO: 582741 - RNA, 22 nt, Human
uaaacacucacuucauagccau

SEQ ID NO: 582742 - RNA, 22 nt, Human
uuucuucucacccaggacagag

SEQ ID NO: 582743 - RNA, 20 nt, Human
caaaugaagcuguuggccuc

SEQ ID NO: 582744 - RNA, 22 nt, Human
aguaguggcuuccuggagugcu

SEQ ID NO: 582745 - RNA, 22 nt, Human
uaguuuaggauccaaucuaaga

SEQ ID NO: 582746 - RNA, 22 nt, Human
gaggcagaggaagguggucucu

SEQ ID NO: 582747 - RNA, 22 nt, Human
aaauugcagguaggugggugau

SEQ ID NO: 582748 - RNA, 22 nt, Human
gcuccaguggauacagcagugg

SEQ ID NO: 582749 - RNA, 22 nt, Human
auuguaaguagaaauguuaugg

SEQ ID NO: 582750 - RNA, 18 nt, Human
aggcccuggccucgaaca

SEQ ID NO: 582751 - RNA, 22 nt, Human
acugccugccucugauucugca

SEQ ID NO: 582752 - RNA, 22 nt, Human
uucccuccuaugcccacugaaa

SEQ ID NO: 582753 - RNA, 22 nt, Human
uccucuccauauuuucugauuu

SEQ ID NO: 582754 - RNA, 22 nt, Human
acuuucugucaucuagacaagu

SEQ ID NO: 582755 - RNA, 22 nt, Human
agcuggccggccuccaggugga

SEQ ID NO: 582756 - RNA, 22 nt, Human
acugcaucugaaacauggguca

SEQ ID NO: 582757 - RNA, 22 nt, Human
uagugauugcugauauuccauu

SEQ ID NO: 582758 - RNA, 22 nt, Human
cuucaacuucccuagaugucau

SEQ ID NO: 582759 - RNA, 22 nt, Human
ucugcugagaugcccaugguua

SEQ ID NO: 582760 - RNA, 22 nt, Human
gcagguggaucaccacgucagg

SEQ ID NO: 582761 - RNA, 22 nt, Human
cugggccucauccccagaguuu

SEQ ID NO: 582762 - RNA, 22 nt, Human
cuggcagauaguaagugaucaa

SEQ ID NO: 582763 - RNA, 22 nt, Human
uacaucccagccagcagaauca

SEQ ID NO: 582764 - RNA, 22 nt, Human
aggagaccuucaccacuuccac

SEQ ID NO: 582765 - RNA, 22 nt, Human
uuuugcuugagugcacaaaaug

SEQ ID NO: 582766 - RNA, 22 nt, Human
cagcugcuguucaguuuuguuu

SEQ ID NO: 582767 - RNA, 22 nt, Human
agaaaauuacuccagagacaag

SEQ ID NO: 582768 - RNA, 22 nt, Human
aucauucagugaccacuuccca

SEQ ID NO: 582769 - RNA, 22 nt, Human
ccacaaauuagguuuugcuugu

SEQ ID NO: 582770 - RNA, 22 nt, Human
aacacaggcauacuggcuccag

SEQ ID NO: 582771 - RNA, 22 nt, Human
ugggaugcccugacccucugga

SEQ ID NO: 582772 - RNA, 22 nt, Human
agaucaaggacaugaagaggcu

SEQ ID NO: 582773 - RNA, 23 nt, Human
cagcccaaagagagagcuacuuu

SEQ ID NO: 582774 - RNA, 22 nt, Human
auuaggauguuccuaugcacau

SEQ ID NO: 582775 - RNA, 22 nt, Human
uaaucuuagacauguauuuuuc

SEQ ID NO: 582776 - RNA, 22 nt, Human
aggagugcaaauaguccagaga

SEQ ID NO: 582777 - RNA, 22 nt, Human
ugcugaauugguaguacuguug

SEQ ID NO: 582778 - RNA, 22 nt, Human
ugggguaggagucagcgagaga

SEQ ID NO: 582779 - RNA, 22 nt, Human
cucagggacguuagaggacagg

SEQ ID NO: 582780 - RNA, 22 nt, Human
uuauugcugcuaacauuuuaug

SEQ ID NO: 582781 - RNA, 22 nt, Human
uaaaguguguauauacauaugg

SEQ ID NO: 582782 - RNA, 22 nt, Human
cugccuggaaggagcaagggga

SEQ ID NO: 582783 - RNA, 22 nt, Human
gaggguggaucagccugauugg

SEQ ID NO: 582784 - RNA, 22 nt, Human
uagggcugaggcaacaagggag

SEQ ID NO: 582785 - RNA, 19 nt, Human
ccagucuccuugcagcauc

SEQ ID NO: 582786 - RNA, 22 nt, Human
gcacacccucucaccagcacug

SEQ ID NO: 582787 - RNA, 22 nt, Human
ccagucccagcucugccaugcu

SEQ ID NO: 582788 - RNA, 22 nt, Human
uggacaacauagugagaccuca

SEQ ID NO: 582789 - RNA, 20 nt, Human
gcugaggucccugugguuuu

SEQ ID NO: 582790 - RNA, 22 nt, Human
auaaauucucugauguauagua

SEQ ID NO: 582791 - RNA, 22 nt, Human
acuucagagacuuuauggucca

SEQ ID NO: 582792 - RNA, 22 nt, Human
caguccugggugcagcaggaaa

SEQ ID NO: 582793 - RNA, 22 nt, Human
uucaugucugccuuuucaagug

SEQ ID NO: 582794 - RNA, 22 nt, Human
cagaaguugccacaugacccuu

SEQ ID NO: 582795 - RNA, 22 nt, Human
uuggucagucagagaauggagu

SEQ ID NO: 582796 - RNA, 22 nt, Human
uggucaggcugcucugcggcgu

SEQ ID NO: 582797 - RNA, 22 nt, Human
gcagggcuugcagcagcuagac

SEQ ID NO: 582798 - RNA, 22 nt, Human
ucaaugcauaggagguggcaga

SEQ ID NO: 582799 - RNA, 22 nt, Human
ugggagcacccugaggagcuuc

SEQ ID NO: 582800 - RNA, 20 nt, Human
cuucaggacccauccucccc

SEQ ID NO: 582801 - RNA, 23 nt, Human
gggggcugguugacucucugcag

SEQ ID NO: 582802 - RNA, 22 nt, Human
cagcucuggggcagagugacua

SEQ ID NO: 582803 - RNA, 22 nt, Human
cugggaugauagugcuaguauu

SEQ ID NO: 582804 - RNA, 22 nt, Human
caugcagucuggagccuucugu

SEQ ID NO: 582805 - RNA, 22 nt, Human
agagggcugggaugugcugugu

SEQ ID NO: 582806 - RNA, 22 nt, Human
gguagacugagcuccuugagga

SEQ ID NO: 582807 - RNA, 22 nt, Human
gagagugaggccugggaaucua

SEQ ID NO: 582808 - RNA, 22 nt, Human
uggaugccugggccuccuucca

SEQ ID NO: 582809 - RNA, 22 nt, Human
accucaguucaauucaguuaga

SEQ ID NO: 582810 - RNA, 22 nt, Human
ugaauaaauugagagcgaaugu

SEQ ID NO: 582811 - RNA, 22 nt, Human
uuuuaacacucagcacuaucuc

SEQ ID NO: 582812 - RNA, 22 nt, Human
cugaaggacacgugaggagcca

SEQ ID NO: 582813 - RNA, 22 nt, Human
cuguguguccucggacgaguuu

SEQ ID NO: 582814 - RNA, 22 nt, Human
aaaucagaggucagcuguacca

SEQ ID NO: 582815 - RNA, 22 nt, Human
cuuggaauugaugauuuucaua

SEQ ID NO: 582816 - RNA, 22 nt, Human
augaagacaaacuggguagaaa

SEQ ID NO: 582817 - RNA, 22 nt, Human
ugugucagcacaguaucaauua

SEQ ID NO: 582818 - RNA, 22 nt, Human
cauucauucacauuuugucuau

SEQ ID NO: 582819 - RNA, 22 nt, Human
aggggccucgcaggaccgcucc

SEQ ID NO: 582820 - RNA, 22 nt, Human
ugcuggaggggccugaccagga

SEQ ID NO: 582821 - RNA, 22 nt, Human
aauguucauuguuuuccauaug

SEQ ID NO: 582822 - RNA, 22 nt, Human
agaaagcccaggagaacagauu

SEQ ID NO: 582823 - RNA, 21 nt, Human
caggaaacugaggccaugggg

SEQ ID NO: 582824 - RNA, 22 nt, Human
agcuguggggaggaggcuagca

SEQ ID NO: 582825 - RNA, 22 nt, Human
aaaucacugauuaaaguuagaa

SEQ ID NO: 582826 - RNA, 22 nt, Human
agcuuuguuugcucacccgccg

SEQ ID NO: 582827 - RNA, 16 nt, Human
acaguaaagcuggaca

SEQ ID NO: 582828 - RNA, 22 nt, Human
ggcuccaggcuccuauuucacu

SEQ ID NO: 582829 - RNA, 22 nt, Human
gccacaugcaauugcagcacgu

SEQ ID NO: 582830 - RNA, 23 nt, Human
ccaggccucucagagggugugcc

SEQ ID NO: 582831 - RNA, 22 nt, Human
aagcauuuauagauaagaauuu

SEQ ID NO: 582832 - RNA, 22 nt, Human
uccugcagcugaagcucaugug

SEQ ID NO: 582833 - RNA, 22 nt, Human
uagauucagauauuuaggacaa

SEQ ID NO: 582834 - RNA, 22 nt, Human
gcuguccagagcaugggagcaa

SEQ ID NO: 582835 - RNA, 22 nt, Human
uuagaggugucaggagcacagg

SEQ ID NO: 582836 - RNA, 22 nt, Human
uuuccuugccuccuguccuucu

SEQ ID NO: 582837 - RNA, 23 nt, Human
cauggaaaacugaaagcugaccu

SEQ ID NO: 582838 - RNA, 22 nt, Human
agcuccagagccacauccauca

SEQ ID NO: 582839 - RNA, 22 nt, Human
ggggcccagggcagcagugcag

SEQ ID NO: 582840 - RNA, 22 nt, Human
aacuagaacgagaaagcugaac

SEQ ID NO: 582841 - RNA, 17 nt, Human
caguggcagaucuucuc

SEQ ID NO: 582842 - RNA, 22 nt, Human
ugaacaaacugcauucuucacu

SEQ ID NO: 582843 - RNA, 22 nt, Human
caguuugcaaaugacuuacaga

SEQ ID NO: 582844 - RNA, 22 nt, Human
guuuguguaacaugaugaugau

SEQ ID NO: 582845 - RNA, 22 nt, Human
gcagggcaucccugagcgggug

SEQ ID NO: 582846 - RNA, 22 nt, Human
aggcaucugcagagcuugguga

SEQ ID NO: 582847 - RNA, 22 nt, Human
aggccaguguggcuggagcaca

SEQ ID NO: 582848 - RNA, 22 nt, Human
caauuuuauugguccaaauaca

SEQ ID NO: 582849 - RNA, 22 nt, Human
agccagugaugaagacucugga

SEQ ID NO: 582850 - RNA, 21 nt, Human
aguccccuguccuuacuucua

SEQ ID NO: 582851 - RNA, 22 nt, Human
ugccaggcagugucagauugag

SEQ ID NO: 582852 - RNA, 22 nt, Human
ggugcugccuauagucugaaac

SEQ ID NO: 582853 - RNA, 22 nt, Human
gauguguagagggaauuucaaa

SEQ ID NO: 582854 - RNA, 22 nt, Human
auuaauguguagccaacuuaau

SEQ ID NO: 582855 - RNA, 22 nt, Human
aguguccccuccaagggccugg

SEQ ID NO: 582856 - RNA, 22 nt, Human
uggcagcugccauguccacgug

SEQ ID NO: 582857 - RNA, 22 nt, Human
gcugcaggcuguggcaggggag

SEQ ID NO: 582858 - RNA, 22 nt, Human
gccaaggccugcagcaccucau

SEQ ID NO: 582859 - RNA, 22 nt, Human
cagccagaggggccagagucgg

SEQ ID NO: 582860 - RNA, 22 nt, Human
gcaguaggagaagaggaugcuu

SEQ ID NO: 582861 - RNA, 22 nt, Human
ccugaggucacaacuugcuuau

SEQ ID NO: 582862 - RNA, 22 nt, Human
aggacuuuagagccagaaagac

SEQ ID NO: 582863 - RNA, 22 nt, Human
ucugcauuuuuaacaagauccc

SEQ ID NO: 582864 - RNA, 22 nt, Human
cuucaaaagccagaagccugcg

SEQ ID NO: 582865 - RNA, 22 nt, Human
ugcuccagcuggagaugggggc

SEQ ID NO: 582866 - RNA, 22 nt, Human
gguuggggcgagcuggaggccc

SEQ ID NO: 582867 - RNA, 22 nt, Human
uauaggaaacauacgugacuag

SEQ ID NO: 582868 - RNA, 19 nt, Human
cuacuuuauaauaugccuc

SEQ ID NO: 582869 - RNA, 22 nt, Human
uggaaauagcuccaguuucauu

SEQ ID NO: 582870 - RNA, 22 nt, Human
cccccagccagcagugcucagc

SEQ ID NO: 582871 - RNA, 22 nt, Human
caaugucagaauuacaguugau

SEQ ID NO: 582872 - RNA, 22 nt, Human
uauuaugaucccagcccuggag

SEQ ID NO: 582873 - RNA, 22 nt, Human
uggcaugaguauaggcuucuca

SEQ ID NO: 582874 - RNA, 22 nt, Human
ccaggaggggucucugucuccc

SEQ ID NO: 582875 - RNA, 22 nt, Human
aaagcaaucagauucagauguc

SEQ ID NO: 582876 - RNA, 22 nt, Human
uccugaaguauggguauggagu

SEQ ID NO: 582877 - RNA, 22 nt, Human
cugcagagcauaaaucugaaua

SEQ ID NO: 582878 - RNA, 22 nt, Human
ggaggggcuccuguucgccccc

SEQ ID NO: 582879 - RNA, 22 nt, Human
gugaacuaaggauucaaacuuc

SEQ ID NO: 582880 - RNA, 22 nt, Human
agggcagcaaugcagcugcugc

SEQ ID NO: 582881 - RNA, 22 nt, Human
ugucucuucccacucagacccc

SEQ ID NO: 582882 - RNA, 22 nt, Human
caugggaggccugcugcuggug

SEQ ID NO: 582883 - RNA, 22 nt, Human
agcagcagaagguuugcaccca

SEQ ID NO: 582884 - RNA, 22 nt, Human
uugugucugggggagugacauc

SEQ ID NO: 582885 - RNA, 22 nt, Human
aggcaggugggucacuugaguc

SEQ ID NO: 582886 - RNA, 22 nt, Human
ugacaggaguggcuagugggag

SEQ ID NO: 582887 - RNA, 22 nt, Human
ccagagggaacugggccucauu

SEQ ID NO: 582888 - RNA, 22 nt, Human
ggccaauuccaggagccggcgg

SEQ ID NO: 582889 - RNA, 22 nt, Human
aaauguucccaauaugaagcug

SEQ ID NO: 582890 - RNA, 22 nt, Human
gaggguggcuccucccugggcc

SEQ ID NO: 582891 - RNA, 22 nt, Human
ucugcagaaaguggcucagugg

SEQ ID NO: 582892 - RNA, 23 nt, Human
accccaggcaucgcauuccucuu

SEQ ID NO: 582893 - RNA, 22 nt, Human
gaggcuggucagcccuaagauc

SEQ ID NO: 582894 - RNA, 22 nt, Human
uuuagcuucauuuggcgugauu

SEQ ID NO: 582895 - RNA, 22 nt, Human
ucugaaauaaaugcacuguuag

SEQ ID NO: 582896 - RNA, 22 nt, Human
aggccacaggcacccuguguuc

SEQ ID NO: 582897 - RNA, 22 nt, Human
cugcugagcaucagggcugccc

SEQ ID NO: 582898 - RNA, 22 nt, Human
auaguuccuacuuugcacuaau

SEQ ID NO: 582899 - RNA, 22 nt, Human
ugagggcugcuuccagagcuag

SEQ ID NO: 582900 - RNA, 21 nt, Human
acugucauuugcuuagggagg

SEQ ID NO: 582901 - RNA, 22 nt, Human
aagcaugucccuugugauucaa

SEQ ID NO: 582902 - RNA, 22 nt, Human
agcuaaggaugacuaguacuuc

SEQ ID NO: 582903 - RNA, 22 nt, Human
aggggcuggaguucgagguuac

SEQ ID NO: 582904 - RNA, 22 nt, Human
aggcagggcugggauuagacuc

SEQ ID NO: 582905 - RNA, 20 nt, Human
ucucauuauauccaagaggc

SEQ ID NO: 582906 - RNA, 22 nt, Human
aguuucucucaguauagaauag

SEQ ID NO: 582907 - RNA, 22 nt, Human
guguaacuuuuauucaugcucu

SEQ ID NO: 582908 - RNA, 22 nt, Human
ugucauuuacuccauacccuca

SEQ ID NO: 582909 - RNA, 22 nt, Human
ccaggagagcgcccucccggcc

SEQ ID NO: 582910 - RNA, 22 nt, Human
cccguguggacagcgugccagu

SEQ ID NO: 582911 - RNA, 22 nt, Human
ucuggccuauuucugucagauc

SEQ ID NO: 582912 - RNA, 22 nt, Human
aacaucuuuuuguuugcugaaa

SEQ ID NO: 582913 - RNA, 22 nt, Human
gcaucuucacacaaagccagug

SEQ ID NO: 582914 - RNA, 22 nt, Human
gagguggcuuagucucuggaca

SEQ ID NO: 582915 - RNA, 21 nt, Human
aucuggaagaacugguaagug

SEQ ID NO: 582916 - RNA, 22 nt, Human
ugggccaguagcuacucgcaag

SEQ ID NO: 582917 - RNA, 22 nt, Human
caagagcauuuaguuagcuggu

SEQ ID NO: 582918 - RNA, 22 nt, Human
agaccagcugccucccagggcc

SEQ ID NO: 582919 - RNA, 22 nt, Human
auuucagaugaccaaauggaaa

SEQ ID NO: 582920 - RNA, 22 nt, Human
gcugcauggagggugcccagga

SEQ ID NO: 582921 - RNA, 22 nt, Human
ggcccagcuuucauuccuugcu

SEQ ID NO: 582922 - RNA, 22 nt, Human
ucucugagcugcuucuugcaua

SEQ ID NO: 582923 - RNA, 22 nt, Human
cuuccuagcuucagagucuguu

SEQ ID NO: 582924 - RNA, 22 nt, Human
cuagcuuuuuaugacaaucuug

SEQ ID NO: 582925 - RNA, 22 nt, Human
aaauacugggcucaaaaggguu

SEQ ID NO: 582926 - RNA, 22 nt, Human
ggcauagauuucuuuagguuua

SEQ ID NO: 582927 - RNA, 22 nt, Human
uucaaaucucuccuaauccacu

SEQ ID NO: 582928 - RNA, 22 nt, Human
acugugauguucucuaucuugg

SEQ ID NO: 582929 - RNA, 22 nt, Human
ucaggcagaguuaauuugcucc

SEQ ID NO: 582930 - RNA, 22 nt, Human
gacagcuucuugggccgggccu

SEQ ID NO: 582931 - RNA, 22 nt, Human
gcagagccaggagcccaggauc

SEQ ID NO: 582932 - RNA, 22 nt, Human
cggggcagaaaguugucuuuug

SEQ ID NO: 582933 - RNA, 22 nt, Human
agggcucagcaucucauucugu

SEQ ID NO: 582934 - RNA, 22 nt, Human
uugcuaauaaaguuuuuaugug

SEQ ID NO: 582935 - RNA, 22 nt, Human
cccagccuuugcuuccugguuc

SEQ ID NO: 582936 - RNA, 22 nt, Human
gggccuggugcuucugacuccu

SEQ ID NO: 582937 - RNA, 22 nt, Human
ugcauuuccagauuucuggagu

SEQ ID NO: 582938 - RNA, 22 nt, Human
cagcaggggugucauuguaguu

SEQ ID NO: 582939 - RNA, 22 nt, Human
uggaggggcaauggagcgcgga

SEQ ID NO: 582940 - RNA, 22 nt, Human
uaagaguaucuauuaaguacuu

SEQ ID NO: 582941 - RNA, 22 nt, Human
uucagaauauccguuuaaguuu

SEQ ID NO: 582942 - RNA, 22 nt, Human
ccugaguggugcuaagcagaua

SEQ ID NO: 582943 - RNA, 21 nt, Human
uauugucaaucugcuuucaga

SEQ ID NO: 582944 - RNA, 22 nt, Human
gugcugagauuggagugagcag

SEQ ID NO: 582945 - RNA, 22 nt, Human
auguauaugaagcuaguauuuu

SEQ ID NO: 582946 - RNA, 22 nt, Human
caacuuuucugugaauuuaagu

SEQ ID NO: 582947 - RNA, 22 nt, Human
gugcucuccagccccacgugga

SEQ ID NO: 582948 - RNA, 22 nt, Human
aagaaaccuagucuggagcagc

SEQ ID NO: 582949 - RNA, 22 nt, Human
ggcagagcugcaugagcacuca

SEQ ID NO: 582950 - RNA, 19 nt, Human
uucucuggacuagaugcug

SEQ ID NO: 582951 - RNA, 22 nt, Human
ucuugcagacagcuuccagccu

SEQ ID NO: 582952 - RNA, 22 nt, Human
cacccagcauuggcuaagagag

SEQ ID NO: 582953 - RNA, 22 nt, Human
cugagguggcgccucucuuuaa

SEQ ID NO: 582954 - RNA, 22 nt, Human
uucuaacucuacacuagcuuug

SEQ ID NO: 582955 - RNA, 22 nt, Human
ucaauucuuauugguguucugc

SEQ ID NO: 582956 - RNA, 22 nt, Human
uacagugugacauuucuacaaa

SEQ ID NO: 582957 - RNA, 22 nt, Human
auaauucaugggccuuucaccu

SEQ ID NO: 582958 - RNA, 22 nt, Human
uaucuauuauguucuauguguc

SEQ ID NO: 582959 - RNA, 22 nt, Human
gggcuccugccuccuggcaccu

SEQ ID NO: 582960 - RNA, 22 nt, Human
aaaaacugguaacuauucccca

SEQ ID NO: 582961 - RNA, 22 nt, Human
gggcuuggguauugugagaggu

SEQ ID NO: 582962 - RNA, 22 nt, Human
aacauuuauugagcaccuacug

SEQ ID NO: 582963 - RNA, 22 nt, Human
caggccaauaaaugugauggcc

SEQ ID NO: 582964 - RNA, 22 nt, Human
auaccuuuuagacauguaguug

SEQ ID NO: 582965 - RNA, 22 nt, Human
auuauaaagaacaugugugugg

SEQ ID NO: 582966 - RNA, 22 nt, Human
augggaggaaggaggcccuuga

SEQ ID NO: 582967 - RNA, 22 nt, Human
auuuguagugaagugaaaauaa

SEQ ID NO: 582968 - RNA, 22 nt, Human
augaugcuguuauuaucuauac

SEQ ID NO: 582969 - RNA, 22 nt, Human
uugucgggcuuacgcagggcca

SEQ ID NO: 582970 - RNA, 22 nt, Human
aagagggguggucugugaggau

SEQ ID NO: 582971 - RNA, 22 nt, Human
ccacccuggguucugaugugga

SEQ ID NO: 582972 - RNA, 22 nt, Human
gcugaggauuacuugaagucag

SEQ ID NO: 582973 - RNA, 18 nt, Human
ucucaaaaauaauggcuu

SEQ ID NO: 582974 - RNA, 22 nt, Human
ggcucagguugggucacaugac

SEQ ID NO: 582975 - RNA, 22 nt, Human
ccuggggaauagagucaagggg

SEQ ID NO: 582976 - RNA, 22 nt, Human
aaacuugcgucaugucaugaaa

SEQ ID NO: 582977 - RNA, 22 nt, Human
auuaggauuuuguccaaguagc

SEQ ID NO: 582978 - RNA, 21 nt, Human
cacuauuuauauaugccagcu

SEQ ID NO: 582979 - RNA, 22 nt, Human
ugucaugggcauuuauugaggg

SEQ ID NO: 582980 - RNA, 22 nt, Human
gggacuggaacuacuggugcag

SEQ ID NO: 582981 - RNA, 22 nt, Human
uugaaacauucuccuauugauu

SEQ ID NO: 582982 - RNA, 22 nt, Human
gaauauauuauucagcuuuuca

SEQ ID NO: 582983 - RNA, 22 nt, Human
ugaggucccagggguagugugc

SEQ ID NO: 582984 - RNA, 19 nt, Human
caggagagcaugcacuuug

SEQ ID NO: 582985 - RNA, 18 nt, Human
uuggggugaggccaggaa

SEQ ID NO: 582986 - RNA, 22 nt, Human
ugccuaggcuggaaugcagugg

SEQ ID NO: 582987 - RNA, 22 nt, Human
gcauguggaaucucuccauggu

SEQ ID NO: 582988 - RNA, 22 nt, Human
uaaaucuuuaggaagcucaaac

SEQ ID NO: 582989 - RNA, 22 nt, Human
aguccccucucgcuuggcugag

SEQ ID NO: 582990 - RNA, 22 nt, Human
caggcuggagugcagugucgcc

SEQ ID NO: 582991 - RNA, 22 nt, Human
caaucuuagagagauucuuuua

SEQ ID NO: 582992 - RNA, 22 nt, Human
gcugcccaguucugcugcugcc

SEQ ID NO: 582993 - RNA, 22 nt, Human
gggauggcugccugcaucagga

SEQ ID NO: 582994 - RNA, 22 nt, Human
gccuguuuccaucaacacaugc

SEQ ID NO: 582995 - RNA, 22 nt, Human
ucuuugcaugugcuucuuggcc

SEQ ID NO: 582996 - RNA, 22 nt, Human
uacauugauucaggauauaggc

SEQ ID NO: 582997 - RNA, 22 nt, Human
uugccugugaggauucugguug

SEQ ID NO: 582998 - RNA, 22 nt, Human
cagcuccugccugggcagcugu

SEQ ID NO: 582999 - RNA, 22 nt, Human
aagaguuugucagaucugcacg

SEQ ID NO: 583000 - RNA, 22 nt, Human
acaaguggguccuacauaaagc

SEQ ID NO: 583001 - RNA, 22 nt, Human
gcaggcugcccucuuguguuga

SEQ ID NO: 583002 - RNA, 22 nt, Human
guggggcugcuuaggcugcgca

SEQ ID NO: 583003 - RNA, 22 nt, Human
ggaggcucuccuggccuugucu

SEQ ID NO: 583004 - RNA, 21 nt, Human
ggccagcagcguccacugugg

SEQ ID NO: 583005 - RNA, 22 nt, Human
cacccacauggaaauucacagu

SEQ ID NO: 583006 - RNA, 22 nt, Human
ucaggagagaguuggguaggcu

SEQ ID NO: 583007 - RNA, 22 nt, Human
caagauaagaucauuuacacua

SEQ ID NO: 583008 - RNA, 22 nt, Human
gucugcugcagagcauggcuuu

SEQ ID NO: 583009 - RNA, 22 nt, Human
ucugucuuagccaucucaggcu

SEQ ID NO: 583010 - RNA, 22 nt, Human
ucuucugaagguaggaagcauu

SEQ ID NO: 583011 - RNA, 22 nt, Human
cugacaguuuuugcuguauugu

SEQ ID NO: 583012 - RNA, 22 nt, Human
cagcuuuggagugugagugcug

SEQ ID NO: 583013 - RNA, 22 nt, Human
ucagggaaaccuaaggaagcca

SEQ ID NO: 583014 - RNA, 22 nt, Human
uagaaaagccccagcuggaggg

SEQ ID NO: 583015 - RNA, 22 nt, Human
agcaaacuaauugcaguucugg

SEQ ID NO: 583016 - RNA, 22 nt, Human
ggaggugggagccuccaguggu

SEQ ID NO: 583017 - RNA, 22 nt, Human
ucccagaaucuccagugcuaca

SEQ ID NO: 583018 - RNA, 22 nt, Human
aaaaguaauugcaauuuuguag

SEQ ID NO: 583019 - RNA, 19 nt, Human
gcugcucugggucucaucu

SEQ ID NO: 583020 - RNA, 22 nt, Human
agagccaguuaagcacuuacag

SEQ ID NO: 583021 - RNA, 22 nt, Human
acaugcuaaaucugagaugcuu

SEQ ID NO: 583022 - RNA, 22 nt, Human
ccugaaugccugacauuucacu

SEQ ID NO: 583023 - RNA, 22 nt, Human
agcuccugauucucagagauag

SEQ ID NO: 583024 - RNA, 22 nt, Human
aaaagagagcugaggagcucca

SEQ ID NO: 583025 - RNA, 22 nt, Human
gcacaugacuuugaggaaacca

SEQ ID NO: 583026 - RNA, 23 nt, Human
aucuuacauauuuagcaccugaa

SEQ ID NO: 583027 - RNA, 22 nt, Human
uggaagaccagacuucccgaac

SEQ ID NO: 583028 - RNA, 20 nt, Human
ugcaaacacagaguguauga

SEQ ID NO: 583029 - RNA, 19 nt, Human
ucuagucagucagucauuc

SEQ ID NO: 583030 - RNA, 22 nt, Human
aaagguuuugcccuggguauuc

SEQ ID NO: 583031 - RNA, 22 nt, Human
cuaagaaaauagaagcaugcua

SEQ ID NO: 583032 - RNA, 22 nt, Human
cugagggccuuggcuccugccc

SEQ ID NO: 583033 - RNA, 22 nt, Human
cggcaggaccucauuuccuucu

SEQ ID NO: 583034 - RNA, 22 nt, Human
ucuuaaaaguaugccaauugga

SEQ ID NO: 583035 - RNA, 19 nt, Human
aaaucagaaucugcauuuu

SEQ ID NO: 583036 - RNA, 22 nt, Human
ucuuuacacaagacaagaauaa

SEQ ID NO: 583037 - RNA, 22 nt, Human
ccugcagaccacacucaguccu

SEQ ID NO: 583038 - RNA, 22 nt, Human
cagcugccuaugaccuagccuc

SEQ ID NO: 583039 - RNA, 22 nt, Human
aggaggguggggucugccuguc

SEQ ID NO: 583040 - RNA, 22 nt, Human
uuucacagauccuacagcuugu

SEQ ID NO: 583041 - RNA, 22 nt, Human
ugcuccuuccucauccugugca

SEQ ID NO: 583042 - RNA, 22 nt, Human
ccagugcuaagguagccucugc

SEQ ID NO: 583043 - RNA, 22 nt, Human
gugcaguugagacaauaggcug

SEQ ID NO: 583044 - RNA, 22 nt, Human
ucuccaggggcagggucuggag

SEQ ID NO: 583045 - RNA, 22 nt, Human
ccucugggcggagaucugcugc

SEQ ID NO: 583046 - RNA, 22 nt, Human
gggagccacaguuuauagugau

SEQ ID NO: 583047 - RNA, 23 nt, Human
uccuccugagugagagugccagc

SEQ ID NO: 583048 - RNA, 22 nt, Human
gaaacugaguaggcuagagcac

SEQ ID NO: 583049 - RNA, 22 nt, Human
guacacuugacucauaggaaau

SEQ ID NO: 583050 - RNA, 22 nt, Human
aauuucagauauuaaagaauga

SEQ ID NO: 583051 - RNA, 23 nt, Human
ucugucacuuucugcuguggagu

SEQ ID NO: 583052 - RNA, 22 nt, Human
ggaaaaauagaguauacuuuaa

SEQ ID NO: 583053 - RNA, 22 nt, Human
ugcccugucuaagcugucagua

SEQ ID NO: 583054 - RNA, 22 nt, Human
gcuuagcaaugugacaagaugc

SEQ ID NO: 583055 - RNA, 22 nt, Human
aggcaauccccugaggauacuu

SEQ ID NO: 583056 - RNA, 22 nt, Human
uagcugccauugcuccaggaag

SEQ ID NO: 583057 - RNA, 23 nt, Human
aucucucugguggucacagucag

SEQ ID NO: 583058 - RNA, 22 nt, Human
gagcugguggugagaaagcucu

SEQ ID NO: 583059 - RNA, 22 nt, Human
ccccaaggugcucacugucugg

SEQ ID NO: 583060 - RNA, 22 nt, Human
caucucugguucagucucugug

SEQ ID NO: 583061 - RNA, 22 nt, Human
gcagcugccccgacugugaguc

SEQ ID NO: 583062 - RNA, 22 nt, Human
ucagaacauuugggacuuuggg

SEQ ID NO: 583063 - RNA, 22 nt, Human
uuucuuggaugugaaacuaggg

SEQ ID NO: 583064 - RNA, 22 nt, Human
ucaggcagaauuaucaaaagau

SEQ ID NO: 583065 - RNA, 22 nt, Human
cagccaggauggagaacuguug

SEQ ID NO: 583066 - RNA, 22 nt, Human
uggaaacugggaguuaaaugua

SEQ ID NO: 583067 - RNA, 18 nt, Human
ggcugugcguggaggcug

SEQ ID NO: 583068 - RNA, 22 nt, Human
cacaggaaaauaaaagaucuaa

SEQ ID NO: 583069 - RNA, 22 nt, Human
guagucugaacaguaauuuugu

SEQ ID NO: 583070 - RNA, 22 nt, Human
ccugcagggugcugccacagau

SEQ ID NO: 583071 - RNA, 22 nt, Human
gacacuuucucagguaaagcau

SEQ ID NO: 583072 - RNA, 22 nt, Human
uucuaguucuuaggaacagaca

SEQ ID NO: 583073 - RNA, 22 nt, Human
agggcaugcuggaggagagaca

SEQ ID NO: 583074 - RNA, 22 nt, Human
uuccaaauuaaaauguacaaug

SEQ ID NO: 583075 - RNA, 22 nt, Human
gcagccacagaggagggaugca

SEQ ID NO: 583076 - RNA, 22 nt, Human
uguguugugacauucuuggaug

SEQ ID NO: 583077 - RNA, 22 nt, Human
uucaccccaaauucccagugga

SEQ ID NO: 583078 - RNA, 22 nt, Human
ccacuccccacgugcugucaga

SEQ ID NO: 583079 - RNA, 22 nt, Human
ugacacugaccuaaagaccugg

SEQ ID NO: 583080 - RNA, 22 nt, Human
aacgcccgugguugccaaggua

SEQ ID NO: 583081 - RNA, 22 nt, Human
gccaccuguuucgcuugcccag

SEQ ID NO: 583082 - RNA, 22 nt, Human
ugcauaaacagauacuucaugu

SEQ ID NO: 583083 - RNA, 22 nt, Human
aaggcuggcaauauauuuguua

SEQ ID NO: 583084 - RNA, 22 nt, Human
acagcuggaggggcugcagagg

SEQ ID NO: 583085 - RNA, 22 nt, Human
ucuccccaaaggacucacucuc

SEQ ID NO: 583086 - RNA, 22 nt, Human
auagauacauuagguaacuugu

SEQ ID NO: 583087 - RNA, 22 nt, Human
ccaggcuggaguguagucgcau

SEQ ID NO: 583088 - RNA, 22 nt, Human
acacacaugccuuuccuaagua

SEQ ID NO: 583089 - RNA, 22 nt, Human
cugcagucaucugaagauuuug

SEQ ID NO: 583090 - RNA, 22 nt, Human
cagggccauuggcguggcuguc

SEQ ID NO: 583091 - RNA, 22 nt, Human
uuacaucuaaacugugaacaau

SEQ ID NO: 583092 - RNA, 22 nt, Human
gggagggagaggacaguucuau

SEQ ID NO: 583093 - RNA, 22 nt, Human
ugaaagcauaugcuaaagacca

SEQ ID NO: 583094 - RNA, 22 nt, Human
gauuggagaguggaacaugcug

SEQ ID NO: 583095 - RNA, 22 nt, Human
gagaggcugcauaugcacacug

SEQ ID NO: 583096 - RNA, 17 nt, Human
cagaccucugugaagcc

SEQ ID NO: 583097 - RNA, 22 nt, Human
uucuuuaugcuucuguuuaggc

SEQ ID NO: 583098 - RNA, 22 nt, Human
ccucccugucuaccuguugugg

SEQ ID NO: 583099 - RNA, 19 nt, Human
guuuccuuggguguaggga

SEQ ID NO: 583100 - RNA, 22 nt, Human
cacagggcagguacucucagag

SEQ ID NO: 583101 - RNA, 22 nt, Human
aagggcugaaugaaggguugaa

SEQ ID NO: 583102 - RNA, 22 nt, Human
uuggaaaaugaggcacagagag

SEQ ID NO: 583103 - RNA, 22 nt, Human
ucugcucugggccagcuauuaa

SEQ ID NO: 583104 - RNA, 22 nt, Human
cccugccccaggcggcuucacu

SEQ ID NO: 583105 - RNA, 22 nt, Human
cacagagaccccuucuggggcc

SEQ ID NO: 583106 - RNA, 22 nt, Human
gcugaagagaggccuugagcac

SEQ ID NO: 583107 - RNA, 22 nt, Human
gaggcugauucggggaacagca

SEQ ID NO: 583108 - RNA, 22 nt, Human
ggagccugcgggagcucccauu

SEQ ID NO: 583109 - RNA, 22 nt, Human
ugucaucugcggguggcacugc

SEQ ID NO: 583110 - RNA, 22 nt, Human
uaaguccacaggcugacagcgg

SEQ ID NO: 583111 - RNA, 22 nt, Human
cccagcccccgagugucuggaa

SEQ ID NO: 583112 - RNA, 22 nt, Human
aagcuggagaguuucacagaug

SEQ ID NO: 583113 - RNA, 22 nt, Human
agccacagagguugaugugguu

SEQ ID NO: 583114 - RNA, 22 nt, Human
cugacucccuccccaaagcugg

SEQ ID NO: 583115 - RNA, 22 nt, Human
ccucuauagaugugugcaucua

SEQ ID NO: 583116 - RNA, 22 nt, Human
acuccugguuuguguccuggcu

SEQ ID NO: 583117 - RNA, 22 nt, Human
aaauuccagaaacucaguauau

SEQ ID NO: 583118 - RNA, 19 nt, Human
agcagagcccugaagaucc

SEQ ID NO: 583119 - RNA, 22 nt, Human
uguaaaugaaacagcuaaaucc

SEQ ID NO: 583120 - RNA, 22 nt, Human
aaugaacacuuagccuuucuau

SEQ ID NO: 583121 - RNA, 22 nt, Human
aagggcugcauuugauguguca

SEQ ID NO: 583122 - RNA, 22 nt, Human
gccuaggaguggggauggcggu

SEQ ID NO: 583123 - RNA, 22 nt, Human
aacuuccaggccuugaauuauu

SEQ ID NO: 583124 - RNA, 21 nt, Human
aucaccagcagaagcugcaga

SEQ ID NO: 583125 - RNA, 22 nt, Human
ggggagcaauaguugaggugug

SEQ ID NO: 583126 - RNA, 22 nt, Human
ucagaaaugaucguuauucauu

SEQ ID NO: 583127 - RNA, 19 nt, Human
acugccugaggcucacagg

SEQ ID NO: 583128 - RNA, 18 nt, Human
ugaucuuugaguauaaug

SEQ ID NO: 583129 - RNA, 21 nt, Human
uucaaaguuugccuaaagauu

SEQ ID NO: 583130 - RNA, 21 nt, Human
uguuuauggaaaagagacaaa

SEQ ID NO: 583131 - RNA, 22 nt, Human
uuucacagcugggaagagauau

SEQ ID NO: 583132 - RNA, 22 nt, Human
cugggcugugguguggcccaaa

SEQ ID NO: 583133 - RNA, 22 nt, Human
aagcuuagguacagaaguuaag

SEQ ID NO: 583134 - RNA, 23 nt, Human
auguauuuaaauuucagugauga

SEQ ID NO: 583135 - RNA, 22 nt, Human
accaugggucagccaccucagc

SEQ ID NO: 583136 - RNA, 22 nt, Human
gcuuuggaaauauagacucaag

SEQ ID NO: 583137 - RNA, 22 nt, Human
acugaacaccauuuauaacauu

SEQ ID NO: 583138 - RNA, 22 nt, Human
agcagagcaugcuaagugacuc

SEQ ID NO: 583139 - RNA, 22 nt, Human
ucuagaaauuuugccuuguauu

SEQ ID NO: 583140 - RNA, 22 nt, Human
gggcccuggauuuaagcaugga

SEQ ID NO: 583141 - RNA, 22 nt, Human
ggcuguggggccggguacagug

SEQ ID NO: 583142 - RNA, 22 nt, Human
ucuuuucuggacucugcaugga

SEQ ID NO: 583143 - RNA, 22 nt, Human
agccccaguaagggagggccug

SEQ ID NO: 583144 - RNA, 22 nt, Human
ugcugaggacaccuagccuucu

SEQ ID NO: 583145 - RNA, 22 nt, Human
gaggaaaaugcaacaggaaugc

SEQ ID NO: 583146 - RNA, 22 nt, Human
ggagccuguggccgucacgacu

SEQ ID NO: 583147 - RNA, 19 nt, Human
ugaaacaaacuuaaaagga

SEQ ID NO: 583148 - RNA, 22 nt, Human
aaugcaaacagcccagaaucca

SEQ ID NO: 583149 - RNA, 22 nt, Human
auggguggccccgugugcaguc

SEQ ID NO: 583150 - RNA, 18 nt, Human
augggaggggccaagaga

SEQ ID NO: 583151 - RNA, 22 nt, Human
cuuccuuucagaggaaggccug

SEQ ID NO: 583152 - RNA, 22 nt, Human
aagugugggacuagggcuccag

SEQ ID NO: 583153 - RNA, 22 nt, Human
gaaaucuuuuccaauuguuuag

SEQ ID NO: 583154 - RNA, 22 nt, Human
aacccagggugaggggagucua

SEQ ID NO: 583155 - RNA, 22 nt, Human
uggggguguccuggugcacaca

SEQ ID NO: 583156 - RNA, 22 nt, Human
uuaacaaaguaacgggaaaaga

SEQ ID NO: 583157 - RNA, 22 nt, Human
gaggggcuggcacgauggcugc

SEQ ID NO: 583158 - RNA, 22 nt, Human
ccuccagucaccuggaugagaa

SEQ ID NO: 583159 - RNA, 21 nt, Human
agcuggugucagagcucuggg

SEQ ID NO: 583160 - RNA, 22 nt, Human
gugcucuguggauugaguugaa

SEQ ID NO: 583161 - RNA, 20 nt, Human
cuuugccuauucucugccug

SEQ ID NO: 583162 - RNA, 22 nt, Human
agacagguaaauagagaugcug

SEQ ID NO: 583163 - RNA, 22 nt, Human
gggagggaggugaugcuuggcu

SEQ ID NO: 583164 - RNA, 22 nt, Human
ucccugcaguaggcagcccucc

SEQ ID NO: 583165 - RNA, 20 nt, Human
gcugaggagcagugugguug

SEQ ID NO: 583166 - RNA, 22 nt, Human
ugggccaggauuucaagacccu

SEQ ID NO: 583167 - RNA, 22 nt, Human
aaagacauauuucuaaguuuau

SEQ ID NO: 583168 - RNA, 22 nt, Human
aggaagccuggggcugcccucg

SEQ ID NO: 583169 - RNA, 22 nt, Human
agguuuguuaaaccagauugcu

SEQ ID NO: 583170 - RNA, 22 nt, Human
ugaaauguguucuaguguuuug

SEQ ID NO: 583171 - RNA, 22 nt, Human
uuucaucuauuugcuuugugaa

SEQ ID NO: 583172 - RNA, 22 nt, Human
aaugcauacguguuuguggcaa

SEQ ID NO: 583173 - RNA, 20 nt, Human
uauaaauucagagcuuuggu

SEQ ID NO: 583174 - RNA, 22 nt, Human
uggcugaguuccuggcacacgg

SEQ ID NO: 583175 - RNA, 22 nt, Human
ggggcugauggaacucaggccu

SEQ ID NO: 583176 - RNA, 22 nt, Human
aaggccacuuuaccuuaaaucc

SEQ ID NO: 583177 - RNA, 22 nt, Human
cugucacacugauaucaggcuu

SEQ ID NO: 583178 - RNA, 22 nt, Human
cacagagaauucccauauguga

SEQ ID NO: 583179 - RNA, 22 nt, Human
cucccugggcagauguggcucu

SEQ ID NO: 583180 - RNA, 22 nt, Human
uacauuuauaaggcuucucugu

SEQ ID NO: 583181 - RNA, 22 nt, Human
acagcagggggagcuguuggac

SEQ ID NO: 583182 - RNA, 22 nt, Human
aaaagguuuugaguacaaauau

SEQ ID NO: 583183 - RNA, 22 nt, Human
cuccugggaauuuaguugugag

SEQ ID NO: 583184 - RNA, 22 nt, Human
gucugcccucacaugcacucuu

SEQ ID NO: 583185 - RNA, 22 nt, Human
guggcaucaagauuuagauuca

SEQ ID NO: 583186 - RNA, 22 nt, Human
gcagagcucaagguguucagcu

SEQ ID NO: 583187 - RNA, 22 nt, Human
uccugccaggagugcuggcccu

SEQ ID NO: 583188 - RNA, 22 nt, Human
augcuuuuccaggagaaauaua

SEQ ID NO: 583189 - RNA, 19 nt, Human
acaaacugaguacacuugu

SEQ ID NO: 583190 - RNA, 19 nt, Human
ugucaggggugugcugugc

SEQ ID NO: 583191 - RNA, 22 nt, Human
uagacacuagggauuuaguacu

SEQ ID NO: 583192 - RNA, 22 nt, Human
ggacagugaauguggggaugca

SEQ ID NO: 583193 - RNA, 22 nt, Human
uccagggcuguuacuuuacaua

SEQ ID NO: 583194 - RNA, 17 nt, Human
uccagccuccucugcug

SEQ ID NO: 583195 - RNA, 22 nt, Human
ugcuuaauauugugauguaaua

SEQ ID NO: 583196 - RNA, 22 nt, Human
gguucucuuccuccugacugag

SEQ ID NO: 583197 - RNA, 22 nt, Human
ccugagccugaguggugcaggg

SEQ ID NO: 583198 - RNA, 21 nt, Human
ugagccaggcugacggcugug

SEQ ID NO: 583199 - RNA, 22 nt, Human
uaaauguguuguggaugaaguu

SEQ ID NO: 583200 - RNA, 22 nt, Human
ggccuugggcuggcugcaguau

SEQ ID NO: 583201 - RNA, 22 nt, Human
aaucuaagccaccaguaguuuc

SEQ ID NO: 583202 - RNA, 21 nt, Human
aguuuacaacuguccagcccc

SEQ ID NO: 583203 - RNA, 22 nt, Human
cccaggcucuuaugugacuugc

SEQ ID NO: 583204 - RNA, 22 nt, Human
auacagggacauccaguuuuuc

SEQ ID NO: 583205 - RNA, 22 nt, Human
auaaaaucaacuggcuccaguu

SEQ ID NO: 583206 - RNA, 22 nt, Human
uccuguggagaggacuggaggu

SEQ ID NO: 583207 - RNA, 22 nt, Human
gccaggaggggagaguguguca

SEQ ID NO: 583208 - RNA, 22 nt, Human
cagggcaguuugugccuaugag

SEQ ID NO: 583209 - RNA, 22 nt, Human
caagucaacucaaauuguuauc

SEQ ID NO: 583210 - RNA, 20 nt, Human
uaugcuuuuuauaagauuga

SEQ ID NO: 583211 - RNA, 22 nt, Human
uuccaaggcaacagccuaggcu

SEQ ID NO: 583212 - RNA, 22 nt, Human
gaauuuaaaggccagaccugag

SEQ ID NO: 583213 - RNA, 18 nt, Human
cucucugggugaggacaa

SEQ ID NO: 583214 - RNA, 22 nt, Human
uuuagacagcaucuggugacuu

SEQ ID NO: 583215 - RNA, 22 nt, Human
aaugcaguugaauuuggguaug

SEQ ID NO: 583216 - RNA, 22 nt, Human
gaaggagaggauugugaggcug

SEQ ID NO: 583217 - RNA, 22 nt, Human
ccagggcauguccaagacuuag

SEQ ID NO: 583218 - RNA, 22 nt, Human
acccaggacacagagaugaccc

SEQ ID NO: 583219 - RNA, 22 nt, Human
agucccaggcagccgagccggu

SEQ ID NO: 583220 - RNA, 22 nt, Human
agggcagcuuccauagucuggc

SEQ ID NO: 583221 - RNA, 22 nt, Human
cucuucuuauggccguggcuga

SEQ ID NO: 583222 - RNA, 22 nt, Human
uuagaacaucugugucuuuaug

SEQ ID NO: 583223 - RNA, 22 nt, Human
uguacacugcaggaugcauugc

SEQ ID NO: 583224 - RNA, 22 nt, Human
aggugcagcaugaguccaacgg

SEQ ID NO: 583225 - RNA, 22 nt, Human
caggaagcugagcugcacugca

SEQ ID NO: 583226 - RNA, 22 nt, Human
gccucagcuguugcaggggccc

SEQ ID NO: 583227 - RNA, 22 nt, Human
cugggaugcggagguugcggug

SEQ ID NO: 583228 - RNA, 22 nt, Human
ucuucagauugcacugagcaag

SEQ ID NO: 583229 - RNA, 22 nt, Human
uacaguaauaaaaugagcuaca

SEQ ID NO: 583230 - RNA, 22 nt, Human
cugccugcaggacaccucgcua

SEQ ID NO: 583231 - RNA, 21 nt, Human
cauuuacaugacagauugguu

SEQ ID NO: 583232 - RNA, 22 nt, Human
gccaggcugaggcucuggaaga

SEQ ID NO: 583233 - RNA, 22 nt, Human
ugugccaagaucaaacuuuucu

SEQ ID NO: 583234 - RNA, 22 nt, Human
uucaggaagguccuauagcaga

SEQ ID NO: 583235 - RNA, 22 nt, Human
gucucuguuauuuccaggguca

SEQ ID NO: 583236 - RNA, 22 nt, Human
ccagggcucgggugcuuaguca

SEQ ID NO: 583237 - RNA, 22 nt, Human
ccaggcccguucccuucuccag

SEQ ID NO: 583238 - RNA, 22 nt, Human
ccucaggggugcccacagcugc

SEQ ID NO: 583239 - RNA, 22 nt, Human
cacaugggcguaauguccaugg

SEQ ID NO: 583240 - RNA, 22 nt, Human
gagcaggaugggagcuggggcc

SEQ ID NO: 583241 - RNA, 22 nt, Human
aucugagucaaauauuucauuu

SEQ ID NO: 583242 - RNA, 22 nt, Human
uccuguggucuggaaggaaugg

SEQ ID NO: 583243 - RNA, 22 nt, Human
gaacccaggagguugcagugag

SEQ ID NO: 583244 - RNA, 22 nt, Human
uccugagagucaagaaugcagg

SEQ ID NO: 583245 - RNA, 22 nt, Human
cuuucuuuguccaccaacaaug

SEQ ID NO: 583246 - RNA, 22 nt, Human
aucugaagaggucauggcugac

SEQ ID NO: 583247 - RNA, 22 nt, Human
uuacagguuguguauucaguga

SEQ ID NO: 583248 - RNA, 22 nt, Human
auucuaaaucagagagcucugu

SEQ ID NO: 583249 - RNA, 22 nt, Human
aaucagaacuucucaggguggg

SEQ ID NO: 583250 - RNA, 23 nt, Human
uaacaauggacuccucuuagcua

SEQ ID NO: 583251 - RNA, 22 nt, Human
guuuaagaaaauucauguuguu

SEQ ID NO: 583252 - RNA, 22 nt, Human
auucucuuuguauaacaucuug

SEQ ID NO: 583253 - RNA, 22 nt, Human
uuuauauuaccuggaauagcuu

SEQ ID NO: 583254 - RNA, 20 nt, Human
gcugagguggaggaaggaga

SEQ ID NO: 583255 - RNA, 18 nt, Human
acagggaugggguaagug

SEQ ID NO: 583256 - RNA, 22 nt, Human
accugagaccuaaucugacugu

SEQ ID NO: 583257 - RNA, 20 nt, Human
uggcagaguugucccaccca

SEQ ID NO: 583258 - RNA, 23 nt, Human
ucuccuggcugcacuguggccac

SEQ ID NO: 583259 - RNA, 22 nt, Human
aaaagagguuaaccaggugugu

SEQ ID NO: 583260 - RNA, 22 nt, Human
acagaauaacucuugcuugagu

SEQ ID NO: 583261 - RNA, 22 nt, Human
gccuccacuuuugcuggcuucu

SEQ ID NO: 583262 - RNA, 22 nt, Human
ucagagaggauuuuaauaagug

SEQ ID NO: 583263 - RNA, 22 nt, Human
gggcugacaaccaucugacaag

SEQ ID NO: 583264 - RNA, 22 nt, Human
ccuccaucuccagcuucugccu

SEQ ID NO: 583265 - RNA, 21 nt, Human
aggguccuacagggcucagga

SEQ ID NO: 583266 - RNA, 22 nt, Human
aacaguaggcaucacauaauga

SEQ ID NO: 583267 - RNA, 22 nt, Human
agggucaccugcuugccagggc

SEQ ID NO: 583268 - RNA, 22 nt, Human
gcccaggaugguguguaguggu

SEQ ID NO: 583269 - RNA, 22 nt, Human
uuuacaauagggucugaaugaa

SEQ ID NO: 583270 - RNA, 22 nt, Human
cacugccugugagcugugugcc

SEQ ID NO: 583271 - RNA, 22 nt, Human
uuuauugaacacuugcacuggc

SEQ ID NO: 583272 - RNA, 22 nt, Human
cagcccuuccaggcagaauucu

SEQ ID NO: 583273 - RNA, 22 nt, Human
cccuccucucccuaagagucac

SEQ ID NO: 583274 - RNA, 22 nt, Human
cuagcuuuguccauugucuugc

SEQ ID NO: 583275 - RNA, 22 nt, Human
gccuggagggcucuagagaggc

SEQ ID NO: 583276 - RNA, 22 nt, Human
cugcugagguccuugcucagac

SEQ ID NO: 583277 - RNA, 22 nt, Human
ucauggggugacagaagggagg

SEQ ID NO: 583278 - RNA, 22 nt, Human
cauacauuuugcauauuuacca

SEQ ID NO: 583279 - RNA, 19 nt, Human
ugggagaggcaacagagua

SEQ ID NO: 583280 - RNA, 22 nt, Human
cucugcccacgucuugcccaga

SEQ ID NO: 583281 - RNA, 22 nt, Human
agaggcaaaaaucuauggcaac

SEQ ID NO: 583282 - RNA, 22 nt, Human
agcuggcccucgagagccaauu

SEQ ID NO: 583283 - RNA, 22 nt, Human
uucaaagugugaccugacaagc

SEQ ID NO: 583284 - RNA, 22 nt, Human
gaaucccaaucuguuauugaca

SEQ ID NO: 583285 - RNA, 22 nt, Human
caucacugaaccccaacuuucu

SEQ ID NO: 583286 - RNA, 22 nt, Human
cuuuucaaacgcugaugucagu

SEQ ID NO: 583287 - RNA, 22 nt, Human
cucugagggcugucaggaaagg

SEQ ID NO: 583288 - RNA, 21 nt, Human
ccuggcagaagccugauaugc

SEQ ID NO: 583289 - RNA, 22 nt, Human
cagccugcuagggcaaugccuu

SEQ ID NO: 583290 - RNA, 22 nt, Human
augauucucugcuacucuaaau

SEQ ID NO: 583291 - RNA, 22 nt, Human
agugggcuuacugagggagugu

SEQ ID NO: 583292 - RNA, 22 nt, Human
ucuuggagacucuuguauauuu

SEQ ID NO: 583293 - RNA, 22 nt, Human
caguaugucuacuggacaaagu

SEQ ID NO: 583294 - RNA, 22 nt, Human
ugcaucauauaaugucuaugga

SEQ ID NO: 583295 - RNA, 22 nt, Human
aaaacacugcaaagcugauugg

SEQ ID NO: 583296 - RNA, 22 nt, Human
auguggggacaaaaugauggcc

SEQ ID NO: 583297 - RNA, 22 nt, Human
ugaauaaucauguccauagugu

SEQ ID NO: 583298 - RNA, 22 nt, Human
cucccagauuccugcuguggga

SEQ ID NO: 583299 - RNA, 22 nt, Human
auguaagacuuuaagaaccuaa

SEQ ID NO: 583300 - RNA, 22 nt, Human
aggcucugcauccaggcuuuau

SEQ ID NO: 583301 - RNA, 22 nt, Human
gggcugccaagccugccugccu

SEQ ID NO: 583302 - RNA, 22 nt, Human
gagcuggcuaauacugacuuau

SEQ ID NO: 583303 - RNA, 22 nt, Human
uuaauuaugcaaaaggccccau

SEQ ID NO: 583304 - RNA, 22 nt, Human
uccagcagguccgagacaaguu

SEQ ID NO: 583305 - RNA, 22 nt, Human
uaggaugugccaggaaagaaag

SEQ ID NO: 583306 - RNA, 22 nt, Human
acucucccagcuauauguggug

SEQ ID NO: 583307 - RNA, 22 nt, Human
aacagcuugagacuggauaugc

SEQ ID NO: 583308 - RNA, 22 nt, Human
aauggcuucuuuuugguauaau

SEQ ID NO: 583309 - RNA, 22 nt, Human
aaugucuuuaaagugcaauaga

SEQ ID NO: 583310 - RNA, 22 nt, Human
gcuggaguuguggguuuacuaa

SEQ ID NO: 583311 - RNA, 22 nt, Human
uauaguacacuuagguacuuca

SEQ ID NO: 583312 - RNA, 22 nt, Human
ccugggaggcuguuuccagccu

SEQ ID NO: 583313 - RNA, 22 nt, Human
auugauaucaguuugcugauug

SEQ ID NO: 583314 - RNA, 22 nt, Human
guauucucaggugguuccucga

SEQ ID NO: 583315 - RNA, 22 nt, Human
gagcuguccgccccugggccga

SEQ ID NO: 583316 - RNA, 22 nt, Human
uaaacaucuguagccuucaguc

SEQ ID NO: 583317 - RNA, 19 nt, Human
gcauaaaaugucaaugugu

SEQ ID NO: 583318 - RNA, 22 nt, Human
ugcucagugagucugugacagg

SEQ ID NO: 583319 - RNA, 22 nt, Human
aaagcaaugucucugccugguu

SEQ ID NO: 583320 - RNA, 22 nt, Human
gcagccccaggagacgcccagg

SEQ ID NO: 583321 - RNA, 22 nt, Human
gaggggcugggcagucccugga

SEQ ID NO: 583322 - RNA, 22 nt, Human
cccaggagagggaaccaaaugu

SEQ ID NO: 583323 - RNA, 22 nt, Human
guguuaauggcuaugaacugau

SEQ ID NO: 583324 - RNA, 21 nt, Human
ccccucauacacucuccuugc

SEQ ID NO: 583325 - RNA, 22 nt, Human
uccagccuaauguucuucccac

SEQ ID NO: 583326 - RNA, 22 nt, Human
auucauaacggcaaaugucacc

SEQ ID NO: 583327 - RNA, 22 nt, Human
uuuuccuuucaucaggacaaag

SEQ ID NO: 583328 - RNA, 22 nt, Human
ccuuagcagggccgggccuggg

SEQ ID NO: 583329 - RNA, 21 nt, Human
caaguguggauguggaaggua

SEQ ID NO: 583330 - RNA, 22 nt, Human
ugagguaggagugggaaaguag

SEQ ID NO: 583331 - RNA, 22 nt, Human
agggaugguggagguugcaagu

SEQ ID NO: 583332 - RNA, 22 nt, Human
gggucaggccucaaggugggcu

SEQ ID NO: 583333 - RNA, 22 nt, Human
cccagaggggucgucugagggg

SEQ ID NO: 583334 - RNA, 22 nt, Human
ggacaggcccucuggucagcuu

SEQ ID NO: 583335 - RNA, 20 nt, Human
gacauuguaauuaaugauga

SEQ ID NO: 583336 - RNA, 22 nt, Human
gugcucugccuggggucauggc

SEQ ID NO: 583337 - RNA, 22 nt, Human
uggcucugggcaccguguccac

SEQ ID NO: 583338 - RNA, 22 nt, Human
ucugaugcaauguaagucuugg

SEQ ID NO: 583339 - RNA, 22 nt, Human
cuucucagcauuuugucagucu

SEQ ID NO: 583340 - RNA, 22 nt, Human
cugccagcuggagaccaaggaa

SEQ ID NO: 583341 - RNA, 22 nt, Human
ugagggcuguggaaggcuaacc

SEQ ID NO: 583342 - RNA, 22 nt, Human
gggcuggaggccugccugguua

SEQ ID NO: 583343 - RNA, 20 nt, Human
augcaaacucacaaaauacc

SEQ ID NO: 583344 - RNA, 22 nt, Human
ugucugaaucgcuuccuagagg

SEQ ID NO: 583345 - RNA, 22 nt, Human
acaugaucuuauguagaagauc

SEQ ID NO: 583346 - RNA, 22 nt, Human
ccugaagagcacucuagaguug

SEQ ID NO: 583347 - RNA, 22 nt, Human
guguauaauaaugugagcuaaa

SEQ ID NO: 583348 - RNA, 22 nt, Human
uuuacacauaccucuuuaaagu

SEQ ID NO: 583349 - RNA, 22 nt, Human
agaauucuggaguugggaggaa

SEQ ID NO: 583350 - RNA, 22 nt, Human
acugcccagugauuggugguua

SEQ ID NO: 583351 - RNA, 20 nt, Human
gcuuuuucuaauagcagucc

SEQ ID NO: 583352 - RNA, 22 nt, Human
ucaggcugcaucuguaagggug

SEQ ID NO: 583353 - RNA, 22 nt, Human
gggcuucuagaauuucugauau

SEQ ID NO: 583354 - RNA, 19 nt, Human
aaaaggaauauucuuuggg

SEQ ID NO: 583355 - RNA, 22 nt, Human
gccugcagccccucugcaguag

SEQ ID NO: 583356 - RNA, 22 nt, Human
uaggaacaacugcagguacaag

SEQ ID NO: 583357 - RNA, 22 nt, Human
uugcucaggcuuagagcuacua

SEQ ID NO: 583358 - RNA, 22 nt, Human
ggagcugcuccuucagccaagu

SEQ ID NO: 583359 - RNA, 22 nt, Human
aaguggcacgcuuuuuggaguu

SEQ ID NO: 583360 - RNA, 22 nt, Human
ucuuagcaaauacuacuuagaa

SEQ ID NO: 583361 - RNA, 22 nt, Human
uauugaaauucuucauguccuc

SEQ ID NO: 583362 - RNA, 22 nt, Human
agaggggaggcgaaccagaguc

SEQ ID NO: 583363 - RNA, 22 nt, Human
uaaaauagaggaugucaugcua

SEQ ID NO: 583364 - RNA, 22 nt, Human
aaauuaguacauugcaaagucc

SEQ ID NO: 583365 - RNA, 22 nt, Human
ugccuugggauauauggacacu

SEQ ID NO: 583366 - RNA, 22 nt, Human
aggcagguguugggagacacca

SEQ ID NO: 583367 - RNA, 22 nt, Human
agcagcucuggcacuguagcau

SEQ ID NO: 583368 - RNA, 22 nt, Human
acccagggccacagcccgcagu

SEQ ID NO: 583369 - RNA, 22 nt, Human
agucuuuaaugaucauguauuu

SEQ ID NO: 583370 - RNA, 22 nt, Human
uuccuggggacuuaccgucauu

SEQ ID NO: 583371 - RNA, 22 nt, Human
cagugcaggaagugagaugccu

SEQ ID NO: 583372 - RNA, 20 nt, Human
uccagcugggaacagcugau

SEQ ID NO: 583373 - RNA, 22 nt, Human
gagagcugggcuuugggugaag

SEQ ID NO: 583374 - RNA, 22 nt, Human
ucuccaggcuuuuugugaauug

SEQ ID NO: 583375 - RNA, 22 nt, Human
gugcugagcugcagaugcgcuc

SEQ ID NO: 583376 - RNA, 23 nt, Human
ucucucuuagcuaugcuuauggc

SEQ ID NO: 583377 - RNA, 22 nt, Human
ucuuacauauagcaugaguaca

SEQ ID NO: 583378 - RNA, 22 nt, Human
uucugcagaucaacuugacugc

SEQ ID NO: 583379 - RNA, 22 nt, Human
uaggccaaggacaguaaggaca

SEQ ID NO: 583380 - RNA, 22 nt, Human
augguggaagagcaucagaaag

SEQ ID NO: 583381 - RNA, 22 nt, Human
ucuacaaugagaaaugaucagu

SEQ ID NO: 583382 - RNA, 22 nt, Human
agggaggaaggaacuccuucua

SEQ ID NO: 583383 - RNA, 22 nt, Human
ucuccagguggcuugggcuucu

SEQ ID NO: 583384 - RNA, 22 nt, Human
aguguaggugagggccuggguu

SEQ ID NO: 583385 - RNA, 22 nt, Human
gugcuucucugcucuacccggc

SEQ ID NO: 583386 - RNA, 22 nt, Human
caauuuuuguacuuauaguacu

SEQ ID NO: 583387 - RNA, 22 nt, Human
uagcacuaucuugggauuugga

SEQ ID NO: 583388 - RNA, 21 nt, Human
agcagcagcaguggggcuucu

SEQ ID NO: 583389 - RNA, 22 nt, Human
ucccagagucuucuccuguaau

SEQ ID NO: 583390 - RNA, 20 nt, Human
cuggaguguagcaguggcug

SEQ ID NO: 583391 - RNA, 22 nt, Human
aggucacagcuuucucgugagg

SEQ ID NO: 583392 - RNA, 22 nt, Human
uggcagagguauauugggagga

SEQ ID NO: 583393 - RNA, 22 nt, Human
gagagaaaacaaguucuccauu

SEQ ID NO: 583394 - RNA, 22 nt, Human
accaggcuugauaccaagaaau

SEQ ID NO: 583395 - RNA, 19 nt, Human
ucacaggcaucuccccaga

SEQ ID NO: 583396 - RNA, 22 nt, Human
gaggagacugacagcagauucu

SEQ ID NO: 583397 - RNA, 22 nt, Human
aaagaguugaaaacuaacagug

SEQ ID NO: 583398 - RNA, 22 nt, Human
ugcuccagaaaaacuugagacu

SEQ ID NO: 583399 - RNA, 22 nt, Human
ggcugcugggaauaugccagcu

SEQ ID NO: 583400 - RNA, 22 nt, Human
uggcucaggagggaucuuugcu

SEQ ID NO: 583401 - RNA, 22 nt, Human
cugccuguggguacaaguggaa

SEQ ID NO: 583402 - RNA, 22 nt, Human
ugcuuuuaggagauuaaaauua

SEQ ID NO: 583403 - RNA, 22 nt, Human
caauuuuuuccaugcucuuaca

SEQ ID NO: 583404 - RNA, 22 nt, Human
ggcuccagggaguggagagaag

SEQ ID NO: 583405 - RNA, 22 nt, Human
cuuaggauuuaauuucagacuc

SEQ ID NO: 583406 - RNA, 22 nt, Human
ggaaaacaagagaaugauguuu

SEQ ID NO: 583407 - RNA, 22 nt, Human
ucagcucuaaguuuuaugcaaa

SEQ ID NO: 583408 - RNA, 22 nt, Human
uucuucuugucugcccucacau

SEQ ID NO: 583409 - RNA, 22 nt, Human
acugcagacucuacaguuauaa

SEQ ID NO: 583410 - RNA, 22 nt, Human
agaagccaugguaugcaacuac

SEQ ID NO: 583411 - RNA, 22 nt, Human
ggucugaguggggccugagauu

SEQ ID NO: 583412 - RNA, 22 nt, Human
uugaaaugaaauauuuaagcuc

SEQ ID NO: 583413 - RNA, 22 nt, Human
uggagaagcuguagguggacuc

SEQ ID NO: 583414 - RNA, 22 nt, Human
cucugagcucgugcaguacuuc

SEQ ID NO: 583415 - RNA, 22 nt, Human
uucuugauuucaugcaguuaag

SEQ ID NO: 583416 - RNA, 22 nt, Human
acauaugcgaucauaggaugca

SEQ ID NO: 583417 - RNA, 22 nt, Human
acaggcugacuuccugccaugu

SEQ ID NO: 583418 - RNA, 20 nt, Human
ucugaacacaauauaucccc

SEQ ID NO: 583419 - RNA, 22 nt, Human
aaagcaauggcacaugauggua

SEQ ID NO: 583420 - RNA, 22 nt, Human
guaaaugccacuuaauguaaag

SEQ ID NO: 583421 - RNA, 22 nt, Human
uccuggggccagcacuggugga

SEQ ID NO: 583422 - RNA, 22 nt, Human
gugaggaucaaaugaaauagca

SEQ ID NO: 583423 - RNA, 22 nt, Human
uucaaaguaccguacuuaaugg

SEQ ID NO: 583424 - RNA, 22 nt, Human
ucugggcugggagcguguggac

SEQ ID NO: 583425 - RNA, 22 nt, Human
auuuaauuguucuucuggcuau

SEQ ID NO: 583426 - RNA, 22 nt, Human
ugucaccagcugcuccucagga

SEQ ID NO: 583427 - RNA, 22 nt, Human
ugcugaggagggcacccggggg

SEQ ID NO: 583428 - RNA, 22 nt, Human
agcuggucagaguggggauaga

SEQ ID NO: 583429 - RNA, 22 nt, Human
ugcagggaagucccagcuccug

SEQ ID NO: 583430 - RNA, 22 nt, Human
cauuguuuguaaaauuccagua

SEQ ID NO: 583431 - RNA, 22 nt, Human
ccaggagcagccggcccaccug

SEQ ID NO: 583432 - RNA, 22 nt, Human
ucaggaaauggaauucuugugu

SEQ ID NO: 583433 - RNA, 22 nt, Human
uggucccuaaagaugucuacau

SEQ ID NO: 583434 - RNA, 22 nt, Human
gucaggcccuggcagccgugac

SEQ ID NO: 583435 - RNA, 17 nt, Human
ccugggaggaguuauga

SEQ ID NO: 583436 - RNA, 22 nt, Human
cccagaggugcuucagaggugc

SEQ ID NO: 583437 - RNA, 22 nt, Human
gcugagucuugagcacugagca

SEQ ID NO: 583438 - RNA, 22 nt, Human
aaauuuucagagcacuagagaa

SEQ ID NO: 583439 - RNA, 22 nt, Human
ucugggaaaguaaauguaaagg

SEQ ID NO: 583440 - RNA, 22 nt, Human
uggcuccagcguccacguccug

SEQ ID NO: 583441 - RNA, 22 nt, Human
gaagagcuccaaaaacagugag

SEQ ID NO: 583442 - RNA, 22 nt, Human
agugaaauugcuguaagaggaa

SEQ ID NO: 583443 - RNA, 22 nt, Human
cuccaggagggggauggcugua

SEQ ID NO: 583444 - RNA, 22 nt, Human
gcugggcaaggcugaagcuacc

SEQ ID NO: 583445 - RNA, 22 nt, Human
ugcaugcacauguagguauggu

SEQ ID NO: 583446 - RNA, 22 nt, Human
uccccaggaguuuuacuuugca

SEQ ID NO: 583447 - RNA, 20 nt, Human
uuuuccugugguuugauaug

SEQ ID NO: 583448 - RNA, 22 nt, Human
ugcucugggaccgucauuaaaa

SEQ ID NO: 583449 - RNA, 22 nt, Human
ucagcucuaccugggagcuguc

SEQ ID NO: 583450 - RNA, 22 nt, Human
agacauauuggcuugcuuuaau

SEQ ID NO: 583451 - RNA, 22 nt, Human
gggcugagauuggugcccuguc

SEQ ID NO: 583452 - RNA, 18 nt, Human
ugcaggagugaccccggc

SEQ ID NO: 583453 - RNA, 22 nt, Human
gcagcacugauccuaaacuuag

SEQ ID NO: 583454 - RNA, 22 nt, Human
uucuguuuccugccuucccauu

SEQ ID NO: 583455 - RNA, 22 nt, Human
gaggauggugagcaggacccag

SEQ ID NO: 583456 - RNA, 18 nt, Human
cagcugugcccuguuugg

SEQ ID NO: 583457 - RNA, 22 nt, Human
cagggcugguuugucgaagaaa

SEQ ID NO: 583458 - RNA, 18 nt, Human
ggacccagggccucaccc

SEQ ID NO: 583459 - RNA, 22 nt, Human
ugguggggccagacuucagcuc

SEQ ID NO: 583460 - RNA, 22 nt, Human
aggcugucaucuuugcaggcag

SEQ ID NO: 583461 - RNA, 22 nt, Human
uccaaagagcuuaggagagaaa

SEQ ID NO: 583462 - RNA, 22 nt, Human
ucucagaaaaaggagaaacugg

SEQ ID NO: 583463 - RNA, 22 nt, Human
ucuguccaggucagccuacauu

SEQ ID NO: 583464 - RNA, 22 nt, Human
gcacugggcuccaggaaggagg

SEQ ID NO: 583465 - RNA, 22 nt, Human
caguaacaggcucugugguaua

SEQ ID NO: 583466 - RNA, 22 nt, Human
gggugagacagaaagagcaaaa

SEQ ID NO: 583467 - RNA, 22 nt, Human
cuuuucucugcaccauguguga

SEQ ID NO: 583468 - RNA, 22 nt, Human
gcccuuagguacuacuuauucu

SEQ ID NO: 583469 - RNA, 22 nt, Human
uggaggaggaacuucuuaucuc

SEQ ID NO: 583470 - RNA, 22 nt, Human
uucauuagaaaaguaaaaaugc

SEQ ID NO: 583471 - RNA, 22 nt, Human
ugugcaauuucaauuuacacag

SEQ ID NO: 583472 - RNA, 22 nt, Human
ccucccugcgcuccugcggcgg

SEQ ID NO: 583473 - RNA, 22 nt, Human
ugcccugcuguggcucugccca

SEQ ID NO: 583474 - RNA, 20 nt, Human
aggcacuguugucuguaucc

SEQ ID NO: 583475 - RNA, 22 nt, Human
gaauauauuggugaaaauaguu

SEQ ID NO: 583476 - RNA, 22 nt, Human
cuugggccaccuggagggacug

SEQ ID NO: 583477 - RNA, 22 nt, Human
gugggacagcggggugggacag

SEQ ID NO: 583478 - RNA, 22 nt, Human
ucaugcagauaagaauaaguaa

SEQ ID NO: 583479 - RNA, 22 nt, Human
agagugaaaagcuagagcagua

SEQ ID NO: 583480 - RNA, 22 nt, Human
aggagucagauuguuugaaugu

SEQ ID NO: 583481 - RNA, 22 nt, Human
uuccuggguucccucucauucu

SEQ ID NO: 583482 - RNA, 22 nt, Human
guggcauugacauguaaacagu

SEQ ID NO: 583483 - RNA, 22 nt, Human
ggcugcagaggcccccaguggg

SEQ ID NO: 583484 - RNA, 22 nt, Human
agaggccuccgaaaggugggcu

SEQ ID NO: 583485 - RNA, 22 nt, Human
gagcugaggugauguggucguu

SEQ ID NO: 583486 - RNA, 22 nt, Human
caggcaccucacguggguccca

SEQ ID NO: 583487 - RNA, 22 nt, Human
ugggcuggagcuuguugcuucc

SEQ ID NO: 583488 - RNA, 22 nt, Human
cugagggguauccaagggguaa

SEQ ID NO: 583489 - RNA, 22 nt, Human
agagauuuacacaugccuuuuc

SEQ ID NO: 583490 - RNA, 22 nt, Human
ugcugggcaccagugccugcag

SEQ ID NO: 583491 - RNA, 22 nt, Human
cuacaggucaagcaguagcucu

SEQ ID NO: 583492 - RNA, 22 nt, Human
ugacauuucagauaugguauuu

SEQ ID NO: 583493 - RNA, 22 nt, Human
aauguauaaaguguuaauaacu

SEQ ID NO: 583494 - RNA, 22 nt, Human
uucuuacauuacuuuacaugug

SEQ ID NO: 583495 - RNA, 22 nt, Human
ggaacauuggcauuuuaaggcu

SEQ ID NO: 583496 - RNA, 22 nt, Human
aggccacagagagugcaugugc

SEQ ID NO: 583497 - RNA, 22 nt, Human
gcuguuucuaccagaagaauca

SEQ ID NO: 583498 - RNA, 22 nt, Human
aaggugucaccagauuggcagg

SEQ ID NO: 583499 - RNA, 22 nt, Human
agaguacauucagagcuaccua

SEQ ID NO: 583500 - RNA, 22 nt, Human
aucuccccgagcuuaccuccug

SEQ ID NO: 583501 - RNA, 22 nt, Human
cugccaggcacugggcucugca

SEQ ID NO: 583502 - RNA, 22 nt, Human
gccugccugaaggcuguaccag

SEQ ID NO: 583503 - RNA, 22 nt, Human
uuuccucaacugucaaaugggg

SEQ ID NO: 583504 - RNA, 21 nt, Human
gacuucaugggucaaccaauu

SEQ ID NO: 583505 - RNA, 19 nt, Human
uccugaaaacuucuggaau

SEQ ID NO: 583506 - RNA, 21 nt, Human
gggcuggacaugguggcucau

SEQ ID NO: 583507 - RNA, 22 nt, Human
caggagcaaggagcagugggau

SEQ ID NO: 583508 - RNA, 22 nt, Human
gagcugaaauaugaagccaauu

SEQ ID NO: 583509 - RNA, 22 nt, Human
agcagagguuuguuggaaaccu

SEQ ID NO: 583510 - RNA, 22 nt, Human
caccaggggcagagaccaaagu

SEQ ID NO: 583511 - RNA, 22 nt, Human
augcauguauuaucuagaugag

SEQ ID NO: 583512 - RNA, 22 nt, Human
ccaaggcaacguuggugucagg

SEQ ID NO: 583513 - RNA, 22 nt, Human
gaagguuuuguuugcaaaucau

SEQ ID NO: 583514 - RNA, 22 nt, Human
ugggccagaaguaugcauguuu

SEQ ID NO: 583515 - RNA, 22 nt, Human
gcugugcagccaagugccucug

SEQ ID NO: 583516 - RNA, 22 nt, Human
aaaggucuuuuuucuaacacca

SEQ ID NO: 583517 - RNA, 22 nt, Human
aaagacuugggagcaguaugcu

SEQ ID NO: 583518 - RNA, 22 nt, Human
aggauaaaugaucuagauuuuc

SEQ ID NO: 583519 - RNA, 21 nt, Human
uugacaggaaagaggggagau

SEQ ID NO: 583520 - RNA, 22 nt, Human
cagagaaagggugaauuccuuc

SEQ ID NO: 583521 - RNA, 22 nt, Human
gcugggacaggcuuggcccugu

SEQ ID NO: 583522 - RNA, 22 nt, Human
cagcagagcuuauguuggguca

SEQ ID NO: 583523 - RNA, 22 nt, Human
agcaggaguuugaugcuuuuau

SEQ ID NO: 583524 - RNA, 22 nt, Human
uauaugacaguaucauuuuaaa

SEQ ID NO: 583525 - RNA, 20 nt, Human
ugaauucuggguuuaucugc

SEQ ID NO: 583526 - RNA, 22 nt, Human
ucagcuguagguauggaugucc

SEQ ID NO: 583527 - RNA, 22 nt, Human
gcugacagagugccuggccuca

SEQ ID NO: 583528 - RNA, 22 nt, Human
aggcagagaaaaaccagauaug

SEQ ID NO: 583529 - RNA, 22 nt, Human
uaagguuuugagaccagaacgu

SEQ ID NO: 583530 - RNA, 22 nt, Human
acagagagaaacaaucagcagc

SEQ ID NO: 583531 - RNA, 22 nt, Human
ucuugguauacgcauggcauug

SEQ ID NO: 583532 - RNA, 22 nt, Human
ucugcaaacuggcucuuacugc

SEQ ID NO: 583533 - RNA, 22 nt, Human
gcagccucagggcacucagaug

SEQ ID NO: 583534 - RNA, 22 nt, Human
ucaagacaucacugugcauuuu

SEQ ID NO: 583535 - RNA, 22 nt, Human
gugggagcauggucccagugcc

SEQ ID NO: 583536 - RNA, 21 nt, Human
uggcagggguaguaguacagc

SEQ ID NO: 583537 - RNA, 22 nt, Human
ucaguguccggagccugagugc

SEQ ID NO: 583538 - RNA, 22 nt, Human
aaguguguugacugaauugggg

SEQ ID NO: 583539 - RNA, 22 nt, Human
agcugcaguaaagcucuccagg

SEQ ID NO: 583540 - RNA, 22 nt, Human
gcugucacaagcaucuggggca

SEQ ID NO: 583541 - RNA, 22 nt, Human
auucacaaauaacaggugcaga

SEQ ID NO: 583542 - RNA, 22 nt, Human
caggcucagucagaaaauguau

SEQ ID NO: 583543 - RNA, 22 nt, Human
gaaugaguuaauauuugcuugg

SEQ ID NO: 583544 - RNA, 22 nt, Human
uauuucacauaccacagagugu

SEQ ID NO: 583545 - RNA, 22 nt, Human
agcugugguuagauagaguccu

SEQ ID NO: 583546 - RNA, 22 nt, Human
ugcugaaacaauaacauacugg

SEQ ID NO: 583547 - RNA, 22 nt, Human
gaggcugcuuuccuccuauccu

SEQ ID NO: 583548 - RNA, 22 nt, Human
cccaggaggcgcagguugcggu

SEQ ID NO: 583549 - RNA, 22 nt, Human
gugcaaaaguaauugagguuuu

SEQ ID NO: 583550 - RNA, 22 nt, Human
acauuaaaaaauguugcaugaa

SEQ ID NO: 583551 - RNA, 22 nt, Human
ugagcagagacuucaagggcag

SEQ ID NO: 583552 - RNA, 21 nt, Human
agggucaggaaccaggguacc

SEQ ID NO: 583553 - RNA, 21 nt, Human
uggcugcaagcagcugccucc

SEQ ID NO: 583554 - RNA, 22 nt, Human
agggccagcccauaaugccaaa

SEQ ID NO: 583555 - RNA, 22 nt, Human
aaaguguggagauugaacuaaa

SEQ ID NO: 583556 - RNA, 22 nt, Human
aggccacagccugggaggugac

SEQ ID NO: 583557 - RNA, 22 nt, Human
agaggaggcucugggaucgucc

SEQ ID NO: 583558 - RNA, 22 nt, Human
gcucaggucuuacccaugccug

SEQ ID NO: 583559 - RNA, 22 nt, Human
cuucuugcugggggccucagug

SEQ ID NO: 583560 - RNA, 21 nt, Human
gacaggggccauggguuucua

SEQ ID NO: 583561 - RNA, 22 nt, Human
ggaaacuuguuauuguauuuuc

SEQ ID NO: 583562 - RNA, 22 nt, Human
ugaguuauugagaaauaacugc

SEQ ID NO: 583563 - RNA, 22 nt, Human
cccaggagacauauagaaggac

SEQ ID NO: 583564 - RNA, 22 nt, Human
ccucagaauaguccucagauca

SEQ ID NO: 583565 - RNA, 22 nt, Human
agcuuuggggguagguauagag

SEQ ID NO: 583566 - RNA, 22 nt, Human
ccacucugcugugcuccaugau

SEQ ID NO: 583567 - RNA, 22 nt, Human
ccugucugaaucaugauuuccu

SEQ ID NO: 583568 - RNA, 22 nt, Human
uggcagaggagaauuaagauua

SEQ ID NO: 583569 - RNA, 22 nt, Human
agagccugguucaaauuuuacc

SEQ ID NO: 583570 - RNA, 22 nt, Human
agagacuguguccaucgugccu

SEQ ID NO: 583571 - RNA, 22 nt, Human
ucauaauguaguucauggcugg

SEQ ID NO: 583572 - RNA, 22 nt, Human
gagcugagaucgugccauugca

SEQ ID NO: 583573 - RNA, 22 nt, Human
ugcuuccugcuaaggcugccug

SEQ ID NO: 583574 - RNA, 22 nt, Human
ucagcagaggggaaggcaucug

SEQ ID NO: 583575 - RNA, 22 nt, Human
augaagcagccucuucccucug

SEQ ID NO: 583576 - RNA, 22 nt, Human
cugaggagagaucacguggugu

SEQ ID NO: 583577 - RNA, 22 nt, Human
ggcaggagauaaaauauuaguu

SEQ ID NO: 583578 - RNA, 22 nt, Human
acacuuuguuguggcauauacg

SEQ ID NO: 583579 - RNA, 22 nt, Human
ucacuuugacagagaaaugaau

SEQ ID NO: 583580 - RNA, 22 nt, Human
agccagggacgcugcaggcuac

SEQ ID NO: 583581 - RNA, 22 nt, Human
ucuuuccuuagaauaauucuuu

SEQ ID NO: 583582 - RNA, 22 nt, Human
cagagcugcacauucuaugaug

SEQ ID NO: 583583 - RNA, 22 nt, Human
acaaaccagcuuaagcaagaug

SEQ ID NO: 583584 - RNA, 22 nt, Human
ucuggggaugaggaccuagaug

SEQ ID NO: 583585 - RNA, 20 nt, Human
auaauuauuuacuuuugugc

SEQ ID NO: 583586 - RNA, 23 nt, Human
uguuuucuuguccugguauaauu

SEQ ID NO: 583587 - RNA, 22 nt, Human
cugcagggagcagauggcgugu

SEQ ID NO: 583588 - RNA, 22 nt, Human
aggaaaaagaguugcugccuuc

SEQ ID NO: 583589 - RNA, 22 nt, Human
ggauguucugggguucucuugu

SEQ ID NO: 583590 - RNA, 22 nt, Human
gaauuaaaauaguuuuggucga

SEQ ID NO: 583591 - RNA, 22 nt, Human
uacauauccaggcugagaagau

SEQ ID NO: 583592 - RNA, 22 nt, Human
uaugcuuuaacauuaaacaaca

SEQ ID NO: 583593 - RNA, 22 nt, Human
cuggaucaugcauugcuugucc

SEQ ID NO: 583594 - RNA, 22 nt, Human
caguagcaggcacucagcacgu

SEQ ID NO: 583595 - RNA, 22 nt, Human
gagccuccuccuggugugccga

SEQ ID NO: 583596 - RNA, 22 nt, Human
uuuuacuucauuccugacuuca

SEQ ID NO: 583597 - RNA, 22 nt, Human
gcuuccuuccuuacauuggugg

SEQ ID NO: 583598 - RNA, 22 nt, Human
accagccugucugagucguggg

SEQ ID NO: 583599 - RNA, 22 nt, Human
guuuugcucauuugguccaagg

SEQ ID NO: 583600 - RNA, 22 nt, Human
cugggcccuauggaagaaaggg

SEQ ID NO: 583601 - RNA, 22 nt, Human
gguggggccugcuccagcggcc

SEQ ID NO: 583602 - RNA, 22 nt, Human
ugaggugaauggugucccugga

SEQ ID NO: 583603 - RNA, 22 nt, Human
ugcaagggguuuaugcagauga

SEQ ID NO: 583604 - RNA, 22 nt, Human
aguuuuauguucacagaaggau

SEQ ID NO: 583605 - RNA, 22 nt, Human
uaauacagauacaaaggaggac

SEQ ID NO: 583606 - RNA, 23 nt, Human
aaagacugaggaaagucucuguc

SEQ ID NO: 583607 - RNA, 22 nt, Human
aauaauuacccaucuuuuugua

SEQ ID NO: 583608 - RNA, 23 nt, Human
aggguugugugcuucaugaucau

SEQ ID NO: 583609 - RNA, 22 nt, Human
aaauuauucucauguguuucuu

SEQ ID NO: 583610 - RNA, 22 nt, Human
caagcuggcugggagaggcacg

SEQ ID NO: 583611 - RNA, 22 nt, Human
uacuuuaucagcgucaaaggua

SEQ ID NO: 583612 - RNA, 22 nt, Human
gaacuacagugcauuuucuuaa

SEQ ID NO: 583613 - RNA, 23 nt, Human
ggcuucuugccugucuuggugcu

SEQ ID NO: 583614 - RNA, 22 nt, Human
auuucagacuguguuggaaaau

SEQ ID NO: 583615 - RNA, 22 nt, Human
uggaggcagucaaaugacugac

SEQ ID NO: 583616 - RNA, 22 nt, Human
uccaggugccggggacugaggc

SEQ ID NO: 583617 - RNA, 22 nt, Human
gcugagguggugaugguucauc

SEQ ID NO: 583618 - RNA, 22 nt, Human
aacaugaagguaggaugguuuu

SEQ ID NO: 583619 - RNA, 22 nt, Human
gcugugugcucacguaguggaa

SEQ ID NO: 583620 - RNA, 22 nt, Human
uaucuugagagacaacacagca

SEQ ID NO: 583621 - RNA, 22 nt, Human
agcacacagucuuccuuccucc

SEQ ID NO: 583622 - RNA, 22 nt, Human
agcuuguuggggaaggagaaag

SEQ ID NO: 583623 - RNA, 22 nt, Human
aaagcuucuauucacuuacuug

SEQ ID NO: 583624 - RNA, 22 nt, Human
gggccugccaggcuuucagcau

SEQ ID NO: 583625 - RNA, 22 nt, Human
uaaggcaggacuggauagcuau

SEQ ID NO: 583626 - RNA, 22 nt, Human
agcauugguggccagagugccu

SEQ ID NO: 583627 - RNA, 22 nt, Human
auugcacaaacacagucagacu

SEQ ID NO: 583628 - RNA, 22 nt, Human
agacagugacuuagugaccaga

SEQ ID NO: 583629 - RNA, 22 nt, Human
agggugcguucuaugagaaucu

SEQ ID NO: 583630 - RNA, 22 nt, Human
cagccagggagggcaaaugaga

SEQ ID NO: 583631 - RNA, 22 nt, Human
ccuuccaguauguuaagauggu

SEQ ID NO: 583632 - RNA, 22 nt, Human
cagagccccucagcucucuccc

SEQ ID NO: 583633 - RNA, 22 nt, Human
guggguggggagcucucuggag

SEQ ID NO: 583634 - RNA, 22 nt, Human
uuaccacacuuauuuacauugg

SEQ ID NO: 583635 - RNA, 19 nt, Human
cagucccaaauucuuguca

SEQ ID NO: 583636 - RNA, 22 nt, Human
cucugagaauauaagacuauuu

SEQ ID NO: 583637 - RNA, 22 nt, Human
aaauaucauucuggugcacaga

SEQ ID NO: 583638 - RNA, 22 nt, Human
cuucagagugcagaagauuggg

SEQ ID NO: 583639 - RNA, 22 nt, Human
uaaaauagcaugugcagugaaa

SEQ ID NO: 583640 - RNA, 23 nt, Human
cugccugcuggggagacagaucu

SEQ ID NO: 583641 - RNA, 22 nt, Human
agccuaggggguccugggccac

SEQ ID NO: 583642 - RNA, 22 nt, Human
ccagcugauucgguggugguug

SEQ ID NO: 583643 - RNA, 22 nt, Human
uacagugugaauaagcaggcau

SEQ ID NO: 583644 - RNA, 22 nt, Human
uuuuauucucaagacaauggga

SEQ ID NO: 583645 - RNA, 22 nt, Human
aguacauuuauuaaugguaaaa

SEQ ID NO: 583646 - RNA, 22 nt, Human
uggccacagccucugccaguuc

SEQ ID NO: 583647 - RNA, 22 nt, Human
acagggcucgucgggcccucgg

SEQ ID NO: 583648 - RNA, 22 nt, Human
gcaggagcagucaggggcagcu

SEQ ID NO: 583649 - RNA, 22 nt, Human
aaagcaugugaauagaauaugg

SEQ ID NO: 583650 - RNA, 20 nt, Human
aaauggccucagauaagcag

SEQ ID NO: 583651 - RNA, 22 nt, Human
gcugagugaggcugucaaaaug

SEQ ID NO: 583652 - RNA, 22 nt, Human
ugagugaggugcuuagggcaca

SEQ ID NO: 583653 - RNA, 23 nt, Human
agacagaggcugaggcuggccgc

SEQ ID NO: 583654 - RNA, 18 nt, Human
caucuacaaaugccagaa

SEQ ID NO: 583655 - RNA, 22 nt, Human
uuagauacauucucauuuguuu

SEQ ID NO: 583656 - RNA, 22 nt, Human
acuuuuaugauaaucaauguuc

SEQ ID NO: 583657 - RNA, 22 nt, Human
gcaggaagcauagaagaaugcc

SEQ ID NO: 583658 - RNA, 22 nt, Human
ccaagcuggauuuagcugcaca

SEQ ID NO: 583659 - RNA, 22 nt, Human
aaaauagauucuaggaugucuu

SEQ ID NO: 583660 - RNA, 21 nt, Human
uuacaguugauggaguauucc

SEQ ID NO: 583661 - RNA, 22 nt, Human
guuccuuggaagaacuugaggu

SEQ ID NO: 583662 - RNA, 22 nt, Human
uuccucaugggguuccuucaga

SEQ ID NO: 583663 - RNA, 22 nt, Human
ggcugcagagcugggugggccu

SEQ ID NO: 583664 - RNA, 22 nt, Human
acauucaugcaccuuccuaucc

SEQ ID NO: 583665 - RNA, 22 nt, Human
gauaacccccaagaaggucuuu

SEQ ID NO: 583666 - RNA, 22 nt, Human
ggcuggcuugccaagcucaggg

SEQ ID NO: 583667 - RNA, 22 nt, Human
ugcaguggaggccgugagacag

SEQ ID NO: 583668 - RNA, 22 nt, Human
agaggcaguauacaauccgagc

SEQ ID NO: 583669 - RNA, 22 nt, Human
uagucccauuuugagguauuug

SEQ ID NO: 583670 - RNA, 22 nt, Human
ugauacuuuucuuuuagacuaa

SEQ ID NO: 583671 - RNA, 22 nt, Human
acugccuggccuggccucacug

SEQ ID NO: 583672 - RNA, 19 nt, Human
agcugggcugucacaguga

SEQ ID NO: 583673 - RNA, 22 nt, Human
uuaaauucauuccaacuuuuga

SEQ ID NO: 583674 - RNA, 22 nt, Human
cgucuagacaguuuccaaaaga

SEQ ID NO: 583675 - RNA, 17 nt, Human
uuauugucaagguucca

SEQ ID NO: 583676 - RNA, 22 nt, Human
ccuuaaaagaacuaucucuucu

SEQ ID NO: 583677 - RNA, 22 nt, Human
aaugucauuuaaagacaaagaa

SEQ ID NO: 583678 - RNA, 22 nt, Human
acugccaaugguaguuugaugg

SEQ ID NO: 583679 - RNA, 22 nt, Human
gcugaagauaagugaagaggcu

SEQ ID NO: 583680 - RNA, 23 nt, Human
cuugcaggaagcagauggcacac

SEQ ID NO: 583681 - RNA, 22 nt, Human
acagaugauuuuuaugaaaaca

SEQ ID NO: 583682 - RNA, 22 nt, Human
agcaguguuggugggagcaucu

SEQ ID NO: 583683 - RNA, 22 nt, Human
aacucaguuacauauuagaaua

SEQ ID NO: 583684 - RNA, 22 nt, Human
gacugcuuugaccaauagcaca

SEQ ID NO: 583685 - RNA, 22 nt, Human
aagagcuggcccaaucugagca

SEQ ID NO: 583686 - RNA, 22 nt, Human
ucagcucugcacuccacugugg

SEQ ID NO: 583687 - RNA, 22 nt, Human
cagugcaguggcugagcuggag

SEQ ID NO: 583688 - RNA, 22 nt, Human
uuuccuuguucauuugcccuau

SEQ ID NO: 583689 - RNA, 22 nt, Human
auaaugcaccuuugaguauggc

SEQ ID NO: 583690 - RNA, 19 nt, Human
cuggccuguguccugugcu

SEQ ID NO: 583691 - RNA, 22 nt, Human
gcauugaguccacucugucuuu

SEQ ID NO: 583692 - RNA, 22 nt, Human
agccaggggauucaucagggac

SEQ ID NO: 583693 - RNA, 22 nt, Human
uguaucaaaccaaauuaauucu

SEQ ID NO: 583694 - RNA, 22 nt, Human
cugugccuccaaguggucucug

SEQ ID NO: 583695 - RNA, 22 nt, Human
auucuuuaauucaauugaagga

SEQ ID NO: 583696 - RNA, 22 nt, Human
ugcagagggagugacgguucac

SEQ ID NO: 583697 - RNA, 16 nt, Human
gugcaaaagugaggag

SEQ ID NO: 583698 - RNA, 22 nt, Human
gggugcagcagagcuccucugu

SEQ ID NO: 583699 - RNA, 22 nt, Human
ucucuuccuugaccuauuguaa

SEQ ID NO: 583700 - RNA, 22 nt, Human
agacauggauuucuuacauaaa

SEQ ID NO: 583701 - RNA, 22 nt, Human
aaugggaaagagacuagaugcu

SEQ ID NO: 583702 - RNA, 22 nt, Human
uauugccugaguguuucauaau

SEQ ID NO: 583703 - RNA, 22 nt, Human
auguuucuaguuguaugucacu

SEQ ID NO: 583704 - RNA, 22 nt, Human
ccagggcugcugggggaguuga

SEQ ID NO: 583705 - RNA, 22 nt, Human
gaggcugcagcuaucagacauu

SEQ ID NO: 583706 - RNA, 22 nt, Human
ugagcugugaggguacagauau

SEQ ID NO: 583707 - RNA, 22 nt, Human
caugccaagcauguucagaagu

SEQ ID NO: 583708 - RNA, 22 nt, Human
ucuacuguggaggcaaauccuu

SEQ ID NO: 583709 - RNA, 21 nt, Human
ggcuguguucagggcaugcgg

SEQ ID NO: 583710 - RNA, 22 nt, Human
cuucugagauguuguuuuacag

SEQ ID NO: 583711 - RNA, 22 nt, Human
acacagaguuauuaugugaacu

SEQ ID NO: 583712 - RNA, 22 nt, Human
aagugcugggauuacagguguc

SEQ ID NO: 583713 - RNA, 22 nt, Human
ucucaucuccauuauagcauca

SEQ ID NO: 583714 - RNA, 22 nt, Human
gauauguaccaccucuuaaaag

SEQ ID NO: 583715 - RNA, 22 nt, Human
gaggaggcuaagugggcucugg

SEQ ID NO: 583716 - RNA, 22 nt, Human
ucaggccagcaccaucccuauc

SEQ ID NO: 583717 - RNA, 21 nt, Human
auaccauuugccaaaaggauc

SEQ ID NO: 583718 - RNA, 22 nt, Human
aucaucaucuaaauugugucgc

SEQ ID NO: 583719 - RNA, 22 nt, Human
ccaggugggaggaaagcagaga

SEQ ID NO: 583720 - RNA, 22 nt, Human
uccugugugggcaggaugagaa

SEQ ID NO: 583721 - RNA, 22 nt, Human
gcacacacaugugaguacaugc

SEQ ID NO: 583722 - RNA, 22 nt, Human
uugguauacaaauauuuagcac

SEQ ID NO: 583723 - RNA, 22 nt, Human
agcaggugcguuacuucacucu

SEQ ID NO: 583724 - RNA, 22 nt, Human
cuauuucauguuccuauggccg

SEQ ID NO: 583725 - RNA, 22 nt, Human
ugagcuuccucccugcauccau

SEQ ID NO: 583726 - RNA, 22 nt, Human
cacagcauaaugaaauauacuu

SEQ ID NO: 583727 - RNA, 22 nt, Human
ucauaaacaaaacaguuuaugc

SEQ ID NO: 583728 - RNA, 22 nt, Human
ucaggaaagaguaauguauaca

SEQ ID NO: 583729 - RNA, 22 nt, Human
aaucacaauuacuuuugcacca

SEQ ID NO: 583730 - RNA, 22 nt, Human
ucaugcaaauacuguuccagaa

SEQ ID NO: 583731 - RNA, 22 nt, Human
ucucaagcuacuaccuuggauc

SEQ ID NO: 583732 - RNA, 22 nt, Human
cuccaggcuggggugcagguug

SEQ ID NO: 583733 - RNA, 23 nt, Human
ucuggcuuccaguggguucaacc

SEQ ID NO: 583734 - RNA, 22 nt, Human
ccuguccuccggagcgggcugu

SEQ ID NO: 583735 - RNA, 22 nt, Human
cgcccuccacacagccccuggc

SEQ ID NO: 583736 - RNA, 19 nt, Human
uggaggagaggaaaaguca

SEQ ID NO: 583737 - RNA, 22 nt, Human
auuucaaguguugagcucauaa

SEQ ID NO: 583738 - RNA, 18 nt, Human
agcauuaggagguuauca

SEQ ID NO: 583739 - RNA, 22 nt, Human
uagggguguuucgagagagguu

SEQ ID NO: 583740 - RNA, 17 nt, Human
acacagagauuaacaca

SEQ ID NO: 583741 - RNA, 22 nt, Human
uucuuaaaauucaagcuagguu

SEQ ID NO: 583742 - RNA, 20 nt, Human
gaggcugcggacugcuggac

SEQ ID NO: 583743 - RNA, 20 nt, Human
cacccucccagcaccuaugc

SEQ ID NO: 583744 - RNA, 23 nt, Human
gagcucagguagggcucgcccgc

SEQ ID NO: 583745 - RNA, 19 nt, Human
gccacuccugaugcugccc

SEQ ID NO: 583746 - RNA, 19 nt, Human
agcaaauauaauaguguuc

SEQ ID NO: 583747 - RNA, 22 nt, Human
gggaaugagagucagcccagga

SEQ ID NO: 583748 - RNA, 22 nt, Human
aucagaauggagcccacauggu

SEQ ID NO: 583749 - RNA, 22 nt, Human
guuuuguugcugcagagcucaa

SEQ ID NO: 583750 - RNA, 22 nt, Human
gcaguguuucccagagauggaa

SEQ ID NO: 583751 - RNA, 22 nt, Human
aggaacuggugggaggugauug

SEQ ID NO: 583752 - RNA, 22 nt, Human
augcauaucagugauuguuugc

SEQ ID NO: 583753 - RNA, 22 nt, Human
cucaaaaugguuaauuuuaaua

SEQ ID NO: 583754 - RNA, 22 nt, Human
caagccugucucaccagugcua

SEQ ID NO: 583755 - RNA, 22 nt, Human
uuuugucuaagaacuuugcaaa

SEQ ID NO: 583756 - RNA, 22 nt, Human
acagccccagcgcggcgggguc

SEQ ID NO: 583757 - RNA, 22 nt, Human
ugggccacagcucacacaucca

SEQ ID NO: 583758 - RNA, 22 nt, Human
uguuagcugugcuuuagccuuc

SEQ ID NO: 583759 - RNA, 18 nt, Human
aagcagacagcagacagu

SEQ ID NO: 583760 - RNA, 22 nt, Human
aggcagcuucugauuagcagcg

SEQ ID NO: 583761 - RNA, 22 nt, Human
gguggcagaggugcaucagccc

SEQ ID NO: 583762 - RNA, 22 nt, Human
ggcccagacccaagaguggugg

SEQ ID NO: 583763 - RNA, 22 nt, Human
acugaggucaugcauaguuucu

SEQ ID NO: 583764 - RNA, 22 nt, Human
gguggcaguggucucugacaga

SEQ ID NO: 583765 - RNA, 22 nt, Human
ugaggugagucaugcauuggag

SEQ ID NO: 583766 - RNA, 22 nt, Human
cccaggaggcagagauagcagu

SEQ ID NO: 583767 - RNA, 18 nt, Human
aggcaggugcuggaaguc

SEQ ID NO: 583768 - RNA, 22 nt, Human
guuccuuguauuucagacauga

SEQ ID NO: 583769 - RNA, 22 nt, Human
ugccagagaggagaaagcauuu

SEQ ID NO: 583770 - RNA, 22 nt, Human
cucacuggcaagacuacaggug

SEQ ID NO: 583771 - RNA, 22 nt, Human
ggguugaggcggaugucggcgg

SEQ ID NO: 583772 - RNA, 22 nt, Human
uagagaaaagcagggaucagga

SEQ ID NO: 583773 - RNA, 22 nt, Human
acauggaagauaaaaauacuca

SEQ ID NO: 583774 - RNA, 16 nt, Human
ccucucuuauuccucc

SEQ ID NO: 583775 - RNA, 22 nt, Human
cauacagucacugugguaccac

SEQ ID NO: 583776 - RNA, 21 nt, Human
aaaguucaugcuuuaauauuc

SEQ ID NO: 583777 - RNA, 19 nt, Human
ugcaaucagcuacccaggu

SEQ ID NO: 583778 - RNA, 22 nt, Human
ugcuccagaaccugaccaugcu

SEQ ID NO: 583779 - RNA, 22 nt, Human
uuucuagaucaaacuuuuauau

SEQ ID NO: 583780 - RNA, 22 nt, Human
accagcacggauuagaaugcuu

SEQ ID NO: 583781 - RNA, 22 nt, Human
cauguucucuuaauguuaacua

SEQ ID NO: 583782 - RNA, 22 nt, Human
ucuguuuauucaauuucuauau

SEQ ID NO: 583783 - RNA, 22 nt, Human
cugucaguaggcucccaucauu

SEQ ID NO: 583784 - RNA, 22 nt, Human
uagcuuuguguaugaugucugu

SEQ ID NO: 583785 - RNA, 22 nt, Human
aaauaggaaugugguccuggga

SEQ ID NO: 583786 - RNA, 22 nt, Human
caggaaauucuuuuguuugugc

SEQ ID NO: 583787 - RNA, 22 nt, Human
ggcagcagggcugucucccuac

SEQ ID NO: 583788 - RNA, 22 nt, Human
uaaagaauaauacccauggagc

SEQ ID NO: 583789 - RNA, 22 nt, Human
gcaggcagguggcaucuuguga

SEQ ID NO: 583790 - RNA, 22 nt, Human
ccaggcugcuguugguguccgc

SEQ ID NO: 583791 - RNA, 22 nt, Human
cucagggcucugcaugcacacg

SEQ ID NO: 583792 - RNA, 22 nt, Human
cacagcagaacuuaauuucaaa

SEQ ID NO: 583793 - RNA, 22 nt, Human
ccacuugaaacuuaguggcaua

SEQ ID NO: 583794 - RNA, 22 nt, Human
uaguaaaaguuuaguugaaagu

SEQ ID NO: 583795 - RNA, 22 nt, Human
guuuacaugcagaaaaucaaug

SEQ ID NO: 583796 - RNA, 22 nt, Human
ucuuucuugguauaaagcaggg

SEQ ID NO: 583797 - RNA, 22 nt, Human
ccagcuccccucagcagguaau

SEQ ID NO: 583798 - RNA, 22 nt, Human
cggaagcguucucagcaggggc

SEQ ID NO: 583799 - RNA, 22 nt, Human
ucucuguagaccugaccagcac

SEQ ID NO: 583800 - RNA, 22 nt, Human
cacaggguuguucugaggauuc

SEQ ID NO: 583801 - RNA, 22 nt, Human
uuucugauaauuuugugaaauc

SEQ ID NO: 583802 - RNA, 22 nt, Human
auguauguucaagcaaugauua

SEQ ID NO: 583803 - RNA, 22 nt, Human
aaaaagauguccugaaguuuag

SEQ ID NO: 583804 - RNA, 22 nt, Human
uguggggguacacguacacaug

SEQ ID NO: 583805 - RNA, 22 nt, Human
agcugucaccaggagccggacc

SEQ ID NO: 583806 - RNA, 22 nt, Human
aucauaaagugcuaucugauug

SEQ ID NO: 583807 - RNA, 22 nt, Human
ucaggaacuucuaggaaagcug

SEQ ID NO: 583808 - RNA, 21 nt, Human
uaagccaccaugugaaaccag

SEQ ID NO: 583809 - RNA, 22 nt, Human
cuggccagacuacacaugugug

SEQ ID NO: 583810 - RNA, 22 nt, Human
acacaaauuguaggauaauugc

SEQ ID NO: 583811 - RNA, 17 nt, Human
auggcucaccugugggc

SEQ ID NO: 583812 - RNA, 22 nt, Human
uuccucacacucccccauucga

SEQ ID NO: 583813 - RNA, 19 nt, Human
gcuccuggaugaccugugg

SEQ ID NO: 583814 - RNA, 22 nt, Human
aggaaugguuauggggauagua

SEQ ID NO: 583815 - RNA, 20 nt, Human
gcccacucuaauccacuguc

SEQ ID NO: 583816 - RNA, 22 nt, Human
cugccucagcguuguggcccua

SEQ ID NO: 583817 - RNA, 22 nt, Human
gccucacauauucaugguuacu

SEQ ID NO: 583818 - RNA, 22 nt, Human
ucaauguccgggccccauucca

SEQ ID NO: 583819 - RNA, 23 nt, Human
guuaacaugguccauggaagagc

SEQ ID NO: 583820 - RNA, 22 nt, Human
augugaaaauccaauggcagca

SEQ ID NO: 583821 - RNA, 22 nt, Human
agggaggaaggauguuccaaag

SEQ ID NO: 583822 - RNA, 22 nt, Human
uuggccuucccuaccugggcca

SEQ ID NO: 583823 - RNA, 22 nt, Human
gagggaugguaguugacacuga

SEQ ID NO: 583824 - RNA, 22 nt, Human
ucaccaggcaacuauguacucc

SEQ ID NO: 583825 - RNA, 19 nt, Human
ggacacagaaagcugcauu

SEQ ID NO: 583826 - RNA, 22 nt, Human
aauacauaauaaguuuugucug

SEQ ID NO: 583827 - RNA, 22 nt, Human
agauaaaaugauuuucuggauc

SEQ ID NO: 583828 - RNA, 18 nt, Human
ugggauggagaguaacug

SEQ ID NO: 583829 - RNA, 22 nt, Human
gaaagaaugcuauagugacuuc

SEQ ID NO: 583830 - RNA, 22 nt, Human
ggguggagccaguugacucugu

SEQ ID NO: 583831 - RNA, 22 nt, Human
uaaagacaaacccacuaggguu

SEQ ID NO: 583832 - RNA, 22 nt, Human
gggagcacugagaggcagguag

SEQ ID NO: 583833 - RNA, 21 nt, Human
uaugcaguuuacuuagguauu

SEQ ID NO: 583834 - RNA, 22 nt, Human
augcuaaauaacugguuugacu

SEQ ID NO: 583835 - RNA, 22 nt, Human
caggcuggaguuaccuuuaggg

SEQ ID NO: 583836 - RNA, 22 nt, Human
ccagaggcuggcaagggcuccu

SEQ ID NO: 583837 - RNA, 22 nt, Human
cagcccuggcgcccccagaucu

SEQ ID NO: 583838 - RNA, 22 nt, Human
cuguacaaguccuucaucaggg

SEQ ID NO: 583839 - RNA, 22 nt, Human
cccuguccuuggcugugaggcu

SEQ ID NO: 583840 - RNA, 22 nt, Human
cccaggagguggagguugcagc

SEQ ID NO: 583841 - RNA, 22 nt, Human
gcagacagaugagggugcuggg

SEQ ID NO: 583842 - RNA, 22 nt, Human
aaagagcacccucaaugucuga

SEQ ID NO: 583843 - RNA, 22 nt, Human
gcugcccucucuggccccacac

SEQ ID NO: 583844 - RNA, 20 nt, Human
gcugccagugccugaugcuu

SEQ ID NO: 583845 - RNA, 22 nt, Human
ggagauggucuguucucauauu

SEQ ID NO: 583846 - RNA, 22 nt, Human
cuuucucuggaggggagugguu

SEQ ID NO: 583847 - RNA, 22 nt, Human
cuacugaagauaacuggcucuu

SEQ ID NO: 583848 - RNA, 18 nt, Human
ugaggcccgcagaggugg

SEQ ID NO: 583849 - RNA, 16 nt, Human
gaggggagcaguaggc

SEQ ID NO: 583850 - RNA, 22 nt, Human
uccaggugagugcaggugcaga

SEQ ID NO: 583851 - RNA, 22 nt, Human
aggucagguaucagcagguauu

SEQ ID NO: 583852 - RNA, 22 nt, Human
auggcagggcacagcucuaguu

SEQ ID NO: 583853 - RNA, 22 nt, Human
gcaaacaucuuagccauagagu

SEQ ID NO: 583854 - RNA, 22 nt, Human
ugauuuugagguuucaggucuu

SEQ ID NO: 583855 - RNA, 22 nt, Human
aggguggcaccuggaagggaug

SEQ ID NO: 583856 - RNA, 22 nt, Human
agcaucagccucuguccuggag

SEQ ID NO: 583857 - RNA, 22 nt, Human
augggcagagcuggugggaggc

SEQ ID NO: 583858 - RNA, 22 nt, Human
cccagaggaggaucucggcccg

SEQ ID NO: 583859 - RNA, 22 nt, Human
ccucaggauacaggagccacag

SEQ ID NO: 583860 - RNA, 22 nt, Human
cugugccaggcccagcugacuu

SEQ ID NO: 583861 - RNA, 22 nt, Human
ugauuagauaguaagugacuaa

SEQ ID NO: 583862 - RNA, 22 nt, Human
uuagaggaaagugacuccgaug

SEQ ID NO: 583863 - RNA, 22 nt, Human
cugcaguugguggguccucggu

SEQ ID NO: 583864 - RNA, 22 nt, Human
ugucuguggcaauuguggguaa

SEQ ID NO: 583865 - RNA, 22 nt, Human
cacugucugcuucgacucuuca

SEQ ID NO: 583866 - RNA, 22 nt, Human
aggaaaggauuggcuucucugu

SEQ ID NO: 583867 - RNA, 22 nt, Human
auuuuccucaagccucuggaag

SEQ ID NO: 583868 - RNA, 18 nt, Human
uggcaaguaaugacaaaa

SEQ ID NO: 583869 - RNA, 22 nt, Human
aagaauuuaaacuaaccauaug

SEQ ID NO: 583870 - RNA, 22 nt, Human
gaggcuaaguaacuguccaugg

SEQ ID NO: 583871 - RNA, 19 nt, Human
uuuugaaguaugagacagg

SEQ ID NO: 583872 - RNA, 22 nt, Human
ggaaagggcauggccuuuucac

SEQ ID NO: 583873 - RNA, 22 nt, Human
aauggagacccuaaggaagagg

SEQ ID NO: 583874 - RNA, 23 nt, Human
gccuggagaaaagcugcaguuca

SEQ ID NO: 583875 - RNA, 22 nt, Human
uuucaguuucauggcacagcua

SEQ ID NO: 583876 - RNA, 22 nt, Human
gagcucagcacuaaaaucaugu

SEQ ID NO: 583877 - RNA, 22 nt, Human
aauaagaauuuacuugucaaga

SEQ ID NO: 583878 - RNA, 22 nt, Human
cugcaguucuuuggcuuuuaga

SEQ ID NO: 583879 - RNA, 22 nt, Human
ucucuguauucugauauucacu

SEQ ID NO: 583880 - RNA, 22 nt, Human
aggcaggcccugggccaucccg

SEQ ID NO: 583881 - RNA, 22 nt, Human
aggcaggcucaggcccaugcuu

SEQ ID NO: 583882 - RNA, 22 nt, Human
ucugaggaauaagaaggaagug

SEQ ID NO: 583883 - RNA, 22 nt, Human
auguuuuuggaaaugggaacau

SEQ ID NO: 583884 - RNA, 22 nt, Human
ggcucaccauuuucacucucug

SEQ ID NO: 583885 - RNA, 22 nt, Human
gucagugguagggcuaguucag

SEQ ID NO: 583886 - RNA, 22 nt, Human
gcacaagaaaucauggacugaa

SEQ ID NO: 583887 - RNA, 22 nt, Human
uggagggcauagcuguucuuuc

SEQ ID NO: 583888 - RNA, 22 nt, Human
uugccuguuugagagcuguguu

SEQ ID NO: 583889 - RNA, 22 nt, Human
augaaguucuagugagaaaugc

SEQ ID NO: 583890 - RNA, 22 nt, Human
acaucuguaaucuagucaaccc

SEQ ID NO: 583891 - RNA, 17 nt, Human
cccuggcucuaggugga

SEQ ID NO: 583892 - RNA, 22 nt, Human
agggauggaagacuugaagacc

SEQ ID NO: 583893 - RNA, 23 nt, Human
caucagagguugccacucccugg

SEQ ID NO: 583894 - RNA, 21 nt, Human
acaggagaccgccuggcaguc

SEQ ID NO: 583895 - RNA, 19 nt, Human
ugggccugcaucugggucu

SEQ ID NO: 583896 - RNA, 22 nt, Human
ccuuuauucaauuaguccuaau

SEQ ID NO: 583897 - RNA, 22 nt, Human
gcacuucacaugccuuuuccug

SEQ ID NO: 583898 - RNA, 22 nt, Human
acucacagcagacuaugaggga

SEQ ID NO: 583899 - RNA, 22 nt, Human
uucuauaagacucauauuucuu

SEQ ID NO: 583900 - RNA, 22 nt, Human
auuucuccuuguugcaaugcag

SEQ ID NO: 583901 - RNA, 22 nt, Human
ugccaggcuuagagcaggggcu

SEQ ID NO: 583902 - RNA, 22 nt, Human
uggcuacaaguguguuuaguuu

SEQ ID NO: 583903 - RNA, 22 nt, Human
uuuuaucagcagggauaacaag

SEQ ID NO: 583904 - RNA, 22 nt, Human
aggcaggccccugagaauagac

SEQ ID NO: 583905 - RNA, 19 nt, Human
cccaggcuacauggagagg

SEQ ID NO: 583906 - RNA, 22 nt, Human
augaaugauuuuauguaaauga

SEQ ID NO: 583907 - RNA, 22 nt, Human
gacaagacagcuugcagacaac

SEQ ID NO: 583908 - RNA, 22 nt, Human
gggcagcucuuugguauccuuc

SEQ ID NO: 583909 - RNA, 22 nt, Human
cuccuggccccagaucccaauc

SEQ ID NO: 583910 - RNA, 22 nt, Human
ccagagccucaacacagguccu

SEQ ID NO: 583911 - RNA, 22 nt, Human
uacagacauucaauuuugaccc

SEQ ID NO: 583912 - RNA, 22 nt, Human
auuuacaggacagcuuggcauu

SEQ ID NO: 583913 - RNA, 22 nt, Human
gaugcuuuccaagaaauccuca

SEQ ID NO: 583914 - RNA, 22 nt, Human
aauauacuauacuacuuucugg

SEQ ID NO: 583915 - RNA, 22 nt, Human
cuuuugcacccagaguuauuug

SEQ ID NO: 583916 - RNA, 22 nt, Human
cccucccugaagaaguuacucu

SEQ ID NO: 583917 - RNA, 22 nt, Human
ggagugugggauggagcucagg

SEQ ID NO: 583918 - RNA, 22 nt, Human
cugugaauugcaacaauugcaa

SEQ ID NO: 583919 - RNA, 22 nt, Human
gugccuggagcuaauguguaua

SEQ ID NO: 583920 - RNA, 22 nt, Human
ccugaagcucuuaagaccuuua

SEQ ID NO: 583921 - RNA, 22 nt, Human
auuccugagacuuaucuguuuc

SEQ ID NO: 583922 - RNA, 22 nt, Human
cauggcaggaucugggcccaca

SEQ ID NO: 583923 - RNA, 22 nt, Human
uaauguuauaaauucuugguuu

SEQ ID NO: 583924 - RNA, 22 nt, Human
cagcucuuugaguauuccauuu

SEQ ID NO: 583925 - RNA, 21 nt, Human
ucuuuccaauauucaugucuc

SEQ ID NO: 583926 - RNA, 22 nt, Human
ucauuuaucgcugccuuuuaaa

SEQ ID NO: 583927 - RNA, 22 nt, Human
caccaggagcaucuaggaggcg

SEQ ID NO: 583928 - RNA, 22 nt, Human
aagucuuagcaacuaucgcuuu

SEQ ID NO: 583929 - RNA, 22 nt, Human
caggcagcucaaccuugggagc

SEQ ID NO: 583930 - RNA, 22 nt, Human
agcugggagcugaaggcugauu

SEQ ID NO: 583931 - RNA, 23 nt, Human
cuggcucauccugguugcagugg

SEQ ID NO: 583932 - RNA, 22 nt, Human
agacagcagggagcaggauuca

SEQ ID NO: 583933 - RNA, 22 nt, Human
uaaaucucagccuuucugcuua

SEQ ID NO: 583934 - RNA, 22 nt, Human
uugcuaauagaagauuugggaa

SEQ ID NO: 583935 - RNA, 22 nt, Human
uuggaggcaaugggaaggaggc

SEQ ID NO: 583936 - RNA, 22 nt, Human
agaggggcagggucuccggauu

SEQ ID NO: 583937 - RNA, 20 nt, Human
aggaacuggaagggaggaaa

SEQ ID NO: 583938 - RNA, 22 nt, Human
agagggagaaaagaaucaguug

SEQ ID NO: 583939 - RNA, 22 nt, Human
uacacagaaccugguguacagu

SEQ ID NO: 583940 - RNA, 22 nt, Human
aaugucuaugauccuuuaaguu

SEQ ID NO: 583941 - RNA, 22 nt, Human
guuaacuuuuuacagaaaugaa

SEQ ID NO: 583942 - RNA, 22 nt, Human
aguaauaauuuauauuagggag

SEQ ID NO: 583943 - RNA, 22 nt, Human
aaggggaaaaaguguuaggagu

SEQ ID NO: 583944 - RNA, 22 nt, Human
uccagggccaugaaguugcaca

SEQ ID NO: 583945 - RNA, 22 nt, Human
ggagagcagggaggcugcucug

SEQ ID NO: 583946 - RNA, 22 nt, Human
ugaagacacauacaagggaaug

SEQ ID NO: 583947 - RNA, 22 nt, Human
cugugcauuguugaguguuuag

SEQ ID NO: 583948 - RNA, 22 nt, Human
aacugcauuugcauaaguccau

SEQ ID NO: 583949 - RNA, 22 nt, Human
cuggcucuaagugucagcuccc

SEQ ID NO: 583950 - RNA, 22 nt, Human
guggggcuuccuggggcaaguu

SEQ ID NO: 583951 - RNA, 22 nt, Human
uccaggagaggccugaccaggu

SEQ ID NO: 583952 - RNA, 22 nt, Human
ucccaucuccaacauuuuucuu

SEQ ID NO: 583953 - RNA, 22 nt, Human
uuuugcaucuggugaagaccag

SEQ ID NO: 583954 - RNA, 22 nt, Human
agucuucugaauaagaaucacu

SEQ ID NO: 583955 - RNA, 22 nt, Human
aggaagcccaagucucaucuuc

SEQ ID NO: 583956 - RNA, 22 nt, Human
acuguacacgugucauuuacag

SEQ ID NO: 583957 - RNA, 17 nt, Human
aacacugggugagccuc

SEQ ID NO: 583958 - RNA, 22 nt, Human
ugugugcuaauguaugcucuaa

SEQ ID NO: 583959 - RNA, 22 nt, Human
cuggugcacaugaaagagaagg

SEQ ID NO: 583960 - RNA, 22 nt, Human
gcacuaaaccaacauguaauaa

SEQ ID NO: 583961 - RNA, 22 nt, Human
uuuccacuguagagauguugaa

SEQ ID NO: 583962 - RNA, 22 nt, Human
ucugcugaaucagauagcuaag

SEQ ID NO: 583963 - RNA, 22 nt, Human
aagaggacuugugaagauguac

SEQ ID NO: 583964 - RNA, 22 nt, Human
ucuucccagcugcugcgaugcc

SEQ ID NO: 583965 - RNA, 22 nt, Human
caugcagugaugcacugcauca

SEQ ID NO: 583966 - RNA, 22 nt, Human
cugaagaggacuggguuggagg

SEQ ID NO: 583967 - RNA, 22 nt, Human
gagcauggugcuucagugaagg

SEQ ID NO: 583968 - RNA, 22 nt, Human
uuuuccuaguaggccuauuaga

SEQ ID NO: 583969 - RNA, 22 nt, Human
gaacaacucuucuugagagaug

SEQ ID NO: 583970 - RNA, 22 nt, Human
uaauucaugggcccagugauau

SEQ ID NO: 583971 - RNA, 22 nt, Human
aaaauugaagugaucaggaacu

SEQ ID NO: 583972 - RNA, 22 nt, Human
gggaaaucucguccucuauuua

SEQ ID NO: 583973 - RNA, 22 nt, Human
gccugcaagauggcuggucacu

SEQ ID NO: 583974 - RNA, 22 nt, Human
ccuggugccacuagagaauguc

SEQ ID NO: 583975 - RNA, 22 nt, Human
uuucuaaucuuuaguuacaaaa

SEQ ID NO: 583976 - RNA, 22 nt, Human
uagugauucugauguaagacaa

SEQ ID NO: 583977 - RNA, 22 nt, Human
uucugaaaggcaugucagguag

SEQ ID NO: 583978 - RNA, 22 nt, Human
ugcaguggaaagacucagacuu

SEQ ID NO: 583979 - RNA, 22 nt, Human
aaguuccuguuacuccccagaa

SEQ ID NO: 583980 - RNA, 22 nt, Human
ccucagaacggaaaugguuuug

SEQ ID NO: 583981 - RNA, 22 nt, Human
auuuauuauugugguuacuucu

SEQ ID NO: 583982 - RNA, 22 nt, Human
uccugaggugcucagccaggaa

SEQ ID NO: 583983 - RNA, 22 nt, Human
auaauaacuccuguugaagaac

SEQ ID NO: 583984 - RNA, 22 nt, Human
agggaaauaaucuauucugagg

SEQ ID NO: 583985 - RNA, 20 nt, Human
agugagauugcugcucuagc

SEQ ID NO: 583986 - RNA, 22 nt, Human
agagauuucuacugcacucuuu

SEQ ID NO: 583987 - RNA, 22 nt, Human
uuuuuacagucauggucacuca

SEQ ID NO: 583988 - RNA, 22 nt, Human
cuaggcagacugagcucuaggg

SEQ ID NO: 583989 - RNA, 22 nt, Human
uauugcuuucucagacguuuag

SEQ ID NO: 583990 - RNA, 22 nt, Human
auggcaaaaauuaacagaucaa

SEQ ID NO: 583991 - RNA, 22 nt, Human
uaagugucucucgaauuaugcu

SEQ ID NO: 583992 - RNA, 20 nt, Human
aguaccuuuuguauguuacc

SEQ ID NO: 583993 - RNA, 22 nt, Human
aacacuguacuggaagauggac

SEQ ID NO: 583994 - RNA, 22 nt, Human
agguacauggggugugugcacg

SEQ ID NO: 583995 - RNA, 22 nt, Human
agcagcagggacaaaggaacag

SEQ ID NO: 583996 - RNA, 22 nt, Human
agggccagcugaugagaaugag

SEQ ID NO: 583997 - RNA, 20 nt, Human
aguagcagugugacauugac

SEQ ID NO: 583998 - RNA, 22 nt, Human
aagcugcuuugucaggaauaug

SEQ ID NO: 583999 - RNA, 22 nt, Human
aguuucuaacauauagcauugg

SEQ ID NO: 584000 - RNA, 22 nt, Human
aagaggaggaugcuuuacagcu

SEQ ID NO: 584001 - RNA, 22 nt, Human
ggccuugggaggagggucagaa

SEQ ID NO: 584002 - RNA, 22 nt, Human
gcaguccaaaguggcucucacc

SEQ ID NO: 584003 - RNA, 22 nt, Human
cacugcagcaccaugcagggcu

SEQ ID NO: 584004 - RNA, 22 nt, Human
uccugaggaaugugaagagaac

SEQ ID NO: 584005 - RNA, 22 nt, Human
ccugggcaacauagugagaccc

SEQ ID NO: 584006 - RNA, 22 nt, Human
auauaccugaaguugguaauua

SEQ ID NO: 584007 - RNA, 22 nt, Human
cagagugggcugucagccacca

SEQ ID NO: 584008 - RNA, 22 nt, Human
aauaagaucuuaaagguuauau

SEQ ID NO: 584009 - RNA, 22 nt, Human
cagcagcucccauccgcugagc

SEQ ID NO: 584010 - RNA, 22 nt, Human
ucaagucuggagaucuggaacu

SEQ ID NO: 584011 - RNA, 22 nt, Human
uuaaagcaucacacuauuaauu

SEQ ID NO: 584012 - RNA, 22 nt, Human
uuuucuccuaagacccuucacc

SEQ ID NO: 584013 - RNA, 19 nt, Human
acagaagcauagaaaagga

SEQ ID NO: 584014 - RNA, 19 nt, Human
accuuugagaagaaauguc

SEQ ID NO: 584015 - RNA, 22 nt, Human
gaaacagcacguuuggagagau

SEQ ID NO: 584016 - RNA, 22 nt, Human
ugcacaguguaaugaaucagaa

SEQ ID NO: 584017 - RNA, 22 nt, Human
ccagcaccuugaucuuggaguu

SEQ ID NO: 584018 - RNA, 22 nt, Human
uuuguucugcaucacagaaaaa

SEQ ID NO: 584019 - RNA, 22 nt, Human
acagccugcugccugcuucuug

SEQ ID NO: 584020 - RNA, 22 nt, Human
aacuguaaugaauuguucauga

SEQ ID NO: 584021 - RNA, 22 nt, Human
augaagcagcguuguagaguga

SEQ ID NO: 584022 - RNA, 22 nt, Human
guggcaggucccauuggagcag

SEQ ID NO: 584023 - RNA, 22 nt, Human
cauaaauuguacccauuccaac

SEQ ID NO: 584024 - RNA, 22 nt, Human
gcggcgccuaagccccgaccuc

SEQ ID NO: 584025 - RNA, 22 nt, Human
ugcaggugccucuugagcuugu

SEQ ID NO: 584026 - RNA, 22 nt, Human
auuucccacucuacuacaugcu

SEQ ID NO: 584027 - RNA, 22 nt, Human
cccagguggguuggccucuguc

SEQ ID NO: 584028 - RNA, 22 nt, Human
aggcugagguaggaggaucgcu

SEQ ID NO: 584029 - RNA, 22 nt, Human
ggggacagucgaucuagugauu

SEQ ID NO: 584030 - RNA, 22 nt, Human
caggagugaaaugaggcccagg

SEQ ID NO: 584031 - RNA, 22 nt, Human
ucuguuauucugcucaguauag

SEQ ID NO: 584032 - RNA, 22 nt, Human
ugaggccagaguuuuuaauucc

SEQ ID NO: 584033 - RNA, 21 nt, Human
gucacacaggccuggagcuga

SEQ ID NO: 584034 - RNA, 22 nt, Human
aggagcagcuucugaaccaugu

SEQ ID NO: 584035 - RNA, 22 nt, Human
ucauggaaacagcaaugcuaau

SEQ ID NO: 584036 - RNA, 19 nt, Human
gacuacagggggaagaagu

SEQ ID NO: 584037 - RNA, 22 nt, Human
cagcaguggcugcaggcagcug

SEQ ID NO: 584038 - RNA, 22 nt, Human
cugugguggcacagcgggcugg

SEQ ID NO: 584039 - RNA, 22 nt, Human
ugccugggggacuaaggccaaa

SEQ ID NO: 584040 - RNA, 21 nt, Human
gggaggaagcugcuucucucu

SEQ ID NO: 584041 - RNA, 22 nt, Human
auaucuaccuagcuuaggcuga

SEQ ID NO: 584042 - RNA, 22 nt, Human
gaugucuuggcuugcucucugu

SEQ ID NO: 584043 - RNA, 17 nt, Human
cccugccaccaggaagc

SEQ ID NO: 584044 - RNA, 22 nt, Human
ucuguucagguuucagagaacu

SEQ ID NO: 584045 - RNA, 22 nt, Human
gagcagaugugugccaggaugc

SEQ ID NO: 584046 - RNA, 22 nt, Human
uccagcuccucuacccgaugcg

SEQ ID NO: 584047 - RNA, 22 nt, Human
gagauggggaauaggagcaagc

SEQ ID NO: 584048 - RNA, 22 nt, Human
uggugcagguguugaugcagga

SEQ ID NO: 584049 - RNA, 22 nt, Human
auguuucauuuagauaucaggc

SEQ ID NO: 584050 - RNA, 22 nt, Human
cuucaguuaugugccaaggaca

SEQ ID NO: 584051 - RNA, 20 nt, Human
ccuggccaaugagauaggaa

SEQ ID NO: 584052 - RNA, 22 nt, Human
uuucaggauuaguuuaagcagg

SEQ ID NO: 584053 - RNA, 22 nt, Human
gcaguggcaugaugugggcuca

SEQ ID NO: 584054 - RNA, 22 nt, Human
gugggagcccucagggaggugc

SEQ ID NO: 584055 - RNA, 23 nt, Human
uggcuccaugaaaauuacgagga

SEQ ID NO: 584056 - RNA, 22 nt, Human
caaaugaaaauggcgucuugga

SEQ ID NO: 584057 - RNA, 22 nt, Human
ccugucuguccuuugcauucuu

SEQ ID NO: 584058 - RNA, 22 nt, Human
aaggcuggggugcagacggccu

SEQ ID NO: 584059 - RNA, 22 nt, Human
cacuccaggucccaguuccugg

SEQ ID NO: 584060 - RNA, 22 nt, Human
gaacacagugugaucguauguc

SEQ ID NO: 584061 - RNA, 22 nt, Human
ucagaggauugccucagcgagc

SEQ ID NO: 584062 - RNA, 22 nt, Human
aacaucacaauuucauuuaugc

SEQ ID NO: 584063 - RNA, 22 nt, Human
uugaggucuuugagcaaacgca

SEQ ID NO: 584064 - RNA, 22 nt, Human
uauacucugagaaacgugucac

SEQ ID NO: 584065 - RNA, 19 nt, Human
aaagcagaggagcaucuga

SEQ ID NO: 584066 - RNA, 22 nt, Human
uggcauggcauuuagagaauua

SEQ ID NO: 584067 - RNA, 22 nt, Human
ucccaggaucugagggcagaga

SEQ ID NO: 584068 - RNA, 22 nt, Human
cuuagcagaauuccaagcuuga

SEQ ID NO: 584069 - RNA, 22 nt, Human
ucccaggguccucuucuggaau

SEQ ID NO: 584070 - RNA, 19 nt, Human
gccaugggcuggcagcaga

SEQ ID NO: 584071 - RNA, 22 nt, Human
ucaggcuggagugcaguggcgc

SEQ ID NO: 584072 - RNA, 22 nt, Human
gaagaagcaggaguguguagca

SEQ ID NO: 584073 - RNA, 22 nt, Human
gggcagcugccagaggccaugg

SEQ ID NO: 584074 - RNA, 21 nt, Human
uguuuuccaccuugaggcaag

SEQ ID NO: 584075 - RNA, 22 nt, Human
aggaagaaaacuaauuagaugg

SEQ ID NO: 584076 - RNA, 20 nt, Human
aaagauacuuuuuguaaugg

SEQ ID NO: 584077 - RNA, 22 nt, Human
ggcaguggcuccucucuacucc

SEQ ID NO: 584078 - RNA, 22 nt, Human
augaaugaagaacaucugugcc

SEQ ID NO: 584079 - RNA, 22 nt, Human
ucaauauagcaguguacuugag

SEQ ID NO: 584080 - RNA, 22 nt, Human
gagcacagcuggagguagcauu

SEQ ID NO: 584081 - RNA, 22 nt, Human
uuccugguaaauuauguccagg

SEQ ID NO: 584082 - RNA, 22 nt, Human
ugcagccaggaaauauuugcug

SEQ ID NO: 584083 - RNA, 22 nt, Human
auaguguguaaagugcagugau

SEQ ID NO: 584084 - RNA, 22 nt, Human
uaaugcaacgugagauaauuaa

SEQ ID NO: 584085 - RNA, 22 nt, Human
gugggaugcaguggugaguggc

SEQ ID NO: 584086 - RNA, 22 nt, Human
cugccugcguugccucgugccu

SEQ ID NO: 584087 - RNA, 22 nt, Human
agggcagaggcggacacggaag

SEQ ID NO: 584088 - RNA, 22 nt, Human
gggaagccaugcucagagguac

SEQ ID NO: 584089 - RNA, 22 nt, Human
gcagagcuguuaauggagcuga

SEQ ID NO: 584090 - RNA, 22 nt, Human
acugucauuaaugaauguaaua

SEQ ID NO: 584091 - RNA, 22 nt, Human
uucccagguaauucugaggcag

SEQ ID NO: 584092 - RNA, 22 nt, Human
ugaaugaguggauucugaguag

SEQ ID NO: 584093 - RNA, 22 nt, Human
cagaagaauggugucugagcuc

SEQ ID NO: 584094 - RNA, 22 nt, Human
cagguccuuuaguguccagaac

SEQ ID NO: 584095 - RNA, 22 nt, Human
gggggagagacgagcggcucug

SEQ ID NO: 584096 - RNA, 17 nt, Human
ugagaaguaggcaucau

SEQ ID NO: 584097 - RNA, 22 nt, Human
uuccugaaaauacagggagacc

SEQ ID NO: 584098 - RNA, 22 nt, Human
cacauuuaagugcuuguucaga

SEQ ID NO: 584099 - RNA, 22 nt, Human
cuggagcaggcuugucccagcu

SEQ ID NO: 584100 - RNA, 22 nt, Human
agcaucuggugagggccuaguu

SEQ ID NO: 584101 - RNA, 23 nt, Human
uuccacaaugaaaauaaagcagg

SEQ ID NO: 584102 - RNA, 22 nt, Human
auuuucaugacuaccuuaaaua

SEQ ID NO: 584103 - RNA, 22 nt, Human
ucaggaaagaguguauccauca

SEQ ID NO: 584104 - RNA, 22 nt, Human
auuccauuguguaaggauaucg

SEQ ID NO: 584105 - RNA, 22 nt, Human
gagcucagcccaaagagcagug

SEQ ID NO: 584106 - RNA, 22 nt, Human
ugaaggcaaccucugugguccu

SEQ ID NO: 584107 - RNA, 22 nt, Human
cacaaggacuggauggaguggg

SEQ ID NO: 584108 - RNA, 18 nt, Human
aggccagcccugcuacug

SEQ ID NO: 584109 - RNA, 22 nt, Human
uccugccugagcguggaggagg

SEQ ID NO: 584110 - RNA, 22 nt, Human
aagggcuggccacauucugggu

SEQ ID NO: 584111 - RNA, 22 nt, Human
uggggcagcagaccuuucuugg

SEQ ID NO: 584112 - RNA, 22 nt, Human
caguggcaugguugacugcagu

SEQ ID NO: 584113 - RNA, 22 nt, Human
aggcccugaccugggagaucua

SEQ ID NO: 584114 - RNA, 22 nt, Human
accugcagcuaaagauguaggg

SEQ ID NO: 584115 - RNA, 22 nt, Human
gcugccaugccacagcacucac

SEQ ID NO: 584116 - RNA, 22 nt, Human
ggaggccagaaucuguguugga

SEQ ID NO: 584117 - RNA, 22 nt, Human
aaaaguuaccucuguaauauaa

SEQ ID NO: 584118 - RNA, 22 nt, Human
uuaccaagcucugcauguuaag

SEQ ID NO: 584119 - RNA, 23 nt, Human
uccagcucccuucaauggcacug

SEQ ID NO: 584120 - RNA, 22 nt, Human
ccacugcccccugaagaccagg

SEQ ID NO: 584121 - RNA, 22 nt, Human
cacaggaggaggccagagcgua

SEQ ID NO: 584122 - RNA, 22 nt, Human
guagcuuauuagggauaauagu

SEQ ID NO: 584123 - RNA, 22 nt, Human
cuacauuuuaauaagcugcuua

SEQ ID NO: 584124 - RNA, 22 nt, Human
uuccagagaggcucauguuccc

SEQ ID NO: 584125 - RNA, 22 nt, Human
ugaaugauauauugggaauaau

SEQ ID NO: 584126 - RNA, 22 nt, Human
uggcucaguuugggggauugaa

SEQ ID NO: 584127 - RNA, 22 nt, Human
auuucucuaagcauccguuugc

SEQ ID NO: 584128 - RNA, 22 nt, Human
ggauuugggcuugcagcagagc

SEQ ID NO: 584129 - RNA, 23 nt, Human
auccaugcuuaaguaaucauuug

SEQ ID NO: 584130 - RNA, 22 nt, Human
uuuuguguccuucacaucaugu

SEQ ID NO: 584131 - RNA, 22 nt, Human
cccagcuccgagcuccgagccg

SEQ ID NO: 584132 - RNA, 22 nt, Human
gaaaacauccagagauagaccu

SEQ ID NO: 584133 - RNA, 22 nt, Human
uauuucuauuccccaggcaagu

SEQ ID NO: 584134 - RNA, 22 nt, Human
cuuacaaaggagaggagauagg

SEQ ID NO: 584135 - RNA, 22 nt, Human
ggcacacauggugguuggugaa

SEQ ID NO: 584136 - RNA, 23 nt, Human
auuugacagagcauagcauuucu

SEQ ID NO: 584137 - RNA, 21 nt, Human
agcugcagucaagccagaggu

SEQ ID NO: 584138 - RNA, 22 nt, Human
ugagcagaagauuggaacuuac

SEQ ID NO: 584139 - RNA, 22 nt, Human
ggggugggagugccauccuuga

SEQ ID NO: 584140 - RNA, 20 nt, Human
ugaagcagccuugauucugu

SEQ ID NO: 584141 - RNA, 22 nt, Human
ucacagcacccugaggugcugg

SEQ ID NO: 584142 - RNA, 22 nt, Human
uuugugcauucaaguaggagcc

SEQ ID NO: 584143 - RNA, 22 nt, Human
ggcugaggguauagcuguccca

SEQ ID NO: 584144 - RNA, 22 nt, Human
uaucuacaguuaauaugucauc

SEQ ID NO: 584145 - RNA, 22 nt, Human
gggucagcugcugggggcugac

SEQ ID NO: 584146 - RNA, 18 nt, Human
ugugguggagcugccuuc

SEQ ID NO: 584147 - RNA, 22 nt, Human
uucacaaagcuggagcauuucc

SEQ ID NO: 584148 - RNA, 22 nt, Human
cccuggagggcagacagaugcc

SEQ ID NO: 584149 - RNA, 19 nt, Human
auagcagcuauacccagau

SEQ ID NO: 584150 - RNA, 22 nt, Human
cagcauggcuugaguguuuccu

SEQ ID NO: 584151 - RNA, 21 nt, Human
agcugcuuucagcuccuagag

SEQ ID NO: 584152 - RNA, 22 nt, Human
ggcaggcaaggcagccugguga

SEQ ID NO: 584153 - RNA, 22 nt, Human
uugauauuagaguauuuguuug

SEQ ID NO: 584154 - RNA, 22 nt, Human
ugucuacuugggcucuacagca

SEQ ID NO: 584155 - RNA, 22 nt, Human
gaacauucacagacucaccauu

SEQ ID NO: 584156 - RNA, 22 nt, Human
aaucugagggaacuugaacucc

SEQ ID NO: 584157 - RNA, 22 nt, Human
uggcagcugauuagauggugcc

SEQ ID NO: 584158 - RNA, 22 nt, Human
ucuccaggugcuaagugugccu

SEQ ID NO: 584159 - RNA, 22 nt, Human
accagagauggggcuucucugu

SEQ ID NO: 584160 - RNA, 22 nt, Human
ugaaucuauguugccccauaau

SEQ ID NO: 584161 - RNA, 22 nt, Human
agcugccacugagggugcacag

SEQ ID NO: 584162 - RNA, 22 nt, Human
cucagggacggaggcuugcgga

SEQ ID NO: 584163 - RNA, 22 nt, Human
augaacaugugacucagaccug

SEQ ID NO: 584164 - RNA, 23 nt, Human
augcaguauaugucaguaguuua

SEQ ID NO: 584165 - RNA, 22 nt, Human
uuucugaggaauuaauacagaa

SEQ ID NO: 584166 - RNA, 22 nt, Human
gugcugaggccaaugucagggu

SEQ ID NO: 584167 - RNA, 21 nt, Human
aggcccagcuuuccucuugcu

SEQ ID NO: 584168 - RNA, 22 nt, Human
aauagcuuauugacagugaauu

SEQ ID NO: 584169 - RNA, 22 nt, Human
gaggcugaaguguacaugggug

SEQ ID NO: 584170 - RNA, 21 nt, Human
caauaaacugcacauugagac

SEQ ID NO: 584171 - RNA, 22 nt, Human
ucugcacauagguaggcuggaa

SEQ ID NO: 584172 - RNA, 22 nt, Human
aaggcaguucacucacgcagcc

SEQ ID NO: 584173 - RNA, 19 nt, Human
cuguuucugagcuugcuuu

SEQ ID NO: 584174 - RNA, 22 nt, Human
ucucuggagggcuccaggcggg

SEQ ID NO: 584175 - RNA, 22 nt, Human
uacacuguuugaacuguggucg

SEQ ID NO: 584176 - RNA, 22 nt, Human
ucagcacugaaucuggauuugc

SEQ ID NO: 584177 - RNA, 22 nt, Human
guguugaugacauuuuagaaac

SEQ ID NO: 584178 - RNA, 22 nt, Human
uuuacagggaauauuuuggcuu

SEQ ID NO: 584179 - RNA, 22 nt, Human
gcuuacaagaucgugcuccagu

SEQ ID NO: 584180 - RNA, 22 nt, Human
uccuccugucuaccaguuccug

SEQ ID NO: 584181 - RNA, 22 nt, Human
cuggcucuuuccuagcuaggcu

SEQ ID NO: 584182 - RNA, 22 nt, Human
gggcucagacaucccuccugga

SEQ ID NO: 584183 - RNA, 22 nt, Human
ucagggaauaaguagaugagug

SEQ ID NO: 584184 - RNA, 22 nt, Human
ugguuugacaaugaggacuggu

SEQ ID NO: 584185 - RNA, 20 nt, Human
cacugggcuggagucagggc

SEQ ID NO: 584186 - RNA, 22 nt, Human
gcagcuggagccagccagacac

SEQ ID NO: 584187 - RNA, 22 nt, Human
ucugccugagaaguggggugcc

SEQ ID NO: 584188 - RNA, 22 nt, Human
ugagagagccugaaucucuuac

SEQ ID NO: 584189 - RNA, 20 nt, Human
ugcagcugcaggaggguggg

SEQ ID NO: 584190 - RNA, 20 nt, Human
ggccuuggguuucgccuguu

SEQ ID NO: 584191 - RNA, 22 nt, Human
caggggaaggagccuugaaacu

SEQ ID NO: 584192 - RNA, 22 nt, Human
uggaaguggcagaaaaugaaca

SEQ ID NO: 584193 - RNA, 15 nt, Human
cagucccagggaccc

SEQ ID NO: 584194 - RNA, 22 nt, Human
ucuuuugagggccagaggaaga

SEQ ID NO: 584195 - RNA, 22 nt, Human
gggauggggucgggacccugcu

SEQ ID NO: 584196 - RNA, 22 nt, Human
augcaguuugcuucgcagcagu

SEQ ID NO: 584197 - RNA, 22 nt, Human
gcagcuuggauuucuguaguuu

SEQ ID NO: 584198 - RNA, 22 nt, Human
ugggcagaggacagggaagauc

SEQ ID NO: 584199 - RNA, 22 nt, Human
agaaucugcauuuuaacaagau

SEQ ID NO: 584200 - RNA, 22 nt, Human
cagcagcauugcucuggauucc

SEQ ID NO: 584201 - RNA, 22 nt, Human
ccacugauccugacuuuggagc

SEQ ID NO: 584202 - RNA, 22 nt, Human
ucuguacaccaggggccauucu

SEQ ID NO: 584203 - RNA, 22 nt, Human
uucaacaagucuuuuuucacug

SEQ ID NO: 584204 - RNA, 22 nt, Human
cagccagcuggcacugugagua

SEQ ID NO: 584205 - RNA, 22 nt, Human
uaguagcaaaacucaucucuuu

SEQ ID NO: 584206 - RNA, 17 nt, Human
agagagaaaagggccau

SEQ ID NO: 584207 - RNA, 20 nt, Human
ugugugcuaggacuacagug

SEQ ID NO: 584208 - RNA, 22 nt, Human
agagcuguggauaguccuggau

SEQ ID NO: 584209 - RNA, 22 nt, Human
ugcugcuggguuugacagucac

SEQ ID NO: 584210 - RNA, 22 nt, Human
aaagacauuagauuaacguaca

SEQ ID NO: 584211 - RNA, 22 nt, Human
aggcucccaugguguggcagga

SEQ ID NO: 584212 - RNA, 19 nt, Human
ugucuccuccccgccgucu

SEQ ID NO: 584213 - RNA, 22 nt, Human
cugaggugagaggaggccaugu

SEQ ID NO: 584214 - RNA, 22 nt, Human
ggccaggaacuuuugggauggg

SEQ ID NO: 584215 - RNA, 22 nt, Human
ugagaaaaguguggaggucaau

SEQ ID NO: 584216 - RNA, 19 nt, Human
ccucaaguaugaagaggcc

SEQ ID NO: 584217 - RNA, 22 nt, Human
uguuuacagaaggcagacuucc

SEQ ID NO: 584218 - RNA, 23 nt, Human
acacaauagaguacuauucagcc

SEQ ID NO: 584219 - RNA, 22 nt, Human
guauuucugguaacugcugcua

SEQ ID NO: 584220 - RNA, 22 nt, Human
agaugugccuccaaggggugca

SEQ ID NO: 584221 - RNA, 22 nt, Human
acagaacauauugcuucucuca

SEQ ID NO: 584222 - RNA, 22 nt, Human
augcuuccaaggcuaagacaag

SEQ ID NO: 584223 - RNA, 22 nt, Human
uuuuccuuugaaaggugagggc

SEQ ID NO: 584224 - RNA, 22 nt, Human
aagcagccaccucaucuccacu

SEQ ID NO: 584225 - RNA, 22 nt, Human
acuugcaaagugagggaguguu

SEQ ID NO: 584226 - RNA, 22 nt, Human
ucaguguggguaagcaugcugu

SEQ ID NO: 584227 - RNA, 22 nt, Human
uuuccuaagauagauacuucag

SEQ ID NO: 584228 - RNA, 22 nt, Human
uaggaaaagcacaggauguucu

SEQ ID NO: 584229 - RNA, 22 nt, Human
ugggccugggcuccuguccucu

SEQ ID NO: 584230 - RNA, 22 nt, Human
ugccuugguuuccccaucugua

SEQ ID NO: 584231 - RNA, 22 nt, Human
gguagcaucuuuggauguuauu

SEQ ID NO: 584232 - RNA, 22 nt, Human
gaggggcacaguaaaggguccc

SEQ ID NO: 584233 - RNA, 22 nt, Human
agggccugggauguccuccuag

SEQ ID NO: 584234 - RNA, 22 nt, Human
gagaggggcgcgcagcucgcga

SEQ ID NO: 584235 - RNA, 22 nt, Human
uaggcugggaagaaagauucuc

SEQ ID NO: 584236 - RNA, 22 nt, Human
cccaggaggcagagcuugcagu

SEQ ID NO: 584237 - RNA, 22 nt, Human
ggguaggcaaagcaaugacguu

SEQ ID NO: 584238 - RNA, 21 nt, Human
aaggaaaagcuuggucucuga

SEQ ID NO: 584239 - RNA, 22 nt, Human
gauuuuaucuuugugugcagua

SEQ ID NO: 584240 - RNA, 22 nt, Human
gugggcugcuuccuccuuccac

SEQ ID NO: 584241 - RNA, 21 nt, Human
cucuguguugaggguguugag

SEQ ID NO: 584242 - RNA, 22 nt, Human
ggucccagcugcucaagaggcu

SEQ ID NO: 584243 - RNA, 22 nt, Human
caaggacacugagcuuuguaaa

SEQ ID NO: 584244 - RNA, 23 nt, Human
caggcaggaugaggacuacacuc

SEQ ID NO: 584245 - RNA, 22 nt, Human
uucuccuuauucauaguugucu

SEQ ID NO: 584246 - RNA, 22 nt, Human
acuaaaacaguggcuaguagac

SEQ ID NO: 584247 - RNA, 22 nt, Human
agacagugauucuucacauuuc

SEQ ID NO: 584248 - RNA, 22 nt, Human
uggccuugagaugcagcagcca

SEQ ID NO: 584249 - RNA, 22 nt, Human
acugugcaugaaccgaaacaaa

SEQ ID NO: 584250 - RNA, 23 nt, Human
auccaugugagaauagacuagca

SEQ ID NO: 584251 - RNA, 22 nt, Human
aacccaggguggagguugcagu

SEQ ID NO: 584252 - RNA, 17 nt, Human
gccaggagguuugagcu

SEQ ID NO: 584253 - RNA, 22 nt, Human
auacacacugcuauccuuuuuu

SEQ ID NO: 584254 - RNA, 22 nt, Human
ucucacaccgucccuaaaccau

SEQ ID NO: 584255 - RNA, 21 nt, Human
cccaggaggagcuccggcucc

SEQ ID NO: 584256 - RNA, 22 nt, Human
ccugccuggaucagccauccug

SEQ ID NO: 584257 - RNA, 22 nt, Human
gcuggggccugaacagucagcu

SEQ ID NO: 584258 - RNA, 22 nt, Human
ugggauucaccaugggcuucag

SEQ ID NO: 584259 - RNA, 22 nt, Human
acccagugacauccuuuaccug

SEQ ID NO: 584260 - RNA, 22 nt, Human
ucagaacagguuguacuauguc

SEQ ID NO: 584261 - RNA, 22 nt, Human
auuuacauuuauuugagaaggu

SEQ ID NO: 584262 - RNA, 22 nt, Human
cacauaauaaauguuccugaug

SEQ ID NO: 584263 - RNA, 22 nt, Human
auguuuuauguuccacucaagg

SEQ ID NO: 584264 - RNA, 22 nt, Human
uauuauuauauuggaugagacu

SEQ ID NO: 584265 - RNA, 22 nt, Human
gcccugcugucuucagaguaua

SEQ ID NO: 584266 - RNA, 22 nt, Human
cugcugggucccccugcugauu

SEQ ID NO: 584267 - RNA, 22 nt, Human
gguaaacuaaccauuuuaauuu

SEQ ID NO: 584268 - RNA, 22 nt, Human
cuuuuguuaggagaaaacauca

SEQ ID NO: 584269 - RNA, 22 nt, Human
ugcugaauaaagauauauuuuc

SEQ ID NO: 584270 - RNA, 22 nt, Human
ugagaagcaguuucaguaagaa

SEQ ID NO: 584271 - RNA, 22 nt, Human
cugagucucccggcaguggagg

SEQ ID NO: 584272 - RNA, 22 nt, Human
agaaucugcauuuuaacaagcc

SEQ ID NO: 584273 - RNA, 17 nt, Human
cugaggauuaugguugu

SEQ ID NO: 584274 - RNA, 22 nt, Human
uuccaggcacaucccaacucca

SEQ ID NO: 584275 - RNA, 22 nt, Human
auugauuucugcuuacucacug

SEQ ID NO: 584276 - RNA, 22 nt, Human
ucacaaugaaaaacacuacaua

SEQ ID NO: 584277 - RNA, 20 nt, Human
uuccuguccucucuuucagg

SEQ ID NO: 584278 - RNA, 22 nt, Human
ucccagggucaguggugaggcc

SEQ ID NO: 584279 - RNA, 22 nt, Human
ggcagcugaccuagcaccaucc

SEQ ID NO: 584280 - RNA, 21 nt, Human
acagcagggcuggcaugacag

SEQ ID NO: 584281 - RNA, 22 nt, Human
aaugcuacagaagugaucuugg

SEQ ID NO: 584282 - RNA, 22 nt, Human
agcagauggagaauggagucag

SEQ ID NO: 584283 - RNA, 22 nt, Human
ccugcagguaaggcuaacugcc

SEQ ID NO: 584284 - RNA, 22 nt, Human
cucugggcaaguuucuucauga

SEQ ID NO: 584285 - RNA, 22 nt, Human
ggcagccaugugggcagcgagu

SEQ ID NO: 584286 - RNA, 22 nt, Human
gacuuagacccugucuuuauuc

SEQ ID NO: 584287 - RNA, 22 nt, Human
ugaagggcaaccccaggcccag

SEQ ID NO: 584288 - RNA, 21 nt, Human
uuaagacacacagauuaagga

SEQ ID NO: 584289 - RNA, 21 nt, Human
uagagaugacgagcucuagca

SEQ ID NO: 584290 - RNA, 17 nt, Human
acaacagaaauguauuc

SEQ ID NO: 584291 - RNA, 22 nt, Human
aggccaggauagcauggaucag

SEQ ID NO: 584292 - RNA, 22 nt, Human
agaguuuggagguguuccugga

SEQ ID NO: 584293 - RNA, 22 nt, Human
caggagagauaugaguccccac

SEQ ID NO: 584294 - RNA, 23 nt, Human
ugucacauuuaguuggcauuguu

SEQ ID NO: 584295 - RNA, 22 nt, Human
agcacagggcccagccuaggcc

SEQ ID NO: 584296 - RNA, 22 nt, Human
aaaauuuugcccuauccuucau

SEQ ID NO: 584297 - RNA, 22 nt, Human
ucagcuccucagagccucaguu

SEQ ID NO: 584298 - RNA, 22 nt, Human
ugaggcucauucugcaugccaa

SEQ ID NO: 584299 - RNA, 22 nt, Human
gugcaaaaguacuugcggauuu

SEQ ID NO: 584300 - RNA, 22 nt, Human
cagcuuuggcccagucgggagg

SEQ ID NO: 584301 - RNA, 22 nt, Human
cuagagaaucuuuuaagaagug

SEQ ID NO: 584302 - RNA, 22 nt, Human
agauggguaacuggagucugcu

SEQ ID NO: 584303 - RNA, 22 nt, Human
uguaaacaguaggacuaaagag

SEQ ID NO: 584304 - RNA, 22 nt, Human
uaaaucucagggaauauauuga

SEQ ID NO: 584305 - RNA, 22 nt, Human
gggagcugagggaccucugugg

SEQ ID NO: 584306 - RNA, 22 nt, Human
gggggccuuauucaucugccag

SEQ ID NO: 584307 - RNA, 22 nt, Human
ccuccugguccagcaucucuuu

SEQ ID NO: 584308 - RNA, 22 nt, Human
uuucaaaagcguacguagugaa

SEQ ID NO: 584309 - RNA, 22 nt, Human
agagcuguuaauuuugcacugg

SEQ ID NO: 584310 - RNA, 22 nt, Human
cuuccaagaugaacagcaagcg

SEQ ID NO: 584311 - RNA, 22 nt, Human
guucacagaaauuguguaccuc

SEQ ID NO: 584312 - RNA, 22 nt, Human
ucucaaauggacaauauugugg

SEQ ID NO: 584313 - RNA, 22 nt, Human
aggaaagauggaaggaggauaa

SEQ ID NO: 584314 - RNA, 22 nt, Human
gccuggaggggacagucucugg

SEQ ID NO: 584315 - RNA, 23 nt, Human
ggccuccuggucuaggcuagacu

SEQ ID NO: 584316 - RNA, 20 nt, Human
gagcugaguguggucauggg

SEQ ID NO: 584317 - RNA, 23 nt, Human
agggccaggugcggaaacagcuc

SEQ ID NO: 584318 - RNA, 22 nt, Human
auaagcucuggacagccacauu

SEQ ID NO: 584319 - RNA, 22 nt, Human
augcaaaaguaacugugauuuu

SEQ ID NO: 584320 - RNA, 22 nt, Human
aggaauuugggguuacaugaug

SEQ ID NO: 584321 - RNA, 22 nt, Human
caggcaagauuagagaugagca

SEQ ID NO: 584322 - RNA, 22 nt, Human
guguggcugauugacaugguca

SEQ ID NO: 584323 - RNA, 22 nt, Human
ggcuggcuggcuuagcagagga

SEQ ID NO: 584324 - RNA, 22 nt, Human
ugcugaggaaagaggauaaaag

SEQ ID NO: 584325 - RNA, 22 nt, Human
acaaaagugagugugucucaga

SEQ ID NO: 584326 - RNA, 22 nt, Human
ccugcucugccaaguccucuuu

SEQ ID NO: 584327 - RNA, 22 nt, Human
agaaaacugcagaguagccuca

SEQ ID NO: 584328 - RNA, 22 nt, Human
uggaacacacuucaaggagaaa

SEQ ID NO: 584329 - RNA, 22 nt, Human
uaaaugcuuucuaugaaagagg

SEQ ID NO: 584330 - RNA, 22 nt, Human
ugcaacauuauuaaacuaagca

SEQ ID NO: 584331 - RNA, 22 nt, Human
augcauauugucauuuaguccu

SEQ ID NO: 584332 - RNA, 22 nt, Human
uggcuccagaagggagggcgcc

SEQ ID NO: 584333 - RNA, 22 nt, Human
uuacauggauguaaaaaaguua

SEQ ID NO: 584334 - RNA, 22 nt, Human
gccagcuggagugagagugggc

SEQ ID NO: 584335 - RNA, 22 nt, Human
cuuauacugaaaaauuauuugu

SEQ ID NO: 584336 - RNA, 22 nt, Human
gccuggggaacuugauccuguc

SEQ ID NO: 584337 - RNA, 22 nt, Human
ugcugggcuucaacugccugag

SEQ ID NO: 584338 - RNA, 22 nt, Human
aaguggagcuauaggcucagau

SEQ ID NO: 584339 - RNA, 22 nt, Human
ucaaggcauacauuuagaagag

SEQ ID NO: 584340 - RNA, 22 nt, Human
gcaggaugggagcuucacucug

SEQ ID NO: 584341 - RNA, 21 nt, Human
agaagccaugugguggagaac

SEQ ID NO: 584342 - RNA, 20 nt, Human
caggcagaggaugcugacca

SEQ ID NO: 584343 - RNA, 22 nt, Human
cccugagccgcugcuccaaccu

SEQ ID NO: 584344 - RNA, 22 nt, Human
ugcuggagcggaggugagccag

SEQ ID NO: 584345 - RNA, 19 nt, Human
ggccuugaugaguggggag

SEQ ID NO: 584346 - RNA, 22 nt, Human
agcugguucauucauucauggu

SEQ ID NO: 584347 - RNA, 22 nt, Human
caguugaaaagauuuuauucug

SEQ ID NO: 584348 - RNA, 22 nt, Human
ugaacagucaaaaagugaccau

SEQ ID NO: 584349 - RNA, 22 nt, Human
cuggaccagaaaggacauggcu

SEQ ID NO: 584350 - RNA, 22 nt, Human
aggagguguagauuuccuguca

SEQ ID NO: 584351 - RNA, 22 nt, Human
uugauacaugcucuagaguuga

SEQ ID NO: 584352 - RNA, 22 nt, Human
uuucauaugggcauuggcaaua

SEQ ID NO: 584353 - RNA, 21 nt, Human
ugaggccugccagucucagaa

SEQ ID NO: 584354 - RNA, 22 nt, Human
acauuucagauucaugaaguga

SEQ ID NO: 584355 - RNA, 22 nt, Human
agaaacaucauuguuugguauu

SEQ ID NO: 584356 - RNA, 22 nt, Human
aucuuucagggccauuuguauu

SEQ ID NO: 584357 - RNA, 22 nt, Human
cugcuuuaaguauucaacaaag

SEQ ID NO: 584358 - RNA, 22 nt, Human
cuacauucugggaaaucagaug

SEQ ID NO: 584359 - RNA, 22 nt, Human
ggacacagcugcagccacaccc

SEQ ID NO: 584360 - RNA, 22 nt, Human
uagcccagagagccaggggcuu

SEQ ID NO: 584361 - RNA, 22 nt, Human
gacaauaaagugauacauggga

SEQ ID NO: 584362 - RNA, 22 nt, Human
uccugaagcaguuagcaugagc

SEQ ID NO: 584363 - RNA, 22 nt, Human
acaucccuugcucggggccccu

SEQ ID NO: 584364 - RNA, 22 nt, Human
cagucccaccaggaucgcucuu

SEQ ID NO: 584365 - RNA, 22 nt, Human
gaggcagagaccuucaggaccu

SEQ ID NO: 584366 - RNA, 22 nt, Human
ccugccuggcccaccuugccac

SEQ ID NO: 584367 - RNA, 22 nt, Human
ugguaagggguggaaccagagc

SEQ ID NO: 584368 - RNA, 22 nt, Human
uagaaacccauguuuauucagu

SEQ ID NO: 584369 - RNA, 22 nt, Human
aaauacauaaagguuguaccag

SEQ ID NO: 584370 - RNA, 22 nt, Human
aauaucuggagaugcuuuuugu

SEQ ID NO: 584371 - RNA, 22 nt, Human
acagagcacauagauuggaguu

SEQ ID NO: 584372 - RNA, 22 nt, Human
aguaaaauuguauuggaaaaca

SEQ ID NO: 584373 - RNA, 22 nt, Human
cuguccuguagcuccaucaguc

SEQ ID NO: 584374 - RNA, 22 nt, Human
caggggcuguuugccucaggcc

SEQ ID NO: 584375 - RNA, 22 nt, Human
cagagcagggugcaccuugggc

SEQ ID NO: 584376 - RNA, 22 nt, Human
ucucaggacuuugggaagcuca

SEQ ID NO: 584377 - RNA, 22 nt, Human
cugccucugguuuuggucccug

SEQ ID NO: 584378 - RNA, 22 nt, Human
ugguccuggagaguguuccaua

SEQ ID NO: 584379 - RNA, 22 nt, Human
caggaggacauacuggcucaca

SEQ ID NO: 584380 - RNA, 22 nt, Human
ccaggucuucacuuuacugaag

SEQ ID NO: 584381 - RNA, 22 nt, Human
guuuggcaucucacuuaaaccg

SEQ ID NO: 584382 - RNA, 22 nt, Human
gaggugggguuuuguucuugaa

SEQ ID NO: 584383 - RNA, 22 nt, Human
aauagcauaagaugucaaauag

SEQ ID NO: 584384 - RNA, 22 nt, Human
acaguguuauuucugaguaaug

SEQ ID NO: 584385 - RNA, 19 nt, Human
caucucugcaaggagcugc

SEQ ID NO: 584386 - RNA, 22 nt, Human
gggcagcucuggcugugggaag

SEQ ID NO: 584387 - RNA, 22 nt, Human
gagcaucuuguucccaacuucu

SEQ ID NO: 584388 - RNA, 22 nt, Human
caggugaccuauggucacuaca

SEQ ID NO: 584389 - RNA, 22 nt, Human
ccagggcaauaggaacacuuuu

SEQ ID NO: 584390 - RNA, 20 nt, Human
ugaggcucagagagguugag

SEQ ID NO: 584391 - RNA, 22 nt, Human
ucagcugccccaguggccccag

SEQ ID NO: 584392 - RNA, 22 nt, Human
gagaugcugccugauuuauuca

SEQ ID NO: 584393 - RNA, 22 nt, Human
agcagccaagguaaccugugcu

SEQ ID NO: 584394 - RNA, 22 nt, Human
ugcagucccuggcccacuuuaa

SEQ ID NO: 584395 - RNA, 18 nt, Human
gccagcccuccaaccucc

SEQ ID NO: 584396 - RNA, 22 nt, Human
ucagaggaauuugcuuuucaug

SEQ ID NO: 584397 - RNA, 22 nt, Human
gcauucuucgaaguaaguagug

SEQ ID NO: 584398 - RNA, 22 nt, Human
uuucuaguauauaacuagaucu

SEQ ID NO: 584399 - RNA, 22 nt, Human
acuacagugugauaagaggggc

SEQ ID NO: 584400 - RNA, 22 nt, Human
ggggccccucggacacgugcgg

SEQ ID NO: 584401 - RNA, 19 nt, Human
gcaggguggcagagcucuu

SEQ ID NO: 584402 - RNA, 18 nt, Human
gguggcaggucagaugcc

SEQ ID NO: 584403 - RNA, 22 nt, Human
cugcaccgugucucgggcugcc

SEQ ID NO: 584404 - RNA, 22 nt, Human
agagccuggcucccagcuaccg

SEQ ID NO: 584405 - RNA, 22 nt, Human
ugcagaagaauguaggcauaag

SEQ ID NO: 584406 - RNA, 22 nt, Human
auaaauuaggaucugggguucc

SEQ ID NO: 584407 - RNA, 18 nt, Human
cuccuuucccuacaccuc

SEQ ID NO: 584408 - RNA, 22 nt, Human
gcuccccagcuuagcccuggcu

SEQ ID NO: 584409 - RNA, 22 nt, Human
ccugggcuuugcuggcaaggcc

SEQ ID NO: 584410 - RNA, 19 nt, Human
agucuuugccuggggccuu

SEQ ID NO: 584411 - RNA, 21 nt, Human
uccuuauauuugaauacuuua

SEQ ID NO: 584412 - RNA, 22 nt, Human
ggugaagggccuuaggagacag

SEQ ID NO: 584413 - RNA, 22 nt, Human
uuugacaugugcuuauaacuuu

SEQ ID NO: 584414 - RNA, 22 nt, Human
uagaacacagaaauguguggcc

SEQ ID NO: 584415 - RNA, 22 nt, Human
acaauggcaugcuagcaaaugg

SEQ ID NO: 584416 - RNA, 23 nt, Human
acuuccaguuauaggaacucuuc

SEQ ID NO: 584417 - RNA, 22 nt, Human
aagaggaggauugaugugggag

SEQ ID NO: 584418 - RNA, 22 nt, Human
agcaggggucucugcuaaugaa

SEQ ID NO: 584419 - RNA, 22 nt, Human
ucucagggccccaaaggcuagu

SEQ ID NO: 584420 - RNA, 22 nt, Human
augaugucuggaggcaugcugu

SEQ ID NO: 584421 - RNA, 21 nt, Human
aagaggaagcauuauggcaua

SEQ ID NO: 584422 - RNA, 22 nt, Human
uuuagugagugugaaucaaaug

SEQ ID NO: 584423 - RNA, 22 nt, Human
acccagcuaacccuacccugga

SEQ ID NO: 584424 - RNA, 22 nt, Human
ucucucuaggcaucuauuuuca

SEQ ID NO: 584425 - RNA, 22 nt, Human
caucuccaggaguucuacucau

SEQ ID NO: 584426 - RNA, 22 nt, Human
acagugcugaacgacauggaag

SEQ ID NO: 584427 - RNA, 22 nt, Human
ucagcacugucuuuuauuugaa

SEQ ID NO: 584428 - RNA, 23 nt, Human
augugugggaggucagagagcca

SEQ ID NO: 584429 - RNA, 22 nt, Human
acucuugucucaacuuuuguau

SEQ ID NO: 584430 - RNA, 22 nt, Human
ucugucuucuguagcuaauaau

SEQ ID NO: 584431 - RNA, 22 nt, Human
ggcucuggugaggguaggagau

SEQ ID NO: 584432 - RNA, 22 nt, Human
guugcucaggcaggaguacagu

SEQ ID NO: 584433 - RNA, 22 nt, Human
agccacagagagggagcugcaa

SEQ ID NO: 584434 - RNA, 22 nt, Human
cucuuacaagcucccgauauaa

SEQ ID NO: 584435 - RNA, 22 nt, Human
cugcucacgccaccguucauca

SEQ ID NO: 584436 - RNA, 22 nt, Human
agucccagcuacucaagaggcu

SEQ ID NO: 584437 - RNA, 22 nt, Human
aggcauggcauggggcagaugu

SEQ ID NO: 584438 - RNA, 22 nt, Human
cagggagcacugcgagcggcag

SEQ ID NO: 584439 - RNA, 22 nt, Human
caaaaguaauggcgguuuuuac

SEQ ID NO: 584440 - RNA, 22 nt, Human
gcccagaagugacucagcacug

SEQ ID NO: 584441 - RNA, 22 nt, Human
uuggccuuuauucuguacuucu

SEQ ID NO: 584442 - RNA, 19 nt, Human
uuucugcagcccagcagca

SEQ ID NO: 584443 - RNA, 22 nt, Human
ugacagggugauuaugagagcu

SEQ ID NO: 584444 - RNA, 22 nt, Human
uugaagcauuucuuugagcuuc

SEQ ID NO: 584445 - RNA, 21 nt, Human
uggcacugcuuagcagguucc

SEQ ID NO: 584446 - RNA, 22 nt, Human
ugaguuaaaugagaacaugaaa

SEQ ID NO: 584447 - RNA, 22 nt, Human
gggagggaagguaccuguguga

SEQ ID NO: 584448 - RNA, 22 nt, Human
aacacuuuccugccuuucugau

SEQ ID NO: 584449 - RNA, 20 nt, Human
ggcuuagacugaguucucac

SEQ ID NO: 584450 - RNA, 22 nt, Human
ccacaggaggaacaauuagaug

SEQ ID NO: 584451 - RNA, 20 nt, Human
aggcagcuggccaggcaggu

SEQ ID NO: 584452 - RNA, 22 nt, Human
ccacccagcagaggaggcaaga

SEQ ID NO: 584453 - RNA, 22 nt, Human
ucagauagugauaauagcaugu

SEQ ID NO: 584454 - RNA, 22 nt, Human
cugugccacugccccaggccuc

SEQ ID NO: 584455 - RNA, 22 nt, Human
uaauuacaaagcaagcacaggg

SEQ ID NO: 584456 - RNA, 22 nt, Human
uaggugucugcucuuauuuaac

SEQ ID NO: 584457 - RNA, 22 nt, Human
aggagacauacuauaggaauau

SEQ ID NO: 584458 - RNA, 23 nt, Human
uggcucucucagugcugcagagg

SEQ ID NO: 584459 - RNA, 22 nt, Human
ugaggugggugucaggucagag

SEQ ID NO: 584460 - RNA, 20 nt, Human
gaggcucugggcauggcgcc

SEQ ID NO: 584461 - RNA, 22 nt, Human
gaaagggucuuugauuucccuc

SEQ ID NO: 584462 - RNA, 22 nt, Human
aagguuuuuuuccaguaucucu

SEQ ID NO: 584463 - RNA, 22 nt, Human
cugaagucagauggcacaaggu

SEQ ID NO: 584464 - RNA, 23 nt, Human
acugagguacugagguugugaca

SEQ ID NO: 584465 - RNA, 22 nt, Human
ugucccugcuguacuuagagca

SEQ ID NO: 584466 - RNA, 21 nt, Human
cuggaggcagguggugccagg

SEQ ID NO: 584467 - RNA, 22 nt, Human
ucuuuccuaggugauaugcaau

SEQ ID NO: 584468 - RNA, 22 nt, Human
agugggagagaagcaaguagua

SEQ ID NO: 584469 - RNA, 22 nt, Human
uuucucaucuggaaacagugcu

SEQ ID NO: 584470 - RNA, 22 nt, Human
cacgggagacgugaucuuggac

SEQ ID NO: 584471 - RNA, 22 nt, Human
augcacuuaaauaacauaacuu

SEQ ID NO: 584472 - RNA, 20 nt, Human
acacagagugagucugcuug

SEQ ID NO: 584473 - RNA, 22 nt, Human
auggcuggcauccaggugggcu

SEQ ID NO: 584474 - RNA, 21 nt, Human
auuucagagcacacaaguaaa

SEQ ID NO: 584475 - RNA, 22 nt, Human
ucuagggaggcaauagcaaugu

SEQ ID NO: 584476 - RNA, 22 nt, Human
aaguguuucuuggaauguugcg

SEQ ID NO: 584477 - RNA, 22 nt, Human
ugcugcuguauccuuaguguca

SEQ ID NO: 584478 - RNA, 22 nt, Human
uuaaauuaggacucuaguucug

SEQ ID NO: 584479 - RNA, 22 nt, Human
ggaggacacuggcucugccuuc

SEQ ID NO: 584480 - RNA, 22 nt, Human
cuggcucaauaaauauuagcug

SEQ ID NO: 584481 - RNA, 22 nt, Human
uucucagaauugacugggagca

SEQ ID NO: 584482 - RNA, 22 nt, Human
ggcuucuuuuuaguaaauguca

SEQ ID NO: 584483 - RNA, 22 nt, Human
cucugaaagcaaaacuagagaa

SEQ ID NO: 584484 - RNA, 22 nt, Human
ucucugaacuuccuggaaaggc

SEQ ID NO: 584485 - RNA, 22 nt, Human
augguuaaauugguuauuuaug

SEQ ID NO: 584486 - RNA, 22 nt, Human
agucccuguacuuuccacugcc

SEQ ID NO: 584487 - RNA, 22 nt, Human
ucaggcugaaggaggccuaucu

SEQ ID NO: 584488 - RNA, 22 nt, Human
aaaaaucacuuuuauaggcagc

SEQ ID NO: 584489 - RNA, 22 nt, Human
ggcagggcaggaaagucaggaa

SEQ ID NO: 584490 - RNA, 22 nt, Human
uguacacaauucuuaacauaca

SEQ ID NO: 584491 - RNA, 22 nt, Human
gcuucagagauuucacuaguuu

SEQ ID NO: 584492 - RNA, 22 nt, Human
gcugcccugugguccagcaggu

SEQ ID NO: 584493 - RNA, 22 nt, Human
gaaagcaaguugacugcagaau

SEQ ID NO: 584494 - RNA, 22 nt, Human
cagaugcagcaaaaugacaggc

SEQ ID NO: 584495 - RNA, 22 nt, Human
cucugacagguggcauuaucuc

SEQ ID NO: 584496 - RNA, 22 nt, Human
cauggauauauuguacaguagc

SEQ ID NO: 584497 - RNA, 22 nt, Human
uguauuagagcauauaauuuga

SEQ ID NO: 584498 - RNA, 20 nt, Human
aaagucuguuuaucucugga

SEQ ID NO: 584499 - RNA, 22 nt, Human
aguauuuucgccaucacaagaa

SEQ ID NO: 584500 - RNA, 22 nt, Human
ugcuucugggucccagccuggc

SEQ ID NO: 584501 - RNA, 22 nt, Human
gaggacugcagaugggugcauc

SEQ ID NO: 584502 - RNA, 22 nt, Human
augagguccagggaaguuaaau

SEQ ID NO: 584503 - RNA, 22 nt, Human
uuauuucccugaggguugcagg

SEQ ID NO: 584504 - RNA, 22 nt, Human
uaaagguuuauucaacaaaaua

SEQ ID NO: 584505 - RNA, 22 nt, Human
aacaagaacaccuacaguucua

SEQ ID NO: 584506 - RNA, 21 nt, Human
uccaggcuggaaggggcguug

SEQ ID NO: 584507 - RNA, 21 nt, Human
ucaguaaaccuaaagauugua

SEQ ID NO: 584508 - RNA, 22 nt, Human
auacuaagcccaagaacacaug

SEQ ID NO: 584509 - RNA, 22 nt, Human
auacacaugcacacaugugugu

SEQ ID NO: 584510 - RNA, 22 nt, Human
ucuuucugaauauuugaccuca

SEQ ID NO: 584511 - RNA, 22 nt, Human
ggcacagggaggcccuggugug

SEQ ID NO: 584512 - RNA, 22 nt, Human
ggcccaggcuggagugcggugg

SEQ ID NO: 584513 - RNA, 22 nt, Human
uugcagggucccagaggccugg

SEQ ID NO: 584514 - RNA, 22 nt, Human
ggacacuguucauggggagggg

SEQ ID NO: 584515 - RNA, 22 nt, Human
acaggcugcugggcuccgugcu

SEQ ID NO: 584516 - RNA, 22 nt, Human
aggaggugacagccugcaucug

SEQ ID NO: 584517 - RNA, 23 nt, Human
gaggagggucugacaaguguagc

SEQ ID NO: 584518 - RNA, 22 nt, Human
ucccaggaggugcuuccuagga

SEQ ID NO: 584519 - RNA, 20 nt, Human
gcugaccccugcugucaugc

SEQ ID NO: 584520 - RNA, 22 nt, Human
auauggaacuauucuguguaga

SEQ ID NO: 584521 - RNA, 22 nt, Human
caggguggcccuguggucucau

SEQ ID NO: 584522 - RNA, 22 nt, Human
uuggaacaaucacauccuugcu

SEQ ID NO: 584523 - RNA, 22 nt, Human
aggcccagggcugcucucugaa

SEQ ID NO: 584524 - RNA, 22 nt, Human
aggcuccugagaggcagaggcu

SEQ ID NO: 584525 - RNA, 23 nt, Human
ccagggcuacgggcaccguccug

SEQ ID NO: 584526 - RNA, 22 nt, Human
gcuguccuggggagggagaaug

SEQ ID NO: 584527 - RNA, 22 nt, Human
agcaagcuaccuagauagucua

SEQ ID NO: 584528 - RNA, 22 nt, Human
gagacagagaucuugcugaguc

SEQ ID NO: 584529 - RNA, 22 nt, Human
cugccaggauucugugaacccc

SEQ ID NO: 584530 - RNA, 22 nt, Human
ugcaugcacguaucugcgugug

SEQ ID NO: 584531 - RNA, 22 nt, Human
caugcucucuggcaacuugugu

SEQ ID NO: 584532 - RNA, 22 nt, Human
aaggggcucuugucaggcgcag

SEQ ID NO: 584533 - RNA, 17 nt, Human
uucauuaauaaaagcaa

SEQ ID NO: 584534 - RNA, 22 nt, Human
aagcaggcuugguguggccgcu

SEQ ID NO: 584535 - RNA, 22 nt, Human
ucuggaguuugagcacuucaau

SEQ ID NO: 584536 - RNA, 20 nt, Human
auuauucauacaugugugac

SEQ ID NO: 584537 - RNA, 22 nt, Human
gggcaauuaaggucccguuucc

SEQ ID NO: 584538 - RNA, 19 nt, Human
gacaggaaggcuaccagua

SEQ ID NO: 584539 - RNA, 22 nt, Human
auggggagagaagggcugagcu

SEQ ID NO: 584540 - RNA, 22 nt, Human
uguuuuugucuccuugucugcu

SEQ ID NO: 584541 - RNA, 22 nt, Human
ggaacauuuccuggcagagagg

SEQ ID NO: 584542 - RNA, 22 nt, Human
uguuucuuuguagauauucuuu

SEQ ID NO: 584543 - RNA, 22 nt, Human
ugggaagggucaacagcuggaa

SEQ ID NO: 584544 - RNA, 22 nt, Human
cagugcugagagccuggccagg

SEQ ID NO: 584545 - RNA, 22 nt, Human
cagccagaaccuaggaugagcu

SEQ ID NO: 584546 - RNA, 22 nt, Human
cuguguccucccgcugcaccca

SEQ ID NO: 584547 - RNA, 22 nt, Human
gggcacaggagaaggaucuggc

SEQ ID NO: 584548 - RNA, 22 nt, Human
gaaaguuucucacacaugcaga

SEQ ID NO: 584549 - RNA, 22 nt, Human
cugagcuaggaguuaggaagcu

SEQ ID NO: 584550 - RNA, 22 nt, Human
ucuucagucaauccagauguuu

SEQ ID NO: 584551 - RNA, 23 nt, Human
ugaggagcauagcugacugacag

SEQ ID NO: 584552 - RNA, 22 nt, Human
gcagaggcuccauuuuacagau

SEQ ID NO: 584553 - RNA, 22 nt, Human
aaugcaccuaccuugauucugc

SEQ ID NO: 584554 - RNA, 22 nt, Human
uaaagagccauuguaugguuuu

SEQ ID NO: 584555 - RNA, 22 nt, Human
aauacagugaaagugagcaagg

SEQ ID NO: 584556 - RNA, 22 nt, Human
ggcugugagcaggcagaaugcu

SEQ ID NO: 584557 - RNA, 22 nt, Human
ugcauauuuuauaaagauggaa

SEQ ID NO: 584558 - RNA, 22 nt, Human
ugaggggcgcuggcagguuccu

SEQ ID NO: 584559 - RNA, 22 nt, Human
cacuuuauaugcauuaccucau

SEQ ID NO: 584560 - RNA, 22 nt, Human
auucuuggcaaggagauuuaaa

SEQ ID NO: 584561 - RNA, 22 nt, Human
agauucaggcaugucuucauuu

SEQ ID NO: 584562 - RNA, 22 nt, Human
ucugcugcuacagacucucuag

SEQ ID NO: 584563 - RNA, 22 nt, Human
ggcucugggaaauggucuuccu

SEQ ID NO: 584564 - RNA, 22 nt, Human
uggucucugcaggccaggcuca

SEQ ID NO: 584565 - RNA, 22 nt, Human
gagcacagcgcaguuuguaauu

SEQ ID NO: 584566 - RNA, 22 nt, Human
cuguggagguaggagcaggaca

SEQ ID NO: 584567 - RNA, 22 nt, Human
caacaauaugccagacucaauu

SEQ ID NO: 584568 - RNA, 22 nt, Human
uaguuacaggaguuucugaaau

SEQ ID NO: 584569 - RNA, 17 nt, Human
cgggcauggagggcagg

SEQ ID NO: 584570 - RNA, 22 nt, Human
ucaggcuguuagccaccuccuc

SEQ ID NO: 584571 - RNA, 22 nt, Human
auuauugucaucuuaaucuuaa

SEQ ID NO: 584572 - RNA, 22 nt, Human
gacugagaaucauagaaggcaa

SEQ ID NO: 584573 - RNA, 22 nt, Human
aggguauaaagagcaagcagaa

SEQ ID NO: 584574 - RNA, 22 nt, Human
cagaggcucagauggcccuggc

SEQ ID NO: 584575 - RNA, 22 nt, Human
aaggcagaaauucaacuacugg

SEQ ID NO: 584576 - RNA, 22 nt, Human
cccagcagggucucugugucua

SEQ ID NO: 584577 - RNA, 22 nt, Human
cgcagagggcaggcagugcugg

SEQ ID NO: 584578 - RNA, 22 nt, Human
agauacauauagaaaacaucaa

SEQ ID NO: 584579 - RNA, 22 nt, Human
ucacagagaacuauaauccauc

SEQ ID NO: 584580 - RNA, 22 nt, Human
gugcccuccguguucauagagc

SEQ ID NO: 584581 - RNA, 22 nt, Human
ucugugcugccauccuguggcc

SEQ ID NO: 584582 - RNA, 22 nt, Human
uugaagacaagggcagggguuc

SEQ ID NO: 584583 - RNA, 23 nt, Human
ugauuuuaaaaaguaaguuauca

SEQ ID NO: 584584 - RNA, 22 nt, Human
ugagcagaaguuauaaauaaga

SEQ ID NO: 584585 - RNA, 21 nt, Human
gcugggcuccagucugccgcu

SEQ ID NO: 584586 - RNA, 22 nt, Human
caaggccuccugggcccagaga

SEQ ID NO: 584587 - RNA, 22 nt, Human
uuccugagucgccgagucuaug

SEQ ID NO: 584588 - RNA, 22 nt, Human
ccagggcaauuauuuggagggu

SEQ ID NO: 584589 - RNA, 22 nt, Human
ccccaggagcuuguuuuagaga

SEQ ID NO: 584590 - RNA, 22 nt, Human
aggcuggucuauacggagacga

SEQ ID NO: 584591 - RNA, 22 nt, Human
uuuuccucuguaugcgugagau

SEQ ID NO: 584592 - RNA, 22 nt, Human
acagauauaaacuauaguagug

SEQ ID NO: 584593 - RNA, 20 nt, Human
cuuaaacacagagauagauu

SEQ ID NO: 584594 - RNA, 22 nt, Human
cuuguauucagcaucuuaacua

SEQ ID NO: 584595 - RNA, 22 nt, Human
aagccagguguuuaggccagcg

SEQ ID NO: 584596 - RNA, 22 nt, Human
cagggaugucucuggaagggag

SEQ ID NO: 584597 - RNA, 22 nt, Human
aaagaggcagguguuacuggaa

SEQ ID NO: 584598 - RNA, 22 nt, Human
aaugccauuccaucacacaccu

SEQ ID NO: 584599 - RNA, 20 nt, Human
cuccagggaacagacuggag

SEQ ID NO: 584600 - RNA, 19 nt, Human
uggcuucuucgguguuccc

SEQ ID NO: 584601 - RNA, 22 nt, Human
ccauggccgccgcugcucagga

SEQ ID NO: 584602 - RNA, 22 nt, Human
cccuccagggagccaugcuggg

SEQ ID NO: 584603 - RNA, 22 nt, Human
ucuuuauuuuaugcuugugcaa

SEQ ID NO: 584604 - RNA, 22 nt, Human
agaugguaaucacauuuaucug

SEQ ID NO: 584605 - RNA, 22 nt, Human
cugagaggcggagguugcagug

SEQ ID NO: 584606 - RNA, 22 nt, Human
uggcugcagugcuugagauguc

SEQ ID NO: 584607 - RNA, 22 nt, Human
gcagggcauagaggcacggagg

SEQ ID NO: 584608 - RNA, 22 nt, Human
uggacaggcuccuagggguucc

SEQ ID NO: 584609 - RNA, 22 nt, Human
gccaguggugagauucccuggg

SEQ ID NO: 584610 - RNA, 22 nt, Human
auaaaguagcuuucagugccaa

SEQ ID NO: 584611 - RNA, 19 nt, Human
acaguucuaauuucugugg

SEQ ID NO: 584612 - RNA, 22 nt, Human
gaggcugguucugaaguacugu

SEQ ID NO: 584613 - RNA, 22 nt, Human
ugcccaggauugugaggucagg

SEQ ID NO: 584614 - RNA, 22 nt, Human
aaaguucuauuggauagugcug

SEQ ID NO: 584615 - RNA, 22 nt, Human
cauaaaagccaccuauuuaaag

SEQ ID NO: 584616 - RNA, 22 nt, Human
agaaaauuagauuuuacugugu

SEQ ID NO: 584617 - RNA, 22 nt, Human
gugcccaguugaggccaggacu

SEQ ID NO: 584618 - RNA, 22 nt, Human
uaccauuguaccaagguaauuu

SEQ ID NO: 584619 - RNA, 22 nt, Human
cagucacauugcccugcauuua

SEQ ID NO: 584620 - RNA, 22 nt, Human
augggggcggcugaagcccagg

SEQ ID NO: 584621 - RNA, 22 nt, Human
aaacucuuuccacgauuacuuu

SEQ ID NO: 584622 - RNA, 22 nt, Human
auaaagaccaguaucuuauguu

SEQ ID NO: 584623 - RNA, 22 nt, Human
cuuauuucagcccugggcaccc

SEQ ID NO: 584624 - RNA, 22 nt, Human
agaauaaaauagucugaagaug

SEQ ID NO: 584625 - RNA, 22 nt, Human
ugucaggaggguccagagaaaa

SEQ ID NO: 584626 - RNA, 23 nt, Human
ggaaagagaggaguugugcauag

SEQ ID NO: 584627 - RNA, 22 nt, Human
aauuaaaagauaacccaugagu

SEQ ID NO: 584628 - RNA, 22 nt, Human
ugguggagcuguggccacgacc

SEQ ID NO: 584629 - RNA, 22 nt, Human
auggcugagaugggcuccaggc

SEQ ID NO: 584630 - RNA, 22 nt, Human
cccaagccuuucaaaacucaga

SEQ ID NO: 584631 - RNA, 22 nt, Human
uauaaagaaguguaaacaggaa

SEQ ID NO: 584632 - RNA, 22 nt, Human
agugcuucuggugggcgugagg

SEQ ID NO: 584633 - RNA, 22 nt, Human
auucuguaauugaacuguguug

SEQ ID NO: 584634 - RNA, 22 nt, Human
ucuucuccaguucauccuacca

SEQ ID NO: 584635 - RNA, 22 nt, Human
caaucuauccucugauuuugua

SEQ ID NO: 584636 - RNA, 16 nt, Human
gcagguggggcgcgca

SEQ ID NO: 584637 - RNA, 22 nt, Human
acugcaugcuuuacaugacaug

SEQ ID NO: 584638 - RNA, 22 nt, Human
aaggacagagagccauuccaga

SEQ ID NO: 584639 - RNA, 22 nt, Human
cuucugggcauggcagagccug

SEQ ID NO: 584640 - RNA, 22 nt, Human
ccagagggagccaccagggugu

SEQ ID NO: 584641 - RNA, 22 nt, Human
aacacugguucugacuacacag

SEQ ID NO: 584642 - RNA, 16 nt, Human
gccuggaguggcaggg

SEQ ID NO: 584643 - RNA, 22 nt, Human
agaauucuguucuucgggugug

SEQ ID NO: 584644 - RNA, 22 nt, Human
augcaguuuuaggggaaggguu

SEQ ID NO: 584645 - RNA, 22 nt, Human
accugcccggggacauuccuuu

SEQ ID NO: 584646 - RNA, 22 nt, Human
uggccugguaccacauagauuu

SEQ ID NO: 584647 - RNA, 22 nt, Human
aguggcuagaucaugagugagc

SEQ ID NO: 584648 - RNA, 22 nt, Human
acagauccugguuacagccauu

SEQ ID NO: 584649 - RNA, 22 nt, Human
uuacaggugggaaaacuaagcu

SEQ ID NO: 584650 - RNA, 22 nt, Human
aaaugcaguuuccugagaccca

SEQ ID NO: 584651 - RNA, 22 nt, Human
aagggagaaaacuuguggcuua

SEQ ID NO: 584652 - RNA, 22 nt, Human
cugcacaguggguggggcguca

SEQ ID NO: 584653 - RNA, 22 nt, Human
ucuguuucuccaacauugugag

SEQ ID NO: 584654 - RNA, 22 nt, Human
ccaggguggaggcuggauggag

SEQ ID NO: 584655 - RNA, 22 nt, Human
ugccugggguuggcaaacugcu

SEQ ID NO: 584656 - RNA, 22 nt, Human
cucucuuucugaaugaggacua

SEQ ID NO: 584657 - RNA, 21 nt, Human
ugggauagaaauauggcugcu

SEQ ID NO: 584658 - RNA, 22 nt, Human
aagaaaccaacccugccagcac

SEQ ID NO: 584659 - RNA, 22 nt, Human
auugucauuccagucauuguua

SEQ ID NO: 584660 - RNA, 22 nt, Human
ugaaggcuugacugaggcagga

SEQ ID NO: 584661 - RNA, 22 nt, Human
ugugccuguugguguagacaua

SEQ ID NO: 584662 - RNA, 22 nt, Human
gggguaggcaggugaucugauc

SEQ ID NO: 584663 - RNA, 22 nt, Human
uccucacagcugguucauucag

SEQ ID NO: 584664 - RNA, 22 nt, Human
accuuugacgcuauuuaauuug

SEQ ID NO: 584665 - RNA, 22 nt, Human
aaacugaggaacaaggaaggau

SEQ ID NO: 584666 - RNA, 22 nt, Human
acagaggaagcauauagcacaa

SEQ ID NO: 584667 - RNA, 22 nt, Human
aagagagagugcgcucacagaa

SEQ ID NO: 584668 - RNA, 22 nt, Human
auugguuacucaauuugacuga

SEQ ID NO: 584669 - RNA, 22 nt, Human
auugaaaguccuaucuaaggga

SEQ ID NO: 584670 - RNA, 22 nt, Human
ugcugaaugcugcaugccguau

SEQ ID NO: 584671 - RNA, 18 nt, Human
guuagcuuccuguugccc

SEQ ID NO: 584672 - RNA, 22 nt, Human
cuucuggcaaaacaggcagaaa

SEQ ID NO: 584673 - RNA, 19 nt, Human
cagaccuguccagccugug

SEQ ID NO: 584674 - RNA, 19 nt, Human
ucaaaacacaaaugguuga

SEQ ID NO: 584675 - RNA, 22 nt, Human
ccaaagugcugggguuacaggc

SEQ ID NO: 584676 - RNA, 22 nt, Human
caguagcaggauuugggauuau

SEQ ID NO: 584677 - RNA, 22 nt, Human
gaaguuaucaggauuaaaguug

SEQ ID NO: 584678 - RNA, 21 nt, Human
cacaggugggucagugaggcc

SEQ ID NO: 584679 - RNA, 22 nt, Human
acacacuguaaggacuaucacu

SEQ ID NO: 584680 - RNA, 22 nt, Human
accugccuauggagccacaugg

SEQ ID NO: 584681 - RNA, 22 nt, Human
ggugggcacauucagucucugu

SEQ ID NO: 584682 - RNA, 17 nt, Human
aacaauaggauguguau

SEQ ID NO: 584683 - RNA, 22 nt, Human
cuaggcagggugcugugccaug

SEQ ID NO: 584684 - RNA, 22 nt, Human
guuaauaaagguauagaaucag

SEQ ID NO: 584685 - RNA, 22 nt, Human
guggcaggaucacggcucacug

SEQ ID NO: 584686 - RNA, 22 nt, Human
agcaccaggccauggggucccu

SEQ ID NO: 584687 - RNA, 22 nt, Human
aggccucugggucuccucugac

SEQ ID NO: 584688 - RNA, 22 nt, Human
ucugagccaccugccagugcug

SEQ ID NO: 584689 - RNA, 23 nt, Human
ccuucuguuaaccaucugggggg

SEQ ID NO: 584690 - RNA, 22 nt, Human
ugaagcagcaaaugaugggaga

SEQ ID NO: 584691 - RNA, 22 nt, Human
ggagaggguagggguccugccc

SEQ ID NO: 584692 - RNA, 19 nt, Human
uaccaaucccuugguuuac

SEQ ID NO: 584693 - RNA, 22 nt, Human
ggagcagagcugggcuuggcug

SEQ ID NO: 584694 - RNA, 22 nt, Human
agggccugggaagaggaacccu

SEQ ID NO: 584695 - RNA, 22 nt, Human
aguuuccacuggagacacugug

SEQ ID NO: 584696 - RNA, 22 nt, Human
ccauggaucuggaucuaucuuu

SEQ ID NO: 584697 - RNA, 22 nt, Human
cccagcuguggcagaggccggg

SEQ ID NO: 584698 - RNA, 16 nt, Human
gggggugagagagagu

SEQ ID NO: 584699 - RNA, 22 nt, Human
uggucaggggcuucugagcugu

SEQ ID NO: 584700 - RNA, 22 nt, Human
uaugucuucgucaccuaucuca

SEQ ID NO: 584701 - RNA, 22 nt, Human
aguacaaagugcuccugguucu

SEQ ID NO: 584702 - RNA, 22 nt, Human
uuuucuuacugucugugauccu

SEQ ID NO: 584703 - RNA, 20 nt, Human
gccugagcuccgccuccugu

SEQ ID NO: 584704 - RNA, 22 nt, Human
guugguuagauuuccucacuuu

SEQ ID NO: 584705 - RNA, 22 nt, Human
acucucugagcuaccaggugag

SEQ ID NO: 584706 - RNA, 22 nt, Human
ugaacaugcuguugauggccug

SEQ ID NO: 584707 - RNA, 19 nt, Human
ugcucaggccaaggagccc

SEQ ID NO: 584708 - RNA, 22 nt, Human
agaaucuugggcaaauucaucu

SEQ ID NO: 584709 - RNA, 22 nt, Human
ugcuccagggccuccagugggg

SEQ ID NO: 584710 - RNA, 21 nt, Human
aguggucuuuuucacccagug

SEQ ID NO: 584711 - RNA, 22 nt, Human
ggagcagacauaaccuuacaga

SEQ ID NO: 584712 - RNA, 22 nt, Human
cuggagauaagcagucccaggc

SEQ ID NO: 584713 - RNA, 22 nt, Human
uacugccugggggagacagcug

SEQ ID NO: 584714 - RNA, 19 nt, Human
ugcccugcacgcuguccug

SEQ ID NO: 584715 - RNA, 22 nt, Human
cccuuccugggugucccggagu

SEQ ID NO: 584716 - RNA, 22 nt, Human
ggcugcuggauuguguaucugu

SEQ ID NO: 584717 - RNA, 22 nt, Human
aaagaucagaggauagcugagu

SEQ ID NO: 584718 - RNA, 20 nt, Human
uguguguguacuucuaaaua

SEQ ID NO: 584719 - RNA, 22 nt, Human
auguagaaaguuauuuuacucu

SEQ ID NO: 584720 - RNA, 22 nt, Human
uuuuauucucagcuccagagag

SEQ ID NO: 584721 - RNA, 22 nt, Human
gccaccagccccaugcgcugug

SEQ ID NO: 584722 - RNA, 22 nt, Human
cugcuuuuuguaggucccagag

SEQ ID NO: 584723 - RNA, 22 nt, Human
uuaaaugacuuuuauuauucuc

SEQ ID NO: 584724 - RNA, 22 nt, Human
uaucugcaucugcauguguauu

SEQ ID NO: 584725 - RNA, 22 nt, Human
auugugcaccaccuuguggcag

SEQ ID NO: 584726 - RNA, 22 nt, Human
ucaccaauaauaacuugagaau

SEQ ID NO: 584727 - RNA, 22 nt, Human
gagacacagcagauauucaauc

SEQ ID NO: 584728 - RNA, 18 nt, Human
ucugaaagcaccggugaa

SEQ ID NO: 584729 - RNA, 22 nt, Human
cuggccagccugucgaugcccu

SEQ ID NO: 584730 - RNA, 22 nt, Human
ggguguccugugccaagcuggg

SEQ ID NO: 584731 - RNA, 22 nt, Human
aagcugccugccacgcuagaua

SEQ ID NO: 584732 - RNA, 22 nt, Human
acaaaagaauaagaugagucau

SEQ ID NO: 584733 - RNA, 22 nt, Human
uggaugcuuaaaucguuugaau

SEQ ID NO: 584734 - RNA, 22 nt, Human
cccagagggcugaggauaugaa

SEQ ID NO: 584735 - RNA, 22 nt, Human
augaagcagacucagguggugc

SEQ ID NO: 584736 - RNA, 20 nt, Human
ucugaggcugagcucuacuu

SEQ ID NO: 584737 - RNA, 22 nt, Human
auacauguuguaccauauguuu

SEQ ID NO: 584738 - RNA, 22 nt, Human
uccugggccaagggcugugagg

SEQ ID NO: 584739 - RNA, 21 nt, Human
uaaaagaugacaagacagcuc

SEQ ID NO: 584740 - RNA, 22 nt, Human
ugcuuugugacagauuaguuuu

SEQ ID NO: 584741 - RNA, 22 nt, Human
ugcuucuggaaacaguggcugu

SEQ ID NO: 584742 - RNA, 21 nt, Human
ugucucaaucagaagucauua

SEQ ID NO: 584743 - RNA, 21 nt, Human
cugaggcaugcaggccugggc

SEQ ID NO: 584744 - RNA, 22 nt, Human
gaggccacagucaguguucauc

SEQ ID NO: 584745 - RNA, 22 nt, Human
cagagcuggagaaguggauuua

SEQ ID NO: 584746 - RNA, 22 nt, Human
cugagccaaggggacagugaca

SEQ ID NO: 584747 - RNA, 22 nt, Human
agguuucugcuguccuccuucu

SEQ ID NO: 584748 - RNA, 22 nt, Human
aggcuaagggaugacuggagug

SEQ ID NO: 584749 - RNA, 22 nt, Human
agucucuuaaagacaguguuga

SEQ ID NO: 584750 - RNA, 22 nt, Human
uuauuuuguagcucugaucuuu

SEQ ID NO: 584751 - RNA, 22 nt, Human
agcuguuggcuggcugagcucu

SEQ ID NO: 584752 - RNA, 22 nt, Human
ccugggcuuugagggcaggaug

SEQ ID NO: 584753 - RNA, 20 nt, Human
cguccccuugagcagguccc

SEQ ID NO: 584754 - RNA, 22 nt, Human
aacauuaauuacagucaaacau

SEQ ID NO: 584755 - RNA, 22 nt, Human
uggggaggacgggcgccuuccu

SEQ ID NO: 584756 - RNA, 22 nt, Human
cagccugacaccagcuuugggc

SEQ ID NO: 584757 - RNA, 22 nt, Human
gagguugggaugagggauacag

SEQ ID NO: 584758 - RNA, 22 nt, Human
auuugcuuuaagguauaaaagg

SEQ ID NO: 584759 - RNA, 22 nt, Human
caugauuuacuaaaauuuguuu

SEQ ID NO: 584760 - RNA, 22 nt, Human
ugguauuuaagacuucacuccu

SEQ ID NO: 584761 - RNA, 22 nt, Human
uaagcaaucuguaguuggaauc

SEQ ID NO: 584762 - RNA, 22 nt, Human
cuacugccauugucucugccau

SEQ ID NO: 584763 - RNA, 22 nt, Human
uacuucauuauucuaguuuuga

SEQ ID NO: 584764 - RNA, 22 nt, Human
ugagccaggcucaagugauccu

SEQ ID NO: 584765 - RNA, 22 nt, Human
uuuaaacuguugauuuuaugaa

SEQ ID NO: 584766 - RNA, 22 nt, Human
ugaggccacaguaucagaacag

SEQ ID NO: 584767 - RNA, 22 nt, Human
uagcuuaaaccaaucugaauaa

SEQ ID NO: 584768 - RNA, 22 nt, Human
cugacucuccucaagcauaaau

SEQ ID NO: 584769 - RNA, 22 nt, Human
ugaggagccacucuagcaguca

SEQ ID NO: 584770 - RNA, 22 nt, Human
caggagaccugguaagccaagu

SEQ ID NO: 584771 - RNA, 22 nt, Human
acauauauuacuaguaaagaca

SEQ ID NO: 584772 - RNA, 22 nt, Human
uuauacagcauugcuagugaug

SEQ ID NO: 584773 - RNA, 22 nt, Human
aaguguaagcaaagcucaagcu

SEQ ID NO: 584774 - RNA, 22 nt, Human
gaagauuaaauggcucccauau

SEQ ID NO: 584775 - RNA, 17 nt, Human
aggucugagaguaucug

SEQ ID NO: 584776 - RNA, 22 nt, Human
uucucuggcgcgcugugcuaug

SEQ ID NO: 584777 - RNA, 22 nt, Human
agccuggaguucccaggagaag

SEQ ID NO: 584778 - RNA, 22 nt, Human
uucagaaagguaaauggauuuc

SEQ ID NO: 584779 - RNA, 22 nt, Human
aauuuacacuucauuuggaggg

SEQ ID NO: 584780 - RNA, 22 nt, Human
ucugagaaugguggauguggug

SEQ ID NO: 584781 - RNA, 22 nt, Human
agacgcuauuuugaggggucua

SEQ ID NO: 584782 - RNA, 22 nt, Human
guuuucaugucuauugggcaua

SEQ ID NO: 584783 - RNA, 22 nt, Human
aguuauucauuuauucuguaca

SEQ ID NO: 584784 - RNA, 22 nt, Human
ggcagcuggccuccucgcccac

SEQ ID NO: 584785 - RNA, 22 nt, Human
gugcaguuguggacaugacaac

SEQ ID NO: 584786 - RNA, 21 nt, Human
ugcauggaggaaaguuauaga

SEQ ID NO: 584787 - RNA, 22 nt, Human
ccacaagacucugucagcauaa

SEQ ID NO: 584788 - RNA, 22 nt, Human
uacaaaggaguagagaaggcuu

SEQ ID NO: 584789 - RNA, 22 nt, Human
gggaccagaagaaggaugguga

SEQ ID NO: 584790 - RNA, 22 nt, Human
cuuauuuuaagucaguuugggu

SEQ ID NO: 584791 - RNA, 22 nt, Human
ccaccaugggaagagagacuaa

SEQ ID NO: 584792 - RNA, 22 nt, Human
caagcauacucauuccagacuc

SEQ ID NO: 584793 - RNA, 22 nt, Human
cauuucugugacacuuccaucu

SEQ ID NO: 584794 - RNA, 22 nt, Human
agcaggagcauuuccaugauuc

SEQ ID NO: 584795 - RNA, 22 nt, Human
uagagaauuguagccugcaaga

SEQ ID NO: 584796 - RNA, 22 nt, Human
ccagggcugcucauuggcuggu

SEQ ID NO: 584797 - RNA, 22 nt, Human
acacauauguggcaacuguaga

SEQ ID NO: 584798 - RNA, 22 nt, Human
agugccuugugugugggcagcc

SEQ ID NO: 584799 - RNA, 22 nt, Human
ucaggcuguuccuguccaaaau

SEQ ID NO: 584800 - RNA, 22 nt, Human
gcccacagguccuaccucuuuc

SEQ ID NO: 584801 - RNA, 22 nt, Human
gcugagagaucaaggcaggauu

SEQ ID NO: 584802 - RNA, 22 nt, Human
gcaggcaguugcaguuuucuag

SEQ ID NO: 584803 - RNA, 22 nt, Human
uugacaucaaauagauaucuuu

SEQ ID NO: 584804 - RNA, 22 nt, Human
agagccugcagcugugaagaaa

SEQ ID NO: 584805 - RNA, 18 nt, Human
acagacaaaauggaaaug

SEQ ID NO: 584806 - RNA, 22 nt, Human
guacauuucucuuguucuuauu

SEQ ID NO: 584807 - RNA, 22 nt, Human
gcugccaugguccaggcuccag

SEQ ID NO: 584808 - RNA, 22 nt, Human
aagcugccuugcugaggagaaa

SEQ ID NO: 584809 - RNA, 21 nt, Human
uuccuggggaaggagcugccu

SEQ ID NO: 584810 - RNA, 22 nt, Human
agagauuaagucacuuggucag

SEQ ID NO: 584811 - RNA, 22 nt, Human
uuacacuaugaaugagaauaua

SEQ ID NO: 584812 - RNA, 22 nt, Human
aggggucuuuaggaacgucggg

SEQ ID NO: 584813 - RNA, 22 nt, Human
agagcuggggccagagucaagg

SEQ ID NO: 584814 - RNA, 22 nt, Human
cagcaugguggagcugcucuuu

SEQ ID NO: 584815 - RNA, 22 nt, Human
augcaggggcagcagagccugg

SEQ ID NO: 584816 - RNA, 22 nt, Human
gacaggguccaaaggcagggga

SEQ ID NO: 584817 - RNA, 22 nt, Human
agugucugugcuuugcagcaaa

SEQ ID NO: 584818 - RNA, 22 nt, Human
ucaggcuguggcuuugaccgca

SEQ ID NO: 584819 - RNA, 22 nt, Human
agugugugcaugcauucgugca

SEQ ID NO: 584820 - RNA, 22 nt, Human
uaucacaauuccuauaguuugu

SEQ ID NO: 584821 - RNA, 22 nt, Human
acaguucuccagugccuuugag

SEQ ID NO: 584822 - RNA, 22 nt, Human
gaggcagcugggcuggugguuu

SEQ ID NO: 584823 - RNA, 21 nt, Human
aucagaaaauguaauggagca

SEQ ID NO: 584824 - RNA, 22 nt, Human
auuccacuuagugacucauuug

SEQ ID NO: 584825 - RNA, 22 nt, Human
uuacaucauggaggguauugaa

SEQ ID NO: 584826 - RNA, 22 nt, Human
uuuaugcacacuuagacauggc

SEQ ID NO: 584827 - RNA, 22 nt, Human
cuucuugucagugauuucuucc

SEQ ID NO: 584828 - RNA, 22 nt, Human
uuagcaggaagaguuggcugga

SEQ ID NO: 584829 - RNA, 22 nt, Human
uucucaguauuacaugcuaaug

SEQ ID NO: 584830 - RNA, 20 nt, Human
caaauggcuuuuauuuccuu

SEQ ID NO: 584831 - RNA, 22 nt, Human
cagggaugggauggagucaguu

SEQ ID NO: 584832 - RNA, 22 nt, Human
cugccaggcagcagagggagaa

SEQ ID NO: 584833 - RNA, 22 nt, Human
cugggcucugcaguugauguuu

SEQ ID NO: 584834 - RNA, 23 nt, Human
ugcaagaguuccaaacuguucaa

SEQ ID NO: 584835 - RNA, 22 nt, Human
aaacaguacucgauuuuuguag

SEQ ID NO: 584836 - RNA, 22 nt, Human
ucuguuuucucuguauuuugac

SEQ ID NO: 584837 - RNA, 22 nt, Human
gggugggaugccgcugucucca

SEQ ID NO: 584838 - RNA, 22 nt, Human
gagcaggcuugcagagaagggg

SEQ ID NO: 584839 - RNA, 22 nt, Human
gacauuuagaagucuaauggcc

SEQ ID NO: 584840 - RNA, 22 nt, Human
agccuggagaggcgccauacac

SEQ ID NO: 584841 - RNA, 22 nt, Human
ccuggccuccuggccuucucau

SEQ ID NO: 584842 - RNA, 20 nt, Human
acugagguuagauaacaggu

SEQ ID NO: 584843 - RNA, 22 nt, Human
ccugucuggccuuccacggggg

SEQ ID NO: 584844 - RNA, 21 nt, Human
gccugcaguuuugaagcccuu

SEQ ID NO: 584845 - RNA, 22 nt, Human
acugcagagguggggugcagag

SEQ ID NO: 584846 - RNA, 22 nt, Human
gcugucucauacaaggcccugc

SEQ ID NO: 584847 - RNA, 22 nt, Human
cuuagaauuuuaauccagaaag

SEQ ID NO: 584848 - RNA, 22 nt, Human
gucuggggguccgggugccugc

SEQ ID NO: 584849 - RNA, 22 nt, Human
guuacaaaggacugggggccac

SEQ ID NO: 584850 - RNA, 22 nt, Human
agcucagaacugcagacaugug

SEQ ID NO: 584851 - RNA, 22 nt, Human
auguuacagaaagcaaagauga

SEQ ID NO: 584852 - RNA, 18 nt, Human
ucaagacaucaugaaaua

SEQ ID NO: 584853 - RNA, 19 nt, Human
acccugagaggugguccgg

SEQ ID NO: 584854 - RNA, 22 nt, Human
cacaggccugggguugagcggg

SEQ ID NO: 584855 - RNA, 22 nt, Human
ugcugcuguaucaugccuucau

SEQ ID NO: 584856 - RNA, 22 nt, Human
aauuaccaggauuuuucaguau

SEQ ID NO: 584857 - RNA, 22 nt, Human
aggaaaggccucagcagaaacc

SEQ ID NO: 584858 - RNA, 22 nt, Human
ccaggccagcaggcacaccugc

SEQ ID NO: 584859 - RNA, 22 nt, Human
gcaggggcuaaggacacagaga

SEQ ID NO: 584860 - RNA, 22 nt, Human
agccauuuggacuucugguagg

SEQ ID NO: 584861 - RNA, 23 nt, Human
gcugagguccugcugaguggugg

SEQ ID NO: 584862 - RNA, 22 nt, Human
gaauaucccgcuaugcaaagua

SEQ ID NO: 584863 - RNA, 22 nt, Human
agaaaggagcaccgugggggau

SEQ ID NO: 584864 - RNA, 22 nt, Human
cagacagacagccguggccacc

SEQ ID NO: 584865 - RNA, 22 nt, Human
cccaggcugaugggaugggcca

SEQ ID NO: 584866 - RNA, 22 nt, Human
cagugauggauauggagaaguc

SEQ ID NO: 584867 - RNA, 20 nt, Human
uguagccagccucucaaugc

SEQ ID NO: 584868 - RNA, 22 nt, Human
cucccuggcuuuguccugaggc

SEQ ID NO: 584869 - RNA, 22 nt, Human
ggccucaggguugggcccauua

SEQ ID NO: 584870 - RNA, 22 nt, Human
guuuuuaucuaauagcaguuau

SEQ ID NO: 584871 - RNA, 22 nt, Human
cugggccaucagaggggcugga

SEQ ID NO: 584872 - RNA, 22 nt, Human
gaacaggcauaagcauuugcau

SEQ ID NO: 584873 - RNA, 22 nt, Human
gugccugggguugagcuaugaa

SEQ ID NO: 584874 - RNA, 22 nt, Human
ucagaagcauguggggagccug

SEQ ID NO: 584875 - RNA, 22 nt, Human
agcagggcucuguggagggugg

SEQ ID NO: 584876 - RNA, 22 nt, Human
uggggaaacuauuuccuugucc

SEQ ID NO: 584877 - RNA, 22 nt, Human
aaauuauucaaaaagcuguguu

SEQ ID NO: 584878 - RNA, 22 nt, Human
ugggaagaggcgggaggcuguu

SEQ ID NO: 584879 - RNA, 22 nt, Human
acacggcacuuuaggaaggggc

SEQ ID NO: 584880 - RNA, 22 nt, Human
auuuauugagccuuuccuaugu

SEQ ID NO: 584881 - RNA, 21 nt, Human
acauuuucuguuuuaggaagu

SEQ ID NO: 584882 - RNA, 22 nt, Human
ugagggcaaaguggugcugagg

SEQ ID NO: 584883 - RNA, 22 nt, Human
ugcagcaagcaaguaugguucu

SEQ ID NO: 584884 - RNA, 22 nt, Human
cccaaccagaaauugacagaga

SEQ ID NO: 584885 - RNA, 22 nt, Human
uuuagcauccaagguuaugacu

SEQ ID NO: 584886 - RNA, 22 nt, Human
uuugcucuugcuggaaaaguug

SEQ ID NO: 584887 - RNA, 22 nt, Human
agcucccugagaugccacagca

SEQ ID NO: 584888 - RNA, 22 nt, Human
gagggugggccagauaugaggg

SEQ ID NO: 584889 - RNA, 22 nt, Human
ucucucuugaaguauuagcuag

SEQ ID NO: 584890 - RNA, 22 nt, Human
uacaguauguucuugaauuugg

SEQ ID NO: 584891 - RNA, 22 nt, Human
uggggcuggcacagucucuauu

SEQ ID NO: 584892 - RNA, 22 nt, Human
gaaauagaagcugccaauuucu

SEQ ID NO: 584893 - RNA, 22 nt, Human
acauuguugccuagccaugagu

SEQ ID NO: 584894 - RNA, 22 nt, Human
cuggcaccaggcaugcugggag

SEQ ID NO: 584895 - RNA, 22 nt, Human
agcucuuaucucuaagcacagc

SEQ ID NO: 584896 - RNA, 22 nt, Human
auauggcagaccaauuagaagc

SEQ ID NO: 584897 - RNA, 22 nt, Human
cccagagaaucuuucagaaagg

SEQ ID NO: 584898 - RNA, 22 nt, Human
ccagggugugggcgucggcacg

SEQ ID NO: 584899 - RNA, 22 nt, Human
cuggagucacucauguagcugc

SEQ ID NO: 584900 - RNA, 22 nt, Human
cugcagccucaaccuccugagc

SEQ ID NO: 584901 - RNA, 22 nt, Human
caagcugguaucagcuagagcg

SEQ ID NO: 584902 - RNA, 22 nt, Human
ggaggccaaggagggcggauca

SEQ ID NO: 584903 - RNA, 22 nt, Human
uggcccugacacgugguacugg

SEQ ID NO: 584904 - RNA, 22 nt, Human
cugucaguucuuccagauagag

SEQ ID NO: 584905 - RNA, 22 nt, Human
gcagagucugggcagccuccau

SEQ ID NO: 584906 - RNA, 22 nt, Human
auuuucaucauggguuuaacau

SEQ ID NO: 584907 - RNA, 22 nt, Human
acagccugauuuauggagcagu

SEQ ID NO: 584908 - RNA, 22 nt, Human
uucugcaucugaauuuaaguac

SEQ ID NO: 584909 - RNA, 19 nt, Human
ugugauaguugaaccugcc

SEQ ID NO: 584910 - RNA, 22 nt, Human
gucccucugggccaucaggucc

SEQ ID NO: 584911 - RNA, 22 nt, Human
uacagucuuuggaaagagauag

SEQ ID NO: 584912 - RNA, 22 nt, Human
ucagaggaauaaugcugcauuu

SEQ ID NO: 584913 - RNA, 22 nt, Human
guuuccuuugccaguaaauggg

SEQ ID NO: 584914 - RNA, 21 nt, Human
ugagguagccagugagaugga

SEQ ID NO: 584915 - RNA, 22 nt, Human
acuguaaugguggauccauguc

SEQ ID NO: 584916 - RNA, 22 nt, Human
ucuggcuuggcgcugcccucug

SEQ ID NO: 584917 - RNA, 22 nt, Human
ccaggguuuagcaagccuacaa

SEQ ID NO: 584918 - RNA, 20 nt, Human
uuaagaaaagcacauccugc

SEQ ID NO: 584919 - RNA, 22 nt, Human
aacaguagguguaaccaaacaa

SEQ ID NO: 584920 - RNA, 22 nt, Human
ucugggaacgaaggcuaauaug

SEQ ID NO: 584921 - RNA, 22 nt, Human
ucagaggagccaaaguucugag

SEQ ID NO: 584922 - RNA, 22 nt, Human
ccagugccuaucuccucuggga

SEQ ID NO: 584923 - RNA, 22 nt, Human
cuguauuagccaggugcacaag

SEQ ID NO: 584924 - RNA, 22 nt, Human
ugcauuccuuugucuguuaaag

SEQ ID NO: 584925 - RNA, 22 nt, Human
cagugcccaagaugugccaugc

SEQ ID NO: 584926 - RNA, 22 nt, Human
agucugggaacugggaacguuu

SEQ ID NO: 584927 - RNA, 22 nt, Human
uugaagcagcucaggaggcuua

SEQ ID NO: 584928 - RNA, 22 nt, Human
guggaaauaguuugguuauaga

SEQ ID NO: 584929 - RNA, 22 nt, Human
cagcucuuuauugccaauauuc

SEQ ID NO: 584930 - RNA, 22 nt, Human
gccaugggucugcuggcucagc

SEQ ID NO: 584931 - RNA, 22 nt, Human
ggaugcaggaacacagcgaccu

SEQ ID NO: 584932 - RNA, 18 nt, Human
gaagggagcuggaaugca

SEQ ID NO: 584933 - RNA, 22 nt, Human
ugggccaggggccucuucugau

SEQ ID NO: 584934 - RNA, 22 nt, Human
aggauuuagcaugaaaugugaa

SEQ ID NO: 584935 - RNA, 22 nt, Human
uuggccagagguuucucucaug

SEQ ID NO: 584936 - RNA, 22 nt, Human
cagugagggcauucagugcugg

SEQ ID NO: 584937 - RNA, 23 nt, Human
aucaccagcggaagcugcagacc

SEQ ID NO: 584938 - RNA, 22 nt, Human
gcaugagggggguuaggaaguu

SEQ ID NO: 584939 - RNA, 22 nt, Human
uggagggauacaaagaugaaaa

SEQ ID NO: 584940 - RNA, 22 nt, Human
cuggagcccugaaugggcagga

SEQ ID NO: 584941 - RNA, 22 nt, Human
auuuuccagccuuucuagaacu

SEQ ID NO: 584942 - RNA, 22 nt, Human
gugcccugucucuugucuccag

SEQ ID NO: 584943 - RNA, 22 nt, Human
ucccugugggcagaggcugccu

SEQ ID NO: 584944 - RNA, 22 nt, Human
ucugaggucucaugacuugcau

SEQ ID NO: 584945 - RNA, 22 nt, Human
guuauuuauaagguguaacucc

SEQ ID NO: 584946 - RNA, 22 nt, Human
cuggugggagcagcaggcagcu

SEQ ID NO: 584947 - RNA, 22 nt, Human
uugauuuuuuucuacuaugcgc

SEQ ID NO: 584948 - RNA, 22 nt, Human
auacauuccuacugacuagcua

SEQ ID NO: 584949 - RNA, 22 nt, Human
agcaccaggcuguuggaagccc

SEQ ID NO: 584950 - RNA, 22 nt, Human
uuuuguaagaaacugccaagcc

SEQ ID NO: 584951 - RNA, 22 nt, Human
aucauacagccuuuguuagugu

SEQ ID NO: 584952 - RNA, 22 nt, Human
cuuucauuugauaagaaugcca

SEQ ID NO: 584953 - RNA, 22 nt, Human
uguuaggacuccccagaagcug

SEQ ID NO: 584954 - RNA, 22 nt, Human
uuuuccucuguauuugaaaugc

SEQ ID NO: 584955 - RNA, 22 nt, Human
uccagguuucgcuacaggagag

SEQ ID NO: 584956 - RNA, 22 nt, Human
agauaagauaguccagcacaau

SEQ ID NO: 584957 - RNA, 22 nt, Human
cugagugauagcgauggggaac

SEQ ID NO: 584958 - RNA, 18 nt, Human
cugggacucaaugcuacu

SEQ ID NO: 584959 - RNA, 22 nt, Human
cacagaauaauucacauggcuc

SEQ ID NO: 584960 - RNA, 22 nt, Human
gggggccaucuucaaggaugug

SEQ ID NO: 584961 - RNA, 22 nt, Human
acggcuucuugacuguggguug

SEQ ID NO: 584962 - RNA, 22 nt, Human
aguguacauguuuacagcaucu

SEQ ID NO: 584963 - RNA, 22 nt, Human
caggguacagaguuuucuaaac

SEQ ID NO: 584964 - RNA, 22 nt, Human
aagggcuggaucucucugagca

SEQ ID NO: 584965 - RNA, 22 nt, Human
ccugccugcguccucugagggc

SEQ ID NO: 584966 - RNA, 23 nt, Human
ggggaaagaccaugcuugaggac

SEQ ID NO: 584967 - RNA, 22 nt, Human
uuaaucucuuagcaaauuaaug

SEQ ID NO: 584968 - RNA, 22 nt, Human
cagccagcuucagauccaagcc

SEQ ID NO: 584969 - RNA, 22 nt, Human
acagcugugggcucugcauaua

SEQ ID NO: 584970 - RNA, 22 nt, Human
acuuucuuaggcuguauaaaug

SEQ ID NO: 584971 - RNA, 21 nt, Human
uaauuuauucagcacaguguu

SEQ ID NO: 584972 - RNA, 22 nt, Human
agucaguguagaaagcccaggc

SEQ ID NO: 584973 - RNA, 21 nt, Human
gacaaacauuucauagcuuua

SEQ ID NO: 584974 - RNA, 22 nt, Human
gagcugagcagggagccucacu

SEQ ID NO: 584975 - RNA, 22 nt, Human
ggagcugcucagagccaguccc

SEQ ID NO: 584976 - RNA, 22 nt, Human
aguuuuauuaaauccacagaag

SEQ ID NO: 584977 - RNA, 22 nt, Human
cuggagcuggcuuccuuccacu

SEQ ID NO: 584978 - RNA, 22 nt, Human
uaacuucuggaaaugcaucugc

SEQ ID NO: 584979 - RNA, 22 nt, Human
guggcaggagagacacagccau

SEQ ID NO: 584980 - RNA, 19 nt, Human
ugugccucuauagcaugug

SEQ ID NO: 584981 - RNA, 22 nt, Human
gcaggcugaugacuggaguugg

SEQ ID NO: 584982 - RNA, 18 nt, Human
uggagagcagcagugggg

SEQ ID NO: 584983 - RNA, 16 nt, Human
gaggcuggcagauguc

SEQ ID NO: 584984 - RNA, 22 nt, Human
uacauacaagcauucaauuuua

SEQ ID NO: 584985 - RNA, 22 nt, Human
uuuaaugaauaauucaaaucug

SEQ ID NO: 584986 - RNA, 22 nt, Human
gcugccacucugagcuugcuuc

SEQ ID NO: 584987 - RNA, 22 nt, Human
uuuguguuggaagaaaugcuac

SEQ ID NO: 584988 - RNA, 22 nt, Human
aucuuucuauuucuaaaaacua

SEQ ID NO: 584989 - RNA, 22 nt, Human
cagaaagcagagcugagccuuu

SEQ ID NO: 584990 - RNA, 22 nt, Human
aaaugcuguagaucagugaguu

SEQ ID NO: 584991 - RNA, 22 nt, Human
gagcuuuucccgucuuucucgu

SEQ ID NO: 584992 - RNA, 22 nt, Human
aacacugguuuggcauuagaug

SEQ ID NO: 584993 - RNA, 19 nt, Human
uggaaaauggauugaauca

SEQ ID NO: 584994 - RNA, 23 nt, Human
cccagagcacagccuccagaugc

SEQ ID NO: 584995 - RNA, 18 nt, Human
agauuuugagaaauacaa

SEQ ID NO: 584996 - RNA, 22 nt, Human
cugggcucuguguuucaguuuc

SEQ ID NO: 584997 - RNA, 22 nt, Human
agggaugggucuaacccagaac

SEQ ID NO: 584998 - RNA, 22 nt, Human
uuggugcaaauuccuguaagag

SEQ ID NO: 584999 - RNA, 22 nt, Human
ggccacugccuccgccauggcu

SEQ ID NO: 585000 - RNA, 22 nt, Human
acacacagcgccuaccaugugc

SEQ ID NO: 585001 - RNA, 22 nt, Human
uucuuucucacucuuuaggaag

SEQ ID NO: 585002 - RNA, 22 nt, Human
auugugcaucuacugugugcag

SEQ ID NO: 585003 - RNA, 22 nt, Human
aacagcuucaucacauggcaua

SEQ ID NO: 585004 - RNA, 22 nt, Human
aauaagugaguuuagcaaguuu

SEQ ID NO: 585005 - RNA, 22 nt, Human
uccagucugguaugaauccuag

SEQ ID NO: 585006 - RNA, 22 nt, Human
caagggaguugcugcaugcagg

SEQ ID NO: 585007 - RNA, 22 nt, Human
aagacacuaagcuuucaggaua

SEQ ID NO: 585008 - RNA, 22 nt, Human
gugggcaggaggcccugcccug

SEQ ID NO: 585009 - RNA, 22 nt, Human
caaauuuagguaacagucugua

SEQ ID NO: 585010 - RNA, 22 nt, Human
ugaaauacacaaauuuaguaag

SEQ ID NO: 585011 - RNA, 22 nt, Human
agccugagagccaagcugugca

SEQ ID NO: 585012 - RNA, 22 nt, Human
cccagccugucuuucccaauga

SEQ ID NO: 585013 - RNA, 22 nt, Human
auguuuguagguaagugacacu

SEQ ID NO: 585014 - RNA, 22 nt, Human
uagcacuauuuuucacuauccu

SEQ ID NO: 585015 - RNA, 22 nt, Human
ggcacagggugauguugcaguu

SEQ ID NO: 585016 - RNA, 22 nt, Human
aggcuccuaucgcuuucagcaa

SEQ ID NO: 585017 - RNA, 22 nt, Human
agggaggcauuagcuacugcga

SEQ ID NO: 585018 - RNA, 22 nt, Human
gugcagcaaaguuugagauaua

SEQ ID NO: 585019 - RNA, 18 nt, Human
ugggcacaaugaacagca

SEQ ID NO: 585020 - RNA, 22 nt, Human
cacagagacagaagcacuuaug

SEQ ID NO: 585021 - RNA, 20 nt, Human
uacaauauucccacuuugcu

SEQ ID NO: 585022 - RNA, 22 nt, Human
cuguccccugugcuuucacuug

SEQ ID NO: 585023 - RNA, 22 nt, Human
gcucucuggaggccauggacag

SEQ ID NO: 585024 - RNA, 22 nt, Human
aauggcagaaugggccagaagc

SEQ ID NO: 585025 - RNA, 22 nt, Human
uucacaggugagcauuaggccg

SEQ ID NO: 585026 - RNA, 22 nt, Human
agucuaguaggaucucugggcu

SEQ ID NO: 585027 - RNA, 22 nt, Human
caaggaaucccauuucuaacuc

SEQ ID NO: 585028 - RNA, 22 nt, Human
cacaaugcguacauauaucaaa

SEQ ID NO: 585029 - RNA, 22 nt, Human
agcucccauuaucuucugaaac

SEQ ID NO: 585030 - RNA, 22 nt, Human
aucugaaaaaucuccuuuguca

SEQ ID NO: 585031 - RNA, 20 nt, Human
agaacaaguacuaaaggaga

SEQ ID NO: 585032 - RNA, 22 nt, Human
ggcuuccuggagaaggucugag

SEQ ID NO: 585033 - RNA, 22 nt, Human
ccaaagugcugagauuacaggu

SEQ ID NO: 585034 - RNA, 22 nt, Human
aguuuuugagaauuuacuaugu

SEQ ID NO: 585035 - RNA, 22 nt, Human
augcuuugauuugguuucucua

SEQ ID NO: 585036 - RNA, 22 nt, Human
uucugugugcuuacugguguuc

SEQ ID NO: 585037 - RNA, 22 nt, Human
cugaagcauaucaugccaaguu

SEQ ID NO: 585038 - RNA, 22 nt, Human
agcuccugcgcacggugcacac

SEQ ID NO: 585039 - RNA, 22 nt, Human
auuccuugggaauuauugaaug

SEQ ID NO: 585040 - RNA, 22 nt, Human
gcagcaggcacuuaccguugcu

SEQ ID NO: 585041 - RNA, 22 nt, Human
uugacuguugcugccauucugg

SEQ ID NO: 585042 - RNA, 22 nt, Human
uaaauaggguaagcguguuuac

SEQ ID NO: 585043 - RNA, 22 nt, Human
augacaauacuucaauaagcug

SEQ ID NO: 585044 - RNA, 22 nt, Human
cagcccugcuuccccgcuaguu

SEQ ID NO: 585045 - RNA, 22 nt, Human
gccaugaggcuccgagaaguca

SEQ ID NO: 585046 - RNA, 22 nt, Human
uggcucagugcauucacaguaa

SEQ ID NO: 585047 - RNA, 22 nt, Human
uuaagaggugaggccuuuaaga

SEQ ID NO: 585048 - RNA, 22 nt, Human
ucuucuucccaucccucaaaug

SEQ ID NO: 585049 - RNA, 22 nt, Human
gcagagugccgagauggaagcg

SEQ ID NO: 585050 - RNA, 22 nt, Human
agcugggcuggagcuccaagcg

SEQ ID NO: 585051 - RNA, 22 nt, Human
ugucaaaaauaagagagauugu

SEQ ID NO: 585052 - RNA, 22 nt, Human
cccuggagggacagcugcucua

SEQ ID NO: 585053 - RNA, 22 nt, Human
acaucucaugaaugauaaauca

SEQ ID NO: 585054 - RNA, 22 nt, Human
auggccugggcccgcuucagau

SEQ ID NO: 585055 - RNA, 22 nt, Human
agagcuaagaaacagaauugcu

SEQ ID NO: 585056 - RNA, 22 nt, Human
cugaaugacugaagucacaauu

SEQ ID NO: 585057 - RNA, 17 nt, Human
auucuguaagguuggau

SEQ ID NO: 585058 - RNA, 22 nt, Human
auucagaagcaaucacagugag

SEQ ID NO: 585059 - RNA, 22 nt, Human
aagcucagugaugccuccaggg

SEQ ID NO: 585060 - RNA, 22 nt, Human
gggcuacagacaugcucuaagc

SEQ ID NO: 585061 - RNA, 22 nt, Human
gagucuggcccugaugcaucau

SEQ ID NO: 585062 - RNA, 22 nt, Human
uucuuucugucaugguguacug

SEQ ID NO: 585063 - RNA, 22 nt, Human
gauagcugcugggauauuuuua

SEQ ID NO: 585064 - RNA, 22 nt, Human
ucugggaaugaggcuugggcaa

SEQ ID NO: 585065 - RNA, 22 nt, Human
gcuucagccgggcacuuaauga

SEQ ID NO: 585066 - RNA, 22 nt, Human
gccaggugggagacagacagca

SEQ ID NO: 585067 - RNA, 22 nt, Human
gaggagggagcuggaagcucuu

SEQ ID NO: 585068 - RNA, 22 nt, Human
uccuccacgauggcacaccugg

SEQ ID NO: 585069 - RNA, 22 nt, Human
gcacccagagggcagggucucc

SEQ ID NO: 585070 - RNA, 20 nt, Human
aaagcaguaugcaaguagag

SEQ ID NO: 585071 - RNA, 22 nt, Human
gaaaagaguccugugugaggag

SEQ ID NO: 585072 - RNA, 22 nt, Human
guuacaauguucuucaguucug

SEQ ID NO: 585073 - RNA, 22 nt, Human
uagcaaaaacugcaguuacuuu

SEQ ID NO: 585074 - RNA, 22 nt, Human
ucaggccaaagaaacagcauga

SEQ ID NO: 585075 - RNA, 22 nt, Human
ccuuccuucaagcacacaucua

SEQ ID NO: 585076 - RNA, 22 nt, Human
cugcagagagugccgggcagcc

SEQ ID NO: 585077 - RNA, 22 nt, Human
ucuuggccccaccugugccagc

SEQ ID NO: 585078 - RNA, 22 nt, Human
ucucuggucccaccuggccauu

SEQ ID NO: 585079 - RNA, 22 nt, Human
agaaacauuuagauuauauguc

SEQ ID NO: 585080 - RNA, 22 nt, Human
ggcugaggcucaugccaucuug

SEQ ID NO: 585081 - RNA, 22 nt, Human
caagauuuccaacccuggguaa

SEQ ID NO: 585082 - RNA, 22 nt, Human
gggcaauucacaggguuguuau

SEQ ID NO: 585083 - RNA, 22 nt, Human
auauauaaccuggauaaggcuu

SEQ ID NO: 585084 - RNA, 22 nt, Human
aaacugaauucaaguauccagu

SEQ ID NO: 585085 - RNA, 18 nt, Human
gauauauaggaggaaagu

SEQ ID NO: 585086 - RNA, 22 nt, Human
ucugacaagucaagucuugacu

SEQ ID NO: 585087 - RNA, 22 nt, Human
cacccaggcuggauugcagugg

SEQ ID NO: 585088 - RNA, 22 nt, Human
cagcaaagguagaagcacagga

SEQ ID NO: 585089 - RNA, 22 nt, Human
gagaaacaggaauugagucgcu

SEQ ID NO: 585090 - RNA, 22 nt, Human
aucucugggcuuugaguuuguu

SEQ ID NO: 585091 - RNA, 23 nt, Human
ugagucuacucaccacaacuggg

SEQ ID NO: 585092 - RNA, 22 nt, Human
aaccucaaacucuugggcuuaa

SEQ ID NO: 585093 - RNA, 22 nt, Human
uacacccuucuccugagugugu

SEQ ID NO: 585094 - RNA, 22 nt, Human
aagggagacaguugugugagga

SEQ ID NO: 585095 - RNA, 22 nt, Human
aaugacaugcuuuuuaauuaua

SEQ ID NO: 585096 - RNA, 22 nt, Human
ugcugcuggaucuuacucaucu

SEQ ID NO: 585097 - RNA, 22 nt, Human
cucagaaagcaaucuggugagg

SEQ ID NO: 585098 - RNA, 22 nt, Human
ucaagcaaguugcauauugcua

SEQ ID NO: 585099 - RNA, 22 nt, Human
gcuccgugggcauugcuaggug

SEQ ID NO: 585100 - RNA, 22 nt, Human
ucagaaauagucuuuaaaauga

SEQ ID NO: 585101 - RNA, 22 nt, Human
ggagggguggucaccuggcagg

SEQ ID NO: 585102 - RNA, 22 nt, Human
ccagguggacaaggcuuucaca

SEQ ID NO: 585103 - RNA, 22 nt, Human
cccaggaggucgaagcugcagu

SEQ ID NO: 585104 - RNA, 22 nt, Human
gggcagagguucaacuucaaca

SEQ ID NO: 585105 - RNA, 22 nt, Human
cccagaaggucgaggcugcagu

SEQ ID NO: 585106 - RNA, 22 nt, Human
cuggagugcaguggcaugauca

SEQ ID NO: 585107 - RNA, 22 nt, Human
ccuguggcucucuuuggagguc

SEQ ID NO: 585108 - RNA, 22 nt, Human
augcaguuagguaauagucuca

SEQ ID NO: 585109 - RNA, 22 nt, Human
uuccugggacuggagcagccca
